United States Patent 8,969,254 (OLIGONUCLEOTIDE ARRAY FOR TISSUE TYPING) - sequence listing, part 9

SEQ ID NO: 193034 - DNA, 21 bp, Artificial Sequence
  Description of Artificial Sequence: Synthetic oligonucleotide
gtcggcgtccacgtgcgccgt

SEQ ID NO: 193035 - DNA, 21 bp, Artificial Sequence
  Description of Artificial Sequence: Synthetic oligonucleotide
tcggcgtccacgtgcgccgtg

SEQ ID NO: 193036 - DNA, 20 bp, Artificial Sequence
  Description of Artificial Sequence: Synthetic oligonucleotide
cggcgtccacgtgcgccgtg

SEQ ID NO: 193037 - DNA, 20 bp, Artificial Sequence
  Description of Artificial Sequence: Synthetic oligonucleotide
ggcgtccacgtgcgccgtgg

SEQ ID NO: 193038 - DNA, 20 bp, Artificial Sequence
  Description of Artificial Sequence: Synthetic oligonucleotide
gcgtccacgtgcgccgtggg

SEQ ID NO: 193039 - DNA, 21 bp, Artificial Sequence
  Description of Artificial Sequence: Synthetic oligonucleotide
cgtccacgtgcgccgtgggga

SEQ ID NO: 193040 - DNA, 24 bp, Artificial Sequence
  Description of Artificial Sequence: Synthetic oligonucleotide
gtccacgtgcgccgtggggactat

SEQ ID NO: 193041 - DNA, 25 bp, Artificial Sequence
  Description of Artificial Sequence: Synthetic oligonucleotide
tccacgtgcgccgtggggactatct

SEQ ID NO: 193042 - DNA, 24 bp, Artificial Sequence
  Description of Artificial Sequence: Synthetic oligonucleotide
ccacgtgcgccgtggggactatct

SEQ ID NO: 193043 - DNA, 24 bp, Artificial Sequence
  Description of Artificial Sequence: Synthetic oligonucleotide
cacgtgcgccgtggggactatctg

SEQ ID NO: 193044 - DNA, 25 bp, Artificial Sequence
  Description of Artificial Sequence: Synthetic oligonucleotide
acgtgcgccgtggggactatctgca

SEQ ID NO: 193045 - DNA, 24 bp, Artificial Sequence
  Description of Artificial Sequence: Synthetic oligonucleotide
cgtgcgccgtggggactatctgca

SEQ ID NO: 193046 - DNA, 24 bp, Artificial Sequence
  Description of Artificial Sequence: Synthetic oligonucleotide
gtgcgccgtggggactatctgcag

SEQ ID NO: 193047 - DNA, 27 bp, Artificial Sequence
  Description of Artificial Sequence: Synthetic oligonucleotide
tgcgccgtggggactatctgcaggtta

SEQ ID NO: 193048 - DNA, 27 bp, Artificial Sequence
  Description of Artificial Sequence: Synthetic oligonucleotide
gcgccgtggggactatctgcaggttat

SEQ ID NO: 193049 - DNA, 27 bp, Artificial Sequence
  Description of Artificial Sequence: Synthetic oligonucleotide
cgccgtggggactatctgcaggttatg

SEQ ID NO: 193050 - DNA, 27 bp, Artificial Sequence
  Description of Artificial Sequence: Synthetic oligonucleotide
gccgtggggactatctgcaggttatgc

SEQ ID NO: 193051 - DNA, 27 bp, Artificial Sequence
  Description of Artificial Sequence: Synthetic oligonucleotide
ccgtggggactatctgcaggttatgcc

SEQ ID NO: 193052 - DNA, 28 bp, Artificial Sequence
  Description of Artificial Sequence: Synthetic oligonucleotide
cgtggggactatctgcaggttatgcctc

SEQ ID NO: 193053 - DNA, 29 bp, Artificial Sequence
  Description of Artificial Sequence: Synthetic oligonucleotide
gtggggactatctgcaggttatgcctcag

SEQ ID NO: 193054 - DNA, 29 bp, Artificial Sequence
  Description of Artificial Sequence: Synthetic oligonucleotide
tggggactatctgcaggttatgcctcagc

SEQ ID NO: 193055 - DNA, 28 bp, Artificial Sequence
  Description of Artificial Sequence: Synthetic oligonucleotide
ggggactatctgcaggttatgcctcagc

SEQ ID NO: 193056 - DNA, 28 bp, Artificial Sequence
  Description of Artificial Sequence: Synthetic oligonucleotide
gggactatctgcaggttatgcctcagcg

SEQ ID NO: 193057 - DNA, 28 bp, Artificial Sequence
  Description of Artificial Sequence: Synthetic oligonucleotide
ggactatctgcaggttatgcctcagcgc

SEQ ID NO: 193058 - DNA, 29 bp, Artificial Sequence
  Description of Artificial Sequence: Synthetic oligonucleotide
gactatctgcaggttatgcctcagcgctg

SEQ ID NO: 193059 - DNA, 29 bp, Artificial Sequence
  Description of Artificial Sequence: Synthetic oligonucleotide
actatctgcaggttatgcctcagcgctgg

SEQ ID NO: 193060 - DNA, 28 bp, Artificial Sequence
  Description of Artificial Sequence: Synthetic oligonucleotide
ctatctgcaggttatgcctcagcgctgg

SEQ ID NO: 193061 - DNA, 30 bp, Artificial Sequence
  Description of Artificial Sequence: Synthetic oligonucleotide
tatctgcaggttatgcctcagcgctggaag

SEQ ID NO: 193062 - DNA, 29 bp, Artificial Sequence
  Description of Artificial Sequence: Synthetic oligonucleotide
atctgcaggttatgcctcagcgctggaag

SEQ ID NO: 193063 - DNA, 28 bp, Artificial Sequence
  Description of Artificial Sequence: Synthetic oligonucleotide
tctgcaggttatgcctcagcgctggaag

SEQ ID NO: 193064 - DNA, 27 bp, Artificial Sequence
  Description of Artificial Sequence: Synthetic oligonucleotide
ctgcaggttatgcctcagcgctggaag

SEQ ID NO: 193065 - DNA, 27 bp, Artificial Sequence
  Description of Artificial Sequence: Synthetic oligonucleotide
tgcaggttatgcctcagcgctggaagg

SEQ ID NO: 193066 - DNA, 26 bp, Artificial Sequence
  Description of Artificial Sequence: Synthetic oligonucleotide
gcaggttatgcctcagcgctggaagg

SEQ ID NO: 193067 - DNA, 27 bp, Artificial Sequence
  Description of Artificial Sequence: Synthetic oligonucleotide
caggttatgcctcagcgctggaagggt

SEQ ID NO: 193068 - DNA, 27 bp, Artificial Sequence
  Description of Artificial Sequence: Synthetic oligonucleotide
aggttatgcctcagcgctggaagggtg

SEQ ID NO: 193069 - DNA, 27 bp, Artificial Sequence
  Description of Artificial Sequence: Synthetic oligonucleotide
ggttatgcctcagcgctggaagggtgt

SEQ ID NO: 193070 - DNA, 27 bp, Artificial Sequence
  Description of Artificial Sequence: Synthetic oligonucleotide
gttatgcctcagcgctggaagggtgtg

SEQ ID NO: 193071 - DNA, 27 bp, Artificial Sequence
  Description of Artificial Sequence: Synthetic oligonucleotide
ttatgcctcagcgctggaagggtgtgg

SEQ ID NO: 193072 - DNA, 27 bp, Artificial Sequence
  Description of Artificial Sequence: Synthetic oligonucleotide
tatgcctcagcgctggaagggtgtggt

SEQ ID NO: 193073 - DNA, 26 bp, Artificial Sequence
  Description of Artificial Sequence: Synthetic oligonucleotide
atgcctcagcgctggaagggtgtggt

SEQ ID NO: 193074 - DNA, 25 bp, Artificial Sequence
  Description of Artificial Sequence: Synthetic oligonucleotide
tgcctcagcgctggaagggtgtggt

SEQ ID NO: 193075 - DNA, 24 bp, Artificial Sequence
  Description of Artificial Sequence: Synthetic oligonucleotide
gcctcagcgctggaagggtgtggt

SEQ ID NO: 193076 - DNA, 24 bp, Artificial Sequence
  Description of Artificial Sequence: Synthetic oligonucleotide
cctcagcgctggaagggtgtggtg

SEQ ID NO: 193077 - DNA, 24 bp, Artificial Sequence
  Description of Artificial Sequence: Synthetic oligonucleotide
ctcagcgctggaagggtgtggtgg

SEQ ID NO: 193078 - DNA, 24 bp, Artificial Sequence
  Description of Artificial Sequence: Synthetic oligonucleotide
tcagcgctggaagggtgtggtggg

SEQ ID NO: 193079 - DNA, 23 bp, Artificial Sequence
  Description of Artificial Sequence: Synthetic oligonucleotide
cagcgctggaagggtgtggtggg

SEQ ID NO: 193080 - DNA, 23 bp, Artificial Sequence
  Description of Artificial Sequence: Synthetic oligonucleotide
agcgctggaagggtgtggtgggc

SEQ ID NO: 193081 - DNA, 22 bp, Artificial Sequence
  Description of Artificial Sequence: Synthetic oligonucleotide
gcgctggaagggtgtggtgggc

SEQ ID NO: 193082 - DNA, 23 bp, Artificial Sequence
  Description of Artificial Sequence: Synthetic oligonucleotide
cgctggaagggtgtggtgggcga

SEQ ID NO: 193083 - DNA, 24 bp, Artificial Sequence
  Description of Artificial Sequence: Synthetic oligonucleotide
gctggaagggtgtggtgggcgaca

SEQ ID NO: 193084 - DNA, 24 bp, Artificial Sequence
  Description of Artificial Sequence: Synthetic oligonucleotide
ctggaagggtgtggtgggcgacag

SEQ ID NO: 193085 - DNA, 24 bp, Artificial Sequence
  Description of Artificial Sequence: Synthetic oligonucleotide
tggaagggtgtggtgggcgacagc

SEQ ID NO: 193086 - DNA, 23 bp, Artificial Sequence
  Description of Artificial Sequence: Synthetic oligonucleotide
ggaagggtgtggtgggcgacagc

SEQ ID NO: 193087 - DNA, 23 bp, Artificial Sequence
  Description of Artificial Sequence: Synthetic oligonucleotide
gaagggtgtggtgggcgacagcg

SEQ ID NO: 193088 - DNA, 23 bp, Artificial Sequence
  Description of Artificial Sequence: Synthetic oligonucleotide
aagggtgtggtgggcgacagcgc

SEQ ID NO: 193089 - DNA, 22 bp, Artificial Sequence
  Description of Artificial Sequence: Synthetic oligonucleotide
agggtgtggtgggcgacagcgc

SEQ ID NO: 193090 - DNA, 21 bp, Artificial Sequence
  Description of Artificial Sequence: Synthetic oligonucleotide
gggtgtggtgggcgacagcgc

SEQ ID NO: 193091 - DNA, 23 bp, Artificial Sequence
  Description of Artificial Sequence: Synthetic oligonucleotide
ggtgtggtgggcgacagcgccta

SEQ ID NO: 193092 - DNA, 23 bp, Artificial Sequence
  Description of Artificial Sequence: Synthetic oligonucleotide
gtgtggtgggcgacagcgcctac

SEQ ID NO: 193093 - DNA, 24 bp, Artificial Sequence
  Description of Artificial Sequence: Synthetic oligonucleotide
tgtggtgggcgacagcgcctacct

SEQ ID NO: 193094 - DNA, 23 bp, Artificial Sequence
  Description of Artificial Sequence: Synthetic oligonucleotide
gtggtgggcgacagcgcctacct

SEQ ID NO: 193095 - DNA, 23 bp, Artificial Sequence
  Description of Artificial Sequence: Synthetic oligonucleotide
tggtgggcgacagcgcctacctc

SEQ ID NO: 193096 - DNA, 22 bp, Artificial Sequence
  Description of Artificial Sequence: Synthetic oligonucleotide
ggtgggcgacagcgcctacctc

SEQ ID NO: 193097 - DNA, 22 bp, Artificial Sequence
  Description of Artificial Sequence: Synthetic oligonucleotide
gtgggcgacagcgcctacctcc

SEQ ID NO: 193098 - DNA, 22 bp, Artificial Sequence
  Description of Artificial Sequence: Synthetic oligonucleotide
tgggcgacagcgcctacctccg

SEQ ID NO: 193099 - DNA, 21 bp, Artificial Sequence
  Description of Artificial Sequence: Synthetic oligonucleotide
gggcgacagcgcctacctccg

SEQ ID NO: 193100 - DNA, 21 bp, Artificial Sequence
  Description of Artificial Sequence: Synthetic oligonucleotide
ggcgacagcgcctacctccgg

SEQ ID NO: 193101 - DNA, 22 bp, Artificial Sequence
  Description of Artificial Sequence: Synthetic oligonucleotide
gcgacagcgcctacctccggca

SEQ ID NO: 193102 - DNA, 22 bp, Artificial Sequence
  Description of Artificial Sequence: Synthetic oligonucleotide
cgacagcgcctacctccggcag

SEQ ID NO: 193103 - DNA, 22 bp, Artificial Sequence
  Description of Artificial Sequence: Synthetic oligonucleotide
gacagcgcctacctccggcagg

SEQ ID NO: 193104 - DNA, 22 bp, Artificial Sequence
  Description of Artificial Sequence: Synthetic oligonucleotide
acagcgcctacctccggcaggc

SEQ ID NO: 193105 - DNA, 21 bp, Artificial Sequence
  Description of Artificial Sequence: Synthetic oligonucleotide
cagcgcctacctccggcaggc

SEQ ID NO: 193106 - DNA, 23 bp, Artificial Sequence
  Description of Artificial Sequence: Synthetic oligonucleotide
agcgcctacctccggcaggccat

SEQ ID NO: 193107 - DNA, 22 bp, Artificial Sequence
  Description of Artificial Sequence: Synthetic oligonucleotide
gcgcctacctccggcaggccat

SEQ ID NO: 193108 - DNA, 22 bp, Artificial Sequence
  Description of Artificial Sequence: Synthetic oligonucleotide
cgcctacctccggcaggccatg

SEQ ID NO: 193109 - DNA, 23 bp, Artificial Sequence
  Description of Artificial Sequence: Synthetic oligonucleotide
gcctacctccggcaggccatgga

SEQ ID NO: 193110 - DNA, 24 bp, Artificial Sequence
  Description of Artificial Sequence: Synthetic oligonucleotide
cctacctccggcaggccatggact

SEQ ID NO: 193111 - DNA, 24 bp, Artificial Sequence
  Description of Artificial Sequence: Synthetic oligonucleotide
ctacctccggcaggccatggactg

SEQ ID NO: 193112 - DNA, 26 bp, Artificial Sequence
  Description of Artificial Sequence: Synthetic oligonucleotide
tacctccggcaggccatggactggtt

SEQ ID NO: 193113 - DNA, 25 bp, Artificial Sequence
  Description of Artificial Sequence: Synthetic oligonucleotide
acctccggcaggccatggactggtt

SEQ ID NO: 193114 - DNA, 24 bp, Artificial Sequence
  Description of Artificial Sequence: Synthetic oligonucleotide
cctccggcaggccatggactggtt

SEQ ID NO: 193115 - DNA, 24 bp, Artificial Sequence
  Description of Artificial Sequence: Synthetic oligonucleotide
ctccggcaggccatggactggttc

SEQ ID NO: 193116 - DNA, 24 bp, Artificial Sequence
  Description of Artificial Sequence: Synthetic oligonucleotide
tccggcaggccatggactggttcc

SEQ ID NO: 193117 - DNA, 23 bp, Artificial Sequence
  Description of Artificial Sequence: Synthetic oligonucleotide
ccggcaggccatggactggttcc

SEQ ID NO: 193118 - DNA, 23 bp, Artificial Sequence
  Description of Artificial Sequence: Synthetic oligonucleotide
cggcaggccatggactggttccg

SEQ ID NO: 193119 - DNA, 23 bp, Artificial Sequence
  Description of Artificial Sequence: Synthetic oligonucleotide
ggcaggccatggactggttccgg

SEQ ID NO: 193120 - DNA, 23 bp, Artificial Sequence
  Description of Artificial Sequence: Synthetic oligonucleotide
gcaggccatggactggttccggg

SEQ ID NO: 193121 - DNA, 24 bp, Artificial Sequence
  Description of Artificial Sequence: Synthetic oligonucleotide
caggccatggactggttccgggca

SEQ ID NO: 193122 - DNA, 24 bp, Artificial Sequence
  Description of Artificial Sequence: Synthetic oligonucleotide
aggccatggactggttccgggcac

SEQ ID NO: 193123 - DNA, 23 bp, Artificial Sequence
  Description of Artificial Sequence: Synthetic oligonucleotide
ggccatggactggttccgggcac

SEQ ID NO: 193124 - DNA, 23 bp, Artificial Sequence
  Description of Artificial Sequence: Synthetic oligonucleotide
gccatggactggttccgggcacg

SEQ ID NO: 193125 - DNA, 23 bp, Artificial Sequence
  Description of Artificial Sequence: Synthetic oligonucleotide
ccatggactggttccgggcacgg

SEQ ID NO: 193126 - DNA, 24 bp, Artificial Sequence
  Description of Artificial Sequence: Synthetic oligonucleotide
catggactggttccgggcacggca

SEQ ID NO: 193127 - DNA, 24 bp, Artificial Sequence
  Description of Artificial Sequence: Synthetic oligonucleotide
atggactggttccgggcacggcac

SEQ ID NO: 193128 - DNA, 23 bp, Artificial Sequence
  Description of Artificial Sequence: Synthetic oligonucleotide
tggactggttccgggcacggcac

SEQ ID NO: 193129 - DNA, 22 bp, Artificial Sequence
  Description of Artificial Sequence: Synthetic oligonucleotide
ggactggttccgggcacggcac

SEQ ID NO: 193130 - DNA, 24 bp, Artificial Sequence
  Description of Artificial Sequence: Synthetic oligonucleotide
gactggttccgggcacggcacgaa

SEQ ID NO: 193131 - DNA, 24 bp, Artificial Sequence
  Description of Artificial Sequence: Synthetic oligonucleotide
actggttccgggcacggcacgaag

SEQ ID NO: 193132 - DNA, 23 bp, Artificial Sequence
  Description of Artificial Sequence: Synthetic oligonucleotide
ctggttccgggcacggcacgaag

SEQ ID NO: 193133 - DNA, 23 bp, Artificial Sequence
  Description of Artificial Sequence: Synthetic oligonucleotide
tggttccgggcacggcacgaagc

SEQ ID NO: 193134 - DNA, 22 bp, Artificial Sequence
  Description of Artificial Sequence: Synthetic oligonucleotide
ggttccgggcacggcacgaagc

SEQ ID NO: 193135 - DNA, 22 bp, Artificial Sequence
  Description of Artificial Sequence: Synthetic oligonucleotide
gttccgggcacggcacgaagcc

SEQ ID NO: 193136 - DNA, 22 bp, Artificial Sequence
  Description of Artificial Sequence: Synthetic oligonucleotide
ttccgggcacggcacgaagccc

SEQ ID NO: 193137 - DNA, 21 bp, Artificial Sequence
  Description of Artificial Sequence: Synthetic oligonucleotide
tccgggcacggcacgaagccc

SEQ ID NO: 193138 - DNA, 20 bp, Artificial Sequence
  Description of Artificial Sequence: Synthetic oligonucleotide
ccgggcacggcacgaagccc

SEQ ID NO: 193139 - DNA, 20 bp, Artificial Sequence
  Description of Artificial Sequence: Synthetic oligonucleotide
cgggcacggcacgaagcccc

SEQ ID NO: 193140 - DNA, 20 bp, Artificial Sequence
  Description of Artificial Sequence: Synthetic oligonucleotide
gggcacggcacgaagccccc

SEQ ID NO: 193141 - DNA, 24 bp, Artificial Sequence
  Description of Artificial Sequence: Synthetic oligonucleotide
ggcacggcacgaagcccccgtttt

SEQ ID NO: 193142 - DNA, 24 bp, Artificial Sequence
  Description of Artificial Sequence: Synthetic oligonucleotide
gcacggcacgaagcccccgttttc

SEQ ID NO: 193143 - DNA, 25 bp, Artificial Sequence
  Description of Artificial Sequence: Synthetic oligonucleotide
cacggcacgaagcccccgttttcgt

SEQ ID NO: 193144 - DNA, 25 bp, Artificial Sequence
  Description of Artificial Sequence: Synthetic oligonucleotide
acggcacgaagcccccgttttcgtg

SEQ ID NO: 193145 - DNA, 24 bp, Artificial Sequence
  Description of Artificial Sequence: Synthetic oligonucleotide
cggcacgaagcccccgttttcgtg

SEQ ID NO: 193146 - DNA, 25 bp, Artificial Sequence
  Description of Artificial Sequence: Synthetic oligonucleotide
ggcacgaagcccccgttttcgtggt

SEQ ID NO: 193147 - DNA, 26 bp, Artificial Sequence
  Description of Artificial Sequence: Synthetic oligonucleotide
gcacgaagcccccgttttcgtggtca

SEQ ID NO: 193148 - DNA, 26 bp, Artificial Sequence
  Description of Artificial Sequence: Synthetic oligonucleotide
cacgaagcccccgttttcgtggtcac

SEQ ID NO: 193149 - DNA, 27 bp, Artificial Sequence
  Description of Artificial Sequence: Synthetic oligonucleotide
acgaagcccccgttttcgtggtcacca

SEQ ID NO: 193150 - DNA, 26 bp, Artificial Sequence
  Description of Artificial Sequence: Synthetic oligonucleotide
cgaagcccccgttttcgtggtcacca

SEQ ID NO: 193151 - DNA, 26 bp, Artificial Sequence
  Description of Artificial Sequence: Synthetic oligonucleotide
gaagcccccgttttcgtggtcaccag

SEQ ID NO: 193152 - DNA, 27 bp, Artificial Sequence
  Description of Artificial Sequence: Synthetic oligonucleotide
aagcccccgttttcgtggtcaccagca

SEQ ID NO: 193153 - DNA, 27 bp, Artificial Sequence
  Description of Artificial Sequence: Synthetic oligonucleotide
agcccccgttttcgtggtcaccagcaa

SEQ ID NO: 193154 - DNA, 26 bp, Artificial Sequence
  Description of Artificial Sequence: Synthetic oligonucleotide
gcccccgttttcgtggtcaccagcaa

SEQ ID NO: 193155 - DNA, 26 bp, Artificial Sequence
  Description of Artificial Sequence: Synthetic oligonucleotide
cccccgttttcgtggtcaccagcaac

SEQ ID NO: 193156 - DNA, 26 bp, Artificial Sequence
  Description of Artificial Sequence: Synthetic oligonucleotide
ccccgttttcgtggtcaccagcaacg

SEQ ID NO: 193157 - DNA, 26 bp, Artificial Sequence
  Description of Artificial Sequence: Synthetic oligonucleotide
cccgttttcgtggtcaccagcaacgg

SEQ ID NO: 193158 - DNA, 27 bp, Artificial Sequence
  Description of Artificial Sequence: Synthetic oligonucleotide
ccgttttcgtggtcaccagcaacggca

SEQ ID NO: 193159 - DNA, 28 bp, Artificial Sequence
  Description of Artificial Sequence: Synthetic oligonucleotide
cgttttcgtggtcaccagcaacggcatg

SEQ ID NO: 193160 - DNA, 28 bp, Artificial Sequence
  Description of Artificial Sequence: Synthetic oligonucleotide
gttttcgtggtcaccagcaacggcatgg

SEQ ID NO: 193161 - DNA, 29 bp, Artificial Sequence
  Description of Artificial Sequence: Synthetic oligonucleotide
ttttcgtggtcaccagcaacggcatggag

SEQ ID NO: 193162 - DNA, 28 bp, Artificial Sequence
  Description of Artificial Sequence: Synthetic oligonucleotide
tttcgtggtcaccagcaacggcatggag

SEQ ID NO: 193163 - DNA, 27 bp, Artificial Sequence
  Description of Artificial Sequence: Synthetic oligonucleotide
ttcgtggtcaccagcaacggcatggag

SEQ ID NO: 193164 - DNA, 27 bp, Artificial Sequence
  Description of Artificial Sequence: Synthetic oligonucleotide
tcgtggtcaccagcaacggcatggagt

SEQ ID NO: 193165 - DNA, 26 bp, Artificial Sequence
  Description of Artificial Sequence: Synthetic oligonucleotide
cgtggtcaccagcaacggcatggagt

SEQ ID NO: 193166 - DNA, 26 bp, Artificial Sequence
  Description of Artificial Sequence: Synthetic oligonucleotide
gtggtcaccagcaacggcatggagtg

SEQ ID NO: 193167 - DNA, 27 bp, Artificial Sequence
  Description of Artificial Sequence: Synthetic oligonucleotide
tggtcaccagcaacggcatggagtggt

SEQ ID NO: 193168 - DNA, 26 bp, Artificial Sequence
  Description of Artificial Sequence: Synthetic oligonucleotide
ggtcaccagcaacggcatggagtggt

SEQ ID NO: 193169 - DNA, 27 bp, Artificial Sequence
  Description of Artificial Sequence: Synthetic oligonucleotide
gtcaccagcaacggcatggagtggtgt

SEQ ID NO: 193170 - DNA, 30 bp, Artificial Sequence
  Description of Artificial Sequence: Synthetic oligonucleotide
tcaccagcaacggcatggagtggtgtaaag

SEQ ID NO: 193171 - DNA, 29 bp, Artificial Sequence
  Description of Artificial Sequence: Synthetic oligonucleotide
caccagcaacggcatggagtggtgtaaag

SEQ ID NO: 193172 - DNA, 33 bp, Artificial Sequence
  Description of Artificial Sequence: Synthetic oligonucleotide
accagcaacggcatggagtggtgtaaagaaaac

SEQ ID NO: 193173 - DNA, 32 bp, Artificial Sequence
  Description of Artificial Sequence: Synthetic oligonucleotide
ccagcaacggcatggagtggtgtaaagaaaac

SEQ ID NO: 193174 - DNA, 34 bp, Artificial Sequence
  Description of Artificial Sequence: Synthetic oligonucleotide
cagcaacggcatggagtggtgtaaagaaaacatc

SEQ ID NO: 193175 - DNA, 34 bp, Artificial Sequence
  Description of Artificial Sequence: Synthetic oligonucleotide
agcaacggcatggagtggtgtaaagaaaacatcg

SEQ ID NO: 193176 - DNA, 33 bp, Artificial Sequence
  Description of Artificial Sequence: Synthetic oligonucleotide
gcaacggcatggagtggtgtaaagaaaacatcg

SEQ ID NO: 193177 - DNA, 34 bp, Artificial Sequence
  Description of Artificial Sequence: Synthetic oligonucleotide
caacggcatggagtggtgtaaagaaaacatcgac

SEQ ID NO: 193178 - DNA, 35 bp, Artificial Sequence
  Description of Artificial Sequence: Synthetic oligonucleotide
aacggcatggagtggtgtaaagaaaacatcgacac

SEQ ID NO: 193179 - DNA, 34 bp, Artificial Sequence
  Description of Artificial Sequence: Synthetic oligonucleotide
acggcatggagtggtgtaaagaaaacatcgacac

SEQ ID NO: 193180 - DNA, 33 bp, Artificial Sequence
  Description of Artificial Sequence: Synthetic oligonucleotide
cggcatggagtggtgtaaagaaaacatcgacac

SEQ ID NO: 193181 - DNA, 33 bp, Artificial Sequence
  Description of Artificial Sequence: Synthetic oligonucleotide
ggcatggagtggtgtaaagaaaacatcgacacc

SEQ ID NO: 193182 - DNA, 34 bp, Artificial Sequence
  Description of Artificial Sequence: Synthetic oligonucleotide
gcatggagtggtgtaaagaaaacatcgacacctc

SEQ ID NO: 193183 - DNA, 34 bp, Artificial Sequence
  Description of Artificial Sequence: Synthetic oligonucleotide
catggagtggtgtaaagaaaacatcgacacctcc

SEQ ID NO: 193184 - DNA, 34 bp, Artificial Sequence
  Description of Artificial Sequence: Synthetic oligonucleotide
atggagtggtgtaaagaaaacatcgacacctccc

SEQ ID NO: 193185 - DNA, 33 bp, Artificial Sequence
  Description of Artificial Sequence: Synthetic oligonucleotide
tggagtggtgtaaagaaaacatcgacacctccc

SEQ ID NO: 193186 - DNA, 32 bp, Artificial Sequence
  Description of Artificial Sequence: Synthetic oligonucleotide
ggagtggtgtaaagaaaacatcgacacctccc

SEQ ID NO: 193187 - DNA, 33 bp, Artificial Sequence
  Description of Artificial Sequence: Synthetic oligonucleotide
gagtggtgtaaagaaaacatcgacacctcccag

SEQ ID NO: 193188 - DNA, 33 bp, Artificial Sequence
  Description of Artificial Sequence: Synthetic oligonucleotide
agtggtgtaaagaaaacatcgacacctcccagg

SEQ ID NO: 193189 - DNA, 32 bp, Artificial Sequence
  Description of Artificial Sequence: Synthetic oligonucleotide
gtggtgtaaagaaaacatcgacacctcccagg

SEQ ID NO: 193190 - DNA, 32 bp, Artificial Sequence
  Description of Artificial Sequence: Synthetic oligonucleotide
tggtgtaaagaaaacatcgacacctcccaggg

SEQ ID NO: 193191 - DNA, 31 bp, Artificial Sequence
  Description of Artificial Sequence: Synthetic oligonucleotide
ggtgtaaagaaaacatcgacacctcccaggg

SEQ ID NO: 193192 - DNA, 31 bp, Artificial Sequence
  Description of Artificial Sequence: Synthetic oligonucleotide
gtgtaaagaaaacatcgacacctcccagggc

SEQ ID NO: 193193 - DNA, 31 bp, Artificial Sequence
  Description of Artificial Sequence: Synthetic oligonucleotide
tgtaaagaaaacatcgacacctcccagggcg

SEQ ID NO: 193194 - DNA, 30 bp, Artificial Sequence
  Description of Artificial Sequence: Synthetic oligonucleotide
gtaaagaaaacatcgacacctcccagggcg

SEQ ID NO: 193195 - DNA, 32 bp, Artificial Sequence
  Description of Artificial Sequence: Synthetic oligonucleotide
taaagaaaacatcgacacctcccagggcgatg

SEQ ID NO: 193196 - DNA, 31 bp, Artificial Sequence
  Description of Artificial Sequence: Synthetic oligonucleotide
aaagaaaacatcgacacctcccagggcgatg

SEQ ID NO: 193197 - DNA, 30 bp, Artificial Sequence
  Description of Artificial Sequence: Synthetic oligonucleotide
aagaaaacatcgacacctcccagggcgatg

SEQ ID NO: 193198 - DNA, 29 bp, Artificial Sequence
  Description of Artificial Sequence: Synthetic oligonucleotide
agaaaacatcgacacctcccagggcgatg

SEQ ID NO: 193199 - DNA, 28 bp, Artificial Sequence
  Description of Artificial Sequence: Synthetic oligonucleotide
gaaaacatcgacacctcccagggcgatg

SEQ ID NO: 193200 - DNA, 29 bp, Artificial Sequence
  Description of Artificial Sequence: Synthetic oligonucleotide
aaaacatcgacacctcccagggcgatgtg

SEQ ID NO: 193201 - DNA, 28 bp, Artificial Sequence
  Description of Artificial Sequence: Synthetic oligonucleotide
aaacatcgacacctcccagggcgatgtg

SEQ ID NO: 193202 - DNA, 27 bp, Artificial Sequence
  Description of Artificial Sequence: Synthetic oligonucleotide
aacatcgacacctcccagggcgatgtg

SEQ ID NO: 193203 - DNA, 27 bp, Artificial Sequence
  Description of Artificial Sequence: Synthetic oligonucleotide
acatcgacacctcccagggcgatgtga

SEQ ID NO: 193204 - DNA, 26 bp, Artificial Sequence
  Description of Artificial Sequence: Synthetic oligonucleotide
catcgacacctcccagggcgatgtga

SEQ ID NO: 193205 - DNA, 26 bp, Artificial Sequence
  Description of Artificial Sequence: Synthetic oligonucleotide
atcgacacctcccagggcgatgtgac

SEQ ID NO: 193206 - DNA, 25 bp, Artificial Sequence
  Description of Artificial Sequence: Synthetic oligonucleotide
tcgacacctcccagggcgatgtgac

SEQ ID NO: 193207 - DNA, 24 bp, Artificial Sequence
  Description of Artificial Sequence: Synthetic oligonucleotide
cgacacctcccagggcgatgtgac

SEQ ID NO: 193208 - DNA, 27 bp, Artificial Sequence
  Description of Artificial Sequence: Synthetic oligonucleotide
gacacctcccagggcgatgtgacgttt

SEQ ID NO: 193209 - DNA, 27 bp, Artificial Sequence
  Description of Artificial Sequence: Synthetic oligonucleotide
acacctcccagggcgatgtgacgtttg

SEQ ID NO: 193210 - DNA, 26 bp, Artificial Sequence
  Description of Artificial Sequence: Synthetic oligonucleotide
cacctcccagggcgatgtgacgtttg

SEQ ID NO: 193211 - DNA, 27 bp, Artificial Sequence
  Description of Artificial Sequence: Synthetic oligonucleotide
acctcccagggcgatgtgacgtttgct

SEQ ID NO: 193212 - DNA, 26 bp, Artificial Sequence
  Description of Artificial Sequence: Synthetic oligonucleotide
cctcccagggcgatgtgacgtttgct

SEQ ID NO: 193213 - DNA, 26 bp, Artificial Sequence
  Description of Artificial Sequence: Synthetic oligonucleotide
ctcccagggcgatgtgacgtttgctg

SEQ ID NO: 193214 - DNA, 26 bp, Artificial Sequence
  Description of Artificial Sequence: Synthetic oligonucleotide
tcccagggcgatgtgacgtttgctgg

SEQ ID NO: 193215 - DNA, 25 bp, Artificial Sequence
  Description of Artificial Sequence: Synthetic oligonucleotide
cccagggcgatgtgacgtttgctgg

SEQ ID NO: 193216 - DNA, 25 bp, Artificial Sequence
  Description of Artificial Sequence: Synthetic oligonucleotide
ccagggcgatgtgacgtttgctggc

SEQ ID NO: 193217 - DNA, 27 bp, Artificial Sequence
  Description of Artificial Sequence: Synthetic oligonucleotide
cagggcgatgtgacgtttgctggcgat

SEQ ID NO: 193218 - DNA, 27 bp, Artificial Sequence
  Description of Artificial Sequence: Synthetic oligonucleotide
agggcgatgtgacgtttgctggcgatg

SEQ ID NO: 193219 - DNA, 26 bp, Artificial Sequence
  Description of Artificial Sequence: Synthetic oligonucleotide
gggcgatgtgacgtttgctggcgatg

SEQ ID NO: 193220 - DNA, 27 bp, Artificial Sequence
  Description of Artificial Sequence: Synthetic oligonucleotide
ggcgatgtgacgtttgctggcgatgga

SEQ ID NO: 193221 - DNA, 27 bp, Artificial Sequence
  Description of Artificial Sequence: Synthetic oligonucleotide
gcgatgtgacgtttgctggcgatggac

SEQ ID NO: 193222 - DNA, 28 bp, Artificial Sequence
  Description of Artificial Sequence: Synthetic oligonucleotide
cgatgtgacgtttgctggcgatggacag

SEQ ID NO: 193223 - DNA, 28 bp, Artificial Sequence
  Description of Artificial Sequence: Synthetic oligonucleotide
gatgtgacgtttgctggcgatggacagg

SEQ ID NO: 193224 - DNA, 29 bp, Artificial Sequence
  Description of Artificial Sequence: Synthetic oligonucleotide
atgtgacgtttgctggcgatggacaggag

SEQ ID NO: 193225 - DNA, 28 bp, Artificial Sequence
  Description of Artificial Sequence: Synthetic oligonucleotide
tgtgacgtttgctggcgatggacaggag

SEQ ID NO: 193226 - DNA, 27 bp, Artificial Sequence
  Description of Artificial Sequence: Synthetic oligonucleotide
gtgacgtttgctggcgatggacaggag

SEQ ID NO: 193227 - DNA, 27 bp, Artificial Sequence
  Description of Artificial Sequence: Synthetic oligonucleotide
tgacgtttgctggcgatggacaggagg

SEQ ID NO: 193228 - DNA, 26 bp, Artificial Sequence
  Description of Artificial Sequence: Synthetic oligonucleotide
gacgtttgctggcgatggacaggagg

SEQ ID NO: 193229 - DNA, 27 bp, Artificial Sequence
  Description of Artificial Sequence: Synthetic oligonucleotide
acgtttgctggcgatggacaggaggct

SEQ ID NO: 193230 - DNA, 27 bp, Artificial Sequence
  Description of Artificial Sequence: Synthetic oligonucleotide
cgtttgctggcgatggacaggaggcta

SEQ ID NO: 193231 - DNA, 27 bp, Artificial Sequence
  Description of Artificial Sequence: Synthetic oligonucleotide
gtttgctggcgatggacaggaggctac

SEQ ID NO: 193232 - DNA, 28 bp, Artificial Sequence
  Description of Artificial Sequence: Synthetic oligonucleotide
tttgctggcgatggacaggaggctacac

SEQ ID NO: 193233 - DNA, 27 bp, Artificial Sequence
  Description of Artificial Sequence: Synthetic oligonucleotide
ttgctggcgatggacaggaggctacac

SEQ ID NO: 193234 - DNA, 26 bp, Artificial Sequence
  Description of Artificial Sequence: Synthetic oligonucleotide
tgctggcgatggacaggaggctacac

SEQ ID NO: 193235 - DNA, 25 bp, Artificial Sequence
  Description of Artificial Sequence: Synthetic oligonucleotide
gctggcgatggacaggaggctacac

SEQ ID NO: 193236 - DNA, 25 bp, Artificial Sequence
  Description of Artificial Sequence: Synthetic oligonucleotide
ctggcgatggacaggaggctacacc

SEQ ID NO: 193237 - DNA, 26 bp, Artificial Sequence
  Description of Artificial Sequence: Synthetic oligonucleotide
tggcgatggacaggaggctacaccgt

SEQ ID NO: 193238 - DNA, 25 bp, Artificial Sequence
  Description of Artificial Sequence: Synthetic oligonucleotide
ggcgatggacaggaggctacaccgt

SEQ ID NO: 193239 - DNA, 25 bp, Artificial Sequence
  Description of Artificial Sequence: Synthetic oligonucleotide
gcgatggacaggaggctacaccgtg

SEQ ID NO: 193240 - DNA, 27 bp, Artificial Sequence
  Description of Artificial Sequence: Synthetic oligonucleotide
cgatggacaggaggctacaccgtggaa

SEQ ID NO: 193241 - DNA, 28 bp, Artificial Sequence
  Description of Artificial Sequence: Synthetic oligonucleotide
gatggacaggaggctacaccgtggaaag

SEQ ID NO: 193242 - DNA, 29 bp, Artificial Sequence
  Description of Artificial Sequence: Synthetic oligonucleotide
atggacaggaggctacaccgtggaaagac

SEQ ID NO: 193243 - DNA, 28 bp, Artificial Sequence
  Description of Artificial Sequence: Synthetic oligonucleotide
tggacaggaggctacaccgtggaaagac

SEQ ID NO: 193244 - DNA, 27 bp, Artificial Sequence
  Description of Artificial Sequence: Synthetic oligonucleotide
ggacaggaggctacaccgtggaaagac

SEQ ID NO: 193245 - DNA, 30 bp, Artificial Sequence
  Description of Artificial Sequence: Synthetic oligonucleotide
gacaggaggctacaccgtggaaagactttg

SEQ ID NO: 193246 - DNA, 30 bp, Artificial Sequence
  Description of Artificial Sequence: Synthetic oligonucleotide
acaggaggctacaccgtggaaagactttgc

SEQ ID NO: 193247 - DNA, 29 bp, Artificial Sequence
  Description of Artificial Sequence: Synthetic oligonucleotide
caggaggctacaccgtggaaagactttgc

SEQ ID NO: 193248 - DNA, 29 bp, Artificial Sequence
  Description of Artificial Sequence: Synthetic oligonucleotide
aggaggctacaccgtggaaagactttgcc

SEQ ID NO: 193249 - DNA, 28 bp, Artificial Sequence
  Description of Artificial Sequence: Synthetic oligonucleotide
ggaggctacaccgtggaaagactttgcc

SEQ ID NO: 193250 - DNA, 28 bp, Artificial Sequence
  Description of Artificial Sequence: Synthetic oligonucleotide
gaggctacaccgtggaaagactttgccc

SEQ ID NO: 193251 - DNA, 29 bp, Artificial Sequence
  Description of Artificial Sequence: Synthetic oligonucleotide
aggctacaccgtggaaagactttgccctg

SEQ ID NO: 193252 - DNA, 28 bp, Artificial Sequence
  Description of Artificial Sequence: Synthetic oligonucleotide
ggctacaccgtggaaagactttgccctg

SEQ ID NO: 193253 - DNA, 28 bp, Artificial Sequence
  Description of Artificial Sequence: Synthetic oligonucleotide
gctacaccgtggaaagactttgccctgc

SEQ ID NO: 193254 - DNA, 29 bp, Artificial Sequence
  Description of Artificial Sequence: Synthetic oligonucleotide
ctacaccgtggaaagactttgccctgctc

SEQ ID NO: 193255 - DNA, 30 bp, Artificial Sequence
  Description of Artificial Sequence: Synthetic oligonucleotide
tacaccgtggaaagactttgccctgctcac

SEQ ID NO: 193256 - DNA, 29 bp, Artificial Sequence
  Description of Artificial Sequence: Synthetic oligonucleotide
acaccgtggaaagactttgccctgctcac

SEQ ID NO: 193257 - DNA, 28 bp, Artificial Sequence
  Description of Artificial Sequence: Synthetic oligonucleotide
caccgtggaaagactttgccctgctcac

SEQ ID NO: 193258 - DNA, 29 bp, Artificial Sequence
  Description of Artificial Sequence: Synthetic oligonucleotide
accgtggaaagactttgccctgctcacac

SEQ ID NO: 193259 - DNA, 28 bp, Artificial Sequence
  Description of Artificial Sequence: Synthetic oligonucleotide
ccgtggaaagactttgccctgctcacac

SEQ ID NO: 193260 - DNA, 29 bp, Artificial Sequence
  Description of Artificial Sequence: Synthetic oligonucleotide
cgtggaaagactttgccctgctcacacag

SEQ ID NO: 193261 - DNA, 30 bp, Artificial Sequence
  Description of Artificial Sequence: Synthetic oligonucleotide
gtggaaagactttgccctgctcacacagtg

SEQ ID NO: 193262 - DNA, 30 bp, Artificial Sequence
  Description of Artificial Sequence: Synthetic oligonucleotide
tggaaagactttgccctgctcacacagtgc

SEQ ID NO: 193263 - DNA, 29 bp, Artificial Sequence
  Description of Artificial Sequence: Synthetic oligonucleotide
ggaaagactttgccctgctcacacagtgc

SEQ ID NO: 193264 - DNA, 31 bp, Artificial Sequence
  Description of Artificial Sequence: Synthetic oligonucleotide
gaaagactttgccctgctcacacagtgcaac

SEQ ID NO: 193265 - DNA, 31 bp, Artificial Sequence
  Description of Artificial Sequence: Synthetic oligonucleotide
aaagactttgccctgctcacacagtgcaacc

SEQ ID NO: 193266 - DNA, 30 bp, Artificial Sequence
  Description of Artificial Sequence: Synthetic oligonucleotide
aagactttgccctgctcacacagtgcaacc

SEQ ID NO: 193267 - DNA, 29 bp, Artificial Sequence
  Description of Artificial Sequence: Synthetic oligonucleotide
agactttgccctgctcacacagtgcaacc

SEQ ID NO: 193268 - DNA, 28 bp, Artificial Sequence
  Description of Artificial Sequence: Synthetic oligonucleotide
gactttgccctgctcacacagtgcaacc

SEQ ID NO: 193269 - DNA, 29 bp, Artificial Sequence
  Description of Artificial Sequence: Synthetic oligonucleotide
actttgccctgctcacacagtgcaaccac

SEQ ID NO: 193270 - DNA, 28 bp, Artificial Sequence
  Description of Artificial Sequence: Synthetic oligonucleotide
ctttgccctgctcacacagtgcaaccac

SEQ ID NO: 193271 - DNA, 29 bp, Artificial Sequence
  Description of Artificial Sequence: Synthetic oligonucleotide
tttgccctgctcacacagtgcaaccacac

SEQ ID NO: 193272 - DNA, 28 bp, Artificial Sequence
  Description of Artificial Sequence: Synthetic oligonucleotide
ttgccctgctcacacagtgcaaccacac

SEQ ID NO: 193273 - DNA, 27 bp, Artificial Sequence
  Description of Artificial Sequence: Synthetic oligonucleotide
tgccctgctcacacagtgcaaccacac

SEQ ID NO: 193274 - DNA, 26 bp, Artificial Sequence
  Description of Artificial Sequence: Synthetic oligonucleotide
gccctgctcacacagtgcaaccacac

SEQ ID NO: 193275 - DNA, 27 bp, Artificial Sequence
  Description of Artificial Sequence: Synthetic oligonucleotide
ccctgctcacacagtgcaaccacacca

SEQ ID NO: 193276 - DNA, 31 bp, Artificial Sequence
  Description of Artificial Sequence: Synthetic oligonucleotide
cctgctcacacagtgcaaccacaccattatg

SEQ ID NO: 193277 - DNA, 32 bp, Artificial Sequence
  Description of Artificial Sequence: Synthetic oligonucleotide
ctgctcacacagtgcaaccacaccattatgac

SEQ ID NO: 193278 - DNA, 32 bp, Artificial Sequence
  Description of Artificial Sequence: Synthetic oligonucleotide
tgctcacacagtgcaaccacaccattatgacc

SEQ ID NO: 193279 - DNA, 31 bp, Artificial Sequence
  Description of Artificial Sequence: Synthetic oligonucleotide
gctcacacagtgcaaccacaccattatgacc

SEQ ID NO: 193280 - DNA, 34 bp, Artificial Sequence
  Description of Artificial Sequence: Synthetic oligonucleotide
ctcacacagtgcaaccacaccattatgaccattg

SEQ ID NO: 193281 - DNA, 34 bp, Artificial Sequence
  Description of Artificial Sequence: Synthetic oligonucleotide
tcacacagtgcaaccacaccattatgaccattgg

SEQ ID NO: 193282 - DNA, 33 bp, Artificial Sequence
  Description of Artificial Sequence: Synthetic oligonucleotide
cacacagtgcaaccacaccattatgaccattgg

SEQ ID NO: 193283 - DNA, 33 bp, Artificial Sequence
  Description of Artificial Sequence: Synthetic oligonucleotide
acacagtgcaaccacaccattatgaccattggc

SEQ ID NO: 193284 - DNA, 32 bp, Artificial Sequence
  Description of Artificial Sequence: Synthetic oligonucleotide
cacagtgcaaccacaccattatgaccattggc

SEQ ID NO: 193285 - DNA, 33 bp, Artificial Sequence
  Description of Artificial Sequence: Synthetic oligonucleotide
acagtgcaaccacaccattatgaccattggcac

SEQ ID NO: 193286 - DNA, 32 bp, Artificial Sequence
  Description of Artificial Sequence: Synthetic oligonucleotide
cagtgcaaccacaccattatgaccattggcac

SEQ ID NO: 193287 - DNA, 32 bp, Artificial Sequence
  Description of Artificial Sequence: Synthetic oligonucleotide
agtgcaaccacaccattatgaccattggcacc

SEQ ID NO: 193288 - DNA, 31 bp, Artificial Sequence
  Description of Artificial Sequence: Synthetic oligonucleotide
gtgcaaccacaccattatgaccattggcacc

SEQ ID NO: 193289 - DNA, 33 bp, Artificial Sequence
  Description of Artificial Sequence: Synthetic oligonucleotide
tgcaaccacaccattatgaccattggcaccttc

SEQ ID NO: 193290 - DNA, 32 bp, Artificial Sequence
  Description of Artificial Sequence: Synthetic oligonucleotide
gcaaccacaccattatgaccattggcaccttc

SEQ ID NO: 193291 - DNA, 32 bp, Artificial Sequence
  Description of Artificial Sequence: Synthetic oligonucleotide
caaccacaccattatgaccattggcaccttcg

SEQ ID NO: 193292 - DNA, 32 bp, Artificial Sequence
  Description of Artificial Sequence: Synthetic oligonucleotide
aaccacaccattatgaccattggcaccttcgg

SEQ ID NO: 193293 - DNA, 31 bp, Artificial Sequence
  Description of Artificial Sequence: Synthetic oligonucleotide
accacaccattatgaccattggcaccttcgg

SEQ ID NO: 193294 - DNA, 30 bp, Artificial Sequence
  Description of Artificial Sequence: Synthetic oligonucleotide
ccacaccattatgaccattggcaccttcgg

SEQ ID NO: 193295 - DNA, 30 bp, Artificial Sequence
  Description of Artificial Sequence: Synthetic oligonucleotide
cacaccattatgaccattggcaccttcggc

SEQ ID NO: 193296 - DNA, 32 bp, Artificial Sequence
  Description of Artificial Sequence: Synthetic oligonucleotide
acaccattatgaccattggcaccttcggcttc

SEQ ID NO: 193297 - DNA, 31 bp, Artificial Sequence
  Description of Artificial Sequence: Synthetic oligonucleotide
caccattatgaccattggcaccttcggcttc

SEQ ID NO: 193298 - DNA, 32 bp, Artificial Sequence
  Description of Artificial Sequence: Synthetic oligonucleotide
accattatgaccattggcaccttcggcttctg

SEQ ID NO: 193299 - DNA, 31 bp, Artificial Sequence
  Description of Artificial Sequence: Synthetic oligonucleotide
ccattatgaccattggcaccttcggcttctg

SEQ ID NO: 193300 - DNA, 31 bp, Artificial Sequence
  Description of Artificial Sequence: Synthetic oligonucleotide
cattatgaccattggcaccttcggcttctgg

SEQ ID NO: 193301 - DNA, 31 bp, Artificial Sequence
  Description of Artificial Sequence: Synthetic oligonucleotide
attatgaccattggcaccttcggcttctggg

SEQ ID NO: 193302 - DNA, 30 bp, Artificial Sequence
  Description of Artificial Sequence: Synthetic oligonucleotide
ttatgaccattggcaccttcggcttctggg

SEQ ID NO: 193303 - DNA, 29 bp, Artificial Sequence
  Description of Artificial Sequence: Synthetic oligonucleotide
tatgaccattggcaccttcggcttctggg

SEQ ID NO: 193304 - DNA, 28 bp, Artificial Sequence
  Description of Artificial Sequence: Synthetic oligonucleotide
atgaccattggcaccttcggcttctggg

SEQ ID NO: 193305 - DNA, 27 bp, Artificial Sequence
  Description of Artificial Sequence: Synthetic oligonucleotide
tgaccattggcaccttcggcttctggg

SEQ ID NO: 193306 - DNA, 26 bp, Artificial Sequence
  Description of Artificial Sequence: Synthetic oligonucleotide
gaccattggcaccttcggcttctggg

SEQ ID NO: 193307 - DNA, 27 bp, Artificial Sequence
  Description of Artificial Sequence: Synthetic oligonucleotide
accattggcaccttcggcttctgggct

SEQ ID NO: 193308 - DNA, 26 bp, Artificial Sequence
  Description of Artificial Sequence: Synthetic oligonucleotide
ccattggcaccttcggcttctgggct

SEQ ID NO: 193309 - DNA, 26 bp, Artificial Sequence
  Description of Artificial Sequence: Synthetic oligonucleotide
cattggcaccttcggcttctgggctg

SEQ ID NO: 193310 - DNA, 26 bp, Artificial Sequence
  Description of Artificial Sequence: Synthetic oligonucleotide
attggcaccttcggcttctgggctgc

SEQ ID NO: 193311 - DNA, 25 bp, Artificial Sequence
  Description of Artificial Sequence: Synthetic oligonucleotide
ttggcaccttcggcttctgggctgc

SEQ ID NO: 193312 - DNA, 24 bp, Artificial Sequence
  Description of Artificial Sequence: Synthetic oligonucleotide
tggcaccttcggcttctgggctgc

SEQ ID NO: 193313 - DNA, 23 bp, Artificial Sequence
  Description of Artificial Sequence: Synthetic oligonucleotide
ggcaccttcggcttctgggctgc

SEQ ID NO: 193314 - DNA, 25 bp, Artificial Sequence
  Description of Artificial Sequence: Synthetic oligonucleotide
gcaccttcggcttctgggctgccta

SEQ ID NO: 193315 - DNA, 25 bp, Artificial Sequence
  Description of Artificial Sequence: Synthetic oligonucleotide
caccttcggcttctgggctgcctac

SEQ ID NO: 193316 - DNA, 26 bp, Artificial Sequence
  Description of Artificial Sequence: Synthetic oligonucleotide
accttcggcttctgggctgcctacct

SEQ ID NO: 193317 - DNA, 25 bp, Artificial Sequence
  Description of Artificial Sequence: Synthetic oligonucleotide
ccttcggcttctgggctgcctacct

SEQ ID NO: 193318 - DNA, 25 bp, Artificial Sequence
  Description of Artificial Sequence: Synthetic oligonucleotide
cttcggcttctgggctgcctacctg

SEQ ID NO: 193319 - DNA, 25 bp, Artificial Sequence
  Description of Artificial Sequence: Synthetic oligonucleotide
ttcggcttctgggctgcctacctgg

SEQ ID NO: 193320 - DNA, 24 bp, Artificial Sequence
  Description of Artificial Sequence: Synthetic oligonucleotide
tcggcttctgggctgcctacctgg

SEQ ID NO: 193321 - DNA, 23 bp, Artificial Sequence
  Description of Artificial Sequence: Synthetic oligonucleotide
cggcttctgggctgcctacctgg

SEQ ID NO: 193322 - DNA, 24 bp, Artificial Sequence
  Description of Artificial Sequence: Synthetic oligonucleotide
ggcttctgggctgcctacctggct

SEQ ID NO: 193323 - DNA, 24 bp, Artificial Sequence
  Description of Artificial Sequence: Synthetic oligonucleotide
gcttctgggctgcctacctggctg

SEQ ID NO: 193324 - DNA, 24 bp, Artificial Sequence
  Description of Artificial Sequence: Synthetic oligonucleotide
cttctgggctgcctacctggctgg

SEQ ID NO: 193325 - DNA, 24 bp, Artificial Sequence
  Description of Artificial Sequence: Synthetic oligonucleotide
ttctgggctgcctacctggctggc

SEQ ID NO: 193326 - DNA, 23 bp, Artificial Sequence
  Description of Artificial Sequence: Synthetic oligonucleotide
tctgggctgcctacctggctggc

SEQ ID NO: 193327 - DNA, 22 bp, Artificial Sequence
  Description of Artificial Sequence: Synthetic oligonucleotide
ctgggctgcctacctggctggc

SEQ ID NO: 193328 - DNA, 22 bp, Artificial Sequence
  Description of Artificial Sequence: Synthetic oligonucleotide
tgggctgcctacctggctggcg

SEQ ID NO: 193329 - DNA, 21 bp, Artificial Sequence
  Description of Artificial Sequence: Synthetic oligonucleotide
gggctgcctacctggctggcg

SEQ ID NO: 193330 - DNA, 22 bp, Artificial Sequence
  Description of Artificial Sequence: Synthetic oligonucleotide
ggctgcctacctggctggcgga

SEQ ID NO: 193331 - DNA, 23 bp, Artificial Sequence
  Description of Artificial Sequence: Synthetic oligonucleotide
gctgcctacctggctggcggaga

SEQ ID NO: 193332 - DNA, 24 bp, Artificial Sequence
  Description of Artificial Sequence: Synthetic oligonucleotide
ctgcctacctggctggcggagaca

SEQ ID NO: 193333 - DNA, 25 bp, Artificial Sequence
  Description of Artificial Sequence: Synthetic oligonucleotide
tgcctacctggctggcggagacact

SEQ ID NO: 193334 - DNA, 24 bp, Artificial Sequence
  Description of Artificial Sequence: Synthetic oligonucleotide
gcctacctggctggcggagacact

SEQ ID NO: 193335 - DNA, 25 bp, Artificial Sequence
  Description of Artificial Sequence: Synthetic oligonucleotide
cctacctggctggcggagacactgt

SEQ ID NO: 193336 - DNA, 27 bp, Artificial Sequence
  Description of Artificial Sequence: Synthetic oligonucleotide
ctacctggctggcggagacactgtcta

SEQ ID NO: 193337 - DNA, 27 bp, Artificial Sequence
  Description of Artificial Sequence: Synthetic oligonucleotide
tacctggctggcggagacactgtctac

SEQ ID NO: 193338 - DNA, 26 bp, Artificial Sequence
  Description of Artificial Sequence: Synthetic oligonucleotide
acctggctggcggagacactgtctac

SEQ ID NO: 193339 - DNA, 25 bp, Artificial Sequence
  Description of Artificial Sequence: Synthetic oligonucleotide
cctggctggcggagacactgtctac

SEQ ID NO: 193340 - DNA, 26 bp, Artificial Sequence
  Description of Artificial Sequence: Synthetic oligonucleotide
ctggctggcggagacactgtctacct

SEQ ID NO: 193341 - DNA, 26 bp, Artificial Sequence
  Description of Artificial Sequence: Synthetic oligonucleotide
tggctggcggagacactgtctacctg

SEQ ID NO: 193342 - DNA, 25 bp, Artificial Sequence
  Description of Artificial Sequence: Synthetic oligonucleotide
ggctggcggagacactgtctacctg

SEQ ID NO: 193343 - DNA, 25 bp, Artificial Sequence
  Description of Artificial Sequence: Synthetic oligonucleotide
gctggcggagacactgtctacctgg

SEQ ID NO: 193344 - DNA, 25 bp, Artificial Sequence
  Description of Artificial Sequence: Synthetic oligonucleotide
ctggcggagacactgtctacctggc

SEQ ID NO: 193345 - DNA, 27 bp, Artificial Sequence
  Description of Artificial Sequence: Synthetic oligonucleotide
tggcggagacactgtctacctggccaa

SEQ ID NO: 193346 - DNA, 26 bp, Artificial Sequence
  Description of Artificial Sequence: Synthetic oligonucleotide
ggcggagacactgtctacctggccaa

SEQ ID NO: 193347 - DNA, 27 bp, Artificial Sequence
  Description of Artificial Sequence: Synthetic oligonucleotide
gcggagacactgtctacctggccaact

SEQ ID NO: 193348 - DNA, 28 bp, Artificial Sequence
  Description of Artificial Sequence: Synthetic oligonucleotide
cggagacactgtctacctggccaacttc

SEQ ID NO: 193349 - DNA, 29 bp, Artificial Sequence
  Description of Artificial Sequence: Synthetic oligonucleotide
ggagacactgtctacctggccaacttcac

SEQ ID NO: 193350 - DNA, 29 bp, Artificial Sequence
  Description of Artificial Sequence: Synthetic oligonucleotide
gagacactgtctacctggccaacttcacc

SEQ ID NO: 193351 - DNA, 29 bp, Artificial Sequence
  Description of Artificial Sequence: Synthetic oligonucleotide
agacactgtctacctggccaacttcaccc

SEQ ID NO: 193352 - DNA, 28 bp, Artificial Sequence
  Description of Artificial Sequence: Synthetic oligonucleotide
gacactgtctacctggccaacttcaccc

SEQ ID NO: 193353 - DNA, 29 bp, Artificial Sequence
  Description of Artificial Sequence: Synthetic oligonucleotide
acactgtctacctggccaacttcaccctg

SEQ ID NO: 193354 - DNA, 28 bp, Artificial Sequence
  Description of Artificial Sequence: Synthetic oligonucleotide
cactgtctacctggccaacttcaccctg

SEQ ID NO: 193355 - DNA, 28 bp, Artificial Sequence
  Description of Artificial Sequence: Synthetic oligonucleotide
actgtctacctggccaacttcaccctgc

SEQ ID NO: 193356 - DNA, 27 bp, Artificial Sequence
  Description of Artificial Sequence: Synthetic oligonucleotide
ctgtctacctggccaacttcaccctgc

SEQ ID NO: 193357 - DNA, 27 bp, Artificial Sequence
  Description of Artificial Sequence: Synthetic oligonucleotide
tgtctacctggccaacttcaccctgcc

SEQ ID NO: 193358 - DNA, 27 bp, Artificial Sequence
  Description of Artificial Sequence: Synthetic oligonucleotide
gtctacctggccaacttcaccctgcca

SEQ ID NO: 193359 - DNA, 27 bp, Artificial Sequence
  Description of Artificial Sequence: Synthetic oligonucleotide
tctacctggccaacttcaccctgccag

SEQ ID NO: 193360 - DNA, 27 bp, Artificial Sequence
  Description of Artificial Sequence: Synthetic oligonucleotide
ctacctggccaacttcaccctgccaga

SEQ ID NO: 193361 - DNA, 27 bp, Artificial Sequence
  Description of Artificial Sequence: Synthetic oligonucleotide
tacctggccaacttcaccctgccagac

SEQ ID NO: 193362 - DNA, 27 bp, Artificial Sequence
  Description of Artificial Sequence: Synthetic oligonucleotide
acctggccaacttcaccctgccagact

SEQ ID NO: 193363 - DNA, 26 bp, Artificial Sequence
  Description of Artificial Sequence: Synthetic oligonucleotide
cctggccaacttcaccctgccagact

SEQ ID NO: 193364 - DNA, 27 bp, Artificial Sequence
  Description of Artificial Sequence: Synthetic oligonucleotide
ctggccaacttcaccctgccagactct

SEQ ID NO: 193365 - DNA, 27 bp, Artificial Sequence
  Description of Artificial Sequence: Synthetic oligonucleotide
tggccaacttcaccctgccagactctg

SEQ ID NO: 193366 - DNA, 27 bp, Artificial Sequence
  Description of Artificial Sequence: Synthetic oligonucleotide
ggccaacttcaccctgccagactctga

SEQ ID NO: 193367 - DNA, 27 bp, Artificial Sequence
  Description of Artificial Sequence: Synthetic oligonucleotide
gccaacttcaccctgccagactctgag

SEQ ID NO: 193368 - DNA, 29 bp, Artificial Sequence
  Description of Artificial Sequence: Synthetic oligonucleotide
ccaacttcaccctgccagactctgagttc

SEQ ID NO: 193369 - DNA, 29 bp, Artificial Sequence
  Description of Artificial Sequence: Synthetic oligonucleotide
caacttcaccctgccagactctgagttcc

SEQ ID NO: 193370 - DNA, 30 bp, Artificial Sequence
  Description of Artificial Sequence: Synthetic oligonucleotide
aacttcaccctgccagactctgagttcctg

SEQ ID NO: 193371 - DNA, 29 bp, Artificial Sequence
  Description of Artificial Sequence: Synthetic oligonucleotide
acttcaccctgccagactctgagttcctg

SEQ ID NO: 193372 - DNA, 28 bp, Artificial Sequence
  Description of Artificial Sequence: Synthetic oligonucleotide
cttcaccctgccagactctgagttcctg

SEQ ID NO: 193373 - DNA, 30 bp, Artificial Sequence
  Description of Artificial Sequence: Synthetic oligonucleotide
ttcaccctgccagactctgagttcctgaag

SEQ ID NO: 193374 - DNA, 29 bp, Artificial Sequence
  Description of Artificial Sequence: Synthetic oligonucleotide
tcaccctgccagactctgagttcctgaag

SEQ ID NO: 193375 - DNA, 28 bp, Artificial Sequence
  Description of Artificial Sequence: Synthetic oligonucleotide
caccctgccagactctgagttcctgaag

SEQ ID NO: 193376 - DNA, 30 bp, Artificial Sequence
  Description of Artificial Sequence: Synthetic oligonucleotide
accctgccagactctgagttcctgaagatc

SEQ ID NO: 193377 - DNA, 29 bp, Artificial Sequence
  Description of Artificial Sequence: Synthetic oligonucleotide
ccctgccagactctgagttcctgaagatc

SEQ ID NO: 193378 - DNA, 34 bp, Artificial Sequence
  Description of Artificial Sequence: Synthetic oligonucleotide
cctgccagactctgagttcctgaagatctttaag

SEQ ID NO: 193379 - DNA, 34 bp, Artificial Sequence
  Description of Artificial Sequence: Synthetic oligonucleotide
ctgccagactctgagttcctgaagatctttaagc

SEQ ID NO: 193380 - DNA, 34 bp, Artificial Sequence
  Description of Artificial Sequence: Synthetic oligonucleotide
tgccagactctgagttcctgaagatctttaagcc

SEQ ID NO: 193381 - DNA, 33 bp, Artificial Sequence
  Description of Artificial Sequence: Synthetic oligonucleotide
gccagactctgagttcctgaagatctttaagcc

SEQ ID NO: 193382 - DNA, 33 bp, Artificial Sequence
  Description of Artificial Sequence: Synthetic oligonucleotide
ccagactctgagttcctgaagatctttaagccg

SEQ ID NO: 193383 - DNA, 33 bp, Artificial Sequence
  Description of Artificial Sequence: Synthetic oligonucleotide
cagactctgagttcctgaagatctttaagccgg

SEQ ID NO: 193384 - DNA, 34 bp, Artificial Sequence
  Description of Artificial Sequence: Synthetic oligonucleotide
agactctgagttcctgaagatctttaagccggag

SEQ ID NO: 193385 - DNA, 33 bp, Artificial Sequence
  Description of Artificial Sequence: Synthetic oligonucleotide
gactctgagttcctgaagatctttaagccggag

SEQ ID NO: 193386 - DNA, 33 bp, Artificial Sequence
  Description of Artificial Sequence: Synthetic oligonucleotide
actctgagttcctgaagatctttaagccggagg

SEQ ID NO: 193387 - DNA, 32 bp, Artificial Sequence
  Description of Artificial Sequence: Synthetic oligonucleotide
ctctgagttcctgaagatctttaagccggagg

SEQ ID NO: 193388 - DNA, 32 bp, Artificial Sequence
  Description of Artificial Sequence: Synthetic oligonucleotide
tctgagttcctgaagatctttaagccggaggc

SEQ ID NO: 193389 - DNA, 31 bp, Artificial Sequence
  Description of Artificial Sequence: Synthetic oligonucleotide
ctgagttcctgaagatctttaagccggaggc

SEQ ID NO: 193390 - DNA, 31 bp, Artificial Sequence
  Description of Artificial Sequence: Synthetic oligonucleotide
tgagttcctgaagatctttaagccggaggcg

SEQ ID NO: 193391 - DNA, 30 bp, Artificial Sequence
  Description of Artificial Sequence: Synthetic oligonucleotide
gagttcctgaagatctttaagccggaggcg

SEQ ID NO: 193392 - DNA, 30 bp, Artificial Sequence
  Description of Artificial Sequence: Synthetic oligonucleotide
agttcctgaagatctttaagccggaggcgg

SEQ ID NO: 193393 - DNA, 29 bp, Artificial Sequence
  Description of Artificial Sequence: Synthetic oligonucleotide
gttcctgaagatctttaagccggaggcgg

SEQ ID NO: 193394 - DNA, 29 bp, Artificial Sequence
  Description of Artificial Sequence: Synthetic oligonucleotide
ttcctgaagatctttaagccggaggcggc

SEQ ID NO: 193395 - DNA, 28 bp, Artificial Sequence
  Description of Artificial Sequence: Synthetic oligonucleotide
tcctgaagatctttaagccggaggcggc

SEQ ID NO: 193396 - DNA, 27 bp, Artificial Sequence
  Description of Artificial Sequence: Synthetic oligonucleotide
cctgaagatctttaagccggaggcggc

SEQ ID NO: 193397 - DNA, 27 bp, Artificial Sequence
  Description of Artificial Sequence: Synthetic oligonucleotide
ctgaagatctttaagccggaggcggcc

SEQ ID NO: 193398 - DNA, 29 bp, Artificial Sequence
  Description of Artificial Sequence: Synthetic oligonucleotide
tgaagatctttaagccggaggcggccttc

SEQ ID NO: 193399 - DNA, 28 bp, Artificial Sequence
  Description of Artificial Sequence: Synthetic oligonucleotide
gaagatctttaagccggaggcggccttc

SEQ ID NO: 193400 - DNA, 28 bp, Artificial Sequence
  Description of Artificial Sequence: Synthetic oligonucleotide
aagatctttaagccggaggcggccttcc

SEQ ID NO: 193401 - DNA, 27 bp, Artificial Sequence
  Description of Artificial Sequence: Synthetic oligonucleotide
agatctttaagccggaggcggccttcc

SEQ ID NO: 193402 - DNA, 27 bp, Artificial Sequence
  Description of Artificial Sequence: Synthetic oligonucleotide
gatctttaagccggaggcggccttcct

SEQ ID NO: 193403 - DNA, 27 bp, Artificial Sequence
  Description of Artificial Sequence: Synthetic oligonucleotide
atctttaagccggaggcggccttcctg

SEQ ID NO: 193404 - DNA, 26 bp, Artificial Sequence
  Description of Artificial Sequence: Synthetic oligonucleotide
tctttaagccggaggcggccttcctg

SEQ ID NO: 193405 - DNA, 25 bp, Artificial Sequence
  Description of Artificial Sequence: Synthetic oligonucleotide
ctttaagccggaggcggccttcctg

SEQ ID NO: 193406 - DNA, 25 bp, Artificial Sequence
  Description of Artificial Sequence: Synthetic oligonucleotide
tttaagccggaggcggccttcctgc

SEQ ID NO: 193407 - DNA, 24 bp, Artificial Sequence
  Description of Artificial Sequence: Synthetic oligonucleotide
ttaagccggaggcggccttcctgc

SEQ ID NO: 193408 - DNA, 23 bp, Artificial Sequence
  Description of Artificial Sequence: Synthetic oligonucleotide
taagccggaggcggccttcctgc

SEQ ID NO: 193409 - DNA, 22 bp, Artificial Sequence
  Description of Artificial Sequence: Synthetic oligonucleotide
aagccggaggcggccttcctgc

SEQ ID NO: 193410 - DNA, 21 bp, Artificial Sequence
  Description of Artificial Sequence: Synthetic oligonucleotide
agccggaggcggccttcctgc

SEQ ID NO: 193411 - DNA, 20 bp, Artificial Sequence
  Description of Artificial Sequence: Synthetic oligonucleotide
gccggaggcggccttcctgc

SEQ ID NO: 193412 - DNA, 20 bp, Artificial Sequence
  Description of Artificial Sequence: Synthetic oligonucleotide
ccggaggcggccttcctgcc

SEQ ID NO: 193413 - DNA, 20 bp, Artificial Sequence
  Description of Artificial Sequence: Synthetic oligonucleotide
cggaggcggccttcctgccc

SEQ ID NO: 193414 - DNA, 21 bp, Artificial Sequence
  Description of Artificial Sequence: Synthetic oligonucleotide
ggaggcggccttcctgcccga

SEQ ID NO: 193415 - DNA, 22 bp, Artificial Sequence
  Description of Artificial Sequence: Synthetic oligonucleotide
gaggcggccttcctgcccgagt

SEQ ID NO: 193416 - DNA, 22 bp, Artificial Sequence
  Description of Artificial Sequence: Synthetic oligonucleotide
aggcggccttcctgcccgagtg

SEQ ID NO: 193417 - DNA, 21 bp, Artificial Sequence
  Description of Artificial Sequence: Synthetic oligonucleotide
ggcggccttcctgcccgagtg

SEQ ID NO: 193418 - DNA, 21 bp, Artificial Sequence
  Description of Artificial Sequence: Synthetic oligonucleotide
gcggccttcctgcccgagtgg

SEQ ID NO: 193419 - DNA, 22 bp, Artificial Sequence
  Description of Artificial Sequence: Synthetic oligonucleotide
cggccttcctgcccgagtgggt

SEQ ID NO: 193420 - DNA, 22 bp, Artificial Sequence
  Description of Artificial Sequence: Synthetic oligonucleotide
ggccttcctgcccgagtgggtg

SEQ ID NO: 193421 - DNA, 22 bp, Artificial Sequence
  Description of Artificial Sequence: Synthetic oligonucleotide
gccttcctgcccgagtgggtgg

SEQ ID NO: 193422 - DNA, 22 bp, Artificial Sequence
  Description of Artificial Sequence: Synthetic oligonucleotide
ccttcctgcccgagtgggtggg

SEQ ID NO: 193423 - DNA, 27 bp, Artificial Sequence
  Description of Artificial Sequence: Synthetic oligonucleotide
cttcctgcccgagtgggtgggcattaa

SEQ ID NO: 193424 - DNA, 28 bp, Artificial Sequence
  Description of Artificial Sequence: Synthetic oligonucleotide
ttcctgcccgagtgggtgggcattaatg

SEQ ID NO: 193425 - DNA, 27 bp, Artificial Sequence
  Description of Artificial Sequence: Synthetic oligonucleotide
tcctgcccgagtgggtgggcattaatg

SEQ ID NO: 193426 - DNA, 26 bp, Artificial Sequence
  Description of Artificial Sequence: Synthetic oligonucleotide
cctgcccgagtgggtgggcattaatg

SEQ ID NO: 193427 - DNA, 27 bp, Artificial Sequence
  Description of Artificial Sequence: Synthetic oligonucleotide
ctgcccgagtgggtgggcattaatgca

SEQ ID NO: 193428 - DNA, 27 bp, Artificial Sequence
  Description of Artificial Sequence: Synthetic oligonucleotide
tgcccgagtgggtgggcattaatgcag

SEQ ID NO: 193429 - DNA, 27 bp, Artificial Sequence
  Description of Artificial Sequence: Synthetic oligonucleotide
gcccgagtgggtgggcattaatgcaga

SEQ ID NO: 193430 - DNA, 27 bp, Artificial Sequence
  Description of Artificial Sequence: Synthetic oligonucleotide
cccgagtgggtgggcattaatgcagac

SEQ ID NO: 193431 - DNA, 29 bp, Artificial Sequence
  Description of Artificial Sequence: Synthetic oligonucleotide
ccgagtgggtgggcattaatgcagacttg

SEQ ID NO: 193432 - DNA, 30 bp, Artificial Sequence
  Description of Artificial Sequence: Synthetic oligonucleotide
cgagtgggtgggcattaatgcagacttgtc

SEQ ID NO: 193433 - DNA, 31 bp, Artificial Sequence
  Description of Artificial Sequence: Synthetic oligonucleotide
gagtgggtgggcattaatgcagacttgtctc

SEQ ID NO: 193434 - DNA, 31 bp, Artificial Sequence
  Description of Artificial Sequence: Synthetic oligonucleotide
agtgggtgggcattaatgcagacttgtctcc

SEQ ID NO: 193435 - DNA, 30 bp, Artificial Sequence
  Description of Artificial Sequence: Synthetic oligonucleotide
gtgggtgggcattaatgcagacttgtctcc

SEQ ID NO: 193436 - DNA, 31 bp, Artificial Sequence
  Description of Artificial Sequence: Synthetic oligonucleotide
tgggtgggcattaatgcagacttgtctccac

SEQ ID NO: 193437 - DNA, 30 bp, Artificial Sequence
  Description of Artificial Sequence: Synthetic oligonucleotide
gggtgggcattaatgcagacttgtctccac

SEQ ID NO: 193438 - DNA, 31 bp, Artificial Sequence
  Description of Artificial Sequence: Synthetic oligonucleotide
ggtgggcattaatgcagacttgtctccactc

SEQ ID NO: 193439 - DNA, 32 bp, Artificial Sequence
  Description of Artificial Sequence: Synthetic oligonucleotide
gtgggcattaatgcagacttgtctccactctg

SEQ ID NO: 193440 - DNA, 32 bp, Artificial Sequence
  Description of Artificial Sequence: Synthetic oligonucleotide
tgggcattaatgcagacttgtctccactctgg

SEQ ID NO: 193441 - DNA, 31 bp, Artificial Sequence
  Description of Artificial Sequence: Synthetic oligonucleotide
gggcattaatgcagacttgtctccactctgg

SEQ ID NO: 193442 - DNA, 32 bp, Artificial Sequence
  Description of Artificial Sequence: Synthetic oligonucleotide
ggcattaatgcagacttgtctccactctggac

SEQ ID NO: 193443 - DNA, 35 bp, Artificial Sequence
  Description of Artificial Sequence: Synthetic oligonucleotide
gcattaatgcagacttgtctccactctggacattg

SEQ ID NO: 193444 - DNA, 35 bp, Artificial Sequence
  Description of Artificial Sequence: Synthetic oligonucleotide
cattaatgcagacttgtctccactctggacattgg

SEQ ID NO: 193445 - DNA, 35 bp, Artificial Sequence
  Description of Artificial Sequence: Synthetic oligonucleotide
attaatgcagacttgtctccactctggacattggc

SEQ ID NO: 193446 - DNA, 34 bp, Artificial Sequence
  Description of Artificial Sequence: Synthetic oligonucleotide
ttaatgcagacttgtctccactctggacattggc

SEQ ID NO: 193447 - DNA, 33 bp, Artificial Sequence
  Description of Artificial Sequence: Synthetic oligonucleotide
taatgcagacttgtctccactctggacattggc

SEQ ID NO: 193448 - DNA, 32 bp, Artificial Sequence
  Description of Artificial Sequence: Synthetic oligonucleotide
aatgcagacttgtctccactctggacattggc

SEQ ID NO: 193449 - DNA, 31 bp, Artificial Sequence
  Description of Artificial Sequence: Synthetic oligonucleotide
atgcagacttgtctccactctggacattggc

SEQ ID NO: 193450 - DNA, 30 bp, Artificial Sequence
  Description of Artificial Sequence: Synthetic oligonucleotide
tgcagacttgtctccactctggacattggc

SEQ ID NO: 193451 - DNA, 29 bp, Artificial Sequence
  Description of Artificial Sequence: Synthetic oligonucleotide
gcagacttgtctccactctggacattggc

SEQ ID NO: 193452 - DNA, 32 bp, Artificial Sequence
  Description of Artificial Sequence: Synthetic oligonucleotide
cagacttgtctccactctggacattggctaag

SEQ ID NO: 193453 - DNA, 32 bp, Artificial Sequence
  Description of Artificial Sequence: Synthetic oligonucleotide
agacttgtctccactctggacattggctaagc

SEQ ID NO: 193454 - DNA, 31 bp, Artificial Sequence
  Description of Artificial Sequence: Synthetic oligonucleotide
gacttgtctccactctggacattggctaagc

SEQ ID NO: 193455 - DNA, 31 bp, Artificial Sequence
  Description of Artificial Sequence: Synthetic oligonucleotide
acttgtctccactctggacattggctaagcc

SEQ ID NO: 193456 - DNA, 30 bp, Artificial Sequence
  Description of Artificial Sequence: Synthetic oligonucleotide
cttgtctccactctggacattggctaagcc

SEQ ID NO: 193457 - DNA, 32 bp, Artificial Sequence
  Description of Artificial Sequence: Synthetic oligonucleotide
ttgtctccactctggacattggctaagccttg

SEQ ID NO: 193458 - DNA, 31 bp, Artificial Sequence
  Description of Artificial Sequence: Synthetic oligonucleotide
tgtctccactctggacattggctaagccttg

SEQ ID NO: 193459 - DNA, 30 bp, Artificial Sequence
  Description of Artificial Sequence: Synthetic oligonucleotide
gtctccactctggacattggctaagccttg

SEQ ID NO: 193460 - DNA, 27 bp, Artificial Sequence
  Description of Artificial Sequence: Synthetic oligonucleotide
atgtggcttcggagccatcgtcagctc

SEQ ID NO: 193461 - DNA, 27 bp, Artificial Sequence
  Description of Artificial Sequence: Synthetic oligonucleotide
tgtggcttcggagccatcgtcagctct

SEQ ID NO: 193462 - DNA, 26 bp, Artificial Sequence
  Description of Artificial Sequence: Synthetic oligonucleotide
gtggcttcggagccatcgtcagctct

SEQ ID NO: 193463 - DNA, 26 bp, Artificial Sequence
  Description of Artificial Sequence: Synthetic oligonucleotide
tggcttcggagccatcgtcagctctg

SEQ ID NO: 193464 - DNA, 25 bp, Artificial Sequence
  Description of Artificial Sequence: Synthetic oligonucleotide
ggcttcggagccatcgtcagctctg

SEQ ID NO: 193465 - DNA, 25 bp, Artificial Sequence
  Description of Artificial Sequence: Synthetic oligonucleotide
gcttcggagccatcgtcagctctgc

SEQ ID NO: 193466 - DNA, 26 bp, Artificial Sequence
  Description of Artificial Sequence: Synthetic oligonucleotide
cttcggagccatcgtcagctctgcct

SEQ ID NO: 193467 - DNA, 26 bp, Artificial Sequence
  Description of Artificial Sequence: Synthetic oligonucleotide
ttcggagccatcgtcagctctgcctg

SEQ ID NO: 193468 - DNA, 25 bp, Artificial Sequence
  Description of Artificial Sequence: Synthetic oligonucleotide
tcggagccatcgtcagctctgcctg

SEQ ID NO: 193469 - DNA, 31 bp, Artificial Sequence
  Description of Artificial Sequence: Synthetic oligonucleotide
tctggcttcccctgctcttggactttcttac

SEQ ID NO: 193470 - DNA, 30 bp, Artificial Sequence
  Description of Artificial Sequence: Synthetic oligonucleotide
ctggcttcccctgctcttggactttcttac

SEQ ID NO: 193471 - DNA, 31 bp, Artificial Sequence
  Description of Artificial Sequence: Synthetic oligonucleotide
tggcttcccctgctcttggactttcttacac

SEQ ID NO: 193472 - DNA, 30 bp, Artificial Sequence
  Description of Artificial Sequence: Synthetic oligonucleotide
ggcttcccctgctcttggactttcttacac

SEQ ID NO: 193473 - DNA, 30 bp, Artificial Sequence
  Description of Artificial Sequence: Synthetic oligonucleotide
gcttcccctgctcttggactttcttacacc

SEQ ID NO: 193474 - DNA, 32 bp, Artificial Sequence
  Description of Artificial Sequence: Synthetic oligonucleotide
cttcccctgctcttggactttcttacaccatc

SEQ ID NO: 193475 - DNA, 33 bp, Artificial Sequence
  Description of Artificial Sequence: Synthetic oligonucleotide
ttcccctgctcttggactttcttacaccatctc

SEQ ID NO: 193476 - DNA, 32 bp, Artificial Sequence
  Description of Artificial Sequence: Synthetic oligonucleotide
tcccctgctcttggactttcttacaccatctc

SEQ ID NO: 193477 - DNA, 31 bp, Artificial Sequence
  Description of Artificial Sequence: Synthetic oligonucleotide
cccctgctcttggactttcttacaccatctc

SEQ ID NO: 193478 - DNA, 31 bp, Artificial Sequence
  Description of Artificial Sequence: Synthetic oligonucleotide
ccctgctcttggactttcttacaccatctcc

SEQ ID NO: 193479 - DNA, 31 bp, Artificial Sequence
  Description of Artificial Sequence: Synthetic oligonucleotide
cctgctcttggactttcttacaccatctccg

SEQ ID NO: 193480 - DNA, 31 bp, Artificial Sequence
  Description of Artificial Sequence: Synthetic oligonucleotide
ctgctcttggactttcttacaccatctccgg

SEQ ID NO: 193481 - DNA, 31 bp, Artificial Sequence
  Description of Artificial Sequence: Synthetic oligonucleotide
tgctcttggactttcttacaccatctccggg

SEQ ID NO: 193482 - DNA, 30 bp, Artificial Sequence
  Description of Artificial Sequence: Synthetic oligonucleotide
gctcttggactttcttacaccatctccggg

SEQ ID NO: 193483 - DNA, 32 bp, Artificial Sequence
  Description of Artificial Sequence: Synthetic oligonucleotide
ctcttggactttcttacaccatctccgggaac

SEQ ID NO: 193484 - DNA, 33 bp, Artificial Sequence
  Description of Artificial Sequence: Synthetic oligonucleotide
tcttggactttcttacaccatctccgggaacag

SEQ ID NO: 193485 - DNA, 32 bp, Artificial Sequence
  Description of Artificial Sequence: Synthetic oligonucleotide
cttggactttcttacaccatctccgggaacag

SEQ ID NO: 193486 - DNA, 34 bp, Artificial Sequence
  Description of Artificial Sequence: Synthetic oligonucleotide
ttggactttcttacaccatctccgggaacagatc

SEQ ID NO: 193487 - DNA, 33 bp, Artificial Sequence
  Description of Artificial Sequence: Synthetic oligonucleotide
tggactttcttacaccatctccgggaacagatc

SEQ ID NO: 193488 - DNA, 32 bp, Artificial Sequence
  Description of Artificial Sequence: Synthetic oligonucleotide
ggactttcttacaccatctccgggaacagatc

SEQ ID NO: 193489 - DNA, 32 bp, Artificial Sequence
  Description of Artificial Sequence: Synthetic oligonucleotide
gactttcttacaccatctccgggaacagatcc

SEQ ID NO: 193490 - DNA, 32 bp, Artificial Sequence
  Description of Artificial Sequence: Synthetic oligonucleotide
actttcttacaccatctccgggaacagatccg

SEQ ID NO: 193491 - DNA, 31 bp, Artificial Sequence
  Description of Artificial Sequence: Synthetic oligonucleotide
ctttcttacaccatctccgggaacagatccg

SEQ ID NO: 193492 - DNA, 31 bp, Artificial Sequence
  Description of Artificial Sequence: Synthetic oligonucleotide
tttcttacaccatctccgggaacagatccgc

SEQ ID NO: 193493 - DNA, 30 bp, Artificial Sequence
  Description of Artificial Sequence: Synthetic oligonucleotide
ttcttacaccatctccgggaacagatccgc

SEQ ID NO: 193494 - DNA, 29 bp, Artificial Sequence
  Description of Artificial Sequence: Synthetic oligonucleotide
tcttacaccatctccgggaacagatccgc

SEQ ID NO: 193495 - DNA, 28 bp, Artificial Sequence
  Description of Artificial Sequence: Synthetic oligonucleotide
cttacaccatctccgggaacagatccgc

SEQ ID NO: 193496 - DNA, 29 bp, Artificial Sequence
  Description of Artificial Sequence: Synthetic oligonucleotide
ttacaccatctccgggaacagatccgcag

SEQ ID NO: 193497 - DNA, 28 bp, Artificial Sequence
  Description of Artificial Sequence: Synthetic oligonucleotide
tacaccatctccgggaacagatccgcag

SEQ ID NO: 193498 - DNA, 27 bp, Artificial Sequence
  Description of Artificial Sequence: Synthetic oligonucleotide
acaccatctccgggaacagatccgcag

SEQ ID NO: 193499 - DNA, 33 bp, Artificial Sequence
  Description of Artificial Sequence: Synthetic oligonucleotide
cggtttggtaatcagatgggacagtatgccatg

SEQ ID NO: 193500 - DNA, 33 bp, Artificial Sequence
  Description of Artificial Sequence: Synthetic oligonucleotide
ggtttggtaatcagatgggacagtatgccatgc

SEQ ID NO: 193501 - DNA, 34 bp, Artificial Sequence
  Description of Artificial Sequence: Synthetic oligonucleotide
gtttggtaatcagatgggacagtatgccatgctg

SEQ ID NO: 193502 - DNA, 34 bp, Artificial Sequence
  Description of Artificial Sequence: Synthetic oligonucleotide
tttggtaatcagatgggacagtatgccatgctgc

SEQ ID NO: 193503 - DNA, 33 bp, Artificial Sequence
  Description of Artificial Sequence: Synthetic oligonucleotide
ttggtaatcagatgggacagtatgccatgctgc

SEQ ID NO: 193504 - DNA, 32 bp, Artificial Sequence
  Description of Artificial Sequence: Synthetic oligonucleotide
tggtaatcagatgggacagtatgccatgctgc

SEQ ID NO: 193505 - DNA, 31 bp, Artificial Sequence
  Description of Artificial Sequence: Synthetic oligonucleotide
ggtaatcagatgggacagtatgccatgctgc

SEQ ID NO: 193506 - DNA, 32 bp, Artificial Sequence
  Description of Artificial Sequence: Synthetic oligonucleotide
gtaatcagatgggacagtatgccatgctgctg

SEQ ID NO: 193507 - DNA, 32 bp, Artificial Sequence
  Description of Artificial Sequence: Synthetic oligonucleotide
taatcagatgggacagtatgccatgctgctgg

SEQ ID NO: 193508 - DNA, 31 bp, Artificial Sequence
  Description of Artificial Sequence: Synthetic oligonucleotide
aatcagatgggacagtatgccatgctgctgg

SEQ ID NO: 193509 - DNA, 30 bp, Artificial Sequence
  Description of Artificial Sequence: Synthetic oligonucleotide
atcagatgggacagtatgccatgctgctgg

SEQ ID NO: 193510 - DNA, 29 bp, Artificial Sequence
  Description of Artificial Sequence: Synthetic oligonucleotide
tcagatgggacagtatgccatgctgctgg

SEQ ID NO: 193511 - DNA, 28 bp, Artificial Sequence
  Description of Artificial Sequence: Synthetic oligonucleotide
cagatgggacagtatgccatgctgctgg

SEQ ID NO: 193512 - DNA, 28 bp, Artificial Sequence
  Description of Artificial Sequence: Synthetic oligonucleotide
agatgggacagtatgccatgctgctggc

SEQ ID NO: 193513 - DNA, 27 bp, Artificial Sequence
  Description of Artificial Sequence: Synthetic oligonucleotide
gatgggacagtatgccatgctgctggc

SEQ ID NO: 193514 - DNA, 28 bp, Artificial Sequence
  Description of Artificial Sequence: Synthetic oligonucleotide
atgggacagtatgccatgctgctggctc

SEQ ID NO: 193515 - DNA, 27 bp, Artificial Sequence
  Description of Artificial Sequence: Synthetic oligonucleotide
tgggacagtatgccatgctgctggctc

SEQ ID NO: 193516 - DNA, 27 bp, Artificial Sequence
  Description of Artificial Sequence: Synthetic oligonucleotide
gggacagtatgccatgctgctggctct

SEQ ID NO: 193517 - DNA, 27 bp, Artificial Sequence
  Description of Artificial Sequence: Synthetic oligonucleotide
ggacagtatgccatgctgctggctctg

SEQ ID NO: 193518 - DNA, 27 bp, Artificial Sequence
  Description of Artificial Sequence: Synthetic oligonucleotide
gacagtatgccatgctgctggctctgg

SEQ ID NO: 193519 - DNA, 27 bp, Artificial Sequence
  Description of Artificial Sequence: Synthetic oligonucleotide
acagtatgccatgctgctggctctggc

SEQ ID NO: 193520 - DNA, 26 bp, Artificial Sequence
  Description of Artificial Sequence: Synthetic oligonucleotide
cagtatgccatgctgctggctctggc

SEQ ID NO: 193521 - DNA, 26 bp, Artificial Sequence
  Description of Artificial Sequence: Synthetic oligonucleotide
agtatgccatgctgctggctctggcc

SEQ ID NO: 193522 - DNA, 25 bp, Artificial Sequence
  Description of Artificial Sequence: Synthetic oligonucleotide
gtatgccatgctgctggctctggcc

SEQ ID NO: 193523 - DNA, 26 bp, Artificial Sequence
  Description of Artificial Sequence: Synthetic oligonucleotide
tatgccatgctgctggctctggccca

SEQ ID NO: 193524 - DNA, 25 bp, Artificial Sequence
  Description of Artificial Sequence: Synthetic oligonucleotide
atgccatgctgctggctctggccca

SEQ ID NO: 193525 - DNA, 24 bp, Artificial Sequence
  Description of Artificial Sequence: Synthetic oligonucleotide
tgccatgctgctggctctggccca

SEQ ID NO: 193526 - DNA, 23 bp, Artificial Sequence
  Description of Artificial Sequence: Synthetic oligonucleotide
gccatgctgctggctctggccca

SEQ ID NO: 193527 - DNA, 23 bp, Artificial Sequence
  Description of Artificial Sequence: Synthetic oligonucleotide
ccatgctgctggctctggcccag

SEQ ID NO: 193528 - DNA, 24 bp, Artificial Sequence
  Description of Artificial Sequence: Synthetic oligonucleotide
catgctgctggctctggcccagct

SEQ ID NO: 193529 - DNA, 26 bp, Artificial Sequence
  Description of Artificial Sequence: Synthetic oligonucleotide
atgctgctggctctggcccagctcaa

SEQ ID NO: 193530 - DNA, 25 bp, Artificial Sequence
  Description of Artificial Sequence: Synthetic oligonucleotide
tgctgctggctctggcccagctcaa

SEQ ID NO: 193531 - DNA, 28 bp, Artificial Sequence
  Description of Artificial Sequence: Synthetic oligonucleotide
agcttcacgactggatgtcggaggagtg

SEQ ID NO: 193532 - DNA, 27 bp, Artificial Sequence
  Description of Artificial Sequence: Synthetic oligonucleotide
gcttcacgactggatgtcggaggagtg

SEQ ID NO: 193533 - DNA, 27 bp, Artificial Sequence
  Description of Artificial Sequence: Synthetic oligonucleotide
cttcacgactggatgtcggaggagtgc

SEQ ID NO: 193534 - DNA, 27 bp, Artificial Sequence
  Description of Artificial Sequence: Synthetic oligonucleotide
ttcacgactggatgtcggaggagtgcg

SEQ ID NO: 193535 - DNA, 26 bp, Artificial Sequence
  Description of Artificial Sequence: Synthetic oligonucleotide
tcacgactggatgtcggaggagtgcg

SEQ ID NO: 193536 - DNA, 25 bp, Artificial Sequence
  Description of Artificial Sequence: Synthetic oligonucleotide
cacgactggatgtcggaggagtgcg

SEQ ID NO: 193537 - DNA, 25 bp, Artificial Sequence
  Description of Artificial Sequence: Synthetic oligonucleotide
acgactggatgtcggaggagtgcgc

SEQ ID NO: 193538 - DNA, 24 bp, Artificial Sequence
  Description of Artificial Sequence: Synthetic oligonucleotide
cgactggatgtcggaggagtgcgc

SEQ ID NO: 193539 - DNA, 24 bp, Artificial Sequence
  Description of Artificial Sequence: Synthetic oligonucleotide
gactggatgtcggaggagtgcgcg

SEQ ID NO: 193540 - DNA, 25 bp, Artificial Sequence
  Description of Artificial Sequence: Synthetic oligonucleotide
actggatgtcggaggagtgcgcgga

SEQ ID NO: 193541 - DNA, 24 bp, Artificial Sequence
  Description of Artificial Sequence: Synthetic oligonucleotide
ctggatgtcggaggagtgcgcgga

SEQ ID NO: 193542 - DNA, 26 bp, Artificial Sequence
  Description of Artificial Sequence: Synthetic oligonucleotide
tggatgtcggaggagtgcgcggactt

SEQ ID NO: 193543 - DNA, 25 bp, Artificial Sequence
  Description of Artificial Sequence: Synthetic oligonucleotide
ggatgtcggaggagtgcgcggactt

SEQ ID NO: 193544 - DNA, 26 bp, Artificial Sequence
  Description of Artificial Sequence: Synthetic oligonucleotide
gatgtcggaggagtgcgcggacttga

SEQ ID NO: 193545 - DNA, 27 bp, Artificial Sequence
  Description of Artificial Sequence: Synthetic oligonucleotide
atgtcggaggagtgcgcggacttgaga

SEQ ID NO: 193546 - DNA, 26 bp, Artificial Sequence
  Description of Artificial Sequence: Synthetic oligonucleotide
tgtcggaggagtgcgcggacttgaga

SEQ ID NO: 193547 - DNA, 25 bp, Artificial Sequence
  Description of Artificial Sequence: Synthetic oligonucleotide
gtcggaggagtgcgcggacttgaga

SEQ ID NO: 193548 - DNA, 27 bp, Artificial Sequence
  Description of Artificial Sequence: Synthetic oligonucleotide
tcggaggagtgcgcggacttgagagat

SEQ ID NO: 193549 - DNA, 26 bp, Artificial Sequence
  Description of Artificial Sequence: Synthetic oligonucleotide
cggaggagtgcgcggacttgagagat

SEQ ID NO: 193550 - DNA, 26 bp, Artificial Sequence
  Description of Artificial Sequence: Synthetic oligonucleotide
ggaggagtgcgcggacttgagagatc

SEQ ID NO: 193551 - DNA, 27 bp, Artificial Sequence
  Description of Artificial Sequence: Synthetic oligonucleotide
gaggagtgcgcggacttgagagatcct

SEQ ID NO: 193552 - DNA, 29 bp, Artificial Sequence
  Description of Artificial Sequence: Synthetic oligonucleotide
aggagtgcgcggacttgagagatcctttc

SEQ ID NO: 193553 - DNA, 28 bp, Artificial Sequence
  Description of Artificial Sequence: Synthetic oligonucleotide
ggagtgcgcggacttgagagatcctttc

SEQ ID NO: 193554 - DNA, 28 bp, Artificial Sequence
  Description of Artificial Sequence: Synthetic oligonucleotide
gagtgcgcggacttgagagatcctttcc

SEQ ID NO: 193555 - DNA, 29 bp, Artificial Sequence
  Description of Artificial Sequence: Synthetic oligonucleotide
agtgcgcggacttgagagatcctttcctg

SEQ ID NO: 193556 - DNA, 28 bp, Artificial Sequence
  Description of Artificial Sequence: Synthetic oligonucleotide
gtgcgcggacttgagagatcctttcctg

SEQ ID NO: 193557 - DNA, 30 bp, Artificial Sequence
  Description of Artificial Sequence: Synthetic oligonucleotide
tgcgcggacttgagagatcctttcctgaag

SEQ ID NO: 193558 - DNA, 29 bp, Artificial Sequence
  Description of Artificial Sequence: Synthetic oligonucleotide
gcgcggacttgagagatcctttcctgaag

SEQ ID NO: 193559 - DNA, 27 bp, Artificial Sequence
  Description of Artificial Sequence: Synthetic oligonucleotide
aagctctctggcttcccctgctcttgc

SEQ ID NO: 193560 - DNA, 27 bp, Artificial Sequence
  Description of Artificial Sequence: Synthetic oligonucleotide
agctctctggcttcccctgctcttgca

SEQ ID NO: 193561 - DNA, 26 bp, Artificial Sequence
  Description of Artificial Sequence: Synthetic oligonucleotide
gctctctggcttcccctgctcttgca

SEQ ID NO: 193562 - DNA, 27 bp, Artificial Sequence
  Description of Artificial Sequence: Synthetic oligonucleotide
ctctctggcttcccctgctcttgcact

SEQ ID NO: 193563 - DNA, 29 bp, Artificial Sequence
  Description of Artificial Sequence: Synthetic oligonucleotide
tctctggcttcccctgctcttgcactttc

SEQ ID NO: 193564 - DNA, 28 bp, Artificial Sequence
  Description of Artificial Sequence: Synthetic oligonucleotide
ctctggcttcccctgctcttgcactttc

SEQ ID NO: 193565 - DNA, 30 bp, Artificial Sequence
  Description of Artificial Sequence: Synthetic oligonucleotide
tctggcttcccctgctcttgcactttcttc

SEQ ID NO: 193566 - DNA, 29 bp, Artificial Sequence
  Description of Artificial Sequence: Synthetic oligonucleotide
ctggcttcccctgctcttgcactttcttc

SEQ ID NO: 193567 - DNA, 29 bp, Artificial Sequence
  Description of Artificial Sequence: Synthetic oligonucleotide
tggcttcccctgctcttgcactttcttcc

SEQ ID NO: 193568 - DNA, 28 bp, Artificial Sequence
  Description of Artificial Sequence: Synthetic oligonucleotide
ggcttcccctgctcttgcactttcttcc

SEQ ID NO: 193569 - DNA, 29 bp, Artificial Sequence
  Description of Artificial Sequence: Synthetic oligonucleotide
gcttcccctgctcttgcactttcttccac

SEQ ID NO: 193570 - DNA, 29 bp, Artificial Sequence
  Description of Artificial Sequence: Synthetic oligonucleotide
cttcccctgctcttgcactttcttccacc

SEQ ID NO: 193571 - DNA, 31 bp, Artificial Sequence
  Description of Artificial Sequence: Synthetic oligonucleotide
ttcccctgctcttgcactttcttccaccatc

SEQ ID NO: 193572 - DNA, 30 bp, Artificial Sequence
  Description of Artificial Sequence: Synthetic oligonucleotide
tcccctgctcttgcactttcttccaccatc

SEQ ID NO: 193573 - DNA, 29 bp, Artificial Sequence
  Description of Artificial Sequence: Synthetic oligonucleotide
cccctgctcttgcactttcttccaccatc

SEQ ID NO: 193574 - DNA, 30 bp, Artificial Sequence
  Description of Artificial Sequence: Synthetic oligonucleotide
ccctgctcttgcactttcttccaccatctc

SEQ ID NO: 193575 - DNA, 30 bp, Artificial Sequence
  Description of Artificial Sequence: Synthetic oligonucleotide
cctgctcttgcactttcttccaccatctcc

SEQ ID NO: 193576 - DNA, 30 bp, Artificial Sequence
  Description of Artificial Sequence: Synthetic oligonucleotide
ctgctcttgcactttcttccaccatctccg

SEQ ID NO: 193577 - DNA, 30 bp, Artificial Sequence
  Description of Artificial Sequence: Synthetic oligonucleotide
tgctcttgcactttcttccaccatctccgg

SEQ ID NO: 193578 - DNA, 29 bp, Artificial Sequence
  Description of Artificial Sequence: Synthetic oligonucleotide
gctcttgcactttcttccaccatctccgg

SEQ ID NO: 193579 - DNA, 29 bp, Artificial Sequence
  Description of Artificial Sequence: Synthetic oligonucleotide
ctcttgcactttcttccaccatctccggg

SEQ ID NO: 193580 - DNA, 31 bp, Artificial Sequence
  Description of Artificial Sequence: Synthetic oligonucleotide
tcttgcactttcttccaccatctccgggaac

SEQ ID NO: 193581 - DNA, 30 bp, Artificial Sequence
  Description of Artificial Sequence: Synthetic oligonucleotide
cttgcactttcttccaccatctccgggaac

SEQ ID NO: 193582 - DNA, 31 bp, Artificial Sequence
  Description of Artificial Sequence: Synthetic oligonucleotide
ttgcactttcttccaccatctccgggaacag

SEQ ID NO: 193583 - DNA, 30 bp, Artificial Sequence
  Description of Artificial Sequence: Synthetic oligonucleotide
tgcactttcttccaccatctccgggaacag

SEQ ID NO: 193584 - DNA, 29 bp, Artificial Sequence
  Description of Artificial Sequence: Synthetic oligonucleotide
gcactttcttccaccatctccgggaacag

SEQ ID NO: 193585 - DNA, 31 bp, Artificial Sequence
  Description of Artificial Sequence: Synthetic oligonucleotide
cactttcttccaccatctccgggaacagatc

SEQ ID NO: 193586 - DNA, 25 bp, Artificial Sequence
  Description of Artificial Sequence: Synthetic oligonucleotide
cacggcacgaagcccccgttttcga

SEQ ID NO: 193587 - DNA, 25 bp, Artificial Sequence
  Description of Artificial Sequence: Synthetic oligonucleotide
acggcacgaagcccccgttttcgag

SEQ ID NO: 193588 - DNA, 24 bp, Artificial Sequence
  Description of Artificial Sequence: Synthetic oligonucleotide
cggcacgaagcccccgttttcgag

SEQ ID NO: 193589 - DNA, 25 bp, Artificial Sequence
  Description of Artificial Sequence: Synthetic oligonucleotide
ggcacgaagcccccgttttcgaggt

SEQ ID NO: 193590 - DNA, 26 bp, Artificial Sequence
  Description of Artificial Sequence: Synthetic oligonucleotide
gcacgaagcccccgttttcgaggtca

SEQ ID NO: 193591 - DNA, 26 bp, Artificial Sequence
  Description of Artificial Sequence: Synthetic oligonucleotide
cacgaagcccccgttttcgaggtcac

SEQ ID NO: 193592 - DNA, 27 bp, Artificial Sequence
  Description of Artificial Sequence: Synthetic oligonucleotide
acgaagcccccgttttcgaggtcacca

SEQ ID NO: 193593 - DNA, 26 bp, Artificial Sequence
  Description of Artificial Sequence: Synthetic oligonucleotide
cgaagcccccgttttcgaggtcacca

SEQ ID NO: 193594 - DNA, 26 bp, Artificial Sequence
  Description of Artificial Sequence: Synthetic oligonucleotide
gaagcccccgttttcgaggtcaccag

SEQ ID NO: 193595 - DNA, 27 bp, Artificial Sequence
  Description of Artificial Sequence: Synthetic oligonucleotide
aagcccccgttttcgaggtcaccagca

SEQ ID NO: 193596 - DNA, 27 bp, Artificial Sequence
  Description of Artificial Sequence: Synthetic oligonucleotide
agcccccgttttcgaggtcaccagcaa

SEQ ID NO: 193597 - DNA, 26 bp, Artificial Sequence
  Description of Artificial Sequence: Synthetic oligonucleotide
gcccccgttttcgaggtcaccagcaa

SEQ ID NO: 193598 - DNA, 26 bp, Artificial Sequence
  Description of Artificial Sequence: Synthetic oligonucleotide
cccccgttttcgaggtcaccagcaac

SEQ ID NO: 193599 - DNA, 26 bp, Artificial Sequence
  Description of Artificial Sequence: Synthetic oligonucleotide
ccccgttttcgaggtcaccagcaacg

SEQ ID NO: 193600 - DNA, 26 bp, Artificial Sequence
  Description of Artificial Sequence: Synthetic oligonucleotide
cccgttttcgaggtcaccagcaacgg

SEQ ID NO: 193601 - DNA, 27 bp, Artificial Sequence
  Description of Artificial Sequence: Synthetic oligonucleotide
ccgttttcgaggtcaccagcaacggca

SEQ ID NO: 193602 - DNA, 28 bp, Artificial Sequence
  Description of Artificial Sequence: Synthetic oligonucleotide
cgttttcgaggtcaccagcaacggcatg

SEQ ID NO: 193603 - DNA, 28 bp, Artificial Sequence
  Description of Artificial Sequence: Synthetic oligonucleotide
gttttcgaggtcaccagcaacggcatgg

SEQ ID NO: 193604 - DNA, 29 bp, Artificial Sequence
  Description of Artificial Sequence: Synthetic oligonucleotide
ttttcgaggtcaccagcaacggcatggag

SEQ ID NO: 193605 - DNA, 28 bp, Artificial Sequence
  Description of Artificial Sequence: Synthetic oligonucleotide
tttcgaggtcaccagcaacggcatggag

SEQ ID NO: 193606 - DNA, 27 bp, Artificial Sequence
  Description of Artificial Sequence: Synthetic oligonucleotide
ttcgaggtcaccagcaacggcatggag

SEQ ID NO: 193607 - DNA, 27 bp, Artificial Sequence
  Description of Artificial Sequence: Synthetic oligonucleotide
tcgaggtcaccagcaacggcatggagt

SEQ ID NO: 193608 - DNA, 26 bp, Artificial Sequence
  Description of Artificial Sequence: Synthetic oligonucleotide
cgaggtcaccagcaacggcatggagt

SEQ ID NO: 193609 - DNA, 26 bp, Artificial Sequence
  Description of Artificial Sequence: Synthetic oligonucleotide
gaggtcaccagcaacggcatggagtg

SEQ ID NO: 193610 - DNA, 27 bp, Artificial Sequence
  Description of Artificial Sequence: Synthetic oligonucleotide
aggtcaccagcaacggcatggagtggt

SEQ ID NO: 193611 - DNA, 27 bp, Artificial Sequence
  Description of Artificial Sequence: Synthetic oligonucleotide
cgaagcccccgttttcgtggtcaccaa

SEQ ID NO: 193612 - DNA, 30 bp, Artificial Sequence
  Description of Artificial Sequence: Synthetic oligonucleotide
gaagcccccgttttcgtggtcaccaaaaac

SEQ ID NO: 193613 - DNA, 30 bp, Artificial Sequence
  Description of Artificial Sequence: Synthetic oligonucleotide
aagcccccgttttcgtggtcaccaaaaacg

SEQ ID NO: 193614 - DNA, 29 bp, Artificial Sequence
  Description of Artificial Sequence: Synthetic oligonucleotide
agcccccgttttcgtggtcaccaaaaacg

SEQ ID NO: 193615 - DNA, 28 bp, Artificial Sequence
  Description of Artificial Sequence: Synthetic oligonucleotide
gcccccgttttcgtggtcaccaaaaacg

SEQ ID NO: 193616 - DNA, 28 bp, Artificial Sequence
  Description of Artificial Sequence: Synthetic oligonucleotide
cccccgttttcgtggtcaccaaaaacgg

SEQ ID NO: 193617 - DNA, 28 bp, Artificial Sequence
  Description of Artificial Sequence: Synthetic oligonucleotide
ccccgttttcgtggtcaccaaaaacggc

SEQ ID NO: 193618 - DNA, 30 bp, Artificial Sequence
  Description of Artificial Sequence: Synthetic oligonucleotide
cccgttttcgtggtcaccaaaaacggcatg

SEQ ID NO: 193619 - DNA, 30 bp, Artificial Sequence
  Description of Artificial Sequence: Synthetic oligonucleotide
ccgttttcgtggtcaccaaaaacggcatgg

SEQ ID NO: 193620 - DNA, 31 bp, Artificial Sequence
  Description of Artificial Sequence: Synthetic oligonucleotide
cgttttcgtggtcaccaaaaacggcatggag

SEQ ID NO: 193621 - DNA, 32 bp, Artificial Sequence
  Description of Artificial Sequence: Synthetic oligonucleotide
gttttcgtggtcaccaaaaacggcatggagtg

SEQ ID NO: 193622 - DNA, 32 bp, Artificial Sequence
  Description of Artificial Sequence: Synthetic oligonucleotide
ttttcgtggtcaccaaaaacggcatggagtgg

SEQ ID NO: 193623 - DNA, 31 bp, Artificial Sequence
  Description of Artificial Sequence: Synthetic oligonucleotide
tttcgtggtcaccaaaaacggcatggagtgg

SEQ ID NO: 193624 - DNA, 30 bp, Artificial Sequence
  Description of Artificial Sequence: Synthetic oligonucleotide
ttcgtggtcaccaaaaacggcatggagtgg

SEQ ID NO: 193625 - DNA, 29 bp, Artificial Sequence
  Description of Artificial Sequence: Synthetic oligonucleotide
tcgtggtcaccaaaaacggcatggagtgg

SEQ ID NO: 193626 - DNA, 28 bp, Artificial Sequence
  Description of Artificial Sequence: Synthetic oligonucleotide
cgtggtcaccaaaaacggcatggagtgg

SEQ ID NO: 193627 - DNA, 29 bp, Artificial Sequence
  Description of Artificial Sequence: Synthetic oligonucleotide
gtggtcaccaaaaacggcatggagtggtg

SEQ ID NO: 193628 - DNA, 33 bp, Artificial Sequence
  Description of Artificial Sequence: Synthetic oligonucleotide
tggtcaccaaaaacggcatggagtggtgtaaag

SEQ ID NO: 193629 - DNA, 32 bp, Artificial Sequence
  Description of Artificial Sequence: Synthetic oligonucleotide
ggtcaccaaaaacggcatggagtggtgtaaag

SEQ ID NO: 193630 - DNA, 36 bp, Artificial Sequence
  Description of Artificial Sequence: Synthetic oligonucleotide
gtcaccaaaaacggcatggagtggtgtaaagaaaac

SEQ ID NO: 193631 - DNA, 38 bp, Artificial Sequence
  Description of Artificial Sequence: Synthetic oligonucleotide
tcaccaaaaacggcatggagtggtgtaaagaaaacatc

SEQ ID NO: 193632 - DNA, 37 bp, Artificial Sequence
  Description of Artificial Sequence: Synthetic oligonucleotide
caccaaaaacggcatggagtggtgtaaagaaaacatc

SEQ ID NO: 193633 - DNA, 37 bp, Artificial Sequence
  Description of Artificial Sequence: Synthetic oligonucleotide
accaaaaacggcatggagtggtgtaaagaaaacatcg

SEQ ID NO: 193634 - DNA, 36 bp, Artificial Sequence
  Description of Artificial Sequence: Synthetic oligonucleotide
ccaaaaacggcatggagtggtgtaaagaaaacatcg

SEQ ID NO: 193635 - DNA, 37 bp, Artificial Sequence
  Description of Artificial Sequence: Synthetic oligonucleotide
caaaaacggcatggagtggtgtaaagaaaacatcgac

SEQ ID NO: 193636 - DNA, 38 bp, Artificial Sequence
  Description of Artificial Sequence: Synthetic oligonucleotide
aaaaacggcatggagtggtgtaaagaaaacatcgacac

SEQ ID NO: 193637 - DNA, 37 bp, Artificial Sequence
  Description of Artificial Sequence: Synthetic oligonucleotide
aaaacggcatggagtggtgtaaagaaaacatcgacac

SEQ ID NO: 193638 - DNA, 36 bp, Artificial Sequence
  Description of Artificial Sequence: Synthetic oligonucleotide
aaacggcatggagtggtgtaaagaaaacatcgacac

SEQ ID NO: 193639 - DNA, 27 bp, Artificial Sequence
  Description of Artificial Sequence: Synthetic oligonucleotide
cattggcaccttcggcttctgggctgt

SEQ ID NO: 193640 - DNA, 27 bp, Artificial Sequence
  Description of Artificial Sequence: Synthetic oligonucleotide
attggcaccttcggcttctgggctgtc

SEQ ID NO: 193641 - DNA, 27 bp, Artificial Sequence
  Description of Artificial Sequence: Synthetic oligonucleotide
ttggcaccttcggcttctgggctgtct

SEQ ID NO: 193642 - DNA, 27 bp, Artificial Sequence
  Description of Artificial Sequence: Synthetic oligonucleotide
tggcaccttcggcttctgggctgtcta

SEQ ID NO: 193643 - DNA, 26 bp, Artificial Sequence
  Description of Artificial Sequence: Synthetic oligonucleotide
ggcaccttcggcttctgggctgtcta

SEQ ID NO: 193644 - DNA, 26 bp, Artificial Sequence
  Description of Artificial Sequence: Synthetic oligonucleotide
gcaccttcggcttctgggctgtctac

SEQ ID NO: 193645 - DNA, 27 bp, Artificial Sequence
  Description of Artificial Sequence: Synthetic oligonucleotide
caccttcggcttctgggctgtctacct

SEQ ID NO: 193646 - DNA, 27 bp, Artificial Sequence
  Description of Artificial Sequence: Synthetic oligonucleotide
accttcggcttctgggctgtctacctg

SEQ ID NO: 193647 - DNA, 26 bp, Artificial Sequence
  Description of Artificial Sequence: Synthetic oligonucleotide
ccttcggcttctgggctgtctacctg

SEQ ID NO: 193648 - DNA, 26 bp, Artificial Sequence
  Description of Artificial Sequence: Synthetic oligonucleotide
cttcggcttctgggctgtctacctgg

SEQ ID NO: 193649 - DNA, 27 bp, Artificial Sequence
  Description of Artificial Sequence: Synthetic oligonucleotide
ttcggcttctgggctgtctacctggct

SEQ ID NO: 193650 - DNA, 26 bp, Artificial Sequence
  Description of Artificial Sequence: Synthetic oligonucleotide
tcggcttctgggctgtctacctggct

SEQ ID NO: 193651 - DNA, 25 bp, Artificial Sequence
  Description of Artificial Sequence: Synthetic oligonucleotide
cggcttctgggctgtctacctggct

SEQ ID NO: 193652 - DNA, 25 bp, Artificial Sequence
  Description of Artificial Sequence: Synthetic oligonucleotide
ggcttctgggctgtctacctggctg

SEQ ID NO: 193653 - DNA, 25 bp, Artificial Sequence
  Description of Artificial Sequence: Synthetic oligonucleotide
gcttctgggctgtctacctggctgg

SEQ ID NO: 193654 - DNA, 25 bp, Artificial Sequence
  Description of Artificial Sequence: Synthetic oligonucleotide
cttctgggctgtctacctggctggc

SEQ ID NO: 193655 - DNA, 25 bp, Artificial Sequence
  Description of Artificial Sequence: Synthetic oligonucleotide
ttctgggctgtctacctggctggcg

SEQ ID NO: 193656 - DNA, 24 bp, Artificial Sequence
  Description of Artificial Sequence: Synthetic oligonucleotide
tctgggctgtctacctggctggcg

SEQ ID NO: 193657 - DNA, 23 bp, Artificial Sequence
  Description of Artificial Sequence: Synthetic oligonucleotide
ctgggctgtctacctggctggcg

SEQ ID NO: 193658 - DNA, 24 bp, Artificial Sequence
  Description of Artificial Sequence: Synthetic oligonucleotide
tgggctgtctacctggctggcgga

SEQ ID NO: 193659 - DNA, 23 bp, Artificial Sequence
  Description of Artificial Sequence: Synthetic oligonucleotide
gggctgtctacctggctggcgga

SEQ ID NO: 193660 - DNA, 24 bp, Artificial Sequence
  Description of Artificial Sequence: Synthetic oligonucleotide
ggctgtctacctggctggcggaga

SEQ ID NO: 193661 - DNA, 25 bp, Artificial Sequence
  Description of Artificial Sequence: Synthetic oligonucleotide
gctgtctacctggctggcggagaca

SEQ ID NO: 193662 - DNA, 26 bp, Artificial Sequence
  Description of Artificial Sequence: Synthetic oligonucleotide
ctgtctacctggctggcggagacact

SEQ ID NO: 193663 - DNA, 27 bp, Artificial Sequence
  Description of Artificial Sequence: Synthetic oligonucleotide
tgtctacctggctggcggagacactgt

SEQ ID NO: 193664 - DNA, 26 bp, Artificial Sequence
  Description of Artificial Sequence: Synthetic oligonucleotide
gtctacctggctggcggagacactgt

SEQ ID NO: 193665 - DNA, 27 bp, Artificial Sequence
  Description of Artificial Sequence: Synthetic oligonucleotide
tctacctggctggcggagacactgtct

SEQ ID NO: 193666 - DNA, 21 bp, Artificial Sequence
  Description of Artificial Sequence: Synthetic oligonucleotide
gcggccttcctgcccgagtgc

SEQ ID NO: 193667 - DNA, 22 bp, Artificial Sequence
  Description of Artificial Sequence: Synthetic oligonucleotide
cggccttcctgcccgagtgcgt

SEQ ID NO: 193668 - DNA, 22 bp, Artificial Sequence
  Description of Artificial Sequence: Synthetic oligonucleotide
ggccttcctgcccgagtgcgtg

SEQ ID NO: 193669 - DNA, 22 bp, Artificial Sequence
  Description of Artificial Sequence: Synthetic oligonucleotide
gccttcctgcccgagtgcgtgg

SEQ ID NO: 193670 - DNA, 22 bp, Artificial Sequence
  Description of Artificial Sequence: Synthetic oligonucleotide
ccttcctgcccgagtgcgtggg

SEQ ID NO: 193671 - DNA, 27 bp, Artificial Sequence
  Description of Artificial Sequence: Synthetic oligonucleotide
cttcctgcccgagtgcgtgggcattaa

SEQ ID NO: 193672 - DNA, 28 bp, Artificial Sequence
  Description of Artificial Sequence: Synthetic oligonucleotide
ttcctgcccgagtgcgtgggcattaatg

SEQ ID NO: 193673 - DNA, 27 bp, Artificial Sequence
  Description of Artificial Sequence: Synthetic oligonucleotide
tcctgcccgagtgcgtgggcattaatg

SEQ ID NO: 193674 - DNA, 26 bp, Artificial Sequence
  Description of Artificial Sequence: Synthetic oligonucleotide
cctgcccgagtgcgtgggcattaatg

SEQ ID NO: 193675 - DNA, 27 bp, Artificial Sequence
  Description of Artificial Sequence: Synthetic oligonucleotide
ctgcccgagtgcgtgggcattaatgca

SEQ ID NO: 193676 - DNA, 27 bp, Artificial Sequence
  Description of Artificial Sequence: Synthetic oligonucleotide
tgcccgagtgcgtgggcattaatgcag

SEQ ID NO: 193677 - DNA, 27 bp, Artificial Sequence
  Description of Artificial Sequence: Synthetic oligonucleotide
gcccgagtgcgtgggcattaatgcaga

SEQ ID NO: 193678 - DNA, 27 bp, Artificial Sequence
  Description of Artificial Sequence: Synthetic oligonucleotide
cccgagtgcgtgggcattaatgcagac

SEQ ID NO: 193679 - DNA, 29 bp, Artificial Sequence
  Description of Artificial Sequence: Synthetic oligonucleotide
ccgagtgcgtgggcattaatgcagacttg

SEQ ID NO: 193680 - DNA, 30 bp, Artificial Sequence
  Description of Artificial Sequence: Synthetic oligonucleotide
cgagtgcgtgggcattaatgcagacttgtc

SEQ ID NO: 193681 - DNA, 31 bp, Artificial Sequence
  Description of Artificial Sequence: Synthetic oligonucleotide
gagtgcgtgggcattaatgcagacttgtctc

SEQ ID NO: 193682 - DNA, 31 bp, Artificial Sequence
  Description of Artificial Sequence: Synthetic oligonucleotide
agtgcgtgggcattaatgcagacttgtctcc

SEQ ID NO: 193683 - DNA, 30 bp, Artificial Sequence
  Description of Artificial Sequence: Synthetic oligonucleotide
gtgcgtgggcattaatgcagacttgtctcc

SEQ ID NO: 193684 - DNA, 31 bp, Artificial Sequence
  Description of Artificial Sequence: Synthetic oligonucleotide
tgcgtgggcattaatgcagacttgtctccac

SEQ ID NO: 193685 - DNA, 30 bp, Artificial Sequence
  Description of Artificial Sequence: Synthetic oligonucleotide
gcgtgggcattaatgcagacttgtctccac

SEQ ID NO: 193686 - DNA, 31 bp, Artificial Sequence
  Description of Artificial Sequence: Synthetic oligonucleotide
cgtgggcattaatgcagacttgtctccactc

SEQ ID NO: 193687 - DNA, 21 bp, Artificial Sequence
  Description of Artificial Sequence: Synthetic oligonucleotide
cccagctcaacggccgccgga

SEQ ID NO: 193688 - DNA, 21 bp, Artificial Sequence
  Description of Artificial Sequence: Synthetic oligonucleotide
ccagctcaacggccgccggac

SEQ ID NO: 193689 - DNA, 26 bp, Artificial Sequence
  Description of Artificial Sequence: Synthetic oligonucleotide
cagctcaacggccgccggacctttat

SEQ ID NO: 193690 - DNA, 26 bp, Artificial Sequence
  Description of Artificial Sequence: Synthetic oligonucleotide
agctcaacggccgccggacctttatc

SEQ ID NO: 193691 - DNA, 25 bp, Artificial Sequence
  Description of Artificial Sequence: Synthetic oligonucleotide
gctcaacggccgccggacctttatc

SEQ ID NO: 193692 - DNA, 26 bp, Artificial Sequence
  Description of Artificial Sequence: Synthetic oligonucleotide
ctcaacggccgccggacctttatcct

SEQ ID NO: 193693 - DNA, 26 bp, Artificial Sequence
  Description of Artificial Sequence: Synthetic oligonucleotide
tcaacggccgccggacctttatcctg

SEQ ID NO: 193694 - DNA, 25 bp, Artificial Sequence
  Description of Artificial Sequence: Synthetic oligonucleotide
caacggccgccggacctttatcctg

SEQ ID NO: 193695 - DNA, 25 bp, Artificial Sequence
  Description of Artificial Sequence: Synthetic oligonucleotide
aacggccgccggacctttatcctgc

SEQ ID NO: 193696 - DNA, 24 bp, Artificial Sequence
  Description of Artificial Sequence: Synthetic oligonucleotide
acggccgccggacctttatcctgc

SEQ ID NO: 193697 - DNA, 23 bp, Artificial Sequence
  Description of Artificial Sequence: Synthetic oligonucleotide
cggccgccggacctttatcctgc

SEQ ID NO: 193698 - DNA, 24 bp, Artificial Sequence
  Description of Artificial Sequence: Synthetic oligonucleotide
ggccgccggacctttatcctgcct

SEQ ID NO: 193699 - DNA, 24 bp, Artificial Sequence
  Description of Artificial Sequence: Synthetic oligonucleotide
gccgccggacctttatcctgcctg

SEQ ID NO: 193700 - DNA, 24 bp, Artificial Sequence
  Description of Artificial Sequence: Synthetic oligonucleotide
ccgccggacctttatcctgcctgc

SEQ ID NO: 193701 - DNA, 26 bp, Artificial Sequence
  Description of Artificial Sequence: Synthetic oligonucleotide
cgccggacctttatcctgcctgccat

SEQ ID NO: 193702 - DNA, 26 bp, Artificial Sequence
  Description of Artificial Sequence: Synthetic oligonucleotide
gccggacctttatcctgcctgccatg

SEQ ID NO: 193703 - DNA, 27 bp, Artificial Sequence
  Description of Artificial Sequence: Synthetic oligonucleotide
ccggacctttatcctgcctgccatgca

SEQ ID NO: 193704 - DNA, 28 bp, Artificial Sequence
  Description of Artificial Sequence: Synthetic oligonucleotide
cggacctttatcctgcctgccatgcatg

SEQ ID NO: 193705 - DNA, 28 bp, Artificial Sequence
  Description of Artificial Sequence: Synthetic oligonucleotide
ggacctttatcctgcctgccatgcatgc

SEQ ID NO: 193706 - DNA, 28 bp, Artificial Sequence
  Description of Artificial Sequence: Synthetic oligonucleotide
gacctttatcctgcctgccatgcatgcc

SEQ ID NO: 193707 - DNA, 28 bp, Artificial Sequence
  Description of Artificial Sequence: Synthetic oligonucleotide
acctttatcctgcctgccatgcatgccg

SEQ ID NO: 193708 - DNA, 25 bp, Artificial Sequence
  Description of Artificial Sequence: Synthetic oligonucleotide
ggagccatcgtcagctctgcctggt

SEQ ID NO: 193709 - DNA, 27 bp, Artificial Sequence
  Description of Artificial Sequence: Synthetic oligonucleotide
gagccatcgtcagctctgcctggtctt

SEQ ID NO: 193710 - DNA, 27 bp, Artificial Sequence
  Description of Artificial Sequence: Synthetic oligonucleotide
agccatcgtcagctctgcctggtcttc

SEQ ID NO: 193711 - DNA, 26 bp, Artificial Sequence
  Description of Artificial Sequence: Synthetic oligonucleotide
gccatcgtcagctctgcctggtcttc

SEQ ID NO: 193712 - DNA, 27 bp, Artificial Sequence
  Description of Artificial Sequence: Synthetic oligonucleotide
ccatcgtcagctctgcctggtcttcct

SEQ ID NO: 193713 - DNA, 27 bp, Artificial Sequence
  Description of Artificial Sequence: Synthetic oligonucleotide
catcgtcagctctgcctggtcttcctg

SEQ ID NO: 193714 - DNA, 27 bp, Artificial Sequence
  Description of Artificial Sequence: Synthetic oligonucleotide
atcgtcagctctgcctggtcttcctgc

SEQ ID NO: 193715 - DNA, 27 bp, Artificial Sequence
  Description of Artificial Sequence: Synthetic oligonucleotide
tcgtcagctctgcctggtcttcctgct

SEQ ID NO: 193716 - DNA, 27 bp, Artificial Sequence
  Description of Artificial Sequence: Synthetic oligonucleotide
cgtcagctctgcctggtcttcctgcta

SEQ ID NO: 193717 - DNA, 27 bp, Artificial Sequence
  Description of Artificial Sequence: Synthetic oligonucleotide
gtcagctctgcctggtcttcctgctag

SEQ ID NO: 193718 - DNA, 28 bp, Artificial Sequence
  Description of Artificial Sequence: Synthetic oligonucleotide
tcagctctgcctggtcttcctgctagtc

SEQ ID NO: 193719 - DNA, 27 bp, Artificial Sequence
  Description of Artificial Sequence: Synthetic oligonucleotide
cagctctgcctggtcttcctgctagtc

SEQ ID NO: 193720 - DNA, 28 bp, Artificial Sequence
  Description of Artificial Sequence: Synthetic oligonucleotide
agctctgcctggtcttcctgctagtctg

SEQ ID NO: 193721 - DNA, 27 bp, Artificial Sequence
  Description of Artificial Sequence: Synthetic oligonucleotide
gctctgcctggtcttcctgctagtctg

SEQ ID NO: 193722 - DNA, 28 bp, Artificial Sequence
  Description of Artificial Sequence: Synthetic oligonucleotide
ctctgcctggtcttcctgctagtctgtg

SEQ ID NO: 193723 - DNA, 29 bp, Artificial Sequence
  Description of Artificial Sequence: Synthetic oligonucleotide
tctgcctggtcttcctgctagtctgtgtc

SEQ ID NO: 193724 - DNA, 28 bp, Artificial Sequence
  Description of Artificial Sequence: Synthetic oligonucleotide
ctgcctggtcttcctgctagtctgtgtc

SEQ ID NO: 193725 - DNA, 28 bp, Artificial Sequence
  Description of Artificial Sequence: Synthetic oligonucleotide
tgcctggtcttcctgctagtctgtgtcc

SEQ ID NO: 193726 - DNA, 27 bp, Artificial Sequence
  Description of Artificial Sequence: Synthetic oligonucleotide
gcctggtcttcctgctagtctgtgtcc

SEQ ID NO: 193727 - DNA, 28 bp, Artificial Sequence
  Description of Artificial Sequence: Synthetic oligonucleotide
cctggtcttcctgctagtctgtgtcctc

SEQ ID NO: 193728 - DNA, 29 bp, Artificial Sequence
  Description of Artificial Sequence: Synthetic oligonucleotide
ctggtcttcctgctagtctgtgtcctctc

SEQ ID NO: 193729 - DNA, 30 bp, Artificial Sequence
  Description of Artificial Sequence: Synthetic oligonucleotide
tggtcttcctgctagtctgtgtcctctctg

SEQ ID NO: 193730 - DNA, 29 bp, Artificial Sequence
  Description of Artificial Sequence: Synthetic oligonucleotide
ggtcttcctgctagtctgtgtcctctctg

SEQ ID NO: 193731 - DNA, 33 bp, Artificial Sequence
  Description of Artificial Sequence: Synthetic oligonucleotide
gtcttcctgctagtctgtgtcctctctgtaatc

SEQ ID NO: 193732 - DNA, 35 bp, Artificial Sequence
  Description of Artificial Sequence: Synthetic oligonucleotide
tcttcctgctagtctgtgtcctctctgtaatcttc

SEQ ID NO: 193733 - DNA, 32 bp, Artificial Sequence
  Description of Artificial Sequence: Synthetic oligonucleotide
gactgtctaccccaatggccggtttgttaatc

SEQ ID NO: 193734 - DNA, 33 bp, Artificial Sequence
  Description of Artificial Sequence: Synthetic oligonucleotide
actgtctaccccaatggccggtttgttaatcag

SEQ ID NO: 193735 - DNA, 32 bp, Artificial Sequence
  Description of Artificial Sequence: Synthetic oligonucleotide
ctgtctaccccaatggccggtttgttaatcag

SEQ ID NO: 193736 - DNA, 34 bp, Artificial Sequence
  Description of Artificial Sequence: Synthetic oligonucleotide
tgtctaccccaatggccggtttgttaatcagatg

SEQ ID NO: 193737 - DNA, 33 bp, Artificial Sequence
  Description of Artificial Sequence: Synthetic oligonucleotide
gtctaccccaatggccggtttgttaatcagatg

SEQ ID NO: 193738 - DNA, 33 bp, Artificial Sequence
  Description of Artificial Sequence: Synthetic oligonucleotide
tctaccccaatggccggtttgttaatcagatgg

SEQ ID NO: 193739 - DNA, 32 bp, Artificial Sequence
  Description of Artificial Sequence: Synthetic oligonucleotide
ctaccccaatggccggtttgttaatcagatgg

SEQ ID NO: 193740 - DNA, 32 bp, Artificial Sequence
  Description of Artificial Sequence: Synthetic oligonucleotide
taccccaatggccggtttgttaatcagatggg

SEQ ID NO: 193741 - DNA, 31 bp, Artificial Sequence
  Description of Artificial Sequence: Synthetic oligonucleotide
accccaatggccggtttgttaatcagatggg

SEQ ID NO: 193742 - DNA, 30 bp, Artificial Sequence
  Description of Artificial Sequence: Synthetic oligonucleotide
ccccaatggccggtttgttaatcagatggg

SEQ ID NO: 193743 - DNA, 31 bp, Artificial Sequence
  Description of Artificial Sequence: Synthetic oligonucleotide
cccaatggccggtttgttaatcagatgggac

SEQ ID NO: 193744 - DNA, 32 bp, Artificial Sequence
  Description of Artificial Sequence: Synthetic oligonucleotide
ccaatggccggtttgttaatcagatgggacag

SEQ ID NO: 193745 - DNA, 35 bp, Artificial Sequence
  Description of Artificial Sequence: Synthetic oligonucleotide
caatggccggtttgttaatcagatgggacagtatg

SEQ ID NO: 193746 - DNA, 35 bp, Artificial Sequence
  Description of Artificial Sequence: Synthetic oligonucleotide
aatggccggtttgttaatcagatgggacagtatgc

SEQ ID NO: 193747 - DNA, 34 bp, Artificial Sequence
  Description of Artificial Sequence: Synthetic oligonucleotide
atggccggtttgttaatcagatgggacagtatgc

SEQ ID NO: 193748 - DNA, 33 bp, Artificial Sequence
  Description of Artificial Sequence: Synthetic oligonucleotide
tggccggtttgttaatcagatgggacagtatgc

SEQ ID NO: 193749 - DNA, 32 bp, Artificial Sequence
  Description of Artificial Sequence: Synthetic oligonucleotide
ggccggtttgttaatcagatgggacagtatgc

SEQ ID NO: 193750 - DNA, 32 bp, Artificial Sequence
  Description of Artificial Sequence: Synthetic oligonucleotide
gccggtttgttaatcagatgggacagtatgcc

SEQ ID NO: 193751 - DNA, 33 bp, Artificial Sequence
  Description of Artificial Sequence: Synthetic oligonucleotide
ccggtttgttaatcagatgggacagtatgccac

SEQ ID NO: 193752 - DNA, 33 bp, Artificial Sequence
  Description of Artificial Sequence: Synthetic oligonucleotide
cggtttgttaatcagatgggacagtatgccacg

SEQ ID NO: 193753 - DNA, 33 bp, Artificial Sequence
  Description of Artificial Sequence: Synthetic oligonucleotide
ggtttgttaatcagatgggacagtatgccacgc

SEQ ID NO: 193754 - DNA, 34 bp, Artificial Sequence
  Description of Artificial Sequence: Synthetic oligonucleotide
gtttgttaatcagatgggacagtatgccacgctg

SEQ ID NO: 193755 - DNA, 34 bp, Artificial Sequence
  Description of Artificial Sequence: Synthetic oligonucleotide
tttgttaatcagatgggacagtatgccacgctgc

SEQ ID NO: 193756 - DNA, 33 bp, Artificial Sequence
  Description of Artificial Sequence: Synthetic oligonucleotide
ttgttaatcagatgggacagtatgccacgctgc

SEQ ID NO: 193757 - DNA, 32 bp, Artificial Sequence
  Description of Artificial Sequence: Synthetic oligonucleotide
tgttaatcagatgggacagtatgccacgctgc

SEQ ID NO: 193758 - DNA, 31 bp, Artificial Sequence
  Description of Artificial Sequence: Synthetic oligonucleotide
gttaatcagatgggacagtatgccacgctgc

SEQ ID NO: 193759 - DNA, 32 bp, Artificial Sequence
  Description of Artificial Sequence: Synthetic oligonucleotide
ttaatcagatgggacagtatgccacgctgctg

SEQ ID NO: 193760 - DNA, 25 bp, Artificial Sequence
  Description of Artificial Sequence: Synthetic oligonucleotide
cagaagtggacagccgcacgccgta

SEQ ID NO: 193761 - DNA, 25 bp, Artificial Sequence
  Description of Artificial Sequence: Synthetic oligonucleotide
agaagtggacagccgcacgccgtag

SEQ ID NO: 193762 - DNA, 24 bp, Artificial Sequence
  Description of Artificial Sequence: Synthetic oligonucleotide
gaagtggacagccgcacgccgtag

SEQ ID NO: 193763 - DNA, 24 bp, Artificial Sequence
  Description of Artificial Sequence: Synthetic oligonucleotide
aagtggacagccgcacgccgtagc

SEQ ID NO: 193764 - DNA, 23 bp, Artificial Sequence
  Description of Artificial Sequence: Synthetic oligonucleotide
agtggacagccgcacgccgtagc

SEQ ID NO: 193765 - DNA, 22 bp, Artificial Sequence
  Description of Artificial Sequence: Synthetic oligonucleotide
gtggacagccgcacgccgtagc

SEQ ID NO: 193766 - DNA, 22 bp, Artificial Sequence
  Description of Artificial Sequence: Synthetic oligonucleotide
tggacagccgcacgccgtagcg

SEQ ID NO: 193767 - DNA, 21 bp, Artificial Sequence
  Description of Artificial Sequence: Synthetic oligonucleotide
ggacagccgcacgccgtagcg

SEQ ID NO: 193768 - DNA, 21 bp, Artificial Sequence
  Description of Artificial Sequence: Synthetic oligonucleotide
gacagccgcacgccgtagcgg

SEQ ID NO: 193769 - DNA, 22 bp, Artificial Sequence
  Description of Artificial Sequence: Synthetic oligonucleotide
acagccgcacgccgtagcggga

SEQ ID NO: 193770 - DNA, 21 bp, Artificial Sequence
  Description of Artificial Sequence: Synthetic oligonucleotide
cagccgcacgccgtagcggga

SEQ ID NO: 193771 - DNA, 21 bp, Artificial Sequence
  Description of Artificial Sequence: Synthetic oligonucleotide
agccgcacgccgtagcgggag

SEQ ID NO: 193772 - DNA, 20 bp, Artificial Sequence
  Description of Artificial Sequence: Synthetic oligonucleotide
gccgcacgccgtagcgggag

SEQ ID NO: 193773 - DNA, 21 bp, Artificial Sequence
  Description of Artificial Sequence: Synthetic oligonucleotide
ccgcacgccgtagcgggagct

SEQ ID NO: 193774 - DNA, 21 bp, Artificial Sequence
  Description of Artificial Sequence: Synthetic oligonucleotide
cgcacgccgtagcgggagctg

SEQ ID NO: 193775 - DNA, 22 bp, Artificial Sequence
  Description of Artificial Sequence: Synthetic oligonucleotide
gcacgccgtagcgggagctgca

SEQ ID NO: 193776 - DNA, 22 bp, Artificial Sequence
  Description of Artificial Sequence: Synthetic oligonucleotide
cacgccgtagcgggagctgcag

SEQ ID NO: 193777 - DNA, 24 bp, Artificial Sequence
  Description of Artificial Sequence: Synthetic oligonucleotide
acgccgtagcgggagctgcagctt

SEQ ID NO: 193778 - DNA, 23 bp, Artificial Sequence
  Description of Artificial Sequence: Synthetic oligonucleotide
cgccgtagcgggagctgcagctt

SEQ ID NO: 193779 - DNA, 24 bp, Artificial Sequence
  Description of Artificial Sequence: Synthetic oligonucleotide
gccgtagcgggagctgcagcttca

SEQ ID NO: 193780 - DNA, 24 bp, Artificial Sequence
  Description of Artificial Sequence: Synthetic oligonucleotide
ccgtagcgggagctgcagcttcac

SEQ ID NO: 193781 - DNA, 25 bp, Artificial Sequence
  Description of Artificial Sequence: Synthetic oligonucleotide
cgtagcgggagctgcagcttcacga

SEQ ID NO: 193782 - DNA, 26 bp, Artificial Sequence
  Description of Artificial Sequence: Synthetic oligonucleotide
gtagcgggagctgcagcttcacgact

SEQ ID NO: 193783 - DNA, 26 bp, Artificial Sequence
  Description of Artificial Sequence: Synthetic oligonucleotide
tagcgggagctgcagcttcacgactg

SEQ ID NO: 193784 - DNA, 25 bp, Artificial Sequence
  Description of Artificial Sequence: Synthetic oligonucleotide
agcgggagctgcagcttcacgactg

SEQ ID NO: 193785 - DNA, 30 bp, Artificial Sequence
  Description of Artificial Sequence: Synthetic oligonucleotide
gcggacttgagagatcctttcctgaagcac

SEQ ID NO: 193786 - DNA, 31 bp, Artificial Sequence
  Description of Artificial Sequence: Synthetic oligonucleotide
cggacttgagagatcctttcctgaagcactc

SEQ ID NO: 193787 - DNA, 32 bp, Artificial Sequence
  Description of Artificial Sequence: Synthetic oligonucleotide
ggacttgagagatcctttcctgaagcactctg

SEQ ID NO: 193788 - DNA, 32 bp, Artificial Sequence
  Description of Artificial Sequence: Synthetic oligonucleotide
gacttgagagatcctttcctgaagcactctgg

SEQ ID NO: 193789 - DNA, 32 bp, Artificial Sequence
  Description of Artificial Sequence: Synthetic oligonucleotide
acttgagagatcctttcctgaagcactctggc

SEQ ID NO: 193790 - DNA, 31 bp, Artificial Sequence
  Description of Artificial Sequence: Synthetic oligonucleotide
cttgagagatcctttcctgaagcactctggc

SEQ ID NO: 193791 - DNA, 33 bp, Artificial Sequence
  Description of Artificial Sequence: Synthetic oligonucleotide
ttgagagatcctttcctgaagcactctggcttc

SEQ ID NO: 193792 - DNA, 32 bp, Artificial Sequence
  Description of Artificial Sequence: Synthetic oligonucleotide
tgagagatcctttcctgaagcactctggcttc

SEQ ID NO: 193793 - DNA, 31 bp, Artificial Sequence
  Description of Artificial Sequence: Synthetic oligonucleotide
gagagatcctttcctgaagcactctggcttc

SEQ ID NO: 193794 - DNA, 31 bp, Artificial Sequence
  Description of Artificial Sequence: Synthetic oligonucleotide
agagatcctttcctgaagcactctggcttcc

SEQ ID NO: 193795 - DNA, 30 bp, Artificial Sequence
  Description of Artificial Sequence: Synthetic oligonucleotide
gagatcctttcctgaagcactctggcttcc

SEQ ID NO: 193796 - DNA, 30 bp, Artificial Sequence
  Description of Artificial Sequence: Synthetic oligonucleotide
agatcctttcctgaagcactctggcttccc

SEQ ID NO: 193797 - DNA, 29 bp, Artificial Sequence
  Description of Artificial Sequence: Synthetic oligonucleotide
gatcctttcctgaagcactctggcttccc

SEQ ID NO: 193798 - DNA, 29 bp, Artificial Sequence
  Description of Artificial Sequence: Synthetic oligonucleotide
atcctttcctgaagcactctggcttcccc

SEQ ID NO: 193799 - DNA, 28 bp, Artificial Sequence
  Description of Artificial Sequence: Synthetic oligonucleotide
tcctttcctgaagcactctggcttcccc

SEQ ID NO: 193800 - DNA, 27 bp, Artificial Sequence
  Description of Artificial Sequence: Synthetic oligonucleotide
cctttcctgaagcactctggcttcccc

SEQ ID NO: 193801 - DNA, 28 bp, Artificial Sequence
  Description of Artificial Sequence: Synthetic oligonucleotide
ctttcctgaagcactctggcttcccctg

SEQ ID NO: 193802 - DNA, 28 bp, Artificial Sequence
  Description of Artificial Sequence: Synthetic oligonucleotide
tttcctgaagcactctggcttcccctgc

SEQ ID NO: 193803 - DNA, 27 bp, Artificial Sequence
  Description of Artificial Sequence: Synthetic oligonucleotide
ttcctgaagcactctggcttcccctgc

SEQ ID NO: 193804 - DNA, 27 bp, Artificial Sequence
  Description of Artificial Sequence: Synthetic oligonucleotide
tcctgaagcactctggcttcccctgct

SEQ ID NO: 193805 - DNA, 26 bp, Artificial Sequence
  Description of Artificial Sequence: Synthetic oligonucleotide
cctgaagcactctggcttcccctgct

SEQ ID NO: 193806 - DNA, 27 bp, Artificial Sequence
  Description of Artificial Sequence: Synthetic oligonucleotide
ctgaagcactctggcttcccctgctct

SEQ ID NO: 193807 - DNA, 28 bp, Artificial Sequence
  Description of Artificial Sequence: Synthetic oligonucleotide
tgaagcactctggcttcccctgctcttg

SEQ ID NO: 193808 - DNA, 27 bp, Artificial Sequence
  Description of Artificial Sequence: Synthetic oligonucleotide
gaagcactctggcttcccctgctcttg

SEQ ID NO: 193809 - DNA, 27 bp, Artificial Sequence
  Description of Artificial Sequence: Synthetic oligonucleotide
aagcactctggcttcccctgctcttgg

SEQ ID NO: 193810 - DNA, 27 bp, Artificial Sequence
  Description of Artificial Sequence: Synthetic oligonucleotide
agcactctggcttcccctgctcttgga

SEQ ID NO: 193811 - DNA, 26 bp, Artificial Sequence
  Description of Artificial Sequence: Synthetic oligonucleotide
gcactctggcttcccctgctcttgga

SEQ ID NO: 193812 - DNA, 27 bp, Artificial Sequence
  Description of Artificial Sequence: Synthetic oligonucleotide
cactctggcttcccctgctcttggact

SEQ ID NO: 193813 - DNA, 29 bp, Artificial Sequence
  Description of Artificial Sequence: Synthetic oligonucleotide
actctggcttcccctgctcttggactttc

SEQ ID NO: 193814 - DNA, 33 bp, Artificial Sequence
  Description of Artificial Sequence: Synthetic oligonucleotide
tcttggactttcttccaccatctccgggaatag

SEQ ID NO: 193815 - DNA, 32 bp, Artificial Sequence
  Description of Artificial Sequence: Synthetic oligonucleotide
cttggactttcttccaccatctccgggaatag

SEQ ID NO: 193816 - DNA, 34 bp, Artificial Sequence
  Description of Artificial Sequence: Synthetic oligonucleotide
ttggactttcttccaccatctccgggaatagatc

SEQ ID NO: 193817 - DNA, 33 bp, Artificial Sequence
  Description of Artificial Sequence: Synthetic oligonucleotide
tggactttcttccaccatctccgggaatagatc

SEQ ID NO: 193818 - DNA, 32 bp, Artificial Sequence
  Description of Artificial Sequence: Synthetic oligonucleotide
ggactttcttccaccatctccgggaatagatc

SEQ ID NO: 193819 - DNA, 32 bp, Artificial Sequence
  Description of Artificial Sequence: Synthetic oligonucleotide
gactttcttccaccatctccgggaatagatcc

SEQ ID NO: 193820 - DNA, 32 bp, Artificial Sequence
  Description of Artificial Sequence: Synthetic oligonucleotide
actttcttccaccatctccgggaatagatccg

SEQ ID NO: 193821 - DNA, 31 bp, Artificial Sequence
  Description of Artificial Sequence: Synthetic oligonucleotide
ctttcttccaccatctccgggaatagatccg

SEQ ID NO: 193822 - DNA, 31 bp, Artificial Sequence
  Description of Artificial Sequence: Synthetic oligonucleotide
tttcttccaccatctccgggaatagatccgc

SEQ ID NO: 193823 - DNA, 30 bp, Artificial Sequence
  Description of Artificial Sequence: Synthetic oligonucleotide
ttcttccaccatctccgggaatagatccgc

SEQ ID NO: 193824 - DNA, 29 bp, Artificial Sequence
  Description of Artificial Sequence: Synthetic oligonucleotide
tcttccaccatctccgggaatagatccgc

SEQ ID NO: 193825 - DNA, 28 bp, Artificial Sequence
  Description of Artificial Sequence: Synthetic oligonucleotide
cttccaccatctccgggaatagatccgc

SEQ ID NO: 193826 - DNA, 29 bp, Artificial Sequence
  Description of Artificial Sequence: Synthetic oligonucleotide
ttccaccatctccgggaatagatccgcag

SEQ ID NO: 193827 - DNA, 28 bp, Artificial Sequence
  Description of Artificial Sequence: Synthetic oligonucleotide
tccaccatctccgggaatagatccgcag

SEQ ID NO: 193828 - DNA, 27 bp, Artificial Sequence
  Description of Artificial Sequence: Synthetic oligonucleotide
ccaccatctccgggaatagatccgcag

SEQ ID NO: 193829 - DNA, 28 bp, Artificial Sequence
  Description of Artificial Sequence: Synthetic oligonucleotide
caccatctccgggaatagatccgcagag

SEQ ID NO: 193830 - DNA, 29 bp, Artificial Sequence
  Description of Artificial Sequence: Synthetic oligonucleotide
accatctccgggaatagatccgcagagag

SEQ ID NO: 193831 - DNA, 28 bp, Artificial Sequence
  Description of Artificial Sequence: Synthetic oligonucleotide
ccatctccgggaatagatccgcagagag

SEQ ID NO: 193832 - DNA, 30 bp, Artificial Sequence
  Description of Artificial Sequence: Synthetic oligonucleotide
catctccgggaatagatccgcagagagttc

SEQ ID NO: 193833 - DNA, 31 bp, Artificial Sequence
  Description of Artificial Sequence: Synthetic oligonucleotide
atctccgggaatagatccgcagagagttcac

SEQ ID NO: 193834 - DNA, 30 bp, Artificial Sequence
  Description of Artificial Sequence: Synthetic oligonucleotide
tctccgggaatagatccgcagagagttcac

SEQ ID NO: 193835 - DNA, 29 bp, Artificial Sequence
  Description of Artificial Sequence: Synthetic oligonucleotide
ctccgggaatagatccgcagagagttcac

SEQ ID NO: 193836 - DNA, 29 bp, Artificial Sequence
  Description of Artificial Sequence: Synthetic oligonucleotide
tccgggaatagatccgcagagagttcacc

SEQ ID NO: 193837 - DNA, 28 bp, Artificial Sequence
  Description of Artificial Sequence: Synthetic oligonucleotide
ccgggaatagatccgcagagagttcacc

SEQ ID NO: 193838 - DNA, 28 bp, Artificial Sequence
  Description of Artificial Sequence: Synthetic oligonucleotide
cgggaatagatccgcagagagttcaccc

SEQ ID NO: 193839 - DNA, 29 bp, Artificial Sequence
  Description of Artificial Sequence: Synthetic oligonucleotide
gggaatagatccgcagagagttcaccctg

SEQ ID NO: 193840 - DNA, 29 bp, Artificial Sequence
  Description of Artificial Sequence: Synthetic oligonucleotide
ggaatagatccgcagagagttcaccctgc

SEQ ID NO: 193841 - DNA, 30 bp, Artificial Sequence
  Description of Artificial Sequence: Synthetic oligonucleotide
gaatagatccgcagagagttcaccctgcac

SEQ ID NO: 193842 - DNA, 30 bp, Artificial Sequence
  Description of Artificial Sequence: Synthetic oligonucleotide
aatagatccgcagagagttcaccctgcacg

SEQ ID NO: 193843 - DNA, 29 bp, Artificial Sequence
  Description of Artificial Sequence: Synthetic oligonucleotide
atagatccgcagagagttcaccctgcacg

SEQ ID NO: 193844 - DNA, 28 bp, Artificial Sequence
  Description of Artificial Sequence: Synthetic oligonucleotide
tagatccgcagagagttcaccctgcacg

SEQ ID NO: 193845 - DNA, 29 bp, Artificial Sequence
  Description of Artificial Sequence: Synthetic oligonucleotide
cagacttgtctccactctggacattggcg

SEQ ID NO: 193846 - DNA, 31 bp, Artificial Sequence
  Description of Artificial Sequence: Synthetic oligonucleotide
agacttgtctccactctggacattggcgaag

SEQ ID NO: 193847 - DNA, 30 bp, Artificial Sequence
  Description of Artificial Sequence: Synthetic oligonucleotide
gacttgtctccactctggacattggcgaag

SEQ ID NO: 193848 - DNA, 30 bp, Artificial Sequence
  Description of Artificial Sequence: Synthetic oligonucleotide
acttgtctccactctggacattggcgaagc

SEQ ID NO: 193849 - DNA, 29 bp, Artificial Sequence
  Description of Artificial Sequence: Synthetic oligonucleotide
cttgtctccactctggacattggcgaagc

SEQ ID NO: 193850 - DNA, 29 bp, Artificial Sequence
  Description of Artificial Sequence: Synthetic oligonucleotide
ttgtctccactctggacattggcgaagcc

SEQ ID NO: 193851 - DNA, 28 bp, Artificial Sequence
  Description of Artificial Sequence: Synthetic oligonucleotide
tgtctccactctggacattggcgaagcc

SEQ ID NO: 193852 - DNA, 27 bp, Artificial Sequence
  Description of Artificial Sequence: Synthetic oligonucleotide
gtctccactctggacattggcgaagcc

SEQ ID NO: 193853 - DNA, 29 bp, Artificial Sequence
  Description of Artificial Sequence: Synthetic oligonucleotide
tctccactctggacattggcgaagccttg

SEQ ID NO: 193854 - DNA, 28 bp, Artificial Sequence
  Description of Artificial Sequence: Synthetic oligonucleotide
ctccactctggacattggcgaagccttg

SEQ ID NO: 193855 - DNA, 26 bp, Artificial Sequence
  Description of Artificial Sequence: Synthetic oligonucleotide
cacgaccaccttcgggaagaggcgta

SEQ ID NO: 193856 - DNA, 27 bp, Artificial Sequence
  Description of Artificial Sequence: Synthetic oligonucleotide
acgaccaccttcgggaagaggcgtaga

SEQ ID NO: 193857 - DNA, 26 bp, Artificial Sequence
  Description of Artificial Sequence: Synthetic oligonucleotide
cgaccaccttcgggaagaggcgtaga

SEQ ID NO: 193858 - DNA, 27 bp, Artificial Sequence
  Description of Artificial Sequence: Synthetic oligonucleotide
gaccaccttcgggaagaggcgtagagt

SEQ ID NO: 193859 - DNA, 27 bp, Artificial Sequence
  Description of Artificial Sequence: Synthetic oligonucleotide
accaccttcgggaagaggcgtagagtg

SEQ ID NO: 193860 - DNA, 27 bp, Artificial Sequence
  Description of Artificial Sequence: Synthetic oligonucleotide
ccaccttcgggaagaggcgtagagtgt

SEQ ID NO: 193861 - DNA, 27 bp, Artificial Sequence
  Description of Artificial Sequence: Synthetic oligonucleotide
caccttcgggaagaggcgtagagtgtg

SEQ ID NO: 193862 - DNA, 27 bp, Artificial Sequence
  Description of Artificial Sequence: Synthetic oligonucleotide
accttcgggaagaggcgtagagtgtgc

SEQ ID NO: 193863 - DNA, 27 bp, Artificial Sequence
  Description of Artificial Sequence: Synthetic oligonucleotide
ccttcgggaagaggcgtagagtgtgct

SEQ ID NO: 193864 - DNA, 27 bp, Artificial Sequence
  Description of Artificial Sequence: Synthetic oligonucleotide
cttcgggaagaggcgtagagtgtgctg

SEQ ID NO: 193865 - DNA, 27 bp, Artificial Sequence
  Description of Artificial Sequence: Synthetic oligonucleotide
ttcgggaagaggcgtagagtgtgctgg

SEQ ID NO: 193866 - DNA, 26 bp, Artificial Sequence
  Description of Artificial Sequence: Synthetic oligonucleotide
tcgggaagaggcgtagagtgtgctgg

SEQ ID NO: 193867 - DNA, 25 bp, Artificial Sequence
  Description of Artificial Sequence: Synthetic oligonucleotide
cgggaagaggcgtagagtgtgctgg

SEQ ID NO: 193868 - DNA, 26 bp, Artificial Sequence
  Description of Artificial Sequence: Synthetic oligonucleotide
gggaagaggcgtagagtgtgctgggt

SEQ ID NO: 193869 - DNA, 27 bp, Artificial Sequence
  Description of Artificial Sequence: Synthetic oligonucleotide
ggaagaggcgtagagtgtgctgggtca

SEQ ID NO: 193870 - DNA, 27 bp, Artificial Sequence
  Description of Artificial Sequence: Synthetic oligonucleotide
gaagaggcgtagagtgtgctgggtcag

SEQ ID NO: 193871 - DNA, 27 bp, Artificial Sequence
  Description of Artificial Sequence: Synthetic oligonucleotide
aagaggcgtagagtgtgctgggtcagc

SEQ ID NO: 193872 - DNA, 27 bp, Artificial Sequence
  Description of Artificial Sequence: Synthetic oligonucleotide
agaggcgtagagtgtgctgggtcagct

SEQ ID NO: 193873 - DNA, 26 bp, Artificial Sequence
  Description of Artificial Sequence: Synthetic oligonucleotide
gaggcgtagagtgtgctgggtcagct

SEQ ID NO: 193874 - DNA, 26 bp, Artificial Sequence
  Description of Artificial Sequence: Synthetic oligonucleotide
aggcgtagagtgtgctgggtcagctc

SEQ ID NO: 193875 - DNA, 25 bp, Artificial Sequence
  Description of Artificial Sequence: Synthetic oligonucleotide
ggcgtagagtgtgctgggtcagctc

SEQ ID NO: 193876 - DNA, 25 bp, Artificial Sequence
  Description of Artificial Sequence: Synthetic oligonucleotide
gcgtagagtgtgctgggtcagctcc

SEQ ID NO: 193877 - DNA, 25 bp, Artificial Sequence
  Description of Artificial Sequence: Synthetic oligonucleotide
cgtagagtgtgctgggtcagctccg

SEQ ID NO: 193878 - DNA, 25 bp, Artificial Sequence
  Description of Artificial Sequence: Synthetic oligonucleotide
gtagagtgtgctgggtcagctccgc

SEQ ID NO: 193879 - DNA, 26 bp, Artificial Sequence
  Description of Artificial Sequence: Synthetic oligonucleotide
tagagtgtgctgggtcagctccgcct

SEQ ID NO: 193880 - DNA, 25 bp, Artificial Sequence
  Description of Artificial Sequence: Synthetic oligonucleotide
acctttgtcggcgtccacgtgcgct

SEQ ID NO: 193881 - DNA, 24 bp, Artificial Sequence
  Description of Artificial Sequence: Synthetic oligonucleotide
cctttgtcggcgtccacgtgcgct

SEQ ID NO: 193882 - DNA, 25 bp, Artificial Sequence
  Description of Artificial Sequence: Synthetic oligonucleotide
ctttgtcggcgtccacgtgcgctgt

SEQ ID NO: 193883 - DNA, 25 bp, Artificial Sequence
  Description of Artificial Sequence: Synthetic oligonucleotide
tttgtcggcgtccacgtgcgctgtg

SEQ ID NO: 193884 - DNA, 24 bp, Artificial Sequence
  Description of Artificial Sequence: Synthetic oligonucleotide
ttgtcggcgtccacgtgcgctgtg

SEQ ID NO: 193885 - DNA, 23 bp, Artificial Sequence
  Description of Artificial Sequence: Synthetic oligonucleotide
tgtcggcgtccacgtgcgctgtg

SEQ ID NO: 193886 - DNA, 22 bp, Artificial Sequence
  Description of Artificial Sequence: Synthetic oligonucleotide
gtcggcgtccacgtgcgctgtg

SEQ ID NO: 193887 - DNA, 22 bp, Artificial Sequence
  Description of Artificial Sequence: Synthetic oligonucleotide
tcggcgtccacgtgcgctgtgg

SEQ ID NO: 193888 - DNA, 21 bp, Artificial Sequence
  Description of Artificial Sequence: Synthetic oligonucleotide
cggcgtccacgtgcgctgtgg

SEQ ID NO: 193889 - DNA, 21 bp, Artificial Sequence
  Description of Artificial Sequence: Synthetic oligonucleotide
ggcgtccacgtgcgctgtggg

SEQ ID NO: 193890 - DNA, 22 bp, Artificial Sequence
  Description of Artificial Sequence: Synthetic oligonucleotide
gcgtccacgtgcgctgtgggga

SEQ ID NO: 193891 - DNA, 25 bp, Artificial Sequence
  Description of Artificial Sequence: Synthetic oligonucleotide
cgtccacgtgcgctgtggggactat

SEQ ID NO: 193892 - DNA, 26 bp, Artificial Sequence
  Description of Artificial Sequence: Synthetic oligonucleotide
gtccacgtgcgctgtggggactatct

SEQ ID NO: 193893 - DNA, 26 bp, Artificial Sequence
  Description of Artificial Sequence: Synthetic oligonucleotide
tccacgtgcgctgtggggactatctg

SEQ ID NO: 193894 - DNA, 25 bp, Artificial Sequence
  Description of Artificial Sequence: Synthetic oligonucleotide
ccacgtgcgctgtggggactatctg

SEQ ID NO: 193895 - DNA, 26 bp, Artificial Sequence
  Description of Artificial Sequence: Synthetic oligonucleotide
cacgtgcgctgtggggactatctgca

SEQ ID NO: 193896 - DNA, 26 bp, Artificial Sequence
  Description of Artificial Sequence: Synthetic oligonucleotide
acgtgcgctgtggggactatctgcag

SEQ ID NO: 193897 - DNA, 25 bp, Artificial Sequence
  Description of Artificial Sequence: Synthetic oligonucleotide
cgtgcgctgtggggactatctgcag

SEQ ID NO: 193898 - DNA, 27 bp, Artificial Sequence
  Description of Artificial Sequence: Synthetic oligonucleotide
gtgcgctgtggggactatctgcaggtt

SEQ ID NO: 193899 - DNA, 29 bp, Artificial Sequence
  Description of Artificial Sequence: Synthetic oligonucleotide
tgcgctgtggggactatctgcaggttatg

SEQ ID NO: 193900 - DNA, 28 bp, Artificial Sequence
  Description of Artificial Sequence: Synthetic oligonucleotide
gcgctgtggggactatctgcaggttatg

SEQ ID NO: 193901 - DNA, 28 bp, Artificial Sequence
  Description of Artificial Sequence: Synthetic oligonucleotide
cgctgtggggactatctgcaggttatgc

SEQ ID NO: 193902 - DNA, 28 bp, Artificial Sequence
  Description of Artificial Sequence: Synthetic oligonucleotide
gctgtggggactatctgcaggttatgcc

SEQ ID NO: 193903 - DNA, 29 bp, Artificial Sequence
  Description of Artificial Sequence: Synthetic oligonucleotide
ctgtggggactatctgcaggttatgcctc

SEQ ID NO: 193904 - DNA, 30 bp, Artificial Sequence
  Description of Artificial Sequence: Synthetic oligonucleotide
tgtggggactatctgcaggttatgcctcag

SEQ ID NO: 193905 - DNA, 26 bp, Artificial Sequence
  Description of Artificial Sequence: Synthetic oligonucleotide
tgcgccgtggggactatctgcaggtt

SEQ ID NO: 193906 - DNA, 25 bp, Artificial Sequence
  Description of Artificial Sequence: Synthetic oligonucleotide
gcgccgtggggactatctgcaggtt

SEQ ID NO: 193907 - DNA, 26 bp, Artificial Sequence
  Description of Artificial Sequence: Synthetic oligonucleotide
cgccgtggggactatctgcaggttgt

SEQ ID NO: 193908 - DNA, 26 bp, Artificial Sequence
  Description of Artificial Sequence: Synthetic oligonucleotide
gccgtggggactatctgcaggttgtg

SEQ ID NO: 193909 - DNA, 26 bp, Artificial Sequence
  Description of Artificial Sequence: Synthetic oligonucleotide
ccgtggggactatctgcaggttgtgc

SEQ ID NO: 193910 - DNA, 27 bp, Artificial Sequence
  Description of Artificial Sequence: Synthetic oligonucleotide
cgtggggactatctgcaggttgtgcct

SEQ ID NO: 193911 - DNA, 27 bp, Artificial Sequence
  Description of Artificial Sequence: Synthetic oligonucleotide
gtggggactatctgcaggttgtgcctc

SEQ ID NO: 193912 - DNA, 28 bp, Artificial Sequence
  Description of Artificial Sequence: Synthetic oligonucleotide
tggggactatctgcaggttgtgcctcag

SEQ ID NO: 193913 - DNA, 27 bp, Artificial Sequence
  Description of Artificial Sequence: Synthetic oligonucleotide
ggggactatctgcaggttgtgcctcag

SEQ ID NO: 193914 - DNA, 27 bp, Artificial Sequence
  Description of Artificial Sequence: Synthetic oligonucleotide
gggactatctgcaggttgtgcctcagc

SEQ ID NO: 193915 - DNA, 27 bp, Artificial Sequence
  Description of Artificial Sequence: Synthetic oligonucleotide
ggactatctgcaggttgtgcctcagcg

SEQ ID NO: 193916 - DNA, 27 bp, Artificial Sequence
  Description of Artificial Sequence: Synthetic oligonucleotide
gactatctgcaggttgtgcctcagcgc

SEQ ID NO: 193917 - DNA, 28 bp, Artificial Sequence
  Description of Artificial Sequence: Synthetic oligonucleotide
actatctgcaggttgtgcctcagcgctg

SEQ ID NO: 193918 - DNA, 27 bp, Artificial Sequence
  Description of Artificial Sequence: Synthetic oligonucleotide
ctatctgcaggttgtgcctcagcgctg

SEQ ID NO: 193919 - DNA, 27 bp, Artificial Sequence
  Description of Artificial Sequence: Synthetic oligonucleotide
tatctgcaggttgtgcctcagcgctgg

SEQ ID NO: 193920 - DNA, 27 bp, Artificial Sequence
  Description of Artificial Sequence: Synthetic oligonucleotide
atctgcaggttgtgcctcagcgctgga

SEQ ID NO: 193921 - DNA, 27 bp, Artificial Sequence
  Description of Artificial Sequence: Synthetic oligonucleotide
tctgcaggttgtgcctcagcgctggaa

SEQ ID NO: 193922 - DNA, 26 bp, Artificial Sequence
  Description of Artificial Sequence: Synthetic oligonucleotide
ctgcaggttgtgcctcagcgctggaa

SEQ ID NO: 193923 - DNA, 26 bp, Artificial Sequence
  Description of Artificial Sequence: Synthetic oligonucleotide
tgcaggttgtgcctcagcgctggaag

SEQ ID NO: 193924 - DNA, 25 bp, Artificial Sequence
  Description of Artificial Sequence: Synthetic oligonucleotide
gcaggttgtgcctcagcgctggaag

SEQ ID NO: 193925 - DNA, 25 bp, Artificial Sequence
  Description of Artificial Sequence: Synthetic oligonucleotide
caggttgtgcctcagcgctggaagg

SEQ ID NO: 193926 - DNA, 26 bp, Artificial Sequence
  Description of Artificial Sequence: Synthetic oligonucleotide
aggttgtgcctcagcgctggaagggt

SEQ ID NO: 193927 - DNA, 25 bp, Artificial Sequence
  Description of Artificial Sequence: Synthetic oligonucleotide
ggttgtgcctcagcgctggaagggt

SEQ ID NO: 193928 - DNA, 26 bp, Artificial Sequence
  Description of Artificial Sequence: Synthetic oligonucleotide
gttgtgcctcagcgctggaagggtgt

SEQ ID NO: 193929 - DNA, 26 bp, Artificial Sequence
  Description of Artificial Sequence: Synthetic oligonucleotide
ttgtgcctcagcgctggaagggtgtg

SEQ ID NO: 193930 - DNA, 25 bp, Artificial Sequence
  Description of Artificial Sequence: Synthetic oligonucleotide
tgtgcctcagcgctggaagggtgtg

SEQ ID NO: 193931 - DNA, 24 bp, Artificial Sequence
  Description of Artificial Sequence: Synthetic oligonucleotide
gtgcctcagcgctggaagggtgtg

SEQ ID NO: 193932 - DNA, 28 bp, Artificial Sequence
  Description of Artificial Sequence: Synthetic oligonucleotide
gtggggactatctgcaggttatgcctcc

SEQ ID NO: 193933 - DNA, 28 bp, Artificial Sequence
  Description of Artificial Sequence: Synthetic oligonucleotide
tggggactatctgcaggttatgcctccg

SEQ ID NO: 193934 - DNA, 27 bp, Artificial Sequence
  Description of Artificial Sequence: Synthetic oligonucleotide
ggggactatctgcaggttatgcctccg

SEQ ID NO: 193935 - DNA, 27 bp, Artificial Sequence
  Description of Artificial Sequence: Synthetic oligonucleotide
gggactatctgcaggttatgcctccgc

SEQ ID NO: 193936 - DNA, 27 bp, Artificial Sequence
  Description of Artificial Sequence: Synthetic oligonucleotide
ggactatctgcaggttatgcctccgcg

SEQ ID NO: 193937 - DNA, 27 bp, Artificial Sequence
  Description of Artificial Sequence: Synthetic oligonucleotide
gactatctgcaggttatgcctccgcgc

SEQ ID NO: 193938 - DNA, 28 bp, Artificial Sequence
  Description of Artificial Sequence: Synthetic oligonucleotide
actatctgcaggttatgcctccgcgctg

SEQ ID NO: 193939 - DNA, 27 bp, Artificial Sequence
  Description of Artificial Sequence: Synthetic oligonucleotide
ctatctgcaggttatgcctccgcgctg

SEQ ID NO: 193940 - DNA, 27 bp, Artificial Sequence
  Description of Artificial Sequence: Synthetic oligonucleotide
tatctgcaggttatgcctccgcgctgg

SEQ ID NO: 193941 - DNA, 27 bp, Artificial Sequence
  Description of Artificial Sequence: Synthetic oligonucleotide
atctgcaggttatgcctccgcgctgga

SEQ ID NO: 193942 - DNA, 27 bp, Artificial Sequence
  Description of Artificial Sequence: Synthetic oligonucleotide
tctgcaggttatgcctccgcgctggaa

SEQ ID NO: 193943 - DNA, 26 bp, Artificial Sequence
  Description of Artificial Sequence: Synthetic oligonucleotide
ctgcaggttatgcctccgcgctggaa

SEQ ID NO: 193944 - DNA, 26 bp, Artificial Sequence
  Description of Artificial Sequence: Synthetic oligonucleotide
tgcaggttatgcctccgcgctggaag

SEQ ID NO: 193945 - DNA, 25 bp, Artificial Sequence
  Description of Artificial Sequence: Synthetic oligonucleotide
gcaggttatgcctccgcgctggaag

SEQ ID NO: 193946 - DNA, 25 bp, Artificial Sequence
  Description of Artificial Sequence: Synthetic oligonucleotide
caggttatgcctccgcgctggaagg

SEQ ID NO: 193947 - DNA, 26 bp, Artificial Sequence
  Description of Artificial Sequence: Synthetic oligonucleotide
aggttatgcctccgcgctggaagggt

SEQ ID NO: 193948 - DNA, 25 bp, Artificial Sequence
  Description of Artificial Sequence: Synthetic oligonucleotide
ggttatgcctccgcgctggaagggt

SEQ ID NO: 193949 - DNA, 26 bp, Artificial Sequence
  Description of Artificial Sequence: Synthetic oligonucleotide
gttatgcctccgcgctggaagggtgt

SEQ ID NO: 193950 - DNA, 26 bp, Artificial Sequence
  Description of Artificial Sequence: Synthetic oligonucleotide
ttatgcctccgcgctggaagggtgtg

SEQ ID NO: 193951 - DNA, 25 bp, Artificial Sequence
  Description of Artificial Sequence: Synthetic oligonucleotide
tatgcctccgcgctggaagggtgtg

SEQ ID NO: 193952 - DNA, 24 bp, Artificial Sequence
  Description of Artificial Sequence: Synthetic oligonucleotide
atgcctccgcgctggaagggtgtg

SEQ ID NO: 193953 - DNA, 23 bp, Artificial Sequence
  Description of Artificial Sequence: Synthetic oligonucleotide
tgcctccgcgctggaagggtgtg

SEQ ID NO: 193954 - DNA, 22 bp, Artificial Sequence
  Description of Artificial Sequence: Synthetic oligonucleotide
gcctccgcgctggaagggtgtg

SEQ ID NO: 193955 - DNA, 23 bp, Artificial Sequence
  Description of Artificial Sequence: Synthetic oligonucleotide
cctccgcgctggaagggtgtggt

SEQ ID NO: 193956 - DNA, 23 bp, Artificial Sequence
  Description of Artificial Sequence: Synthetic oligonucleotide
ctccgcgctggaagggtgtggtg

SEQ ID NO: 193957 - DNA, 23 bp, Artificial Sequence
  Description of Artificial Sequence: Synthetic oligonucleotide
tccgcgctggaagggtgtggtgg

SEQ ID NO: 193958 - DNA, 22 bp, Artificial Sequence
  Description of Artificial Sequence: Synthetic oligonucleotide
ccgcgctggaagggtgtggtgg

SEQ ID NO: 193959 - DNA, 22 bp, Artificial Sequence
  Description of Artificial Sequence: Synthetic oligonucleotide
cgcgctggaagggtgtggtggg

SEQ ID NO: 193960 - DNA, 27 bp, Artificial Sequence
  Description of Artificial Sequence: Synthetic oligonucleotide
tggtcaccagcaacggcatggagtgct

SEQ ID NO: 193961 - DNA, 26 bp, Artificial Sequence
  Description of Artificial Sequence: Synthetic oligonucleotide
ggtcaccagcaacggcatggagtgct

SEQ ID NO: 193962 - DNA, 27 bp, Artificial Sequence
  Description of Artificial Sequence: Synthetic oligonucleotide
gtcaccagcaacggcatggagtgctgt

SEQ ID NO: 193963 - DNA, 30 bp, Artificial Sequence
  Description of Artificial Sequence: Synthetic oligonucleotide
tcaccagcaacggcatggagtgctgtaaag

SEQ ID NO: 193964 - DNA, 29 bp, Artificial Sequence
  Description of Artificial Sequence: Synthetic oligonucleotide
caccagcaacggcatggagtgctgtaaag

SEQ ID NO: 193965 - DNA, 33 bp, Artificial Sequence
  Description of Artificial Sequence: Synthetic oligonucleotide
accagcaacggcatggagtgctgtaaagaaaac

SEQ ID NO: 193966 - DNA, 32 bp, Artificial Sequence
  Description of Artificial Sequence: Synthetic oligonucleotide
ccagcaacggcatggagtgctgtaaagaaaac

SEQ ID NO: 193967 - DNA, 34 bp, Artificial Sequence
  Description of Artificial Sequence: Synthetic oligonucleotide
cagcaacggcatggagtgctgtaaagaaaacatc

SEQ ID NO: 193968 - DNA, 34 bp, Artificial Sequence
  Description of Artificial Sequence: Synthetic oligonucleotide
agcaacggcatggagtgctgtaaagaaaacatcg

SEQ ID NO: 193969 - DNA, 33 bp, Artificial Sequence
  Description of Artificial Sequence: Synthetic oligonucleotide
gcaacggcatggagtgctgtaaagaaaacatcg

SEQ ID NO: 193970 - DNA, 34 bp, Artificial Sequence
  Description of Artificial Sequence: Synthetic oligonucleotide
caacggcatggagtgctgtaaagaaaacatcgac

SEQ ID NO: 193971 - DNA, 35 bp, Artificial Sequence
  Description of Artificial Sequence: Synthetic oligonucleotide
aacggcatggagtgctgtaaagaaaacatcgacac

SEQ ID NO: 193972 - DNA, 34 bp, Artificial Sequence
  Description of Artificial Sequence: Synthetic oligonucleotide
acggcatggagtgctgtaaagaaaacatcgacac

SEQ ID NO: 193973 - DNA, 33 bp, Artificial Sequence
  Description of Artificial Sequence: Synthetic oligonucleotide
cggcatggagtgctgtaaagaaaacatcgacac

SEQ ID NO: 193974 - DNA, 33 bp, Artificial Sequence
  Description of Artificial Sequence: Synthetic oligonucleotide
ggcatggagtgctgtaaagaaaacatcgacacc

SEQ ID NO: 193975 - DNA, 34 bp, Artificial Sequence
  Description of Artificial Sequence: Synthetic oligonucleotide
gcatggagtgctgtaaagaaaacatcgacacctc

SEQ ID NO: 193976 - DNA, 34 bp, Artificial Sequence
  Description of Artificial Sequence: Synthetic oligonucleotide
catggagtgctgtaaagaaaacatcgacacctcc

SEQ ID NO: 193977 - DNA, 34 bp, Artificial Sequence
  Description of Artificial Sequence: Synthetic oligonucleotide
atggagtgctgtaaagaaaacatcgacacctccc

SEQ ID NO: 193978 - DNA, 33 bp, Artificial Sequence
  Description of Artificial Sequence: Synthetic oligonucleotide
tggagtgctgtaaagaaaacatcgacacctccc

SEQ ID NO: 193979 - DNA, 32 bp, Artificial Sequence
  Description of Artificial Sequence: Synthetic oligonucleotide
ggagtgctgtaaagaaaacatcgacacctccc

SEQ ID NO: 193980 - DNA, 33 bp, Artificial Sequence
  Description of Artificial Sequence: Synthetic oligonucleotide
gagtgctgtaaagaaaacatcgacacctcccag

SEQ ID NO: 193981 - DNA, 33 bp, Artificial Sequence
  Description of Artificial Sequence: Synthetic oligonucleotide
agtgctgtaaagaaaacatcgacacctcccagg

SEQ ID NO: 193982 - DNA, 32 bp, Artificial Sequence
  Description of Artificial Sequence: Synthetic oligonucleotide
gtgctgtaaagaaaacatcgacacctcccagg

SEQ ID NO: 193983 - DNA, 32 bp, Artificial Sequence
  Description of Artificial Sequence: Synthetic oligonucleotide
tgctgtaaagaaaacatcgacacctcccaggg

SEQ ID NO: 193984 - DNA, 31 bp, Artificial Sequence
  Description of Artificial Sequence: Synthetic oligonucleotide
gctgtaaagaaaacatcgacacctcccaggg

SEQ ID NO: 193985 - DNA, 31 bp, Artificial Sequence
  Description of Artificial Sequence: Synthetic oligonucleotide
ctgtaaagaaaacatcgacacctcccagggc

SEQ ID NO: 193986 - DNA, 27 bp, Artificial Sequence
  Description of Artificial Sequence: Synthetic oligonucleotide
gtggtcaccagcaacggcatggagtgt

SEQ ID NO: 193987 - DNA, 28 bp, Artificial Sequence
  Description of Artificial Sequence: Synthetic oligonucleotide
tggtcaccagcaacggcatggagtgttg

SEQ ID NO: 193988 - DNA, 27 bp, Artificial Sequence
  Description of Artificial Sequence: Synthetic oligonucleotide
ggtcaccagcaacggcatggagtgttg

SEQ ID NO: 193989 - DNA, 31 bp, Artificial Sequence
  Description of Artificial Sequence: Synthetic oligonucleotide
gtcaccagcaacggcatggagtgttgtaaag

SEQ ID NO: 193990 - DNA, 35 bp, Artificial Sequence
  Description of Artificial Sequence: Synthetic oligonucleotide
tcaccagcaacggcatggagtgttgtaaagaaaac

SEQ ID NO: 193991 - DNA, 34 bp, Artificial Sequence
  Description of Artificial Sequence: Synthetic oligonucleotide
caccagcaacggcatggagtgttgtaaagaaaac

SEQ ID NO: 193992 - DNA, 36 bp, Artificial Sequence
  Description of Artificial Sequence: Synthetic oligonucleotide
accagcaacggcatggagtgttgtaaagaaaacatc

SEQ ID NO: 193993 - DNA, 35 bp, Artificial Sequence
  Description of Artificial Sequence: Synthetic oligonucleotide
ccagcaacggcatggagtgttgtaaagaaaacatc

SEQ ID NO: 193994 - DNA, 35 bp, Artificial Sequence
  Description of Artificial Sequence: Synthetic oligonucleotide
cagcaacggcatggagtgttgtaaagaaaacatcg

SEQ ID NO: 193995 - DNA, 36 bp, Artificial Sequence
  Description of Artificial Sequence: Synthetic oligonucleotide
agcaacggcatggagtgttgtaaagaaaacatcgac

SEQ ID NO: 193996 - DNA, 35 bp, Artificial Sequence
  Description of Artificial Sequence: Synthetic oligonucleotide
gcaacggcatggagtgttgtaaagaaaacatcgac

SEQ ID NO: 193997 - DNA, 36 bp, Artificial Sequence
  Description of Artificial Sequence: Synthetic oligonucleotide
caacggcatggagtgttgtaaagaaaacatcgacac

SEQ ID NO: 193998 - DNA, 36 bp, Artificial Sequence
  Description of Artificial Sequence: Synthetic oligonucleotide
aacggcatggagtgttgtaaagaaaacatcgacacc

SEQ ID NO: 193999 - DNA, 35 bp, Artificial Sequence
  Description of Artificial Sequence: Synthetic oligonucleotide
acggcatggagtgttgtaaagaaaacatcgacacc

SEQ ID NO: 194000 - DNA, 34 bp, Artificial Sequence
  Description of Artificial Sequence: Synthetic oligonucleotide
cggcatggagtgttgtaaagaaaacatcgacacc

SEQ ID NO: 194001 - DNA, 35 bp, Artificial Sequence
  Description of Artificial Sequence: Synthetic oligonucleotide
ggcatggagtgttgtaaagaaaacatcgacacctc

SEQ ID NO: 194002 - DNA, 35 bp, Artificial Sequence
  Description of Artificial Sequence: Synthetic oligonucleotide
gcatggagtgttgtaaagaaaacatcgacacctcc

SEQ ID NO: 194003 - DNA, 35 bp, Artificial Sequence
  Description of Artificial Sequence: Synthetic oligonucleotide
catggagtgttgtaaagaaaacatcgacacctccc

SEQ ID NO: 194004 - DNA, 36 bp, Artificial Sequence
  Description of Artificial Sequence: Synthetic oligonucleotide
atggagtgttgtaaagaaaacatcgacacctcccag

SEQ ID NO: 194005 - DNA, 35 bp, Artificial Sequence
  Description of Artificial Sequence: Synthetic oligonucleotide
tggagtgttgtaaagaaaacatcgacacctcccag

SEQ ID NO: 194006 - DNA, 34 bp, Artificial Sequence
  Description of Artificial Sequence: Synthetic oligonucleotide
ggagtgttgtaaagaaaacatcgacacctcccag

SEQ ID NO: 194007 - DNA, 34 bp, Artificial Sequence
  Description of Artificial Sequence: Synthetic oligonucleotide
gagtgttgtaaagaaaacatcgacacctcccagg

SEQ ID NO: 194008 - DNA, 34 bp, Artificial Sequence
  Description of Artificial Sequence: Synthetic oligonucleotide
agtgttgtaaagaaaacatcgacacctcccaggg

SEQ ID NO: 194009 - DNA, 33 bp, Artificial Sequence
  Description of Artificial Sequence: Synthetic oligonucleotide
gtgttgtaaagaaaacatcgacacctcccaggg

SEQ ID NO: 194010 - DNA, 33 bp, Artificial Sequence
  Description of Artificial Sequence: Synthetic oligonucleotide
tgttgtaaagaaaacatcgacacctcccagggc

SEQ ID NO: 194011 - DNA, 32 bp, Artificial Sequence
  Description of Artificial Sequence: Synthetic oligonucleotide
gttgtaaagaaaacatcgacacctcccagggc

SEQ ID NO: 194012 - DNA, 32 bp, Artificial Sequence
  Description of Artificial Sequence: Synthetic oligonucleotide
ttgtaaagaaaacatcgacacctcccagggcg

SEQ ID NO: 194013 - DNA, 25 bp, Artificial Sequence
  Description of Artificial Sequence: Synthetic oligonucleotide
caccttcggcttctgggctgcctag

SEQ ID NO: 194014 - DNA, 26 bp, Artificial Sequence
  Description of Artificial Sequence: Synthetic oligonucleotide
accttcggcttctgggctgcctagct

SEQ ID NO: 194015 - DNA, 25 bp, Artificial Sequence
  Description of Artificial Sequence: Synthetic oligonucleotide
ccttcggcttctgggctgcctagct

SEQ ID NO: 194016 - DNA, 25 bp, Artificial Sequence
  Description of Artificial Sequence: Synthetic oligonucleotide
cttcggcttctgggctgcctagctg

SEQ ID NO: 194017 - DNA, 25 bp, Artificial Sequence
  Description of Artificial Sequence: Synthetic oligonucleotide
ttcggcttctgggctgcctagctgg

SEQ ID NO: 194018 - DNA, 24 bp, Artificial Sequence
  Description of Artificial Sequence: Synthetic oligonucleotide
tcggcttctgggctgcctagctgg

SEQ ID NO: 194019 - DNA, 23 bp, Artificial Sequence
  Description of Artificial Sequence: Synthetic oligonucleotide
cggcttctgggctgcctagctgg

SEQ ID NO: 194020 - DNA, 24 bp, Artificial Sequence
  Description of Artificial Sequence: Synthetic oligonucleotide
ggcttctgggctgcctagctggct

SEQ ID NO: 194021 - DNA, 24 bp, Artificial Sequence
  Description of Artificial Sequence: Synthetic oligonucleotide
gcttctgggctgcctagctggctg

SEQ ID NO: 194022 - DNA, 24 bp, Artificial Sequence
  Description of Artificial Sequence: Synthetic oligonucleotide
cttctgggctgcctagctggctgg

SEQ ID NO: 194023 - DNA, 24 bp, Artificial Sequence
  Description of Artificial Sequence: Synthetic oligonucleotide
ttctgggctgcctagctggctggc

SEQ ID NO: 194024 - DNA, 23 bp, Artificial Sequence
  Description of Artificial Sequence: Synthetic oligonucleotide
tctgggctgcctagctggctggc

SEQ ID NO: 194025 - DNA, 22 bp, Artificial Sequence
  Description of Artificial Sequence: Synthetic oligonucleotide
ctgggctgcctagctggctggc

SEQ ID NO: 194026 - DNA, 22 bp, Artificial Sequence
  Description of Artificial Sequence: Synthetic oligonucleotide
tgggctgcctagctggctggcg

SEQ ID NO: 194027 - DNA, 21 bp, Artificial Sequence
  Description of Artificial Sequence: Synthetic oligonucleotide
gggctgcctagctggctggcg

SEQ ID NO: 194028 - DNA, 22 bp, Artificial Sequence
  Description of Artificial Sequence: Synthetic oligonucleotide
ggctgcctagctggctggcgga

SEQ ID NO: 194029 - DNA, 23 bp, Artificial Sequence
  Description of Artificial Sequence: Synthetic oligonucleotide
gctgcctagctggctggcggaga

SEQ ID NO: 194030 - DNA, 24 bp, Artificial Sequence
  Description of Artificial Sequence: Synthetic oligonucleotide
ctgcctagctggctggcggagaca

SEQ ID NO: 194031 - DNA, 25 bp, Artificial Sequence
  Description of Artificial Sequence: Synthetic oligonucleotide
tgcctagctggctggcggagacact

SEQ ID NO: 194032 - DNA, 24 bp, Artificial Sequence
  Description of Artificial Sequence: Synthetic oligonucleotide
gcctagctggctggcggagacact

SEQ ID NO: 194033 - DNA, 25 bp, Artificial Sequence
  Description of Artificial Sequence: Synthetic oligonucleotide
cctagctggctggcggagacactgt

SEQ ID NO: 194034 - DNA, 27 bp, Artificial Sequence
  Description of Artificial Sequence: Synthetic oligonucleotide
ctagctggctggcggagacactgtcta

SEQ ID NO: 194035 - DNA, 27 bp, Artificial Sequence
  Description of Artificial Sequence: Synthetic oligonucleotide
tagctggctggcggagacactgtctac

SEQ ID NO: 194036 - DNA, 26 bp, Artificial Sequence
  Description of Artificial Sequence: Synthetic oligonucleotide
agctggctggcggagacactgtctac

SEQ ID NO: 194037 - DNA, 25 bp, Artificial Sequence
  Description of Artificial Sequence: Synthetic oligonucleotide
gctggctggcggagacactgtctac

SEQ ID NO: 194038 - DNA, 36 bp, Artificial Sequence
  Description of Artificial Sequence: Synthetic oligonucleotide
atggagtggtgtaaagaaaacatcgacacctcctag

SEQ ID NO: 194039 - DNA, 35 bp, Artificial Sequence
  Description of Artificial Sequence: Synthetic oligonucleotide
tggagtggtgtaaagaaaacatcgacacctcctag

SEQ ID NO: 194040 - DNA, 34 bp, Artificial Sequence
  Description of Artificial Sequence: Synthetic oligonucleotide
ggagtggtgtaaagaaaacatcgacacctcctag

SEQ ID NO: 194041 - DNA, 34 bp, Artificial Sequence
  Description of Artificial Sequence: Synthetic oligonucleotide
gagtggtgtaaagaaaacatcgacacctcctagg

SEQ ID NO: 194042 - DNA, 34 bp, Artificial Sequence
  Description of Artificial Sequence: Synthetic oligonucleotide
agtggtgtaaagaaaacatcgacacctcctaggg

SEQ ID NO: 194043 - DNA, 33 bp, Artificial Sequence
  Description of Artificial Sequence: Synthetic oligonucleotide
gtggtgtaaagaaaacatcgacacctcctaggg

SEQ ID NO: 194044 - DNA, 33 bp, Artificial Sequence
  Description of Artificial Sequence: Synthetic oligonucleotide
tggtgtaaagaaaacatcgacacctcctagggc

SEQ ID NO: 194045 - DNA, 32 bp, Artificial Sequence
  Description of Artificial Sequence: Synthetic oligonucleotide
ggtgtaaagaaaacatcgacacctcctagggc

SEQ ID NO: 194046 - DNA, 32 bp, Artificial Sequence
  Description of Artificial Sequence: Synthetic oligonucleotide
gtgtaaagaaaacatcgacacctcctagggcg

SEQ ID NO: 194047 - DNA, 34 bp, Artificial Sequence
  Description of Artificial Sequence: Synthetic oligonucleotide
tgtaaagaaaacatcgacacctcctagggcgatg

SEQ ID NO: 194048 - DNA, 33 bp, Artificial Sequence
  Description of Artificial Sequence: Synthetic oligonucleotide
gtaaagaaaacatcgacacctcctagggcgatg

SEQ ID NO: 194049 - DNA, 34 bp, Artificial Sequence
  Description of Artificial Sequence: Synthetic oligonucleotide
taaagaaaacatcgacacctcctagggcgatgtg

SEQ ID NO: 194050 - DNA, 33 bp, Artificial Sequence
  Description of Artificial Sequence: Synthetic oligonucleotide
aaagaaaacatcgacacctcctagggcgatgtg

SEQ ID NO: 194051 - DNA, 32 bp, Artificial Sequence
  Description of Artificial Sequence: Synthetic oligonucleotide
aagaaaacatcgacacctcctagggcgatgtg

SEQ ID NO: 194052 - DNA, 31 bp, Artificial Sequence
  Description of Artificial Sequence: Synthetic oligonucleotide
agaaaacatcgacacctcctagggcgatgtg

SEQ ID NO: 194053 - DNA, 30 bp, Artificial Sequence
  Description of Artificial Sequence: Synthetic oligonucleotide
gaaaacatcgacacctcctagggcgatgtg

SEQ ID NO: 194054 - DNA, 31 bp, Artificial Sequence
  Description of Artificial Sequence: Synthetic oligonucleotide
aaaacatcgacacctcctagggcgatgtgac

SEQ ID NO: 194055 - DNA, 30 bp, Artificial Sequence
  Description of Artificial Sequence: Synthetic oligonucleotide
aaacatcgacacctcctagggcgatgtgac

SEQ ID NO: 194056 - DNA, 29 bp, Artificial Sequence
  Description of Artificial Sequence: Synthetic oligonucleotide
aacatcgacacctcctagggcgatgtgac

SEQ ID NO: 194057 - DNA, 28 bp, Artificial Sequence
  Description of Artificial Sequence: Synthetic oligonucleotide
acatcgacacctcctagggcgatgtgac

SEQ ID NO: 194058 - DNA, 27 bp, Artificial Sequence
  Description of Artificial Sequence: Synthetic oligonucleotide
catcgacacctcctagggcgatgtgac

SEQ ID NO: 194059 - DNA, 27 bp, Artificial Sequence
  Description of Artificial Sequence: Synthetic oligonucleotide
atcgacacctcctagggcgatgtgacg

SEQ ID NO: 194060 - DNA, 27 bp, Artificial Sequence
  Description of Artificial Sequence: Synthetic oligonucleotide
tcgacacctcctagggcgatgtgacgt

SEQ ID NO: 194061 - DNA, 27 bp, Artificial Sequence
  Description of Artificial Sequence: Synthetic oligonucleotide
cgacacctcctagggcgatgtgacgtt

SEQ ID NO: 194062 - DNA, 28 bp, Artificial Sequence
  Description of Artificial Sequence: Synthetic oligonucleotide
gacacctcctagggcgatgtgacgtttg

SEQ ID NO: 194063 - DNA, 28 bp, Artificial Sequence
  Description of Artificial Sequence: Synthetic oligonucleotide
acacctcctagggcgatgtgacgtttgc

SEQ ID NO: 194064 - DNA, 27 bp, Artificial Sequence
  Description of Artificial Sequence: Synthetic oligonucleotide
cacctcctagggcgatgtgacgtttgc

SEQ ID NO: 194065 - DNA, 28 bp, Artificial Sequence
  Description of Artificial Sequence: Synthetic oligonucleotide
acctcctagggcgatgtgacgtttgctg

SEQ ID NO: 194066 - DNA, 27 bp, Artificial Sequence
  Description of Artificial Sequence: Synthetic oligonucleotide
cctcctagggcgatgtgacgtttgctg

SEQ ID NO: 194067 - DNA, 27 bp, Artificial Sequence
  Description of Artificial Sequence: Synthetic oligonucleotide
ctcctagggcgatgtgacgtttgctgg

SEQ ID NO: 194068 - DNA, 27 bp, Artificial Sequence
  Description of Artificial Sequence: Synthetic oligonucleotide
tcctagggcgatgtgacgtttgctggc

SEQ ID NO: 194069 - DNA, 26 bp, Artificial Sequence
  Description of Artificial Sequence: Synthetic oligonucleotide
cctagggcgatgtgacgtttgctggc

SEQ ID NO: 194070 - DNA, 27 bp, Artificial Sequence
  Description of Artificial Sequence: Synthetic oligonucleotide
ctagggcgatgtgacgtttgctggcga

SEQ ID NO: 194071 - DNA, 28 bp, Artificial Sequence
  Description of Artificial Sequence: Synthetic oligonucleotide
tagggcgatgtgacgtttgctggcgatg

SEQ ID NO: 194072 - DNA, 34 bp, Artificial Sequence
  Description of Artificial Sequence: Synthetic oligonucleotide
tgtaaagaaaacatcgacacctcccagggcaatg

SEQ ID NO: 194073 - DNA, 33 bp, Artificial Sequence
  Description of Artificial Sequence: Synthetic oligonucleotide
gtaaagaaaacatcgacacctcccagggcaatg

SEQ ID NO: 194074 - DNA, 34 bp, Artificial Sequence
  Description of Artificial Sequence: Synthetic oligonucleotide
taaagaaaacatcgacacctcccagggcaatgtg

SEQ ID NO: 194075 - DNA, 33 bp, Artificial Sequence
  Description of Artificial Sequence: Synthetic oligonucleotide
aaagaaaacatcgacacctcccagggcaatgtg

SEQ ID NO: 194076 - DNA, 32 bp, Artificial Sequence
  Description of Artificial Sequence: Synthetic oligonucleotide
aagaaaacatcgacacctcccagggcaatgtg

SEQ ID NO: 194077 - DNA, 31 bp, Artificial Sequence
  Description of Artificial Sequence: Synthetic oligonucleotide
agaaaacatcgacacctcccagggcaatgtg

SEQ ID NO: 194078 - DNA, 30 bp, Artificial Sequence
  Description of Artificial Sequence: Synthetic oligonucleotide
gaaaacatcgacacctcccagggcaatgtg

SEQ ID NO: 194079 - DNA, 31 bp, Artificial Sequence
  Description of Artificial Sequence: Synthetic oligonucleotide
aaaacatcgacacctcccagggcaatgtgac

SEQ ID NO: 194080 - DNA, 30 bp, Artificial Sequence
  Description of Artificial Sequence: Synthetic oligonucleotide
aaacatcgacacctcccagggcaatgtgac

SEQ ID NO: 194081 - DNA, 29 bp, Artificial Sequence
  Description of Artificial Sequence: Synthetic oligonucleotide
aacatcgacacctcccagggcaatgtgac

SEQ ID NO: 194082 - DNA, 28 bp, Artificial Sequence
  Description of Artificial Sequence: Synthetic oligonucleotide
acatcgacacctcccagggcaatgtgac

SEQ ID NO: 194083 - DNA, 27 bp, Artificial Sequence
  Description of Artificial Sequence: Synthetic oligonucleotide
catcgacacctcccagggcaatgtgac

SEQ ID NO: 194084 - DNA, 27 bp, Artificial Sequence
  Description of Artificial Sequence: Synthetic oligonucleotide
atcgacacctcccagggcaatgtgacg

SEQ ID NO: 194085 - DNA, 27 bp, Artificial Sequence
  Description of Artificial Sequence: Synthetic oligonucleotide
tcgacacctcccagggcaatgtgacgt

SEQ ID NO: 194086 - DNA, 27 bp, Artificial Sequence
  Description of Artificial Sequence: Synthetic oligonucleotide
cgacacctcccagggcaatgtgacgtt

SEQ ID NO: 194087 - DNA, 28 bp, Artificial Sequence
  Description of Artificial Sequence: Synthetic oligonucleotide
gacacctcccagggcaatgtgacgtttg

SEQ ID NO: 194088 - DNA, 28 bp, Artificial Sequence
  Description of Artificial Sequence: Synthetic oligonucleotide
acacctcccagggcaatgtgacgtttgc

SEQ ID NO: 194089 - DNA, 27 bp, Artificial Sequence
  Description of Artificial Sequence: Synthetic oligonucleotide
cacctcccagggcaatgtgacgtttgc

SEQ ID NO: 194090 - DNA, 28 bp, Artificial Sequence
  Description of Artificial Sequence: Synthetic oligonucleotide
acctcccagggcaatgtgacgtttgctg

SEQ ID NO: 194091 - DNA, 27 bp, Artificial Sequence
  Description of Artificial Sequence: Synthetic oligonucleotide
cctcccagggcaatgtgacgtttgctg

SEQ ID NO: 194092 - DNA, 27 bp, Artificial Sequence
  Description of Artificial Sequence: Synthetic oligonucleotide
ctcccagggcaatgtgacgtttgctgg

SEQ ID NO: 194093 - DNA, 27 bp, Artificial Sequence
  Description of Artificial Sequence: Synthetic oligonucleotide
tcccagggcaatgtgacgtttgctggc

SEQ ID NO: 194094 - DNA, 26 bp, Artificial Sequence
  Description of Artificial Sequence: Synthetic oligonucleotide
cccagggcaatgtgacgtttgctggc

SEQ ID NO: 194095 - DNA, 27 bp, Artificial Sequence
  Description of Artificial Sequence: Synthetic oligonucleotide
ccagggcaatgtgacgtttgctggcga

SEQ ID NO: 194096 - DNA, 28 bp, Artificial Sequence
  Description of Artificial Sequence: Synthetic oligonucleotide
cagggcaatgtgacgtttgctggcgatg

SEQ ID NO: 194097 - DNA, 28 bp, Artificial Sequence
  Description of Artificial Sequence: Synthetic oligonucleotide
agggcaatgtgacgtttgctggcgatgg

SEQ ID NO: 194098 - DNA, 27 bp, Artificial Sequence
  Description of Artificial Sequence: Synthetic oligonucleotide
gggcaatgtgacgtttgctggcgatgg

SEQ ID NO: 194099 - DNA, 28 bp, Artificial Sequence
  Description of Artificial Sequence: Synthetic oligonucleotide
ggcaatgtgacgtttgctggcgatggac

SEQ ID NO: 194100 - DNA, 29 bp, Artificial Sequence
  Description of Artificial Sequence: Synthetic oligonucleotide
gcaatgtgacgtttgctggcgatggacag

SEQ ID NO: 194101 - DNA, 29 bp, Artificial Sequence
  Description of Artificial Sequence: Synthetic oligonucleotide
caatgtgacgtttgctggcgatggacagg

SEQ ID NO: 194102 - DNA, 30 bp, Artificial Sequence
  Description of Artificial Sequence: Synthetic oligonucleotide
aatgtgacgtttgctggcgatggacaggag

SEQ ID NO: 194103 - DNA, 33 bp, Artificial Sequence
  Description of Artificial Sequence: Synthetic oligonucleotide
ctgctcacacagtgcaaccacaccattatgatc

SEQ ID NO: 194104 - DNA, 36 bp, Artificial Sequence
  Description of Artificial Sequence: Synthetic oligonucleotide
tgctcacacagtgcaaccacaccattatgatcattg

SEQ ID NO: 194105 - DNA, 35 bp, Artificial Sequence
  Description of Artificial Sequence: Synthetic oligonucleotide
gctcacacagtgcaaccacaccattatgatcattg

SEQ ID NO: 194106 - DNA, 35 bp, Artificial Sequence
  Description of Artificial Sequence: Synthetic oligonucleotide
ctcacacagtgcaaccacaccattatgatcattgg

SEQ ID NO: 194107 - DNA, 35 bp, Artificial Sequence
  Description of Artificial Sequence: Synthetic oligonucleotide
tcacacagtgcaaccacaccattatgatcattggc

SEQ ID NO: 194108 - DNA, 34 bp, Artificial Sequence
  Description of Artificial Sequence: Synthetic oligonucleotide
cacacagtgcaaccacaccattatgatcattggc

SEQ ID NO: 194109 - DNA, 35 bp, Artificial Sequence
  Description of Artificial Sequence: Synthetic oligonucleotide
acacagtgcaaccacaccattatgatcattggcac

SEQ ID NO: 194110 - DNA, 34 bp, Artificial Sequence
  Description of Artificial Sequence: Synthetic oligonucleotide
cacagtgcaaccacaccattatgatcattggcac

SEQ ID NO: 194111 - DNA, 34 bp, Artificial Sequence
  Description of Artificial Sequence: Synthetic oligonucleotide
acagtgcaaccacaccattatgatcattggcacc

SEQ ID NO: 194112 - DNA, 33 bp, Artificial Sequence
  Description of Artificial Sequence: Synthetic oligonucleotide
cagtgcaaccacaccattatgatcattggcacc

SEQ ID NO: 194113 - DNA, 35 bp, Artificial Sequence
  Description of Artificial Sequence: Synthetic oligonucleotide
agtgcaaccacaccattatgatcattggcaccttc

SEQ ID NO: 194114 - DNA, 34 bp, Artificial Sequence
  Description of Artificial Sequence: Synthetic oligonucleotide
gtgcaaccacaccattatgatcattggcaccttc

SEQ ID NO: 194115 - DNA, 34 bp, Artificial Sequence
  Description of Artificial Sequence: Synthetic oligonucleotide
tgcaaccacaccattatgatcattggcaccttcg

SEQ ID NO: 194116 - DNA, 33 bp, Artificial Sequence
  Description of Artificial Sequence: Synthetic oligonucleotide
gcaaccacaccattatgatcattggcaccttcg

SEQ ID NO: 194117 - DNA, 33 bp, Artificial Sequence
  Description of Artificial Sequence: Synthetic oligonucleotide
caaccacaccattatgatcattggcaccttcgg

SEQ ID NO: 194118 - DNA, 33 bp, Artificial Sequence
  Description of Artificial Sequence: Synthetic oligonucleotide
aaccacaccattatgatcattggcaccttcggc

SEQ ID NO: 194119 - DNA, 32 bp, Artificial Sequence
  Description of Artificial Sequence: Synthetic oligonucleotide
accacaccattatgatcattggcaccttcggc

SEQ ID NO: 194120 - DNA, 31 bp, Artificial Sequence
  Description of Artificial Sequence: Synthetic oligonucleotide
ccacaccattatgatcattggcaccttcggc

SEQ ID NO: 194121 - DNA, 33 bp, Artificial Sequence
  Description of Artificial Sequence: Synthetic oligonucleotide
cacaccattatgatcattggcaccttcggcttc

SEQ ID NO: 194122 - DNA, 34 bp, Artificial Sequence
  Description of Artificial Sequence: Synthetic oligonucleotide
acaccattatgatcattggcaccttcggcttctg

SEQ ID NO: 194123 - DNA, 33 bp, Artificial Sequence
  Description of Artificial Sequence: Synthetic oligonucleotide
caccattatgatcattggcaccttcggcttctg

SEQ ID NO: 194124 - DNA, 33 bp, Artificial Sequence
  Description of Artificial Sequence: Synthetic oligonucleotide
accattatgatcattggcaccttcggcttctgg

SEQ ID NO: 194125 - DNA, 32 bp, Artificial Sequence
  Description of Artificial Sequence: Synthetic oligonucleotide
ccattatgatcattggcaccttcggcttctgg

SEQ ID NO: 194126 - DNA, 32 bp, Artificial Sequence
  Description of Artificial Sequence: Synthetic oligonucleotide
cattatgatcattggcaccttcggcttctggg

SEQ ID NO: 194127 - DNA, 32 bp, Artificial Sequence
  Description of Artificial Sequence: Synthetic oligonucleotide
attatgatcattggcaccttcggcttctgggc

SEQ ID NO: 194128 - DNA, 31 bp, Artificial Sequence
  Description of Artificial Sequence: Synthetic oligonucleotide
ttatgatcattggcaccttcggcttctgggc

SEQ ID NO: 194129 - DNA, 30 bp, Artificial Sequence
  Description of Artificial Sequence: Synthetic oligonucleotide
tatgatcattggcaccttcggcttctgggc

SEQ ID NO: 194130 - DNA, 29 bp, Artificial Sequence
  Description of Artificial Sequence: Synthetic oligonucleotide
atgatcattggcaccttcggcttctgggc

SEQ ID NO: 194131 - DNA, 28 bp, Artificial Sequence
  Description of Artificial Sequence: Synthetic oligonucleotide
tgatcattggcaccttcggcttctgggc

SEQ ID NO: 194132 - DNA, 27 bp, Artificial Sequence
  Description of Artificial Sequence: Synthetic oligonucleotide
gatcattggcaccttcggcttctgggc

SEQ ID NO: 194133 - DNA, 28 bp, Artificial Sequence
  Description of Artificial Sequence: Synthetic oligonucleotide
atcattggcaccttcggcttctgggctg

SEQ ID NO: 194134 - DNA, 27 bp, Artificial Sequence
  Description of Artificial Sequence: Synthetic oligonucleotide
tcattggcaccttcggcttctgggctg

SEQ ID NO: 194135 - DNA, 30 bp, Artificial Sequence
  Description of Artificial Sequence: Synthetic oligonucleotide
gactatctgcaggttatgcctcagcgctag

SEQ ID NO: 194136 - DNA, 32 bp, Artificial Sequence
  Description of Artificial Sequence: Synthetic oligonucleotide
actatctgcaggttatgcctcagcgctagaag

SEQ ID NO: 194137 - DNA, 31 bp, Artificial Sequence
  Description of Artificial Sequence: Synthetic oligonucleotide
ctatctgcaggttatgcctcagcgctagaag

SEQ ID NO: 194138 - DNA, 31 bp, Artificial Sequence
  Description of Artificial Sequence: Synthetic oligonucleotide
tatctgcaggttatgcctcagcgctagaagg

SEQ ID NO: 194139 - DNA, 30 bp, Artificial Sequence
  Description of Artificial Sequence: Synthetic oligonucleotide
atctgcaggttatgcctcagcgctagaagg

SEQ ID NO: 194140 - DNA, 29 bp, Artificial Sequence
  Description of Artificial Sequence: Synthetic oligonucleotide
tctgcaggttatgcctcagcgctagaagg

SEQ ID NO: 194141 - DNA, 28 bp, Artificial Sequence
  Description of Artificial Sequence: Synthetic oligonucleotide
ctgcaggttatgcctcagcgctagaagg

SEQ ID NO: 194142 - DNA, 28 bp, Artificial Sequence
  Description of Artificial Sequence: Synthetic oligonucleotide
tgcaggttatgcctcagcgctagaaggg

SEQ ID NO: 194143 - DNA, 27 bp, Artificial Sequence
  Description of Artificial Sequence: Synthetic oligonucleotide
gcaggttatgcctcagcgctagaaggg

SEQ ID NO: 194144 - DNA, 28 bp, Artificial Sequence
  Description of Artificial Sequence: Synthetic oligonucleotide
caggttatgcctcagcgctagaagggtg

SEQ ID NO: 194145 - DNA, 29 bp, Artificial Sequence
  Description of Artificial Sequence: Synthetic oligonucleotide
aggttatgcctcagcgctagaagggtgtg

SEQ ID NO: 194146 - DNA, 28 bp, Artificial Sequence
  Description of Artificial Sequence: Synthetic oligonucleotide
ggttatgcctcagcgctagaagggtgtg

SEQ ID NO: 194147 - DNA, 28 bp, Artificial Sequence
  Description of Artificial Sequence: Synthetic oligonucleotide
gttatgcctcagcgctagaagggtgtgg

SEQ ID NO: 194148 - DNA, 29 bp, Artificial Sequence
  Description of Artificial Sequence: Synthetic oligonucleotide
ttatgcctcagcgctagaagggtgtggtg

SEQ ID NO: 194149 - DNA, 28 bp, Artificial Sequence
  Description of Artificial Sequence: Synthetic oligonucleotide
tatgcctcagcgctagaagggtgtggtg

SEQ ID NO: 194150 - DNA, 27 bp, Artificial Sequence
  Description of Artificial Sequence: Synthetic oligonucleotide
atgcctcagcgctagaagggtgtggtg

SEQ ID NO: 194151 - DNA, 26 bp, Artificial Sequence
  Description of Artificial Sequence: Synthetic oligonucleotide
tgcctcagcgctagaagggtgtggtg

SEQ ID NO: 194152 - DNA, 25 bp, Artificial Sequence
  Description of Artificial Sequence: Synthetic oligonucleotide
gcctcagcgctagaagggtgtggtg

SEQ ID NO: 194153 - DNA, 25 bp, Artificial Sequence
  Description of Artificial Sequence: Synthetic oligonucleotide
cctcagcgctagaagggtgtggtgg

SEQ ID NO: 194154 - DNA, 25 bp, Artificial Sequence
  Description of Artificial Sequence: Synthetic oligonucleotide
ctcagcgctagaagggtgtggtggg

SEQ ID NO: 194155 - DNA, 25 bp, Artificial Sequence
  Description of Artificial Sequence: Synthetic oligonucleotide
tcagcgctagaagggtgtggtgggc

SEQ ID NO: 194156 - DNA, 24 bp, Artificial Sequence
  Description of Artificial Sequence: Synthetic oligonucleotide
cagcgctagaagggtgtggtgggc

SEQ ID NO: 194157 - DNA, 25 bp, Artificial Sequence
  Description of Artificial Sequence: Synthetic oligonucleotide
agcgctagaagggtgtggtgggcga

SEQ ID NO: 194158 - DNA, 24 bp, Artificial Sequence
  Description of Artificial Sequence: Synthetic oligonucleotide
gcgctagaagggtgtggtgggcga

SEQ ID NO: 194159 - DNA, 25 bp, Artificial Sequence
  Description of Artificial Sequence: Synthetic oligonucleotide
cgctagaagggtgtggtgggcgaca

SEQ ID NO: 194160 - DNA, 25 bp, Artificial Sequence
  Description of Artificial Sequence: Synthetic oligonucleotide
gctagaagggtgtggtgggcgacag

SEQ ID NO: 194161 - DNA, 25 bp, Artificial Sequence
  Description of Artificial Sequence: Synthetic oligonucleotide
ctagaagggtgtggtgggcgacagc

SEQ ID NO: 194162 - DNA, 25 bp, Artificial Sequence
  Description of Artificial Sequence: Synthetic oligonucleotide
tagaagggtgtggtgggcgacagcg

SEQ ID NO: 194163 - DNA, 24 bp, Artificial Sequence
  Description of Artificial Sequence: Synthetic oligonucleotide
agaagggtgtggtgggcgacagcg

SEQ ID NO: 194164 - DNA, 27 bp, Artificial Sequence
  Description of Artificial Sequence: Synthetic oligonucleotide
ccatctccgggaacagatccgcagagt

SEQ ID NO: 194165 - DNA, 28 bp, Artificial Sequence
  Description of Artificial Sequence: Synthetic oligonucleotide
catctccgggaacagatccgcagagttc

SEQ ID NO: 194166 - DNA, 29 bp, Artificial Sequence
  Description of Artificial Sequence: Synthetic oligonucleotide
atctccgggaacagatccgcagagttcac

SEQ ID NO: 194167 - DNA, 28 bp, Artificial Sequence
  Description of Artificial Sequence: Synthetic oligonucleotide
tctccgggaacagatccgcagagttcac

SEQ ID NO: 194168 - DNA, 27 bp, Artificial Sequence
  Description of Artificial Sequence: Synthetic oligonucleotide
ctccgggaacagatccgcagagttcac

SEQ ID NO: 194169 - DNA, 27 bp, Artificial Sequence
  Description of Artificial Sequence: Synthetic oligonucleotide
tccgggaacagatccgcagagttcacc

SEQ ID NO: 194170 - DNA, 26 bp, Artificial Sequence
  Description of Artificial Sequence: Synthetic oligonucleotide
ccgggaacagatccgcagagttcacc

SEQ ID NO: 194171 - DNA, 27 bp, Artificial Sequence
  Description of Artificial Sequence: Synthetic oligonucleotide
cgggaacagatccgcagagttcaccct

SEQ ID NO: 194172 - DNA, 27 bp, Artificial Sequence
  Description of Artificial Sequence: Synthetic oligonucleotide
gggaacagatccgcagagttcaccctg

SEQ ID NO: 194173 - DNA, 27 bp, Artificial Sequence
  Description of Artificial Sequence: Synthetic oligonucleotide
ggaacagatccgcagagttcaccctgc

SEQ ID NO: 194174 - DNA, 28 bp, Artificial Sequence
  Description of Artificial Sequence: Synthetic oligonucleotide
gaacagatccgcagagttcaccctgcac

SEQ ID NO: 194175 - DNA, 28 bp, Artificial Sequence
  Description of Artificial Sequence: Synthetic oligonucleotide
aacagatccgcagagttcaccctgcacg

SEQ ID NO: 194176 - DNA, 27 bp, Artificial Sequence
  Description of Artificial Sequence: Synthetic oligonucleotide
acagatccgcagagttcaccctgcacg

SEQ ID NO: 194177 - DNA, 27 bp, Artificial Sequence
  Description of Artificial Sequence: Synthetic oligonucleotide
cagatccgcagagttcaccctgcacga

SEQ ID NO: 194178 - DNA, 27 bp, Artificial Sequence
  Description of Artificial Sequence: Synthetic oligonucleotide
agatccgcagagttcaccctgcacgac

SEQ ID NO: 194179 - DNA, 26 bp, Artificial Sequence
  Description of Artificial Sequence: Synthetic oligonucleotide
gatccgcagagttcaccctgcacgac

SEQ ID NO: 194180 - DNA, 27 bp, Artificial Sequence
  Description of Artificial Sequence: Synthetic oligonucleotide
atccgcagagttcaccctgcacgacca

SEQ ID NO: 194181 - DNA, 26 bp, Artificial Sequence
  Description of Artificial Sequence: Synthetic oligonucleotide
tccgcagagttcaccctgcacgacca

SEQ ID NO: 194182 - DNA, 25 bp, Artificial Sequence
  Description of Artificial Sequence: Synthetic oligonucleotide
ccgcagagttcaccctgcacgacca

SEQ ID NO: 194183 - DNA, 25 bp, Artificial Sequence
  Description of Artificial Sequence: Synthetic oligonucleotide
cgcagagttcaccctgcacgaccac

SEQ ID NO: 194184 - DNA, 27 bp, Artificial Sequence
  Description of Artificial Sequence: Synthetic oligonucleotide
gcagagttcaccctgcacgaccacctt

SEQ ID NO: 194185 - DNA, 27 bp, Artificial Sequence
  Description of Artificial Sequence: Synthetic oligonucleotide
cagagttcaccctgcacgaccaccttc

SEQ ID NO: 194186 - DNA, 29 bp, Artificial Sequence
  Description of Artificial Sequence: Synthetic oligonucleotide
acactgtctacctggccaacttcaccctc

SEQ ID NO: 194187 - DNA, 28 bp, Artificial Sequence
  Description of Artificial Sequence: Synthetic oligonucleotide
cactgtctacctggccaacttcaccctc

SEQ ID NO: 194188 - DNA, 28 bp, Artificial Sequence
  Description of Artificial Sequence: Synthetic oligonucleotide
actgtctacctggccaacttcaccctcc

SEQ ID NO: 194189 - DNA, 27 bp, Artificial Sequence
  Description of Artificial Sequence: Synthetic oligonucleotide
ctgtctacctggccaacttcaccctcc

SEQ ID NO: 194190 - DNA, 28 bp, Artificial Sequence
  Description of Artificial Sequence: Synthetic oligonucleotide
tgtctacctggccaacttcaccctccag

SEQ ID NO: 194191 - DNA, 27 bp, Artificial Sequence
  Description of Artificial Sequence: Synthetic oligonucleotide
gtctacctggccaacttcaccctccag

SEQ ID NO: 194192 - DNA, 28 bp, Artificial Sequence
  Description of Artificial Sequence: Synthetic oligonucleotide
tctacctggccaacttcaccctccagac

SEQ ID NO: 194193 - DNA, 27 bp, Artificial Sequence
  Description of Artificial Sequence: Synthetic oligonucleotide
ctacctggccaacttcaccctccagac

SEQ ID NO: 194194 - DNA, 28 bp, Artificial Sequence
  Description of Artificial Sequence: Synthetic oligonucleotide
tacctggccaacttcaccctccagactc

SEQ ID NO: 194195 - DNA, 27 bp, Artificial Sequence
  Description of Artificial Sequence: Synthetic oligonucleotide
acctggccaacttcaccctccagactc

SEQ ID NO: 194196 - DNA, 27 bp, Artificial Sequence
  Description of Artificial Sequence: Synthetic oligonucleotide
cctggccaacttcaccctccagactct

SEQ ID NO: 194197 - DNA, 27 bp, Artificial Sequence
  Description of Artificial Sequence: Synthetic oligonucleotide
ctggccaacttcaccctccagactctg

SEQ ID NO: 194198 - DNA, 28 bp, Artificial Sequence
  Description of Artificial Sequence: Synthetic oligonucleotide
tggccaacttcaccctccagactctgag

SEQ ID NO: 194199 - DNA, 27 bp, Artificial Sequence
  Description of Artificial Sequence: Synthetic oligonucleotide
ggccaacttcaccctccagactctgag

SEQ ID NO: 194200 - DNA, 29 bp, Artificial Sequence
  Description of Artificial Sequence: Synthetic oligonucleotide
gccaacttcaccctccagactctgagttc

SEQ ID NO: 194201 - DNA, 29 bp, Artificial Sequence
  Description of Artificial Sequence: Synthetic oligonucleotide
ccaacttcaccctccagactctgagttcc

SEQ ID NO: 194202 - DNA, 30 bp, Artificial Sequence
  Description of Artificial Sequence: Synthetic oligonucleotide
caacttcaccctccagactctgagttcctg

SEQ ID NO: 194203 - DNA, 32 bp, Artificial Sequence
  Description of Artificial Sequence: Synthetic oligonucleotide
aacttcaccctccagactctgagttcctgaag

SEQ ID NO: 194204 - DNA, 31 bp, Artificial Sequence
  Description of Artificial Sequence: Synthetic oligonucleotide
acttcaccctccagactctgagttcctgaag

SEQ ID NO: 194205 - DNA, 30 bp, Artificial Sequence
  Description of Artificial Sequence: Synthetic oligonucleotide
cttcaccctccagactctgagttcctgaag

SEQ ID NO: 194206 - DNA, 32 bp, Artificial Sequence
  Description of Artificial Sequence: Synthetic oligonucleotide
ttcaccctccagactctgagttcctgaagatc

SEQ ID NO: 194207 - DNA, 31 bp, Artificial Sequence
  Description of Artificial Sequence: Synthetic oligonucleotide
tcaccctccagactctgagttcctgaagatc

SEQ ID NO: 194208 - DNA, 30 bp, Artificial Sequence
  Description of Artificial Sequence: Synthetic oligonucleotide
caccctccagactctgagttcctgaagatc

SEQ ID NO: 194209 - DNA, 35 bp, Artificial Sequence
  Description of Artificial Sequence: Synthetic oligonucleotide
accctccagactctgagttcctgaagatctttaag

SEQ ID NO: 194210 - DNA, 34 bp, Artificial Sequence
  Description of Artificial Sequence: Synthetic oligonucleotide
ccctccagactctgagttcctgaagatctttaag

SEQ ID NO: 194211 - DNA, 34 bp, Artificial Sequence
  Description of Artificial Sequence: Synthetic oligonucleotide
cctccagactctgagttcctgaagatctttaagc

SEQ ID NO: 194212 - DNA, 34 bp, Artificial Sequence
  Description of Artificial Sequence: Synthetic oligonucleotide
ctccagactctgagttcctgaagatctttaagcc

SEQ ID NO: 194213 - DNA, 34 bp, Artificial Sequence
  Description of Artificial Sequence: Synthetic oligonucleotide
tccagactctgagttcctgaagatctttaagccg

SEQ ID NO: 194214 - DNA, 28 bp, Artificial Sequence
  Description of Artificial Sequence: Synthetic oligonucleotide
gacaggaggctacaccgtggaaagactg

SEQ ID NO: 194215 - DNA, 28 bp, Artificial Sequence
  Description of Artificial Sequence: Synthetic oligonucleotide
acaggaggctacaccgtggaaagactgc

SEQ ID NO: 194216 - DNA, 27 bp, Artificial Sequence
  Description of Artificial Sequence: Synthetic oligonucleotide
caggaggctacaccgtggaaagactgc

SEQ ID NO: 194217 - DNA, 27 bp, Artificial Sequence
  Description of Artificial Sequence: Synthetic oligonucleotide
aggaggctacaccgtggaaagactgcc

SEQ ID NO: 194218 - DNA, 26 bp, Artificial Sequence
  Description of Artificial Sequence: Synthetic oligonucleotide
ggaggctacaccgtggaaagactgcc

SEQ ID NO: 194219 - DNA, 27 bp, Artificial Sequence
  Description of Artificial Sequence: Synthetic oligonucleotide
gaggctacaccgtggaaagactgccct

SEQ ID NO: 194220 - DNA, 27 bp, Artificial Sequence
  Description of Artificial Sequence: Synthetic oligonucleotide
aggctacaccgtggaaagactgccctg

SEQ ID NO: 194221 - DNA, 26 bp, Artificial Sequence
  Description of Artificial Sequence: Synthetic oligonucleotide
ggctacaccgtggaaagactgccctg

SEQ ID NO: 194222 - DNA, 27 bp, Artificial Sequence
  Description of Artificial Sequence: Synthetic oligonucleotide
gctacaccgtggaaagactgccctgct

SEQ ID NO: 194223 - DNA, 27 bp, Artificial Sequence
  Description of Artificial Sequence: Synthetic oligonucleotide
ctacaccgtggaaagactgccctgctc

SEQ ID NO: 194224 - DNA, 28 bp, Artificial Sequence
  Description of Artificial Sequence: Synthetic oligonucleotide
tacaccgtggaaagactgccctgctcac

SEQ ID NO: 194225 - DNA, 27 bp, Artificial Sequence
  Description of Artificial Sequence: Synthetic oligonucleotide
acaccgtggaaagactgccctgctcac

SEQ ID NO: 194226 - DNA, 27 bp, Artificial Sequence
  Description of Artificial Sequence: Synthetic oligonucleotide
caccgtggaaagactgccctgctcaca

SEQ ID NO: 194227 - DNA, 27 bp, Artificial Sequence
  Description of Artificial Sequence: Synthetic oligonucleotide
accgtggaaagactgccctgctcacac

SEQ ID NO: 194228 - DNA, 27 bp, Artificial Sequence
  Description of Artificial Sequence: Synthetic oligonucleotide
ccgtggaaagactgccctgctcacaca

SEQ ID NO: 194229 - DNA, 27 bp, Artificial Sequence
  Description of Artificial Sequence: Synthetic oligonucleotide
cgtggaaagactgccctgctcacacag

SEQ ID NO: 194230 - DNA, 28 bp, Artificial Sequence
  Description of Artificial Sequence: Synthetic oligonucleotide
gtggaaagactgccctgctcacacagtg

SEQ ID NO: 194231 - DNA, 28 bp, Artificial Sequence
  Description of Artificial Sequence: Synthetic oligonucleotide
tggaaagactgccctgctcacacagtgc

SEQ ID NO: 194232 - DNA, 27 bp, Artificial Sequence
  Description of Artificial Sequence: Synthetic oligonucleotide
ggaaagactgccctgctcacacagtgc

SEQ ID NO: 194233 - DNA, 29 bp, Artificial Sequence
  Description of Artificial Sequence: Synthetic oligonucleotide
gaaagactgccctgctcacacagtgcaac

SEQ ID NO: 194234 - DNA, 29 bp, Artificial Sequence
  Description of Artificial Sequence: Synthetic oligonucleotide
aaagactgccctgctcacacagtgcaacc

SEQ ID NO: 194235 - DNA, 28 bp, Artificial Sequence
  Description of Artificial Sequence: Synthetic oligonucleotide
aagactgccctgctcacacagtgcaacc

SEQ ID NO: 194236 - DNA, 27 bp, Artificial Sequence
  Description of Artificial Sequence: Synthetic oligonucleotide
agactgccctgctcacacagtgcaacc

SEQ ID NO: 194237 - DNA, 27 bp, Artificial Sequence
  Description of Artificial Sequence: Synthetic oligonucleotide
gactgccctgctcacacagtgcaacca

SEQ ID NO: 194238 - DNA, 27 bp, Artificial Sequence
  Description of Artificial Sequence: Synthetic oligonucleotide
actgccctgctcacacagtgcaaccac

SEQ ID NO: 194239 - DNA, 27 bp, Artificial Sequence
  Description of Artificial Sequence: Synthetic oligonucleotide
ctgccctgctcacacagtgcaaccaca

SEQ ID NO: 194240 - DNA, 21 bp, Artificial Sequence
  Description of Artificial Sequence: Synthetic oligonucleotide
ggtgtggtgggcgacagcgcc

SEQ ID NO: 194241 - DNA, 22 bp, Artificial Sequence
  Description of Artificial Sequence: Synthetic oligonucleotide
gtgtggtgggcgacagcgccca

SEQ ID NO: 194242 - DNA, 22 bp, Artificial Sequence
  Description of Artificial Sequence: Synthetic oligonucleotide
tgtggtgggcgacagcgcccac

SEQ ID NO: 194243 - DNA, 21 bp, Artificial Sequence
  Description of Artificial Sequence: Synthetic oligonucleotide
gtggtgggcgacagcgcccac

SEQ ID NO: 194244 - DNA, 22 bp, Artificial Sequence
  Description of Artificial Sequence: Synthetic oligonucleotide
tggtgggcgacagcgcccacct

SEQ ID NO: 194245 - DNA, 21 bp, Artificial Sequence
  Description of Artificial Sequence: Synthetic oligonucleotide
ggtgggcgacagcgcccacct

SEQ ID NO: 194246 - DNA, 21 bp, Artificial Sequence
  Description of Artificial Sequence: Synthetic oligonucleotide
gtgggcgacagcgcccacctc

SEQ ID NO: 194247 - DNA, 21 bp, Artificial Sequence
  Description of Artificial Sequence: Synthetic oligonucleotide
tgggcgacagcgcccacctcc

SEQ ID NO: 194248 - DNA, 20 bp, Artificial Sequence
  Description of Artificial Sequence: Synthetic oligonucleotide
gggcgacagcgcccacctcc

SEQ ID NO: 194249 - DNA, 20 bp, Artificial Sequence
  Description of Artificial Sequence: Synthetic oligonucleotide
ggcgacagcgcccacctccg

SEQ ID NO: 194250 - DNA, 20 bp, Artificial Sequence
  Description of Artificial Sequence: Synthetic oligonucleotide
gcgacagcgcccacctccgg

SEQ ID NO: 194251 - DNA, 21 bp, Artificial Sequence
  Description of Artificial Sequence: Synthetic oligonucleotide
cgacagcgcccacctccggca

SEQ ID NO: 194252 - DNA, 21 bp, Artificial Sequence
  Description of Artificial Sequence: Synthetic oligonucleotide
gacagcgcccacctccggcag

SEQ ID NO: 194253 - DNA, 21 bp, Artificial Sequence
  Description of Artificial Sequence: Synthetic oligonucleotide
acagcgcccacctccggcagg

SEQ ID NO: 194254 - DNA, 20 bp, Artificial Sequence
  Description of Artificial Sequence: Synthetic oligonucleotide
cagcgcccacctccggcagg

SEQ ID NO: 194255 - DNA, 20 bp, Artificial Sequence
  Description of Artificial Sequence: Synthetic oligonucleotide
agcgcccacctccggcaggc

SEQ ID NO: 194256 - DNA, 20 bp, Artificial Sequence
  Description of Artificial Sequence: Synthetic oligonucleotide
gcgcccacctccggcaggct

SEQ ID NO: 194257 - DNA, 21 bp, Artificial Sequence
  Description of Artificial Sequence: Synthetic oligonucleotide
cgcccacctccggcaggccat

SEQ ID NO: 194258 - DNA, 21 bp, Artificial Sequence
  Description of Artificial Sequence: Synthetic oligonucleotide
gcccacctccggcaggccatg

SEQ ID NO: 194259 - DNA, 22 bp, Artificial Sequence
  Description of Artificial Sequence: Synthetic oligonucleotide
cccacctccggcaggccatgga

SEQ ID NO: 194260 - DNA, 23 bp, Artificial Sequence
  Description of Artificial Sequence: Synthetic oligonucleotide
ccacctccggcaggccatggact

SEQ ID NO: 194261 - DNA, 23 bp, Artificial Sequence
  Description of Artificial Sequence: Synthetic oligonucleotide
cacctccggcaggccatggactg

SEQ ID NO: 194262 - DNA, 25 bp, Artificial Sequence
  Description of Artificial Sequence: Synthetic oligonucleotide
cgcacctttgtcggcgtccacgtgt

SEQ ID NO: 194263 - DNA, 25 bp, Artificial Sequence
  Description of Artificial Sequence: Synthetic oligonucleotide
gcacctttgtcggcgtccacgtgtg

SEQ ID NO: 194264 - DNA, 25 bp, Artificial Sequence
  Description of Artificial Sequence: Synthetic oligonucleotide
cacctttgtcggcgtccacgtgtgc

SEQ ID NO: 194265 - DNA, 25 bp, Artificial Sequence
  Description of Artificial Sequence: Synthetic oligonucleotide
acctttgtcggcgtccacgtgtgcc

SEQ ID NO: 194266 - DNA, 24 bp, Artificial Sequence
  Description of Artificial Sequence: Synthetic oligonucleotide
cctttgtcggcgtccacgtgtgcc

SEQ ID NO: 194267 - DNA, 25 bp, Artificial Sequence
  Description of Artificial Sequence: Synthetic oligonucleotide
ctttgtcggcgtccacgtgtgccgt

SEQ ID NO: 194268 - DNA, 25 bp, Artificial Sequence
  Description of Artificial Sequence: Synthetic oligonucleotide
tttgtcggcgtccacgtgtgccgtg

SEQ ID NO: 194269 - DNA, 24 bp, Artificial Sequence
  Description of Artificial Sequence: Synthetic oligonucleotide
ttgtcggcgtccacgtgtgccgtg

SEQ ID NO: 194270 - DNA, 23 bp, Artificial Sequence
  Description of Artificial Sequence: Synthetic oligonucleotide
tgtcggcgtccacgtgtgccgtg

SEQ ID NO: 194271 - DNA, 22 bp, Artificial Sequence
  Description of Artificial Sequence: Synthetic oligonucleotide
gtcggcgtccacgtgtgccgtg

SEQ ID NO: 194272 - DNA, 22 bp, Artificial Sequence
  Description of Artificial Sequence: Synthetic oligonucleotide
tcggcgtccacgtgtgccgtgg

SEQ ID NO: 194273 - DNA, 21 bp, Artificial Sequence
  Description of Artificial Sequence: Synthetic oligonucleotide
cggcgtccacgtgtgccgtgg

SEQ ID NO: 194274 - DNA, 21 bp, Artificial Sequence
  Description of Artificial Sequence: Synthetic oligonucleotide
ggcgtccacgtgtgccgtggg

SEQ ID NO: 194275 - DNA, 22 bp, Artificial Sequence
  Description of Artificial Sequence: Synthetic oligonucleotide
gcgtccacgtgtgccgtgggga

SEQ ID NO: 194276 - DNA, 25 bp, Artificial Sequence
  Description of Artificial Sequence: Synthetic oligonucleotide
cgtccacgtgtgccgtggggactat

SEQ ID NO: 194277 - DNA, 26 bp, Artificial Sequence
  Description of Artificial Sequence: Synthetic oligonucleotide
gtccacgtgtgccgtggggactatct

SEQ ID NO: 194278 - DNA, 26 bp, Artificial Sequence
  Description of Artificial Sequence: Synthetic oligonucleotide
tccacgtgtgccgtggggactatctg

SEQ ID NO: 194279 - DNA, 25 bp, Artificial Sequence
  Description of Artificial Sequence: Synthetic oligonucleotide
ccacgtgtgccgtggggactatctg

SEQ ID NO: 194280 - DNA, 26 bp, Artificial Sequence
  Description of Artificial Sequence: Synthetic oligonucleotide
cacgtgtgccgtggggactatctgca

SEQ ID NO: 194281 - DNA, 26 bp, Artificial Sequence
  Description of Artificial Sequence: Synthetic oligonucleotide
acgtgtgccgtggggactatctgcag

SEQ ID NO: 194282 - DNA, 25 bp, Artificial Sequence
  Description of Artificial Sequence: Synthetic oligonucleotide
cgtgtgccgtggggactatctgcag

SEQ ID NO: 194283 - DNA, 27 bp, Artificial Sequence
  Description of Artificial Sequence: Synthetic oligonucleotide
gtgtgccgtggggactatctgcaggtt

SEQ ID NO: 194284 - DNA, 29 bp, Artificial Sequence
  Description of Artificial Sequence: Synthetic oligonucleotide
tgtgccgtggggactatctgcaggttatg

SEQ ID NO: 194285 - DNA, 28 bp, Artificial Sequence
  Description of Artificial Sequence: Synthetic oligonucleotide
gtgccgtggggactatctgcaggttatg

SEQ ID NO: 194286 - DNA, 28 bp, Artificial Sequence
  Description of Artificial Sequence: Synthetic oligonucleotide
tgccgtggggactatctgcaggttatgc

SEQ ID NO: 194287 - DNA, 25 bp, Artificial Sequence
  Description of Artificial Sequence: Synthetic oligonucleotide
cgtggcgggagctgcagcttcacta

SEQ ID NO: 194288 - DNA, 26 bp, Artificial Sequence
  Description of Artificial Sequence: Synthetic oligonucleotide
gtggcgggagctgcagcttcactact

SEQ ID NO: 194289 - DNA, 26 bp, Artificial Sequence
  Description of Artificial Sequence: Synthetic oligonucleotide
tggcgggagctgcagcttcactactg

SEQ ID NO: 194290 - DNA, 25 bp, Artificial Sequence
  Description of Artificial Sequence: Synthetic oligonucleotide
ggcgggagctgcagcttcactactg

SEQ ID NO: 194291 - DNA, 27 bp, Artificial Sequence
  Description of Artificial Sequence: Synthetic oligonucleotide
gcgggagctgcagcttcactactggat

SEQ ID NO: 194292 - DNA, 27 bp, Artificial Sequence
  Description of Artificial Sequence: Synthetic oligonucleotide
cgggagctgcagcttcactactggatg

SEQ ID NO: 194293 - DNA, 28 bp, Artificial Sequence
  Description of Artificial Sequence: Synthetic oligonucleotide
gggagctgcagcttcactactggatgtc

SEQ ID NO: 194294 - DNA, 28 bp, Artificial Sequence
  Description of Artificial Sequence: Synthetic oligonucleotide
ggagctgcagcttcactactggatgtcg

SEQ ID NO: 194295 - DNA, 28 bp, Artificial Sequence
  Description of Artificial Sequence: Synthetic oligonucleotide
gagctgcagcttcactactggatgtcgg

SEQ ID NO: 194296 - DNA, 29 bp, Artificial Sequence
  Description of Artificial Sequence: Synthetic oligonucleotide
agctgcagcttcactactggatgtcggag

SEQ ID NO: 194297 - DNA, 28 bp, Artificial Sequence
  Description of Artificial Sequence: Synthetic oligonucleotide
gctgcagcttcactactggatgtcggag

SEQ ID NO: 194298 - DNA, 28 bp, Artificial Sequence
  Description of Artificial Sequence: Synthetic oligonucleotide
ctgcagcttcactactggatgtcggagg

SEQ ID NO: 194299 - DNA, 29 bp, Artificial Sequence
  Description of Artificial Sequence: Synthetic oligonucleotide
tgcagcttcactactggatgtcggaggag

SEQ ID NO: 194300 - DNA, 28 bp, Artificial Sequence
  Description of Artificial Sequence: Synthetic oligonucleotide
gcagcttcactactggatgtcggaggag

SEQ ID NO: 194301 - DNA, 30 bp, Artificial Sequence
  Description of Artificial Sequence: Synthetic oligonucleotide
cagcttcactactggatgtcggaggagtac

SEQ ID NO: 194302 - DNA, 30 bp, Artificial Sequence
  Description of Artificial Sequence: Synthetic oligonucleotide
agcttcactactggatgtcggaggagtacg

SEQ ID NO: 194303 - DNA, 29 bp, Artificial Sequence
  Description of Artificial Sequence: Synthetic oligonucleotide
gcttcactactggatgtcggaggagtacg

SEQ ID NO: 194304 - DNA, 29 bp, Artificial Sequence
  Description of Artificial Sequence: Synthetic oligonucleotide
cttcactactggatgtcggaggagtacgc

SEQ ID NO: 194305 - DNA, 29 bp, Artificial Sequence
  Description of Artificial Sequence: Synthetic oligonucleotide
ttcactactggatgtcggaggagtacgcg

SEQ ID NO: 194306 - DNA, 28 bp, Artificial Sequence
  Description of Artificial Sequence: Synthetic oligonucleotide
tcactactggatgtcggaggagtacgcg

SEQ ID NO: 194307 - DNA, 27 bp, Artificial Sequence
  Description of Artificial Sequence: Synthetic oligonucleotide
cactactggatgtcggaggagtacgcg

SEQ ID NO: 194308 - DNA, 27 bp, Artificial Sequence
  Description of Artificial Sequence: Synthetic oligonucleotide
actactggatgtcggaggagtacgcgg

SEQ ID NO: 194309 - DNA, 27 bp, Artificial Sequence
  Description of Artificial Sequence: Synthetic oligonucleotide
ctactggatgtcggaggagtacgcgga

SEQ ID NO: 194310 - DNA, 27 bp, Artificial Sequence
  Description of Artificial Sequence: Synthetic oligonucleotide
tactggatgtcggaggagtacgcggac

SEQ ID NO: 194311 - DNA, 27 bp, Artificial Sequence
  Description of Artificial Sequence: Synthetic oligonucleotide
agcttcacgactggatgtcggaggagc

SEQ ID NO: 194312 - DNA, 27 bp, Artificial Sequence
  Description of Artificial Sequence: Synthetic oligonucleotide
gcttcacgactggatgtcggaggagca

SEQ ID NO: 194313 - DNA, 27 bp, Artificial Sequence
  Description of Artificial Sequence: Synthetic oligonucleotide
cttcacgactggatgtcggaggagcac

SEQ ID NO: 194314 - DNA, 27 bp, Artificial Sequence
  Description of Artificial Sequence: Synthetic oligonucleotide
ttcacgactggatgtcggaggagcacg

SEQ ID NO: 194315 - DNA, 26 bp, Artificial Sequence
  Description of Artificial Sequence: Synthetic oligonucleotide
tcacgactggatgtcggaggagcacg

SEQ ID NO: 194316 - DNA, 25 bp, Artificial Sequence
  Description of Artificial Sequence: Synthetic oligonucleotide
cacgactggatgtcggaggagcacg

SEQ ID NO: 194317 - DNA, 25 bp, Artificial Sequence
  Description of Artificial Sequence: Synthetic oligonucleotide
acgactggatgtcggaggagcacgc

SEQ ID NO: 194318 - DNA, 24 bp, Artificial Sequence
  Description of Artificial Sequence: Synthetic oligonucleotide
cgactggatgtcggaggagcacgc

SEQ ID NO: 194319 - DNA, 24 bp, Artificial Sequence
  Description of Artificial Sequence: Synthetic oligonucleotide
gactggatgtcggaggagcacgcg

SEQ ID NO: 194320 - DNA, 25 bp, Artificial Sequence
  Description of Artificial Sequence: Synthetic oligonucleotide
actggatgtcggaggagcacgcgga

SEQ ID NO: 194321 - DNA, 24 bp, Artificial Sequence
  Description of Artificial Sequence: Synthetic oligonucleotide
ctggatgtcggaggagcacgcgga

SEQ ID NO: 194322 - DNA, 26 bp, Artificial Sequence
  Description of Artificial Sequence: Synthetic oligonucleotide
tggatgtcggaggagcacgcggactt

SEQ ID NO: 194323 - DNA, 25 bp, Artificial Sequence
  Description of Artificial Sequence: Synthetic oligonucleotide
ggatgtcggaggagcacgcggactt

SEQ ID NO: 194324 - DNA, 26 bp, Artificial Sequence
  Description of Artificial Sequence: Synthetic oligonucleotide
gatgtcggaggagcacgcggacttga

SEQ ID NO: 194325 - DNA, 27 bp, Artificial Sequence
  Description of Artificial Sequence: Synthetic oligonucleotide
atgtcggaggagcacgcggacttgaga

SEQ ID NO: 194326 - DNA, 26 bp, Artificial Sequence
  Description of Artificial Sequence: Synthetic oligonucleotide
tgtcggaggagcacgcggacttgaga

SEQ ID NO: 194327 - DNA, 25 bp, Artificial Sequence
  Description of Artificial Sequence: Synthetic oligonucleotide
gtcggaggagcacgcggacttgaga

SEQ ID NO: 194328 - DNA, 27 bp, Artificial Sequence
  Description of Artificial Sequence: Synthetic oligonucleotide
tcggaggagcacgcggacttgagagat

SEQ ID NO: 194329 - DNA, 26 bp, Artificial Sequence
  Description of Artificial Sequence: Synthetic oligonucleotide
cggaggagcacgcggacttgagagat

SEQ ID NO: 194330 - DNA, 26 bp, Artificial Sequence
  Description of Artificial Sequence: Synthetic oligonucleotide
ggaggagcacgcggacttgagagatc

SEQ ID NO: 194331 - DNA, 27 bp, Artificial Sequence
  Description of Artificial Sequence: Synthetic oligonucleotide
gaggagcacgcggacttgagagatcct

SEQ ID NO: 194332 - DNA, 29 bp, Artificial Sequence
  Description of Artificial Sequence: Synthetic oligonucleotide
aggagcacgcggacttgagagatcctttc

SEQ ID NO: 194333 - DNA, 28 bp, Artificial Sequence
  Description of Artificial Sequence: Synthetic oligonucleotide
ggagcacgcggacttgagagatcctttc

SEQ ID NO: 194334 - DNA, 28 bp, Artificial Sequence
  Description of Artificial Sequence: Synthetic oligonucleotide
gagcacgcggacttgagagatcctttcc

SEQ ID NO: 194335 - DNA, 29 bp, Artificial Sequence
  Description of Artificial Sequence: Synthetic oligonucleotide
agcacgcggacttgagagatcctttcctg

SEQ ID NO: 194336 - DNA, 28 bp, Artificial Sequence
  Description of Artificial Sequence: Synthetic oligonucleotide
gcacgcggacttgagagatcctttcctg

SEQ ID NO: 194337 - DNA, 30 bp, Artificial Sequence
  Description of Artificial Sequence: Synthetic oligonucleotide
cacgcggacttgagagatcctttcctgaag

SEQ ID NO: 194338 - DNA, 22 bp, Artificial Sequence
  Description of Artificial Sequence: Synthetic oligonucleotide
cggaggcggccttcctgcccaa

SEQ ID NO: 194339 - DNA, 23 bp, Artificial Sequence
  Description of Artificial Sequence: Synthetic oligonucleotide
ggaggcggccttcctgcccaagt

SEQ ID NO: 194340 - DNA, 23 bp, Artificial Sequence
  Description of Artificial Sequence: Synthetic oligonucleotide
gaggcggccttcctgcccaagtg

SEQ ID NO: 194341 - DNA, 23 bp, Artificial Sequence
  Description of Artificial Sequence: Synthetic oligonucleotide
aggcggccttcctgcccaagtgg

SEQ ID NO: 194342 - DNA, 22 bp, Artificial Sequence
  Description of Artificial Sequence: Synthetic oligonucleotide
ggcggccttcctgcccaagtgg

SEQ ID NO: 194343 - DNA, 23 bp, Artificial Sequence
  Description of Artificial Sequence: Synthetic oligonucleotide
gcggccttcctgcccaagtgggt

SEQ ID NO: 194344 - DNA, 23 bp, Artificial Sequence
  Description of Artificial Sequence: Synthetic oligonucleotide
cggccttcctgcccaagtgggtg

SEQ ID NO: 194345 - DNA, 23 bp, Artificial Sequence
  Description of Artificial Sequence: Synthetic oligonucleotide
ggccttcctgcccaagtgggtgg

SEQ ID NO: 194346 - DNA, 23 bp, Artificial Sequence
  Description of Artificial Sequence: Synthetic oligonucleotide
gccttcctgcccaagtgggtggg

SEQ ID NO: 194347 - DNA, 27 bp, Artificial Sequence
  Description of Artificial Sequence: Synthetic oligonucleotide
ccttcctgcccaagtgggtgggcatta

SEQ ID NO: 194348 - DNA, 29 bp, Artificial Sequence
  Description of Artificial Sequence: Synthetic oligonucleotide
cttcctgcccaagtgggtgggcattaatg

SEQ ID NO: 194349 - DNA, 29 bp, Artificial Sequence
  Description of Artificial Sequence: Synthetic oligonucleotide
ttcctgcccaagtgggtgggcattaatgc

SEQ ID NO: 194350 - DNA, 28 bp, Artificial Sequence
  Description of Artificial Sequence: Synthetic oligonucleotide
tcctgcccaagtgggtgggcattaatgc

SEQ ID NO: 194351 - DNA, 27 bp, Artificial Sequence
  Description of Artificial Sequence: Synthetic oligonucleotide
cctgcccaagtgggtgggcattaatgc

SEQ ID NO: 194352 - DNA, 28 bp, Artificial Sequence
  Description of Artificial Sequence: Synthetic oligonucleotide
ctgcccaagtgggtgggcattaatgcag

SEQ ID NO: 194353 - DNA, 29 bp, Artificial Sequence
  Description of Artificial Sequence: Synthetic oligonucleotide
tgcccaagtgggtgggcattaatgcagac

SEQ ID NO: 194354 - DNA, 28 bp, Artificial Sequence
  Description of Artificial Sequence: Synthetic oligonucleotide
gcccaagtgggtgggcattaatgcagac

SEQ ID NO: 194355 - DNA, 30 bp, Artificial Sequence
  Description of Artificial Sequence: Synthetic oligonucleotide
cccaagtgggtgggcattaatgcagacttg

SEQ ID NO: 194356 - DNA, 31 bp, Artificial Sequence
  Description of Artificial Sequence: Synthetic oligonucleotide
ccaagtgggtgggcattaatgcagacttgtc

SEQ ID NO: 194357 - DNA, 32 bp, Artificial Sequence
  Description of Artificial Sequence: Synthetic oligonucleotide
caagtgggtgggcattaatgcagacttgtctc

SEQ ID NO: 194358 - DNA, 32 bp, Artificial Sequence
  Description of Artificial Sequence: Synthetic oligonucleotide
aagtgggtgggcattaatgcagacttgtctcc

SEQ ID NO: 194359 - DNA, 22 bp, Artificial Sequence
  Description of Artificial Sequence: Synthetic oligonucleotide
catgcatgccgccctggcccca

SEQ ID NO: 194360 - DNA, 24 bp, Artificial Sequence
  Description of Artificial Sequence: Synthetic oligonucleotide
atgcatgccgccctggccccagaa

SEQ ID NO: 194361 - DNA, 23 bp, Artificial Sequence
  Description of Artificial Sequence: Synthetic oligonucleotide
tgcatgccgccctggccccagaa

SEQ ID NO: 194362 - DNA, 22 bp, Artificial Sequence
  Description of Artificial Sequence: Synthetic oligonucleotide
gcatgccgccctggccccagaa

SEQ ID NO: 194363 - DNA, 23 bp, Artificial Sequence
  Description of Artificial Sequence: Synthetic oligonucleotide
catgccgccctggccccagaagt

SEQ ID NO: 194364 - DNA, 23 bp, Artificial Sequence
  Description of Artificial Sequence: Synthetic oligonucleotide
atgccgccctggccccagaagtg

SEQ ID NO: 194365 - DNA, 22 bp, Artificial Sequence
  Description of Artificial Sequence: Synthetic oligonucleotide
tgccgccctggccccagaagtg

SEQ ID NO: 194366 - DNA, 21 bp, Artificial Sequence
  Description of Artificial Sequence: Synthetic oligonucleotide
gccgccctggccccagaagtg

SEQ ID NO: 194367 - DNA, 22 bp, Artificial Sequence
  Description of Artificial Sequence: Synthetic oligonucleotide
ccgccctggccccagaagtgga

SEQ ID NO: 194368 - DNA, 23 bp, Artificial Sequence
  Description of Artificial Sequence: Synthetic oligonucleotide
cgccctggccccagaagtggaca

SEQ ID NO: 194369 - DNA, 23 bp, Artificial Sequence
  Description of Artificial Sequence: Synthetic oligonucleotide
gccctggccccagaagtggacag

SEQ ID NO: 194370 - DNA, 23 bp, Artificial Sequence
  Description of Artificial Sequence: Synthetic oligonucleotide
ccctggccccagaagtggacagc

SEQ ID NO: 194371 - DNA, 23 bp, Artificial Sequence
  Description of Artificial Sequence: Synthetic oligonucleotide
cctggccccagaagtggacagcc

SEQ ID NO: 194372 - DNA, 30 bp, Artificial Sequence
  Description of Artificial Sequence: Synthetic oligonucleotide
agcttcacgactggatgtcggaggagtaag

SEQ ID NO: 194373 - DNA, 29 bp, Artificial Sequence
  Description of Artificial Sequence: Synthetic oligonucleotide
gcttcacgactggatgtcggaggagtaag

SEQ ID NO: 194374 - DNA, 29 bp, Artificial Sequence
  Description of Artificial Sequence: Synthetic oligonucleotide
cttcacgactggatgtcggaggagtaagc

SEQ ID NO: 194375 - DNA, 29 bp, Artificial Sequence
  Description of Artificial Sequence: Synthetic oligonucleotide
ttcacgactggatgtcggaggagtaagcg

SEQ ID NO: 194376 - DNA, 28 bp, Artificial Sequence
  Description of Artificial Sequence: Synthetic oligonucleotide
tcacgactggatgtcggaggagtaagcg

SEQ ID NO: 194377 - DNA, 27 bp, Artificial Sequence
  Description of Artificial Sequence: Synthetic oligonucleotide
cacgactggatgtcggaggagtaagcg

SEQ ID NO: 194378 - DNA, 27 bp, Artificial Sequence
  Description of Artificial Sequence: Synthetic oligonucleotide
acgactggatgtcggaggagtaagcgg

SEQ ID NO: 194379 - DNA, 27 bp, Artificial Sequence
  Description of Artificial Sequence: Synthetic oligonucleotide
cgactggatgtcggaggagtaagcgga

SEQ ID NO: 194380 - DNA, 27 bp, Artificial Sequence
  Description of Artificial Sequence: Synthetic oligonucleotide
gactggatgtcggaggagtaagcggac

SEQ ID NO: 194381 - DNA, 29 bp, Artificial Sequence
  Description of Artificial Sequence: Synthetic oligonucleotide
actggatgtcggaggagtaagcggacttg

SEQ ID NO: 194382 - DNA, 28 bp, Artificial Sequence
  Description of Artificial Sequence: Synthetic oligonucleotide
ctggatgtcggaggagtaagcggacttg

SEQ ID NO: 194383 - DNA, 29 bp, Artificial Sequence
  Description of Artificial Sequence: Synthetic oligonucleotide
tggatgtcggaggagtaagcggacttgag

SEQ ID NO: 194384 - DNA, 28 bp, Artificial Sequence
  Description of Artificial Sequence: Synthetic oligonucleotide
ggatgtcggaggagtaagcggacttgag

SEQ ID NO: 194385 - DNA, 29 bp, Artificial Sequence
  Description of Artificial Sequence: Synthetic oligonucleotide
gatgtcggaggagtaagcggacttgagag

SEQ ID NO: 194386 - DNA, 31 bp, Artificial Sequence
  Description of Artificial Sequence: Synthetic oligonucleotide
atgtcggaggagtaagcggacttgagagatc

SEQ ID NO: 194387 - DNA, 30 bp, Artificial Sequence
  Description of Artificial Sequence: Synthetic oligonucleotide
tgtcggaggagtaagcggacttgagagatc

SEQ ID NO: 194388 - DNA, 29 bp, Artificial Sequence
  Description of Artificial Sequence: Synthetic oligonucleotide
gtcggaggagtaagcggacttgagagatc

SEQ ID NO: 194389 - DNA, 29 bp, Artificial Sequence
  Description of Artificial Sequence: Synthetic oligonucleotide
tcggaggagtaagcggacttgagagatcc

SEQ ID NO: 194390 - DNA, 28 bp, Artificial Sequence
  Description of Artificial Sequence: Synthetic oligonucleotide
cggaggagtaagcggacttgagagatcc

SEQ ID NO: 194391 - DNA, 31 bp, Artificial Sequence
  Description of Artificial Sequence: Synthetic oligonucleotide
ggaggagtaagcggacttgagagatcctttc

SEQ ID NO: 194392 - DNA, 31 bp, Artificial Sequence
  Description of Artificial Sequence: Synthetic oligonucleotide
gaggagtaagcggacttgagagatcctttcc

SEQ ID NO: 194393 - DNA, 32 bp, Artificial Sequence
  Description of Artificial Sequence: Synthetic oligonucleotide
aggagtaagcggacttgagagatcctttcctg

SEQ ID NO: 194394 - DNA, 31 bp, Artificial Sequence
  Description of Artificial Sequence: Synthetic oligonucleotide
ggagtaagcggacttgagagatcctttcctg

SEQ ID NO: 194395 - DNA, 33 bp, Artificial Sequence
  Description of Artificial Sequence: Synthetic oligonucleotide
gagtaagcggacttgagagatcctttcctgaag

SEQ ID NO: 194396 - DNA, 33 bp, Artificial Sequence
  Description of Artificial Sequence: Synthetic oligonucleotide
agtaagcggacttgagagatcctttcctgaagc

SEQ ID NO: 194397 - DNA, 32 bp, Artificial Sequence
  Description of Artificial Sequence: Synthetic oligonucleotide
gtaagcggacttgagagatcctttcctgaagc

SEQ ID NO: 194398 - DNA, 33 bp, Artificial Sequence
  Description of Artificial Sequence: Synthetic oligonucleotide
taagcggacttgagagatcctttcctgaagctc

SEQ ID NO: 194399 - DNA, 32 bp, Artificial Sequence
  Description of Artificial Sequence: Synthetic oligonucleotide
aagcggacttgagagatcctttcctgaagctc

SEQ ID NO: 194400 - DNA, 31 bp, Artificial Sequence
  Description of Artificial Sequence: Synthetic oligonucleotide
agcggacttgagagatcctttcctgaagctc

SEQ ID NO: 194401 - DNA, 33 bp, Artificial Sequence
  Description of Artificial Sequence: Synthetic oligonucleotide
aaagactttgccctgctcacacagtgcaacaac

SEQ ID NO: 194402 - DNA, 32 bp, Artificial Sequence
  Description of Artificial Sequence: Synthetic oligonucleotide
aagactttgccctgctcacacagtgcaacaac

SEQ ID NO: 194403 - DNA, 31 bp, Artificial Sequence
  Description of Artificial Sequence: Synthetic oligonucleotide
agactttgccctgctcacacagtgcaacaac

SEQ ID NO: 194404 - DNA, 30 bp, Artificial Sequence
  Description of Artificial Sequence: Synthetic oligonucleotide
gactttgccctgctcacacagtgcaacaac

SEQ ID NO: 194405 - DNA, 30 bp, Artificial Sequence
  Description of Artificial Sequence: Synthetic oligonucleotide
actttgccctgctcacacagtgcaacaacc

SEQ ID NO: 194406 - DNA, 29 bp, Artificial Sequence
  Description of Artificial Sequence: Synthetic oligonucleotide
ctttgccctgctcacacagtgcaacaacc

SEQ ID NO: 194407 - DNA, 30 bp, Artificial Sequence
  Description of Artificial Sequence: Synthetic oligonucleotide
tttgccctgctcacacagtgcaacaaccac

SEQ ID NO: 194408 - DNA, 29 bp, Artificial Sequence
  Description of Artificial Sequence: Synthetic oligonucleotide
ttgccctgctcacacagtgcaacaaccac

SEQ ID NO: 194409 - DNA, 28 bp, Artificial Sequence
  Description of Artificial Sequence: Synthetic oligonucleotide
tgccctgctcacacagtgcaacaaccac

SEQ ID NO: 194410 - DNA, 27 bp, Artificial Sequence
  Description of Artificial Sequence: Synthetic oligonucleotide
gccctgctcacacagtgcaacaaccac

SEQ ID NO: 194411 - DNA, 28 bp, Artificial Sequence
  Description of Artificial Sequence: Synthetic oligonucleotide
ccctgctcacacagtgcaacaaccacac

SEQ ID NO: 194412 - DNA, 28 bp, Artificial Sequence
  Description of Artificial Sequence: Synthetic oligonucleotide
cctgctcacacagtgcaacaaccacacc

SEQ ID NO: 194413 - DNA, 33 bp, Artificial Sequence
  Description of Artificial Sequence: Synthetic oligonucleotide
ctgctcacacagtgcaacaaccacaccattatg

SEQ ID NO: 194414 - DNA, 34 bp, Artificial Sequence
  Description of Artificial Sequence: Synthetic oligonucleotide
tgctcacacagtgcaacaaccacaccattatgac

SEQ ID NO: 194415 - DNA, 33 bp, Artificial Sequence
  Description of Artificial Sequence: Synthetic oligonucleotide
gctcacacagtgcaacaaccacaccattatgac

SEQ ID NO: 194416 - DNA, 33 bp, Artificial Sequence
  Description of Artificial Sequence: Synthetic oligonucleotide
ctcacacagtgcaacaaccacaccattatgacc

SEQ ID NO: 194417 - DNA, 36 bp, Artificial Sequence
  Description of Artificial Sequence: Synthetic oligonucleotide
tcacacagtgcaacaaccacaccattatgaccattg

SEQ ID NO: 194418 - DNA, 35 bp, Artificial Sequence
  Description of Artificial Sequence: Synthetic oligonucleotide
cacacagtgcaacaaccacaccattatgaccattg

SEQ ID NO: 194419 - DNA, 35 bp, Artificial Sequence
  Description of Artificial Sequence: Synthetic oligonucleotide
acacagtgcaacaaccacaccattatgaccattgg

SEQ ID NO: 194420 - DNA, 34 bp, Artificial Sequence
  Description of Artificial Sequence: Synthetic oligonucleotide
cacagtgcaacaaccacaccattatgaccattgg

SEQ ID NO: 194421 - DNA, 34 bp, Artificial Sequence
  Description of Artificial Sequence: Synthetic oligonucleotide
acagtgcaacaaccacaccattatgaccattggc

SEQ ID NO: 194422 - DNA, 33 bp, Artificial Sequence
  Description of Artificial Sequence: Synthetic oligonucleotide
cagtgcaacaaccacaccattatgaccattggc

SEQ ID NO: 194423 - DNA, 34 bp, Artificial Sequence
  Description of Artificial Sequence: Synthetic oligonucleotide
agtgcaacaaccacaccattatgaccattggcac

SEQ ID NO: 194424 - DNA, 33 bp, Artificial Sequence
  Description of Artificial Sequence: Synthetic oligonucleotide
gtgcaacaaccacaccattatgaccattggcac

SEQ ID NO: 194425 - DNA, 33 bp, Artificial Sequence
  Description of Artificial Sequence: Synthetic oligonucleotide
tgcaacaaccacaccattatgaccattggcacc

SEQ ID NO: 194426 - DNA, 32 bp, Artificial Sequence
  Description of Artificial Sequence: Synthetic oligonucleotide
gcaacaaccacaccattatgaccattggcacc

SEQ ID NO: 194427 - DNA, 34 bp, Artificial Sequence
  Description of Artificial Sequence: Synthetic oligonucleotide
caacaaccacaccattatgaccattggcaccttc

SEQ ID NO: 194428 - DNA, 34 bp, Artificial Sequence
  Description of Artificial Sequence: Synthetic oligonucleotide
aacaaccacaccattatgaccattggcaccttcg

SEQ ID NO: 194429 - DNA, 33 bp, Artificial Sequence
  Description of Artificial Sequence: Synthetic oligonucleotide
acaaccacaccattatgaccattggcaccttcg

SEQ ID NO: 194430 - DNA, 23 bp, Artificial Sequence
  Description of Artificial Sequence: Synthetic oligonucleotide
tgtggtgggcgacagcgcctacc

SEQ ID NO: 194431 - DNA, 22 bp, Artificial Sequence
  Description of Artificial Sequence: Synthetic oligonucleotide
gtggtgggcgacagcgcctacc

SEQ ID NO: 194432 - DNA, 22 bp, Artificial Sequence
  Description of Artificial Sequence: Synthetic oligonucleotide
tggtgggcgacagcgcctaccg

SEQ ID NO: 194433 - DNA, 21 bp, Artificial Sequence
  Description of Artificial Sequence: Synthetic oligonucleotide
ggtgggcgacagcgcctaccg

SEQ ID NO: 194434 - DNA, 21 bp, Artificial Sequence
  Description of Artificial Sequence: Synthetic oligonucleotide
gtgggcgacagcgcctaccgc

SEQ ID NO: 194435 - DNA, 21 bp, Artificial Sequence
  Description of Artificial Sequence: Synthetic oligonucleotide
tgggcgacagcgcctaccgcc

SEQ ID NO: 194436 - DNA, 20 bp, Artificial Sequence
  Description of Artificial Sequence: Synthetic oligonucleotide
gggcgacagcgcctaccgcc

SEQ ID NO: 194437 - DNA, 20 bp, Artificial Sequence
  Description of Artificial Sequence: Synthetic oligonucleotide
ggcgacagcgcctaccgccg

SEQ ID NO: 194438 - DNA, 20 bp, Artificial Sequence
  Description of Artificial Sequence: Synthetic oligonucleotide
gcgacagcgcctaccgccgg

SEQ ID NO: 194439 - DNA, 21 bp, Artificial Sequence
  Description of Artificial Sequence: Synthetic oligonucleotide
cgacagcgcctaccgccggca

SEQ ID NO: 194440 - DNA, 21 bp, Artificial Sequence
  Description of Artificial Sequence: Synthetic oligonucleotide
gacagcgcctaccgccggcag

SEQ ID NO: 194441 - DNA, 21 bp, Artificial Sequence
  Description of Artificial Sequence: Synthetic oligonucleotide
acagcgcctaccgccggcagg

SEQ ID NO: 194442 - DNA, 20 bp, Artificial Sequence
  Description of Artificial Sequence: Synthetic oligonucleotide
cagcgcctaccgccggcagg

SEQ ID NO: 194443 - DNA, 20 bp, Artificial Sequence
  Description of Artificial Sequence: Synthetic oligonucleotide
agcgcctaccgccggcaggc

SEQ ID NO: 194444 - DNA, 20 bp, Artificial Sequence
  Description of Artificial Sequence: Synthetic oligonucleotide
gcgcctaccgccggcaggct

SEQ ID NO: 194445 - DNA, 21 bp, Artificial Sequence
  Description of Artificial Sequence: Synthetic oligonucleotide
cgcctaccgccggcaggccat

SEQ ID NO: 194446 - DNA, 21 bp, Artificial Sequence
  Description of Artificial Sequence: Synthetic oligonucleotide
gcctaccgccggcaggccatg

SEQ ID NO: 194447 - DNA, 22 bp, Artificial Sequence
  Description of Artificial Sequence: Synthetic oligonucleotide
cctaccgccggcaggccatgga

SEQ ID NO: 194448 - DNA, 23 bp, Artificial Sequence
  Description of Artificial Sequence: Synthetic oligonucleotide
ctaccgccggcaggccatggact

SEQ ID NO: 194449 - DNA, 23 bp, Artificial Sequence
  Description of Artificial Sequence: Synthetic oligonucleotide
taccgccggcaggccatggactg

SEQ ID NO: 194450 - DNA, 22 bp, Artificial Sequence
  Description of Artificial Sequence: Synthetic oligonucleotide
accgccggcaggccatggactg

SEQ ID NO: 194451 - DNA, 21 bp, Artificial Sequence
  Description of Artificial Sequence: Synthetic oligonucleotide
ccgccggcaggccatggactg

SEQ ID NO: 194452 - DNA, 23 bp, Artificial Sequence
  Description of Artificial Sequence: Synthetic oligonucleotide
cgccggcaggccatggactggtt

SEQ ID NO: 194453 - DNA, 23 bp, Artificial Sequence
  Description of Artificial Sequence: Synthetic oligonucleotide
gccggcaggccatggactggttc

SEQ ID NO: 194454 - DNA, 27 bp, Artificial Sequence
  Description of Artificial Sequence: Synthetic oligonucleotide
ccgggcctttatcctgcctgccatgta

SEQ ID NO: 194455 - DNA, 28 bp, Artificial Sequence
  Description of Artificial Sequence: Synthetic oligonucleotide
cgggcctttatcctgcctgccatgtatg

SEQ ID NO: 194456 - DNA, 28 bp, Artificial Sequence
  Description of Artificial Sequence: Synthetic oligonucleotide
gggcctttatcctgcctgccatgtatgc

SEQ ID NO: 194457 - DNA, 28 bp, Artificial Sequence
  Description of Artificial Sequence: Synthetic oligonucleotide
ggcctttatcctgcctgccatgtatgcc

SEQ ID NO: 194458 - DNA, 28 bp, Artificial Sequence
  Description of Artificial Sequence: Synthetic oligonucleotide
gcctttatcctgcctgccatgtatgccg

SEQ ID NO: 194459 - DNA, 28 bp, Artificial Sequence
  Description of Artificial Sequence: Synthetic oligonucleotide
cctttatcctgcctgccatgtatgccgc

SEQ ID NO: 194460 - DNA, 28 bp, Artificial Sequence
  Description of Artificial Sequence: Synthetic oligonucleotide
ctttatcctgcctgccatgtatgccgcc

SEQ ID NO: 194461 - DNA, 28 bp, Artificial Sequence
  Description of Artificial Sequence: Synthetic oligonucleotide
tttatcctgcctgccatgtatgccgccc

SEQ ID NO: 194462 - DNA, 27 bp, Artificial Sequence
  Description of Artificial Sequence: Synthetic oligonucleotide
ttatcctgcctgccatgtatgccgccc

SEQ ID NO: 194463 - DNA, 27 bp, Artificial Sequence
  Description of Artificial Sequence: Synthetic oligonucleotide
tatcctgcctgccatgtatgccgccct

SEQ ID NO: 194464 - DNA, 26 bp, Artificial Sequence
  Description of Artificial Sequence: Synthetic oligonucleotide
atcctgcctgccatgtatgccgccct

SEQ ID NO: 194465 - DNA, 25 bp, Artificial Sequence
  Description of Artificial Sequence: Synthetic oligonucleotide
tcctgcctgccatgtatgccgccct

SEQ ID NO: 194466 - DNA, 24 bp, Artificial Sequence
  Description of Artificial Sequence: Synthetic oligonucleotide
cctgcctgccatgtatgccgccct

SEQ ID NO: 194467 - DNA, 24 bp, Artificial Sequence
  Description of Artificial Sequence: Synthetic oligonucleotide
ctgcctgccatgtatgccgccctg

SEQ ID NO: 194468 - DNA, 24 bp, Artificial Sequence
  Description of Artificial Sequence: Synthetic oligonucleotide
tgcctgccatgtatgccgccctgg

SEQ ID NO: 194469 - DNA, 23 bp, Artificial Sequence
  Description of Artificial Sequence: Synthetic oligonucleotide
gcctgccatgtatgccgccctgg

SEQ ID NO: 194470 - DNA, 23 bp, Artificial Sequence
  Description of Artificial Sequence: Synthetic oligonucleotide
cctgccatgtatgccgccctggc

SEQ ID NO: 194471 - DNA, 23 bp, Artificial Sequence
  Description of Artificial Sequence: Synthetic oligonucleotide
ctgccatgtatgccgccctggcc

SEQ ID NO: 194472 - DNA, 23 bp, Artificial Sequence
  Description of Artificial Sequence: Synthetic oligonucleotide
tgccatgtatgccgccctggccc

SEQ ID NO: 194473 - DNA, 22 bp, Artificial Sequence
  Description of Artificial Sequence: Synthetic oligonucleotide
gccatgtatgccgccctggccc

SEQ ID NO: 194474 - DNA, 22 bp, Artificial Sequence
  Description of Artificial Sequence: Synthetic oligonucleotide
ccatgtatgccgccctggcccc

SEQ ID NO: 194475 - DNA, 22 bp, Artificial Sequence
  Description of Artificial Sequence: Synthetic oligonucleotide
catgtatgccgccctggccccg

SEQ ID NO: 194476 - DNA, 26 bp, Artificial Sequence
  Description of Artificial Sequence: Synthetic oligonucleotide
atgtatgccgccctggccccggtatt

SEQ ID NO: 194477 - DNA, 25 bp, Artificial Sequence
  Description of Artificial Sequence: Synthetic oligonucleotide
tgtatgccgccctggccccggtatt

SEQ ID NO: 194478 - DNA, 24 bp, Artificial Sequence
  Description of Artificial Sequence: Synthetic oligonucleotide
gtatgccgccctggccccggtatt

SEQ ID NO: 194479 - DNA, 24 bp, Artificial Sequence
  Description of Artificial Sequence: Synthetic oligonucleotide
tatgccgccctggccccggtattc

SEQ ID NO: 194480 - DNA, 29 bp, Artificial Sequence
  Description of Artificial Sequence: Synthetic oligonucleotide
actgtctacctggccaacttcaccctgac

SEQ ID NO: 194481 - DNA, 28 bp, Artificial Sequence
  Description of Artificial Sequence: Synthetic oligonucleotide
ctgtctacctggccaacttcaccctgac

SEQ ID NO: 194482 - DNA, 29 bp, Artificial Sequence
  Description of Artificial Sequence: Synthetic oligonucleotide
tgtctacctggccaacttcaccctgacag

SEQ ID NO: 194483 - DNA, 28 bp, Artificial Sequence
  Description of Artificial Sequence: Synthetic oligonucleotide
gtctacctggccaacttcaccctgacag

SEQ ID NO: 194484 - DNA, 29 bp, Artificial Sequence
  Description of Artificial Sequence: Synthetic oligonucleotide
tctacctggccaacttcaccctgacagac

SEQ ID NO: 194485 - DNA, 28 bp, Artificial Sequence
  Description of Artificial Sequence: Synthetic oligonucleotide
ctacctggccaacttcaccctgacagac

SEQ ID NO: 194486 - DNA, 29 bp, Artificial Sequence
  Description of Artificial Sequence: Synthetic oligonucleotide
tacctggccaacttcaccctgacagactc

SEQ ID NO: 194487 - DNA, 28 bp, Artificial Sequence
  Description of Artificial Sequence: Synthetic oligonucleotide
acctggccaacttcaccctgacagactc

SEQ ID NO: 194488 - DNA, 27 bp, Artificial Sequence
  Description of Artificial Sequence: Synthetic oligonucleotide
cctggccaacttcaccctgacagactc

SEQ ID NO: 194489 - DNA, 28 bp, Artificial Sequence
  Description of Artificial Sequence: Synthetic oligonucleotide
ctggccaacttcaccctgacagactctg

SEQ ID NO: 194490 - DNA, 29 bp, Artificial Sequence
  Description of Artificial Sequence: Synthetic oligonucleotide
tggccaacttcaccctgacagactctgag

SEQ ID NO: 194491 - DNA, 28 bp, Artificial Sequence
  Description of Artificial Sequence: Synthetic oligonucleotide
ggccaacttcaccctgacagactctgag

SEQ ID NO: 194492 - DNA, 30 bp, Artificial Sequence
  Description of Artificial Sequence: Synthetic oligonucleotide
gccaacttcaccctgacagactctgagttc

SEQ ID NO: 194493 - DNA, 30 bp, Artificial Sequence
  Description of Artificial Sequence: Synthetic oligonucleotide
ccaacttcaccctgacagactctgagttcc

SEQ ID NO: 194494 - DNA, 31 bp, Artificial Sequence
  Description of Artificial Sequence: Synthetic oligonucleotide
caacttcaccctgacagactctgagttcctg

SEQ ID NO: 194495 - DNA, 33 bp, Artificial Sequence
  Description of Artificial Sequence: Synthetic oligonucleotide
aacttcaccctgacagactctgagttcctgaag

SEQ ID NO: 194496 - DNA, 32 bp, Artificial Sequence
  Description of Artificial Sequence: Synthetic oligonucleotide
acttcaccctgacagactctgagttcctgaag

SEQ ID NO: 194497 - DNA, 31 bp, Artificial Sequence
  Description of Artificial Sequence: Synthetic oligonucleotide
cttcaccctgacagactctgagttcctgaag

SEQ ID NO: 194498 - DNA, 33 bp, Artificial Sequence
  Description of Artificial Sequence: Synthetic oligonucleotide
ttcaccctgacagactctgagttcctgaagatc

SEQ ID NO: 194499 - DNA, 32 bp, Artificial Sequence
  Description of Artificial Sequence: Synthetic oligonucleotide
tcaccctgacagactctgagttcctgaagatc

SEQ ID NO: 194500 - DNA, 31 bp, Artificial Sequence
  Description of Artificial Sequence: Synthetic oligonucleotide
caccctgacagactctgagttcctgaagatc

SEQ ID NO: 194501 - DNA, 36 bp, Artificial Sequence
  Description of Artificial Sequence: Synthetic oligonucleotide
accctgacagactctgagttcctgaagatctttaag

SEQ ID NO: 194502 - DNA, 35 bp, Artificial Sequence
  Description of Artificial Sequence: Synthetic oligonucleotide
ccctgacagactctgagttcctgaagatctttaag

SEQ ID NO: 194503 - DNA, 35 bp, Artificial Sequence
  Description of Artificial Sequence: Synthetic oligonucleotide
cctgacagactctgagttcctgaagatctttaagc

SEQ ID NO: 194504 - DNA, 35 bp, Artificial Sequence
  Description of Artificial Sequence: Synthetic oligonucleotide
ctgacagactctgagttcctgaagatctttaagcc

SEQ ID NO: 194505 - DNA, 35 bp, Artificial Sequence
  Description of Artificial Sequence: Synthetic oligonucleotide
tgacagactctgagttcctgaagatctttaagccg

SEQ ID NO: 194506 - DNA, 34 bp, Artificial Sequence
  Description of Artificial Sequence: Synthetic oligonucleotide
gacagactctgagttcctgaagatctttaagccg

SEQ ID NO: 194507 - DNA, 34 bp, Artificial Sequence
  Description of Artificial Sequence: Synthetic oligonucleotide
acagactctgagttcctgaagatctttaagccgg

SEQ ID NO: 194508 - DNA, 23 bp, Artificial Sequence
  Description of Artificial Sequence: Synthetic oligonucleotide
ccagcaccctgcttccctctccc

SEQ ID NO: 194509 - DNA, 23 bp, Artificial Sequence
  Description of Artificial Sequence: Synthetic oligonucleotide
cagcaccctgcttccctctcccg

SEQ ID NO: 194510 - DNA, 24 bp, Artificial Sequence
  Description of Artificial Sequence: Synthetic oligonucleotide
agcaccctgcttccctctcccgca

SEQ ID NO: 194511 - DNA, 23 bp, Artificial Sequence
  Description of Artificial Sequence: Synthetic oligonucleotide
gcaccctgcttccctctcccgca

SEQ ID NO: 194512 - DNA, 23 bp, Artificial Sequence
  Description of Artificial Sequence: Synthetic oligonucleotide
caccctgcttccctctcccgcac

SEQ ID NO: 194513 - DNA, 24 bp, Artificial Sequence
  Description of Artificial Sequence: Synthetic oligonucleotide
accctgcttccctctcccgcacct

SEQ ID NO: 194514 - DNA, 23 bp, Artificial Sequence
  Description of Artificial Sequence: Synthetic oligonucleotide
ccctgcttccctctcccgcacct

SEQ ID NO: 194515 - DNA, 23 bp, Artificial Sequence
  Description of Artificial Sequence: Synthetic oligonucleotide
cctgcttccctctcccgcacctg

SEQ ID NO: 194516 - DNA, 24 bp, Artificial Sequence
  Description of Artificial Sequence: Synthetic oligonucleotide
ctgcttccctctcccgcacctgga

SEQ ID NO: 194517 - DNA, 25 bp, Artificial Sequence
  Description of Artificial Sequence: Synthetic oligonucleotide
tgcttccctctcccgcacctggact

SEQ ID NO: 194518 - DNA, 24 bp, Artificial Sequence
  Description of Artificial Sequence: Synthetic oligonucleotide
gcttccctctcccgcacctggact

SEQ ID NO: 194519 - DNA, 25 bp, Artificial Sequence
  Description of Artificial Sequence: Synthetic oligonucleotide
cttccctctcccgcacctggactgt

SEQ ID NO: 194520 - DNA, 27 bp, Artificial Sequence
  Description of Artificial Sequence: Synthetic oligonucleotide
ttccctctcccgcacctggactgtcta

SEQ ID NO: 194521 - DNA, 26 bp, Artificial Sequence
  Description of Artificial Sequence: Synthetic oligonucleotide
tccctctcccgcacctggactgtcta

SEQ ID NO: 194522 - DNA, 25 bp, Artificial Sequence
  Description of Artificial Sequence: Synthetic oligonucleotide
ccctctcccgcacctggactgtcta

SEQ ID NO: 194523 - DNA, 25 bp, Artificial Sequence
  Description of Artificial Sequence: Synthetic oligonucleotide
cctctcccgcacctggactgtctac

SEQ ID NO: 194524 - DNA, 25 bp, Artificial Sequence
  Description of Artificial Sequence: Synthetic oligonucleotide
ctctcccgcacctggactgtctacc

SEQ ID NO: 194525 - DNA, 25 bp, Artificial Sequence
  Description of Artificial Sequence: Synthetic oligonucleotide
tctcccgcacctggactgtctaccc

SEQ ID NO: 194526 - DNA, 24 bp, Artificial Sequence
  Description of Artificial Sequence: Synthetic oligonucleotide
ctcccgcacctggactgtctaccc

SEQ ID NO: 194527 - DNA, 27 bp, Artificial Sequence
  Description of Artificial Sequence: Synthetic oligonucleotide
tcccgcacctggactgtctaccccaat

SEQ ID NO: 194528 - DNA, 26 bp, Artificial Sequence
  Description of Artificial Sequence: Synthetic oligonucleotide
cccgcacctggactgtctaccccaat

SEQ ID NO: 194529 - DNA, 26 bp, Artificial Sequence
  Description of Artificial Sequence: Synthetic oligonucleotide
ccgcacctggactgtctaccccaatg

SEQ ID NO: 194530 - DNA, 26 bp, Artificial Sequence
  Description of Artificial Sequence: Synthetic oligonucleotide
cgcacctggactgtctaccccaatgg

SEQ ID NO: 194531 - DNA, 34 bp, Artificial Sequence
  Description of Artificial Sequence: Synthetic oligonucleotide
atgatgggctcttggaagcactgtctttttagcg

SEQ ID NO: 194532 - DNA, 33 bp, Artificial Sequence
  Description of Artificial Sequence: Synthetic oligonucleotide
tgatgggctcttggaagcactgtctttttagcg

SEQ ID NO: 194533 - DNA, 32 bp, Artificial Sequence
  Description of Artificial Sequence: Synthetic oligonucleotide
gatgggctcttggaagcactgtctttttagcg

SEQ ID NO: 194534 - DNA, 32 bp, Artificial Sequence
  Description of Artificial Sequence: Synthetic oligonucleotide
atgggctcttggaagcactgtctttttagcgc

SEQ ID NO: 194535 - DNA, 31 bp, Artificial Sequence
  Description of Artificial Sequence: Synthetic oligonucleotide
tgggctcttggaagcactgtctttttagcgc

SEQ ID NO: 194536 - DNA, 30 bp, Artificial Sequence
  Description of Artificial Sequence: Synthetic oligonucleotide
gggctcttggaagcactgtctttttagcgc

SEQ ID NO: 194537 - DNA, 30 bp, Artificial Sequence
  Description of Artificial Sequence: Synthetic oligonucleotide
ggctcttggaagcactgtctttttagcgcg

SEQ ID NO: 194538 - DNA, 31 bp, Artificial Sequence
  Description of Artificial Sequence: Synthetic oligonucleotide
gctcttggaagcactgtctttttagcgcgtc

SEQ ID NO: 194539 - DNA, 32 bp, Artificial Sequence
  Description of Artificial Sequence: Synthetic oligonucleotide
ctcttggaagcactgtctttttagcgcgtctc

SEQ ID NO: 194540 - DNA, 36 bp, Artificial Sequence
  Description of Artificial Sequence: Synthetic oligonucleotide
tcttggaagcactgtctttttagcgcgtctcttatc

SEQ ID NO: 194541 - DNA, 35 bp, Artificial Sequence
  Description of Artificial Sequence: Synthetic oligonucleotide
cttggaagcactgtctttttagcgcgtctcttatc

SEQ ID NO: 194542 - DNA, 36 bp, Artificial Sequence
  Description of Artificial Sequence: Synthetic oligonucleotide
ttggaagcactgtctttttagcgcgtctcttatctc

SEQ ID NO: 194543 - DNA, 35 bp, Artificial Sequence
  Description of Artificial Sequence: Synthetic oligonucleotide
tggaagcactgtctttttagcgcgtctcttatctc

SEQ ID NO: 194544 - DNA, 34 bp, Artificial Sequence
  Description of Artificial Sequence: Synthetic oligonucleotide
ggaagcactgtctttttagcgcgtctcttatctc

SEQ ID NO: 194545 - DNA, 35 bp, Artificial Sequence
  Description of Artificial Sequence: Synthetic oligonucleotide
gaagcactgtctttttagcgcgtctcttatctctg

SEQ ID NO: 194546 - DNA, 35 bp, Artificial Sequence
  Description of Artificial Sequence: Synthetic oligonucleotide
aagcactgtctttttagcgcgtctcttatctctgc

SEQ ID NO: 194547 - DNA, 34 bp, Artificial Sequence
  Description of Artificial Sequence: Synthetic oligonucleotide
agcactgtctttttagcgcgtctcttatctctgc

SEQ ID NO: 194548 - DNA, 33 bp, Artificial Sequence
  Description of Artificial Sequence: Synthetic oligonucleotide
gcactgtctttttagcgcgtctcttatctctgc

SEQ ID NO: 194549 - DNA, 33 bp, Artificial Sequence
  Description of Artificial Sequence: Synthetic oligonucleotide
cactgtctttttagcgcgtctcttatctctgcc

SEQ ID NO: 194550 - DNA, 33 bp, Artificial Sequence
  Description of Artificial Sequence: Synthetic oligonucleotide
actgtctttttagcgcgtctcttatctctgccc

SEQ ID NO: 194551 - DNA, 32 bp, Artificial Sequence
  Description of Artificial Sequence: Synthetic oligonucleotide
ctgtctttttagcgcgtctcttatctctgccc

SEQ ID NO: 194552 - DNA, 33 bp, Artificial Sequence
  Description of Artificial Sequence: Synthetic oligonucleotide
tgtctttttagcgcgtctcttatctctgccctg

SEQ ID NO: 194553 - DNA, 32 bp, Artificial Sequence
  Description of Artificial Sequence: Synthetic oligonucleotide
gtctttttagcgcgtctcttatctctgccctg

SEQ ID NO: 194554 - DNA, 38 bp, Artificial Sequence
  Description of Artificial Sequence: Synthetic oligonucleotide
tctttttagcgcgtctcttatctctgccctgatttttg

SEQ ID NO: 194555 - DNA, 37 bp, Artificial Sequence
  Description of Artificial Sequence: Synthetic oligonucleotide
ctttttagcgcgtctcttatctctgccctgatttttg

SEQ ID NO: 194556 - DNA, 42 bp, Artificial Sequence
  Description of Artificial Sequence: Synthetic oligonucleotide
tttttagcgcgtctcttatctctgccctgatttttgtatttg

SEQ ID NO: 194557 - DNA, 41 bp, Artificial Sequence
  Description of Artificial Sequence: Synthetic oligonucleotide
ttttagcgcgtctcttatctctgccctgatttttgtatttg

SEQ ID NO: 194558 - DNA, 40 bp, Artificial Sequence
  Description of Artificial Sequence: Synthetic oligonucleotide
tttagcgcgtctcttatctctgccctgatttttgtatttg

SEQ ID NO: 194559 - DNA, 39 bp, Artificial Sequence
  Description of Artificial Sequence: Synthetic oligonucleotide
ttagcgcgtctcttatctctgccctgatttttgtatttg

SEQ ID NO: 194560 - DNA, 38 bp, Artificial Sequence
  Description of Artificial Sequence: Synthetic oligonucleotide
tagcgcgtctcttatctctgccctgatttttgtatttg

SEQ ID NO: 194561 - DNA, 37 bp, Artificial Sequence
  Description of Artificial Sequence: Synthetic oligonucleotide
agcgcgtctcttatctctgccctgatttttgtatttg

SEQ ID NO: 194562 - DNA, 36 bp, Artificial Sequence
  Description of Artificial Sequence: Synthetic oligonucleotide
gcgcgtctcttatctctgccctgatttttgtatttg

SEQ ID NO: 194563 - DNA, 40 bp, Artificial Sequence
  Description of Artificial Sequence: Synthetic oligonucleotide
cgcgtctcttatctctgccctgatttttgtatttgtttac

SEQ ID NO: 194564 - DNA, 44 bp, Artificial Sequence
  Description of Artificial Sequence: Synthetic oligonucleotide
gcgtctcttatctctgccctgatttttgtatttgtttacaatac

SEQ ID NO: 194565 - DNA, 45 bp, Artificial Sequence
  Description of Artificial Sequence: Synthetic oligonucleotide
cgtctcttatctctgccctgatttttgtatttgtttacaatactg

SEQ ID NO: 194566 - DNA, 46 bp, Artificial Sequence
  Description of Artificial Sequence: Synthetic oligonucleotide
gtctcttatctctgccctgatttttgtatttgtttacaatactgag

SEQ ID NO: 194567 - DNA, 50 bp, Artificial Sequence
  Description of Artificial Sequence: Synthetic oligonucleotide
tctcttatctctgccctgatttttgtatttgtttacaatactgagttatg

SEQ ID NO: 194568 - DNA, 49 bp, Artificial Sequence
  Description of Artificial Sequence: Synthetic oligonucleotide
ctcttatctctgccctgatttttgtatttgtttacaatactgagttatg

SEQ ID NO: 194569 - DNA, 49 bp, Artificial Sequence
  Description of Artificial Sequence: Synthetic oligonucleotide
tcttatctctgccctgatttttgtatttgtttacaatactgagttatgg

SEQ ID NO: 194570 - DNA, 48 bp, Artificial Sequence
  Description of Artificial Sequence: Synthetic oligonucleotide
cttatctctgccctgatttttgtatttgtttacaatactgagttatgg

SEQ ID NO: 194571 - DNA, 48 bp, Artificial Sequence
  Description of Artificial Sequence: Synthetic oligonucleotide
ttatctctgccctgatttttgtatttgtttacaatactgagttatggg

SEQ ID NO: 194572 - DNA, 47 bp, Artificial Sequence
  Description of Artificial Sequence: Synthetic oligonucleotide
tatctctgccctgatttttgtatttgtttacaatactgagttatggg

SEQ ID NO: 194573 - DNA, 46 bp, Artificial Sequence
  Description of Artificial Sequence: Synthetic oligonucleotide
atctctgccctgatttttgtatttgtttacaatactgagttatggg

SEQ ID NO: 194574 - DNA, 45 bp, Artificial Sequence
  Description of Artificial Sequence: Synthetic oligonucleotide
tctctgccctgatttttgtatttgtttacaatactgagttatggg

SEQ ID NO: 194575 - DNA, 44 bp, Artificial Sequence
  Description of Artificial Sequence: Synthetic oligonucleotide
ctctgccctgatttttgtatttgtttacaatactgagttatggg

SEQ ID NO: 194576 - DNA, 45 bp, Artificial Sequence
  Description of Artificial Sequence: Synthetic oligonucleotide
tctgccctgatttttgtatttgtttacaatactgagttatgggag

SEQ ID NO: 194577 - DNA, 44 bp, Artificial Sequence
  Description of Artificial Sequence: Synthetic oligonucleotide
ctgccctgatttttgtatttgtttacaatactgagttatgggag

SEQ ID NO: 194578 - DNA, 50 bp, Artificial Sequence
  Description of Artificial Sequence: Synthetic oligonucleotide
tgccctgatttttgtatttgtttacaatactgagttatgggagaataaac

SEQ ID NO: 194579 - DNA, 49 bp, Artificial Sequence
  Description of Artificial Sequence: Synthetic oligonucleotide
gccctgatttttgtatttgtttacaatactgagttatgggagaataaac

SEQ ID NO: 194580 - DNA, 49 bp, Artificial Sequence
  Description of Artificial Sequence: Synthetic oligonucleotide
ccctgatttttgtatttgtttacaatactgagttatgggagaataaacg

SEQ ID NO: 194581 - DNA, 53 bp, Artificial Sequence
  Description of Artificial Sequence: Synthetic oligonucleotide
cctgatttttgtatttgtttacaatactgagttatgggagaataaacgttttc

SEQ ID NO: 194582 - DNA, 54 bp, Artificial Sequence
  Description of Artificial Sequence: Synthetic oligonucleotide
ctgatttttgtatttgtttacaatactgagttatgggagaataaacgttttctg

SEQ ID NO: 194583 - DNA, 55 bp, Artificial Sequence
  Description of Artificial Sequence: Synthetic oligonucleotide
tgatttttgtatttgtttacaatactgagttatgggagaataaacgttttctgag

SEQ ID NO: 194584 - DNA, 54 bp, Artificial Sequence
  Description of Artificial Sequence: Synthetic oligonucleotide
gatttttgtatttgtttacaatactgagttatgggagaataaacgttttctgag

SEQ ID NO: 194585 - DNA, 54 bp, Artificial Sequence
  Description of Artificial Sequence: Synthetic oligonucleotide
atttttgtatttgtttacaatactgagttatgggagaataaacgttttctgagg

SEQ ID NO: 194586 - DNA, 53 bp, Artificial Sequence
  Description of Artificial Sequence: Synthetic oligonucleotide
tttttgtatttgtttacaatactgagttatgggagaataaacgttttctgagg

SEQ ID NO: 194587 - DNA, 52 bp, Artificial Sequence
  Description of Artificial Sequence: Synthetic oligonucleotide
ttttgtatttgtttacaatactgagttatgggagaataaacgttttctgagg

SEQ ID NO: 194588 - DNA, 51 bp, Artificial Sequence
  Description of Artificial Sequence: Synthetic oligonucleotide
tttgtatttgtttacaatactgagttatgggagaataaacgttttctgagg

SEQ ID NO: 194589 - DNA, 50 bp, Artificial Sequence
  Description of Artificial Sequence: Synthetic oligonucleotide
ttgtatttgtttacaatactgagttatgggagaataaacgttttctgagg

SEQ ID NO: 194590 - DNA, 49 bp, Artificial Sequence
  Description of Artificial Sequence: Synthetic oligonucleotide
tgtatttgtttacaatactgagttatgggagaataaacgttttctgagg

SEQ ID NO: 194591 - DNA, 48 bp, Artificial Sequence
  Description of Artificial Sequence: Synthetic oligonucleotide
gtatttgtttacaatactgagttatgggagaataaacgttttctgagg

SEQ ID NO: 194592 - DNA, 48 bp, Artificial Sequence
  Description of Artificial Sequence: Synthetic oligonucleotide
tatttgtttacaatactgagttatgggagaataaacgttttctgaggg

SEQ ID NO: 194593 - DNA, 47 bp, Artificial Sequence
  Description of Artificial Sequence: Synthetic oligonucleotide
atttgtttacaatactgagttatgggagaataaacgttttctgaggg

SEQ ID NO: 194594 - DNA, 46 bp, Artificial Sequence
  Description of Artificial Sequence: Synthetic oligonucleotide
tttgtttacaatactgagttatgggagaataaacgttttctgaggg

SEQ ID NO: 194595 - DNA, 45 bp, Artificial Sequence
  Description of Artificial Sequence: Synthetic oligonucleotide
ttgtttacaatactgagttatgggagaataaacgttttctgaggg

SEQ ID NO: 194596 - DNA, 44 bp, Artificial Sequence
  Description of Artificial Sequence: Synthetic oligonucleotide
tgtttacaatactgagttatgggagaataaacgttttctgaggg

SEQ ID NO: 194597 - DNA, 43 bp, Artificial Sequence
  Description of Artificial Sequence: Synthetic oligonucleotide
gtttacaatactgagttatgggagaataaacgttttctgaggg

SEQ ID NO: 194598 - DNA, 43 bp, Artificial Sequence
  Description of Artificial Sequence: Synthetic oligonucleotide
tttacaatactgagttatgggagaataaacgttttctgagggc

SEQ ID NO: 194599 - DNA, 42 bp, Artificial Sequence
  Description of Artificial Sequence: Synthetic oligonucleotide
ttacaatactgagttatgggagaataaacgttttctgagggc

SEQ ID NO: 194600 - DNA, 41 bp, Artificial Sequence
  Description of Artificial Sequence: Synthetic oligonucleotide
tacaatactgagttatgggagaataaacgttttctgagggc

SEQ ID NO: 194601 - DNA, 40 bp, Artificial Sequence
  Description of Artificial Sequence: Synthetic oligonucleotide
acaatactgagttatgggagaataaacgttttctgagggc

SEQ ID NO: 194602 - DNA, 39 bp, Artificial Sequence
  Description of Artificial Sequence: Synthetic oligonucleotide
caatactgagttatgggagaataaacgttttctgagggc

SEQ ID NO: 194603 - DNA, 40 bp, Artificial Sequence
  Description of Artificial Sequence: Synthetic oligonucleotide
aatactgagttatgggagaataaacgttttctgagggcag

SEQ ID NO: 194604 - DNA, 39 bp, Artificial Sequence
  Description of Artificial Sequence: Synthetic oligonucleotide
atactgagttatgggagaataaacgttttctgagggcag

SEQ ID NO: 194605 - DNA, 38 bp, Artificial Sequence
  Description of Artificial Sequence: Synthetic oligonucleotide
tactgagttatgggagaataaacgttttctgagggcag

SEQ ID NO: 194606 - DNA, 37 bp, Artificial Sequence
  Description of Artificial Sequence: Synthetic oligonucleotide
actgagttatgggagaataaacgttttctgagggcag

SEQ ID NO: 194607 - DNA, 36 bp, Artificial Sequence
  Description of Artificial Sequence: Synthetic oligonucleotide
ctgagttatgggagaataaacgttttctgagggcag

SEQ ID NO: 194608 - DNA, 36 bp, Artificial Sequence
  Description of Artificial Sequence: Synthetic oligonucleotide
tgagttatgggagaataaacgttttctgagggcagc

SEQ ID NO: 194609 - DNA, 35 bp, Artificial Sequence
  Description of Artificial Sequence: Synthetic oligonucleotide
gagttatgggagaataaacgttttctgagggcagc

SEQ ID NO: 194610 - DNA, 36 bp, Artificial Sequence
  Description of Artificial Sequence: Synthetic oligonucleotide
agttatgggagaataaacgttttctgagggcagctc

SEQ ID NO: 194611 - DNA, 35 bp, Artificial Sequence
  Description of Artificial Sequence: Synthetic oligonucleotide
gttatgggagaataaacgttttctgagggcagctc

SEQ ID NO: 194612 - DNA, 36 bp, Artificial Sequence
  Description of Artificial Sequence: Synthetic oligonucleotide
ttatgggagaataaacgttttctgagggcagctctg

SEQ ID NO: 194613 - DNA, 35 bp, Artificial Sequence
  Description of Artificial Sequence: Synthetic oligonucleotide
tatgggagaataaacgttttctgagggcagctctg

SEQ ID NO: 194614 - DNA, 34 bp, Artificial Sequence
  Description of Artificial Sequence: Synthetic oligonucleotide
atgggagaataaacgttttctgagggcagctctg

SEQ ID NO: 194615 - DNA, 33 bp, Artificial Sequence
  Description of Artificial Sequence: Synthetic oligonucleotide
tgggagaataaacgttttctgagggcagctctg

SEQ ID NO: 194616 - DNA, 32 bp, Artificial Sequence
  Description of Artificial Sequence: Synthetic oligonucleotide
gggagaataaacgttttctgagggcagctctg

SEQ ID NO: 194617 - DNA, 33 bp, Artificial Sequence
  Description of Artificial Sequence: Synthetic oligonucleotide
ggagaataaacgttttctgagggcagctctgtc

SEQ ID NO: 194618 - DNA, 33 bp, Artificial Sequence
  Description of Artificial Sequence: Synthetic oligonucleotide
gagaataaacgttttctgagggcagctctgtcc

SEQ ID NO: 194619 - DNA, 36 bp, Artificial Sequence
  Description of Artificial Sequence: Synthetic oligonucleotide
agaataaacgttttctgagggcagctctgtccaatg

SEQ ID NO: 194620 - DNA, 35 bp, Artificial Sequence
  Description of Artificial Sequence: Synthetic oligonucleotide
gaataaacgttttctgagggcagctctgtccaatg

SEQ ID NO: 194621 - DNA, 35 bp, Artificial Sequence
  Description of Artificial Sequence: Synthetic oligonucleotide
aataaacgttttctgagggcagctctgtccaatgc

SEQ ID NO: 194622 - DNA, 34 bp, Artificial Sequence
  Description of Artificial Sequence: Synthetic oligonucleotide
ataaacgttttctgagggcagctctgtccaatgc

SEQ ID NO: 194623 - DNA, 33 bp, Artificial Sequence
  Description of Artificial Sequence: Synthetic oligonucleotide
taaacgttttctgagggcagctctgtccaatgc

SEQ ID NO: 194624 - DNA, 32 bp, Artificial Sequence
  Description of Artificial Sequence: Synthetic oligonucleotide
aaacgttttctgagggcagctctgtccaatgc

SEQ ID NO: 194625 - DNA, 31 bp, Artificial Sequence
  Description of Artificial Sequence: Synthetic oligonucleotide
aacgttttctgagggcagctctgtccaatgc

SEQ ID NO: 194626 - DNA, 30 bp, Artificial Sequence
  Description of Artificial Sequence: Synthetic oligonucleotide
acgttttctgagggcagctctgtccaatgc

SEQ ID NO: 194627 - DNA, 29 bp, Artificial Sequence
  Description of Artificial Sequence: Synthetic oligonucleotide
cgttttctgagggcagctctgtccaatgc

SEQ ID NO: 194628 - DNA, 31 bp, Artificial Sequence
  Description of Artificial Sequence: Synthetic oligonucleotide
gttttctgagggcagctctgtccaatgcttc

SEQ ID NO: 194629 - DNA, 32 bp, Artificial Sequence
  Description of Artificial Sequence: Synthetic oligonucleotide
ttttctgagggcagctctgtccaatgcttcac

SEQ ID NO: 194630 - DNA, 31 bp, Artificial Sequence
  Description of Artificial Sequence: Synthetic oligonucleotide
tttctgagggcagctctgtccaatgcttcac

SEQ ID NO: 194631 - DNA, 30 bp, Artificial Sequence
  Description of Artificial Sequence: Synthetic oligonucleotide
ttctgagggcagctctgtccaatgcttcac

SEQ ID NO: 194632 - DNA, 29 bp, Artificial Sequence
  Description of Artificial Sequence: Synthetic oligonucleotide
tctgagggcagctctgtccaatgcttcac

SEQ ID NO: 194633 - DNA, 28 bp, Artificial Sequence
  Description of Artificial Sequence: Synthetic oligonucleotide
ctgagggcagctctgtccaatgcttcac

SEQ ID NO: 194634 - DNA, 29 bp, Artificial Sequence
  Description of Artificial Sequence: Synthetic oligonucleotide
tgagggcagctctgtccaatgcttcactg

SEQ ID NO: 194635 - DNA, 28 bp, Artificial Sequence
  Description of Artificial Sequence: Synthetic oligonucleotide
gagggcagctctgtccaatgcttcactg

SEQ ID NO: 194636 - DNA, 31 bp, Artificial Sequence
  Description of Artificial Sequence: Synthetic oligonucleotide
agggcagctctgtccaatgcttcactgttag

SEQ ID NO: 194637 - DNA, 30 bp, Artificial Sequence
  Description of Artificial Sequence: Synthetic oligonucleotide
gggcagctctgtccaatgcttcactgttag

SEQ ID NO: 194638 - DNA, 30 bp, Artificial Sequence
  Description of Artificial Sequence: Synthetic oligonucleotide
ggcagctctgtccaatgcttcactgttagc

SEQ ID NO: 194639 - DNA, 31 bp, Artificial Sequence
  Description of Artificial Sequence: Synthetic oligonucleotide
gcagctctgtccaatgcttcactgttagcag

SEQ ID NO: 194640 - DNA, 33 bp, Artificial Sequence
  Description of Artificial Sequence: Synthetic oligonucleotide
cagctctgtccaatgcttcactgttagcagaag

SEQ ID NO: 194641 - DNA, 33 bp, Artificial Sequence
  Description of Artificial Sequence: Synthetic oligonucleotide
agctctgtccaatgcttcactgttagcagaagc

SEQ ID NO: 194642 - DNA, 32 bp, Artificial Sequence
  Description of Artificial Sequence: Synthetic oligonucleotide
gctctgtccaatgcttcactgttagcagaagc

SEQ ID NO: 194643 - DNA, 32 bp, Artificial Sequence
  Description of Artificial Sequence: Synthetic oligonucleotide
ctctgtccaatgcttcactgttagcagaagcc

SEQ ID NO: 194644 - DNA, 33 bp, Artificial Sequence
  Description of Artificial Sequence: Synthetic oligonucleotide
tctgtccaatgcttcactgttagcagaagcctg

SEQ ID NO: 194645 - DNA, 32 bp, Artificial Sequence
  Description of Artificial Sequence: Synthetic oligonucleotide
ctgtccaatgcttcactgttagcagaagcctg

SEQ ID NO: 194646 - DNA, 33 bp, Artificial Sequence
  Description of Artificial Sequence: Synthetic oligonucleotide
tgtccaatgcttcactgttagcagaagcctgtc

SEQ ID NO: 194647 - DNA, 32 bp, Artificial Sequence
  Description of Artificial Sequence: Synthetic oligonucleotide
gtccaatgcttcactgttagcagaagcctgtc

SEQ ID NO: 194648 - DNA, 34 bp, Artificial Sequence
  Description of Artificial Sequence: Synthetic oligonucleotide
tccaatgcttcactgttagcagaagcctgtcatc

SEQ ID NO: 194649 - DNA, 33 bp, Artificial Sequence
  Description of Artificial Sequence: Synthetic oligonucleotide
ccaatgcttcactgttagcagaagcctgtcatc

SEQ ID NO: 194650 - DNA, 34 bp, Artificial Sequence
  Description of Artificial Sequence: Synthetic oligonucleotide
caatgcttcactgttagcagaagcctgtcatcag

SEQ ID NO: 194651 - DNA, 40 bp, Artificial Sequence
  Description of Artificial Sequence: Synthetic oligonucleotide
aatgcttcactgttagcagaagcctgtcatcagatttttg

SEQ ID NO: 194652 - DNA, 39 bp, Artificial Sequence
  Description of Artificial Sequence: Synthetic oligonucleotide
atgcttcactgttagcagaagcctgtcatcagatttttg

SEQ ID NO: 194653 - DNA, 38 bp, Artificial Sequence
  Description of Artificial Sequence: Synthetic oligonucleotide
tgcttcactgttagcagaagcctgtcatcagatttttg

SEQ ID NO: 194654 - DNA, 37 bp, Artificial Sequence
  Description of Artificial Sequence: Synthetic oligonucleotide
gcttcactgttagcagaagcctgtcatcagatttttg

SEQ ID NO: 194655 - DNA, 38 bp, Artificial Sequence
  Description of Artificial Sequence: Synthetic oligonucleotide
cttcactgttagcagaagcctgtcatcagatttttgag

SEQ ID NO: 194656 - DNA, 38 bp, Artificial Sequence
  Description of Artificial Sequence: Synthetic oligonucleotide
ttcactgttagcagaagcctgtcatcagatttttgagg

SEQ ID NO: 194657 - DNA, 37 bp, Artificial Sequence
  Description of Artificial Sequence: Synthetic oligonucleotide
tcactgttagcagaagcctgtcatcagatttttgagg

SEQ ID NO: 194658 - DNA, 36 bp, Artificial Sequence
  Description of Artificial Sequence: Synthetic oligonucleotide
cactgttagcagaagcctgtcatcagatttttgagg

SEQ ID NO: 194659 - DNA, 36 bp, Artificial Sequence
  Description of Artificial Sequence: Synthetic oligonucleotide
actgttagcagaagcctgtcatcagatttttgaggg

SEQ ID NO: 194660 - DNA, 35 bp, Artificial Sequence
  Description of Artificial Sequence: Synthetic oligonucleotide
ctgttagcagaagcctgtcatcagatttttgaggg

SEQ ID NO: 194661 - DNA, 35 bp, Artificial Sequence
  Description of Artificial Sequence: Synthetic oligonucleotide
tgttagcagaagcctgtcatcagatttttgagggg

SEQ ID NO: 194662 - DNA, 34 bp, Artificial Sequence
  Description of Artificial Sequence: Synthetic oligonucleotide
gttagcagaagcctgtcatcagatttttgagggg

SEQ ID NO: 194663 - DNA, 37 bp, Artificial Sequence
  Description of Artificial Sequence: Synthetic oligonucleotide
ttagcagaagcctgtcatcagatttttgaggggaaag

SEQ ID NO: 194664 - DNA, 36 bp, Artificial Sequence
  Description of Artificial Sequence: Synthetic oligonucleotide
tagcagaagcctgtcatcagatttttgaggggaaag

SEQ ID NO: 194665 - DNA, 35 bp, Artificial Sequence
  Description of Artificial Sequence: Synthetic oligonucleotide
agcagaagcctgtcatcagatttttgaggggaaag

SEQ ID NO: 194666 - DNA, 34 bp, Artificial Sequence
  Description of Artificial Sequence: Synthetic oligonucleotide
gcagaagcctgtcatcagatttttgaggggaaag

SEQ ID NO: 194667 - DNA, 41 bp, Artificial Sequence
  Description of Artificial Sequence: Synthetic oligonucleotide
cagaagcctgtcatcagatttttgaggggaaagttttttac

SEQ ID NO: 194668 - DNA, 41 bp, Artificial Sequence
  Description of Artificial Sequence: Synthetic oligonucleotide
agaagcctgtcatcagatttttgaggggaaagttttttacc

SEQ ID NO: 194669 - DNA, 40 bp, Artificial Sequence
  Description of Artificial Sequence: Synthetic oligonucleotide
gaagcctgtcatcagatttttgaggggaaagttttttacc

SEQ ID NO: 194670 - DNA, 40 bp, Artificial Sequence
  Description of Artificial Sequence: Synthetic oligonucleotide
aagcctgtcatcagatttttgaggggaaagttttttaccc

SEQ ID NO: 194671 - DNA, 39 bp, Artificial Sequence
  Description of Artificial Sequence: Synthetic oligonucleotide
agcctgtcatcagatttttgaggggaaagttttttaccc

SEQ ID NO: 194672 - DNA, 38 bp, Artificial Sequence
  Description of Artificial Sequence: Synthetic oligonucleotide
gcctgtcatcagatttttgaggggaaagttttttaccc

SEQ ID NO: 194673 - DNA, 40 bp, Artificial Sequence
  Description of Artificial Sequence: Synthetic oligonucleotide
cctgtcatcagatttttgaggggaaagttttttacccaac

SEQ ID NO: 194674 - DNA, 41 bp, Artificial Sequence
  Description of Artificial Sequence: Synthetic oligonucleotide
ctgtcatcagatttttgaggggaaagttttttacccaacag

SEQ ID NO: 194675 - DNA, 46 bp, Artificial Sequence
  Description of Artificial Sequence: Synthetic oligonucleotide
tgtcatcagatttttgaggggaaagttttttacccaacagaaaatg

SEQ ID NO: 194676 - DNA, 45 bp, Artificial Sequence
  Description of Artificial Sequence: Synthetic oligonucleotide
gtcatcagatttttgaggggaaagttttttacccaacagaaaatg

SEQ ID NO: 194677 - DNA, 45 bp, Artificial Sequence
  Description of Artificial Sequence: Synthetic oligonucleotide
tcatcagatttttgaggggaaagttttttacccaacagaaaatgc

SEQ ID NO: 194678 - DNA, 44 bp, Artificial Sequence
  Description of Artificial Sequence: Synthetic oligonucleotide
catcagatttttgaggggaaagttttttacccaacagaaaatgc

SEQ ID NO: 194679 - DNA, 47 bp, Artificial Sequence
  Description of Artificial Sequence: Synthetic oligonucleotide
atcagatttttgaggggaaagttttttacccaacagaaaatgcattg

SEQ ID NO: 194680 - DNA, 46 bp, Artificial Sequence
  Description of Artificial Sequence: Synthetic oligonucleotide
tcagatttttgaggggaaagttttttacccaacagaaaatgcattg

SEQ ID NO: 194681 - DNA, 45 bp, Artificial Sequence
  Description of Artificial Sequence: Synthetic oligonucleotide
cagatttttgaggggaaagttttttacccaacagaaaatgcattg

SEQ ID NO: 194682 - DNA, 49 bp, Artificial Sequence
  Description of Artificial Sequence: Synthetic oligonucleotide
agatttttgaggggaaagttttttacccaacagaaaatgcattgaaaac

SEQ ID NO: 194683 - DNA, 48 bp, Artificial Sequence
  Description of Artificial Sequence: Synthetic oligonucleotide
gatttttgaggggaaagttttttacccaacagaaaatgcattgaaaac

SEQ ID NO: 194684 - DNA, 50 bp, Artificial Sequence
  Description of Artificial Sequence: Synthetic oligonucleotide
atttttgaggggaaagttttttacccaacagaaaatgcattgaaaactac

SEQ ID NO: 194685 - DNA, 49 bp, Artificial Sequence
  Description of Artificial Sequence: Synthetic oligonucleotide
tttttgaggggaaagttttttacccaacagaaaatgcattgaaaactac

SEQ ID NO: 194686 - DNA, 48 bp, Artificial Sequence
  Description of Artificial Sequence: Synthetic oligonucleotide
ttttgaggggaaagttttttacccaacagaaaatgcattgaaaactac

SEQ ID NO: 194687 - DNA, 47 bp, Artificial Sequence
  Description of Artificial Sequence: Synthetic oligonucleotide
tttgaggggaaagttttttacccaacagaaaatgcattgaaaactac

SEQ ID NO: 194688 - DNA, 46 bp, Artificial Sequence
  Description of Artificial Sequence: Synthetic oligonucleotide
ttgaggggaaagttttttacccaacagaaaatgcattgaaaactac

SEQ ID NO: 194689 - DNA, 45 bp, Artificial Sequence
  Description of Artificial Sequence: Synthetic oligonucleotide
tgaggggaaagttttttacccaacagaaaatgcattgaaaactac

SEQ ID NO: 194690 - DNA, 44 bp, Artificial Sequence
  Description of Artificial Sequence: Synthetic oligonucleotide
gaggggaaagttttttacccaacagaaaatgcattgaaaactac

SEQ ID NO: 194691 - DNA, 44 bp, Artificial Sequence
  Description of Artificial Sequence: Synthetic oligonucleotide
aggggaaagttttttacccaacagaaaatgcattgaaaactacc

SEQ ID NO: 194692 - DNA, 43 bp, Artificial Sequence
  Description of Artificial Sequence: Synthetic oligonucleotide
ggggaaagttttttacccaacagaaaatgcattgaaaactacc

SEQ ID NO: 194693 - DNA, 43 bp, Artificial Sequence
  Description of Artificial Sequence: Synthetic oligonucleotide
gggaaagttttttacccaacagaaaatgcattgaaaactaccc

SEQ ID NO: 194694 - DNA, 45 bp, Artificial Sequence
  Description of Artificial Sequence: Synthetic oligonucleotide
ggaaagttttttacccaacagaaaatgcattgaaaactacccttg

SEQ ID NO: 194695 - DNA, 47 bp, Artificial Sequence
  Description of Artificial Sequence: Synthetic oligonucleotide
gaaagttttttacccaacagaaaatgcattgaaaactacccttgatg

SEQ ID NO: 194696 - DNA, 49 bp, Artificial Sequence
  Description of Artificial Sequence: Synthetic oligonucleotide
aaagttttttacccaacagaaaatgcattgaaaactacccttgatgaag

SEQ ID NO: 194697 - DNA, 48 bp, Artificial Sequence
  Description of Artificial Sequence: Synthetic oligonucleotide
aagttttttacccaacagaaaatgcattgaaaactacccttgatgaag

SEQ ID NO: 194698 - DNA, 47 bp, Artificial Sequence
  Description of Artificial Sequence: Synthetic oligonucleotide
agttttttacccaacagaaaatgcattgaaaactacccttgatgaag

SEQ ID NO: 194699 - DNA, 46 bp, Artificial Sequence
  Description of Artificial Sequence: Synthetic oligonucleotide
gttttttacccaacagaaaatgcattgaaaactacccttgatgaag

SEQ ID NO: 194700 - DNA, 46 bp, Artificial Sequence
  Description of Artificial Sequence: Synthetic oligonucleotide
ttttttacccaacagaaaatgcattgaaaactacccttgatgaagc

SEQ ID NO: 194701 - DNA, 45 bp, Artificial Sequence
  Description of Artificial Sequence: Synthetic oligonucleotide
tttttacccaacagaaaatgcattgaaaactacccttgatgaagc

SEQ ID NO: 194702 - DNA, 44 bp, Artificial Sequence
  Description of Artificial Sequence: Synthetic oligonucleotide
ttttacccaacagaaaatgcattgaaaactacccttgatgaagc

SEQ ID NO: 194703 - DNA, 43 bp, Artificial Sequence
  Description of Artificial Sequence: Synthetic oligonucleotide
tttacccaacagaaaatgcattgaaaactacccttgatgaagc

SEQ ID NO: 194704 - DNA, 42 bp, Artificial Sequence
  Description of Artificial Sequence: Synthetic oligonucleotide
ttacccaacagaaaatgcattgaaaactacccttgatgaagc

SEQ ID NO: 194705 - DNA, 41 bp, Artificial Sequence
  Description of Artificial Sequence: Synthetic oligonucleotide
tacccaacagaaaatgcattgaaaactacccttgatgaagc

SEQ ID NO: 194706 - DNA, 40 bp, Artificial Sequence
  Description of Artificial Sequence: Synthetic oligonucleotide
acccaacagaaaatgcattgaaaactacccttgatgaagc

SEQ ID NO: 194707 - DNA, 39 bp, Artificial Sequence
  Description of Artificial Sequence: Synthetic oligonucleotide
cccaacagaaaatgcattgaaaactacccttgatgaagc

SEQ ID NO: 194708 - DNA, 41 bp, Artificial Sequence
  Description of Artificial Sequence: Synthetic oligonucleotide
ccaacagaaaatgcattgaaaactacccttgatgaagctac

SEQ ID NO: 194709 - DNA, 41 bp, Artificial Sequence
  Description of Artificial Sequence: Synthetic oligonucleotide
caacagaaaatgcattgaaaactacccttgatgaagctacc

SEQ ID NO: 194710 - DNA, 42 bp, Artificial Sequence
  Description of Artificial Sequence: Synthetic oligonucleotide
aacagaaaatgcattgaaaactacccttgatgaagctacctg

SEQ ID NO: 194711 - DNA, 41 bp, Artificial Sequence
  Description of Artificial Sequence: Synthetic oligonucleotide
acagaaaatgcattgaaaactacccttgatgaagctacctg

SEQ ID NO: 194712 - DNA, 40 bp, Artificial Sequence
  Description of Artificial Sequence: Synthetic oligonucleotide
cagaaaatgcattgaaaactacccttgatgaagctacctg

SEQ ID NO: 194713 - DNA, 40 bp, Artificial Sequence
  Description of Artificial Sequence: Synthetic oligonucleotide
agaaaatgcattgaaaactacccttgatgaagctacctgc

SEQ ID NO: 194714 - DNA, 39 bp, Artificial Sequence
  Description of Artificial Sequence: Synthetic oligonucleotide
gaaaatgcattgaaaactacccttgatgaagctacctgc

SEQ ID NO: 194715 - DNA, 42 bp, Artificial Sequence
  Description of Artificial Sequence: Synthetic oligonucleotide
aaaatgcattgaaaactacccttgatgaagctacctgctatg

SEQ ID NO: 194716 - DNA, 41 bp, Artificial Sequence
  Description of Artificial Sequence: Synthetic oligonucleotide
aaatgcattgaaaactacccttgatgaagctacctgctatg

SEQ ID NO: 194717 - DNA, 40 bp, Artificial Sequence
  Description of Artificial Sequence: Synthetic oligonucleotide
aatgcattgaaaactacccttgatgaagctacctgctatg

SEQ ID NO: 194718 - DNA, 39 bp, Artificial Sequence
  Description of Artificial Sequence: Synthetic oligonucleotide
atgcattgaaaactacccttgatgaagctacctgctatg

SEQ ID NO: 194719 - DNA, 38 bp, Artificial Sequence
  Description of Artificial Sequence: Synthetic oligonucleotide
tgcattgaaaactacccttgatgaagctacctgctatg

SEQ ID NO: 194720 - DNA, 37 bp, Artificial Sequence
  Description of Artificial Sequence: Synthetic oligonucleotide
gcattgaaaactacccttgatgaagctacctgctatg

SEQ ID NO: 194721 - DNA, 38 bp, Artificial Sequence
  Description of Artificial Sequence: Synthetic oligonucleotide
cattgaaaactacccttgatgaagctacctgctatgag

SEQ ID NO: 194722 - DNA, 40 bp, Artificial Sequence
  Description of Artificial Sequence: Synthetic oligonucleotide
attgaaaactacccttgatgaagctacctgctatgagtac

SEQ ID NO: 194723 - DNA, 39 bp, Artificial Sequence
  Description of Artificial Sequence: Synthetic oligonucleotide
ttgaaaactacccttgatgaagctacctgctatgagtac

SEQ ID NO: 194724 - DNA, 38 bp, Artificial Sequence
  Description of Artificial Sequence: Synthetic oligonucleotide
tgaaaactacccttgatgaagctacctgctatgagtac

SEQ ID NO: 194725 - DNA, 37 bp, Artificial Sequence
  Description of Artificial Sequence: Synthetic oligonucleotide
gaaaactacccttgatgaagctacctgctatgagtac

SEQ ID NO: 194726 - DNA, 39 bp, Artificial Sequence
  Description of Artificial Sequence: Synthetic oligonucleotide
aaaactacccttgatgaagctacctgctatgagtacatg

SEQ ID NO: 194727 - DNA, 38 bp, Artificial Sequence
  Description of Artificial Sequence: Synthetic oligonucleotide
aaactacccttgatgaagctacctgctatgagtacatg

SEQ ID NO: 194728 - DNA, 37 bp, Artificial Sequence
  Description of Artificial Sequence: Synthetic oligonucleotide
aactacccttgatgaagctacctgctatgagtacatg

SEQ ID NO: 194729 - DNA, 36 bp, Artificial Sequence
  Description of Artificial Sequence: Synthetic oligonucleotide
actacccttgatgaagctacctgctatgagtacatg

SEQ ID NO: 194730 - DNA, 35 bp, Artificial Sequence
  Description of Artificial Sequence: Synthetic oligonucleotide
ctacccttgatgaagctacctgctatgagtacatg

SEQ ID NO: 194731 - DNA, 35 bp, Artificial Sequence
  Description of Artificial Sequence: Synthetic oligonucleotide
tacccttgatgaagctacctgctatgagtacatgg

SEQ ID NO: 194732 - DNA, 34 bp, Artificial Sequence
  Description of Artificial Sequence: Synthetic oligonucleotide
acccttgatgaagctacctgctatgagtacatgg

SEQ ID NO: 194733 - DNA, 33 bp, Artificial Sequence
  Description of Artificial Sequence: Synthetic oligonucleotide
cccttgatgaagctacctgctatgagtacatgg

SEQ ID NO: 194734 - DNA, 35 bp, Artificial Sequence
  Description of Artificial Sequence: Synthetic oligonucleotide
ccttgatgaagctacctgctatgagtacatggttc

SEQ ID NO: 194735 - DNA, 35 bp, Artificial Sequence
  Description of Artificial Sequence: Synthetic oligonucleotide
cttgatgaagctacctgctatgagtacatggttcg

SEQ ID NO: 194736 - DNA, 37 bp, Artificial Sequence
  Description of Artificial Sequence: Synthetic oligonucleotide
ttgatgaagctacctgctatgagtacatggttcgaag

SEQ ID NO: 194737 - DNA, 36 bp, Artificial Sequence
  Description of Artificial Sequence: Synthetic oligonucleotide
tgatgaagctacctgctatgagtacatggttcgaag

SEQ ID NO: 194738 - DNA, 35 bp, Artificial Sequence
  Description of Artificial Sequence: Synthetic oligonucleotide
gatgaagctacctgctatgagtacatggttcgaag

SEQ ID NO: 194739 - DNA, 35 bp, Artificial Sequence
  Description of Artificial Sequence: Synthetic oligonucleotide
atgaagctacctgctatgagtacatggttcgaagc

SEQ ID NO: 194740 - DNA, 34 bp, Artificial Sequence
  Description of Artificial Sequence: Synthetic oligonucleotide
tgaagctacctgctatgagtacatggttcgaagc

SEQ ID NO: 194741 - DNA, 33 bp, Artificial Sequence
  Description of Artificial Sequence: Synthetic oligonucleotide
gaagctacctgctatgagtacatggttcgaagc

SEQ ID NO: 194742 - DNA, 33 bp, Artificial Sequence
  Description of Artificial Sequence: Synthetic oligonucleotide
aagctacctgctatgagtacatggttcgaagcc

SEQ ID NO: 194743 - DNA, 32 bp, Artificial Sequence
  Description of Artificial Sequence: Synthetic oligonucleotide
agctacctgctatgagtacatggttcgaagcc

SEQ ID NO: 194744 - DNA, 31 bp, Artificial Sequence
  Description of Artificial Sequence: Synthetic oligonucleotide
gctacctgctatgagtacatggttcgaagcc

SEQ ID NO: 194745 - DNA, 32 bp, Artificial Sequence
  Description of Artificial Sequence: Synthetic oligonucleotide
ctacctgctatgagtacatggttcgaagccac

SEQ ID NO: 194746 - DNA, 35 bp, Artificial Sequence
  Description of Artificial Sequence: Synthetic oligonucleotide
tacctgctatgagtacatggttcgaagccactatg

SEQ ID NO: 194747 - DNA, 34 bp, Artificial Sequence
  Description of Artificial Sequence: Synthetic oligonucleotide
acctgctatgagtacatggttcgaagccactatg

SEQ ID NO: 194748 - DNA, 33 bp, Artificial Sequence
  Description of Artificial Sequence: Synthetic oligonucleotide
cctgctatgagtacatggttcgaagccactatg

SEQ ID NO: 194749 - DNA, 36 bp, Artificial Sequence
  Description of Artificial Sequence: Synthetic oligonucleotide
ctgctatgagtacatggttcgaagccactatgtaac

SEQ ID NO: 194750 - DNA, 37 bp, Artificial Sequence
  Description of Artificial Sequence: Synthetic oligonucleotide
tgctatgagtacatggttcgaagccactatgtaacag

SEQ ID NO: 194751 - DNA, 36 bp, Artificial Sequence
  Description of Artificial Sequence: Synthetic oligonucleotide
gctatgagtacatggttcgaagccactatgtaacag

SEQ ID NO: 194752 - DNA, 39 bp, Artificial Sequence
  Description of Artificial Sequence: Synthetic oligonucleotide
ctatgagtacatggttcgaagccactatgtaacagaaac

SEQ ID NO: 194753 - DNA, 40 bp, Artificial Sequence
  Description of Artificial Sequence: Synthetic oligonucleotide
tatgagtacatggttcgaagccactatgtaacagaaacac

SEQ ID NO: 194754 - DNA, 39 bp, Artificial Sequence
  Description of Artificial Sequence: Synthetic oligonucleotide
atgagtacatggttcgaagccactatgtaacagaaacac

SEQ ID NO: 194755 - DNA, 38 bp, Artificial Sequence
  Description of Artificial Sequence: Synthetic oligonucleotide
tgagtacatggttcgaagccactatgtaacagaaacac

SEQ ID NO: 194756 - DNA, 37 bp, Artificial Sequence
  Description of Artificial Sequence: Synthetic oligonucleotide
gagtacatggttcgaagccactatgtaacagaaacac

SEQ ID NO: 194757 - DNA, 38 bp, Artificial Sequence
  Description of Artificial Sequence: Synthetic oligonucleotide
agtacatggttcgaagccactatgtaacagaaacactc

SEQ ID NO: 194758 - DNA, 37 bp, Artificial Sequence
  Description of Artificial Sequence: Synthetic oligonucleotide
gtacatggttcgaagccactatgtaacagaaacactc

SEQ ID NO: 194759 - DNA, 38 bp, Artificial Sequence
  Description of Artificial Sequence: Synthetic oligonucleotide
tacatggttcgaagccactatgtaacagaaacactctc

SEQ ID NO: 194760 - DNA, 37 bp, Artificial Sequence
  Description of Artificial Sequence: Synthetic oligonucleotide
acatggttcgaagccactatgtaacagaaacactctc

SEQ ID NO: 194761 - DNA, 36 bp, Artificial Sequence
  Description of Artificial Sequence: Synthetic oligonucleotide
catggttcgaagccactatgtaacagaaacactctc

SEQ ID NO: 194762 - DNA, 37 bp, Artificial Sequence
  Description of Artificial Sequence: Synthetic oligonucleotide
atggttcgaagccactatgtaacagaaacactctctg

SEQ ID NO: 194763 - DNA, 36 bp, Artificial Sequence
  Description of Artificial Sequence: Synthetic oligonucleotide
tggttcgaagccactatgtaacagaaacactctctg

SEQ ID NO: 194764 - DNA, 35 bp, Artificial Sequence
  Description of Artificial Sequence: Synthetic oligonucleotide
ggttcgaagccactatgtaacagaaacactctctg

SEQ ID NO: 194765 - DNA, 37 bp, Artificial Sequence
  Description of Artificial Sequence: Synthetic oligonucleotide
gttcgaagccactatgtaacagaaacactctctgaag

SEQ ID NO: 194766 - DNA, 39 bp, Artificial Sequence
  Description of Artificial Sequence: Synthetic oligonucleotide
ttcgaagccactatgtaacagaaacactctctgaagaag

SEQ ID NO: 194767 - DNA, 38 bp, Artificial Sequence
  Description of Artificial Sequence: Synthetic oligonucleotide
tcgaagccactatgtaacagaaacactctctgaagaag

SEQ ID NO: 194768 - DNA, 37 bp, Artificial Sequence
  Description of Artificial Sequence: Synthetic oligonucleotide
cgaagccactatgtaacagaaacactctctgaagaag

SEQ ID NO: 194769 - DNA, 38 bp, Artificial Sequence
  Description of Artificial Sequence: Synthetic oligonucleotide
gaagccactatgtaacagaaacactctctgaagaagag

SEQ ID NO: 194770 - DNA, 38 bp, Artificial Sequence
  Description of Artificial Sequence: Synthetic oligonucleotide
aagccactatgtaacagaaacactctctgaagaagagg

SEQ ID NO: 194771 - DNA, 37 bp, Artificial Sequence
  Description of Artificial Sequence: Synthetic oligonucleotide
agccactatgtaacagaaacactctctgaagaagagg

SEQ ID NO: 194772 - DNA, 36 bp, Artificial Sequence
  Description of Artificial Sequence: Synthetic oligonucleotide
gccactatgtaacagaaacactctctgaagaagagg

SEQ ID NO: 194773 - DNA, 36 bp, Artificial Sequence
  Description of Artificial Sequence: Synthetic oligonucleotide
ccactatgtaacagaaacactctctgaagaagaggc

SEQ ID NO: 194774 - DNA, 37 bp, Artificial Sequence
  Description of Artificial Sequence: Synthetic oligonucleotide
cactatgtaacagaaacactctctgaagaagaggctg

SEQ ID NO: 194775 - DNA, 37 bp, Artificial Sequence
  Description of Artificial Sequence: Synthetic oligonucleotide
actatgtaacagaaacactctctgaagaagaggctgg

SEQ ID NO: 194776 - DNA, 36 bp, Artificial Sequence
  Description of Artificial Sequence: Synthetic oligonucleotide
ctatgtaacagaaacactctctgaagaagaggctgg

SEQ ID NO: 194777 - DNA, 36 bp, Artificial Sequence
  Description of Artificial Sequence: Synthetic oligonucleotide
tatgtaacagaaacactctctgaagaagaggctggg

SEQ ID NO: 194778 - DNA, 35 bp, Artificial Sequence
  Description of Artificial Sequence: Synthetic oligonucleotide
atgtaacagaaacactctctgaagaagaggctggg

SEQ ID NO: 194779 - DNA, 34 bp, Artificial Sequence
  Description of Artificial Sequence: Synthetic oligonucleotide
tgtaacagaaacactctctgaagaagaggctggg

SEQ ID NO: 194780 - DNA, 33 bp, Artificial Sequence
  Description of Artificial Sequence: Synthetic oligonucleotide
gtaacagaaacactctctgaagaagaggctggg

SEQ ID NO: 194781 - DNA, 35 bp, Artificial Sequence
  Description of Artificial Sequence: Synthetic oligonucleotide
taacagaaacactctctgaagaagaggctgggttc

SEQ ID NO: 194782 - DNA, 34 bp, Artificial Sequence
  Description of Artificial Sequence: Synthetic oligonucleotide
aacagaaacactctctgaagaagaggctgggttc

SEQ ID NO: 194783 - DNA, 33 bp, Artificial Sequence
  Description of Artificial Sequence: Synthetic oligonucleotide
acagaaacactctctgaagaagaggctgggttc

SEQ ID NO: 194784 - DNA, 32 bp, Artificial Sequence
  Description of Artificial Sequence: Synthetic oligonucleotide
cagaaacactctctgaagaagaggctgggttc

SEQ ID NO: 194785 - DNA, 32 bp, Artificial Sequence
  Description of Artificial Sequence: Synthetic oligonucleotide
agaaacactctctgaagaagaggctgggttcc

SEQ ID NO: 194786 - DNA, 31 bp, Artificial Sequence
  Description of Artificial Sequence: Synthetic oligonucleotide
gaaacactctctgaagaagaggctgggttcc

SEQ ID NO: 194787 - DNA, 31 bp, Artificial Sequence
  Description of Artificial Sequence: Synthetic oligonucleotide
aaacactctctgaagaagaggctgggttccc

SEQ ID NO: 194788 - DNA, 30 bp, Artificial Sequence
  Description of Artificial Sequence: Synthetic oligonucleotide
aacactctctgaagaagaggctgggttccc

SEQ ID NO: 194789 - DNA, 29 bp, Artificial Sequence
  Description of Artificial Sequence: Synthetic oligonucleotide
acactctctgaagaagaggctgggttccc

SEQ ID NO: 194790 - DNA, 28 bp, Artificial Sequence
  Description of Artificial Sequence: Synthetic oligonucleotide
cactctctgaagaagaggctgggttccc

SEQ ID NO: 194791 - DNA, 32 bp, Artificial Sequence
  Description of Artificial Sequence: Synthetic oligonucleotide
actctctgaagaagaggctgggttccctttag

SEQ ID NO: 194792 - DNA, 31 bp, Artificial Sequence
  Description of Artificial Sequence: Synthetic oligonucleotide
ctctctgaagaagaggctgggttccctttag

SEQ ID NO: 194793 - DNA, 31 bp, Artificial Sequence
  Description of Artificial Sequence: Synthetic oligonucleotide
tctctgaagaagaggctgggttccctttagc

SEQ ID NO: 194794 - DNA, 30 bp, Artificial Sequence
  Description of Artificial Sequence: Synthetic oligonucleotide
ctctgaagaagaggctgggttccctttagc

SEQ ID NO: 194795 - DNA, 33 bp, Artificial Sequence
  Description of Artificial Sequence: Synthetic oligonucleotide
tctgaagaagaggctgggttccctttagcttac

SEQ ID NO: 194796 - DNA, 32 bp, Artificial Sequence
  Description of Artificial Sequence: Synthetic oligonucleotide
ctgaagaagaggctgggttccctttagcttac

SEQ ID NO: 194797 - DNA, 33 bp, Artificial Sequence
  Description of Artificial Sequence: Synthetic oligonucleotide
tgaagaagaggctgggttccctttagcttacac

SEQ ID NO: 194798 - DNA, 32 bp, Artificial Sequence
  Description of Artificial Sequence: Synthetic oligonucleotide
gaagaagaggctgggttccctttagcttacac

SEQ ID NO: 194799 - DNA, 33 bp, Artificial Sequence
  Description of Artificial Sequence: Synthetic oligonucleotide
aagaagaggctgggttccctttagcttacacag

SEQ ID NO: 194800 - DNA, 32 bp, Artificial Sequence
  Description of Artificial Sequence: Synthetic oligonucleotide
agaagaggctgggttccctttagcttacacag

SEQ ID NO: 194801 - DNA, 31 bp, Artificial Sequence
  Description of Artificial Sequence: Synthetic oligonucleotide
gaagaggctgggttccctttagcttacacag

SEQ ID NO: 194802 - DNA, 32 bp, Artificial Sequence
  Description of Artificial Sequence: Synthetic oligonucleotide
aagaggctgggttccctttagcttacacagtg

SEQ ID NO: 194803 - DNA, 31 bp, Artificial Sequence
  Description of Artificial Sequence: Synthetic oligonucleotide
agaggctgggttccctttagcttacacagtg

SEQ ID NO: 194804 - DNA, 30 bp, Artificial Sequence
  Description of Artificial Sequence: Synthetic oligonucleotide
gaggctgggttccctttagcttacacagtg

SEQ ID NO: 194805 - DNA, 31 bp, Artificial Sequence
  Description of Artificial Sequence: Synthetic oligonucleotide
aggctgggttccctttagcttacacagtgac

SEQ ID NO: 194806 - DNA, 30 bp, Artificial Sequence
  Description of Artificial Sequence: Synthetic oligonucleotide
ggctgggttccctttagcttacacagtgac

SEQ ID NO: 194807 - DNA, 30 bp, Artificial Sequence
  Description of Artificial Sequence: Synthetic oligonucleotide
gctgggttccctttagcttacacagtgacc

SEQ ID NO: 194808 - DNA, 32 bp, Artificial Sequence
  Description of Artificial Sequence: Synthetic oligonucleotide
ctgggttccctttagcttacacagtgaccatc

SEQ ID NO: 194809 - DNA, 32 bp, Artificial Sequence
  Description of Artificial Sequence: Synthetic oligonucleotide
tgggttccctttagcttacacagtgaccatcc

SEQ ID NO: 194810 - DNA, 31 bp, Artificial Sequence
  Description of Artificial Sequence: Synthetic oligonucleotide
gggttccctttagcttacacagtgaccatcc

SEQ ID NO: 194811 - DNA, 32 bp, Artificial Sequence
  Description of Artificial Sequence: Synthetic oligonucleotide
ggttccctttagcttacacagtgaccatccac

SEQ ID NO: 194812 - DNA, 35 bp, Artificial Sequence
  Description of Artificial Sequence: Synthetic oligonucleotide
gttccctttagcttacacagtgaccatccacaaag

SEQ ID NO: 194813 - DNA, 36 bp, Artificial Sequence
  Description of Artificial Sequence: Synthetic oligonucleotide
ttccctttagcttacacagtgaccatccacaaagac

SEQ ID NO: 194814 - DNA, 35 bp, Artificial Sequence
  Description of Artificial Sequence: Synthetic oligonucleotide
tccctttagcttacacagtgaccatccacaaagac

SEQ ID NO: 194815 - DNA, 34 bp, Artificial Sequence
  Description of Artificial Sequence: Synthetic oligonucleotide
ccctttagcttacacagtgaccatccacaaagac

SEQ ID NO: 194816 - DNA, 36 bp, Artificial Sequence
  Description of Artificial Sequence: Synthetic oligonucleotide
cctttagcttacacagtgaccatccacaaagacttc

SEQ ID NO: 194817 - DNA, 36 bp, Artificial Sequence
  Description of Artificial Sequence: Synthetic oligonucleotide
ctttagcttacacagtgaccatccacaaagacttcg

SEQ ID NO: 194818 - DNA, 36 bp, Artificial Sequence
  Description of Artificial Sequence: Synthetic oligonucleotide
tttagcttacacagtgaccatccacaaagacttcgg

SEQ ID NO: 194819 - DNA, 35 bp, Artificial Sequence
  Description of Artificial Sequence: Synthetic oligonucleotide
ttagcttacacagtgaccatccacaaagacttcgg

SEQ ID NO: 194820 - DNA, 34 bp, Artificial Sequence
  Description of Artificial Sequence: Synthetic oligonucleotide
tagcttacacagtgaccatccacaaagacttcgg

SEQ ID NO: 194821 - DNA, 33 bp, Artificial Sequence
  Description of Artificial Sequence: Synthetic oligonucleotide
agcttacacagtgaccatccacaaagacttcgg

SEQ ID NO: 194822 - DNA, 32 bp, Artificial Sequence
  Description of Artificial Sequence: Synthetic oligonucleotide
gcttacacagtgaccatccacaaagacttcgg

SEQ ID NO: 194823 - DNA, 32 bp, Artificial Sequence
  Description of Artificial Sequence: Synthetic oligonucleotide
cttacacagtgaccatccacaaagacttcggc

SEQ ID NO: 194824 - DNA, 33 bp, Artificial Sequence
  Description of Artificial Sequence: Synthetic oligonucleotide
ttacacagtgaccatccacaaagacttcggcac

SEQ ID NO: 194825 - DNA, 32 bp, Artificial Sequence
  Description of Artificial Sequence: Synthetic oligonucleotide
tacacagtgaccatccacaaagacttcggcac

SEQ ID NO: 194826 - DNA, 31 bp, Artificial Sequence
  Description of Artificial Sequence: Synthetic oligonucleotide
acacagtgaccatccacaaagacttcggcac

SEQ ID NO: 194827 - DNA, 30 bp, Artificial Sequence
  Description of Artificial Sequence: Synthetic oligonucleotide
cacagtgaccatccacaaagacttcggcac

SEQ ID NO: 194828 - DNA, 34 bp, Artificial Sequence
  Description of Artificial Sequence: Synthetic oligonucleotide
acagtgaccatccacaaagacttcggcacttttg

SEQ ID NO: 194829 - DNA, 33 bp, Artificial Sequence
  Description of Artificial Sequence: Synthetic oligonucleotide
cagtgaccatccacaaagacttcggcacttttg

SEQ ID NO: 194830 - DNA, 34 bp, Artificial Sequence
  Description of Artificial Sequence: Synthetic oligonucleotide
agtgaccatccacaaagacttcggcacttttgag

SEQ ID NO: 194831 - DNA, 33 bp, Artificial Sequence
  Description of Artificial Sequence: Synthetic oligonucleotide
gtgaccatccacaaagacttcggcacttttgag

SEQ ID NO: 194832 - DNA, 34 bp, Artificial Sequence
  Description of Artificial Sequence: Synthetic oligonucleotide
tgaccatccacaaagacttcggcacttttgagag

SEQ ID NO: 194833 - DNA, 33 bp, Artificial Sequence
  Description of Artificial Sequence: Synthetic oligonucleotide
gaccatccacaaagacttcggcacttttgagag

SEQ ID NO: 194834 - DNA, 33 bp, Artificial Sequence
  Description of Artificial Sequence: Synthetic oligonucleotide
accatccacaaagacttcggcacttttgagagg

SEQ ID NO: 194835 - DNA, 32 bp, Artificial Sequence
  Description of Artificial Sequence: Synthetic oligonucleotide
ccatccacaaagacttcggcacttttgagagg

SEQ ID NO: 194836 - DNA, 32 bp, Artificial Sequence
  Description of Artificial Sequence: Synthetic oligonucleotide
catccacaaagacttcggcacttttgagaggc

SEQ ID NO: 194837 - DNA, 33 bp, Artificial Sequence
  Description of Artificial Sequence: Synthetic oligonucleotide
atccacaaagacttcggcacttttgagaggctc

SEQ ID NO: 194838 - DNA, 32 bp, Artificial Sequence
  Description of Artificial Sequence: Synthetic oligonucleotide
tccacaaagacttcggcacttttgagaggctc

SEQ ID NO: 194839 - DNA, 31 bp, Artificial Sequence
  Description of Artificial Sequence: Synthetic oligonucleotide
ccacaaagacttcggcacttttgagaggctc

SEQ ID NO: 194840 - DNA, 33 bp, Artificial Sequence
  Description of Artificial Sequence: Synthetic oligonucleotide
cacaaagacttcggcacttttgagaggctcttc

SEQ ID NO: 194841 - DNA, 34 bp, Artificial Sequence
  Description of Artificial Sequence: Synthetic oligonucleotide
acaaagacttcggcacttttgagaggctcttcag

SEQ ID NO: 194842 - DNA, 33 bp, Artificial Sequence
  Description of Artificial Sequence: Synthetic oligonucleotide
caaagacttcggcacttttgagaggctcttcag

SEQ ID NO: 194843 - DNA, 33 bp, Artificial Sequence
  Description of Artificial Sequence: Synthetic oligonucleotide
aaagacttcggcacttttgagaggctcttcagg

SEQ ID NO: 194844 - DNA, 32 bp, Artificial Sequence
  Description of Artificial Sequence: Synthetic oligonucleotide
aagacttcggcacttttgagaggctcttcagg

SEQ ID NO: 194845 - DNA, 31 bp, Artificial Sequence
  Description of Artificial Sequence: Synthetic oligonucleotide
agacttcggcacttttgagaggctcttcagg

SEQ ID NO: 194846 - DNA, 30 bp, Artificial Sequence
  Description of Artificial Sequence: Synthetic oligonucleotide
gacttcggcacttttgagaggctcttcagg

SEQ ID NO: 194847 - DNA, 30 bp, Artificial Sequence
  Description of Artificial Sequence: Synthetic oligonucleotide
acttcggcacttttgagaggctcttcaggg

SEQ ID NO: 194848 - DNA, 29 bp, Artificial Sequence
  Description of Artificial Sequence: Synthetic oligonucleotide
cttcggcacttttgagaggctcttcaggg

SEQ ID NO: 194849 - DNA, 29 bp, Artificial Sequence
  Description of Artificial Sequence: Synthetic oligonucleotide
ttcggcacttttgagaggctcttcagggc

SEQ ID NO: 194850 - DNA, 28 bp, Artificial Sequence
  Description of Artificial Sequence: Synthetic oligonucleotide
tcggcacttttgagaggctcttcagggc

SEQ ID NO: 194851 - DNA, 27 bp, Artificial Sequence
  Description of Artificial Sequence: Synthetic oligonucleotide
cggcacttttgagaggctcttcagggc

SEQ ID NO: 194852 - DNA, 27 bp, Artificial Sequence
  Description of Artificial Sequence: Synthetic oligonucleotide
ggcacttttgagaggctcttcagggcg

SEQ ID NO: 194853 - DNA, 35 bp, Artificial Sequence
  Description of Artificial Sequence: Synthetic oligonucleotide
gcacttttgagaggctcttcagggcgatttatatg

SEQ ID NO: 194854 - DNA, 35 bp, Artificial Sequence
  Description of Artificial Sequence: Synthetic oligonucleotide
cacttttgagaggctcttcagggcgatttatatgc

SEQ ID NO: 194855 - DNA, 35 bp, Artificial Sequence
  Description of Artificial Sequence: Synthetic oligonucleotide
acttttgagaggctcttcagggcgatttatatgcc

SEQ ID NO: 194856 - DNA, 34 bp, Artificial Sequence
  Description of Artificial Sequence: Synthetic oligonucleotide
cttttgagaggctcttcagggcgatttatatgcc

SEQ ID NO: 194857 - DNA, 34 bp, Artificial Sequence
  Description of Artificial Sequence: Synthetic oligonucleotide
ttttgagaggctcttcagggcgatttatatgccc

SEQ ID NO: 194858 - DNA, 33 bp, Artificial Sequence
  Description of Artificial Sequence: Synthetic oligonucleotide
tttgagaggctcttcagggcgatttatatgccc

SEQ ID NO: 194859 - DNA, 32 bp, Artificial Sequence
  Description of Artificial Sequence: Synthetic oligonucleotide
ttgagaggctcttcagggcgatttatatgccc

SEQ ID NO: 194860 - DNA, 31 bp, Artificial Sequence
  Description of Artificial Sequence: Synthetic oligonucleotide
tgagaggctcttcagggcgatttatatgccc

SEQ ID NO: 194861 - DNA, 30 bp, Artificial Sequence
  Description of Artificial Sequence: Synthetic oligonucleotide
gagaggctcttcagggcgatttatatgccc

SEQ ID NO: 194862 - DNA, 30 bp, Artificial Sequence
  Description of Artificial Sequence: Synthetic oligonucleotide
agaggctcttcagggcgatttatatgcccc

SEQ ID NO: 194863 - DNA, 29 bp, Artificial Sequence
  Description of Artificial Sequence: Synthetic oligonucleotide
gaggctcttcagggcgatttatatgcccc

SEQ ID NO: 194864 - DNA, 34 bp, Artificial Sequence
  Description of Artificial Sequence: Synthetic oligonucleotide
aggctcttcagggcgatttatatgccccaaaatg

SEQ ID NO: 194865 - DNA, 33 bp, Artificial Sequence
  Description of Artificial Sequence: Synthetic oligonucleotide
ggctcttcagggcgatttatatgccccaaaatg

SEQ ID NO: 194866 - DNA, 34 bp, Artificial Sequence
  Description of Artificial Sequence: Synthetic oligonucleotide
gctcttcagggcgatttatatgccccaaaatgtc

SEQ ID NO: 194867 - DNA, 36 bp, Artificial Sequence
  Description of Artificial Sequence: Synthetic oligonucleotide
ctcttcagggcgatttatatgccccaaaatgtctac

SEQ ID NO: 194868 - DNA, 37 bp, Artificial Sequence
  Description of Artificial Sequence: Synthetic oligonucleotide
tcttcagggcgatttatatgccccaaaatgtctactg

SEQ ID NO: 194869 - DNA, 36 bp, Artificial Sequence
  Description of Artificial Sequence: Synthetic oligonucleotide
cttcagggcgatttatatgccccaaaatgtctactg

SEQ ID NO: 194870 - DNA, 37 bp, Artificial Sequence
  Description of Artificial Sequence: Synthetic oligonucleotide
ttcagggcgatttatatgccccaaaatgtctactgtg

SEQ ID NO: 194871 - DNA, 36 bp, Artificial Sequence
  Description of Artificial Sequence: Synthetic oligonucleotide
tcagggcgatttatatgccccaaaatgtctactgtg

SEQ ID NO: 194872 - DNA, 35 bp, Artificial Sequence
  Description of Artificial Sequence: Synthetic oligonucleotide
cagggcgatttatatgccccaaaatgtctactgtg

SEQ ID NO: 194873 - DNA, 36 bp, Artificial Sequence
  Description of Artificial Sequence: Synthetic oligonucleotide
agggcgatttatatgccccaaaatgtctactgtgtg

SEQ ID NO: 194874 - DNA, 35 bp, Artificial Sequence
  Description of Artificial Sequence: Synthetic oligonucleotide
gggcgatttatatgccccaaaatgtctactgtgtg

SEQ ID NO: 194875 - DNA, 35 bp, Artificial Sequence
  Description of Artificial Sequence: Synthetic oligonucleotide
ggcgatttatatgccccaaaatgtctactgtgtgc

SEQ ID NO: 194876 - DNA, 36 bp, Artificial Sequence
  Description of Artificial Sequence: Synthetic oligonucleotide
gcgatttatatgccccaaaatgtctactgtgtgcac

SEQ ID NO: 194877 - DNA, 36 bp, Artificial Sequence
  Description of Artificial Sequence: Synthetic oligonucleotide
cgatttatatgccccaaaatgtctactgtgtgcacc

SEQ ID NO: 194878 - DNA, 37 bp, Artificial Sequence
  Description of Artificial Sequence: Synthetic oligonucleotide
gatttatatgccccaaaatgtctactgtgtgcacctg

SEQ ID NO: 194879 - DNA, 37 bp, Artificial Sequence
  Description of Artificial Sequence: Synthetic oligonucleotide
atttatatgccccaaaatgtctactgtgtgcacctgg

SEQ ID NO: 194880 - DNA, 36 bp, Artificial Sequence
  Description of Artificial Sequence: Synthetic oligonucleotide
tttatatgccccaaaatgtctactgtgtgcacctgg

SEQ ID NO: 194881 - DNA, 35 bp, Artificial Sequence
  Description of Artificial Sequence: Synthetic oligonucleotide
ttatatgccccaaaatgtctactgtgtgcacctgg

SEQ ID NO: 194882 - DNA, 34 bp, Artificial Sequence
  Description of Artificial Sequence: Synthetic oligonucleotide
tatatgccccaaaatgtctactgtgtgcacctgg

SEQ ID NO: 194883 - DNA, 33 bp, Artificial Sequence
  Description of Artificial Sequence: Synthetic oligonucleotide
atatgccccaaaatgtctactgtgtgcacctgg

SEQ ID NO: 194884 - DNA, 32 bp, Artificial Sequence
  Description of Artificial Sequence: Synthetic oligonucleotide
tatgccccaaaatgtctactgtgtgcacctgg

SEQ ID NO: 194885 - DNA, 31 bp, Artificial Sequence
  Description of Artificial Sequence: Synthetic oligonucleotide
atgccccaaaatgtctactgtgtgcacctgg

SEQ ID NO: 194886 - DNA, 30 bp, Artificial Sequence
  Description of Artificial Sequence: Synthetic oligonucleotide
tgccccaaaatgtctactgtgtgcacctgg

SEQ ID NO: 194887 - DNA, 29 bp, Artificial Sequence
  Description of Artificial Sequence: Synthetic oligonucleotide
gccccaaaatgtctactgtgtgcacctgg

SEQ ID NO: 194888 - DNA, 31 bp, Artificial Sequence
  Description of Artificial Sequence: Synthetic oligonucleotide
ccccaaaatgtctactgtgtgcacctggatc

SEQ ID NO: 194889 - DNA, 32 bp, Artificial Sequence
  Description of Artificial Sequence: Synthetic oligonucleotide
cccaaaatgtctactgtgtgcacctggatcag

SEQ ID NO: 194890 - DNA, 34 bp, Artificial Sequence
  Description of Artificial Sequence: Synthetic oligonucleotide
ccaaaatgtctactgtgtgcacctggatcagaag

SEQ ID NO: 194891 - DNA, 34 bp, Artificial Sequence
  Description of Artificial Sequence: Synthetic oligonucleotide
caaaatgtctactgtgtgcacctggatcagaagg

SEQ ID NO: 194892 - DNA, 34 bp, Artificial Sequence
  Description of Artificial Sequence: Synthetic oligonucleotide
aaaatgtctactgtgtgcacctggatcagaaggc

SEQ ID NO: 194893 - DNA, 33 bp, Artificial Sequence
  Description of Artificial Sequence: Synthetic oligonucleotide
aaatgtctactgtgtgcacctggatcagaaggc

SEQ ID NO: 194894 - DNA, 32 bp, Artificial Sequence
  Description of Artificial Sequence: Synthetic oligonucleotide
aatgtctactgtgtgcacctggatcagaaggc

SEQ ID NO: 194895 - DNA, 31 bp, Artificial Sequence
  Description of Artificial Sequence: Synthetic oligonucleotide
atgtctactgtgtgcacctggatcagaaggc

SEQ ID NO: 194896 - DNA, 30 bp, Artificial Sequence
  Description of Artificial Sequence: Synthetic oligonucleotide
tgtctactgtgtgcacctggatcagaaggc

SEQ ID NO: 194897 - DNA, 29 bp, Artificial Sequence
  Description of Artificial Sequence: Synthetic oligonucleotide
gtctactgtgtgcacctggatcagaaggc

SEQ ID NO: 194898 - DNA, 29 bp, Artificial Sequence
  Description of Artificial Sequence: Synthetic oligonucleotide
tctactgtgtgcacctggatcagaaggcg

SEQ ID NO: 194899 - DNA, 28 bp, Artificial Sequence
  Description of Artificial Sequence: Synthetic oligonucleotide
ctactgtgtgcacctggatcagaaggcg

SEQ ID NO: 194900 - DNA, 29 bp, Artificial Sequence
  Description of Artificial Sequence: Synthetic oligonucleotide
tactgtgtgcacctggatcagaaggcgac

SEQ ID NO: 194901 - DNA, 28 bp, Artificial Sequence
  Description of Artificial Sequence: Synthetic oligonucleotide
actgtgtgcacctggatcagaaggcgac

SEQ ID NO: 194902 - DNA, 27 bp, Artificial Sequence
  Description of Artificial Sequence: Synthetic oligonucleotide
ctgtgtgcacctggatcagaaggcgac

SEQ ID NO: 194903 - DNA, 27 bp, Artificial Sequence
  Description of Artificial Sequence: Synthetic oligonucleotide
tgtgtgcacctggatcagaaggcgacg

SEQ ID NO: 194904 - DNA, 26 bp, Artificial Sequence
  Description of Artificial Sequence: Synthetic oligonucleotide
gtgtgcacctggatcagaaggcgacg

SEQ ID NO: 194905 - DNA, 27 bp, Artificial Sequence
  Description of Artificial Sequence: Synthetic oligonucleotide
tgtgcacctggatcagaaggcgacgga

SEQ ID NO: 194906 - DNA, 27 bp, Artificial Sequence
  Description of Artificial Sequence: Synthetic oligonucleotide
gtgcacctggatcagaaggcgacggat

SEQ ID NO: 194907 - DNA, 27 bp, Artificial Sequence
  Description of Artificial Sequence: Synthetic oligonucleotide
tgcacctggatcagaaggcgacggatg

SEQ ID NO: 194908 - DNA, 26 bp, Artificial Sequence
  Description of Artificial Sequence: Synthetic oligonucleotide
gcacctggatcagaaggcgacggatg

SEQ ID NO: 194909 - DNA, 26 bp, Artificial Sequence
  Description of Artificial Sequence: Synthetic oligonucleotide
cacctggatcagaaggcgacggatgc

SEQ ID NO: 194910 - DNA, 27 bp, Artificial Sequence
  Description of Artificial Sequence: Synthetic oligonucleotide
acctggatcagaaggcgacggatgcct

SEQ ID NO: 194911 - DNA, 27 bp, Artificial Sequence
  Description of Artificial Sequence: Synthetic oligonucleotide
cctggatcagaaggcgacggatgcctt

SEQ ID NO: 194912 - DNA, 31 bp, Artificial Sequence
  Description of Artificial Sequence: Synthetic oligonucleotide
ctggatcagaaggcgacggatgcctttaaag

SEQ ID NO: 194913 - DNA, 31 bp, Artificial Sequence
  Description of Artificial Sequence: Synthetic oligonucleotide
tggatcagaaggcgacggatgcctttaaagg

SEQ ID NO: 194914 - DNA, 30 bp, Artificial Sequence
  Description of Artificial Sequence: Synthetic oligonucleotide
ggatcagaaggcgacggatgcctttaaagg

SEQ ID NO: 194915 - DNA, 31 bp, Artificial Sequence
  Description of Artificial Sequence: Synthetic oligonucleotide
gatcagaaggcgacggatgcctttaaaggtg

SEQ ID NO: 194916 - DNA, 31 bp, Artificial Sequence
  Description of Artificial Sequence: Synthetic oligonucleotide
atcagaaggcgacggatgcctttaaaggtgc

SEQ ID NO: 194917 - DNA, 30 bp, Artificial Sequence
  Description of Artificial Sequence: Synthetic oligonucleotide
tcagaaggcgacggatgcctttaaaggtgc

SEQ ID NO: 194918 - DNA, 29 bp, Artificial Sequence
  Description of Artificial Sequence: Synthetic oligonucleotide
cagaaggcgacggatgcctttaaaggtgc

SEQ ID NO: 194919 - DNA, 30 bp, Artificial Sequence
  Description of Artificial Sequence: Synthetic oligonucleotide
agaaggcgacggatgcctttaaaggtgcag

SEQ ID NO: 194920 - DNA, 29 bp, Artificial Sequence
  Description of Artificial Sequence: Synthetic oligonucleotide
gaaggcgacggatgcctttaaaggtgcag

SEQ ID NO: 194921 - DNA, 30 bp, Artificial Sequence
  Description of Artificial Sequence: Synthetic oligonucleotide
aaggcgacggatgcctttaaaggtgcagtg

SEQ ID NO: 194922 - DNA, 29 bp, Artificial Sequence
  Description of Artificial Sequence: Synthetic oligonucleotide
aggcgacggatgcctttaaaggtgcagtg

SEQ ID NO: 194923 - DNA, 28 bp, Artificial Sequence
  Description of Artificial Sequence: Synthetic oligonucleotide
ggcgacggatgcctttaaaggtgcagtg

SEQ ID NO: 194924 - DNA, 31 bp, Artificial Sequence
  Description of Artificial Sequence: Synthetic oligonucleotide
gcgacggatgcctttaaaggtgcagtgaaac

SEQ ID NO: 194925 - DNA, 32 bp, Artificial Sequence
  Description of Artificial Sequence: Synthetic oligonucleotide
cgacggatgcctttaaaggtgcagtgaaacag

SEQ ID NO: 194926 - DNA, 35 bp, Artificial Sequence
  Description of Artificial Sequence: Synthetic oligonucleotide
gacggatgcctttaaaggtgcagtgaaacagttac

SEQ ID NO: 194927 - DNA, 36 bp, Artificial Sequence
  Description of Artificial Sequence: Synthetic oligonucleotide
acggatgcctttaaaggtgcagtgaaacagttactc

SEQ ID NO: 194928 - DNA, 35 bp, Artificial Sequence
  Description of Artificial Sequence: Synthetic oligonucleotide
cggatgcctttaaaggtgcagtgaaacagttactc

SEQ ID NO: 194929 - DNA, 36 bp, Artificial Sequence
  Description of Artificial Sequence: Synthetic oligonucleotide
ggatgcctttaaaggtgcagtgaaacagttactcag

SEQ ID NO: 194930 - DNA, 36 bp, Artificial Sequence
  Description of Artificial Sequence: Synthetic oligonucleotide
gatgcctttaaaggtgcagtgaaacagttactcagc

SEQ ID NO: 194931 - DNA, 37 bp, Artificial Sequence
  Description of Artificial Sequence: Synthetic oligonucleotide
atgcctttaaaggtgcagtgaaacagttactcagctg

SEQ ID NO: 194932 - DNA, 36 bp, Artificial Sequence
  Description of Artificial Sequence: Synthetic oligonucleotide
tgcctttaaaggtgcagtgaaacagttactcagctg

SEQ ID NO: 194933 - DNA, 35 bp, Artificial Sequence
  Description of Artificial Sequence: Synthetic oligonucleotide
gcctttaaaggtgcagtgaaacagttactcagctg

SEQ ID NO: 194934 - DNA, 35 bp, Artificial Sequence
  Description of Artificial Sequence: Synthetic oligonucleotide
cctttaaaggtgcagtgaaacagttactcagctgc

SEQ ID NO: 194935 - DNA, 37 bp, Artificial Sequence
  Description of Artificial Sequence: Synthetic oligonucleotide
ctttaaaggtgcagtgaaacagttactcagctgcttc

SEQ ID NO: 194936 - DNA, 37 bp, Artificial Sequence
  Description of Artificial Sequence: Synthetic oligonucleotide
tttaaaggtgcagtgaaacagttactcagctgcttcc

SEQ ID NO: 194937 - DNA, 36 bp, Artificial Sequence
  Description of Artificial Sequence: Synthetic oligonucleotide
ttaaaggtgcagtgaaacagttactcagctgcttcc

SEQ ID NO: 194938 - DNA, 35 bp, Artificial Sequence
  Description of Artificial Sequence: Synthetic oligonucleotide
taaaggtgcagtgaaacagttactcagctgcttcc

SEQ ID NO: 194939 - DNA, 34 bp, Artificial Sequence
  Description of Artificial Sequence: Synthetic oligonucleotide
aaaggtgcagtgaaacagttactcagctgcttcc

SEQ ID NO: 194940 - DNA, 33 bp, Artificial Sequence
  Description of Artificial Sequence: Synthetic oligonucleotide
aaggtgcagtgaaacagttactcagctgcttcc

SEQ ID NO: 194941 - DNA, 32 bp, Artificial Sequence
  Description of Artificial Sequence: Synthetic oligonucleotide
aggtgcagtgaaacagttactcagctgcttcc

SEQ ID NO: 194942 - DNA, 31 bp, Artificial Sequence
  Description of Artificial Sequence: Synthetic oligonucleotide
ggtgcagtgaaacagttactcagctgcttcc

SEQ ID NO: 194943 - DNA, 31 bp, Artificial Sequence
  Description of Artificial Sequence: Synthetic oligonucleotide
gtgcagtgaaacagttactcagctgcttccc

SEQ ID NO: 194944 - DNA, 35 bp, Artificial Sequence
  Description of Artificial Sequence: Synthetic oligonucleotide
tgcagtgaaacagttactcagctgcttcccaaatg

SEQ ID NO: 194945 - DNA, 34 bp, Artificial Sequence
  Description of Artificial Sequence: Synthetic oligonucleotide
gcagtgaaacagttactcagctgcttcccaaatg

SEQ ID NO: 194946 - DNA, 34 bp, Artificial Sequence
  Description of Artificial Sequence: Synthetic oligonucleotide
cagtgaaacagttactcagctgcttcccaaatgc

SEQ ID NO: 194947 - DNA, 38 bp, Artificial Sequence
  Description of Artificial Sequence: Synthetic oligonucleotide
agtgaaacagttactcagctgcttcccaaatgcttttc

SEQ ID NO: 194948 - DNA, 37 bp, Artificial Sequence
  Description of Artificial Sequence: Synthetic oligonucleotide
gtgaaacagttactcagctgcttcccaaatgcttttc

SEQ ID NO: 194949 - DNA, 38 bp, Artificial Sequence
  Description of Artificial Sequence: Synthetic oligonucleotide
tgaaacagttactcagctgcttcccaaatgcttttctg

SEQ ID NO: 194950 - DNA, 37 bp, Artificial Sequence
  Description of Artificial Sequence: Synthetic oligonucleotide
gaaacagttactcagctgcttcccaaatgcttttctg

SEQ ID NO: 194951 - DNA, 37 bp, Artificial Sequence
  Description of Artificial Sequence: Synthetic oligonucleotide
aaacagttactcagctgcttcccaaatgcttttctgg

SEQ ID NO: 194952 - DNA, 36 bp, Artificial Sequence
  Description of Artificial Sequence: Synthetic oligonucleotide
aacagttactcagctgcttcccaaatgcttttctgg

SEQ ID NO: 194953 - DNA, 35 bp, Artificial Sequence
  Description of Artificial Sequence: Synthetic oligonucleotide
acagttactcagctgcttcccaaatgcttttctgg

SEQ ID NO: 194954 - DNA, 34 bp, Artificial Sequence
  Description of Artificial Sequence: Synthetic oligonucleotide
cagttactcagctgcttcccaaatgcttttctgg

SEQ ID NO: 194955 - DNA, 34 bp, Artificial Sequence
  Description of Artificial Sequence: Synthetic oligonucleotide
agttactcagctgcttcccaaatgcttttctggc

SEQ ID NO: 194956 - DNA, 33 bp, Artificial Sequence
  Description of Artificial Sequence: Synthetic oligonucleotide
gttactcagctgcttcccaaatgcttttctggc

SEQ ID NO: 194957 - DNA, 35 bp, Artificial Sequence
  Description of Artificial Sequence: Synthetic oligonucleotide
ttactcagctgcttcccaaatgcttttctggcttc

SEQ ID NO: 194958 - DNA, 34 bp, Artificial Sequence
  Description of Artificial Sequence: Synthetic oligonucleotide
tactcagctgcttcccaaatgcttttctggcttc

SEQ ID NO: 194959 - DNA, 33 bp, Artificial Sequence
  Description of Artificial Sequence: Synthetic oligonucleotide
actcagctgcttcccaaatgcttttctggcttc

SEQ ID NO: 194960 - DNA, 32 bp, Artificial Sequence
  Description of Artificial Sequence: Synthetic oligonucleotide
ctcagctgcttcccaaatgcttttctggcttc

SEQ ID NO: 194961 - DNA, 32 bp, Artificial Sequence
  Description of Artificial Sequence: Synthetic oligonucleotide
tcagctgcttcccaaatgcttttctggcttcc

SEQ ID NO: 194962 - DNA, 31 bp, Artificial Sequence
  Description of Artificial Sequence: Synthetic oligonucleotide
cagctgcttcccaaatgcttttctggcttcc

SEQ ID NO: 194963 - DNA, 33 bp, Artificial Sequence
  Description of Artificial Sequence: Synthetic oligonucleotide
agctgcttcccaaatgcttttctggcttccaag

SEQ ID NO: 194964 - DNA, 32 bp, Artificial Sequence
  Description of Artificial Sequence: Synthetic oligonucleotide
gctgcttcccaaatgcttttctggcttccaag

SEQ ID NO: 194965 - DNA, 34 bp, Artificial Sequence
  Description of Artificial Sequence: Synthetic oligonucleotide
ctgcttcccaaatgcttttctggcttccaagaag

SEQ ID NO: 194966 - DNA, 34 bp, Artificial Sequence
  Description of Artificial Sequence: Synthetic oligonucleotide
tgcttcccaaatgcttttctggcttccaagaagg

SEQ ID NO: 194967 - DNA, 33 bp, Artificial Sequence
  Description of Artificial Sequence: Synthetic oligonucleotide
gcttcccaaatgcttttctggcttccaagaagg

SEQ ID NO: 194968 - DNA, 34 bp, Artificial Sequence
  Description of Artificial Sequence: Synthetic oligonucleotide
cttcccaaatgcttttctggcttccaagaaggag

SEQ ID NO: 194969 - DNA, 35 bp, Artificial Sequence
  Description of Artificial Sequence: Synthetic oligonucleotide
ttcccaaatgcttttctggcttccaagaaggagtc

SEQ ID NO: 194970 - DNA, 34 bp, Artificial Sequence
  Description of Artificial Sequence: Synthetic oligonucleotide
tcccaaatgcttttctggcttccaagaaggagtc

SEQ ID NO: 194971 - DNA, 33 bp, Artificial Sequence
  Description of Artificial Sequence: Synthetic oligonucleotide
cccaaatgcttttctggcttccaagaaggagtc

SEQ ID NO: 194972 - DNA, 33 bp, Artificial Sequence
  Description of Artificial Sequence: Synthetic oligonucleotide
ccaaatgcttttctggcttccaagaaggagtcg

SEQ ID NO: 194973 - DNA, 33 bp, Artificial Sequence
  Description of Artificial Sequence: Synthetic oligonucleotide
caaatgcttttctggcttccaagaaggagtcgg

SEQ ID NO: 194974 - DNA, 35 bp, Artificial Sequence
  Description of Artificial Sequence: Synthetic oligonucleotide
aaatgcttttctggcttccaagaaggagtcggttg

SEQ ID NO: 194975 - DNA, 34 bp, Artificial Sequence
  Description of Artificial Sequence: Synthetic oligonucleotide
aatgcttttctggcttccaagaaggagtcggttg

SEQ ID NO: 194976 - DNA, 33 bp, Artificial Sequence
  Description of Artificial Sequence: Synthetic oligonucleotide
atgcttttctggcttccaagaaggagtcggttg

SEQ ID NO: 194977 - DNA, 32 bp, Artificial Sequence
  Description of Artificial Sequence: Synthetic oligonucleotide
tgcttttctggcttccaagaaggagtcggttg

SEQ ID NO: 194978 - DNA, 31 bp, Artificial Sequence
  Description of Artificial Sequence: Synthetic oligonucleotide
gcttttctggcttccaagaaggagtcggttg

SEQ ID NO: 194979 - DNA, 32 bp, Artificial Sequence
  Description of Artificial Sequence: Synthetic oligonucleotide
cttttctggcttccaagaaggagtcggttgtc

SEQ ID NO: 194980 - DNA, 35 bp, Artificial Sequence
  Description of Artificial Sequence: Synthetic oligonucleotide
ttttctggcttccaagaaggagtcggttgtctatg

SEQ ID NO: 194981 - DNA, 34 bp, Artificial Sequence
  Description of Artificial Sequence: Synthetic oligonucleotide
tttctggcttccaagaaggagtcggttgtctatg

SEQ ID NO: 194982 - DNA, 33 bp, Artificial Sequence
  Description of Artificial Sequence: Synthetic oligonucleotide
ttctggcttccaagaaggagtcggttgtctatg

SEQ ID NO: 194983 - DNA, 32 bp, Artificial Sequence
  Description of Artificial Sequence: Synthetic oligonucleotide
tctggcttccaagaaggagtcggttgtctatg

SEQ ID NO: 194984 - DNA, 31 bp, Artificial Sequence
  Description of Artificial Sequence: Synthetic oligonucleotide
ctggcttccaagaaggagtcggttgtctatg

SEQ ID NO: 194985 - DNA, 31 bp, Artificial Sequence
  Description of Artificial Sequence: Synthetic oligonucleotide
tggcttccaagaaggagtcggttgtctatgg

SEQ ID NO: 194986 - DNA, 30 bp, Artificial Sequence
  Description of Artificial Sequence: Synthetic oligonucleotide
ggcttccaagaaggagtcggttgtctatgg

SEQ ID NO: 194987 - DNA, 30 bp, Artificial Sequence
  Description of Artificial Sequence: Synthetic oligonucleotide
gcttccaagaaggagtcggttgtctatggg

SEQ ID NO: 194988 - DNA, 30 bp, Artificial Sequence
  Description of Artificial Sequence: Synthetic oligonucleotide
cttccaagaaggagtcggttgtctatgggg

SEQ ID NO: 194989 - DNA, 30 bp, Artificial Sequence
  Description of Artificial Sequence: Synthetic oligonucleotide
ttccaagaaggagtcggttgtctatggggg

SEQ ID NO: 194990 - DNA, 29 bp, Artificial Sequence
  Description of Artificial Sequence: Synthetic oligonucleotide
tccaagaaggagtcggttgtctatggggg

SEQ ID NO: 194991 - DNA, 28 bp, Artificial Sequence
  Description of Artificial Sequence: Synthetic oligonucleotide
ccaagaaggagtcggttgtctatggggg

SEQ ID NO: 194992 - DNA, 28 bp, Artificial Sequence
  Description of Artificial Sequence: Synthetic oligonucleotide
caagaaggagtcggttgtctatgggggg

SEQ ID NO: 194993 - DNA, 30 bp, Artificial Sequence
  Description of Artificial Sequence: Synthetic oligonucleotide
aagaaggagtcggttgtctatggggggatc

SEQ ID NO: 194994 - DNA, 29 bp, Artificial Sequence
  Description of Artificial Sequence: Synthetic oligonucleotide
agaaggagtcggttgtctatggggggatc

SEQ ID NO: 194995 - DNA, 28 bp, Artificial Sequence
  Description of Artificial Sequence: Synthetic oligonucleotide
gaaggagtcggttgtctatggggggatc

SEQ ID NO: 194996 - DNA, 29 bp, Artificial Sequence
  Description of Artificial Sequence: Synthetic oligonucleotide
aaggagtcggttgtctatggggggatctc

SEQ ID NO: 194997 - DNA, 28 bp, Artificial Sequence
  Description of Artificial Sequence: Synthetic oligonucleotide
aggagtcggttgtctatggggggatctc

SEQ ID NO: 194998 - DNA, 27 bp, Artificial Sequence
  Description of Artificial Sequence: Synthetic oligonucleotide
ggagtcggttgtctatggggggatctc

SEQ ID NO: 194999 - DNA, 27 bp, Artificial Sequence
  Description of Artificial Sequence: Synthetic oligonucleotide
gagtcggttgtctatggggggatctcc

SEQ ID NO: 195000 - DNA, 28 bp, Artificial Sequence
  Description of Artificial Sequence: Synthetic oligonucleotide
agtcggttgtctatggggggatctccag

SEQ ID NO: 195001 - DNA, 27 bp, Artificial Sequence
  Description of Artificial Sequence: Synthetic oligonucleotide
gtcggttgtctatggggggatctccag

SEQ ID NO: 195002 - DNA, 27 bp, Artificial Sequence
  Description of Artificial Sequence: Synthetic oligonucleotide
tcggttgtctatggggggatctccagg

SEQ ID NO: 195003 - DNA, 26 bp, Artificial Sequence
  Description of Artificial Sequence: Synthetic oligonucleotide
cggttgtctatggggggatctccagg

SEQ ID NO: 195004 - DNA, 27 bp, Artificial Sequence
  Description of Artificial Sequence: Synthetic oligonucleotide
ggttgtctatggggggatctccaggct

SEQ ID NO: 195005 - DNA, 27 bp, Artificial Sequence
  Description of Artificial Sequence: Synthetic oligonucleotide
gttgtctatggggggatctccaggctc

SEQ ID NO: 195006 - DNA, 27 bp, Artificial Sequence
  Description of Artificial Sequence: Synthetic oligonucleotide
ttgtctatggggggatctccaggctcc

SEQ ID NO: 195007 - DNA, 27 bp, Artificial Sequence
  Description of Artificial Sequence: Synthetic oligonucleotide
tgtctatggggggatctccaggctcca

SEQ ID NO: 195008 - DNA, 26 bp, Artificial Sequence
  Description of Artificial Sequence: Synthetic oligonucleotide
gtctatggggggatctccaggctcca

SEQ ID NO: 195009 - DNA, 26 bp, Artificial Sequence
  Description of Artificial Sequence: Synthetic oligonucleotide
tctatggggggatctccaggctccag

SEQ ID NO: 195010 - DNA, 25 bp, Artificial Sequence
  Description of Artificial Sequence: Synthetic oligonucleotide
ctatggggggatctccaggctccag

SEQ ID NO: 195011 - DNA, 25 bp, Artificial Sequence
  Description of Artificial Sequence: Synthetic oligonucleotide
tatggggggatctccaggctccagg

SEQ ID NO: 195012 - DNA, 24 bp, Artificial Sequence
  Description of Artificial Sequence: Synthetic oligonucleotide
atggggggatctccaggctccagg

SEQ ID NO: 195013 - DNA, 23 bp, Artificial Sequence
  Description of Artificial Sequence: Synthetic oligonucleotide
tggggggatctccaggctccagg

SEQ ID NO: 195014 - DNA, 22 bp, Artificial Sequence
  Description of Artificial Sequence: Synthetic oligonucleotide
ggggggatctccaggctccagg

SEQ ID NO: 195015 - DNA, 23 bp, Artificial Sequence
  Description of Artificial Sequence: Synthetic oligonucleotide
gggggatctccaggctccaggct

SEQ ID NO: 195016 - DNA, 24 bp, Artificial Sequence
  Description of Artificial Sequence: Synthetic oligonucleotide
ggggatctccaggctccaggctga

SEQ ID NO: 195017 - DNA, 24 bp, Artificial Sequence
  Description of Artificial Sequence: Synthetic oligonucleotide
gggatctccaggctccaggctgac

SEQ ID NO: 195018 - DNA, 25 bp, Artificial Sequence
  Description of Artificial Sequence: Synthetic oligonucleotide
ggatctccaggctccaggctgacct

SEQ ID NO: 195019 - DNA, 27 bp, Artificial Sequence
  Description of Artificial Sequence: Synthetic oligonucleotide
gatctccaggctccaggctgacctgaa

SEQ ID NO: 195020 - DNA, 27 bp, Artificial Sequence
  Description of Artificial Sequence: Synthetic oligonucleotide
atctccaggctccaggctgacctgaac

SEQ ID NO: 195021 - DNA, 27 bp, Artificial Sequence
  Description of Artificial Sequence: Synthetic oligonucleotide
tctccaggctccaggctgacctgaact

SEQ ID NO: 195022 - DNA, 26 bp, Artificial Sequence
  Description of Artificial Sequence: Synthetic oligonucleotide
ctccaggctccaggctgacctgaact

SEQ ID NO: 195023 - DNA, 26 bp, Artificial Sequence
  Description of Artificial Sequence: Synthetic oligonucleotide
tccaggctccaggctgacctgaactg

SEQ ID NO: 195024 - DNA, 25 bp, Artificial Sequence
  Description of Artificial Sequence: Synthetic oligonucleotide
ccaggctccaggctgacctgaactg

SEQ ID NO: 195025 - DNA, 25 bp, Artificial Sequence
  Description of Artificial Sequence: Synthetic oligonucleotide
caggctccaggctgacctgaactgc

SEQ ID NO: 195026 - DNA, 26 bp, Artificial Sequence
  Description of Artificial Sequence: Synthetic oligonucleotide
aggctccaggctgacctgaactgcct

SEQ ID NO: 195027 - DNA, 25 bp, Artificial Sequence
  Description of Artificial Sequence: Synthetic oligonucleotide
ggctccaggctgacctgaactgcct

SEQ ID NO: 195028 - DNA, 25 bp, Artificial Sequence
  Description of Artificial Sequence: Synthetic oligonucleotide
gctccaggctgacctgaactgcctg

SEQ ID NO: 195029 - DNA, 27 bp, Artificial Sequence
  Description of Artificial Sequence: Synthetic oligonucleotide
ctccaggctgacctgaactgcctggaa

SEQ ID NO: 195030 - DNA, 27 bp, Artificial Sequence
  Description of Artificial Sequence: Synthetic oligonucleotide
tccaggctgacctgaactgcctggaag

SEQ ID NO: 195031 - DNA, 27 bp, Artificial Sequence
  Description of Artificial Sequence: Synthetic oligonucleotide
ccaggctgacctgaactgcctggaaga

SEQ ID NO: 195032 - DNA, 27 bp, Artificial Sequence
  Description of Artificial Sequence: Synthetic oligonucleotide
caggctgacctgaactgcctggaagac

SEQ ID NO: 195033 - DNA, 27 bp, Artificial Sequence
  Description of Artificial Sequence: Synthetic oligonucleotide
aggctgacctgaactgcctggaagacc

SEQ ID NO: 195034 - DNA, 27 bp, Artificial Sequence
  Description of Artificial Sequence: Synthetic oligonucleotide
ggctgacctgaactgcctggaagacct

SEQ ID NO: 195035 - DNA, 28 bp, Artificial Sequence
  Description of Artificial Sequence: Synthetic oligonucleotide
gctgacctgaactgcctggaagaccttg

SEQ ID NO: 195036 - DNA, 29 bp, Artificial Sequence
  Description of Artificial Sequence: Synthetic oligonucleotide
ctgacctgaactgcctggaagaccttgtg

SEQ ID NO: 195037 - DNA, 29 bp, Artificial Sequence
  Description of Artificial Sequence: Synthetic oligonucleotide
tgacctgaactgcctggaagaccttgtgg

SEQ ID NO: 195038 - DNA, 28 bp, Artificial Sequence
  Description of Artificial Sequence: Synthetic oligonucleotide
gacctgaactgcctggaagaccttgtgg

SEQ ID NO: 195039 - DNA, 28 bp, Artificial Sequence
  Description of Artificial Sequence: Synthetic oligonucleotide
acctgaactgcctggaagaccttgtggc

SEQ ID NO: 195040 - DNA, 27 bp, Artificial Sequence
  Description of Artificial Sequence: Synthetic oligonucleotide
cctgaactgcctggaagaccttgtggc

SEQ ID NO: 195041 - DNA, 27 bp, Artificial Sequence
  Description of Artificial Sequence: Synthetic oligonucleotide
ctgaactgcctggaagaccttgtggcc

SEQ ID NO: 195042 - DNA, 28 bp, Artificial Sequence
  Description of Artificial Sequence: Synthetic oligonucleotide
tgaactgcctggaagaccttgtggcctc

SEQ ID NO: 195043 - DNA, 27 bp, Artificial Sequence
  Description of Artificial Sequence: Synthetic oligonucleotide
gaactgcctggaagaccttgtggcctc

SEQ ID NO: 195044 - DNA, 28 bp, Artificial Sequence
  Description of Artificial Sequence: Synthetic oligonucleotide
aactgcctggaagaccttgtggcctctg

SEQ ID NO: 195045 - DNA, 27 bp, Artificial Sequence
  Description of Artificial Sequence: Synthetic oligonucleotide
actgcctggaagaccttgtggcctctg

SEQ ID NO: 195046 - DNA, 27 bp, Artificial Sequence
  Description of Artificial Sequence: Synthetic oligonucleotide
ctgcctggaagaccttgtggcctctga

SEQ ID NO: 195047 - DNA, 28 bp, Artificial Sequence
  Description of Artificial Sequence: Synthetic oligonucleotide
tgcctggaagaccttgtggcctctgaag

SEQ ID NO: 195048 - DNA, 27 bp, Artificial Sequence
  Description of Artificial Sequence: Synthetic oligonucleotide
gcctggaagaccttgtggcctctgaag

SEQ ID NO: 195049 - DNA, 29 bp, Artificial Sequence
  Description of Artificial Sequence: Synthetic oligonucleotide
cctggaagaccttgtggcctctgaagttc

SEQ ID NO: 195050 - DNA, 29 bp, Artificial Sequence
  Description of Artificial Sequence: Synthetic oligonucleotide
ctggaagaccttgtggcctctgaagttcc

SEQ ID NO: 195051 - DNA, 29 bp, Artificial Sequence
  Description of Artificial Sequence: Synthetic oligonucleotide
tggaagaccttgtggcctctgaagttccc

SEQ ID NO: 195052 - DNA, 28 bp, Artificial Sequence
  Description of Artificial Sequence: Synthetic oligonucleotide
ggaagaccttgtggcctctgaagttccc

SEQ ID NO: 195053 - DNA, 29 bp, Artificial Sequence
  Description of Artificial Sequence: Synthetic oligonucleotide
gaagaccttgtggcctctgaagttccctg

SEQ ID NO: 195054 - DNA, 29 bp, Artificial Sequence
  Description of Artificial Sequence: Synthetic oligonucleotide
aagaccttgtggcctctgaagttccctgg

SEQ ID NO: 195055 - DNA, 28 bp, Artificial Sequence
  Description of Artificial Sequence: Synthetic oligonucleotide
agaccttgtggcctctgaagttccctgg

SEQ ID NO: 195056 - DNA, 27 bp, Artificial Sequence
  Description of Artificial Sequence: Synthetic oligonucleotide
gaccttgtggcctctgaagttccctgg

SEQ ID NO: 195057 - DNA, 29 bp, Artificial Sequence
  Description of Artificial Sequence: Synthetic oligonucleotide
accttgtggcctctgaagttccctggaag

SEQ ID NO: 195058 - DNA, 28 bp, Artificial Sequence
  Description of Artificial Sequence: Synthetic oligonucleotide
ccttgtggcctctgaagttccctggaag

SEQ ID NO: 195059 - DNA, 31 bp, Artificial Sequence
  Description of Artificial Sequence: Synthetic oligonucleotide
cttgtggcctctgaagttccctggaagtatg

SEQ ID NO: 195060 - DNA, 32 bp, Artificial Sequence
  Description of Artificial Sequence: Synthetic oligonucleotide
ttgtggcctctgaagttccctggaagtatgtc

SEQ ID NO: 195061 - DNA, 31 bp, Artificial Sequence
  Description of Artificial Sequence: Synthetic oligonucleotide
tgtggcctctgaagttccctggaagtatgtc

SEQ ID NO: 195062 - DNA, 30 bp, Artificial Sequence
  Description of Artificial Sequence: Synthetic oligonucleotide
gtggcctctgaagttccctggaagtatgtc

SEQ ID NO: 195063 - DNA, 32 bp, Artificial Sequence
  Description of Artificial Sequence: Synthetic oligonucleotide
tggcctctgaagttccctggaagtatgtcatc

SEQ ID NO: 195064 - DNA, 31 bp, Artificial Sequence
  Description of Artificial Sequence: Synthetic oligonucleotide
ggcctctgaagttccctggaagtatgtcatc

SEQ ID NO: 195065 - DNA, 33 bp, Artificial Sequence
  Description of Artificial Sequence: Synthetic oligonucleotide
gcctctgaagttccctggaagtatgtcatcaac

SEQ ID NO: 195066 - DNA, 34 bp, Artificial Sequence
  Description of Artificial Sequence: Synthetic oligonucleotide
cctctgaagttccctggaagtatgtcatcaacac

SEQ ID NO: 195067 - DNA, 34 bp, Artificial Sequence
  Description of Artificial Sequence: Synthetic oligonucleotide
ctctgaagttccctggaagtatgtcatcaacacc

SEQ ID NO: 195068 - DNA, 35 bp, Artificial Sequence
  Description of Artificial Sequence: Synthetic oligonucleotide
tctgaagttccctggaagtatgtcatcaacacctg

SEQ ID NO: 195069 - DNA, 34 bp, Artificial Sequence
  Description of Artificial Sequence: Synthetic oligonucleotide
ctgaagttccctggaagtatgtcatcaacacctg

SEQ ID NO: 195070 - DNA, 34 bp, Artificial Sequence
  Description of Artificial Sequence: Synthetic oligonucleotide
tgaagttccctggaagtatgtcatcaacacctgc

SEQ ID NO: 195071 - DNA, 33 bp, Artificial Sequence
  Description of Artificial Sequence: Synthetic oligonucleotide
gaagttccctggaagtatgtcatcaacacctgc

SEQ ID NO: 195072 - DNA, 33 bp, Artificial Sequence
  Description of Artificial Sequence: Synthetic oligonucleotide
aagttccctggaagtatgtcatcaacacctgcg

SEQ ID NO: 195073 - DNA, 32 bp, Artificial Sequence
  Description of Artificial Sequence: Synthetic oligonucleotide
agttccctggaagtatgtcatcaacacctgcg

SEQ ID NO: 195074 - DNA, 31 bp, Artificial Sequence
  Description of Artificial Sequence: Synthetic oligonucleotide
gttccctggaagtatgtcatcaacacctgcg

SEQ ID NO: 195075 - DNA, 31 bp, Artificial Sequence
  Description of Artificial Sequence: Synthetic oligonucleotide
ttccctggaagtatgtcatcaacacctgcgg

SEQ ID NO: 195076 - DNA, 30 bp, Artificial Sequence
  Description of Artificial Sequence: Synthetic oligonucleotide
tccctggaagtatgtcatcaacacctgcgg

SEQ ID NO: 195077 - DNA, 29 bp, Artificial Sequence
  Description of Artificial Sequence: Synthetic oligonucleotide
ccctggaagtatgtcatcaacacctgcgg

SEQ ID NO: 195078 - DNA, 29 bp, Artificial Sequence
  Description of Artificial Sequence: Synthetic oligonucleotide
cctggaagtatgtcatcaacacctgcggg

SEQ ID NO: 195079 - DNA, 29 bp, Artificial Sequence
  Description of Artificial Sequence: Synthetic oligonucleotide
ctggaagtatgtcatcaacacctgcgggc

SEQ ID NO: 195080 - DNA, 31 bp, Artificial Sequence
  Description of Artificial Sequence: Synthetic oligonucleotide
tggaagtatgtcatcaacacctgcgggcaag

SEQ ID NO: 195081 - DNA, 30 bp, Artificial Sequence
  Description of Artificial Sequence: Synthetic oligonucleotide
ggaagtatgtcatcaacacctgcgggcaag

SEQ ID NO: 195082 - DNA, 31 bp, Artificial Sequence
  Description of Artificial Sequence: Synthetic oligonucleotide
gaagtatgtcatcaacacctgcgggcaagac

SEQ ID NO: 195083 - DNA, 34 bp, Artificial Sequence
  Description of Artificial Sequence: Synthetic oligonucleotide
aagtatgtcatcaacacctgcgggcaagactttc

SEQ ID NO: 195084 - DNA, 33 bp, Artificial Sequence
  Description of Artificial Sequence: Synthetic oligonucleotide
agtatgtcatcaacacctgcgggcaagactttc

SEQ ID NO: 195085 - DNA, 32 bp, Artificial Sequence
  Description of Artificial Sequence: Synthetic oligonucleotide
gtatgtcatcaacacctgcgggcaagactttc

SEQ ID NO: 195086 - DNA, 32 bp, Artificial Sequence
  Description of Artificial Sequence: Synthetic oligonucleotide
tatgtcatcaacacctgcgggcaagactttcc

SEQ ID NO: 195087 - DNA, 31 bp, Artificial Sequence
  Description of Artificial Sequence: Synthetic oligonucleotide
atgtcatcaacacctgcgggcaagactttcc

SEQ ID NO: 195088 - DNA, 30 bp, Artificial Sequence
  Description of Artificial Sequence: Synthetic oligonucleotide
tgtcatcaacacctgcgggcaagactttcc

SEQ ID NO: 195089 - DNA, 29 bp, Artificial Sequence
  Description of Artificial Sequence: Synthetic oligonucleotide
gtcatcaacacctgcgggcaagactttcc

SEQ ID NO: 195090 - DNA, 29 bp, Artificial Sequence
  Description of Artificial Sequence: Synthetic oligonucleotide
tcatcaacacctgcgggcaagactttccc

SEQ ID NO: 195091 - DNA, 28 bp, Artificial Sequence
  Description of Artificial Sequence: Synthetic oligonucleotide
catcaacacctgcgggcaagactttccc

SEQ ID NO: 195092 - DNA, 28 bp, Artificial Sequence
  Description of Artificial Sequence: Synthetic oligonucleotide
atcaacacctgcgggcaagactttcccc

SEQ ID NO: 195093 - DNA, 27 bp, Artificial Sequence
  Description of Artificial Sequence: Synthetic oligonucleotide
tcaacacctgcgggcaagactttcccc

SEQ ID NO: 195094 - DNA, 27 bp, Artificial Sequence
  Description of Artificial Sequence: Synthetic oligonucleotide
caacacctgcgggcaagactttcccct

SEQ ID NO: 195095 - DNA, 27 bp, Artificial Sequence
  Description of Artificial Sequence: Synthetic oligonucleotide
aacacctgcgggcaagactttcccctg

SEQ ID NO: 195096 - DNA, 27 bp, Artificial Sequence
  Description of Artificial Sequence: Synthetic oligonucleotide
acacctgcgggcaagactttcccctga

SEQ ID NO: 195097 - DNA, 27 bp, Artificial Sequence
  Description of Artificial Sequence: Synthetic oligonucleotide
cacctgcgggcaagactttcccctgaa

SEQ ID NO: 195098 - DNA, 29 bp, Artificial Sequence
  Description of Artificial Sequence: Synthetic oligonucleotide
acctgcgggcaagactttcccctgaaaac

SEQ ID NO: 195099 - DNA, 28 bp, Artificial Sequence
  Description of Artificial Sequence: Synthetic oligonucleotide
cctgcgggcaagactttcccctgaaaac

SEQ ID NO: 195100 - DNA, 28 bp, Artificial Sequence
  Description of Artificial Sequence: Synthetic oligonucleotide
ctgcgggcaagactttcccctgaaaacc

SEQ ID NO: 195101 - DNA, 30 bp, Artificial Sequence
  Description of Artificial Sequence: Synthetic oligonucleotide
tgcgggcaagactttcccctgaaaaccaac

SEQ ID NO: 195102 - DNA, 29 bp, Artificial Sequence
  Description of Artificial Sequence: Synthetic oligonucleotide
gcgggcaagactttcccctgaaaaccaac

SEQ ID NO: 195103 - DNA, 30 bp, Artificial Sequence
  Description of Artificial Sequence: Synthetic oligonucleotide
cgggcaagactttcccctgaaaaccaacag

SEQ ID NO: 195104 - DNA, 30 bp, Artificial Sequence
  Description of Artificial Sequence: Synthetic oligonucleotide
gggcaagactttcccctgaaaaccaacagg

SEQ ID NO: 195105 - DNA, 30 bp, Artificial Sequence
  Description of Artificial Sequence: Synthetic oligonucleotide
ggcaagactttcccctgaaaaccaacaggg

SEQ ID NO: 195106 - DNA, 35 bp, Artificial Sequence
  Description of Artificial Sequence: Synthetic oligonucleotide
gcaagactttcccctgaaaaccaacagggaaatag

SEQ ID NO: 195107 - DNA, 37 bp, Artificial Sequence
  Description of Artificial Sequence: Synthetic oligonucleotide
caagactttcccctgaaaaccaacagggaaatagttc

SEQ ID NO: 195108 - DNA, 38 bp, Artificial Sequence
  Description of Artificial Sequence: Synthetic oligonucleotide
aagactttcccctgaaaaccaacagggaaatagttcag

SEQ ID NO: 195109 - DNA, 37 bp, Artificial Sequence
  Description of Artificial Sequence: Synthetic oligonucleotide
agactttcccctgaaaaccaacagggaaatagttcag

SEQ ID NO: 195110 - DNA, 36 bp, Artificial Sequence
  Description of Artificial Sequence: Synthetic oligonucleotide
gactttcccctgaaaaccaacagggaaatagttcag

SEQ ID NO: 195111 - DNA, 39 bp, Artificial Sequence
  Description of Artificial Sequence: Synthetic oligonucleotide
actttcccctgaaaaccaacagggaaatagttcagtatc

SEQ ID NO: 195112 - DNA, 38 bp, Artificial Sequence
  Description of Artificial Sequence: Synthetic oligonucleotide
ctttcccctgaaaaccaacagggaaatagttcagtatc

SEQ ID NO: 195113 - DNA, 39 bp, Artificial Sequence
  Description of Artificial Sequence: Synthetic oligonucleotide
tttcccctgaaaaccaacagggaaatagttcagtatctg

SEQ ID NO: 195114 - DNA, 38 bp, Artificial Sequence
  Description of Artificial Sequence: Synthetic oligonucleotide
ttcccctgaaaaccaacagggaaatagttcagtatctg

SEQ ID NO: 195115 - DNA, 37 bp, Artificial Sequence
  Description of Artificial Sequence: Synthetic oligonucleotide
tcccctgaaaaccaacagggaaatagttcagtatctg

SEQ ID NO: 195116 - DNA, 36 bp, Artificial Sequence
  Description of Artificial Sequence: Synthetic oligonucleotide
cccctgaaaaccaacagggaaatagttcagtatctg

SEQ ID NO: 195117 - DNA, 38 bp, Artificial Sequence
  Description of Artificial Sequence: Synthetic oligonucleotide
ccctgaaaaccaacagggaaatagttcagtatctgaag

SEQ ID NO: 195118 - DNA, 38 bp, Artificial Sequence
  Description of Artificial Sequence: Synthetic oligonucleotide
cctgaaaaccaacagggaaatagttcagtatctgaagg

SEQ ID NO: 195119 - DNA, 38 bp, Artificial Sequence
  Description of Artificial Sequence: Synthetic oligonucleotide
ctgaaaaccaacagggaaatagttcagtatctgaaggg

SEQ ID NO: 195120 - DNA, 45 bp, Artificial Sequence
  Description of Artificial Sequence: Synthetic oligonucleotide
tgaaaaccaacagggaaatagttcagtatctgaagggatttaaag

SEQ ID NO: 195121 - DNA, 44 bp, Artificial Sequence
  Description of Artificial Sequence: Synthetic oligonucleotide
gaaaaccaacagggaaatagttcagtatctgaagggatttaaag

SEQ ID NO: 195122 - DNA, 44 bp, Artificial Sequence
  Description of Artificial Sequence: Synthetic oligonucleotide
aaaaccaacagggaaatagttcagtatctgaagggatttaaagg

SEQ ID NO: 195123 - DNA, 43 bp, Artificial Sequence
  Description of Artificial Sequence: Synthetic oligonucleotide
aaaccaacagggaaatagttcagtatctgaagggatttaaagg

SEQ ID NO: 195124 - DNA, 42 bp, Artificial Sequence
  Description of Artificial Sequence: Synthetic oligonucleotide
aaccaacagggaaatagttcagtatctgaagggatttaaagg

SEQ ID NO: 195125 - DNA, 41 bp, Artificial Sequence
  Description of Artificial Sequence: Synthetic oligonucleotide
accaacagggaaatagttcagtatctgaagggatttaaagg

SEQ ID NO: 195126 - DNA, 40 bp, Artificial Sequence
  Description of Artificial Sequence: Synthetic oligonucleotide
ccaacagggaaatagttcagtatctgaagggatttaaagg

SEQ ID NO: 195127 - DNA, 40 bp, Artificial Sequence
  Description of Artificial Sequence: Synthetic oligonucleotide
caacagggaaatagttcagtatctgaagggatttaaaggg

SEQ ID NO: 195128 - DNA, 48 bp, Artificial Sequence
  Description of Artificial Sequence: Synthetic oligonucleotide
aacagggaaatagttcagtatctgaagggatttaaagggaaaaatatc

SEQ ID NO: 195129 - DNA, 47 bp, Artificial Sequence
  Description of Artificial Sequence: Synthetic oligonucleotide
acagggaaatagttcagtatctgaagggatttaaagggaaaaatatc

SEQ ID NO: 195130 - DNA, 46 bp, Artificial Sequence
  Description of Artificial Sequence: Synthetic oligonucleotide
cagggaaatagttcagtatctgaagggatttaaagggaaaaatatc

SEQ ID NO: 195131 - DNA, 47 bp, Artificial Sequence
  Description of Artificial Sequence: Synthetic oligonucleotide
agggaaatagttcagtatctgaagggatttaaagggaaaaatatcac

SEQ ID NO: 195132 - DNA, 46 bp, Artificial Sequence
  Description of Artificial Sequence: Synthetic oligonucleotide
gggaaatagttcagtatctgaagggatttaaagggaaaaatatcac

SEQ ID NO: 195133 - DNA, 46 bp, Artificial Sequence
  Description of Artificial Sequence: Synthetic oligonucleotide
ggaaatagttcagtatctgaagggatttaaagggaaaaatatcacc

SEQ ID NO: 195134 - DNA, 46 bp, Artificial Sequence
  Description of Artificial Sequence: Synthetic oligonucleotide
gaaatagttcagtatctgaagggatttaaagggaaaaatatcaccc

SEQ ID NO: 195135 - DNA, 46 bp, Artificial Sequence
  Description of Artificial Sequence: Synthetic oligonucleotide
aaatagttcagtatctgaagggatttaaagggaaaaatatcacccc

SEQ ID NO: 195136 - DNA, 45 bp, Artificial Sequence
  Description of Artificial Sequence: Synthetic oligonucleotide
aatagttcagtatctgaagggatttaaagggaaaaatatcacccc

SEQ ID NO: 195137 - DNA, 44 bp, Artificial Sequence
  Description of Artificial Sequence: Synthetic oligonucleotide
atagttcagtatctgaagggatttaaagggaaaaatatcacccc

SEQ ID NO: 195138 - DNA, 43 bp, Artificial Sequence
  Description of Artificial Sequence: Synthetic oligonucleotide
tagttcagtatctgaagggatttaaagggaaaaatatcacccc

SEQ ID NO: 195139 - DNA, 42 bp, Artificial Sequence
  Description of Artificial Sequence: Synthetic oligonucleotide
agttcagtatctgaagggatttaaagggaaaaatatcacccc

SEQ ID NO: 195140 - DNA, 41 bp, Artificial Sequence
  Description of Artificial Sequence: Synthetic oligonucleotide
gttcagtatctgaagggatttaaagggaaaaatatcacccc

SEQ ID NO: 195141 - DNA, 41 bp, Artificial Sequence
  Description of Artificial Sequence: Synthetic oligonucleotide
ttcagtatctgaagggatttaaagggaaaaatatcaccccc

SEQ ID NO: 195142 - DNA, 40 bp, Artificial Sequence
  Description of Artificial Sequence: Synthetic oligonucleotide
tcagtatctgaagggatttaaagggaaaaatatcaccccc

SEQ ID NO: 195143 - DNA, 39 bp, Artificial Sequence
  Description of Artificial Sequence: Synthetic oligonucleotide
cagtatctgaagggatttaaagggaaaaatatcaccccc

SEQ ID NO: 195144 - DNA, 39 bp, Artificial Sequence
  Description of Artificial Sequence: Synthetic oligonucleotide
agtatctgaagggatttaaagggaaaaatatcacccccg

SEQ ID NO: 195145 - DNA, 38 bp, Artificial Sequence
  Description of Artificial Sequence: Synthetic oligonucleotide
gtatctgaagggatttaaagggaaaaatatcacccccg

SEQ ID NO: 195146 - DNA, 38 bp, Artificial Sequence
  Description of Artificial Sequence: Synthetic oligonucleotide
tatctgaagggatttaaagggaaaaatatcacccccgg

SEQ ID NO: 195147 - DNA, 37 bp, Artificial Sequence
  Description of Artificial Sequence: Synthetic oligonucleotide
atctgaagggatttaaagggaaaaatatcacccccgg

SEQ ID NO: 195148 - DNA, 36 bp, Artificial Sequence
  Description of Artificial Sequence: Synthetic oligonucleotide
tctgaagggatttaaagggaaaaatatcacccccgg

SEQ ID NO: 195149 - DNA, 35 bp, Artificial Sequence
  Description of Artificial Sequence: Synthetic oligonucleotide
ctgaagggatttaaagggaaaaatatcacccccgg

SEQ ID NO: 195150 - DNA, 36 bp, Artificial Sequence
  Description of Artificial Sequence: Synthetic oligonucleotide
tgaagggatttaaagggaaaaatatcacccccggag

SEQ ID NO: 195151 - DNA, 35 bp, Artificial Sequence
  Description of Artificial Sequence: Synthetic oligonucleotide
gaagggatttaaagggaaaaatatcacccccggag

SEQ ID NO: 195152 - DNA, 36 bp, Artificial Sequence
  Description of Artificial Sequence: Synthetic oligonucleotide
aagggatttaaagggaaaaatatcacccccggagtg

SEQ ID NO: 195153 - DNA, 35 bp, Artificial Sequence
  Description of Artificial Sequence: Synthetic oligonucleotide
agggatttaaagggaaaaatatcacccccggagtg

SEQ ID NO: 195154 - DNA, 34 bp, Artificial Sequence
  Description of Artificial Sequence: Synthetic oligonucleotide
gggatttaaagggaaaaatatcacccccggagtg

SEQ ID NO: 195155 - DNA, 34 bp, Artificial Sequence
  Description of Artificial Sequence: Synthetic oligonucleotide
ggatttaaagggaaaaatatcacccccggagtgc

SEQ ID NO: 195156 - DNA, 35 bp, Artificial Sequence
  Description of Artificial Sequence: Synthetic oligonucleotide
gatttaaagggaaaaatatcacccccggagtgctg

SEQ ID NO: 195157 - DNA, 35 bp, Artificial Sequence
  Description of Artificial Sequence: Synthetic oligonucleotide
atttaaagggaaaaatatcacccccggagtgctgc

SEQ ID NO: 195158 - DNA, 34 bp, Artificial Sequence
  Description of Artificial Sequence: Synthetic oligonucleotide
tttaaagggaaaaatatcacccccggagtgctgc

SEQ ID NO: 195159 - DNA, 33 bp, Artificial Sequence
  Description of Artificial Sequence: Synthetic oligonucleotide
ttaaagggaaaaatatcacccccggagtgctgc

SEQ ID NO: 195160 - DNA, 32 bp, Artificial Sequence
  Description of Artificial Sequence: Synthetic oligonucleotide
taaagggaaaaatatcacccccggagtgctgc

SEQ ID NO: 195161 - DNA, 31 bp, Artificial Sequence
  Description of Artificial Sequence: Synthetic oligonucleotide
aaagggaaaaatatcacccccggagtgctgc

SEQ ID NO: 195162 - DNA, 30 bp, Artificial Sequence
  Description of Artificial Sequence: Synthetic oligonucleotide
aagggaaaaatatcacccccggagtgctgc

SEQ ID NO: 195163 - DNA, 29 bp, Artificial Sequence
  Description of Artificial Sequence: Synthetic oligonucleotide
agggaaaaatatcacccccggagtgctgc

SEQ ID NO: 195164 - DNA, 28 bp, Artificial Sequence
  Description of Artificial Sequence: Synthetic oligonucleotide
gggaaaaatatcacccccggagtgctgc

SEQ ID NO: 195165 - DNA, 28 bp, Artificial Sequence
  Description of Artificial Sequence: Synthetic oligonucleotide
ggaaaaatatcacccccggagtgctgcc

SEQ ID NO: 195166 - DNA, 29 bp, Artificial Sequence
  Description of Artificial Sequence: Synthetic oligonucleotide
gaaaaatatcacccccggagtgctgcctc

SEQ ID NO: 195167 - DNA, 29 bp, Artificial Sequence
  Description of Artificial Sequence: Synthetic oligonucleotide
aaaaatatcacccccggagtgctgcctcc

SEQ ID NO: 195168 - DNA, 28 bp, Artificial Sequence
  Description of Artificial Sequence: Synthetic oligonucleotide
aaaatatcacccccggagtgctgcctcc

SEQ ID NO: 195169 - DNA, 27 bp, Artificial Sequence
  Description of Artificial Sequence: Synthetic oligonucleotide
aaatatcacccccggagtgctgcctcc

SEQ ID NO: 195170 - DNA, 27 bp, Artificial Sequence
  Description of Artificial Sequence: Synthetic oligonucleotide
aatatcacccccggagtgctgcctcct

SEQ ID NO: 195171 - DNA, 26 bp, Artificial Sequence
  Description of Artificial Sequence: Synthetic oligonucleotide
atatcacccccggagtgctgcctcct

SEQ ID NO: 195172 - DNA, 25 bp, Artificial Sequence
  Description of Artificial Sequence: Synthetic oligonucleotide
tatcacccccggagtgctgcctcct

SEQ ID NO: 195173 - DNA, 24 bp, Artificial Sequence
  Description of Artificial Sequence: Synthetic oligonucleotide
atcacccccggagtgctgcctcct

SEQ ID NO: 195174 - DNA, 23 bp, Artificial Sequence
  Description of Artificial Sequence: Synthetic oligonucleotide
tcacccccggagtgctgcctcct

SEQ ID NO: 195175 - DNA, 22 bp, Artificial Sequence
  Description of Artificial Sequence: Synthetic oligonucleotide
cacccccggagtgctgcctcct

SEQ ID NO: 195176 - DNA, 23 bp, Artificial Sequence
  Description of Artificial Sequence: Synthetic oligonucleotide
acccccggagtgctgcctcctga

SEQ ID NO: 195177 - DNA, 22 bp, Artificial Sequence
  Description of Artificial Sequence: Synthetic oligonucleotide
cccccggagtgctgcctcctga

SEQ ID NO: 195178 - DNA, 22 bp, Artificial Sequence
  Description of Artificial Sequence: Synthetic oligonucleotide
ccccggagtgctgcctcctgac

SEQ ID NO: 195179 - DNA, 23 bp, Artificial Sequence
  Description of Artificial Sequence: Synthetic oligonucleotide
cccggagtgctgcctcctgacca

SEQ ID NO: 195180 - DNA, 23 bp, Artificial Sequence
  Description of Artificial Sequence: Synthetic oligonucleotide
ccggagtgctgcctcctgaccac

SEQ ID NO: 195181 - DNA, 23 bp, Artificial Sequence
  Description of Artificial Sequence: Synthetic oligonucleotide
cggagtgctgcctcctgaccacg

SEQ ID NO: 195182 - DNA, 24 bp, Artificial Sequence
  Description of Artificial Sequence: Synthetic oligonucleotide
ggagtgctgcctcctgaccacgct

SEQ ID NO: 195183 - DNA, 26 bp, Artificial Sequence
  Description of Artificial Sequence: Synthetic oligonucleotide
gagtgctgcctcctgaccacgctgtt

SEQ ID NO: 195184 - DNA, 26 bp, Artificial Sequence
  Description of Artificial Sequence: Synthetic oligonucleotide
agtgctgcctcctgaccacgctgttg

SEQ ID NO: 195185 - DNA, 25 bp, Artificial Sequence
  Description of Artificial Sequence: Synthetic oligonucleotide
gtgctgcctcctgaccacgctgttg

SEQ ID NO: 195186 - DNA, 26 bp, Artificial Sequence
  Description of Artificial Sequence: Synthetic oligonucleotide
tgctgcctcctgaccacgctgttgga

SEQ ID NO: 195187 - DNA, 25 bp, Artificial Sequence
  Description of Artificial Sequence: Synthetic oligonucleotide
gctgcctcctgaccacgctgttgga

SEQ ID NO: 195188 - DNA, 25 bp, Artificial Sequence
  Description of Artificial Sequence: Synthetic oligonucleotide
ctgcctcctgaccacgctgttggac

SEQ ID NO: 195189 - DNA, 25 bp, Artificial Sequence
  Description of Artificial Sequence: Synthetic oligonucleotide
tgcctcctgaccacgctgttggacg

SEQ ID NO: 195190 - DNA, 24 bp, Artificial Sequence
  Description of Artificial Sequence: Synthetic oligonucleotide
gcctcctgaccacgctgttggacg

SEQ ID NO: 195191 - DNA, 25 bp, Artificial Sequence
  Description of Artificial Sequence: Synthetic oligonucleotide
cctcctgaccacgctgttggacgga

SEQ ID NO: 195192 - DNA, 27 bp, Artificial Sequence
  Description of Artificial Sequence: Synthetic oligonucleotide
ctcctgaccacgctgttggacggacta

SEQ ID NO: 195193 - DNA, 31 bp, Artificial Sequence
  Description of Artificial Sequence: Synthetic oligonucleotide
tcctgaccacgctgttggacggactaaatac

SEQ ID NO: 195194 - DNA, 30 bp, Artificial Sequence
  Description of Artificial Sequence: Synthetic oligonucleotide
cctgaccacgctgttggacggactaaatac

SEQ ID NO: 195195 - DNA, 30 bp, Artificial Sequence
  Description of Artificial Sequence: Synthetic oligonucleotide
ctgaccacgctgttggacggactaaatacg

SEQ ID NO: 195196 - DNA, 31 bp, Artificial Sequence
  Description of Artificial Sequence: Synthetic oligonucleotide
tgaccacgctgttggacggactaaatacgtc

SEQ ID NO: 195197 - DNA, 30 bp, Artificial Sequence
  Description of Artificial Sequence: Synthetic oligonucleotide
gaccacgctgttggacggactaaatacgtc

SEQ ID NO: 195198 - DNA, 30 bp, Artificial Sequence
  Description of Artificial Sequence: Synthetic oligonucleotide
accacgctgttggacggactaaatacgtcc

SEQ ID NO: 195199 - DNA, 29 bp, Artificial Sequence
  Description of Artificial Sequence: Synthetic oligonucleotide
ccacgctgttggacggactaaatacgtcc

SEQ ID NO: 195200 - DNA, 30 bp, Artificial Sequence
  Description of Artificial Sequence: Synthetic oligonucleotide
cacgctgttggacggactaaatacgtccac

SEQ ID NO: 195201 - DNA, 30 bp, Artificial Sequence
  Description of Artificial Sequence: Synthetic oligonucleotide
acgctgttggacggactaaatacgtccacc

SEQ ID NO: 195202 - DNA, 29 bp, Artificial Sequence
  Description of Artificial Sequence: Synthetic oligonucleotide
cgctgttggacggactaaatacgtccacc

SEQ ID NO: 195203 - DNA, 31 bp, Artificial Sequence
  Description of Artificial Sequence: Synthetic oligonucleotide
gctgttggacggactaaatacgtccaccaag

SEQ ID NO: 195204 - DNA, 33 bp, Artificial Sequence
  Description of Artificial Sequence: Synthetic oligonucleotide
ctgttggacggactaaatacgtccaccaagaac

SEQ ID NO: 195205 - DNA, 34 bp, Artificial Sequence
  Description of Artificial Sequence: Synthetic oligonucleotide
tgttggacggactaaatacgtccaccaagaactg

SEQ ID NO: 195206 - DNA, 33 bp, Artificial Sequence
  Description of Artificial Sequence: Synthetic oligonucleotide
gttggacggactaaatacgtccaccaagaactg

SEQ ID NO: 195207 - DNA, 38 bp, Artificial Sequence
  Description of Artificial Sequence: Synthetic oligonucleotide
ttggacggactaaatacgtccaccaagaactgttaaac

SEQ ID NO: 195208 - DNA, 37 bp, Artificial Sequence
  Description of Artificial Sequence: Synthetic oligonucleotide
tggacggactaaatacgtccaccaagaactgttaaac

SEQ ID NO: 195209 - DNA, 36 bp, Artificial Sequence
  Description of Artificial Sequence: Synthetic oligonucleotide
ggacggactaaatacgtccaccaagaactgttaaac

SEQ ID NO: 195210 - DNA, 36 bp, Artificial Sequence
  Description of Artificial Sequence: Synthetic oligonucleotide
gacggactaaatacgtccaccaagaactgttaaacc

SEQ ID NO: 195211 - DNA, 37 bp, Artificial Sequence
  Description of Artificial Sequence: Synthetic oligonucleotide
acggactaaatacgtccaccaagaactgttaaaccac

SEQ ID NO: 195212 - DNA, 36 bp, Artificial Sequence
  Description of Artificial Sequence: Synthetic oligonucleotide
cggactaaatacgtccaccaagaactgttaaaccac

SEQ ID NO: 195213 - DNA, 43 bp, Artificial Sequence
  Description of Artificial Sequence: Synthetic oligonucleotide
ggactaaatacgtccaccaagaactgttaaaccacaaaaattc

SEQ ID NO: 195214 - DNA, 43 bp, Artificial Sequence
  Description of Artificial Sequence: Synthetic oligonucleotide
gactaaatacgtccaccaagaactgttaaaccacaaaaattcc

SEQ ID NO: 195215 - DNA, 45 bp, Artificial Sequence
  Description of Artificial Sequence: Synthetic oligonucleotide
actaaatacgtccaccaagaactgttaaaccacaaaaattcctac

SEQ ID NO: 195216 - DNA, 44 bp, Artificial Sequence
  Description of Artificial Sequence: Synthetic oligonucleotide
ctaaatacgtccaccaagaactgttaaaccacaaaaattcctac

SEQ ID NO: 195217 - DNA, 44 bp, Artificial Sequence
  Description of Artificial Sequence: Synthetic oligonucleotide
taaatacgtccaccaagaactgttaaaccacaaaaattcctacg

SEQ ID NO: 195218 - DNA, 43 bp, Artificial Sequence
  Description of Artificial Sequence: Synthetic oligonucleotide
aaatacgtccaccaagaactgttaaaccacaaaaattcctacg

SEQ ID NO: 195219 - DNA, 42 bp, Artificial Sequence
  Description of Artificial Sequence: Synthetic oligonucleotide
aatacgtccaccaagaactgttaaaccacaaaaattcctacg

SEQ ID NO: 195220 - DNA, 41 bp, Artificial Sequence
  Description of Artificial Sequence: Synthetic oligonucleotide
atacgtccaccaagaactgttaaaccacaaaaattcctacg

SEQ ID NO: 195221 - DNA, 40 bp, Artificial Sequence
  Description of Artificial Sequence: Synthetic oligonucleotide
tacgtccaccaagaactgttaaaccacaaaaattcctacg

SEQ ID NO: 195222 - DNA, 39 bp, Artificial Sequence
  Description of Artificial Sequence: Synthetic oligonucleotide
acgtccaccaagaactgttaaaccacaaaaattcctacg

SEQ ID NO: 195223 - DNA, 38 bp, Artificial Sequence
  Description of Artificial Sequence: Synthetic oligonucleotide
cgtccaccaagaactgttaaaccacaaaaattcctacg

SEQ ID NO: 195224 - DNA, 39 bp, Artificial Sequence
  Description of Artificial Sequence: Synthetic oligonucleotide
gtccaccaagaactgttaaaccacaaaaattcctacgtg

SEQ ID NO: 195225 - DNA, 46 bp, Artificial Sequence
  Description of Artificial Sequence: Synthetic oligonucleotide
tccaccaagaactgttaaaccacaaaaattcctacgtgattaaaac

SEQ ID NO: 195226 - DNA, 45 bp, Artificial Sequence
  Description of Artificial Sequence: Synthetic oligonucleotide
ccaccaagaactgttaaaccacaaaaattcctacgtgattaaaac

SEQ ID NO: 195227 - DNA, 47 bp, Artificial Sequence
  Description of Artificial Sequence: Synthetic oligonucleotide
caccaagaactgttaaaccacaaaaattcctacgtgattaaaacaac

SEQ ID NO: 195228 - DNA, 58 bp, Artificial Sequence
  Description of Artificial Sequence: Synthetic oligonucleotide
accaagaactgttaaaccacaaaaattcctacgtgattaaaacaacaaaattaaaaac

SEQ ID NO: 195229 - DNA, 57 bp, Artificial Sequence
  Description of Artificial Sequence: Synthetic oligonucleotide
ccaagaactgttaaaccacaaaaattcctacgtgattaaaacaacaaaattaaaaac

SEQ ID NO: 195230 - DNA, 58 bp, Artificial Sequence
  Description of Artificial Sequence: Synthetic oligonucleotide
caagaactgttaaaccacaaaaattcctacgtgattaaaacaacaaaattaaaaactc

SEQ ID NO: 195231 - DNA, 58 bp, Artificial Sequence
  Description of Artificial Sequence: Synthetic oligonucleotide
aagaactgttaaaccacaaaaattcctacgtgattaaaacaacaaaattaaaaactcc

SEQ ID NO: 195232 - DNA, 57 bp, Artificial Sequence
  Description of Artificial Sequence: Synthetic oligonucleotide
agaactgttaaaccacaaaaattcctacgtgattaaaacaacaaaattaaaaactcc

SEQ ID NO: 195233 - DNA, 56 bp, Artificial Sequence
  Description of Artificial Sequence: Synthetic oligonucleotide
gaactgttaaaccacaaaaattcctacgtgattaaaacaacaaaattaaaaactcc

SEQ ID NO: 195234 - DNA, 57 bp, Artificial Sequence
  Description of Artificial Sequence: Synthetic oligonucleotide
aactgttaaaccacaaaaattcctacgtgattaaaacaacaaaattaaaaactcctc

SEQ ID NO: 195235 - DNA, 56 bp, Artificial Sequence
  Description of Artificial Sequence: Synthetic oligonucleotide
actgttaaaccacaaaaattcctacgtgattaaaacaacaaaattaaaaactcctc

SEQ ID NO: 195236 - DNA, 55 bp, Artificial Sequence
  Description of Artificial Sequence: Synthetic oligonucleotide
ctgttaaaccacaaaaattcctacgtgattaaaacaacaaaattaaaaactcctc

SEQ ID NO: 195237 - DNA, 55 bp, Artificial Sequence
  Description of Artificial Sequence: Synthetic oligonucleotide
tgttaaaccacaaaaattcctacgtgattaaaacaacaaaattaaaaactcctcc

SEQ ID NO: 195238 - DNA, 54 bp, Artificial Sequence
  Description of Artificial Sequence: Synthetic oligonucleotide
gttaaaccacaaaaattcctacgtgattaaaacaacaaaattaaaaactcctcc

SEQ ID NO: 195239 - DNA, 55 bp, Artificial Sequence
  Description of Artificial Sequence: Synthetic oligonucleotide
ttaaaccacaaaaattcctacgtgattaaaacaacaaaattaaaaactcctcctc

SEQ ID NO: 195240 - DNA, 54 bp, Artificial Sequence
  Description of Artificial Sequence: Synthetic oligonucleotide
taaaccacaaaaattcctacgtgattaaaacaacaaaattaaaaactcctcctc

SEQ ID NO: 195241 - DNA, 53 bp, Artificial Sequence
  Description of Artificial Sequence: Synthetic oligonucleotide
aaaccacaaaaattcctacgtgattaaaacaacaaaattaaaaactcctcctc

SEQ ID NO: 195242 - DNA, 52 bp, Artificial Sequence
  Description of Artificial Sequence: Synthetic oligonucleotide
aaccacaaaaattcctacgtgattaaaacaacaaaattaaaaactcctcctc

SEQ ID NO: 195243 - DNA, 51 bp, Artificial Sequence
  Description of Artificial Sequence: Synthetic oligonucleotide
accacaaaaattcctacgtgattaaaacaacaaaattaaaaactcctcctc

SEQ ID NO: 195244 - DNA, 50 bp, Artificial Sequence
  Description of Artificial Sequence: Synthetic oligonucleotide
ccacaaaaattcctacgtgattaaaacaacaaaattaaaaactcctcctc

SEQ ID NO: 195245 - DNA, 50 bp, Artificial Sequence
  Description of Artificial Sequence: Synthetic oligonucleotide
cacaaaaattcctacgtgattaaaacaacaaaattaaaaactcctcctcc

SEQ ID NO: 195246 - DNA, 51 bp, Artificial Sequence
  Description of Artificial Sequence: Synthetic oligonucleotide
acaaaaattcctacgtgattaaaacaacaaaattaaaaactcctcctcctc

SEQ ID NO: 195247 - DNA, 50 bp, Artificial Sequence
  Description of Artificial Sequence: Synthetic oligonucleotide
caaaaattcctacgtgattaaaacaacaaaattaaaaactcctcctcctc

SEQ ID NO: 195248 - DNA, 52 bp, Artificial Sequence
  Description of Artificial Sequence: Synthetic oligonucleotide
aaaaattcctacgtgattaaaacaacaaaattaaaaactcctcctcctcatg

SEQ ID NO: 195249 - DNA, 51 bp, Artificial Sequence
  Description of Artificial Sequence: Synthetic oligonucleotide
aaaattcctacgtgattaaaacaacaaaattaaaaactcctcctcctcatg

SEQ ID NO: 195250 - DNA, 50 bp, Artificial Sequence
  Description of Artificial Sequence: Synthetic oligonucleotide
aaattcctacgtgattaaaacaacaaaattaaaaactcctcctcctcatg

SEQ ID NO: 195251 - DNA, 49 bp, Artificial Sequence
  Description of Artificial Sequence: Synthetic oligonucleotide
aattcctacgtgattaaaacaacaaaattaaaaactcctcctcctcatg

SEQ ID NO: 195252 - DNA, 48 bp, Artificial Sequence
  Description of Artificial Sequence: Synthetic oligonucleotide
attcctacgtgattaaaacaacaaaattaaaaactcctcctcctcatg

SEQ ID NO: 195253 - DNA, 47 bp, Artificial Sequence
  Description of Artificial Sequence: Synthetic oligonucleotide
ttcctacgtgattaaaacaacaaaattaaaaactcctcctcctcatg

SEQ ID NO: 195254 - DNA, 46 bp, Artificial Sequence
  Description of Artificial Sequence: Synthetic oligonucleotide
tcctacgtgattaaaacaacaaaattaaaaactcctcctcctcatg

SEQ ID NO: 195255 - DNA, 45 bp, Artificial Sequence
  Description of Artificial Sequence: Synthetic oligonucleotide
cctacgtgattaaaacaacaaaattaaaaactcctcctcctcatg

SEQ ID NO: 195256 - DNA, 46 bp, Artificial Sequence
  Description of Artificial Sequence: Synthetic oligonucleotide
ctacgtgattaaaacaacaaaattaaaaactcctcctcctcatgac

SEQ ID NO: 195257 - DNA, 48 bp, Artificial Sequence
  Description of Artificial Sequence: Synthetic oligonucleotide
tacgtgattaaaacaacaaaattaaaaactcctcctcctcatgacatg

SEQ ID NO: 195258 - DNA, 47 bp, Artificial Sequence
  Description of Artificial Sequence: Synthetic oligonucleotide
acgtgattaaaacaacaaaattaaaaactcctcctcctcatgacatg

SEQ ID NO: 195259 - DNA, 46 bp, Artificial Sequence
  Description of Artificial Sequence: Synthetic oligonucleotide
cgtgattaaaacaacaaaattaaaaactcctcctcctcatgacatg

SEQ ID NO: 195260 - DNA, 46 bp, Artificial Sequence
  Description of Artificial Sequence: Synthetic oligonucleotide
gtgattaaaacaacaaaattaaaaactcctcctcctcatgacatgg

SEQ ID NO: 195261 - DNA, 47 bp, Artificial Sequence
  Description of Artificial Sequence: Synthetic oligonucleotide
tgattaaaacaacaaaattaaaaactcctcctcctcatgacatggtg

SEQ ID NO: 195262 - DNA, 46 bp, Artificial Sequence
  Description of Artificial Sequence: Synthetic oligonucleotide
gattaaaacaacaaaattaaaaactcctcctcctcatgacatggtg

SEQ ID NO: 195263 - DNA, 51 bp, Artificial Sequence
  Description of Artificial Sequence: Synthetic oligonucleotide
attaaaacaacaaaattaaaaactcctcctcctcatgacatggtgatttac

SEQ ID NO: 195264 - DNA, 50 bp, Artificial Sequence
  Description of Artificial Sequence: Synthetic oligonucleotide
ttaaaacaacaaaattaaaaactcctcctcctcatgacatggtgatttac

SEQ ID NO: 195265 - DNA, 49 bp, Artificial Sequence
  Description of Artificial Sequence: Synthetic oligonucleotide
taaaacaacaaaattaaaaactcctcctcctcatgacatggtgatttac

SEQ ID NO: 195266 - DNA, 48 bp, Artificial Sequence
  Description of Artificial Sequence: Synthetic oligonucleotide
aaaacaacaaaattaaaaactcctcctcctcatgacatggtgatttac

SEQ ID NO: 195267 - DNA, 47 bp, Artificial Sequence
  Description of Artificial Sequence: Synthetic oligonucleotide
aaacaacaaaattaaaaactcctcctcctcatgacatggtgatttac

SEQ ID NO: 195268 - DNA, 46 bp, Artificial Sequence
  Description of Artificial Sequence: Synthetic oligonucleotide
aacaacaaaattaaaaactcctcctcctcatgacatggtgatttac

SEQ ID NO: 195269 - DNA, 45 bp, Artificial Sequence
  Description of Artificial Sequence: Synthetic oligonucleotide
acaacaaaattaaaaactcctcctcctcatgacatggtgatttac

SEQ ID NO: 195270 - DNA, 44 bp, Artificial Sequence
  Description of Artificial Sequence: Synthetic oligonucleotide
caacaaaattaaaaactcctcctcctcatgacatggtgatttac

SEQ ID NO: 195271 - DNA, 47 bp, Artificial Sequence
  Description of Artificial Sequence: Synthetic oligonucleotide
aacaaaattaaaaactcctcctcctcatgacatggtgatttactttg

SEQ ID NO: 195272 - DNA, 46 bp, Artificial Sequence
  Description of Artificial Sequence: Synthetic oligonucleotide
acaaaattaaaaactcctcctcctcatgacatggtgatttactttg

SEQ ID NO: 195273 - DNA, 45 bp, Artificial Sequence
  Description of Artificial Sequence: Synthetic oligonucleotide
caaaattaaaaactcctcctcctcatgacatggtgatttactttg

SEQ ID NO: 195274 - DNA, 45 bp, Artificial Sequence
  Description of Artificial Sequence: Synthetic oligonucleotide
aaaattaaaaactcctcctcctcatgacatggtgatttactttgg

SEQ ID NO: 195275 - DNA, 44 bp, Artificial Sequence
  Description of Artificial Sequence: Synthetic oligonucleotide
aaattaaaaactcctcctcctcatgacatggtgatttactttgg

SEQ ID NO: 195276 - DNA, 43 bp, Artificial Sequence
  Description of Artificial Sequence: Synthetic oligonucleotide
aattaaaaactcctcctcctcatgacatggtgatttactttgg

SEQ ID NO: 195277 - DNA, 42 bp, Artificial Sequence
  Description of Artificial Sequence: Synthetic oligonucleotide
attaaaaactcctcctcctcatgacatggtgatttactttgg

SEQ ID NO: 195278 - DNA, 41 bp, Artificial Sequence
  Description of Artificial Sequence: Synthetic oligonucleotide
ttaaaaactcctcctcctcatgacatggtgatttactttgg

SEQ ID NO: 195279 - DNA, 40 bp, Artificial Sequence
  Description of Artificial Sequence: Synthetic oligonucleotide
taaaaactcctcctcctcatgacatggtgatttactttgg

SEQ ID NO: 195280 - DNA, 39 bp, Artificial Sequence
  Description of Artificial Sequence: Synthetic oligonucleotide
aaaaactcctcctcctcatgacatggtgatttactttgg

SEQ ID NO: 195281 - DNA, 38 bp, Artificial Sequence
  Description of Artificial Sequence: Synthetic oligonucleotide
aaaactcctcctcctcatgacatggtgatttactttgg

SEQ ID NO: 195282 - DNA, 37 bp, Artificial Sequence
  Description of Artificial Sequence: Synthetic oligonucleotide
aaactcctcctcctcatgacatggtgatttactttgg

SEQ ID NO: 195283 - DNA, 36 bp, Artificial Sequence
  Description of Artificial Sequence: Synthetic oligonucleotide
aactcctcctcctcatgacatggtgatttactttgg

SEQ ID NO: 195284 - DNA, 35 bp, Artificial Sequence
  Description of Artificial Sequence: Synthetic oligonucleotide
actcctcctcctcatgacatggtgatttactttgg

SEQ ID NO: 195285 - DNA, 34 bp, Artificial Sequence
  Description of Artificial Sequence: Synthetic oligonucleotide
ctcctcctcctcatgacatggtgatttactttgg

SEQ ID NO: 195286 - DNA, 34 bp, Artificial Sequence
  Description of Artificial Sequence: Synthetic oligonucleotide
tcctcctcctcatgacatggtgatttactttggc

SEQ ID NO: 195287 - DNA, 33 bp, Artificial Sequence
  Description of Artificial Sequence: Synthetic oligonucleotide
cctcctcctcatgacatggtgatttactttggc

SEQ ID NO: 195288 - DNA, 34 bp, Artificial Sequence
  Description of Artificial Sequence: Synthetic oligonucleotide
ctcctcctcatgacatggtgatttactttggcac

SEQ ID NO: 195289 - DNA, 34 bp, Artificial Sequence
  Description of Artificial Sequence: Synthetic oligonucleotide
tcctcctcatgacatggtgatttactttggcacg

SEQ ID NO: 195290 - DNA, 33 bp, Artificial Sequence
  Description of Artificial Sequence: Synthetic oligonucleotide
cctcctcatgacatggtgatttactttggcacg

SEQ ID NO: 195291 - DNA, 33 bp, Artificial Sequence
  Description of Artificial Sequence: Synthetic oligonucleotide
ctcctcatgacatggtgatttactttggcacgg

SEQ ID NO: 195292 - DNA, 33 bp, Artificial Sequence
  Description of Artificial Sequence: Synthetic oligonucleotide
tcctcatgacatggtgatttactttggcacggc

SEQ ID NO: 195293 - DNA, 32 bp, Artificial Sequence
  Description of Artificial Sequence: Synthetic oligonucleotide
cctcatgacatggtgatttactttggcacggc

SEQ ID NO: 195294 - DNA, 32 bp, Artificial Sequence
  Description of Artificial Sequence: Synthetic oligonucleotide
ctcatgacatggtgatttactttggcacggcc

SEQ ID NO: 195295 - DNA, 34 bp, Artificial Sequence
  Description of Artificial Sequence: Synthetic oligonucleotide
tcatgacatggtgatttactttggcacggcctac

SEQ ID NO: 195296 - DNA, 33 bp, Artificial Sequence
  Description of Artificial Sequence: Synthetic oligonucleotide
catgacatggtgatttactttggcacggcctac

SEQ ID NO: 195297 - DNA, 33 bp, Artificial Sequence
  Description of Artificial Sequence: Synthetic oligonucleotide
atgacatggtgatttactttggcacggcctacg

SEQ ID NO: 195298 - DNA, 32 bp, Artificial Sequence
  Description of Artificial Sequence: Synthetic oligonucleotide
tgacatggtgatttactttggcacggcctacg

SEQ ID NO: 195299 - DNA, 31 bp, Artificial Sequence
  Description of Artificial Sequence: Synthetic oligonucleotide
gacatggtgatttactttggcacggcctacg

SEQ ID NO: 195300 - DNA, 32 bp, Artificial Sequence
  Description of Artificial Sequence: Synthetic oligonucleotide
acatggtgatttactttggcacggcctacgtg

SEQ ID NO: 195301 - DNA, 31 bp, Artificial Sequence
  Description of Artificial Sequence: Synthetic oligonucleotide
catggtgatttactttggcacggcctacgtg

SEQ ID NO: 195302 - DNA, 31 bp, Artificial Sequence
  Description of Artificial Sequence: Synthetic oligonucleotide
atggtgatttactttggcacggcctacgtgg

SEQ ID NO: 195303 - DNA, 30 bp, Artificial Sequence
  Description of Artificial Sequence: Synthetic oligonucleotide
tggtgatttactttggcacggcctacgtgg

SEQ ID NO: 195304 - DNA, 29 bp, Artificial Sequence
  Description of Artificial Sequence: Synthetic oligonucleotide
ggtgatttactttggcacggcctacgtgg

SEQ ID NO: 195305 - DNA, 29 bp, Artificial Sequence
  Description of Artificial Sequence: Synthetic oligonucleotide
gtgatttactttggcacggcctacgtggc

SEQ ID NO: 195306 - DNA, 30 bp, Artificial Sequence
  Description of Artificial Sequence: Synthetic oligonucleotide
tgatttactttggcacggcctacgtggctc

SEQ ID NO: 195307 - DNA, 29 bp, Artificial Sequence
  Description of Artificial Sequence: Synthetic oligonucleotide
gatttactttggcacggcctacgtggctc

SEQ ID NO: 195308 - DNA, 30 bp, Artificial Sequence
  Description of Artificial Sequence: Synthetic oligonucleotide
atttactttggcacggcctacgtggctctc

SEQ ID NO: 195309 - DNA, 29 bp, Artificial Sequence
  Description of Artificial Sequence: Synthetic oligonucleotide
tttactttggcacggcctacgtggctctc

SEQ ID NO: 195310 - DNA, 28 bp, Artificial Sequence
  Description of Artificial Sequence: Synthetic oligonucleotide
ttactttggcacggcctacgtggctctc

SEQ ID NO: 195311 - DNA, 27 bp, Artificial Sequence
  Description of Artificial Sequence: Synthetic oligonucleotide
tactttggcacggcctacgtggctctc

SEQ ID NO: 195312 - DNA, 27 bp, Artificial Sequence
  Description of Artificial Sequence: Synthetic oligonucleotide
actttggcacggcctacgtggctctca

SEQ ID NO: 195313 - DNA, 26 bp, Artificial Sequence
  Description of Artificial Sequence: Synthetic oligonucleotide
ctttggcacggcctacgtggctctca

SEQ ID NO: 195314 - DNA, 27 bp, Artificial Sequence
  Description of Artificial Sequence: Synthetic oligonucleotide
tttggcacggcctacgtggctctcaca

SEQ ID NO: 195315 - DNA, 27 bp, Artificial Sequence
  Description of Artificial Sequence: Synthetic oligonucleotide
ttggcacggcctacgtggctctcacaa

SEQ ID NO: 195316 - DNA, 26 bp, Artificial Sequence
  Description of Artificial Sequence: Synthetic oligonucleotide
tggcacggcctacgtggctctcacaa

SEQ ID NO: 195317 - DNA, 25 bp, Artificial Sequence
  Description of Artificial Sequence: Synthetic oligonucleotide
ggcacggcctacgtggctctcacaa

SEQ ID NO: 195318 - DNA, 25 bp, Artificial Sequence
  Description of Artificial Sequence: Synthetic oligonucleotide
gcacggcctacgtggctctcacaag

SEQ ID NO: 195319 - DNA, 25 bp, Artificial Sequence
  Description of Artificial Sequence: Synthetic oligonucleotide
cacggcctacgtggctctcacaagg

SEQ ID NO: 195320 - DNA, 26 bp, Artificial Sequence
  Description of Artificial Sequence: Synthetic oligonucleotide
acggcctacgtggctctcacaaggga

SEQ ID NO: 195321 - DNA, 25 bp, Artificial Sequence
  Description of Artificial Sequence: Synthetic oligonucleotide
cggcctacgtggctctcacaaggga

SEQ ID NO: 195322 - DNA, 27 bp, Artificial Sequence
  Description of Artificial Sequence: Synthetic oligonucleotide
ggcctacgtggctctcacaagggactt

SEQ ID NO: 195323 - DNA, 28 bp, Artificial Sequence
  Description of Artificial Sequence: Synthetic oligonucleotide
gcctacgtggctctcacaagggactttg

SEQ ID NO: 195324 - DNA, 28 bp, Artificial Sequence
  Description of Artificial Sequence: Synthetic oligonucleotide
cctacgtggctctcacaagggactttgc

SEQ ID NO: 195325 - DNA, 31 bp, Artificial Sequence
  Description of Artificial Sequence: Synthetic oligonucleotide
ctacgtggctctcacaagggactttgctaac

SEQ ID NO: 195326 - DNA, 33 bp, Artificial Sequence
  Description of Artificial Sequence: Synthetic oligonucleotide
tacgtggctctcacaagggactttgctaacttc

SEQ ID NO: 195327 - DNA, 32 bp, Artificial Sequence
  Description of Artificial Sequence: Synthetic oligonucleotide
acgtggctctcacaagggactttgctaacttc

SEQ ID NO: 195328 - DNA, 31 bp, Artificial Sequence
  Description of Artificial Sequence: Synthetic oligonucleotide
cgtggctctcacaagggactttgctaacttc

SEQ ID NO: 195329 - DNA, 31 bp, Artificial Sequence
  Description of Artificial Sequence: Synthetic oligonucleotide
gtggctctcacaagggactttgctaacttcg

SEQ ID NO: 195330 - DNA, 32 bp, Artificial Sequence
  Description of Artificial Sequence: Synthetic oligonucleotide
tggctctcacaagggactttgctaacttcgtc

SEQ ID NO: 195331 - DNA, 31 bp, Artificial Sequence
  Description of Artificial Sequence: Synthetic oligonucleotide
ggctctcacaagggactttgctaacttcgtc

SEQ ID NO: 195332 - DNA, 31 bp, Artificial Sequence
  Description of Artificial Sequence: Synthetic oligonucleotide
gctctcacaagggactttgctaacttcgtcc

SEQ ID NO: 195333 - DNA, 32 bp, Artificial Sequence
  Description of Artificial Sequence: Synthetic oligonucleotide
ctctcacaagggactttgctaacttcgtcctc

SEQ ID NO: 195334 - DNA, 32 bp, Artificial Sequence
  Description of Artificial Sequence: Synthetic oligonucleotide
tctcacaagggactttgctaacttcgtcctcc

SEQ ID NO: 195335 - DNA, 31 bp, Artificial Sequence
  Description of Artificial Sequence: Synthetic oligonucleotide
ctcacaagggactttgctaacttcgtcctcc

SEQ ID NO: 195336 - DNA, 33 bp, Artificial Sequence
  Description of Artificial Sequence: Synthetic oligonucleotide
tcacaagggactttgctaacttcgtcctccaag

SEQ ID NO: 195337 - DNA, 32 bp, Artificial Sequence
  Description of Artificial Sequence: Synthetic oligonucleotide
cacaagggactttgctaacttcgtcctccaag

SEQ ID NO: 195338 - DNA, 33 bp, Artificial Sequence
  Description of Artificial Sequence: Synthetic oligonucleotide
acaagggactttgctaacttcgtcctccaagac

SEQ ID NO: 195339 - DNA, 32 bp, Artificial Sequence
  Description of Artificial Sequence: Synthetic oligonucleotide
caagggactttgctaacttcgtcctccaagac

SEQ ID NO: 195340 - DNA, 32 bp, Artificial Sequence
  Description of Artificial Sequence: Synthetic oligonucleotide
aagggactttgctaacttcgtcctccaagacc

SEQ ID NO: 195341 - DNA, 31 bp, Artificial Sequence
  Description of Artificial Sequence: Synthetic oligonucleotide
agggactttgctaacttcgtcctccaagacc

SEQ ID NO: 195342 - DNA, 30 bp, Artificial Sequence
  Description of Artificial Sequence: Synthetic oligonucleotide
gggactttgctaacttcgtcctccaagacc

SEQ ID NO: 195343 - DNA, 31 bp, Artificial Sequence
  Description of Artificial Sequence: Synthetic oligonucleotide
ggactttgctaacttcgtcctccaagaccag

SEQ ID NO: 195344 - DNA, 31 bp, Artificial Sequence
  Description of Artificial Sequence: Synthetic oligonucleotide
gactttgctaacttcgtcctccaagaccagc

SEQ ID NO: 195345 - DNA, 32 bp, Artificial Sequence
  Description of Artificial Sequence: Synthetic oligonucleotide
actttgctaacttcgtcctccaagaccagctc

SEQ ID NO: 195346 - DNA, 31 bp, Artificial Sequence
  Description of Artificial Sequence: Synthetic oligonucleotide
ctttgctaacttcgtcctccaagaccagctc

SEQ ID NO: 195347 - DNA, 31 bp, Artificial Sequence
  Description of Artificial Sequence: Synthetic oligonucleotide
tttgctaacttcgtcctccaagaccagctcg

SEQ ID NO: 195348 - DNA, 30 bp, Artificial Sequence
  Description of Artificial Sequence: Synthetic oligonucleotide
ttgctaacttcgtcctccaagaccagctcg

SEQ ID NO: 195349 - DNA, 29 bp, Artificial Sequence
  Description of Artificial Sequence: Synthetic oligonucleotide
tgctaacttcgtcctccaagaccagctcg

SEQ ID NO: 195350 - DNA, 28 bp, Artificial Sequence
  Description of Artificial Sequence: Synthetic oligonucleotide
gctaacttcgtcctccaagaccagctcg

SEQ ID NO: 195351 - DNA, 28 bp, Artificial Sequence
  Description of Artificial Sequence: Synthetic oligonucleotide
ctaacttcgtcctccaagaccagctcgc

SEQ ID NO: 195352 - DNA, 29 bp, Artificial Sequence
  Description of Artificial Sequence: Synthetic oligonucleotide
taacttcgtcctccaagaccagctcgcac

SEQ ID NO: 195353 - DNA, 28 bp, Artificial Sequence
  Description of Artificial Sequence: Synthetic oligonucleotide
aacttcgtcctccaagaccagctcgcac

SEQ ID NO: 195354 - DNA, 27 bp, Artificial Sequence
  Description of Artificial Sequence: Synthetic oligonucleotide
acttcgtcctccaagaccagctcgcac

SEQ ID NO: 195355 - DNA, 27 bp, Artificial Sequence
  Description of Artificial Sequence: Synthetic oligonucleotide
cttcgtcctccaagaccagctcgcact

SEQ ID NO: 195356 - DNA, 28 bp, Artificial Sequence
  Description of Artificial Sequence: Synthetic oligonucleotide
ttcgtcctccaagaccagctcgcacttg

SEQ ID NO: 195357 - DNA, 27 bp, Artificial Sequence
  Description of Artificial Sequence: Synthetic oligonucleotide
tcgtcctccaagaccagctcgcacttg

SEQ ID NO: 195358 - DNA, 27 bp, Artificial Sequence
  Description of Artificial Sequence: Synthetic oligonucleotide
cgtcctccaagaccagctcgcacttga

SEQ ID NO: 195359 - DNA, 27 bp, Artificial Sequence
  Description of Artificial Sequence: Synthetic oligonucleotide
gtcctccaagaccagctcgcacttgac

SEQ ID NO: 195360 - DNA, 30 bp, Artificial Sequence
  Description of Artificial Sequence: Synthetic oligonucleotide
tcctccaagaccagctcgcacttgacttac

SEQ ID NO: 195361 - DNA, 29 bp, Artificial Sequence
  Description of Artificial Sequence: Synthetic oligonucleotide
cctccaagaccagctcgcacttgacttac

SEQ ID NO: 195362 - DNA, 30 bp, Artificial Sequence
  Description of Artificial Sequence: Synthetic oligonucleotide
ctccaagaccagctcgcacttgacttactc

SEQ ID NO: 195363 - DNA, 31 bp, Artificial Sequence
  Description of Artificial Sequence: Synthetic oligonucleotide
tccaagaccagctcgcacttgacttactctc

SEQ ID NO: 195364 - DNA, 30 bp, Artificial Sequence
  Description of Artificial Sequence: Synthetic oligonucleotide
ccaagaccagctcgcacttgacttactctc

SEQ ID NO: 195365 - DNA, 30 bp, Artificial Sequence
  Description of Artificial Sequence: Synthetic oligonucleotide
caagaccagctcgcacttgacttactctcc

SEQ ID NO: 195366 - DNA, 31 bp, Artificial Sequence
  Description of Artificial Sequence: Synthetic oligonucleotide
aagaccagctcgcacttgacttactctcctg

SEQ ID NO: 195367 - DNA, 30 bp, Artificial Sequence
  Description of Artificial Sequence: Synthetic oligonucleotide
agaccagctcgcacttgacttactctcctg

SEQ ID NO: 195368 - DNA, 29 bp, Artificial Sequence
  Description of Artificial Sequence: Synthetic oligonucleotide
gaccagctcgcacttgacttactctcctg

SEQ ID NO: 195369 - DNA, 29 bp, Artificial Sequence
  Description of Artificial Sequence: Synthetic oligonucleotide
accagctcgcacttgacttactctcctgg

SEQ ID NO: 195370 - DNA, 28 bp, Artificial Sequence
  Description of Artificial Sequence: Synthetic oligonucleotide
ccagctcgcacttgacttactctcctgg

SEQ ID NO: 195371 - DNA, 29 bp, Artificial Sequence
  Description of Artificial Sequence: Synthetic oligonucleotide
cagctcgcacttgacttactctcctggtc

SEQ ID NO: 195372 - DNA, 29 bp, Artificial Sequence
  Description of Artificial Sequence: Synthetic oligonucleotide
agctcgcacttgacttactctcctggtcc

SEQ ID NO: 195373 - DNA, 28 bp, Artificial Sequence
  Description of Artificial Sequence: Synthetic oligonucleotide
gctcgcacttgacttactctcctggtcc

SEQ ID NO: 195374 - DNA, 30 bp, Artificial Sequence
  Description of Artificial Sequence: Synthetic oligonucleotide
ctcgcacttgacttactctcctggtccaag

SEQ ID NO: 195375 - DNA, 30 bp, Artificial Sequence
  Description of Artificial Sequence: Synthetic oligonucleotide
tcgcacttgacttactctcctggtccaagg

SEQ ID NO: 195376 - DNA, 29 bp, Artificial Sequence
  Description of Artificial Sequence: Synthetic oligonucleotide
cgcacttgacttactctcctggtccaagg

SEQ ID NO: 195377 - DNA, 30 bp, Artificial Sequence
  Description of Artificial Sequence: Synthetic oligonucleotide
gcacttgacttactctcctggtccaaggac

SEQ ID NO: 195378 - DNA, 31 bp, Artificial Sequence
  Description of Artificial Sequence: Synthetic oligonucleotide
cacttgacttactctcctggtccaaggacac

SEQ ID NO: 195379 - DNA, 31 bp, Artificial Sequence
  Description of Artificial Sequence: Synthetic oligonucleotide
acttgacttactctcctggtccaaggacacc

SEQ ID NO: 195380 - DNA, 30 bp, Artificial Sequence
  Description of Artificial Sequence: Synthetic oligonucleotide
cttgacttactctcctggtccaaggacacc

SEQ ID NO: 195381 - DNA, 32 bp, Artificial Sequence
  Description of Artificial Sequence: Synthetic oligonucleotide
ttgacttactctcctggtccaaggacacctac

SEQ ID NO: 195382 - DNA, 31 bp, Artificial Sequence
  Description of Artificial Sequence: Synthetic oligonucleotide
tgacttactctcctggtccaaggacacctac

SEQ ID NO: 195383 - DNA, 30 bp, Artificial Sequence
  Description of Artificial Sequence: Synthetic oligonucleotide
gacttactctcctggtccaaggacacctac

SEQ ID NO: 195384 - DNA, 31 bp, Artificial Sequence
  Description of Artificial Sequence: Synthetic oligonucleotide
acttactctcctggtccaaggacacctacag

SEQ ID NO: 195385 - DNA, 30 bp, Artificial Sequence
  Description of Artificial Sequence: Synthetic oligonucleotide
cttactctcctggtccaaggacacctacag

SEQ ID NO: 195386 - DNA, 30 bp, Artificial Sequence
  Description of Artificial Sequence: Synthetic oligonucleotide
ttactctcctggtccaaggacacctacagc

SEQ ID NO: 195387 - DNA, 29 bp, Artificial Sequence
  Description of Artificial Sequence: Synthetic oligonucleotide
tactctcctggtccaaggacacctacagc

SEQ ID NO: 195388 - DNA, 28 bp, Artificial Sequence
  Description of Artificial Sequence: Synthetic oligonucleotide
actctcctggtccaaggacacctacagc

SEQ ID NO: 195389 - DNA, 27 bp, Artificial Sequence
  Description of Artificial Sequence: Synthetic oligonucleotide
ctctcctggtccaaggacacctacagc

SEQ ID NO: 195390 - DNA, 27 bp, Artificial Sequence
  Description of Artificial Sequence: Synthetic oligonucleotide
tctcctggtccaaggacacctacagcc

SEQ ID NO: 195391 - DNA, 26 bp, Artificial Sequence
  Description of Artificial Sequence: Synthetic oligonucleotide
ctcctggtccaaggacacctacagcc

SEQ ID NO: 195392 - DNA, 26 bp, Artificial Sequence
  Description of Artificial Sequence: Synthetic oligonucleotide
tcctggtccaaggacacctacagccc

SEQ ID NO: 195393 - DNA, 25 bp, Artificial Sequence
  Description of Artificial Sequence: Synthetic oligonucleotide
cctggtccaaggacacctacagccc

SEQ ID NO: 195394 - DNA, 25 bp, Artificial Sequence
  Description of Artificial Sequence: Synthetic oligonucleotide
ctggtccaaggacacctacagcccc

SEQ ID NO: 195395 - DNA, 26 bp, Artificial Sequence
  Description of Artificial Sequence: Synthetic oligonucleotide
tggtccaaggacacctacagccccga

SEQ ID NO: 195396 - DNA, 25 bp, Artificial Sequence
  Description of Artificial Sequence: Synthetic oligonucleotide
ggtccaaggacacctacagccccga

SEQ ID NO: 195397 - DNA, 25 bp, Artificial Sequence
  Description of Artificial Sequence: Synthetic oligonucleotide
gtccaaggacacctacagccccgac

SEQ ID NO: 195398 - DNA, 27 bp, Artificial Sequence
  Description of Artificial Sequence: Synthetic oligonucleotide
tccaaggacacctacagccccgacgaa

SEQ ID NO: 195399 - DNA, 26 bp, Artificial Sequence
  Description of Artificial Sequence: Synthetic oligonucleotide
ccaaggacacctacagccccgacgaa

SEQ ID NO: 195400 - DNA, 27 bp, Artificial Sequence
  Description of Artificial Sequence: Synthetic oligonucleotide
caaggacacctacagccccgacgaaca

SEQ ID NO: 195401 - DNA, 30 bp, Artificial Sequence
  Description of Artificial Sequence: Synthetic oligonucleotide
aaggacacctacagccccgacgaacatttc

SEQ ID NO: 195402 - DNA, 29 bp, Artificial Sequence
  Description of Artificial Sequence: Synthetic oligonucleotide
aggacacctacagccccgacgaacatttc

SEQ ID NO: 195403 - DNA, 28 bp, Artificial Sequence
  Description of Artificial Sequence: Synthetic oligonucleotide
ggacacctacagccccgacgaacatttc

SEQ ID NO: 195404 - DNA, 29 bp, Artificial Sequence
  Description of Artificial Sequence: Synthetic oligonucleotide
gacacctacagccccgacgaacatttctg

SEQ ID NO: 195405 - DNA, 29 bp, Artificial Sequence
  Description of Artificial Sequence: Synthetic oligonucleotide
acacctacagccccgacgaacatttctgg

SEQ ID NO: 195406 - DNA, 28 bp, Artificial Sequence
  Description of Artificial Sequence: Synthetic oligonucleotide
cacctacagccccgacgaacatttctgg

SEQ ID NO: 195407 - DNA, 28 bp, Artificial Sequence
  Description of Artificial Sequence: Synthetic oligonucleotide
acctacagccccgacgaacatttctggg

SEQ ID NO: 195408 - DNA, 27 bp, Artificial Sequence
  Description of Artificial Sequence: Synthetic oligonucleotide
cctacagccccgacgaacatttctggg

SEQ ID NO: 195409 - DNA, 28 bp, Artificial Sequence
  Description of Artificial Sequence: Synthetic oligonucleotide
ctacagccccgacgaacatttctgggtg

SEQ ID NO: 195410 - DNA, 29 bp, Artificial Sequence
  Description of Artificial Sequence: Synthetic oligonucleotide
tacagccccgacgaacatttctgggtgac

SEQ ID NO: 195411 - DNA, 28 bp, Artificial Sequence
  Description of Artificial Sequence: Synthetic oligonucleotide
acagccccgacgaacatttctgggtgac

SEQ ID NO: 195412 - DNA, 27 bp, Artificial Sequence
  Description of Artificial Sequence: Synthetic oligonucleotide
cagccccgacgaacatttctgggtgac

SEQ ID NO: 195413 - DNA, 28 bp, Artificial Sequence
  Description of Artificial Sequence: Synthetic oligonucleotide
agccccgacgaacatttctgggtgacac

SEQ ID NO: 195414 - DNA, 27 bp, Artificial Sequence
  Description of Artificial Sequence: Synthetic oligonucleotide
gccccgacgaacatttctgggtgacac

SEQ ID NO: 195415 - DNA, 28 bp, Artificial Sequence
  Description of Artificial Sequence: Synthetic oligonucleotide
ccccgacgaacatttctgggtgacactc

SEQ ID NO: 195416 - DNA, 30 bp, Artificial Sequence
  Description of Artificial Sequence: Synthetic oligonucleotide
cccgacgaacatttctgggtgacactcaac

SEQ ID NO: 195417 - DNA, 31 bp, Artificial Sequence
  Description of Artificial Sequence: Synthetic oligonucleotide
ccgacgaacatttctgggtgacactcaacag

SEQ ID NO: 195418 - DNA, 31 bp, Artificial Sequence
  Description of Artificial Sequence: Synthetic oligonucleotide
cgacgaacatttctgggtgacactcaacagg

SEQ ID NO: 195419 - DNA, 34 bp, Artificial Sequence
  Description of Artificial Sequence: Synthetic oligonucleotide
gacgaacatttctgggtgacactcaacaggattc

SEQ ID NO: 195420 - DNA, 34 bp, Artificial Sequence
  Description of Artificial Sequence: Synthetic oligonucleotide
acgaacatttctgggtgacactcaacaggattcc

SEQ ID NO: 195421 - DNA, 33 bp, Artificial Sequence
  Description of Artificial Sequence: Synthetic oligonucleotide
cgaacatttctgggtgacactcaacaggattcc

SEQ ID NO: 195422 - DNA, 33 bp, Artificial Sequence
  Description of Artificial Sequence: Synthetic oligonucleotide
gaacatttctgggtgacactcaacaggattccc

SEQ ID NO: 195423 - DNA, 33 bp, Artificial Sequence
  Description of Artificial Sequence: Synthetic oligonucleotide
aacatttctgggtgacactcaacaggattcccg

SEQ ID NO: 195424 - DNA, 32 bp, Artificial Sequence
  Description of Artificial Sequence: Synthetic oligonucleotide
acatttctgggtgacactcaacaggattcccg

SEQ ID NO: 195425 - DNA, 31 bp, Artificial Sequence
  Description of Artificial Sequence: Synthetic oligonucleotide
catttctgggtgacactcaacaggattcccg

SEQ ID NO: 195426 - DNA, 31 bp, Artificial Sequence
  Description of Artificial Sequence: Synthetic oligonucleotide
atttctgggtgacactcaacaggattcccgg

SEQ ID NO: 195427 - DNA, 30 bp, Artificial Sequence
  Description of Artificial Sequence: Synthetic oligonucleotide
tttctgggtgacactcaacaggattcccgg

SEQ ID NO: 195428 - DNA, 29 bp, Artificial Sequence
  Description of Artificial Sequence: Synthetic oligonucleotide
ttctgggtgacactcaacaggattcccgg

SEQ ID NO: 195429 - DNA, 28 bp, Artificial Sequence
  Description of Artificial Sequence: Synthetic oligonucleotide
tctgggtgacactcaacaggattcccgg

SEQ ID NO: 195430 - DNA, 27 bp, Artificial Sequence
  Description of Artificial Sequence: Synthetic oligonucleotide
ctgggtgacactcaacaggattcccgg

SEQ ID NO: 195431 - DNA, 28 bp, Artificial Sequence
  Description of Artificial Sequence: Synthetic oligonucleotide
tgggtgacactcaacaggattcccggtg

SEQ ID NO: 195432 - DNA, 27 bp, Artificial Sequence
  Description of Artificial Sequence: Synthetic oligonucleotide
gggtgacactcaacaggattcccggtg

SEQ ID NO: 195433 - DNA, 29 bp, Artificial Sequence
  Description of Artificial Sequence: Synthetic oligonucleotide
ggtgacactcaacaggattcccggtgttc

SEQ ID NO: 195434 - DNA, 29 bp, Artificial Sequence
  Description of Artificial Sequence: Synthetic oligonucleotide
gtgacactcaacaggattcccggtgttcc

SEQ ID NO: 195435 - DNA, 30 bp, Artificial Sequence
  Description of Artificial Sequence: Synthetic oligonucleotide
tgacactcaacaggattcccggtgttcctg

SEQ ID NO: 195436 - DNA, 29 bp, Artificial Sequence
  Description of Artificial Sequence: Synthetic oligonucleotide
gacactcaacaggattcccggtgttcctg

SEQ ID NO: 195437 - DNA, 29 bp, Artificial Sequence
  Description of Artificial Sequence: Synthetic oligonucleotide
acactcaacaggattcccggtgttcctgg

SEQ ID NO: 195438 - DNA, 28 bp, Artificial Sequence
  Description of Artificial Sequence: Synthetic oligonucleotide
cactcaacaggattcccggtgttcctgg

SEQ ID NO: 195439 - DNA, 28 bp, Artificial Sequence
  Description of Artificial Sequence: Synthetic oligonucleotide
actcaacaggattcccggtgttcctggc

SEQ ID NO: 195440 - DNA, 27 bp, Artificial Sequence
  Description of Artificial Sequence: Synthetic oligonucleotide
ctcaacaggattcccggtgttcctggc

SEQ ID NO: 195441 - DNA, 28 bp, Artificial Sequence
  Description of Artificial Sequence: Synthetic oligonucleotide
tcaacaggattcccggtgttcctggctc

SEQ ID NO: 195442 - DNA, 27 bp, Artificial Sequence
  Description of Artificial Sequence: Synthetic oligonucleotide
caacaggattcccggtgttcctggctc

SEQ ID NO: 195443 - DNA, 30 bp, Artificial Sequence
  Description of Artificial Sequence: Synthetic oligonucleotide
aacaggattcccggtgttcctggctctatg

SEQ ID NO: 195444 - DNA, 29 bp, Artificial Sequence
  Description of Artificial Sequence: Synthetic oligonucleotide
acaggattcccggtgttcctggctctatg

SEQ ID NO: 195445 - DNA, 28 bp, Artificial Sequence
  Description of Artificial Sequence: Synthetic oligonucleotide
caggattcccggtgttcctggctctatg

SEQ ID NO: 195446 - DNA, 28 bp, Artificial Sequence
  Description of Artificial Sequence: Synthetic oligonucleotide
aggattcccggtgttcctggctctatgc

SEQ ID NO: 195447 - DNA, 27 bp, Artificial Sequence
  Description of Artificial Sequence: Synthetic oligonucleotide
ggattcccggtgttcctggctctatgc

SEQ ID NO: 195448 - DNA, 27 bp, Artificial Sequence
  Description of Artificial Sequence: Synthetic oligonucleotide
gattcccggtgttcctggctctatgcc

SEQ ID NO: 195449 - DNA, 31 bp, Artificial Sequence
  Description of Artificial Sequence: Synthetic oligonucleotide
attcccggtgttcctggctctatgccaaatg

SEQ ID NO: 195450 - DNA, 30 bp, Artificial Sequence
  Description of Artificial Sequence: Synthetic oligonucleotide
ttcccggtgttcctggctctatgccaaatg

SEQ ID NO: 195451 - DNA, 29 bp, Artificial Sequence
  Description of Artificial Sequence: Synthetic oligonucleotide
tcccggtgttcctggctctatgccaaatg

SEQ ID NO: 195452 - DNA, 28 bp, Artificial Sequence
  Description of Artificial Sequence: Synthetic oligonucleotide
cccggtgttcctggctctatgccaaatg

SEQ ID NO: 195453 - DNA, 28 bp, Artificial Sequence
  Description of Artificial Sequence: Synthetic oligonucleotide
ccggtgttcctggctctatgccaaatgc

SEQ ID NO: 195454 - DNA, 30 bp, Artificial Sequence
  Description of Artificial Sequence: Synthetic oligonucleotide
cggtgttcctggctctatgccaaatgcatc

SEQ ID NO: 195455 - DNA, 30 bp, Artificial Sequence
  Description of Artificial Sequence: Synthetic oligonucleotide
ggtgttcctggctctatgccaaatgcatcc

SEQ ID NO: 195456 - DNA, 31 bp, Artificial Sequence
  Description of Artificial Sequence: Synthetic oligonucleotide
gtgttcctggctctatgccaaatgcatcctg

SEQ ID NO: 195457 - DNA, 31 bp, Artificial Sequence
  Description of Artificial Sequence: Synthetic oligonucleotide
tgttcctggctctatgccaaatgcatcctgg

SEQ ID NO: 195458 - DNA, 30 bp, Artificial Sequence
  Description of Artificial Sequence: Synthetic oligonucleotide
gttcctggctctatgccaaatgcatcctgg

SEQ ID NO: 195459 - DNA, 31 bp, Artificial Sequence
  Description of Artificial Sequence: Synthetic oligonucleotide
ttcctggctctatgccaaatgcatcctggac

SEQ ID NO: 195460 - DNA, 30 bp, Artificial Sequence
  Description of Artificial Sequence: Synthetic oligonucleotide
tcctggctctatgccaaatgcatcctggac

SEQ ID NO: 195461 - DNA, 29 bp, Artificial Sequence
  Description of Artificial Sequence: Synthetic oligonucleotide
cctggctctatgccaaatgcatcctggac

SEQ ID NO: 195462 - DNA, 30 bp, Artificial Sequence
  Description of Artificial Sequence: Synthetic oligonucleotide
ctggctctatgccaaatgcatcctggactg

SEQ ID NO: 195463 - DNA, 30 bp, Artificial Sequence
  Description of Artificial Sequence: Synthetic oligonucleotide
tggctctatgccaaatgcatcctggactgg

SEQ ID NO: 195464 - DNA, 29 bp, Artificial Sequence
  Description of Artificial Sequence: Synthetic oligonucleotide
ggctctatgccaaatgcatcctggactgg

SEQ ID NO: 195465 - DNA, 32 bp, Artificial Sequence
  Description of Artificial Sequence: Synthetic oligonucleotide
gctctatgccaaatgcatcctggactggaaac

SEQ ID NO: 195466 - DNA, 32 bp, Artificial Sequence
  Description of Artificial Sequence: Synthetic oligonucleotide
ctctatgccaaatgcatcctggactggaaacc

SEQ ID NO: 195467 - DNA, 33 bp, Artificial Sequence
  Description of Artificial Sequence: Synthetic oligonucleotide
tctatgccaaatgcatcctggactggaaacctc

SEQ ID NO: 195468 - DNA, 32 bp, Artificial Sequence
  Description of Artificial Sequence: Synthetic oligonucleotide
ctatgccaaatgcatcctggactggaaacctc

SEQ ID NO: 195469 - DNA, 33 bp, Artificial Sequence
  Description of Artificial Sequence: Synthetic oligonucleotide
tatgccaaatgcatcctggactggaaacctcag

SEQ ID NO: 195470 - DNA, 32 bp, Artificial Sequence
  Description of Artificial Sequence: Synthetic oligonucleotide
atgccaaatgcatcctggactggaaacctcag

SEQ ID NO: 195471 - DNA, 31 bp, Artificial Sequence
  Description of Artificial Sequence: Synthetic oligonucleotide
tgccaaatgcatcctggactggaaacctcag

SEQ ID NO: 195472 - DNA, 30 bp, Artificial Sequence
  Description of Artificial Sequence: Synthetic oligonucleotide
gccaaatgcatcctggactggaaacctcag

SEQ ID NO: 195473 - DNA, 31 bp, Artificial Sequence
  Description of Artificial Sequence: Synthetic oligonucleotide
ccaaatgcatcctggactggaaacctcagag

SEQ ID NO: 195474 - DNA, 31 bp, Artificial Sequence
  Description of Artificial Sequence: Synthetic oligonucleotide
caaatgcatcctggactggaaacctcagagc

SEQ ID NO: 195475 - DNA, 37 bp, Artificial Sequence
  Description of Artificial Sequence: Synthetic oligonucleotide
aaatgcatcctggactggaaacctcagagctataaag

SEQ ID NO: 195476 - DNA, 36 bp, Artificial Sequence
  Description of Artificial Sequence: Synthetic oligonucleotide
aatgcatcctggactggaaacctcagagctataaag

SEQ ID NO: 195477 - DNA, 35 bp, Artificial Sequence
  Description of Artificial Sequence: Synthetic oligonucleotide
atgcatcctggactggaaacctcagagctataaag

SEQ ID NO: 195478 - DNA, 34 bp, Artificial Sequence
  Description of Artificial Sequence: Synthetic oligonucleotide
tgcatcctggactggaaacctcagagctataaag

SEQ ID NO: 195479 - DNA, 33 bp, Artificial Sequence
  Description of Artificial Sequence: Synthetic oligonucleotide
gcatcctggactggaaacctcagagctataaag

SEQ ID NO: 195480 - DNA, 34 bp, Artificial Sequence
  Description of Artificial Sequence: Synthetic oligonucleotide
catcctggactggaaacctcagagctataaagtg

SEQ ID NO: 195481 - DNA, 34 bp, Artificial Sequence
  Description of Artificial Sequence: Synthetic oligonucleotide
atcctggactggaaacctcagagctataaagtgg

SEQ ID NO: 195482 - DNA, 33 bp, Artificial Sequence
  Description of Artificial Sequence: Synthetic oligonucleotide
tcctggactggaaacctcagagctataaagtgg

SEQ ID NO: 195483 - DNA, 32 bp, Artificial Sequence
  Description of Artificial Sequence: Synthetic oligonucleotide
cctggactggaaacctcagagctataaagtgg

SEQ ID NO: 195484 - DNA, 33 bp, Artificial Sequence
  Description of Artificial Sequence: Synthetic oligonucleotide
ctggactggaaacctcagagctataaagtggag

SEQ ID NO: 195485 - DNA, 34 bp, Artificial Sequence
  Description of Artificial Sequence: Synthetic oligonucleotide
tggactggaaacctcagagctataaagtggagtg

SEQ ID NO: 195486 - DNA, 33 bp, Artificial Sequence
  Description of Artificial Sequence: Synthetic oligonucleotide
ggactggaaacctcagagctataaagtggagtg

SEQ ID NO: 195487 - DNA, 34 bp, Artificial Sequence
  Description of Artificial Sequence: Synthetic oligonucleotide
gactggaaacctcagagctataaagtggagtgac

SEQ ID NO: 195488 - DNA, 36 bp, Artificial Sequence
  Description of Artificial Sequence: Synthetic oligonucleotide
actggaaacctcagagctataaagtggagtgacatg

SEQ ID NO: 195489 - DNA, 35 bp, Artificial Sequence
  Description of Artificial Sequence: Synthetic oligonucleotide
ctggaaacctcagagctataaagtggagtgacatg

SEQ ID NO: 195490 - DNA, 35 bp, Artificial Sequence
  Description of Artificial Sequence: Synthetic oligonucleotide
tggaaacctcagagctataaagtggagtgacatgg

SEQ ID NO: 195491 - DNA, 34 bp, Artificial Sequence
  Description of Artificial Sequence: Synthetic oligonucleotide
ggaaacctcagagctataaagtggagtgacatgg

SEQ ID NO: 195492 - DNA, 36 bp, Artificial Sequence
  Description of Artificial Sequence: Synthetic oligonucleotide
gaaacctcagagctataaagtggagtgacatggaag

SEQ ID NO: 195493 - DNA, 37 bp, Artificial Sequence
  Description of Artificial Sequence: Synthetic oligonucleotide
aaacctcagagctataaagtggagtgacatggaagac

SEQ ID NO: 195494 - DNA, 36 bp, Artificial Sequence
  Description of Artificial Sequence: Synthetic oligonucleotide
aacctcagagctataaagtggagtgacatggaagac

SEQ ID NO: 195495 - DNA, 35 bp, Artificial Sequence
  Description of Artificial Sequence: Synthetic oligonucleotide
acctcagagctataaagtggagtgacatggaagac

SEQ ID NO: 195496 - DNA, 34 bp, Artificial Sequence
  Description of Artificial Sequence: Synthetic oligonucleotide
cctcagagctataaagtggagtgacatggaagac

SEQ ID NO: 195497 - DNA, 35 bp, Artificial Sequence
  Description of Artificial Sequence: Synthetic oligonucleotide
ctcagagctataaagtggagtgacatggaagacag

SEQ ID NO: 195498 - DNA, 36 bp, Artificial Sequence
  Description of Artificial Sequence: Synthetic oligonucleotide
tcagagctataaagtggagtgacatggaagacagac

SEQ ID NO: 195499 - DNA, 35 bp, Artificial Sequence
  Description of Artificial Sequence: Synthetic oligonucleotide
cagagctataaagtggagtgacatggaagacagac

SEQ ID NO: 195500 - DNA, 36 bp, Artificial Sequence
  Description of Artificial Sequence: Synthetic oligonucleotide
agagctataaagtggagtgacatggaagacagacac

SEQ ID NO: 195501 - DNA, 35 bp, Artificial Sequence
  Description of Artificial Sequence: Synthetic oligonucleotide
gagctataaagtggagtgacatggaagacagacac

SEQ ID NO: 195502 - DNA, 35 bp, Artificial Sequence
  Description of Artificial Sequence: Synthetic oligonucleotide
agctataaagtggagtgacatggaagacagacacg

SEQ ID NO: 195503 - DNA, 34 bp, Artificial Sequence
  Description of Artificial Sequence: Synthetic oligonucleotide
gctataaagtggagtgacatggaagacagacacg

SEQ ID NO: 195504 - DNA, 34 bp, Artificial Sequence
  Description of Artificial Sequence: Synthetic oligonucleotide
ctataaagtggagtgacatggaagacagacacgg

SEQ ID NO: 195505 - DNA, 35 bp, Artificial Sequence
  Description of Artificial Sequence: Synthetic oligonucleotide
tataaagtggagtgacatggaagacagacacggag

SEQ ID NO: 195506 - DNA, 34 bp, Artificial Sequence
  Description of Artificial Sequence: Synthetic oligonucleotide
ataaagtggagtgacatggaagacagacacggag

SEQ ID NO: 195507 - DNA, 33 bp, Artificial Sequence
  Description of Artificial Sequence: Synthetic oligonucleotide
taaagtggagtgacatggaagacagacacggag

SEQ ID NO: 195508 - DNA, 32 bp, Artificial Sequence
  Description of Artificial Sequence: Synthetic oligonucleotide
aaagtggagtgacatggaagacagacacggag

SEQ ID NO: 195509 - DNA, 31 bp, Artificial Sequence
  Description of Artificial Sequence: Synthetic oligonucleotide
aagtggagtgacatggaagacagacacggag

SEQ ID NO: 195510 - DNA, 30 bp, Artificial Sequence
  Description of Artificial Sequence: Synthetic oligonucleotide
agtggagtgacatggaagacagacacggag

SEQ ID NO: 195511 - DNA, 29 bp, Artificial Sequence
  Description of Artificial Sequence: Synthetic oligonucleotide
gtggagtgacatggaagacagacacggag

SEQ ID NO: 195512 - DNA, 29 bp, Artificial Sequence
  Description of Artificial Sequence: Synthetic oligonucleotide
tggagtgacatggaagacagacacggagg

SEQ ID NO: 195513 - DNA, 28 bp, Artificial Sequence
  Description of Artificial Sequence: Synthetic oligonucleotide
ggagtgacatggaagacagacacggagg

SEQ ID NO: 195514 - DNA, 28 bp, Artificial Sequence
  Description of Artificial Sequence: Synthetic oligonucleotide
gagtgacatggaagacagacacggaggc

SEQ ID NO: 195515 - DNA, 29 bp, Artificial Sequence
  Description of Artificial Sequence: Synthetic oligonucleotide
agtgacatggaagacagacacggaggctg

SEQ ID NO: 195516 - DNA, 28 bp, Artificial Sequence
  Description of Artificial Sequence: Synthetic oligonucleotide
gtgacatggaagacagacacggaggctg

SEQ ID NO: 195517 - DNA, 28 bp, Artificial Sequence
  Description of Artificial Sequence: Synthetic oligonucleotide
tgacatggaagacagacacggaggctgc

SEQ ID NO: 195518 - DNA, 27 bp, Artificial Sequence
  Description of Artificial Sequence: Synthetic oligonucleotide
gacatggaagacagacacggaggctgc

SEQ ID NO: 195519 - DNA, 27 bp, Artificial Sequence
  Description of Artificial Sequence: Synthetic oligonucleotide
acatggaagacagacacggaggctgcc

SEQ ID NO: 195520 - DNA, 27 bp, Artificial Sequence
  Description of Artificial Sequence: Synthetic oligonucleotide
catggaagacagacacggaggctgcca

SEQ ID NO: 195521 - DNA, 27 bp, Artificial Sequence
  Description of Artificial Sequence: Synthetic oligonucleotide
atggaagacagacacggaggctgccac

SEQ ID NO: 195522 - DNA, 26 bp, Artificial Sequence
  Description of Artificial Sequence: Synthetic oligonucleotide
tggaagacagacacggaggctgccac

SEQ ID NO: 195523 - DNA, 25 bp, Artificial Sequence
  Description of Artificial Sequence: Synthetic oligonucleotide
ggaagacagacacggaggctgccac

SEQ ID NO: 195524 - DNA, 25 bp, Artificial Sequence
  Description of Artificial Sequence: Synthetic oligonucleotide
gaagacagacacggaggctgccacg

SEQ ID NO: 195525 - DNA, 25 bp, Artificial Sequence
  Description of Artificial Sequence: Synthetic oligonucleotide
aagacagacacggaggctgccacgg

SEQ ID NO: 195526 - DNA, 24 bp, Artificial Sequence
  Description of Artificial Sequence: Synthetic oligonucleotide
agacagacacggaggctgccacgg

SEQ ID NO: 195527 - DNA, 23 bp, Artificial Sequence
  Description of Artificial Sequence: Synthetic oligonucleotide
gacagacacggaggctgccacgg

SEQ ID NO: 195528 - DNA, 23 bp, Artificial Sequence
  Description of Artificial Sequence: Synthetic oligonucleotide
acagacacggaggctgccacggc

SEQ ID NO: 195529 - DNA, 22 bp, Artificial Sequence
  Description of Artificial Sequence: Synthetic oligonucleotide
cagacacggaggctgccacggc

SEQ ID NO: 195530 - DNA, 23 bp, Artificial Sequence
  Description of Artificial Sequence: Synthetic oligonucleotide
agacacggaggctgccacggcca

SEQ ID NO: 195531 - DNA, 22 bp, Artificial Sequence
  Description of Artificial Sequence: Synthetic oligonucleotide
gacacggaggctgccacggcca

SEQ ID NO: 195532 - DNA, 25 bp, Artificial Sequence
  Description of Artificial Sequence: Synthetic oligonucleotide
acacggaggctgccacggccactat

SEQ ID NO: 195533 - DNA, 24 bp, Artificial Sequence
  Description of Artificial Sequence: Synthetic oligonucleotide
cacggaggctgccacggccactat

SEQ ID NO: 195534 - DNA, 26 bp, Artificial Sequence
  Description of Artificial Sequence: Synthetic oligonucleotide
acggaggctgccacggccactatgta

SEQ ID NO: 195535 - DNA, 25 bp, Artificial Sequence
  Description of Artificial Sequence: Synthetic oligonucleotide
cggaggctgccacggccactatgta

SEQ ID NO: 195536 - DNA, 27 bp, Artificial Sequence
  Description of Artificial Sequence: Synthetic oligonucleotide
ggaggctgccacggccactatgtacat

SEQ ID NO: 195537 - DNA, 27 bp, Artificial Sequence
  Description of Artificial Sequence: Synthetic oligonucleotide
gaggctgccacggccactatgtacatg

SEQ ID NO: 195538 - DNA, 27 bp, Artificial Sequence
  Description of Artificial Sequence: Synthetic oligonucleotide
aggctgccacggccactatgtacatgg

SEQ ID NO: 195539 - DNA, 27 bp, Artificial Sequence
  Description of Artificial Sequence: Synthetic oligonucleotide
ggctgccacggccactatgtacatggt

SEQ ID NO: 195540 - DNA, 31 bp, Artificial Sequence
  Description of Artificial Sequence: Synthetic oligonucleotide
gctgccacggccactatgtacatggtatttg

SEQ ID NO: 195541 - DNA, 34 bp, Artificial Sequence
  Description of Artificial Sequence: Synthetic oligonucleotide
ctgccacggccactatgtacatggtatttgtatc

SEQ ID NO: 195542 - DNA, 37 bp, Artificial Sequence
  Description of Artificial Sequence: Synthetic oligonucleotide
tgccacggccactatgtacatggtatttgtatctatg

SEQ ID NO: 195543 - DNA, 36 bp, Artificial Sequence
  Description of Artificial Sequence: Synthetic oligonucleotide
gccacggccactatgtacatggtatttgtatctatg

SEQ ID NO: 195544 - DNA, 36 bp, Artificial Sequence
  Description of Artificial Sequence: Synthetic oligonucleotide
ccacggccactatgtacatggtatttgtatctatgg

SEQ ID NO: 195545 - DNA, 39 bp, Artificial Sequence
  Description of Artificial Sequence: Synthetic oligonucleotide
cacggccactatgtacatggtatttgtatctatggaaac

SEQ ID NO: 195546 - DNA, 39 bp, Artificial Sequence
  Description of Artificial Sequence: Synthetic oligonucleotide
acggccactatgtacatggtatttgtatctatggaaacg

SEQ ID NO: 195547 - DNA, 38 bp, Artificial Sequence
  Description of Artificial Sequence: Synthetic oligonucleotide
cggccactatgtacatggtatttgtatctatggaaacg

SEQ ID NO: 195548 - DNA, 38 bp, Artificial Sequence
  Description of Artificial Sequence: Synthetic oligonucleotide
ggccactatgtacatggtatttgtatctatggaaacgg

SEQ ID NO: 195549 - DNA, 39 bp, Artificial Sequence
  Description of Artificial Sequence: Synthetic oligonucleotide
gccactatgtacatggtatttgtatctatggaaacggag

SEQ ID NO: 195550 - DNA, 40 bp, Artificial Sequence
  Description of Artificial Sequence: Synthetic oligonucleotide
ccactatgtacatggtatttgtatctatggaaacggagac

SEQ ID NO: 195551 - DNA, 45 bp, Artificial Sequence
  Description of Artificial Sequence: Synthetic oligonucleotide
cactatgtacatggtatttgtatctatggaaacggagacttaaag

SEQ ID NO: 195552 - DNA, 46 bp, Artificial Sequence
  Description of Artificial Sequence: Synthetic oligonucleotide
actatgtacatggtatttgtatctatggaaacggagacttaaagtg

SEQ ID NO: 195553 - DNA, 45 bp, Artificial Sequence
  Description of Artificial Sequence: Synthetic oligonucleotide
ctatgtacatggtatttgtatctatggaaacggagacttaaagtg

SEQ ID NO: 195554 - DNA, 45 bp, Artificial Sequence
  Description of Artificial Sequence: Synthetic oligonucleotide
tatgtacatggtatttgtatctatggaaacggagacttaaagtgg

SEQ ID NO: 195555 - DNA, 44 bp, Artificial Sequence
  Description of Artificial Sequence: Synthetic oligonucleotide
atgtacatggtatttgtatctatggaaacggagacttaaagtgg

SEQ ID NO: 195556 - DNA, 43 bp, Artificial Sequence
  Description of Artificial Sequence: Synthetic oligonucleotide
tgtacatggtatttgtatctatggaaacggagacttaaagtgg

SEQ ID NO: 195557 - DNA, 42 bp, Artificial Sequence
  Description of Artificial Sequence: Synthetic oligonucleotide
gtacatggtatttgtatctatggaaacggagacttaaagtgg

SEQ ID NO: 195558 - DNA, 42 bp, Artificial Sequence
  Description of Artificial Sequence: Synthetic oligonucleotide
tacatggtatttgtatctatggaaacggagacttaaagtggc

SEQ ID NO: 195559 - DNA, 41 bp, Artificial Sequence
  Description of Artificial Sequence: Synthetic oligonucleotide
acatggtatttgtatctatggaaacggagacttaaagtggc

SEQ ID NO: 195560 - DNA, 40 bp, Artificial Sequence
  Description of Artificial Sequence: Synthetic oligonucleotide
catggtatttgtatctatggaaacggagacttaaagtggc

SEQ ID NO: 195561 - DNA, 41 bp, Artificial Sequence
  Description of Artificial Sequence: Synthetic oligonucleotide
atggtatttgtatctatggaaacggagacttaaagtggctg

SEQ ID NO: 195562 - DNA, 40 bp, Artificial Sequence
  Description of Artificial Sequence: Synthetic oligonucleotide
tggtatttgtatctatggaaacggagacttaaagtggctg

SEQ ID NO: 195563 - DNA, 39 bp, Artificial Sequence
  Description of Artificial Sequence: Synthetic oligonucleotide
ggtatttgtatctatggaaacggagacttaaagtggctg

SEQ ID NO: 195564 - DNA, 39 bp, Artificial Sequence
  Description of Artificial Sequence: Synthetic oligonucleotide
gtatttgtatctatggaaacggagacttaaagtggctgg

SEQ ID NO: 195565 - DNA, 45 bp, Artificial Sequence
  Description of Artificial Sequence: Synthetic oligonucleotide
tatttgtatctatggaaacggagacttaaagtggctggttaattc

SEQ ID NO: 195566 - DNA, 44 bp, Artificial Sequence
  Description of Artificial Sequence: Synthetic oligonucleotide
atttgtatctatggaaacggagacttaaagtggctggttaattc

SEQ ID NO: 195567 - DNA, 43 bp, Artificial Sequence
  Description of Artificial Sequence: Synthetic oligonucleotide
tttgtatctatggaaacggagacttaaagtggctggttaattc

SEQ ID NO: 195568 - DNA, 42 bp, Artificial Sequence
  Description of Artificial Sequence: Synthetic oligonucleotide
ttgtatctatggaaacggagacttaaagtggctggttaattc

SEQ ID NO: 195569 - DNA, 41 bp, Artificial Sequence
  Description of Artificial Sequence: Synthetic oligonucleotide
tgtatctatggaaacggagacttaaagtggctggttaattc

SEQ ID NO: 195570 - DNA, 40 bp, Artificial Sequence
  Description of Artificial Sequence: Synthetic oligonucleotide
gtatctatggaaacggagacttaaagtggctggttaattc

SEQ ID NO: 195571 - DNA, 41 bp, Artificial Sequence
  Description of Artificial Sequence: Synthetic oligonucleotide
tatctatggaaacggagacttaaagtggctggttaattcac

SEQ ID NO: 195572 - DNA, 40 bp, Artificial Sequence
  Description of Artificial Sequence: Synthetic oligonucleotide
atctatggaaacggagacttaaagtggctggttaattcac

SEQ ID NO: 195573 - DNA, 39 bp, Artificial Sequence
  Description of Artificial Sequence: Synthetic oligonucleotide
tctatggaaacggagacttaaagtggctggttaattcac

SEQ ID NO: 195574 - DNA, 38 bp, Artificial Sequence
  Description of Artificial Sequence: Synthetic oligonucleotide
ctatggaaacggagacttaaagtggctggttaattcac

SEQ ID NO: 195575 - DNA, 38 bp, Artificial Sequence
  Description of Artificial Sequence: Synthetic oligonucleotide
tatggaaacggagacttaaagtggctggttaattcacc

SEQ ID NO: 195576 - DNA, 37 bp, Artificial Sequence
  Description of Artificial Sequence: Synthetic oligonucleotide
atggaaacggagacttaaagtggctggttaattcacc

SEQ ID NO: 195577 - DNA, 36 bp, Artificial Sequence
  Description of Artificial Sequence: Synthetic oligonucleotide
tggaaacggagacttaaagtggctggttaattcacc

SEQ ID NO: 195578 - DNA, 35 bp, Artificial Sequence
  Description of Artificial Sequence: Synthetic oligonucleotide
ggaaacggagacttaaagtggctggttaattcacc

SEQ ID NO: 195579 - DNA, 37 bp, Artificial Sequence
  Description of Artificial Sequence: Synthetic oligonucleotide
gaaacggagacttaaagtggctggttaattcaccaag

SEQ ID NO: 195580 - DNA, 37 bp, Artificial Sequence
  Description of Artificial Sequence: Synthetic oligonucleotide
aaacggagacttaaagtggctggttaattcaccaagc

SEQ ID NO: 195581 - DNA, 36 bp, Artificial Sequence
  Description of Artificial Sequence: Synthetic oligonucleotide
aacggagacttaaagtggctggttaattcaccaagc

SEQ ID NO: 195582 - DNA, 35 bp, Artificial Sequence
  Description of Artificial Sequence: Synthetic oligonucleotide
acggagacttaaagtggctggttaattcaccaagc

SEQ ID NO: 195583 - DNA, 34 bp, Artificial Sequence
  Description of Artificial Sequence: Synthetic oligonucleotide
cggagacttaaagtggctggttaattcaccaagc

SEQ ID NO: 195584 - DNA, 34 bp, Artificial Sequence
  Description of Artificial Sequence: Synthetic oligonucleotide
ggagacttaaagtggctggttaattcaccaagcc

SEQ ID NO: 195585 - DNA, 35 bp, Artificial Sequence
  Description of Artificial Sequence: Synthetic oligonucleotide
gagacttaaagtggctggttaattcaccaagcctg

SEQ ID NO: 195586 - DNA, 38 bp, Artificial Sequence
  Description of Artificial Sequence: Synthetic oligonucleotide
agacttaaagtggctggttaattcaccaagcctgtttg

SEQ ID NO: 195587 - DNA, 37 bp, Artificial Sequence
  Description of Artificial Sequence: Synthetic oligonucleotide
gacttaaagtggctggttaattcaccaagcctgtttg

SEQ ID NO: 195588 - DNA, 37 bp, Artificial Sequence
  Description of Artificial Sequence: Synthetic oligonucleotide
acttaaagtggctggttaattcaccaagcctgtttgc

SEQ ID NO: 195589 - DNA, 36 bp, Artificial Sequence
  Description of Artificial Sequence: Synthetic oligonucleotide
cttaaagtggctggttaattcaccaagcctgtttgc

SEQ ID NO: 195590 - DNA, 39 bp, Artificial Sequence
  Description of Artificial Sequence: Synthetic oligonucleotide
ttaaagtggctggttaattcaccaagcctgtttgctaac

SEQ ID NO: 195591 - DNA, 38 bp, Artificial Sequence
  Description of Artificial Sequence: Synthetic oligonucleotide
taaagtggctggttaattcaccaagcctgtttgctaac

SEQ ID NO: 195592 - DNA, 37 bp, Artificial Sequence
  Description of Artificial Sequence: Synthetic oligonucleotide
aaagtggctggttaattcaccaagcctgtttgctaac

SEQ ID NO: 195593 - DNA, 36 bp, Artificial Sequence
  Description of Artificial Sequence: Synthetic oligonucleotide
aagtggctggttaattcaccaagcctgtttgctaac

SEQ ID NO: 195594 - DNA, 35 bp, Artificial Sequence
  Description of Artificial Sequence: Synthetic oligonucleotide
agtggctggttaattcaccaagcctgtttgctaac

SEQ ID NO: 195595 - DNA, 34 bp, Artificial Sequence
  Description of Artificial Sequence: Synthetic oligonucleotide
gtggctggttaattcaccaagcctgtttgctaac

SEQ ID NO: 195596 - DNA, 36 bp, Artificial Sequence
  Description of Artificial Sequence: Synthetic oligonucleotide
tggctggttaattcaccaagcctgtttgctaacaag

SEQ ID NO: 195597 - DNA, 35 bp, Artificial Sequence
  Description of Artificial Sequence: Synthetic oligonucleotide
ggctggttaattcaccaagcctgtttgctaacaag

SEQ ID NO: 195598 - DNA, 38 bp, Artificial Sequence
  Description of Artificial Sequence: Synthetic oligonucleotide
gctggttaattcaccaagcctgtttgctaacaagtttg

SEQ ID NO: 195599 - DNA, 39 bp, Artificial Sequence
  Description of Artificial Sequence: Synthetic oligonucleotide
ctggttaattcaccaagcctgtttgctaacaagtttgag

SEQ ID NO: 195600 - DNA, 39 bp, Artificial Sequence
  Description of Artificial Sequence: Synthetic oligonucleotide
tggttaattcaccaagcctgtttgctaacaagtttgagc

SEQ ID NO: 195601 - DNA, 38 bp, Artificial Sequence
  Description of Artificial Sequence: Synthetic oligonucleotide
ggttaattcaccaagcctgtttgctaacaagtttgagc

SEQ ID NO: 195602 - DNA, 44 bp, Artificial Sequence
  Description of Artificial Sequence: Synthetic oligonucleotide
gttaattcaccaagcctgtttgctaacaagtttgagcttaatac

SEQ ID NO: 195603 - DNA, 44 bp, Artificial Sequence
  Description of Artificial Sequence: Synthetic oligonucleotide
ttaattcaccaagcctgtttgctaacaagtttgagcttaatacc

SEQ ID NO: 195604 - DNA, 43 bp, Artificial Sequence
  Description of Artificial Sequence: Synthetic oligonucleotide
taattcaccaagcctgtttgctaacaagtttgagcttaatacc

SEQ ID NO: 195605 - DNA, 42 bp, Artificial Sequence
  Description of Artificial Sequence: Synthetic oligonucleotide
aattcaccaagcctgtttgctaacaagtttgagcttaatacc

SEQ ID NO: 195606 - DNA, 41 bp, Artificial Sequence
  Description of Artificial Sequence: Synthetic oligonucleotide
attcaccaagcctgtttgctaacaagtttgagcttaatacc

SEQ ID NO: 195607 - DNA, 40 bp, Artificial Sequence
  Description of Artificial Sequence: Synthetic oligonucleotide
ttcaccaagcctgtttgctaacaagtttgagcttaatacc

SEQ ID NO: 195608 - DNA, 39 bp, Artificial Sequence
  Description of Artificial Sequence: Synthetic oligonucleotide
tcaccaagcctgtttgctaacaagtttgagcttaatacc

SEQ ID NO: 195609 - DNA, 38 bp, Artificial Sequence
  Description of Artificial Sequence: Synthetic oligonucleotide
caccaagcctgtttgctaacaagtttgagcttaatacc

SEQ ID NO: 195610 - DNA, 40 bp, Artificial Sequence
  Description of Artificial Sequence: Synthetic oligonucleotide
accaagcctgtttgctaacaagtttgagcttaatacctac

SEQ ID NO: 195611 - DNA, 39 bp, Artificial Sequence
  Description of Artificial Sequence: Synthetic oligonucleotide
ccaagcctgtttgctaacaagtttgagcttaatacctac

SEQ ID NO: 195612 - DNA, 39 bp, Artificial Sequence
  Description of Artificial Sequence: Synthetic oligonucleotide
caagcctgtttgctaacaagtttgagcttaatacctacc

SEQ ID NO: 195613 - DNA, 39 bp, Artificial Sequence
  Description of Artificial Sequence: Synthetic oligonucleotide
aagcctgtttgctaacaagtttgagcttaatacctaccc

SEQ ID NO: 195614 - DNA, 38 bp, Artificial Sequence
  Description of Artificial Sequence: Synthetic oligonucleotide
agcctgtttgctaacaagtttgagcttaatacctaccc

SEQ ID NO: 195615 - DNA, 37 bp, Artificial Sequence
  Description of Artificial Sequence: Synthetic oligonucleotide
gcctgtttgctaacaagtttgagcttaatacctaccc

SEQ ID NO: 195616 - DNA, 37 bp, Artificial Sequence
  Description of Artificial Sequence: Synthetic oligonucleotide
cctgtttgctaacaagtttgagcttaatacctacccc

SEQ ID NO: 195617 - DNA, 37 bp, Artificial Sequence
  Description of Artificial Sequence: Synthetic oligonucleotide
ctgtttgctaacaagtttgagcttaatacctaccccc

SEQ ID NO: 195618 - DNA, 40 bp, Artificial Sequence
  Description of Artificial Sequence: Synthetic oligonucleotide
tgtttgctaacaagtttgagcttaatacctacccccttac

SEQ ID NO: 195619 - DNA, 39 bp, Artificial Sequence
  Description of Artificial Sequence: Synthetic oligonucleotide
gtttgctaacaagtttgagcttaatacctacccccttac

SEQ ID NO: 195620 - DNA, 40 bp, Artificial Sequence
  Description of Artificial Sequence: Synthetic oligonucleotide
tttgctaacaagtttgagcttaatacctacccccttactg

SEQ ID NO: 195621 - DNA, 39 bp, Artificial Sequence
  Description of Artificial Sequence: Synthetic oligonucleotide
ttgctaacaagtttgagcttaatacctacccccttactg

SEQ ID NO: 195622 - DNA, 38 bp, Artificial Sequence
  Description of Artificial Sequence: Synthetic oligonucleotide
tgctaacaagtttgagcttaatacctacccccttactg

SEQ ID NO: 195623 - DNA, 37 bp, Artificial Sequence
  Description of Artificial Sequence: Synthetic oligonucleotide
gctaacaagtttgagcttaatacctacccccttactg

SEQ ID NO: 195624 - DNA, 38 bp, Artificial Sequence
  Description of Artificial Sequence: Synthetic oligonucleotide
ctaacaagtttgagcttaatacctacccccttactgtg

SEQ ID NO: 195625 - DNA, 38 bp, Artificial Sequence
  Description of Artificial Sequence: Synthetic oligonucleotide
taacaagtttgagcttaatacctacccccttactgtgg

SEQ ID NO: 195626 - DNA, 37 bp, Artificial Sequence
  Description of Artificial Sequence: Synthetic oligonucleotide
aacaagtttgagcttaatacctacccccttactgtgg

SEQ ID NO: 195627 - DNA, 36 bp, Artificial Sequence
  Description of Artificial Sequence: Synthetic oligonucleotide
acaagtttgagcttaatacctacccccttactgtgg

SEQ ID NO: 195628 - DNA, 35 bp, Artificial Sequence
  Description of Artificial Sequence: Synthetic oligonucleotide
caagtttgagcttaatacctacccccttactgtgg

SEQ ID NO: 195629 - DNA, 38 bp, Artificial Sequence
  Description of Artificial Sequence: Synthetic oligonucleotide
aagtttgagcttaatacctacccccttactgtggaatg

SEQ ID NO: 195630 - DNA, 37 bp, Artificial Sequence
  Description of Artificial Sequence: Synthetic oligonucleotide
agtttgagcttaatacctacccccttactgtggaatg

SEQ ID NO: 195631 - DNA, 36 bp, Artificial Sequence
  Description of Artificial Sequence: Synthetic oligonucleotide
gtttgagcttaatacctacccccttactgtggaatg

SEQ ID NO: 195632 - DNA, 36 bp, Artificial Sequence
  Description of Artificial Sequence: Synthetic oligonucleotide
tttgagcttaatacctacccccttactgtggaatgc

SEQ ID NO: 195633 - DNA, 35 bp, Artificial Sequence
  Description of Artificial Sequence: Synthetic oligonucleotide
ttgagcttaatacctacccccttactgtggaatgc

SEQ ID NO: 195634 - DNA, 34 bp, Artificial Sequence
  Description of Artificial Sequence: Synthetic oligonucleotide
tgagcttaatacctacccccttactgtggaatgc

SEQ ID NO: 195635 - DNA, 33 bp, Artificial Sequence
  Description of Artificial Sequence: Synthetic oligonucleotide
gagcttaatacctacccccttactgtggaatgc

SEQ ID NO: 195636 - DNA, 33 bp, Artificial Sequence
  Description of Artificial Sequence: Synthetic oligonucleotide
agcttaatacctacccccttactgtggaatgcc

SEQ ID NO: 195637 - DNA, 32 bp, Artificial Sequence
  Description of Artificial Sequence: Synthetic oligonucleotide
gcttaatacctacccccttactgtggaatgcc

SEQ ID NO: 195638 - DNA, 34 bp, Artificial Sequence
  Description of Artificial Sequence: Synthetic oligonucleotide
cttaatacctacccccttactgtggaatgcctag

SEQ ID NO: 195639 - DNA, 36 bp, Artificial Sequence
  Description of Artificial Sequence: Synthetic oligonucleotide
ttaatacctacccccttactgtggaatgcctagaac

SEQ ID NO: 195640 - DNA, 35 bp, Artificial Sequence
  Description of Artificial Sequence: Synthetic oligonucleotide
taatacctacccccttactgtggaatgcctagaac

SEQ ID NO: 195641 - DNA, 34 bp, Artificial Sequence
  Description of Artificial Sequence: Synthetic oligonucleotide
aatacctacccccttactgtggaatgcctagaac

SEQ ID NO: 195642 - DNA, 33 bp, Artificial Sequence
  Description of Artificial Sequence: Synthetic oligonucleotide
atacctacccccttactgtggaatgcctagaac

SEQ ID NO: 195643 - DNA, 32 bp, Artificial Sequence
  Description of Artificial Sequence: Synthetic oligonucleotide
tacctacccccttactgtggaatgcctagaac

SEQ ID NO: 195644 - DNA, 31 bp, Artificial Sequence
  Description of Artificial Sequence: Synthetic oligonucleotide
acctacccccttactgtggaatgcctagaac

SEQ ID NO: 195645 - DNA, 30 bp, Artificial Sequence
  Description of Artificial Sequence: Synthetic oligonucleotide
cctacccccttactgtggaatgcctagaac

SEQ ID NO: 195646 - DNA, 31 bp, Artificial Sequence
  Description of Artificial Sequence: Synthetic oligonucleotide
ctacccccttactgtggaatgcctagaactg

SEQ ID NO: 195647 - DNA, 32 bp, Artificial Sequence
  Description of Artificial Sequence: Synthetic oligonucleotide
tacccccttactgtggaatgcctagaactgag

SEQ ID NO: 195648 - DNA, 31 bp, Artificial Sequence
  Description of Artificial Sequence: Synthetic oligonucleotide
acccccttactgtggaatgcctagaactgag

SEQ ID NO: 195649 - DNA, 30 bp, Artificial Sequence
  Description of Artificial Sequence: Synthetic oligonucleotide
cccccttactgtggaatgcctagaactgag

SEQ ID NO: 195650 - DNA, 30 bp, Artificial Sequence
  Description of Artificial Sequence: Synthetic oligonucleotide
ccccttactgtggaatgcctagaactgagg

SEQ ID NO: 195651 - DNA, 30 bp, Artificial Sequence
  Description of Artificial Sequence: Synthetic oligonucleotide
cccttactgtggaatgcctagaactgaggc

SEQ ID NO: 195652 - DNA, 32 bp, Artificial Sequence
  Description of Artificial Sequence: Synthetic oligonucleotide
ccttactgtggaatgcctagaactgaggcatc

SEQ ID NO: 195653 - DNA, 32 bp, Artificial Sequence
  Description of Artificial Sequence: Synthetic oligonucleotide
cttactgtggaatgcctagaactgaggcatcg

SEQ ID NO: 195654 - DNA, 32 bp, Artificial Sequence
  Description of Artificial Sequence: Synthetic oligonucleotide
ttactgtggaatgcctagaactgaggcatcgc

SEQ ID NO: 195655 - DNA, 31 bp, Artificial Sequence
  Description of Artificial Sequence: Synthetic oligonucleotide
tactgtggaatgcctagaactgaggcatcgc

SEQ ID NO: 195656 - DNA, 30 bp, Artificial Sequence
  Description of Artificial Sequence: Synthetic oligonucleotide
actgtggaatgcctagaactgaggcatcgc

SEQ ID NO: 195657 - DNA, 29 bp, Artificial Sequence
  Description of Artificial Sequence: Synthetic oligonucleotide
ctgtggaatgcctagaactgaggcatcgc

SEQ ID NO: 195658 - DNA, 29 bp, Artificial Sequence
  Description of Artificial Sequence: Synthetic oligonucleotide
tgtggaatgcctagaactgaggcatcgcg

SEQ ID NO: 195659 - DNA, 28 bp, Artificial Sequence
  Description of Artificial Sequence: Synthetic oligonucleotide
gtggaatgcctagaactgaggcatcgcg

SEQ ID NO: 195660 - DNA, 31 bp, Artificial Sequence
  Description of Artificial Sequence: Synthetic oligonucleotide
tggaatgcctagaactgaggcatcgcgaaag

SEQ ID NO: 195661 - DNA, 30 bp, Artificial Sequence
  Description of Artificial Sequence: Synthetic oligonucleotide
ggaatgcctagaactgaggcatcgcgaaag

SEQ ID NO: 195662 - DNA, 32 bp, Artificial Sequence
  Description of Artificial Sequence: Synthetic oligonucleotide
gaatgcctagaactgaggcatcgcgaaagaac

SEQ ID NO: 195663 - DNA, 32 bp, Artificial Sequence
  Description of Artificial Sequence: Synthetic oligonucleotide
aatgcctagaactgaggcatcgcgaaagaacc

SEQ ID NO: 195664 - DNA, 31 bp, Artificial Sequence
  Description of Artificial Sequence: Synthetic oligonucleotide
atgcctagaactgaggcatcgcgaaagaacc

SEQ ID NO: 195665 - DNA, 30 bp, Artificial Sequence
  Description of Artificial Sequence: Synthetic oligonucleotide
tgcctagaactgaggcatcgcgaaagaacc

SEQ ID NO: 195666 - DNA, 29 bp, Artificial Sequence
  Description of Artificial Sequence: Synthetic oligonucleotide
gcctagaactgaggcatcgcgaaagaacc

SEQ ID NO: 195667 - DNA, 29 bp, Artificial Sequence
  Description of Artificial Sequence: Synthetic oligonucleotide
cctagaactgaggcatcgcgaaagaaccc

SEQ ID NO: 195668 - DNA, 30 bp, Artificial Sequence
  Description of Artificial Sequence: Synthetic oligonucleotide
ctagaactgaggcatcgcgaaagaaccctc

SEQ ID NO: 195669 - DNA, 33 bp, Artificial Sequence
  Description of Artificial Sequence: Synthetic oligonucleotide
tagaactgaggcatcgcgaaagaaccctcaatc

SEQ ID NO: 195670 - DNA, 32 bp, Artificial Sequence
  Description of Artificial Sequence: Synthetic oligonucleotide
agaactgaggcatcgcgaaagaaccctcaatc

SEQ ID NO: 195671 - DNA, 31 bp, Artificial Sequence
  Description of Artificial Sequence: Synthetic oligonucleotide
gaactgaggcatcgcgaaagaaccctcaatc

SEQ ID NO: 195672 - DNA, 32 bp, Artificial Sequence
  Description of Artificial Sequence: Synthetic oligonucleotide
aactgaggcatcgcgaaagaaccctcaatcag

SEQ ID NO: 195673 - DNA, 31 bp, Artificial Sequence
  Description of Artificial Sequence: Synthetic oligonucleotide
actgaggcatcgcgaaagaaccctcaatcag

SEQ ID NO: 195674 - DNA, 30 bp, Artificial Sequence
  Description of Artificial Sequence: Synthetic oligonucleotide
ctgaggcatcgcgaaagaaccctcaatcag

SEQ ID NO: 195675 - DNA, 31 bp, Artificial Sequence
  Description of Artificial Sequence: Synthetic oligonucleotide
tgaggcatcgcgaaagaaccctcaatcagag

SEQ ID NO: 195676 - DNA, 30 bp, Artificial Sequence
  Description of Artificial Sequence: Synthetic oligonucleotide
gaggcatcgcgaaagaaccctcaatcagag

SEQ ID NO: 195677 - DNA, 31 bp, Artificial Sequence
  Description of Artificial Sequence: Synthetic oligonucleotide
aggcatcgcgaaagaaccctcaatcagagtg

SEQ ID NO: 195678 - DNA, 30 bp, Artificial Sequence
  Description of Artificial Sequence: Synthetic oligonucleotide
ggcatcgcgaaagaaccctcaatcagagtg

SEQ ID NO: 195679 - DNA, 33 bp, Artificial Sequence
  Description of Artificial Sequence: Synthetic oligonucleotide
gcatcgcgaaagaaccctcaatcagagtgaaac

SEQ ID NO: 195680 - DNA, 34 bp, Artificial Sequence
  Description of Artificial Sequence: Synthetic oligonucleotide
catcgcgaaagaaccctcaatcagagtgaaactg

SEQ ID NO: 195681 - DNA, 34 bp, Artificial Sequence
  Description of Artificial Sequence: Synthetic oligonucleotide
atcgcgaaagaaccctcaatcagagtgaaactgc

SEQ ID NO: 195682 - DNA, 33 bp, Artificial Sequence
  Description of Artificial Sequence: Synthetic oligonucleotide
tcgcgaaagaaccctcaatcagagtgaaactgc

SEQ ID NO: 195683 - DNA, 32 bp, Artificial Sequence
  Description of Artificial Sequence: Synthetic oligonucleotide
cgcgaaagaaccctcaatcagagtgaaactgc

SEQ ID NO: 195684 - DNA, 32 bp, Artificial Sequence
  Description of Artificial Sequence: Synthetic oligonucleotide
gcgaaagaaccctcaatcagagtgaaactgcg

SEQ ID NO: 195685 - DNA, 35 bp, Artificial Sequence
  Description of Artificial Sequence: Synthetic oligonucleotide
cgaaagaaccctcaatcagagtgaaactgcgatac

SEQ ID NO: 195686 - DNA, 37 bp, Artificial Sequence
  Description of Artificial Sequence: Synthetic oligonucleotide
gaaagaaccctcaatcagagtgaaactgcgatacaac

SEQ ID NO: 195687 - DNA, 37 bp, Artificial Sequence
  Description of Artificial Sequence: Synthetic oligonucleotide
aaagaaccctcaatcagagtgaaactgcgatacaacc

SEQ ID NO: 195688 - DNA, 36 bp, Artificial Sequence
  Description of Artificial Sequence: Synthetic oligonucleotide
aagaaccctcaatcagagtgaaactgcgatacaacc

SEQ ID NO: 195689 - DNA, 35 bp, Artificial Sequence
  Description of Artificial Sequence: Synthetic oligonucleotide
agaaccctcaatcagagtgaaactgcgatacaacc

SEQ ID NO: 195690 - DNA, 34 bp, Artificial Sequence
  Description of Artificial Sequence: Synthetic oligonucleotide
gaaccctcaatcagagtgaaactgcgatacaacc

SEQ ID NO: 195691 - DNA, 34 bp, Artificial Sequence
  Description of Artificial Sequence: Synthetic oligonucleotide
aaccctcaatcagagtgaaactgcgatacaaccc

SEQ ID NO: 195692 - DNA, 33 bp, Artificial Sequence
  Description of Artificial Sequence: Synthetic oligonucleotide
accctcaatcagagtgaaactgcgatacaaccc

SEQ ID NO: 195693 - DNA, 32 bp, Artificial Sequence
  Description of Artificial Sequence: Synthetic oligonucleotide
ccctcaatcagagtgaaactgcgatacaaccc

SEQ ID NO: 195694 - DNA, 33 bp, Artificial Sequence
  Description of Artificial Sequence: Synthetic oligonucleotide
cctcaatcagagtgaaactgcgatacaacccag

SEQ ID NO: 195695 - DNA, 33 bp, Artificial Sequence
  Description of Artificial Sequence: Synthetic oligonucleotide
ctcaatcagagtgaaactgcgatacaacccagc

SEQ ID NO: 195696 - DNA, 34 bp, Artificial Sequence
  Description of Artificial Sequence: Synthetic oligonucleotide
tcaatcagagtgaaactgcgatacaacccagctg

SEQ ID NO: 195697 - DNA, 33 bp, Artificial Sequence
  Description of Artificial Sequence: Synthetic oligonucleotide
caatcagagtgaaactgcgatacaacccagctg

SEQ ID NO: 195698 - DNA, 33 bp, Artificial Sequence
  Description of Artificial Sequence: Synthetic oligonucleotide
aatcagagtgaaactgcgatacaacccagctgg

SEQ ID NO: 195699 - DNA, 32 bp, Artificial Sequence
  Description of Artificial Sequence: Synthetic oligonucleotide
atcagagtgaaactgcgatacaacccagctgg

SEQ ID NO: 195700 - DNA, 31 bp, Artificial Sequence
  Description of Artificial Sequence: Synthetic oligonucleotide
tcagagtgaaactgcgatacaacccagctgg

SEQ ID NO: 195701 - DNA, 30 bp, Artificial Sequence
  Description of Artificial Sequence: Synthetic oligonucleotide
cagagtgaaactgcgatacaacccagctgg

SEQ ID NO: 195702 - DNA, 37 bp, Artificial Sequence
  Description of Artificial Sequence: Synthetic oligonucleotide
agagtgaaactgcgatacaacccagctggtatttttg

SEQ ID NO: 195703 - DNA, 36 bp, Artificial Sequence
  Description of Artificial Sequence: Synthetic oligonucleotide
gagtgaaactgcgatacaacccagctggtatttttg

SEQ ID NO: 195704 - DNA, 40 bp, Artificial Sequence
  Description of Artificial Sequence: Synthetic oligonucleotide
ccacggccactatgtacatggtatttgtatctatgaaaac

SEQ ID NO: 195705 - DNA, 40 bp, Artificial Sequence
  Description of Artificial Sequence: Synthetic oligonucleotide
cacggccactatgtacatggtatttgtatctatgaaaacg

SEQ ID NO: 195706 - DNA, 40 bp, Artificial Sequence
  Description of Artificial Sequence: Synthetic oligonucleotide
acggccactatgtacatggtatttgtatctatgaaaacgg

SEQ ID NO: 195707 - DNA, 39 bp, Artificial Sequence
  Description of Artificial Sequence: Synthetic oligonucleotide
cggccactatgtacatggtatttgtatctatgaaaacgg

SEQ ID NO: 195708 - DNA, 40 bp, Artificial Sequence
  Description of Artificial Sequence: Synthetic oligonucleotide
ggccactatgtacatggtatttgtatctatgaaaacggag

SEQ ID NO: 195709 - DNA, 41 bp, Artificial Sequence
  Description of Artificial Sequence: Synthetic oligonucleotide
gccactatgtacatggtatttgtatctatgaaaacggagac

SEQ ID NO: 195710 - DNA, 46 bp, Artificial Sequence
  Description of Artificial Sequence: Synthetic oligonucleotide
ccactatgtacatggtatttgtatctatgaaaacggagacttaaag

SEQ ID NO: 195711 - DNA, 47 bp, Artificial Sequence
  Description of Artificial Sequence: Synthetic oligonucleotide
cactatgtacatggtatttgtatctatgaaaacggagacttaaagtg

SEQ ID NO: 195712 - DNA, 47 bp, Artificial Sequence
  Description of Artificial Sequence: Synthetic oligonucleotide
actatgtacatggtatttgtatctatgaaaacggagacttaaagtgg

SEQ ID NO: 195713 - DNA, 46 bp, Artificial Sequence
  Description of Artificial Sequence: Synthetic oligonucleotide
ctatgtacatggtatttgtatctatgaaaacggagacttaaagtgg

SEQ ID NO: 195714 - DNA, 46 bp, Artificial Sequence
  Description of Artificial Sequence: Synthetic oligonucleotide
tatgtacatggtatttgtatctatgaaaacggagacttaaagtggc

SEQ ID NO: 195715 - DNA, 45 bp, Artificial Sequence
  Description of Artificial Sequence: Synthetic oligonucleotide
atgtacatggtatttgtatctatgaaaacggagacttaaagtggc

SEQ ID NO: 195716 - DNA, 44 bp, Artificial Sequence
  Description of Artificial Sequence: Synthetic oligonucleotide
tgtacatggtatttgtatctatgaaaacggagacttaaagtggc

SEQ ID NO: 195717 - DNA, 43 bp, Artificial Sequence
  Description of Artificial Sequence: Synthetic oligonucleotide
gtacatggtatttgtatctatgaaaacggagacttaaagtggc

SEQ ID NO: 195718 - DNA, 44 bp, Artificial Sequence
  Description of Artificial Sequence: Synthetic oligonucleotide
tacatggtatttgtatctatgaaaacggagacttaaagtggctg

SEQ ID NO: 195719 - DNA, 43 bp, Artificial Sequence
  Description of Artificial Sequence: Synthetic oligonucleotide
acatggtatttgtatctatgaaaacggagacttaaagtggctg

SEQ ID NO: 195720 - DNA, 42 bp, Artificial Sequence
  Description of Artificial Sequence: Synthetic oligonucleotide
catggtatttgtatctatgaaaacggagacttaaagtggctg

SEQ ID NO: 195721 - DNA, 42 bp, Artificial Sequence
  Description of Artificial Sequence: Synthetic oligonucleotide
atggtatttgtatctatgaaaacggagacttaaagtggctgg

SEQ ID NO: 195722 - DNA, 41 bp, Artificial Sequence
  Description of Artificial Sequence: Synthetic oligonucleotide
tggtatttgtatctatgaaaacggagacttaaagtggctgg

SEQ ID NO: 195723 - DNA, 40 bp, Artificial Sequence
  Description of Artificial Sequence: Synthetic oligonucleotide
ggtatttgtatctatgaaaacggagacttaaagtggctgg

SEQ ID NO: 195724 - DNA, 46 bp, Artificial Sequence
  Description of Artificial Sequence: Synthetic oligonucleotide
gtatttgtatctatgaaaacggagacttaaagtggctggttaattc

SEQ ID NO: 195725 - DNA, 47 bp, Artificial Sequence
  Description of Artificial Sequence: Synthetic oligonucleotide
tatttgtatctatgaaaacggagacttaaagtggctggttaattcac

SEQ ID NO: 195726 - DNA, 46 bp, Artificial Sequence
  Description of Artificial Sequence: Synthetic oligonucleotide
atttgtatctatgaaaacggagacttaaagtggctggttaattcac

SEQ ID NO: 195727 - DNA, 45 bp, Artificial Sequence
  Description of Artificial Sequence: Synthetic oligonucleotide
tttgtatctatgaaaacggagacttaaagtggctggttaattcac

SEQ ID NO: 195728 - DNA, 44 bp, Artificial Sequence
  Description of Artificial Sequence: Synthetic oligonucleotide
ttgtatctatgaaaacggagacttaaagtggctggttaattcac

SEQ ID NO: 195729 - DNA, 43 bp, Artificial Sequence
  Description of Artificial Sequence: Synthetic oligonucleotide
tgtatctatgaaaacggagacttaaagtggctggttaattcac

SEQ ID NO: 195730 - DNA, 42 bp, Artificial Sequence
  Description of Artificial Sequence: Synthetic oligonucleotide
gtatctatgaaaacggagacttaaagtggctggttaattcac

SEQ ID NO: 195731 - DNA, 42 bp, Artificial Sequence
  Description of Artificial Sequence: Synthetic oligonucleotide
tatctatgaaaacggagacttaaagtggctggttaattcacc

SEQ ID NO: 195732 - DNA, 41 bp, Artificial Sequence
  Description of Artificial Sequence: Synthetic oligonucleotide
atctatgaaaacggagacttaaagtggctggttaattcacc

SEQ ID NO: 195733 - DNA, 40 bp, Artificial Sequence
  Description of Artificial Sequence: Synthetic oligonucleotide
tctatgaaaacggagacttaaagtggctggttaattcacc

SEQ ID NO: 195734 - DNA, 39 bp, Artificial Sequence
  Description of Artificial Sequence: Synthetic oligonucleotide
ctatgaaaacggagacttaaagtggctggttaattcacc

SEQ ID NO: 195735 - DNA, 41 bp, Artificial Sequence
  Description of Artificial Sequence: Synthetic oligonucleotide
tatgaaaacggagacttaaagtggctggttaattcaccaag

SEQ ID NO: 195736 - DNA, 40 bp, Artificial Sequence
  Description of Artificial Sequence: Synthetic oligonucleotide
atgaaaacggagacttaaagtggctggttaattcaccaag

SEQ ID NO: 195737 - DNA, 39 bp, Artificial Sequence
  Description of Artificial Sequence: Synthetic oligonucleotide
tgaaaacggagacttaaagtggctggttaattcaccaag

SEQ ID NO: 195738 - DNA, 38 bp, Artificial Sequence
  Description of Artificial Sequence: Synthetic oligonucleotide
gaaaacggagacttaaagtggctggttaattcaccaag

SEQ ID NO: 195739 - DNA, 38 bp, Artificial Sequence
  Description of Artificial Sequence: Synthetic oligonucleotide
aaaacggagacttaaagtggctggttaattcaccaagc

SEQ ID NO: 195740 - DNA, 33 bp, Artificial Sequence
  Description of Artificial Sequence: Synthetic oligonucleotide
cttactgtggaatgcctagaactgaggcatcac

SEQ ID NO: 195741 - DNA, 33 bp, Artificial Sequence
  Description of Artificial Sequence: Synthetic oligonucleotide
ttactgtggaatgcctagaactgaggcatcacg

SEQ ID NO: 195742 - DNA, 32 bp, Artificial Sequence
  Description of Artificial Sequence: Synthetic oligonucleotide
tactgtggaatgcctagaactgaggcatcacg

SEQ ID NO: 195743 - DNA, 31 bp, Artificial Sequence
  Description of Artificial Sequence: Synthetic oligonucleotide
actgtggaatgcctagaactgaggcatcacg

SEQ ID NO: 195744 - DNA, 30 bp, Artificial Sequence
  Description of Artificial Sequence: Synthetic oligonucleotide
ctgtggaatgcctagaactgaggcatcacg

SEQ ID NO: 195745 - DNA, 33 bp, Artificial Sequence
  Description of Artificial Sequence: Synthetic oligonucleotide
tgtggaatgcctagaactgaggcatcacgaaag

SEQ ID NO: 195746 - DNA, 32 bp, Artificial Sequence
  Description of Artificial Sequence: Synthetic oligonucleotide
gtggaatgcctagaactgaggcatcacgaaag

SEQ ID NO: 195747 - DNA, 34 bp, Artificial Sequence
  Description of Artificial Sequence: Synthetic oligonucleotide
tggaatgcctagaactgaggcatcacgaaagaac

SEQ ID NO: 195748 - DNA, 33 bp, Artificial Sequence
  Description of Artificial Sequence: Synthetic oligonucleotide
ggaatgcctagaactgaggcatcacgaaagaac

SEQ ID NO: 195749 - DNA, 33 bp, Artificial Sequence
  Description of Artificial Sequence: Synthetic oligonucleotide
gaatgcctagaactgaggcatcacgaaagaacc

SEQ ID NO: 195750 - DNA, 33 bp, Artificial Sequence
  Description of Artificial Sequence: Synthetic oligonucleotide
aatgcctagaactgaggcatcacgaaagaaccc

SEQ ID NO: 195751 - DNA, 32 bp, Artificial Sequence
  Description of Artificial Sequence: Synthetic oligonucleotide
atgcctagaactgaggcatcacgaaagaaccc

SEQ ID NO: 195752 - DNA, 31 bp, Artificial Sequence
  Description of Artificial Sequence: Synthetic oligonucleotide
tgcctagaactgaggcatcacgaaagaaccc

SEQ ID NO: 195753 - DNA, 30 bp, Artificial Sequence
  Description of Artificial Sequence: Synthetic oligonucleotide
gcctagaactgaggcatcacgaaagaaccc

SEQ ID NO: 195754 - DNA, 31 bp, Artificial Sequence
  Description of Artificial Sequence: Synthetic oligonucleotide
cctagaactgaggcatcacgaaagaaccctc

SEQ ID NO: 195755 - DNA, 34 bp, Artificial Sequence
  Description of Artificial Sequence: Synthetic oligonucleotide
ctagaactgaggcatcacgaaagaaccctcaatc

SEQ ID NO: 195756 - DNA, 35 bp, Artificial Sequence
  Description of Artificial Sequence: Synthetic oligonucleotide
tagaactgaggcatcacgaaagaaccctcaatcag

SEQ ID NO: 195757 - DNA, 34 bp, Artificial Sequence
  Description of Artificial Sequence: Synthetic oligonucleotide
agaactgaggcatcacgaaagaaccctcaatcag

SEQ ID NO: 195758 - DNA, 33 bp, Artificial Sequence
  Description of Artificial Sequence: Synthetic oligonucleotide
gaactgaggcatcacgaaagaaccctcaatcag

SEQ ID NO: 195759 - DNA, 34 bp, Artificial Sequence
  Description of Artificial Sequence: Synthetic oligonucleotide
aactgaggcatcacgaaagaaccctcaatcagag

SEQ ID NO: 195760 - DNA, 33 bp, Artificial Sequence
  Description of Artificial Sequence: Synthetic oligonucleotide
actgaggcatcacgaaagaaccctcaatcagag

SEQ ID NO: 195761 - DNA, 32 bp, Artificial Sequence
  Description of Artificial Sequence: Synthetic oligonucleotide
ctgaggcatcacgaaagaaccctcaatcagag

SEQ ID NO: 195762 - DNA, 33 bp, Artificial Sequence
  Description of Artificial Sequence: Synthetic oligonucleotide
tgaggcatcacgaaagaaccctcaatcagagtg

SEQ ID NO: 195763 - DNA, 32 bp, Artificial Sequence
  Description of Artificial Sequence: Synthetic oligonucleotide
gaggcatcacgaaagaaccctcaatcagagtg

SEQ ID NO: 195764 - DNA, 35 bp, Artificial Sequence
  Description of Artificial Sequence: Synthetic oligonucleotide
aggcatcacgaaagaaccctcaatcagagtgaaac

SEQ ID NO: 195765 - DNA, 34 bp, Artificial Sequence
  Description of Artificial Sequence: Synthetic oligonucleotide
ggcatcacgaaagaaccctcaatcagagtgaaac

SEQ ID NO: 195766 - DNA, 35 bp, Artificial Sequence
  Description of Artificial Sequence: Synthetic oligonucleotide
gcatcacgaaagaaccctcaatcagagtgaaactg

SEQ ID NO: 195767 - DNA, 35 bp, Artificial Sequence
  Description of Artificial Sequence: Synthetic oligonucleotide
catcacgaaagaaccctcaatcagagtgaaactgc

SEQ ID NO: 195768 - DNA, 35 bp, Artificial Sequence
  Description of Artificial Sequence: Synthetic oligonucleotide
atcacgaaagaaccctcaatcagagtgaaactgcg

SEQ ID NO: 195769 - DNA, 34 bp, Artificial Sequence
  Description of Artificial Sequence: Synthetic oligonucleotide
tcacgaaagaaccctcaatcagagtgaaactgcg

SEQ ID NO: 195770 - DNA, 33 bp, Artificial Sequence
  Description of Artificial Sequence: Synthetic oligonucleotide
cacgaaagaaccctcaatcagagtgaaactgcg

SEQ ID NO: 195771 - DNA, 36 bp, Artificial Sequence
  Description of Artificial Sequence: Synthetic oligonucleotide
acgaaagaaccctcaatcagagtgaaactgcgatac

SEQ ID NO: 195772 - DNA, 34 bp, Artificial Sequence
  Description of Artificial Sequence: Synthetic oligonucleotide
acttgacttactctcctggtccaaggacacttac

SEQ ID NO: 195773 - DNA, 33 bp, Artificial Sequence
  Description of Artificial Sequence: Synthetic oligonucleotide
cttgacttactctcctggtccaaggacacttac

SEQ ID NO: 195774 - DNA, 34 bp, Artificial Sequence
  Description of Artificial Sequence: Synthetic oligonucleotide
ttgacttactctcctggtccaaggacacttacag

SEQ ID NO: 195775 - DNA, 33 bp, Artificial Sequence
  Description of Artificial Sequence: Synthetic oligonucleotide
tgacttactctcctggtccaaggacacttacag

SEQ ID NO: 195776 - DNA, 32 bp, Artificial Sequence
  Description of Artificial Sequence: Synthetic oligonucleotide
gacttactctcctggtccaaggacacttacag

SEQ ID NO: 195777 - DNA, 32 bp, Artificial Sequence
  Description of Artificial Sequence: Synthetic oligonucleotide
acttactctcctggtccaaggacacttacagc

SEQ ID NO: 195778 - DNA, 31 bp, Artificial Sequence
  Description of Artificial Sequence: Synthetic oligonucleotide
cttactctcctggtccaaggacacttacagc

SEQ ID NO: 195779 - DNA, 31 bp, Artificial Sequence
  Description of Artificial Sequence: Synthetic oligonucleotide
ttactctcctggtccaaggacacttacagcc

SEQ ID NO: 195780 - DNA, 30 bp, Artificial Sequence
  Description of Artificial Sequence: Synthetic oligonucleotide
tactctcctggtccaaggacacttacagcc

SEQ ID NO: 195781 - DNA, 29 bp, Artificial Sequence
  Description of Artificial Sequence: Synthetic oligonucleotide
actctcctggtccaaggacacttacagcc

SEQ ID NO: 195782 - DNA, 28 bp, Artificial Sequence
  Description of Artificial Sequence: Synthetic oligonucleotide
ctctcctggtccaaggacacttacagcc

SEQ ID NO: 195783 - DNA, 28 bp, Artificial Sequence
  Description of Artificial Sequence: Synthetic oligonucleotide
tctcctggtccaaggacacttacagccc

SEQ ID NO: 195784 - DNA, 27 bp, Artificial Sequence
  Description of Artificial Sequence: Synthetic oligonucleotide
ctcctggtccaaggacacttacagccc

SEQ ID NO: 195785 - DNA, 27 bp, Artificial Sequence
  Description of Artificial Sequence: Synthetic oligonucleotide
tcctggtccaaggacacttacagcccc

SEQ ID NO: 195786 - DNA, 26 bp, Artificial Sequence
  Description of Artificial Sequence: Synthetic oligonucleotide
cctggtccaaggacacttacagcccc

SEQ ID NO: 195787 - DNA, 27 bp, Artificial Sequence
  Description of Artificial Sequence: Synthetic oligonucleotide
ctggtccaaggacacttacagccccga

SEQ ID NO: 195788 - DNA, 27 bp, Artificial Sequence
  Description of Artificial Sequence: Synthetic oligonucleotide
tggtccaaggacacttacagccccgac

SEQ ID NO: 195789 - DNA, 26 bp, Artificial Sequence
  Description of Artificial Sequence: Synthetic oligonucleotide
ggtccaaggacacttacagccccgac

SEQ ID NO: 195790 - DNA, 27 bp, Artificial Sequence
  Description of Artificial Sequence: Synthetic oligonucleotide
gtccaaggacacttacagccccgacga

SEQ ID NO: 195791 - DNA, 28 bp, Artificial Sequence
  Description of Artificial Sequence: Synthetic oligonucleotide
tccaaggacacttacagccccgacgaac

SEQ ID NO: 195792 - DNA, 27 bp, Artificial Sequence
  Description of Artificial Sequence: Synthetic oligonucleotide
ccaaggacacttacagccccgacgaac

SEQ ID NO: 195793 - DNA, 31 bp, Artificial Sequence
  Description of Artificial Sequence: Synthetic oligonucleotide
caaggacacttacagccccgacgaacatttc

SEQ ID NO: 195794 - DNA, 32 bp, Artificial Sequence
  Description of Artificial Sequence: Synthetic oligonucleotide
aaggacacttacagccccgacgaacatttctg

SEQ ID NO: 195795 - DNA, 31 bp, Artificial Sequence
  Description of Artificial Sequence: Synthetic oligonucleotide
aggacacttacagccccgacgaacatttctg

SEQ ID NO: 195796 - DNA, 30 bp, Artificial Sequence
  Description of Artificial Sequence: Synthetic oligonucleotide
ggacacttacagccccgacgaacatttctg

SEQ ID NO: 195797 - DNA, 30 bp, Artificial Sequence
  Description of Artificial Sequence: Synthetic oligonucleotide
gacacttacagccccgacgaacatttctgg

SEQ ID NO: 195798 - DNA, 30 bp, Artificial Sequence
  Description of Artificial Sequence: Synthetic oligonucleotide
acacttacagccccgacgaacatttctggg

SEQ ID NO: 195799 - DNA, 29 bp, Artificial Sequence
  Description of Artificial Sequence: Synthetic oligonucleotide
cacttacagccccgacgaacatttctggg

SEQ ID NO: 195800 - DNA, 30 bp, Artificial Sequence
  Description of Artificial Sequence: Synthetic oligonucleotide
acttacagccccgacgaacatttctgggtg

SEQ ID NO: 195801 - DNA, 29 bp, Artificial Sequence
  Description of Artificial Sequence: Synthetic oligonucleotide
cttacagccccgacgaacatttctgggtg

SEQ ID NO: 195802 - DNA, 30 bp, Artificial Sequence
  Description of Artificial Sequence: Synthetic oligonucleotide
ttacagccccgacgaacatttctgggtgac

SEQ ID NO: 195803 - DNA, 38 bp, Artificial Sequence
  Description of Artificial Sequence: Synthetic oligonucleotide
agagtgaaactgcgatacaacccagctggtattttttg

SEQ ID NO: 195804 - DNA, 29 bp, Artificial Sequence
  Description of Artificial Sequence: Synthetic oligonucleotide
atggacaagttttggtggcacgcagcctg

SEQ ID NO: 195805 - DNA, 28 bp, Artificial Sequence
  Description of Artificial Sequence: Synthetic oligonucleotide
tggacaagttttggtggcacgcagcctg

SEQ ID NO: 195806 - DNA, 27 bp, Artificial Sequence
  Description of Artificial Sequence: Synthetic oligonucleotide
ggacaagttttggtggcacgcagcctg

SEQ ID NO: 195807 - DNA, 27 bp, Artificial Sequence
  Description of Artificial Sequence: Synthetic oligonucleotide
gacaagttttggtggcacgcagcctgg

SEQ ID NO: 195808 - DNA, 27 bp, Artificial Sequence
  Description of Artificial Sequence: Synthetic oligonucleotide
acaagttttggtggcacgcagcctggg

SEQ ID NO: 195809 - DNA, 26 bp, Artificial Sequence
  Description of Artificial Sequence: Synthetic oligonucleotide
caagttttggtggcacgcagcctggg

SEQ ID NO: 195810 - DNA, 27 bp, Artificial Sequence
  Description of Artificial Sequence: Synthetic oligonucleotide
aagttttggtggcacgcagcctgggga

SEQ ID NO: 195811 - DNA, 26 bp, Artificial Sequence
  Description of Artificial Sequence: Synthetic oligonucleotide
agttttggtggcacgcagcctgggga

SEQ ID NO: 195812 - DNA, 25 bp, Artificial Sequence
  Description of Artificial Sequence: Synthetic oligonucleotide
gttttggtggcacgcagcctgggga

SEQ ID NO: 195813 - DNA, 26 bp, Artificial Sequence
  Description of Artificial Sequence: Synthetic oligonucleotide
ttttggtggcacgcagcctggggact

SEQ ID NO: 195814 - DNA, 25 bp, Artificial Sequence
  Description of Artificial Sequence: Synthetic oligonucleotide
tttggtggcacgcagcctggggact

SEQ ID NO: 195815 - DNA, 24 bp, Artificial Sequence
  Description of Artificial Sequence: Synthetic oligonucleotide
ttggtggcacgcagcctggggact

SEQ ID NO: 195816 - DNA, 23 bp, Artificial Sequence
  Description of Artificial Sequence: Synthetic oligonucleotide
tggtggcacgcagcctggggact

SEQ ID NO: 195817 - DNA, 22 bp, Artificial Sequence
  Description of Artificial Sequence: Synthetic oligonucleotide
ggtggcacgcagcctggggact

SEQ ID NO: 195818 - DNA, 23 bp, Artificial Sequence
  Description of Artificial Sequence: Synthetic oligonucleotide
gtggcacgcagcctggggactct

SEQ ID NO: 195819 - DNA, 23 bp, Artificial Sequence
  Description of Artificial Sequence: Synthetic oligonucleotide
tggcacgcagcctggggactctg

SEQ ID NO: 195820 - DNA, 22 bp, Artificial Sequence
  Description of Artificial Sequence: Synthetic oligonucleotide
ggcacgcagcctggggactctg

SEQ ID NO: 195821 - DNA, 22 bp, Artificial Sequence
  Description of Artificial Sequence: Synthetic oligonucleotide
gcacgcagcctggggactctgc

SEQ ID NO: 195822 - DNA, 23 bp, Artificial Sequence
  Description of Artificial Sequence: Synthetic oligonucleotide
cacgcagcctggggactctgcct

SEQ ID NO: 195823 - DNA, 23 bp, Artificial Sequence
  Description of Artificial Sequence: Synthetic oligonucleotide
acgcagcctggggactctgcctc

SEQ ID NO: 195824 - DNA, 22 bp, Artificial Sequence
  Description of Artificial Sequence: Synthetic oligonucleotide
cgcagcctggggactctgcctc

SEQ ID NO: 195825 - DNA, 23 bp, Artificial Sequence
  Description of Artificial Sequence: Synthetic oligonucleotide
gcagcctggggactctgcctcgt

SEQ ID NO: 195826 - DNA, 23 bp, Artificial Sequence
  Description of Artificial Sequence: Synthetic oligonucleotide
cagcctggggactctgcctcgtg

SEQ ID NO: 195827 - DNA, 23 bp, Artificial Sequence
  Description of Artificial Sequence: Synthetic oligonucleotide
agcctggggactctgcctcgtgc

SEQ ID NO: 195828 - DNA, 22 bp, Artificial Sequence
  Description of Artificial Sequence: Synthetic oligonucleotide
gcctggggactctgcctcgtgc

SEQ ID NO: 195829 - DNA, 22 bp, Artificial Sequence
  Description of Artificial Sequence: Synthetic oligonucleotide
cctggggactctgcctcgtgcc

SEQ ID NO: 195830 - DNA, 22 bp, Artificial Sequence
  Description of Artificial Sequence: Synthetic oligonucleotide
ctggggactctgcctcgtgccg

SEQ ID NO: 195831 - DNA, 23 bp, Artificial Sequence
  Description of Artificial Sequence: Synthetic oligonucleotide
tggggactctgcctcgtgccgct

SEQ ID NO: 195832 - DNA, 22 bp, Artificial Sequence
  Description of Artificial Sequence: Synthetic oligonucleotide
ggggactctgcctcgtgccgct

SEQ ID NO: 195833 - DNA, 23 bp, Artificial Sequence
  Description of Artificial Sequence: Synthetic oligonucleotide
gggactctgcctcgtgccgctga

SEQ ID NO: 195834 - DNA, 23 bp, Artificial Sequence
  Description of Artificial Sequence: Synthetic oligonucleotide
ggactctgcctcgtgccgctgag

SEQ ID NO: 195835 - DNA, 23 bp, Artificial Sequence
  Description of Artificial Sequence: Synthetic oligonucleotide
gactctgcctcgtgccgctgagc

SEQ ID NO: 195836 - DNA, 24 bp, Artificial Sequence
  Description of Artificial Sequence: Synthetic oligonucleotide
actctgcctcgtgccgctgagcct

SEQ ID NO: 195837 - DNA, 23 bp, Artificial Sequence
  Description of Artificial Sequence: Synthetic oligonucleotide
ctctgcctcgtgccgctgagcct

SEQ ID NO: 195838 - DNA, 23 bp, Artificial Sequence
  Description of Artificial Sequence: Synthetic oligonucleotide
tctgcctcgtgccgctgagcctg

SEQ ID NO: 195839 - DNA, 22 bp, Artificial Sequence
  Description of Artificial Sequence: Synthetic oligonucleotide
ctgcctcgtgccgctgagcctg

SEQ ID NO: 195840 - DNA, 22 bp, Artificial Sequence
  Description of Artificial Sequence: Synthetic oligonucleotide
tgcctcgtgccgctgagcctgg

SEQ ID NO: 195841 - DNA, 21 bp, Artificial Sequence
  Description of Artificial Sequence: Synthetic oligonucleotide
gcctcgtgccgctgagcctgg

SEQ ID NO: 195842 - DNA, 21 bp, Artificial Sequence
  Description of Artificial Sequence: Synthetic oligonucleotide
cctcgtgccgctgagcctggc

SEQ ID NO: 195843 - DNA, 21 bp, Artificial Sequence
  Description of Artificial Sequence: Synthetic oligonucleotide
ctcgtgccgctgagcctggcg

SEQ ID NO: 195844 - DNA, 22 bp, Artificial Sequence
  Description of Artificial Sequence: Synthetic oligonucleotide
tcgtgccgctgagcctggcgca

SEQ ID NO: 195845 - DNA, 21 bp, Artificial Sequence
  Description of Artificial Sequence: Synthetic oligonucleotide
cgtgccgctgagcctggcgca

SEQ ID NO: 195846 - DNA, 23 bp, Artificial Sequence
  Description of Artificial Sequence: Synthetic oligonucleotide
gtgccgctgagcctggcgcagat

SEQ ID NO: 195847 - DNA, 23 bp, Artificial Sequence
  Description of Artificial Sequence: Synthetic oligonucleotide
tgccgctgagcctggcgcagatc

SEQ ID NO: 195848 - DNA, 22 bp, Artificial Sequence
  Description of Artificial Sequence: Synthetic oligonucleotide
gccgctgagcctggcgcagatc

SEQ ID NO: 195849 - DNA, 26 bp, Artificial Sequence
  Description of Artificial Sequence: Synthetic oligonucleotide
ccgctgagcctggcgcagatcgattt

SEQ ID NO: 195850 - DNA, 27 bp, Artificial Sequence
  Description of Artificial Sequence: Synthetic oligonucleotide
cgctgagcctggcgcagatcgatttga

SEQ ID NO: 195851 - DNA, 33 bp, Artificial Sequence
  Description of Artificial Sequence: Synthetic oligonucleotide
gctgagcctggcgcagatcgatttgaatataac

SEQ ID NO: 195852 - DNA, 33 bp, Artificial Sequence
  Description of Artificial Sequence: Synthetic oligonucleotide
ctgagcctggcgcagatcgatttgaatataacc

SEQ ID NO: 195853 - DNA, 34 bp, Artificial Sequence
  Description of Artificial Sequence: Synthetic oligonucleotide
tgagcctggcgcagatcgatttgaatataacctg

SEQ ID NO: 195854 - DNA, 33 bp, Artificial Sequence
  Description of Artificial Sequence: Synthetic oligonucleotide
gagcctggcgcagatcgatttgaatataacctg

SEQ ID NO: 195855 - DNA, 33 bp, Artificial Sequence
  Description of Artificial Sequence: Synthetic oligonucleotide
agcctggcgcagatcgatttgaatataacctgc

SEQ ID NO: 195856 - DNA, 32 bp, Artificial Sequence
  Description of Artificial Sequence: Synthetic oligonucleotide
gcctggcgcagatcgatttgaatataacctgc

SEQ ID NO: 195857 - DNA, 32 bp, Artificial Sequence
  Description of Artificial Sequence: Synthetic oligonucleotide
cctggcgcagatcgatttgaatataacctgcc

SEQ ID NO: 195858 - DNA, 32 bp, Artificial Sequence
  Description of Artificial Sequence: Synthetic oligonucleotide
ctggcgcagatcgatttgaatataacctgccg

SEQ ID NO: 195859 - DNA, 32 bp, Artificial Sequence
  Description of Artificial Sequence: Synthetic oligonucleotide
tggcgcagatcgatttgaatataacctgccgc

SEQ ID NO: 195860 - DNA, 31 bp, Artificial Sequence
  Description of Artificial Sequence: Synthetic oligonucleotide
ggcgcagatcgatttgaatataacctgccgc

SEQ ID NO: 195861 - DNA, 34 bp, Artificial Sequence
  Description of Artificial Sequence: Synthetic oligonucleotide
gcgcagatcgatttgaatataacctgccgctttg

SEQ ID NO: 195862 - DNA, 34 bp, Artificial Sequence
  Description of Artificial Sequence: Synthetic oligonucleotide
cgcagatcgatttgaatataacctgccgctttgc

SEQ ID NO: 195863 - DNA, 35 bp, Artificial Sequence
  Description of Artificial Sequence: Synthetic oligonucleotide
gcagatcgatttgaatataacctgccgctttgcag

SEQ ID NO: 195864 - DNA, 35 bp, Artificial Sequence
  Description of Artificial Sequence: Synthetic oligonucleotide
cagatcgatttgaatataacctgccgctttgcagg

SEQ ID NO: 195865 - DNA, 36 bp, Artificial Sequence
  Description of Artificial Sequence: Synthetic oligonucleotide
agatcgatttgaatataacctgccgctttgcaggtg

SEQ ID NO: 195866 - DNA, 35 bp, Artificial Sequence
  Description of Artificial Sequence: Synthetic oligonucleotide
gatcgatttgaatataacctgccgctttgcaggtg

SEQ ID NO: 195867 - DNA, 39 bp, Artificial Sequence
  Description of Artificial Sequence: Synthetic oligonucleotide
atcgatttgaatataacctgccgctttgcaggtgtattc

SEQ ID NO: 195868 - DNA, 38 bp, Artificial Sequence
  Description of Artificial Sequence: Synthetic oligonucleotide
tcgatttgaatataacctgccgctttgcaggtgtattc

SEQ ID NO: 195869 - DNA, 37 bp, Artificial Sequence
  Description of Artificial Sequence: Synthetic oligonucleotide
cgatttgaatataacctgccgctttgcaggtgtattc

SEQ ID NO: 195870 - DNA, 37 bp, Artificial Sequence
  Description of Artificial Sequence: Synthetic oligonucleotide
gatttgaatataacctgccgctttgcaggtgtattcc

SEQ ID NO: 195871 - DNA, 38 bp, Artificial Sequence
  Description of Artificial Sequence: Synthetic oligonucleotide
atttgaatataacctgccgctttgcaggtgtattccac

SEQ ID NO: 195872 - DNA, 37 bp, Artificial Sequence
  Description of Artificial Sequence: Synthetic oligonucleotide
tttgaatataacctgccgctttgcaggtgtattccac

SEQ ID NO: 195873 - DNA, 36 bp, Artificial Sequence
  Description of Artificial Sequence: Synthetic oligonucleotide
ttgaatataacctgccgctttgcaggtgtattccac

SEQ ID NO: 195874 - DNA, 35 bp, Artificial Sequence
  Description of Artificial Sequence: Synthetic oligonucleotide
tgaatataacctgccgctttgcaggtgtattccac

SEQ ID NO: 195875 - DNA, 34 bp, Artificial Sequence
  Description of Artificial Sequence: Synthetic oligonucleotide
gaatataacctgccgctttgcaggtgtattccac

SEQ ID NO: 195876 - DNA, 34 bp, Artificial Sequence
  Description of Artificial Sequence: Synthetic oligonucleotide
aatataacctgccgctttgcaggtgtattccacg

SEQ ID NO: 195877 - DNA, 33 bp, Artificial Sequence
  Description of Artificial Sequence: Synthetic oligonucleotide
atataacctgccgctttgcaggtgtattccacg

SEQ ID NO: 195878 - DNA, 32 bp, Artificial Sequence
  Description of Artificial Sequence: Synthetic oligonucleotide
tataacctgccgctttgcaggtgtattccacg

SEQ ID NO: 195879 - DNA, 31 bp, Artificial Sequence
  Description of Artificial Sequence: Synthetic oligonucleotide
ataacctgccgctttgcaggtgtattccacg

SEQ ID NO: 195880 - DNA, 30 bp, Artificial Sequence
  Description of Artificial Sequence: Synthetic oligonucleotide
taacctgccgctttgcaggtgtattccacg

SEQ ID NO: 195881 - DNA, 29 bp, Artificial Sequence
  Description of Artificial Sequence: Synthetic oligonucleotide
aacctgccgctttgcaggtgtattccacg

SEQ ID NO: 195882 - DNA, 28 bp, Artificial Sequence
  Description of Artificial Sequence: Synthetic oligonucleotide
acctgccgctttgcaggtgtattccacg

SEQ ID NO: 195883 - DNA, 27 bp, Artificial Sequence
  Description of Artificial Sequence: Synthetic oligonucleotide
cctgccgctttgcaggtgtattccacg

SEQ ID NO: 195884 - DNA, 28 bp, Artificial Sequence
  Description of Artificial Sequence: Synthetic oligonucleotide
ctgccgctttgcaggtgtattccacgtg

SEQ ID NO: 195885 - DNA, 28 bp, Artificial Sequence
  Description of Artificial Sequence: Synthetic oligonucleotide
tgccgctttgcaggtgtattccacgtgg

SEQ ID NO: 195886 - DNA, 27 bp, Artificial Sequence
  Description of Artificial Sequence: Synthetic oligonucleotide
gccgctttgcaggtgtattccacgtgg

SEQ ID NO: 195887 - DNA, 28 bp, Artificial Sequence
  Description of Artificial Sequence: Synthetic oligonucleotide
ccgctttgcaggtgtattccacgtggag

SEQ ID NO: 195888 - DNA, 34 bp, Artificial Sequence
  Description of Artificial Sequence: Synthetic oligonucleotide
cgctttgcaggtgtattccacgtggagaaaaatg

SEQ ID NO: 195889 - DNA, 34 bp, Artificial Sequence
  Description of Artificial Sequence: Synthetic oligonucleotide
gctttgcaggtgtattccacgtggagaaaaatgg

SEQ ID NO: 195890 - DNA, 35 bp, Artificial Sequence
  Description of Artificial Sequence: Synthetic oligonucleotide
ctttgcaggtgtattccacgtggagaaaaatggtc

SEQ ID NO: 195891 - DNA, 35 bp, Artificial Sequence
  Description of Artificial Sequence: Synthetic oligonucleotide
tttgcaggtgtattccacgtggagaaaaatggtcg

SEQ ID NO: 195892 - DNA, 34 bp, Artificial Sequence
  Description of Artificial Sequence: Synthetic oligonucleotide
ttgcaggtgtattccacgtggagaaaaatggtcg

SEQ ID NO: 195893 - DNA, 33 bp, Artificial Sequence
  Description of Artificial Sequence: Synthetic oligonucleotide
tgcaggtgtattccacgtggagaaaaatggtcg

SEQ ID NO: 195894 - DNA, 32 bp, Artificial Sequence
  Description of Artificial Sequence: Synthetic oligonucleotide
gcaggtgtattccacgtggagaaaaatggtcg

SEQ ID NO: 195895 - DNA, 32 bp, Artificial Sequence
  Description of Artificial Sequence: Synthetic oligonucleotide
caggtgtattccacgtggagaaaaatggtcgc

SEQ ID NO: 195896 - DNA, 34 bp, Artificial Sequence
  Description of Artificial Sequence: Synthetic oligonucleotide
aggtgtattccacgtggagaaaaatggtcgctac

SEQ ID NO: 195897 - DNA, 33 bp, Artificial Sequence
  Description of Artificial Sequence: Synthetic oligonucleotide
ggtgtattccacgtggagaaaaatggtcgctac

SEQ ID NO: 195898 - DNA, 34 bp, Artificial Sequence
  Description of Artificial Sequence: Synthetic oligonucleotide
gtgtattccacgtggagaaaaatggtcgctacag

SEQ ID NO: 195899 - DNA, 34 bp, Artificial Sequence
  Description of Artificial Sequence: Synthetic oligonucleotide
tgtattccacgtggagaaaaatggtcgctacagc

SEQ ID NO: 195900 - DNA, 33 bp, Artificial Sequence
  Description of Artificial Sequence: Synthetic oligonucleotide
gtattccacgtggagaaaaatggtcgctacagc

SEQ ID NO: 195901 - DNA, 35 bp, Artificial Sequence
  Description of Artificial Sequence: Synthetic oligonucleotide
tattccacgtggagaaaaatggtcgctacagcatc

SEQ ID NO: 195902 - DNA, 34 bp, Artificial Sequence
  Description of Artificial Sequence: Synthetic oligonucleotide
attccacgtggagaaaaatggtcgctacagcatc

SEQ ID NO: 195903 - DNA, 33 bp, Artificial Sequence
  Description of Artificial Sequence: Synthetic oligonucleotide
ttccacgtggagaaaaatggtcgctacagcatc

SEQ ID NO: 195904 - DNA, 32 bp, Artificial Sequence
  Description of Artificial Sequence: Synthetic oligonucleotide
tccacgtggagaaaaatggtcgctacagcatc

SEQ ID NO: 195905 - DNA, 31 bp, Artificial Sequence
  Description of Artificial Sequence: Synthetic oligonucleotide
ccacgtggagaaaaatggtcgctacagcatc

SEQ ID NO: 195906 - DNA, 32 bp, Artificial Sequence
  Description of Artificial Sequence: Synthetic oligonucleotide
cacgtggagaaaaatggtcgctacagcatctc

SEQ ID NO: 195907 - DNA, 33 bp, Artificial Sequence
  Description of Artificial Sequence: Synthetic oligonucleotide
acgtggagaaaaatggtcgctacagcatctctc

SEQ ID NO: 195908 - DNA, 32 bp, Artificial Sequence
  Description of Artificial Sequence: Synthetic oligonucleotide
cgtggagaaaaatggtcgctacagcatctctc

SEQ ID NO: 195909 - DNA, 32 bp, Artificial Sequence
  Description of Artificial Sequence: Synthetic oligonucleotide
gtggagaaaaatggtcgctacagcatctctcg

SEQ ID NO: 195910 - DNA, 32 bp, Artificial Sequence
  Description of Artificial Sequence: Synthetic oligonucleotide
tggagaaaaatggtcgctacagcatctctcgg

SEQ ID NO: 195911 - DNA, 31 bp, Artificial Sequence
  Description of Artificial Sequence: Synthetic oligonucleotide
ggagaaaaatggtcgctacagcatctctcgg

SEQ ID NO: 195912 - DNA, 32 bp, Artificial Sequence
  Description of Artificial Sequence: Synthetic oligonucleotide
gagaaaaatggtcgctacagcatctctcggac

SEQ ID NO: 195913 - DNA, 32 bp, Artificial Sequence
  Description of Artificial Sequence: Synthetic oligonucleotide
agaaaaatggtcgctacagcatctctcggacg

SEQ ID NO: 195914 - DNA, 31 bp, Artificial Sequence
  Description of Artificial Sequence: Synthetic oligonucleotide
gaaaaatggtcgctacagcatctctcggacg

SEQ ID NO: 195915 - DNA, 31 bp, Artificial Sequence
  Description of Artificial Sequence: Synthetic oligonucleotide
aaaaatggtcgctacagcatctctcggacgg

SEQ ID NO: 195916 - DNA, 30 bp, Artificial Sequence
  Description of Artificial Sequence: Synthetic oligonucleotide
aaaatggtcgctacagcatctctcggacgg

SEQ ID NO: 195917 - DNA, 29 bp, Artificial Sequence
  Description of Artificial Sequence: Synthetic oligonucleotide
aaatggtcgctacagcatctctcggacgg

SEQ ID NO: 195918 - DNA, 28 bp, Artificial Sequence
  Description of Artificial Sequence: Synthetic oligonucleotide
aatggtcgctacagcatctctcggacgg

SEQ ID NO: 195919 - DNA, 27 bp, Artificial Sequence
  Description of Artificial Sequence: Synthetic oligonucleotide
atggtcgctacagcatctctcggacgg

SEQ ID NO: 195920 - DNA, 27 bp, Artificial Sequence
  Description of Artificial Sequence: Synthetic oligonucleotide
tggtcgctacagcatctctcggacgga

SEQ ID NO: 195921 - DNA, 26 bp, Artificial Sequence
  Description of Artificial Sequence: Synthetic oligonucleotide
ggtcgctacagcatctctcggacgga

SEQ ID NO: 195922 - DNA, 26 bp, Artificial Sequence
  Description of Artificial Sequence: Synthetic oligonucleotide
gtcgctacagcatctctcggacggag

SEQ ID NO: 195923 - DNA, 26 bp, Artificial Sequence
  Description of Artificial Sequence: Synthetic oligonucleotide
tcgctacagcatctctcggacggagg

SEQ ID NO: 195924 - DNA, 25 bp, Artificial Sequence
  Description of Artificial Sequence: Synthetic oligonucleotide
cgctacagcatctctcggacggagg

SEQ ID NO: 195925 - DNA, 25 bp, Artificial Sequence
  Description of Artificial Sequence: Synthetic oligonucleotide
gctacagcatctctcggacggaggc

SEQ ID NO: 195926 - DNA, 25 bp, Artificial Sequence
  Description of Artificial Sequence: Synthetic oligonucleotide
ctacagcatctctcggacggaggcc

SEQ ID NO: 195927 - DNA, 25 bp, Artificial Sequence
  Description of Artificial Sequence: Synthetic oligonucleotide
tacagcatctctcggacggaggccg

SEQ ID NO: 195928 - DNA, 24 bp, Artificial Sequence
  Description of Artificial Sequence: Synthetic oligonucleotide
acagcatctctcggacggaggccg

SEQ ID NO: 195929 - DNA, 23 bp, Artificial Sequence
  Description of Artificial Sequence: Synthetic oligonucleotide
cagcatctctcggacggaggccg

SEQ ID NO: 195930 - DNA, 24 bp, Artificial Sequence
  Description of Artificial Sequence: Synthetic oligonucleotide
agcatctctcggacggaggccgct

SEQ ID NO: 195931 - DNA, 23 bp, Artificial Sequence
  Description of Artificial Sequence: Synthetic oligonucleotide
gcatctctcggacggaggccgct

SEQ ID NO: 195932 - DNA, 24 bp, Artificial Sequence
  Description of Artificial Sequence: Synthetic oligonucleotide
catctctcggacggaggccgctga

SEQ ID NO: 195933 - DNA, 24 bp, Artificial Sequence
  Description of Artificial Sequence: Synthetic oligonucleotide
atctctcggacggaggccgctgac

SEQ ID NO: 195934 - DNA, 23 bp, Artificial Sequence
  Description of Artificial Sequence: Synthetic oligonucleotide
tctctcggacggaggccgctgac

SEQ ID NO: 195935 - DNA, 22 bp, Artificial Sequence
  Description of Artificial Sequence: Synthetic oligonucleotide
ctctcggacggaggccgctgac

SEQ ID NO: 195936 - DNA, 23 bp, Artificial Sequence
  Description of Artificial Sequence: Synthetic oligonucleotide
tctcggacggaggccgctgacct

SEQ ID NO: 195937 - DNA, 22 bp, Artificial Sequence
  Description of Artificial Sequence: Synthetic oligonucleotide
ctcggacggaggccgctgacct

SEQ ID NO: 195938 - DNA, 23 bp, Artificial Sequence
  Description of Artificial Sequence: Synthetic oligonucleotide
tcggacggaggccgctgacctct

SEQ ID NO: 195939 - DNA, 22 bp, Artificial Sequence
  Description of Artificial Sequence: Synthetic oligonucleotide
cggacggaggccgctgacctct

SEQ ID NO: 195940 - DNA, 22 bp, Artificial Sequence
  Description of Artificial Sequence: Synthetic oligonucleotide
ggacggaggccgctgacctctg

SEQ ID NO: 195941 - DNA, 24 bp, Artificial Sequence
  Description of Artificial Sequence: Synthetic oligonucleotide
gacggaggccgctgacctctgcaa

SEQ ID NO: 195942 - DNA, 24 bp, Artificial Sequence
  Description of Artificial Sequence: Synthetic oligonucleotide
acggaggccgctgacctctgcaag

SEQ ID NO: 195943 - DNA, 23 bp, Artificial Sequence
  Description of Artificial Sequence: Synthetic oligonucleotide
cggaggccgctgacctctgcaag

SEQ ID NO: 195944 - DNA, 23 bp, Artificial Sequence
  Description of Artificial Sequence: Synthetic oligonucleotide
ggaggccgctgacctctgcaagg

SEQ ID NO: 195945 - DNA, 26 bp, Artificial Sequence
  Description of Artificial Sequence: Synthetic oligonucleotide
gaggccgctgacctctgcaaggcttt

SEQ ID NO: 195946 - DNA, 27 bp, Artificial Sequence
  Description of Artificial Sequence: Synthetic oligonucleotide
aggccgctgacctctgcaaggctttca

SEQ ID NO: 195947 - DNA, 27 bp, Artificial Sequence
  Description of Artificial Sequence: Synthetic oligonucleotide
ggccgctgacctctgcaaggctttcaa

SEQ ID NO: 195948 - DNA, 29 bp, Artificial Sequence
  Description of Artificial Sequence: Synthetic oligonucleotide
gccgctgacctctgcaaggctttcaatag

SEQ ID NO: 195949 - DNA, 29 bp, Artificial Sequence
  Description of Artificial Sequence: Synthetic oligonucleotide
ccgctgacctctgcaaggctttcaatagc

SEQ ID NO: 195950 - DNA, 30 bp, Artificial Sequence
  Description of Artificial Sequence: Synthetic oligonucleotide
cgctgacctctgcaaggctttcaatagcac

SEQ ID NO: 195951 - DNA, 30 bp, Artificial Sequence
  Description of Artificial Sequence: Synthetic oligonucleotide
gctgacctctgcaaggctttcaatagcacc

SEQ ID NO: 195952 - DNA, 32 bp, Artificial Sequence
  Description of Artificial Sequence: Synthetic oligonucleotide
ctgacctctgcaaggctttcaatagcaccttg

SEQ ID NO: 195953 - DNA, 32 bp, Artificial Sequence
  Description of Artificial Sequence: Synthetic oligonucleotide
tgacctctgcaaggctttcaatagcaccttgc

SEQ ID NO: 195954 - DNA, 31 bp, Artificial Sequence
  Description of Artificial Sequence: Synthetic oligonucleotide
gacctctgcaaggctttcaatagcaccttgc

SEQ ID NO: 195955 - DNA, 31 bp, Artificial Sequence
  Description of Artificial Sequence: Synthetic oligonucleotide
acctctgcaaggctttcaatagcaccttgcc

SEQ ID NO: 195956 - DNA, 30 bp, Artificial Sequence
  Description of Artificial Sequence: Synthetic oligonucleotide
cctctgcaaggctttcaatagcaccttgcc

SEQ ID NO: 195957 - DNA, 30 bp, Artificial Sequence
  Description of Artificial Sequence: Synthetic oligonucleotide
ctctgcaaggctttcaatagcaccttgccc

SEQ ID NO: 195958 - DNA, 31 bp, Artificial Sequence
  Description of Artificial Sequence: Synthetic oligonucleotide
tctgcaaggctttcaatagcaccttgcccac

SEQ ID NO: 195959 - DNA, 30 bp, Artificial Sequence
  Description of Artificial Sequence: Synthetic oligonucleotide
ctgcaaggctttcaatagcaccttgcccac

SEQ ID NO: 195960 - DNA, 33 bp, Artificial Sequence
  Description of Artificial Sequence: Synthetic oligonucleotide
tgcaaggctttcaatagcaccttgcccacaatg

SEQ ID NO: 195961 - DNA, 32 bp, Artificial Sequence
  Description of Artificial Sequence: Synthetic oligonucleotide
gcaaggctttcaatagcaccttgcccacaatg

SEQ ID NO: 195962 - DNA, 32 bp, Artificial Sequence
  Description of Artificial Sequence: Synthetic oligonucleotide
caaggctttcaatagcaccttgcccacaatgg

SEQ ID NO: 195963 - DNA, 32 bp, Artificial Sequence
  Description of Artificial Sequence: Synthetic oligonucleotide
aaggctttcaatagcaccttgcccacaatggc

SEQ ID NO: 195964 - DNA, 31 bp, Artificial Sequence
  Description of Artificial Sequence: Synthetic oligonucleotide
aggctttcaatagcaccttgcccacaatggc

SEQ ID NO: 195965 - DNA, 30 bp, Artificial Sequence
  Description of Artificial Sequence: Synthetic oligonucleotide
ggctttcaatagcaccttgcccacaatggc

SEQ ID NO: 195966 - DNA, 30 bp, Artificial Sequence
  Description of Artificial Sequence: Synthetic oligonucleotide
gctttcaatagcaccttgcccacaatggcc

SEQ ID NO: 195967 - DNA, 30 bp, Artificial Sequence
  Description of Artificial Sequence: Synthetic oligonucleotide
ctttcaatagcaccttgcccacaatggccc

SEQ ID NO: 195968 - DNA, 31 bp, Artificial Sequence
  Description of Artificial Sequence: Synthetic oligonucleotide
tttcaatagcaccttgcccacaatggcccag

SEQ ID NO: 195969 - DNA, 30 bp, Artificial Sequence
  Description of Artificial Sequence: Synthetic oligonucleotide
ttcaatagcaccttgcccacaatggcccag

SEQ ID NO: 195970 - DNA, 29 bp, Artificial Sequence
  Description of Artificial Sequence: Synthetic oligonucleotide
tcaatagcaccttgcccacaatggcccag

SEQ ID NO: 195971 - DNA, 28 bp, Artificial Sequence
  Description of Artificial Sequence: Synthetic oligonucleotide
caatagcaccttgcccacaatggcccag

SEQ ID NO: 195972 - DNA, 30 bp, Artificial Sequence
  Description of Artificial Sequence: Synthetic oligonucleotide
aatagcaccttgcccacaatggcccagatg

SEQ ID NO: 195973 - DNA, 29 bp, Artificial Sequence
  Description of Artificial Sequence: Synthetic oligonucleotide
atagcaccttgcccacaatggcccagatg

SEQ ID NO: 195974 - DNA, 28 bp, Artificial Sequence
  Description of Artificial Sequence: Synthetic oligonucleotide
tagcaccttgcccacaatggcccagatg

SEQ ID NO: 195975 - DNA, 27 bp, Artificial Sequence
  Description of Artificial Sequence: Synthetic oligonucleotide
agcaccttgcccacaatggcccagatg

SEQ ID NO: 195976 - DNA, 26 bp, Artificial Sequence
  Description of Artificial Sequence: Synthetic oligonucleotide
gcaccttgcccacaatggcccagatg

SEQ ID NO: 195977 - DNA, 27 bp, Artificial Sequence
  Description of Artificial Sequence: Synthetic oligonucleotide
caccttgcccacaatggcccagatgga

SEQ ID NO: 195978 - DNA, 27 bp, Artificial Sequence
  Description of Artificial Sequence: Synthetic oligonucleotide
accttgcccacaatggcccagatggag

SEQ ID NO: 195979 - DNA, 27 bp, Artificial Sequence
  Description of Artificial Sequence: Synthetic oligonucleotide
ccttgcccacaatggcccagatggaga

SEQ ID NO: 195980 - DNA, 29 bp, Artificial Sequence
  Description of Artificial Sequence: Synthetic oligonucleotide
cttgcccacaatggcccagatggagaaag

SEQ ID NO: 195981 - DNA, 29 bp, Artificial Sequence
  Description of Artificial Sequence: Synthetic oligonucleotide
ttgcccacaatggcccagatggagaaagc

SEQ ID NO: 195982 - DNA, 28 bp, Artificial Sequence
  Description of Artificial Sequence: Synthetic oligonucleotide
tgcccacaatggcccagatggagaaagc

SEQ ID NO: 195983 - DNA, 27 bp, Artificial Sequence
  Description of Artificial Sequence: Synthetic oligonucleotide
gcccacaatggcccagatggagaaagc

SEQ ID NO: 195984 - DNA, 28 bp, Artificial Sequence
  Description of Artificial Sequence: Synthetic oligonucleotide
cccacaatggcccagatggagaaagctc

SEQ ID NO: 195985 - DNA, 29 bp, Artificial Sequence
  Description of Artificial Sequence: Synthetic oligonucleotide
ccacaatggcccagatggagaaagctctg

SEQ ID NO: 195986 - DNA, 30 bp, Artificial Sequence
  Description of Artificial Sequence: Synthetic oligonucleotide
cacaatggcccagatggagaaagctctgag

SEQ ID NO: 195987 - DNA, 30 bp, Artificial Sequence
  Description of Artificial Sequence: Synthetic oligonucleotide
acaatggcccagatggagaaagctctgagc

SEQ ID NO: 195988 - DNA, 29 bp, Artificial Sequence
  Description of Artificial Sequence: Synthetic oligonucleotide
caatggcccagatggagaaagctctgagc

SEQ ID NO: 195989 - DNA, 31 bp, Artificial Sequence
  Description of Artificial Sequence: Synthetic oligonucleotide
aatggcccagatggagaaagctctgagcatc

SEQ ID NO: 195990 - DNA, 30 bp, Artificial Sequence
  Description of Artificial Sequence: Synthetic oligonucleotide
atggcccagatggagaaagctctgagcatc

SEQ ID NO: 195991 - DNA, 29 bp, Artificial Sequence
  Description of Artificial Sequence: Synthetic oligonucleotide
tggcccagatggagaaagctctgagcatc

SEQ ID NO: 195992 - DNA, 28 bp, Artificial Sequence
  Description of Artificial Sequence: Synthetic oligonucleotide
ggcccagatggagaaagctctgagcatc

SEQ ID NO: 195993 - DNA, 28 bp, Artificial Sequence
  Description of Artificial Sequence: Synthetic oligonucleotide
gcccagatggagaaagctctgagcatcg

SEQ ID NO: 195994 - DNA, 28 bp, Artificial Sequence
  Description of Artificial Sequence: Synthetic oligonucleotide
cccagatggagaaagctctgagcatcgg

SEQ ID NO: 195995 - DNA, 32 bp, Artificial Sequence
  Description of Artificial Sequence: Synthetic oligonucleotide
ccagatggagaaagctctgagcatcggatttg

SEQ ID NO: 195996 - DNA, 33 bp, Artificial Sequence
  Description of Artificial Sequence: Synthetic oligonucleotide
cagatggagaaagctctgagcatcggatttgag

SEQ ID NO: 195997 - DNA, 34 bp, Artificial Sequence
  Description of Artificial Sequence: Synthetic oligonucleotide
agatggagaaagctctgagcatcggatttgagac

SEQ ID NO: 195998 - DNA, 33 bp, Artificial Sequence
  Description of Artificial Sequence: Synthetic oligonucleotide
gatggagaaagctctgagcatcggatttgagac

SEQ ID NO: 195999 - DNA, 33 bp, Artificial Sequence
  Description of Artificial Sequence: Synthetic oligonucleotide
atggagaaagctctgagcatcggatttgagacc

SEQ ID NO: 196000 - DNA, 32 bp, Artificial Sequence
  Description of Artificial Sequence: Synthetic oligonucleotide
tggagaaagctctgagcatcggatttgagacc

SEQ ID NO: 196001 - DNA, 31 bp, Artificial Sequence
  Description of Artificial Sequence: Synthetic oligonucleotide
ggagaaagctctgagcatcggatttgagacc

SEQ ID NO: 196002 - DNA, 32 bp, Artificial Sequence
  Description of Artificial Sequence: Synthetic oligonucleotide
gagaaagctctgagcatcggatttgagacctg

SEQ ID NO: 196003 - DNA, 32 bp, Artificial Sequence
  Description of Artificial Sequence: Synthetic oligonucleotide
agaaagctctgagcatcggatttgagacctgc

SEQ ID NO: 196004 - DNA, 31 bp, Artificial Sequence
  Description of Artificial Sequence: Synthetic oligonucleotide
gaaagctctgagcatcggatttgagacctgc

SEQ ID NO: 196005 - DNA, 32 bp, Artificial Sequence
  Description of Artificial Sequence: Synthetic oligonucleotide
aaagctctgagcatcggatttgagacctgcag

SEQ ID NO: 196006 - DNA, 31 bp, Artificial Sequence
  Description of Artificial Sequence: Synthetic oligonucleotide
aagctctgagcatcggatttgagacctgcag

SEQ ID NO: 196007 - DNA, 30 bp, Artificial Sequence
  Description of Artificial Sequence: Synthetic oligonucleotide
agctctgagcatcggatttgagacctgcag

SEQ ID NO: 196008 - DNA, 29 bp, Artificial Sequence
  Description of Artificial Sequence: Synthetic oligonucleotide
gctctgagcatcggatttgagacctgcag

SEQ ID NO: 196009 - DNA, 29 bp, Artificial Sequence
  Description of Artificial Sequence: Synthetic oligonucleotide
ctctgagcatcggatttgagacctgcagg

SEQ ID NO: 196010 - DNA, 32 bp, Artificial Sequence
  Description of Artificial Sequence: Synthetic oligonucleotide
tctgagcatcggatttgagacctgcaggtatg

SEQ ID NO: 196011 - DNA, 31 bp, Artificial Sequence
  Description of Artificial Sequence: Synthetic oligonucleotide
ctgagcatcggatttgagacctgcaggtatg

SEQ ID NO: 196012 - DNA, 31 bp, Artificial Sequence
  Description of Artificial Sequence: Synthetic oligonucleotide
tgagcatcggatttgagacctgcaggtatgg

SEQ ID NO: 196013 - DNA, 30 bp, Artificial Sequence
  Description of Artificial Sequence: Synthetic oligonucleotide
gagcatcggatttgagacctgcaggtatgg

SEQ ID NO: 196014 - DNA, 30 bp, Artificial Sequence
  Description of Artificial Sequence: Synthetic oligonucleotide
agcatcggatttgagacctgcaggtatggg

SEQ ID NO: 196015 - DNA, 29 bp, Artificial Sequence
  Description of Artificial Sequence: Synthetic oligonucleotide
gcatcggatttgagacctgcaggtatggg

SEQ ID NO: 196016 - DNA, 31 bp, Artificial Sequence
  Description of Artificial Sequence: Synthetic oligonucleotide
catcggatttgagacctgcaggtatgggttc

SEQ ID NO: 196017 - DNA, 34 bp, Artificial Sequence
  Description of Artificial Sequence: Synthetic oligonucleotide
atcggatttgagacctgcaggtatgggttcatag

SEQ ID NO: 196018 - DNA, 33 bp, Artificial Sequence
  Description of Artificial Sequence: Synthetic oligonucleotide
tcggatttgagacctgcaggtatgggttcatag

SEQ ID NO: 196019 - DNA, 32 bp, Artificial Sequence
  Description of Artificial Sequence: Synthetic oligonucleotide
cggatttgagacctgcaggtatgggttcatag

SEQ ID NO: 196020 - DNA, 34 bp, Artificial Sequence
  Description of Artificial Sequence: Synthetic oligonucleotide
ggatttgagacctgcaggtatgggttcatagaag

SEQ ID NO: 196021 - DNA, 34 bp, Artificial Sequence
  Description of Artificial Sequence: Synthetic oligonucleotide
gatttgagacctgcaggtatgggttcatagaagg

SEQ ID NO: 196022 - DNA, 34 bp, Artificial Sequence
  Description of Artificial Sequence: Synthetic oligonucleotide
atttgagacctgcaggtatgggttcatagaaggg

SEQ ID NO: 196023 - DNA, 33 bp, Artificial Sequence
  Description of Artificial Sequence: Synthetic oligonucleotide
tttgagacctgcaggtatgggttcatagaaggg

SEQ ID NO: 196024 - DNA, 32 bp, Artificial Sequence
  Description of Artificial Sequence: Synthetic oligonucleotide
ttgagacctgcaggtatgggttcatagaaggg

SEQ ID NO: 196025 - DNA, 31 bp, Artificial Sequence
  Description of Artificial Sequence: Synthetic oligonucleotide
tgagacctgcaggtatgggttcatagaaggg

SEQ ID NO: 196026 - DNA, 30 bp, Artificial Sequence
  Description of Artificial Sequence: Synthetic oligonucleotide
gagacctgcaggtatgggttcatagaaggg

SEQ ID NO: 196027 - DNA, 30 bp, Artificial Sequence
  Description of Artificial Sequence: Synthetic oligonucleotide
agacctgcaggtatgggttcatagaagggc

SEQ ID NO: 196028 - DNA, 29 bp, Artificial Sequence
  Description of Artificial Sequence: Synthetic oligonucleotide
gacctgcaggtatgggttcatagaagggc

SEQ ID NO: 196029 - DNA, 30 bp, Artificial Sequence
  Description of Artificial Sequence: Synthetic oligonucleotide
acctgcaggtatgggttcatagaagggcac

SEQ ID NO: 196030 - DNA, 29 bp, Artificial Sequence
  Description of Artificial Sequence: Synthetic oligonucleotide
cctgcaggtatgggttcatagaagggcac

SEQ ID NO: 196031 - DNA, 29 bp, Artificial Sequence
  Description of Artificial Sequence: Synthetic oligonucleotide
ctgcaggtatgggttcatagaagggcacg

SEQ ID NO: 196032 - DNA, 30 bp, Artificial Sequence
  Description of Artificial Sequence: Synthetic oligonucleotide
tgcaggtatgggttcatagaagggcacgtg

SEQ ID NO: 196033 - DNA, 29 bp, Artificial Sequence
  Description of Artificial Sequence: Synthetic oligonucleotide
gcaggtatgggttcatagaagggcacgtg

SEQ ID NO: 196034 - DNA, 29 bp, Artificial Sequence
  Description of Artificial Sequence: Synthetic oligonucleotide
caggtatgggttcatagaagggcacgtgg

SEQ ID NO: 196035 - DNA, 30 bp, Artificial Sequence
  Description of Artificial Sequence: Synthetic oligonucleotide
aggtatgggttcatagaagggcacgtggtg

SEQ ID NO: 196036 - DNA, 29 bp, Artificial Sequence
  Description of Artificial Sequence: Synthetic oligonucleotide
ggtatgggttcatagaagggcacgtggtg

SEQ ID NO: 196037 - DNA, 32 bp, Artificial Sequence
  Description of Artificial Sequence: Synthetic oligonucleotide
gtatgggttcatagaagggcacgtggtgattc

SEQ ID NO: 196038 - DNA, 32 bp, Artificial Sequence
  Description of Artificial Sequence: Synthetic oligonucleotide
tatgggttcatagaagggcacgtggtgattcc

SEQ ID NO: 196039 - DNA, 31 bp, Artificial Sequence
  Description of Artificial Sequence: Synthetic oligonucleotide
atgggttcatagaagggcacgtggtgattcc

SEQ ID NO: 196040 - DNA, 30 bp, Artificial Sequence
  Description of Artificial Sequence: Synthetic oligonucleotide
tgggttcatagaagggcacgtggtgattcc

SEQ ID NO: 196041 - DNA, 29 bp, Artificial Sequence
  Description of Artificial Sequence: Synthetic oligonucleotide
gggttcatagaagggcacgtggtgattcc

SEQ ID NO: 196042 - DNA, 29 bp, Artificial Sequence
  Description of Artificial Sequence: Synthetic oligonucleotide
ggttcatagaagggcacgtggtgattccc

SEQ ID NO: 196043 - DNA, 29 bp, Artificial Sequence
  Description of Artificial Sequence: Synthetic oligonucleotide
gttcatagaagggcacgtggtgattcccc

SEQ ID NO: 196044 - DNA, 29 bp, Artificial Sequence
  Description of Artificial Sequence: Synthetic oligonucleotide
ttcatagaagggcacgtggtgattccccg

SEQ ID NO: 196045 - DNA, 28 bp, Artificial Sequence
  Description of Artificial Sequence: Synthetic oligonucleotide
tcatagaagggcacgtggtgattccccg

SEQ ID NO: 196046 - DNA, 27 bp, Artificial Sequence
  Description of Artificial Sequence: Synthetic oligonucleotide
catagaagggcacgtggtgattccccg

SEQ ID NO: 196047 - DNA, 27 bp, Artificial Sequence
  Description of Artificial Sequence: Synthetic oligonucleotide
atagaagggcacgtggtgattccccgg

SEQ ID NO: 196048 - DNA, 27 bp, Artificial Sequence
  Description of Artificial Sequence: Synthetic oligonucleotide
tagaagggcacgtggtgattccccgga

SEQ ID NO: 196049 - DNA, 27 bp, Artificial Sequence
  Description of Artificial Sequence: Synthetic oligonucleotide
agaagggcacgtggtgattccccggat

SEQ ID NO: 196050 - DNA, 26 bp, Artificial Sequence
  Description of Artificial Sequence: Synthetic oligonucleotide
gaagggcacgtggtgattccccggat

SEQ ID NO: 196051 - DNA, 26 bp, Artificial Sequence
  Description of Artificial Sequence: Synthetic oligonucleotide
aagggcacgtggtgattccccggatc

SEQ ID NO: 196052 - DNA, 25 bp, Artificial Sequence
  Description of Artificial Sequence: Synthetic oligonucleotide
agggcacgtggtgattccccggatc

SEQ ID NO: 196053 - DNA, 24 bp, Artificial Sequence
  Description of Artificial Sequence: Synthetic oligonucleotide
gggcacgtggtgattccccggatc

SEQ ID NO: 196054 - DNA, 25 bp, Artificial Sequence
  Description of Artificial Sequence: Synthetic oligonucleotide
ggcacgtggtgattccccggatcca

SEQ ID NO: 196055 - DNA, 25 bp, Artificial Sequence
  Description of Artificial Sequence: Synthetic oligonucleotide
gcacgtggtgattccccggatccac

SEQ ID NO: 196056 - DNA, 25 bp, Artificial Sequence
  Description of Artificial Sequence: Synthetic oligonucleotide
cacgtggtgattccccggatccacc

SEQ ID NO: 196057 - DNA, 25 bp, Artificial Sequence
  Description of Artificial Sequence: Synthetic oligonucleotide
acgtggtgattccccggatccaccc

SEQ ID NO: 196058 - DNA, 24 bp, Artificial Sequence
  Description of Artificial Sequence: Synthetic oligonucleotide
cgtggtgattccccggatccaccc

SEQ ID NO: 196059 - DNA, 26 bp, Artificial Sequence
  Description of Artificial Sequence: Synthetic oligonucleotide
gtggtgattccccggatccaccccaa

SEQ ID NO: 196060 - DNA, 27 bp, Artificial Sequence
  Description of Artificial Sequence: Synthetic oligonucleotide
tggtgattccccggatccaccccaact

SEQ ID NO: 196061 - DNA, 26 bp, Artificial Sequence
  Description of Artificial Sequence: Synthetic oligonucleotide
ggtgattccccggatccaccccaact

SEQ ID NO: 196062 - DNA, 26 bp, Artificial Sequence
  Description of Artificial Sequence: Synthetic oligonucleotide
gtgattccccggatccaccccaactc

SEQ ID NO: 196063 - DNA, 27 bp, Artificial Sequence
  Description of Artificial Sequence: Synthetic oligonucleotide
tgattccccggatccaccccaactcca

SEQ ID NO: 196064 - DNA, 27 bp, Artificial Sequence
  Description of Artificial Sequence: Synthetic oligonucleotide
gattccccggatccaccccaactccat

SEQ ID NO: 196065 - DNA, 27 bp, Artificial Sequence
  Description of Artificial Sequence: Synthetic oligonucleotide
attccccggatccaccccaactccatc

SEQ ID NO: 196066 - DNA, 27 bp, Artificial Sequence
  Description of Artificial Sequence: Synthetic oligonucleotide
ttccccggatccaccccaactccatct

SEQ ID NO: 196067 - DNA, 26 bp, Artificial Sequence
  Description of Artificial Sequence: Synthetic oligonucleotide
tccccggatccaccccaactccatct

SEQ ID NO: 196068 - DNA, 25 bp, Artificial Sequence
  Description of Artificial Sequence: Synthetic oligonucleotide
ccccggatccaccccaactccatct

SEQ ID NO: 196069 - DNA, 26 bp, Artificial Sequence
  Description of Artificial Sequence: Synthetic oligonucleotide
cccggatccaccccaactccatctgt

SEQ ID NO: 196070 - DNA, 26 bp, Artificial Sequence
  Description of Artificial Sequence: Synthetic oligonucleotide
ccggatccaccccaactccatctgtg

SEQ ID NO: 196071 - DNA, 27 bp, Artificial Sequence
  Description of Artificial Sequence: Synthetic oligonucleotide
cggatccaccccaactccatctgtgca

SEQ ID NO: 196072 - DNA, 27 bp, Artificial Sequence
  Description of Artificial Sequence: Synthetic oligonucleotide
ggatccaccccaactccatctgtgcag

SEQ ID NO: 196073 - DNA, 27 bp, Artificial Sequence
  Description of Artificial Sequence: Synthetic oligonucleotide
gatccaccccaactccatctgtgcagc

SEQ ID NO: 196074 - DNA, 30 bp, Artificial Sequence
  Description of Artificial Sequence: Synthetic oligonucleotide
atccaccccaactccatctgtgcagcaaac

SEQ ID NO: 196075 - DNA, 29 bp, Artificial Sequence
  Description of Artificial Sequence: Synthetic oligonucleotide
tccaccccaactccatctgtgcagcaaac

SEQ ID NO: 196076 - DNA, 28 bp, Artificial Sequence
  Description of Artificial Sequence: Synthetic oligonucleotide
ccaccccaactccatctgtgcagcaaac

SEQ ID NO: 196077 - DNA, 30 bp, Artificial Sequence
  Description of Artificial Sequence: Synthetic oligonucleotide
caccccaactccatctgtgcagcaaacaac

SEQ ID NO: 196078 - DNA, 31 bp, Artificial Sequence
  Description of Artificial Sequence: Synthetic oligonucleotide
accccaactccatctgtgcagcaaacaacac

SEQ ID NO: 196079 - DNA, 30 bp, Artificial Sequence
  Description of Artificial Sequence: Synthetic oligonucleotide
ccccaactccatctgtgcagcaaacaacac

SEQ ID NO: 196080 - DNA, 31 bp, Artificial Sequence
  Description of Artificial Sequence: Synthetic oligonucleotide
cccaactccatctgtgcagcaaacaacacag

SEQ ID NO: 196081 - DNA, 31 bp, Artificial Sequence
  Description of Artificial Sequence: Synthetic oligonucleotide
ccaactccatctgtgcagcaaacaacacagg

SEQ ID NO: 196082 - DNA, 31 bp, Artificial Sequence
  Description of Artificial Sequence: Synthetic oligonucleotide
caactccatctgtgcagcaaacaacacaggg

SEQ ID NO: 196083 - DNA, 31 bp, Artificial Sequence
  Description of Artificial Sequence: Synthetic oligonucleotide
aactccatctgtgcagcaaacaacacagggg

SEQ ID NO: 196084 - DNA, 30 bp, Artificial Sequence
  Description of Artificial Sequence: Synthetic oligonucleotide
actccatctgtgcagcaaacaacacagggg

SEQ ID NO: 196085 - DNA, 29 bp, Artificial Sequence
  Description of Artificial Sequence: Synthetic oligonucleotide
ctccatctgtgcagcaaacaacacagggg

SEQ ID NO: 196086 - DNA, 30 bp, Artificial Sequence
  Description of Artificial Sequence: Synthetic oligonucleotide
tccatctgtgcagcaaacaacacaggggtg

SEQ ID NO: 196087 - DNA, 29 bp, Artificial Sequence
  Description of Artificial Sequence: Synthetic oligonucleotide
ccatctgtgcagcaaacaacacaggggtg

SEQ ID NO: 196088 - DNA, 31 bp, Artificial Sequence
  Description of Artificial Sequence: Synthetic oligonucleotide
catctgtgcagcaaacaacacaggggtgtac

SEQ ID NO: 196089 - DNA, 33 bp, Artificial Sequence
  Description of Artificial Sequence: Synthetic oligonucleotide
atctgtgcagcaaacaacacaggggtgtacatc

SEQ ID NO: 196090 - DNA, 32 bp, Artificial Sequence
  Description of Artificial Sequence: Synthetic oligonucleotide
tctgtgcagcaaacaacacaggggtgtacatc

SEQ ID NO: 196091 - DNA, 31 bp, Artificial Sequence
  Description of Artificial Sequence: Synthetic oligonucleotide
ctgtgcagcaaacaacacaggggtgtacatc

SEQ ID NO: 196092 - DNA, 31 bp, Artificial Sequence
  Description of Artificial Sequence: Synthetic oligonucleotide
tgtgcagcaaacaacacaggggtgtacatcc

SEQ ID NO: 196093 - DNA, 30 bp, Artificial Sequence
  Description of Artificial Sequence: Synthetic oligonucleotide
gtgcagcaaacaacacaggggtgtacatcc

SEQ ID NO: 196094 - DNA, 31 bp, Artificial Sequence
  Description of Artificial Sequence: Synthetic oligonucleotide
tgcagcaaacaacacaggggtgtacatcctc

SEQ ID NO: 196095 - DNA, 30 bp, Artificial Sequence
  Description of Artificial Sequence: Synthetic oligonucleotide
gcagcaaacaacacaggggtgtacatcctc

SEQ ID NO: 196096 - DNA, 31 bp, Artificial Sequence
  Description of Artificial Sequence: Synthetic oligonucleotide
cagcaaacaacacaggggtgtacatcctcac

SEQ ID NO: 196097 - DNA, 33 bp, Artificial Sequence
  Description of Artificial Sequence: Synthetic oligonucleotide
agcaaacaacacaggggtgtacatcctcacatc

SEQ ID NO: 196098 - DNA, 32 bp, Artificial Sequence
  Description of Artificial Sequence: Synthetic oligonucleotide
gcaaacaacacaggggtgtacatcctcacatc

SEQ ID NO: 196099 - DNA, 32 bp, Artificial Sequence
  Description of Artificial Sequence: Synthetic oligonucleotide
caaacaacacaggggtgtacatcctcacatcc

SEQ ID NO: 196100 - DNA, 34 bp, Artificial Sequence
  Description of Artificial Sequence: Synthetic oligonucleotide
aaacaacacaggggtgtacatcctcacatccaac

SEQ ID NO: 196101 - DNA, 33 bp, Artificial Sequence
  Description of Artificial Sequence: Synthetic oligonucleotide
aacaacacaggggtgtacatcctcacatccaac

SEQ ID NO: 196102 - DNA, 32 bp, Artificial Sequence
  Description of Artificial Sequence: Synthetic oligonucleotide
acaacacaggggtgtacatcctcacatccaac

SEQ ID NO: 196103 - DNA, 31 bp, Artificial Sequence
  Description of Artificial Sequence: Synthetic oligonucleotide
caacacaggggtgtacatcctcacatccaac

SEQ ID NO: 196104 - DNA, 32 bp, Artificial Sequence
  Description of Artificial Sequence: Synthetic oligonucleotide
aacacaggggtgtacatcctcacatccaacac

SEQ ID NO: 196105 - DNA, 31 bp, Artificial Sequence
  Description of Artificial Sequence: Synthetic oligonucleotide
acacaggggtgtacatcctcacatccaacac

SEQ ID NO: 196106 - DNA, 30 bp, Artificial Sequence
  Description of Artificial Sequence: Synthetic oligonucleotide
cacaggggtgtacatcctcacatccaacac

SEQ ID NO: 196107 - DNA, 30 bp, Artificial Sequence
  Description of Artificial Sequence: Synthetic oligonucleotide
acaggggtgtacatcctcacatccaacacc

SEQ ID NO: 196108 - DNA, 29 bp, Artificial Sequence
  Description of Artificial Sequence: Synthetic oligonucleotide
caggggtgtacatcctcacatccaacacc

SEQ ID NO: 196109 - DNA, 30 bp, Artificial Sequence
  Description of Artificial Sequence: Synthetic oligonucleotide
aggggtgtacatcctcacatccaacacctc

SEQ ID NO: 196110 - DNA, 29 bp, Artificial Sequence
  Description of Artificial Sequence: Synthetic oligonucleotide
ggggtgtacatcctcacatccaacacctc

SEQ ID NO: 196111 - DNA, 29 bp, Artificial Sequence
  Description of Artificial Sequence: Synthetic oligonucleotide
gggtgtacatcctcacatccaacacctcc

SEQ ID NO: 196112 - DNA, 29 bp, Artificial Sequence
  Description of Artificial Sequence: Synthetic oligonucleotide
ggtgtacatcctcacatccaacacctccc

SEQ ID NO: 196113 - DNA, 30 bp, Artificial Sequence
  Description of Artificial Sequence: Synthetic oligonucleotide
gtgtacatcctcacatccaacacctcccag

SEQ ID NO: 196114 - DNA, 33 bp, Artificial Sequence
  Description of Artificial Sequence: Synthetic oligonucleotide
tgtacatcctcacatccaacacctcccagtatg

SEQ ID NO: 196115 - DNA, 32 bp, Artificial Sequence
  Description of Artificial Sequence: Synthetic oligonucleotide
gtacatcctcacatccaacacctcccagtatg

SEQ ID NO: 196116 - DNA, 33 bp, Artificial Sequence
  Description of Artificial Sequence: Synthetic oligonucleotide
tacatcctcacatccaacacctcccagtatgac

SEQ ID NO: 196117 - DNA, 32 bp, Artificial Sequence
  Description of Artificial Sequence: Synthetic oligonucleotide
acatcctcacatccaacacctcccagtatgac

SEQ ID NO: 196118 - DNA, 31 bp, Artificial Sequence
  Description of Artificial Sequence: Synthetic oligonucleotide
catcctcacatccaacacctcccagtatgac

SEQ ID NO: 196119 - DNA, 32 bp, Artificial Sequence
  Description of Artificial Sequence: Synthetic oligonucleotide
atcctcacatccaacacctcccagtatgacac

SEQ ID NO: 196120 - DNA, 31 bp, Artificial Sequence
  Description of Artificial Sequence: Synthetic oligonucleotide
tcctcacatccaacacctcccagtatgacac

SEQ ID NO: 196121 - DNA, 30 bp, Artificial Sequence
  Description of Artificial Sequence: Synthetic oligonucleotide
cctcacatccaacacctcccagtatgacac

SEQ ID NO: 196122 - DNA, 35 bp, Artificial Sequence
  Description of Artificial Sequence: Synthetic oligonucleotide
ctcacatccaacacctcccagtatgacacatattg

SEQ ID NO: 196123 - DNA, 35 bp, Artificial Sequence
  Description of Artificial Sequence: Synthetic oligonucleotide
tcacatccaacacctcccagtatgacacatattgc

SEQ ID NO: 196124 - DNA, 34 bp, Artificial Sequence
  Description of Artificial Sequence: Synthetic oligonucleotide
cacatccaacacctcccagtatgacacatattgc

SEQ ID NO: 196125 - DNA, 36 bp, Artificial Sequence
  Description of Artificial Sequence: Synthetic oligonucleotide
acatccaacacctcccagtatgacacatattgcttc

SEQ ID NO: 196126 - DNA, 35 bp, Artificial Sequence
  Description of Artificial Sequence: Synthetic oligonucleotide
catccaacacctcccagtatgacacatattgcttc

SEQ ID NO: 196127 - DNA, 38 bp, Artificial Sequence
  Description of Artificial Sequence: Synthetic oligonucleotide
atccaacacctcccagtatgacacatattgcttcaatg

SEQ ID NO: 196128 - DNA, 37 bp, Artificial Sequence
  Description of Artificial Sequence: Synthetic oligonucleotide
tccaacacctcccagtatgacacatattgcttcaatg

SEQ ID NO: 196129 - DNA, 36 bp, Artificial Sequence
  Description of Artificial Sequence: Synthetic oligonucleotide
ccaacacctcccagtatgacacatattgcttcaatg

SEQ ID NO: 196130 - DNA, 36 bp, Artificial Sequence
  Description of Artificial Sequence: Synthetic oligonucleotide
caacacctcccagtatgacacatattgcttcaatgc

SEQ ID NO: 196131 - DNA, 38 bp, Artificial Sequence
  Description of Artificial Sequence: Synthetic oligonucleotide
aacacctcccagtatgacacatattgcttcaatgcttc

SEQ ID NO: 196132 - DNA, 37 bp, Artificial Sequence
  Description of Artificial Sequence: Synthetic oligonucleotide
acacctcccagtatgacacatattgcttcaatgcttc

SEQ ID NO: 196133 - DNA, 36 bp, Artificial Sequence
  Description of Artificial Sequence: Synthetic oligonucleotide
cacctcccagtatgacacatattgcttcaatgcttc

SEQ ID NO: 196134 - DNA, 37 bp, Artificial Sequence
  Description of Artificial Sequence: Synthetic oligonucleotide
acctcccagtatgacacatattgcttcaatgcttcag

SEQ ID NO: 196135 - DNA, 36 bp, Artificial Sequence
  Description of Artificial Sequence: Synthetic oligonucleotide
cctcccagtatgacacatattgcttcaatgcttcag

SEQ ID NO: 196136 - DNA, 36 bp, Artificial Sequence
  Description of Artificial Sequence: Synthetic oligonucleotide
ctcccagtatgacacatattgcttcaatgcttcagc

SEQ ID NO: 196137 - DNA, 37 bp, Artificial Sequence
  Description of Artificial Sequence: Synthetic oligonucleotide
tcccagtatgacacatattgcttcaatgcttcagctc

SEQ ID NO: 196138 - DNA, 36 bp, Artificial Sequence
  Description of Artificial Sequence: Synthetic oligonucleotide
cccagtatgacacatattgcttcaatgcttcagctc

SEQ ID NO: 196139 - DNA, 36 bp, Artificial Sequence
  Description of Artificial Sequence: Synthetic oligonucleotide
ccagtatgacacatattgcttcaatgcttcagctcc

SEQ ID NO: 196140 - DNA, 37 bp, Artificial Sequence
  Description of Artificial Sequence: Synthetic oligonucleotide
cagtatgacacatattgcttcaatgcttcagctccac

SEQ ID NO: 196141 - DNA, 37 bp, Artificial Sequence
  Description of Artificial Sequence: Synthetic oligonucleotide
agtatgacacatattgcttcaatgcttcagctccacc

SEQ ID NO: 196142 - DNA, 36 bp, Artificial Sequence
  Description of Artificial Sequence: Synthetic oligonucleotide
gtatgacacatattgcttcaatgcttcagctccacc

SEQ ID NO: 196143 - DNA, 37 bp, Artificial Sequence
  Description of Artificial Sequence: Synthetic oligonucleotide
tatgacacatattgcttcaatgcttcagctccacctg

SEQ ID NO: 196144 - DNA, 36 bp, Artificial Sequence
  Description of Artificial Sequence: Synthetic oligonucleotide
atgacacatattgcttcaatgcttcagctccacctg

SEQ ID NO: 196145 - DNA, 35 bp, Artificial Sequence
  Description of Artificial Sequence: Synthetic oligonucleotide
tgacacatattgcttcaatgcttcagctccacctg

SEQ ID NO: 196146 - DNA, 34 bp, Artificial Sequence
  Description of Artificial Sequence: Synthetic oligonucleotide
gacacatattgcttcaatgcttcagctccacctg

SEQ ID NO: 196147 - DNA, 36 bp, Artificial Sequence
  Description of Artificial Sequence: Synthetic oligonucleotide
acacatattgcttcaatgcttcagctccacctgaag

SEQ ID NO: 196148 - DNA, 35 bp, Artificial Sequence
  Description of Artificial Sequence: Synthetic oligonucleotide
cacatattgcttcaatgcttcagctccacctgaag

SEQ ID NO: 196149 - DNA, 37 bp, Artificial Sequence
  Description of Artificial Sequence: Synthetic oligonucleotide
acatattgcttcaatgcttcagctccacctgaagaag

SEQ ID NO: 196150 - DNA, 36 bp, Artificial Sequence
  Description of Artificial Sequence: Synthetic oligonucleotide
catattgcttcaatgcttcagctccacctgaagaag

SEQ ID NO: 196151 - DNA, 39 bp, Artificial Sequence
  Description of Artificial Sequence: Synthetic oligonucleotide
atattgcttcaatgcttcagctccacctgaagaagattg

SEQ ID NO: 196152 - DNA, 38 bp, Artificial Sequence
  Description of Artificial Sequence: Synthetic oligonucleotide
tattgcttcaatgcttcagctccacctgaagaagattg

SEQ ID NO: 196153 - DNA, 37 bp, Artificial Sequence
  Description of Artificial Sequence: Synthetic oligonucleotide
attgcttcaatgcttcagctccacctgaagaagattg

SEQ ID NO: 196154 - DNA, 36 bp, Artificial Sequence
  Description of Artificial Sequence: Synthetic oligonucleotide
ttgcttcaatgcttcagctccacctgaagaagattg

SEQ ID NO: 196155 - DNA, 35 bp, Artificial Sequence
  Description of Artificial Sequence: Synthetic oligonucleotide
tgcttcaatgcttcagctccacctgaagaagattg

SEQ ID NO: 196156 - DNA, 34 bp, Artificial Sequence
  Description of Artificial Sequence: Synthetic oligonucleotide
gcttcaatgcttcagctccacctgaagaagattg

SEQ ID NO: 196157 - DNA, 36 bp, Artificial Sequence
  Description of Artificial Sequence: Synthetic oligonucleotide
cttcaatgcttcagctccacctgaagaagattgtac

SEQ ID NO: 196158 - DNA, 38 bp, Artificial Sequence
  Description of Artificial Sequence: Synthetic oligonucleotide
ttcaatgcttcagctccacctgaagaagattgtacatc

SEQ ID NO: 196159 - DNA, 37 bp, Artificial Sequence
  Description of Artificial Sequence: Synthetic oligonucleotide
tcaatgcttcagctccacctgaagaagattgtacatc

SEQ ID NO: 196160 - DNA, 36 bp, Artificial Sequence
  Description of Artificial Sequence: Synthetic oligonucleotide
caatgcttcagctccacctgaagaagattgtacatc

SEQ ID NO: 196161 - DNA, 37 bp, Artificial Sequence
  Description of Artificial Sequence: Synthetic oligonucleotide
aatgcttcagctccacctgaagaagattgtacatcag

SEQ ID NO: 196162 - DNA, 36 bp, Artificial Sequence
  Description of Artificial Sequence: Synthetic oligonucleotide
atgcttcagctccacctgaagaagattgtacatcag

SEQ ID NO: 196163 - DNA, 35 bp, Artificial Sequence
  Description of Artificial Sequence: Synthetic oligonucleotide
tgcttcagctccacctgaagaagattgtacatcag

SEQ ID NO: 196164 - DNA, 34 bp, Artificial Sequence
  Description of Artificial Sequence: Synthetic oligonucleotide
gcttcagctccacctgaagaagattgtacatcag

SEQ ID NO: 196165 - DNA, 35 bp, Artificial Sequence
  Description of Artificial Sequence: Synthetic oligonucleotide
cttcagctccacctgaagaagattgtacatcagtc

SEQ ID NO: 196166 - DNA, 36 bp, Artificial Sequence
  Description of Artificial Sequence: Synthetic oligonucleotide
ttcagctccacctgaagaagattgtacatcagtcac

SEQ ID NO: 196167 - DNA, 35 bp, Artificial Sequence
  Description of Artificial Sequence: Synthetic oligonucleotide
tcagctccacctgaagaagattgtacatcagtcac

SEQ ID NO: 196168 - DNA, 34 bp, Artificial Sequence
  Description of Artificial Sequence: Synthetic oligonucleotide
cagctccacctgaagaagattgtacatcagtcac

SEQ ID NO: 196169 - DNA, 35 bp, Artificial Sequence
  Description of Artificial Sequence: Synthetic oligonucleotide
agctccacctgaagaagattgtacatcagtcacag

SEQ ID NO: 196170 - DNA, 34 bp, Artificial Sequence
  Description of Artificial Sequence: Synthetic oligonucleotide
gctccacctgaagaagattgtacatcagtcacag

SEQ ID NO: 196171 - DNA, 35 bp, Artificial Sequence
  Description of Artificial Sequence: Synthetic oligonucleotide
ctccacctgaagaagattgtacatcagtcacagac

SEQ ID NO: 196172 - DNA, 35 bp, Artificial Sequence
  Description of Artificial Sequence: Synthetic oligonucleotide
tccacctgaagaagattgtacatcagtcacagacc

SEQ ID NO: 196173 - DNA, 34 bp, Artificial Sequence
  Description of Artificial Sequence: Synthetic oligonucleotide
ccacctgaagaagattgtacatcagtcacagacc

SEQ ID NO: 196174 - DNA, 35 bp, Artificial Sequence
  Description of Artificial Sequence: Synthetic oligonucleotide
cacctgaagaagattgtacatcagtcacagacctg

SEQ ID NO: 196175 - DNA, 35 bp, Artificial Sequence
  Description of Artificial Sequence: Synthetic oligonucleotide
acctgaagaagattgtacatcagtcacagacctgc

SEQ ID NO: 196176 - DNA, 34 bp, Artificial Sequence
  Description of Artificial Sequence: Synthetic oligonucleotide
cctgaagaagattgtacatcagtcacagacctgc

SEQ ID NO: 196177 - DNA, 34 bp, Artificial Sequence
  Description of Artificial Sequence: Synthetic oligonucleotide
ctgaagaagattgtacatcagtcacagacctgcc

SEQ ID NO: 196178 - DNA, 34 bp, Artificial Sequence
  Description of Artificial Sequence: Synthetic oligonucleotide
tgaagaagattgtacatcagtcacagacctgccc

SEQ ID NO: 196179 - DNA, 33 bp, Artificial Sequence
  Description of Artificial Sequence: Synthetic oligonucleotide
gaagaagattgtacatcagtcacagacctgccc

SEQ ID NO: 196180 - DNA, 36 bp, Artificial Sequence
  Description of Artificial Sequence: Synthetic oligonucleotide
aagaagattgtacatcagtcacagacctgcccaatg

SEQ ID NO: 196181 - DNA, 35 bp, Artificial Sequence
  Description of Artificial Sequence: Synthetic oligonucleotide
agaagattgtacatcagtcacagacctgcccaatg

SEQ ID NO: 196182 - DNA, 34 bp, Artificial Sequence
  Description of Artificial Sequence: Synthetic oligonucleotide
gaagattgtacatcagtcacagacctgcccaatg

SEQ ID NO: 196183 - DNA, 34 bp, Artificial Sequence
  Description of Artificial Sequence: Synthetic oligonucleotide
aagattgtacatcagtcacagacctgcccaatgc

SEQ ID NO: 196184 - DNA, 33 bp, Artificial Sequence
  Description of Artificial Sequence: Synthetic oligonucleotide
agattgtacatcagtcacagacctgcccaatgc

SEQ ID NO: 196185 - DNA, 32 bp, Artificial Sequence
  Description of Artificial Sequence: Synthetic oligonucleotide
gattgtacatcagtcacagacctgcccaatgc

SEQ ID NO: 196186 - DNA, 32 bp, Artificial Sequence
  Description of Artificial Sequence: Synthetic oligonucleotide
attgtacatcagtcacagacctgcccaatgcc

SEQ ID NO: 196187 - DNA, 31 bp, Artificial Sequence
  Description of Artificial Sequence: Synthetic oligonucleotide
ttgtacatcagtcacagacctgcccaatgcc

SEQ ID NO: 196188 - DNA, 30 bp, Artificial Sequence
  Description of Artificial Sequence: Synthetic oligonucleotide
tgtacatcagtcacagacctgcccaatgcc

SEQ ID NO: 196189 - DNA, 29 bp, Artificial Sequence
  Description of Artificial Sequence: Synthetic oligonucleotide
gtacatcagtcacagacctgcccaatgcc

SEQ ID NO: 196190 - DNA, 32 bp, Artificial Sequence
  Description of Artificial Sequence: Synthetic oligonucleotide
tacatcagtcacagacctgcccaatgcctttg

SEQ ID NO: 196191 - DNA, 31 bp, Artificial Sequence
  Description of Artificial Sequence: Synthetic oligonucleotide
acatcagtcacagacctgcccaatgcctttg

SEQ ID NO: 196192 - DNA, 30 bp, Artificial Sequence
  Description of Artificial Sequence: Synthetic oligonucleotide
catcagtcacagacctgcccaatgcctttg

SEQ ID NO: 196193 - DNA, 32 bp, Artificial Sequence
  Description of Artificial Sequence: Synthetic oligonucleotide
atcagtcacagacctgcccaatgcctttgatg

SEQ ID NO: 196194 - DNA, 31 bp, Artificial Sequence
  Description of Artificial Sequence: Synthetic oligonucleotide
tcagtcacagacctgcccaatgcctttgatg

SEQ ID NO: 196195 - DNA, 30 bp, Artificial Sequence
  Description of Artificial Sequence: Synthetic oligonucleotide
cagtcacagacctgcccaatgcctttgatg

SEQ ID NO: 196196 - DNA, 30 bp, Artificial Sequence
  Description of Artificial Sequence: Synthetic oligonucleotide
agtcacagacctgcccaatgcctttgatgg

SEQ ID NO: 196197 - DNA, 29 bp, Artificial Sequence
  Description of Artificial Sequence: Synthetic oligonucleotide
gtcacagacctgcccaatgcctttgatgg

SEQ ID NO: 196198 - DNA, 30 bp, Artificial Sequence
  Description of Artificial Sequence: Synthetic oligonucleotide
tcacagacctgcccaatgcctttgatggac

SEQ ID NO: 196199 - DNA, 29 bp, Artificial Sequence
  Description of Artificial Sequence: Synthetic oligonucleotide
cacagacctgcccaatgcctttgatggac

SEQ ID NO: 196200 - DNA, 29 bp, Artificial Sequence
  Description of Artificial Sequence: Synthetic oligonucleotide
acagacctgcccaatgcctttgatggacc

SEQ ID NO: 196201 - DNA, 28 bp, Artificial Sequence
  Description of Artificial Sequence: Synthetic oligonucleotide
cagacctgcccaatgcctttgatggacc

SEQ ID NO: 196202 - DNA, 33 bp, Artificial Sequence
  Description of Artificial Sequence: Synthetic oligonucleotide
agacctgcccaatgcctttgatggaccaattac

SEQ ID NO: 196203 - DNA, 32 bp, Artificial Sequence
  Description of Artificial Sequence: Synthetic oligonucleotide
gacctgcccaatgcctttgatggaccaattac

SEQ ID NO: 196204 - DNA, 32 bp, Artificial Sequence
  Description of Artificial Sequence: Synthetic oligonucleotide
acctgcccaatgcctttgatggaccaattacc

SEQ ID NO: 196205 - DNA, 31 bp, Artificial Sequence
  Description of Artificial Sequence: Synthetic oligonucleotide
cctgcccaatgcctttgatggaccaattacc

SEQ ID NO: 196206 - DNA, 35 bp, Artificial Sequence
  Description of Artificial Sequence: Synthetic oligonucleotide
ctgcccaatgcctttgatggaccaattaccataac

SEQ ID NO: 196207 - DNA, 39 bp, Artificial Sequence
  Description of Artificial Sequence: Synthetic oligonucleotide
tgcccaatgcctttgatggaccaattaccataactattg

SEQ ID NO: 196208 - DNA, 38 bp, Artificial Sequence
  Description of Artificial Sequence: Synthetic oligonucleotide
gcccaatgcctttgatggaccaattaccataactattg

SEQ ID NO: 196209 - DNA, 42 bp, Artificial Sequence
  Description of Artificial Sequence: Synthetic oligonucleotide
cccaatgcctttgatggaccaattaccataactattgttaac

SEQ ID NO: 196210 - DNA, 42 bp, Artificial Sequence
  Description of Artificial Sequence: Synthetic oligonucleotide
ccaatgcctttgatggaccaattaccataactattgttaacc

SEQ ID NO: 196211 - DNA, 42 bp, Artificial Sequence
  Description of Artificial Sequence: Synthetic oligonucleotide
caatgcctttgatggaccaattaccataactattgttaaccg

SEQ ID NO: 196212 - DNA, 43 bp, Artificial Sequence
  Description of Artificial Sequence: Synthetic oligonucleotide
aatgcctttgatggaccaattaccataactattgttaaccgtg

SEQ ID NO: 196213 - DNA, 42 bp, Artificial Sequence
  Description of Artificial Sequence: Synthetic oligonucleotide
atgcctttgatggaccaattaccataactattgttaaccgtg

SEQ ID NO: 196214 - DNA, 41 bp, Artificial Sequence
  Description of Artificial Sequence: Synthetic oligonucleotide
tgcctttgatggaccaattaccataactattgttaaccgtg

SEQ ID NO: 196215 - DNA, 40 bp, Artificial Sequence
  Description of Artificial Sequence: Synthetic oligonucleotide
gcctttgatggaccaattaccataactattgttaaccgtg

SEQ ID NO: 196216 - DNA, 42 bp, Artificial Sequence
  Description of Artificial Sequence: Synthetic oligonucleotide
cctttgatggaccaattaccataactattgttaaccgtgatg

SEQ ID NO: 196217 - DNA, 42 bp, Artificial Sequence
  Description of Artificial Sequence: Synthetic oligonucleotide
ctttgatggaccaattaccataactattgttaaccgtgatgg

SEQ ID NO: 196218 - DNA, 42 bp, Artificial Sequence
  Description of Artificial Sequence: Synthetic oligonucleotide
tttgatggaccaattaccataactattgttaaccgtgatggc

SEQ ID NO: 196219 - DNA, 41 bp, Artificial Sequence
  Description of Artificial Sequence: Synthetic oligonucleotide
ttgatggaccaattaccataactattgttaaccgtgatggc

SEQ ID NO: 196220 - DNA, 40 bp, Artificial Sequence
  Description of Artificial Sequence: Synthetic oligonucleotide
tgatggaccaattaccataactattgttaaccgtgatggc

SEQ ID NO: 196221 - DNA, 39 bp, Artificial Sequence
  Description of Artificial Sequence: Synthetic oligonucleotide
gatggaccaattaccataactattgttaaccgtgatggc

SEQ ID NO: 196222 - DNA, 40 bp, Artificial Sequence
  Description of Artificial Sequence: Synthetic oligonucleotide
atggaccaattaccataactattgttaaccgtgatggcac

SEQ ID NO: 196223 - DNA, 39 bp, Artificial Sequence
  Description of Artificial Sequence: Synthetic oligonucleotide
tggaccaattaccataactattgttaaccgtgatggcac

SEQ ID NO: 196224 - DNA, 38 bp, Artificial Sequence
  Description of Artificial Sequence: Synthetic oligonucleotide
ggaccaattaccataactattgttaaccgtgatggcac

SEQ ID NO: 196225 - DNA, 38 bp, Artificial Sequence
  Description of Artificial Sequence: Synthetic oligonucleotide
gaccaattaccataactattgttaaccgtgatggcacc

SEQ ID NO: 196226 - DNA, 38 bp, Artificial Sequence
  Description of Artificial Sequence: Synthetic oligonucleotide
accaattaccataactattgttaaccgtgatggcaccc

SEQ ID NO: 196227 - DNA, 37 bp, Artificial Sequence
  Description of Artificial Sequence: Synthetic oligonucleotide
ccaattaccataactattgttaaccgtgatggcaccc

SEQ ID NO: 196228 - DNA, 37 bp, Artificial Sequence
  Description of Artificial Sequence: Synthetic oligonucleotide
caattaccataactattgttaaccgtgatggcacccg

SEQ ID NO: 196229 - DNA, 37 bp, Artificial Sequence
  Description of Artificial Sequence: Synthetic oligonucleotide
aattaccataactattgttaaccgtgatggcacccgc

SEQ ID NO: 196230 - DNA, 36 bp, Artificial Sequence
  Description of Artificial Sequence: Synthetic oligonucleotide
attaccataactattgttaaccgtgatggcacccgc

SEQ ID NO: 196231 - DNA, 35 bp, Artificial Sequence
  Description of Artificial Sequence: Synthetic oligonucleotide
ttaccataactattgttaaccgtgatggcacccgc

SEQ ID NO: 196232 - DNA, 34 bp, Artificial Sequence
  Description of Artificial Sequence: Synthetic oligonucleotide
taccataactattgttaaccgtgatggcacccgc

SEQ ID NO: 196233 - DNA, 33 bp, Artificial Sequence
  Description of Artificial Sequence: Synthetic oligonucleotide
accataactattgttaaccgtgatggcacccgc

SEQ ID NO: 196234 - DNA, 32 bp, Artificial Sequence
  Description of Artificial Sequence: Synthetic oligonucleotide
ccataactattgttaaccgtgatggcacccgc

SEQ ID NO: 196235 - DNA, 35 bp, Artificial Sequence
  Description of Artificial Sequence: Synthetic oligonucleotide
cataactattgttaaccgtgatggcacccgctatg

SEQ ID NO: 196236 - DNA, 36 bp, Artificial Sequence
  Description of Artificial Sequence: Synthetic oligonucleotide
ataactattgttaaccgtgatggcacccgctatgtc

SEQ ID NO: 196237 - DNA, 35 bp, Artificial Sequence
  Description of Artificial Sequence: Synthetic oligonucleotide
taactattgttaaccgtgatggcacccgctatgtc

SEQ ID NO: 196238 - DNA, 34 bp, Artificial Sequence
  Description of Artificial Sequence: Synthetic oligonucleotide
aactattgttaaccgtgatggcacccgctatgtc

SEQ ID NO: 196239 - DNA, 33 bp, Artificial Sequence
  Description of Artificial Sequence: Synthetic oligonucleotide
actattgttaaccgtgatggcacccgctatgtc

SEQ ID NO: 196240 - DNA, 32 bp, Artificial Sequence
  Description of Artificial Sequence: Synthetic oligonucleotide
ctattgttaaccgtgatggcacccgctatgtc

SEQ ID NO: 196241 - DNA, 32 bp, Artificial Sequence
  Description of Artificial Sequence: Synthetic oligonucleotide
tattgttaaccgtgatggcacccgctatgtcc

SEQ ID NO: 196242 - DNA, 31 bp, Artificial Sequence
  Description of Artificial Sequence: Synthetic oligonucleotide
attgttaaccgtgatggcacccgctatgtcc

SEQ ID NO: 196243 - DNA, 30 bp, Artificial Sequence
  Description of Artificial Sequence: Synthetic oligonucleotide
ttgttaaccgtgatggcacccgctatgtcc

SEQ ID NO: 196244 - DNA, 29 bp, Artificial Sequence
  Description of Artificial Sequence: Synthetic oligonucleotide
tgttaaccgtgatggcacccgctatgtcc

SEQ ID NO: 196245 - DNA, 28 bp, Artificial Sequence
  Description of Artificial Sequence: Synthetic oligonucleotide
gttaaccgtgatggcacccgctatgtcc

SEQ ID NO: 196246 - DNA, 29 bp, Artificial Sequence
  Description of Artificial Sequence: Synthetic oligonucleotide
ttaaccgtgatggcacccgctatgtccag

SEQ ID NO: 196247 - DNA, 28 bp, Artificial Sequence
  Description of Artificial Sequence: Synthetic oligonucleotide
taaccgtgatggcacccgctatgtccag

SEQ ID NO: 196248 - DNA, 27 bp, Artificial Sequence
  Description of Artificial Sequence: Synthetic oligonucleotide
aaccgtgatggcacccgctatgtccag

SEQ ID NO: 196249 - DNA, 27 bp, Artificial Sequence
  Description of Artificial Sequence: Synthetic oligonucleotide
accgtgatggcacccgctatgtccaga

SEQ ID NO: 196250 - DNA, 27 bp, Artificial Sequence
  Description of Artificial Sequence: Synthetic oligonucleotide
ccgtgatggcacccgctatgtccagaa

SEQ ID NO: 196251 - DNA, 28 bp, Artificial Sequence
  Description of Artificial Sequence: Synthetic oligonucleotide
cgtgatggcacccgctatgtccagaaag

SEQ ID NO: 196252 - DNA, 28 bp, Artificial Sequence
  Description of Artificial Sequence: Synthetic oligonucleotide
gtgatggcacccgctatgtccagaaagg

SEQ ID NO: 196253 - DNA, 29 bp, Artificial Sequence
  Description of Artificial Sequence: Synthetic oligonucleotide
tgatggcacccgctatgtccagaaaggag

SEQ ID NO: 196254 - DNA, 28 bp, Artificial Sequence
  Description of Artificial Sequence: Synthetic oligonucleotide
gatggcacccgctatgtccagaaaggag

SEQ ID NO: 196255 - DNA, 32 bp, Artificial Sequence
  Description of Artificial Sequence: Synthetic oligonucleotide
atggcacccgctatgtccagaaaggagaatac

SEQ ID NO: 196256 - DNA, 31 bp, Artificial Sequence
  Description of Artificial Sequence: Synthetic oligonucleotide
tggcacccgctatgtccagaaaggagaatac

SEQ ID NO: 196257 - DNA, 30 bp, Artificial Sequence
  Description of Artificial Sequence: Synthetic oligonucleotide
ggcacccgctatgtccagaaaggagaatac

SEQ ID NO: 196258 - DNA, 31 bp, Artificial Sequence
  Description of Artificial Sequence: Synthetic oligonucleotide
gcacccgctatgtccagaaaggagaatacag

SEQ ID NO: 196259 - DNA, 33 bp, Artificial Sequence
  Description of Artificial Sequence: Synthetic oligonucleotide
cacccgctatgtccagaaaggagaatacagaac

SEQ ID NO: 196260 - DNA, 33 bp, Artificial Sequence
  Description of Artificial Sequence: Synthetic oligonucleotide
acccgctatgtccagaaaggagaatacagaacg

SEQ ID NO: 196261 - DNA, 32 bp, Artificial Sequence
  Description of Artificial Sequence: Synthetic oligonucleotide
cccgctatgtccagaaaggagaatacagaacg

SEQ ID NO: 196262 - DNA, 35 bp, Artificial Sequence
  Description of Artificial Sequence: Synthetic oligonucleotide
ccgctatgtccagaaaggagaatacagaacgaatc

SEQ ID NO: 196263 - DNA, 35 bp, Artificial Sequence
  Description of Artificial Sequence: Synthetic oligonucleotide
cgctatgtccagaaaggagaatacagaacgaatcc

SEQ ID NO: 196264 - DNA, 36 bp, Artificial Sequence
  Description of Artificial Sequence: Synthetic oligonucleotide
gctatgtccagaaaggagaatacagaacgaatcctg

SEQ ID NO: 196265 - DNA, 38 bp, Artificial Sequence
  Description of Artificial Sequence: Synthetic oligonucleotide
ctatgtccagaaaggagaatacagaacgaatcctgaag

SEQ ID NO: 196266 - DNA, 39 bp, Artificial Sequence
  Description of Artificial Sequence: Synthetic oligonucleotide
tatgtccagaaaggagaatacagaacgaatcctgaagac

SEQ ID NO: 196267 - DNA, 38 bp, Artificial Sequence
  Description of Artificial Sequence: Synthetic oligonucleotide
atgtccagaaaggagaatacagaacgaatcctgaagac

SEQ ID NO: 196268 - DNA, 37 bp, Artificial Sequence
  Description of Artificial Sequence: Synthetic oligonucleotide
tgtccagaaaggagaatacagaacgaatcctgaagac

SEQ ID NO: 196269 - DNA, 36 bp, Artificial Sequence
  Description of Artificial Sequence: Synthetic oligonucleotide
gtccagaaaggagaatacagaacgaatcctgaagac

SEQ ID NO: 196270 - DNA, 38 bp, Artificial Sequence
  Description of Artificial Sequence: Synthetic oligonucleotide
tccagaaaggagaatacagaacgaatcctgaagacatc

SEQ ID NO: 196271 - DNA, 37 bp, Artificial Sequence
  Description of Artificial Sequence: Synthetic oligonucleotide
ccagaaaggagaatacagaacgaatcctgaagacatc

SEQ ID NO: 196272 - DNA, 39 bp, Artificial Sequence
  Description of Artificial Sequence: Synthetic oligonucleotide
cagaaaggagaatacagaacgaatcctgaagacatctac

SEQ ID NO: 196273 - DNA, 39 bp, Artificial Sequence
  Description of Artificial Sequence: Synthetic oligonucleotide
agaaaggagaatacagaacgaatcctgaagacatctacc

SEQ ID NO: 196274 - DNA, 38 bp, Artificial Sequence
  Description of Artificial Sequence: Synthetic oligonucleotide
gaaaggagaatacagaacgaatcctgaagacatctacc

SEQ ID NO: 196275 - DNA, 38 bp, Artificial Sequence
  Description of Artificial Sequence: Synthetic oligonucleotide
aaaggagaatacagaacgaatcctgaagacatctaccc

SEQ ID NO: 196276 - DNA, 37 bp, Artificial Sequence
  Description of Artificial Sequence: Synthetic oligonucleotide
aaggagaatacagaacgaatcctgaagacatctaccc

SEQ ID NO: 196277 - DNA, 36 bp, Artificial Sequence
  Description of Artificial Sequence: Synthetic oligonucleotide
aggagaatacagaacgaatcctgaagacatctaccc

SEQ ID NO: 196278 - DNA, 35 bp, Artificial Sequence
  Description of Artificial Sequence: Synthetic oligonucleotide
ggagaatacagaacgaatcctgaagacatctaccc

SEQ ID NO: 196279 - DNA, 35 bp, Artificial Sequence
  Description of Artificial Sequence: Synthetic oligonucleotide
gagaatacagaacgaatcctgaagacatctacccc

SEQ ID NO: 196280 - DNA, 36 bp, Artificial Sequence
  Description of Artificial Sequence: Synthetic oligonucleotide
agaatacagaacgaatcctgaagacatctaccccag

SEQ ID NO: 196281 - DNA, 35 bp, Artificial Sequence
  Description of Artificial Sequence: Synthetic oligonucleotide
gaatacagaacgaatcctgaagacatctaccccag

SEQ ID NO: 196282 - DNA, 35 bp, Artificial Sequence
  Description of Artificial Sequence: Synthetic oligonucleotide
aatacagaacgaatcctgaagacatctaccccagc

SEQ ID NO: 196283 - DNA, 34 bp, Artificial Sequence
  Description of Artificial Sequence: Synthetic oligonucleotide
atacagaacgaatcctgaagacatctaccccagc

SEQ ID NO: 196284 - DNA, 33 bp, Artificial Sequence
  Description of Artificial Sequence: Synthetic oligonucleotide
tacagaacgaatcctgaagacatctaccccagc

SEQ ID NO: 196285 - DNA, 32 bp, Artificial Sequence
  Description of Artificial Sequence: Synthetic oligonucleotide
acagaacgaatcctgaagacatctaccccagc

SEQ ID NO: 196286 - DNA, 31 bp, Artificial Sequence
  Description of Artificial Sequence: Synthetic oligonucleotide
cagaacgaatcctgaagacatctaccccagc

SEQ ID NO: 196287 - DNA, 33 bp, Artificial Sequence
  Description of Artificial Sequence: Synthetic oligonucleotide
agaacgaatcctgaagacatctaccccagcaac

SEQ ID NO: 196288 - DNA, 32 bp, Artificial Sequence
  Description of Artificial Sequence: Synthetic oligonucleotide
gaacgaatcctgaagacatctaccccagcaac

SEQ ID NO: 196289 - DNA, 32 bp, Artificial Sequence
  Description of Artificial Sequence: Synthetic oligonucleotide
aacgaatcctgaagacatctaccccagcaacc

SEQ ID NO: 196290 - DNA, 31 bp, Artificial Sequence
  Description of Artificial Sequence: Synthetic oligonucleotide
acgaatcctgaagacatctaccccagcaacc

SEQ ID NO: 196291 - DNA, 30 bp, Artificial Sequence
  Description of Artificial Sequence: Synthetic oligonucleotide
cgaatcctgaagacatctaccccagcaacc

SEQ ID NO: 196292 - DNA, 30 bp, Artificial Sequence
  Description of Artificial Sequence: Synthetic oligonucleotide
gaatcctgaagacatctaccccagcaaccc

SEQ ID NO: 196293 - DNA, 32 bp, Artificial Sequence
  Description of Artificial Sequence: Synthetic oligonucleotide
aatcctgaagacatctaccccagcaaccctac

SEQ ID NO: 196294 - DNA, 31 bp, Artificial Sequence
  Description of Artificial Sequence: Synthetic oligonucleotide
atcctgaagacatctaccccagcaaccctac

SEQ ID NO: 196295 - DNA, 30 bp, Artificial Sequence
  Description of Artificial Sequence: Synthetic oligonucleotide
tcctgaagacatctaccccagcaaccctac

SEQ ID NO: 196296 - DNA, 29 bp, Artificial Sequence
  Description of Artificial Sequence: Synthetic oligonucleotide
cctgaagacatctaccccagcaaccctac

SEQ ID NO: 196297 - DNA, 30 bp, Artificial Sequence
  Description of Artificial Sequence: Synthetic oligonucleotide
ctgaagacatctaccccagcaaccctactg

SEQ ID NO: 196298 - DNA, 32 bp, Artificial Sequence
  Description of Artificial Sequence: Synthetic oligonucleotide
tgaagacatctaccccagcaaccctactgatg

SEQ ID NO: 196299 - DNA, 31 bp, Artificial Sequence
  Description of Artificial Sequence: Synthetic oligonucleotide
gaagacatctaccccagcaaccctactgatg

SEQ ID NO: 196300 - DNA, 33 bp, Artificial Sequence
  Description of Artificial Sequence: Synthetic oligonucleotide
aagacatctaccccagcaaccctactgatgatg

SEQ ID NO: 196301 - DNA, 32 bp, Artificial Sequence
  Description of Artificial Sequence: Synthetic oligonucleotide
agacatctaccccagcaaccctactgatgatg

SEQ ID NO: 196302 - DNA, 31 bp, Artificial Sequence
  Description of Artificial Sequence: Synthetic oligonucleotide
gacatctaccccagcaaccctactgatgatg

SEQ ID NO: 196303 - DNA, 32 bp, Artificial Sequence
  Description of Artificial Sequence: Synthetic oligonucleotide
acatctaccccagcaaccctactgatgatgac

SEQ ID NO: 196304 - DNA, 31 bp, Artificial Sequence
  Description of Artificial Sequence: Synthetic oligonucleotide
catctaccccagcaaccctactgatgatgac

SEQ ID NO: 196305 - DNA, 31 bp, Artificial Sequence
  Description of Artificial Sequence: Synthetic oligonucleotide
atctaccccagcaaccctactgatgatgacg

SEQ ID NO: 196306 - DNA, 30 bp, Artificial Sequence
  Description of Artificial Sequence: Synthetic oligonucleotide
tctaccccagcaaccctactgatgatgacg

SEQ ID NO: 196307 - DNA, 29 bp, Artificial Sequence
  Description of Artificial Sequence: Synthetic oligonucleotide
ctaccccagcaaccctactgatgatgacg

SEQ ID NO: 196308 - DNA, 30 bp, Artificial Sequence
  Description of Artificial Sequence: Synthetic oligonucleotide
taccccagcaaccctactgatgatgacgtg

SEQ ID NO: 196309 - DNA, 29 bp, Artificial Sequence
  Description of Artificial Sequence: Synthetic oligonucleotide
accccagcaaccctactgatgatgacgtg

SEQ ID NO: 196310 - DNA, 28 bp, Artificial Sequence
  Description of Artificial Sequence: Synthetic oligonucleotide
ccccagcaaccctactgatgatgacgtg

SEQ ID NO: 196311 - DNA, 29 bp, Artificial Sequence
  Description of Artificial Sequence: Synthetic oligonucleotide
cccagcaaccctactgatgatgacgtgag

SEQ ID NO: 196312 - DNA, 29 bp, Artificial Sequence
  Description of Artificial Sequence: Synthetic oligonucleotide
ccagcaaccctactgatgatgacgtgagc

SEQ ID NO: 196313 - DNA, 30 bp, Artificial Sequence
  Description of Artificial Sequence: Synthetic oligonucleotide
cagcaaccctactgatgatgacgtgagcag

SEQ ID NO: 196314 - DNA, 30 bp, Artificial Sequence
  Description of Artificial Sequence: Synthetic oligonucleotide
agcaaccctactgatgatgacgtgagcagc

SEQ ID NO: 196315 - DNA, 29 bp, Artificial Sequence
  Description of Artificial Sequence: Synthetic oligonucleotide
gcaaccctactgatgatgacgtgagcagc

SEQ ID NO: 196316 - DNA, 29 bp, Artificial Sequence
  Description of Artificial Sequence: Synthetic oligonucleotide
caaccctactgatgatgacgtgagcagcg

SEQ ID NO: 196317 - DNA, 29 bp, Artificial Sequence
  Description of Artificial Sequence: Synthetic oligonucleotide
aaccctactgatgatgacgtgagcagcgg

SEQ ID NO: 196318 - DNA, 28 bp, Artificial Sequence
  Description of Artificial Sequence: Synthetic oligonucleotide
accctactgatgatgacgtgagcagcgg

SEQ ID NO: 196319 - DNA, 27 bp, Artificial Sequence
  Description of Artificial Sequence: Synthetic oligonucleotide
ccctactgatgatgacgtgagcagcgg

SEQ ID NO: 196320 - DNA, 27 bp, Artificial Sequence
  Description of Artificial Sequence: Synthetic oligonucleotide
cctactgatgatgacgtgagcagcggc

SEQ ID NO: 196321 - DNA, 28 bp, Artificial Sequence
  Description of Artificial Sequence: Synthetic oligonucleotide
ctactgatgatgacgtgagcagcggctc

SEQ ID NO: 196322 - DNA, 28 bp, Artificial Sequence
  Description of Artificial Sequence: Synthetic oligonucleotide
tactgatgatgacgtgagcagcggctcc

SEQ ID NO: 196323 - DNA, 27 bp, Artificial Sequence
  Description of Artificial Sequence: Synthetic oligonucleotide
actgatgatgacgtgagcagcggctcc

SEQ ID NO: 196324 - DNA, 27 bp, Artificial Sequence
  Description of Artificial Sequence: Synthetic oligonucleotide
ctgatgatgacgtgagcagcggctcct

SEQ ID NO: 196325 - DNA, 27 bp, Artificial Sequence
  Description of Artificial Sequence: Synthetic oligonucleotide
tgatgatgacgtgagcagcggctcctc

SEQ ID NO: 196326 - DNA, 26 bp, Artificial Sequence
  Description of Artificial Sequence: Synthetic oligonucleotide
gatgatgacgtgagcagcggctcctc

SEQ ID NO: 196327 - DNA, 27 bp, Artificial Sequence
  Description of Artificial Sequence: Synthetic oligonucleotide
atgatgacgtgagcagcggctcctcca

SEQ ID NO: 196328 - DNA, 26 bp, Artificial Sequence
  Description of Artificial Sequence: Synthetic oligonucleotide
tgatgacgtgagcagcggctcctcca

SEQ ID NO: 196329 - DNA, 25 bp, Artificial Sequence
  Description of Artificial Sequence: Synthetic oligonucleotide
gatgacgtgagcagcggctcctcca

SEQ ID NO: 196330 - DNA, 26 bp, Artificial Sequence
  Description of Artificial Sequence: Synthetic oligonucleotide
atgacgtgagcagcggctcctccagt

SEQ ID NO: 196331 - DNA, 25 bp, Artificial Sequence
  Description of Artificial Sequence: Synthetic oligonucleotide
tgacgtgagcagcggctcctccagt

SEQ ID NO: 196332 - DNA, 24 bp, Artificial Sequence
  Description of Artificial Sequence: Synthetic oligonucleotide
gacgtgagcagcggctcctccagt

SEQ ID NO: 196333 - DNA, 27 bp, Artificial Sequence
  Description of Artificial Sequence: Synthetic oligonucleotide
acgtgagcagcggctcctccagtgaaa

SEQ ID NO: 196334 - DNA, 26 bp, Artificial Sequence
  Description of Artificial Sequence: Synthetic oligonucleotide
cgtgagcagcggctcctccagtgaaa

SEQ ID NO: 196335 - DNA, 26 bp, Artificial Sequence
  Description of Artificial Sequence: Synthetic oligonucleotide
gtgagcagcggctcctccagtgaaag

SEQ ID NO: 196336 - DNA, 27 bp, Artificial Sequence
  Description of Artificial Sequence: Synthetic oligonucleotide
tgagcagcggctcctccagtgaaagga

SEQ ID NO: 196337 - DNA, 26 bp, Artificial Sequence
  Description of Artificial Sequence: Synthetic oligonucleotide
gagcagcggctcctccagtgaaagga

SEQ ID NO: 196338 - DNA, 26 bp, Artificial Sequence
  Description of Artificial Sequence: Synthetic oligonucleotide
agcagcggctcctccagtgaaaggag

SEQ ID NO: 196339 - DNA, 25 bp, Artificial Sequence
  Description of Artificial Sequence: Synthetic oligonucleotide
gcagcggctcctccagtgaaaggag

SEQ ID NO: 196340 - DNA, 26 bp, Artificial Sequence
  Description of Artificial Sequence: Synthetic oligonucleotide
cagcggctcctccagtgaaaggagca

SEQ ID NO: 196341 - DNA, 26 bp, Artificial Sequence
  Description of Artificial Sequence: Synthetic oligonucleotide
agcggctcctccagtgaaaggagcag

SEQ ID NO: 196342 - DNA, 25 bp, Artificial Sequence
  Description of Artificial Sequence: Synthetic oligonucleotide
gcggctcctccagtgaaaggagcag

SEQ ID NO: 196343 - DNA, 26 bp, Artificial Sequence
  Description of Artificial Sequence: Synthetic oligonucleotide
cggctcctccagtgaaaggagcagca

SEQ ID NO: 196344 - DNA, 27 bp, Artificial Sequence
  Description of Artificial Sequence: Synthetic oligonucleotide
ggctcctccagtgaaaggagcagcact

SEQ ID NO: 196345 - DNA, 28 bp, Artificial Sequence
  Description of Artificial Sequence: Synthetic oligonucleotide
gctcctccagtgaaaggagcagcacttc

SEQ ID NO: 196346 - DNA, 29 bp, Artificial Sequence
  Description of Artificial Sequence: Synthetic oligonucleotide
ctcctccagtgaaaggagcagcacttcag

SEQ ID NO: 196347 - DNA, 29 bp, Artificial Sequence
  Description of Artificial Sequence: Synthetic oligonucleotide
tcctccagtgaaaggagcagcacttcagg

SEQ ID NO: 196348 - DNA, 28 bp, Artificial Sequence
  Description of Artificial Sequence: Synthetic oligonucleotide
cctccagtgaaaggagcagcacttcagg

SEQ ID NO: 196349 - DNA, 29 bp, Artificial Sequence
  Description of Artificial Sequence: Synthetic oligonucleotide
ctccagtgaaaggagcagcacttcaggag

SEQ ID NO: 196350 - DNA, 29 bp, Artificial Sequence
  Description of Artificial Sequence: Synthetic oligonucleotide
tccagtgaaaggagcagcacttcaggagg

SEQ ID NO: 196351 - DNA, 28 bp, Artificial Sequence
  Description of Artificial Sequence: Synthetic oligonucleotide
ccagtgaaaggagcagcacttcaggagg

SEQ ID NO: 196352 - DNA, 31 bp, Artificial Sequence
  Description of Artificial Sequence: Synthetic oligonucleotide
cagtgaaaggagcagcacttcaggaggttac

SEQ ID NO: 196353 - DNA, 33 bp, Artificial Sequence
  Description of Artificial Sequence: Synthetic oligonucleotide
agtgaaaggagcagcacttcaggaggttacatc

SEQ ID NO: 196354 - DNA, 32 bp, Artificial Sequence
  Description of Artificial Sequence: Synthetic oligonucleotide
gtgaaaggagcagcacttcaggaggttacatc

SEQ ID NO: 196355 - DNA, 37 bp, Artificial Sequence
  Description of Artificial Sequence: Synthetic oligonucleotide
tgaaaggagcagcacttcaggaggttacatcttttac

SEQ ID NO: 196356 - DNA, 36 bp, Artificial Sequence
  Description of Artificial Sequence: Synthetic oligonucleotide
gaaaggagcagcacttcaggaggttacatcttttac

SEQ ID NO: 196357 - DNA, 37 bp, Artificial Sequence
  Description of Artificial Sequence: Synthetic oligonucleotide
aaaggagcagcacttcaggaggttacatcttttacac

SEQ ID NO: 196358 - DNA, 36 bp, Artificial Sequence
  Description of Artificial Sequence: Synthetic oligonucleotide
aaggagcagcacttcaggaggttacatcttttacac

SEQ ID NO: 196359 - DNA, 35 bp, Artificial Sequence
  Description of Artificial Sequence: Synthetic oligonucleotide
aggagcagcacttcaggaggttacatcttttacac

SEQ ID NO: 196360 - DNA, 34 bp, Artificial Sequence
  Description of Artificial Sequence: Synthetic oligonucleotide
ggagcagcacttcaggaggttacatcttttacac

SEQ ID NO: 196361 - DNA, 34 bp, Artificial Sequence
  Description of Artificial Sequence: Synthetic oligonucleotide
gagcagcacttcaggaggttacatcttttacacc

SEQ ID NO: 196362 - DNA, 38 bp, Artificial Sequence
  Description of Artificial Sequence: Synthetic oligonucleotide
agcagcacttcaggaggttacatcttttacaccttttc

SEQ ID NO: 196363 - DNA, 37 bp, Artificial Sequence
  Description of Artificial Sequence: Synthetic oligonucleotide
gcagcacttcaggaggttacatcttttacaccttttc

SEQ ID NO: 196364 - DNA, 39 bp, Artificial Sequence
  Description of Artificial Sequence: Synthetic oligonucleotide
cagcacttcaggaggttacatcttttacaccttttctac

SEQ ID NO: 196365 - DNA, 40 bp, Artificial Sequence
  Description of Artificial Sequence: Synthetic oligonucleotide
agcacttcaggaggttacatcttttacaccttttctactg

SEQ ID NO: 196366 - DNA, 39 bp, Artificial Sequence
  Description of Artificial Sequence: Synthetic oligonucleotide
gcacttcaggaggttacatcttttacaccttttctactg

SEQ ID NO: 196367 - DNA, 41 bp, Artificial Sequence
  Description of Artificial Sequence: Synthetic oligonucleotide
cacttcaggaggttacatcttttacaccttttctactgtac

SEQ ID NO: 196368 - DNA, 42 bp, Artificial Sequence
  Description of Artificial Sequence: Synthetic oligonucleotide
acttcaggaggttacatcttttacaccttttctactgtacac

SEQ ID NO: 196369 - DNA, 41 bp, Artificial Sequence
  Description of Artificial Sequence: Synthetic oligonucleotide
cttcaggaggttacatcttttacaccttttctactgtacac

SEQ ID NO: 196370 - DNA, 41 bp, Artificial Sequence
  Description of Artificial Sequence: Synthetic oligonucleotide
ttcaggaggttacatcttttacaccttttctactgtacacc

SEQ ID NO: 196371 - DNA, 40 bp, Artificial Sequence
  Description of Artificial Sequence: Synthetic oligonucleotide
tcaggaggttacatcttttacaccttttctactgtacacc

SEQ ID NO: 196372 - DNA, 39 bp, Artificial Sequence
  Description of Artificial Sequence: Synthetic oligonucleotide
caggaggttacatcttttacaccttttctactgtacacc

SEQ ID NO: 196373 - DNA, 39 bp, Artificial Sequence
  Description of Artificial Sequence: Synthetic oligonucleotide
aggaggttacatcttttacaccttttctactgtacaccc

SEQ ID NO: 196374 - DNA, 38 bp, Artificial Sequence
  Description of Artificial Sequence: Synthetic oligonucleotide
ggaggttacatcttttacaccttttctactgtacaccc

SEQ ID NO: 196375 - DNA, 38 bp, Artificial Sequence
  Description of Artificial Sequence: Synthetic oligonucleotide
gaggttacatcttttacaccttttctactgtacacccc

SEQ ID NO: 196376 - DNA, 40 bp, Artificial Sequence
  Description of Artificial Sequence: Synthetic oligonucleotide
aggttacatcttttacaccttttctactgtacaccccatc

SEQ ID NO: 196377 - DNA, 39 bp, Artificial Sequence
  Description of Artificial Sequence: Synthetic oligonucleotide
ggttacatcttttacaccttttctactgtacaccccatc

SEQ ID NO: 196378 - DNA, 39 bp, Artificial Sequence
  Description of Artificial Sequence: Synthetic oligonucleotide
gttacatcttttacaccttttctactgtacaccccatcc

SEQ ID NO: 196379 - DNA, 39 bp, Artificial Sequence
  Description of Artificial Sequence: Synthetic oligonucleotide
ttacatcttttacaccttttctactgtacaccccatccc

SEQ ID NO: 196380 - DNA, 38 bp, Artificial Sequence
  Description of Artificial Sequence: Synthetic oligonucleotide
tacatcttttacaccttttctactgtacaccccatccc

SEQ ID NO: 196381 - DNA, 37 bp, Artificial Sequence
  Description of Artificial Sequence: Synthetic oligonucleotide
acatcttttacaccttttctactgtacaccccatccc

SEQ ID NO: 196382 - DNA, 36 bp, Artificial Sequence
  Description of Artificial Sequence: Synthetic oligonucleotide
catcttttacaccttttctactgtacaccccatccc

SEQ ID NO: 196383 - DNA, 37 bp, Artificial Sequence
  Description of Artificial Sequence: Synthetic oligonucleotide
atcttttacaccttttctactgtacaccccatcccag

SEQ ID NO: 196384 - DNA, 36 bp, Artificial Sequence
  Description of Artificial Sequence: Synthetic oligonucleotide
tcttttacaccttttctactgtacaccccatcccag

SEQ ID NO: 196385 - DNA, 35 bp, Artificial Sequence
  Description of Artificial Sequence: Synthetic oligonucleotide
cttttacaccttttctactgtacaccccatcccag

SEQ ID NO: 196386 - DNA, 36 bp, Artificial Sequence
  Description of Artificial Sequence: Synthetic oligonucleotide
ttttacaccttttctactgtacaccccatcccagac

SEQ ID NO: 196387 - DNA, 35 bp, Artificial Sequence
  Description of Artificial Sequence: Synthetic oligonucleotide
tttacaccttttctactgtacaccccatcccagac

SEQ ID NO: 196388 - DNA, 34 bp, Artificial Sequence
  Description of Artificial Sequence: Synthetic oligonucleotide
ttacaccttttctactgtacaccccatcccagac

SEQ ID NO: 196389 - DNA, 33 bp, Artificial Sequence
  Description of Artificial Sequence: Synthetic oligonucleotide
tacaccttttctactgtacaccccatcccagac

SEQ ID NO: 196390 - DNA, 32 bp, Artificial Sequence
  Description of Artificial Sequence: Synthetic oligonucleotide
acaccttttctactgtacaccccatcccagac

SEQ ID NO: 196391 - DNA, 31 bp, Artificial Sequence
  Description of Artificial Sequence: Synthetic oligonucleotide
caccttttctactgtacaccccatcccagac

SEQ ID NO: 196392 - DNA, 31 bp, Artificial Sequence
  Description of Artificial Sequence: Synthetic oligonucleotide
accttttctactgtacaccccatcccagacg

SEQ ID NO: 196393 - DNA, 30 bp, Artificial Sequence
  Description of Artificial Sequence: Synthetic oligonucleotide
ccttttctactgtacaccccatcccagacg

SEQ ID NO: 196394 - DNA, 32 bp, Artificial Sequence
  Description of Artificial Sequence: Synthetic oligonucleotide
cttttctactgtacaccccatcccagacgaag

SEQ ID NO: 196395 - DNA, 33 bp, Artificial Sequence
  Description of Artificial Sequence: Synthetic oligonucleotide
ttttctactgtacaccccatcccagacgaagac

SEQ ID NO: 196396 - DNA, 32 bp, Artificial Sequence
  Description of Artificial Sequence: Synthetic oligonucleotide
tttctactgtacaccccatcccagacgaagac

SEQ ID NO: 196397 - DNA, 31 bp, Artificial Sequence
  Description of Artificial Sequence: Synthetic oligonucleotide
ttctactgtacaccccatcccagacgaagac

SEQ ID NO: 196398 - DNA, 30 bp, Artificial Sequence
  Description of Artificial Sequence: Synthetic oligonucleotide
tctactgtacaccccatcccagacgaagac

SEQ ID NO: 196399 - DNA, 29 bp, Artificial Sequence
  Description of Artificial Sequence: Synthetic oligonucleotide
ctactgtacaccccatcccagacgaagac

SEQ ID NO: 196400 - DNA, 30 bp, Artificial Sequence
  Description of Artificial Sequence: Synthetic oligonucleotide
tactgtacaccccatcccagacgaagacag

SEQ ID NO: 196401 - DNA, 29 bp, Artificial Sequence
  Description of Artificial Sequence: Synthetic oligonucleotide
actgtacaccccatcccagacgaagacag

SEQ ID NO: 196402 - DNA, 28 bp, Artificial Sequence
  Description of Artificial Sequence: Synthetic oligonucleotide
ctgtacaccccatcccagacgaagacag

SEQ ID NO: 196403 - DNA, 29 bp, Artificial Sequence
  Description of Artificial Sequence: Synthetic oligonucleotide
tgtacaccccatcccagacgaagacagtc

SEQ ID NO: 196404 - DNA, 28 bp, Artificial Sequence
  Description of Artificial Sequence: Synthetic oligonucleotide
gtacaccccatcccagacgaagacagtc

SEQ ID NO: 196405 - DNA, 28 bp, Artificial Sequence
  Description of Artificial Sequence: Synthetic oligonucleotide
tacaccccatcccagacgaagacagtcc

SEQ ID NO: 196406 - DNA, 27 bp, Artificial Sequence
  Description of Artificial Sequence: Synthetic oligonucleotide
acaccccatcccagacgaagacagtcc

SEQ ID NO: 196407 - DNA, 26 bp, Artificial Sequence
  Description of Artificial Sequence: Synthetic oligonucleotide
caccccatcccagacgaagacagtcc

SEQ ID NO: 196408 - DNA, 27 bp, Artificial Sequence
  Description of Artificial Sequence: Synthetic oligonucleotide
accccatcccagacgaagacagtccct

SEQ ID NO: 196409 - DNA, 26 bp, Artificial Sequence
  Description of Artificial Sequence: Synthetic oligonucleotide
ccccatcccagacgaagacagtccct

SEQ ID NO: 196410 - DNA, 26 bp, Artificial Sequence
  Description of Artificial Sequence: Synthetic oligonucleotide
cccatcccagacgaagacagtccctg

SEQ ID NO: 196411 - DNA, 27 bp, Artificial Sequence
  Description of Artificial Sequence: Synthetic oligonucleotide
ccatcccagacgaagacagtccctgga

SEQ ID NO: 196412 - DNA, 28 bp, Artificial Sequence
  Description of Artificial Sequence: Synthetic oligonucleotide
catcccagacgaagacagtccctggatc

SEQ ID NO: 196413 - DNA, 29 bp, Artificial Sequence
  Description of Artificial Sequence: Synthetic oligonucleotide
atcccagacgaagacagtccctggatcac

SEQ ID NO: 196414 - DNA, 28 bp, Artificial Sequence
  Description of Artificial Sequence: Synthetic oligonucleotide
tcccagacgaagacagtccctggatcac

SEQ ID NO: 196415 - DNA, 27 bp, Artificial Sequence
  Description of Artificial Sequence: Synthetic oligonucleotide
cccagacgaagacagtccctggatcac

SEQ ID NO: 196416 - DNA, 27 bp, Artificial Sequence
  Description of Artificial Sequence: Synthetic oligonucleotide
ccagacgaagacagtccctggatcacc

SEQ ID NO: 196417 - DNA, 27 bp, Artificial Sequence
  Description of Artificial Sequence: Synthetic oligonucleotide
cagacgaagacagtccctggatcaccg

SEQ ID NO: 196418 - DNA, 28 bp, Artificial Sequence
  Description of Artificial Sequence: Synthetic oligonucleotide
agacgaagacagtccctggatcaccgac

SEQ ID NO: 196419 - DNA, 27 bp, Artificial Sequence
  Description of Artificial Sequence: Synthetic oligonucleotide
gacgaagacagtccctggatcaccgac

SEQ ID NO: 196420 - DNA, 28 bp, Artificial Sequence
  Description of Artificial Sequence: Synthetic oligonucleotide
acgaagacagtccctggatcaccgacag

SEQ ID NO: 196421 - DNA, 27 bp, Artificial Sequence
  Description of Artificial Sequence: Synthetic oligonucleotide
cgaagacagtccctggatcaccgacag

SEQ ID NO: 196422 - DNA, 27 bp, Artificial Sequence
  Description of Artificial Sequence: Synthetic oligonucleotide
gaagacagtccctggatcaccgacagc

SEQ ID NO: 196423 - DNA, 28 bp, Artificial Sequence
  Description of Artificial Sequence: Synthetic oligonucleotide
aagacagtccctggatcaccgacagcac

SEQ ID NO: 196424 - DNA, 27 bp, Artificial Sequence
  Description of Artificial Sequence: Synthetic oligonucleotide
agacagtccctggatcaccgacagcac

SEQ ID NO: 196425 - DNA, 27 bp, Artificial Sequence
  Description of Artificial Sequence: Synthetic oligonucleotide
gacagtccctggatcaccgacagcaca

SEQ ID NO: 196426 - DNA, 27 bp, Artificial Sequence
  Description of Artificial Sequence: Synthetic oligonucleotide
acagtccctggatcaccgacagcacag

SEQ ID NO: 196427 - DNA, 27 bp, Artificial Sequence
  Description of Artificial Sequence: Synthetic oligonucleotide
cagtccctggatcaccgacagcacaga

SEQ ID NO: 196428 - DNA, 27 bp, Artificial Sequence
  Description of Artificial Sequence: Synthetic oligonucleotide
agtccctggatcaccgacagcacagac

SEQ ID NO: 196429 - DNA, 27 bp, Artificial Sequence
  Description of Artificial Sequence: Synthetic oligonucleotide
gtccctggatcaccgacagcacagaca

SEQ ID NO: 196430 - DNA, 27 bp, Artificial Sequence
  Description of Artificial Sequence: Synthetic oligonucleotide
tccctggatcaccgacagcacagacag

SEQ ID NO: 196431 - DNA, 27 bp, Artificial Sequence
  Description of Artificial Sequence: Synthetic oligonucleotide
ccctggatcaccgacagcacagacaga

SEQ ID NO: 196432 - DNA, 29 bp, Artificial Sequence
  Description of Artificial Sequence: Synthetic oligonucleotide
cctggatcaccgacagcacagacagaatc

SEQ ID NO: 196433 - DNA, 29 bp, Artificial Sequence
  Description of Artificial Sequence: Synthetic oligonucleotide
ctggatcaccgacagcacagacagaatcc

SEQ ID NO: 196434 - DNA, 29 bp, Artificial Sequence
  Description of Artificial Sequence: Synthetic oligonucleotide
tggatcaccgacagcacagacagaatccc

SEQ ID NO: 196435 - DNA, 28 bp, Artificial Sequence
  Description of Artificial Sequence: Synthetic oligonucleotide
ggatcaccgacagcacagacagaatccc

SEQ ID NO: 196436 - DNA, 29 bp, Artificial Sequence
  Description of Artificial Sequence: Synthetic oligonucleotide
gatcaccgacagcacagacagaatccctg

SEQ ID NO: 196437 - DNA, 29 bp, Artificial Sequence
  Description of Artificial Sequence: Synthetic oligonucleotide
atcaccgacagcacagacagaatccctgc

SEQ ID NO: 196438 - DNA, 28 bp, Artificial Sequence
  Description of Artificial Sequence: Synthetic oligonucleotide
tcaccgacagcacagacagaatccctgc

SEQ ID NO: 196439 - DNA, 27 bp, Artificial Sequence
  Description of Artificial Sequence: Synthetic oligonucleotide
caccgacagcacagacagaatccctgc

SEQ ID NO: 196440 - DNA, 29 bp, Artificial Sequence
  Description of Artificial Sequence: Synthetic oligonucleotide
accgacagcacagacagaatccctgctac

SEQ ID NO: 196441 - DNA, 28 bp, Artificial Sequence
  Description of Artificial Sequence: Synthetic oligonucleotide
ccgacagcacagacagaatccctgctac

SEQ ID NO: 196442 - DNA, 28 bp, Artificial Sequence
  Description of Artificial Sequence: Synthetic oligonucleotide
cgacagcacagacagaatccctgctacc

SEQ ID NO: 196443 - DNA, 29 bp, Artificial Sequence
  Description of Artificial Sequence: Synthetic oligonucleotide
gacagcacagacagaatccctgctaccac

SEQ ID NO: 196444 - DNA, 32 bp, Artificial Sequence
  Description of Artificial Sequence: Synthetic oligonucleotide
acagcacagacagaatccctgctaccactttg

SEQ ID NO: 196445 - DNA, 31 bp, Artificial Sequence
  Description of Artificial Sequence: Synthetic oligonucleotide
cagcacagacagaatccctgctaccactttg

SEQ ID NO: 196446 - DNA, 33 bp, Artificial Sequence
  Description of Artificial Sequence: Synthetic oligonucleotide
agcacagacagaatccctgctaccactttgatg

SEQ ID NO: 196447 - DNA, 32 bp, Artificial Sequence
  Description of Artificial Sequence: Synthetic oligonucleotide
gcacagacagaatccctgctaccactttgatg

SEQ ID NO: 196448 - DNA, 33 bp, Artificial Sequence
  Description of Artificial Sequence: Synthetic oligonucleotide
cacagacagaatccctgctaccactttgatgag

SEQ ID NO: 196449 - DNA, 33 bp, Artificial Sequence
  Description of Artificial Sequence: Synthetic oligonucleotide
acagacagaatccctgctaccactttgatgagc

SEQ ID NO: 196450 - DNA, 32 bp, Artificial Sequence
  Description of Artificial Sequence: Synthetic oligonucleotide
cagacagaatccctgctaccactttgatgagc

SEQ ID NO: 196451 - DNA, 33 bp, Artificial Sequence
  Description of Artificial Sequence: Synthetic oligonucleotide
agacagaatccctgctaccactttgatgagcac

SEQ ID NO: 196452 - DNA, 32 bp, Artificial Sequence
  Description of Artificial Sequence: Synthetic oligonucleotide
gacagaatccctgctaccactttgatgagcac

SEQ ID NO: 196453 - DNA, 34 bp, Artificial Sequence
  Description of Artificial Sequence: Synthetic oligonucleotide
acagaatccctgctaccactttgatgagcactag

SEQ ID NO: 196454 - DNA, 33 bp, Artificial Sequence
  Description of Artificial Sequence: Synthetic oligonucleotide
cagaatccctgctaccactttgatgagcactag

SEQ ID NO: 196455 - DNA, 34 bp, Artificial Sequence
  Description of Artificial Sequence: Synthetic oligonucleotide
agaatccctgctaccactttgatgagcactagtg

SEQ ID NO: 196456 - DNA, 33 bp, Artificial Sequence
  Description of Artificial Sequence: Synthetic oligonucleotide
gaatccctgctaccactttgatgagcactagtg

SEQ ID NO: 196457 - DNA, 33 bp, Artificial Sequence
  Description of Artificial Sequence: Synthetic oligonucleotide
aatccctgctaccactttgatgagcactagtgc

SEQ ID NO: 196458 - DNA, 32 bp, Artificial Sequence
  Description of Artificial Sequence: Synthetic oligonucleotide
atccctgctaccactttgatgagcactagtgc

SEQ ID NO: 196459 - DNA, 31 bp, Artificial Sequence
  Description of Artificial Sequence: Synthetic oligonucleotide
tccctgctaccactttgatgagcactagtgc

SEQ ID NO: 196460 - DNA, 30 bp, Artificial Sequence
  Description of Artificial Sequence: Synthetic oligonucleotide
ccctgctaccactttgatgagcactagtgc

SEQ ID NO: 196461 - DNA, 32 bp, Artificial Sequence
  Description of Artificial Sequence: Synthetic oligonucleotide
cctgctaccactttgatgagcactagtgctac

SEQ ID NO: 196462 - DNA, 33 bp, Artificial Sequence
  Description of Artificial Sequence: Synthetic oligonucleotide
ctgctaccactttgatgagcactagtgctacag

SEQ ID NO: 196463 - DNA, 33 bp, Artificial Sequence
  Description of Artificial Sequence: Synthetic oligonucleotide
tgctaccactttgatgagcactagtgctacagc

SEQ ID NO: 196464 - DNA, 32 bp, Artificial Sequence
  Description of Artificial Sequence: Synthetic oligonucleotide
gctaccactttgatgagcactagtgctacagc

SEQ ID NO: 196465 - DNA, 34 bp, Artificial Sequence
  Description of Artificial Sequence: Synthetic oligonucleotide
ctaccactttgatgagcactagtgctacagcaac

SEQ ID NO: 196466 - DNA, 35 bp, Artificial Sequence
  Description of Artificial Sequence: Synthetic oligonucleotide
taccactttgatgagcactagtgctacagcaactg

SEQ ID NO: 196467 - DNA, 34 bp, Artificial Sequence
  Description of Artificial Sequence: Synthetic oligonucleotide
accactttgatgagcactagtgctacagcaactg

SEQ ID NO: 196468 - DNA, 33 bp, Artificial Sequence
  Description of Artificial Sequence: Synthetic oligonucleotide
ccactttgatgagcactagtgctacagcaactg

SEQ ID NO: 196469 - DNA, 34 bp, Artificial Sequence
  Description of Artificial Sequence: Synthetic oligonucleotide
cactttgatgagcactagtgctacagcaactgag

SEQ ID NO: 196470 - DNA, 35 bp, Artificial Sequence
  Description of Artificial Sequence: Synthetic oligonucleotide
actttgatgagcactagtgctacagcaactgagac

SEQ ID NO: 196471 - DNA, 34 bp, Artificial Sequence
  Description of Artificial Sequence: Synthetic oligonucleotide
ctttgatgagcactagtgctacagcaactgagac

SEQ ID NO: 196472 - DNA, 35 bp, Artificial Sequence
  Description of Artificial Sequence: Synthetic oligonucleotide
tttgatgagcactagtgctacagcaactgagacag

SEQ ID NO: 196473 - DNA, 34 bp, Artificial Sequence
  Description of Artificial Sequence: Synthetic oligonucleotide
ttgatgagcactagtgctacagcaactgagacag

SEQ ID NO: 196474 - DNA, 33 bp, Artificial Sequence
  Description of Artificial Sequence: Synthetic oligonucleotide
tgatgagcactagtgctacagcaactgagacag

SEQ ID NO: 196475 - DNA, 32 bp, Artificial Sequence
  Description of Artificial Sequence: Synthetic oligonucleotide
gatgagcactagtgctacagcaactgagacag

SEQ ID NO: 196476 - DNA, 32 bp, Artificial Sequence
  Description of Artificial Sequence: Synthetic oligonucleotide
atgagcactagtgctacagcaactgagacagc

SEQ ID NO: 196477 - DNA, 31 bp, Artificial Sequence
  Description of Artificial Sequence: Synthetic oligonucleotide
tgagcactagtgctacagcaactgagacagc

SEQ ID NO: 196478 - DNA, 30 bp, Artificial Sequence
  Description of Artificial Sequence: Synthetic oligonucleotide
gagcactagtgctacagcaactgagacagc

SEQ ID NO: 196479 - DNA, 32 bp, Artificial Sequence
  Description of Artificial Sequence: Synthetic oligonucleotide
agcactagtgctacagcaactgagacagcaac

SEQ ID NO: 196480 - DNA, 31 bp, Artificial Sequence
  Description of Artificial Sequence: Synthetic oligonucleotide
gcactagtgctacagcaactgagacagcaac

SEQ ID NO: 196481 - DNA, 31 bp, Artificial Sequence
  Description of Artificial Sequence: Synthetic oligonucleotide
cactagtgctacagcaactgagacagcaacc

SEQ ID NO: 196482 - DNA, 33 bp, Artificial Sequence
  Description of Artificial Sequence: Synthetic oligonucleotide
actagtgctacagcaactgagacagcaaccaag

SEQ ID NO: 196483 - DNA, 32 bp, Artificial Sequence
  Description of Artificial Sequence: Synthetic oligonucleotide
ctagtgctacagcaactgagacagcaaccaag

SEQ ID NO: 196484 - DNA, 33 bp, Artificial Sequence
  Description of Artificial Sequence: Synthetic oligonucleotide
tagtgctacagcaactgagacagcaaccaagag

SEQ ID NO: 196485 - DNA, 32 bp, Artificial Sequence
  Description of Artificial Sequence: Synthetic oligonucleotide
agtgctacagcaactgagacagcaaccaagag

SEQ ID NO: 196486 - DNA, 31 bp, Artificial Sequence
  Description of Artificial Sequence: Synthetic oligonucleotide
gtgctacagcaactgagacagcaaccaagag

SEQ ID NO: 196487 - DNA, 31 bp, Artificial Sequence
  Description of Artificial Sequence: Synthetic oligonucleotide
tgctacagcaactgagacagcaaccaagagg

SEQ ID NO: 196488 - DNA, 30 bp, Artificial Sequence
  Description of Artificial Sequence: Synthetic oligonucleotide
gctacagcaactgagacagcaaccaagagg

SEQ ID NO: 196489 - DNA, 30 bp, Artificial Sequence
  Description of Artificial Sequence: Synthetic oligonucleotide
ctacagcaactgagacagcaaccaagaggc

SEQ ID NO: 196490 - DNA, 32 bp, Artificial Sequence
  Description of Artificial Sequence: Synthetic oligonucleotide
tacagcaactgagacagcaaccaagaggcaag

SEQ ID NO: 196491 - DNA, 31 bp, Artificial Sequence
  Description of Artificial Sequence: Synthetic oligonucleotide
acagcaactgagacagcaaccaagaggcaag

SEQ ID NO: 196492 - DNA, 30 bp, Artificial Sequence
  Description of Artificial Sequence: Synthetic oligonucleotide
cagcaactgagacagcaaccaagaggcaag

SEQ ID NO: 196493 - DNA, 33 bp, Artificial Sequence
  Description of Artificial Sequence: Synthetic oligonucleotide
agcaactgagacagcaaccaagaggcaagaaac

SEQ ID NO: 196494 - DNA, 32 bp, Artificial Sequence
  Description of Artificial Sequence: Synthetic oligonucleotide
gcaactgagacagcaaccaagaggcaagaaac

SEQ ID NO: 196495 - DNA, 32 bp, Artificial Sequence
  Description of Artificial Sequence: Synthetic oligonucleotide
caactgagacagcaaccaagaggcaagaaacc

SEQ ID NO: 196496 - DNA, 33 bp, Artificial Sequence
  Description of Artificial Sequence: Synthetic oligonucleotide
aactgagacagcaaccaagaggcaagaaacctg

SEQ ID NO: 196497 - DNA, 32 bp, Artificial Sequence
  Description of Artificial Sequence: Synthetic oligonucleotide
actgagacagcaaccaagaggcaagaaacctg

SEQ ID NO: 196498 - DNA, 31 bp, Artificial Sequence
  Description of Artificial Sequence: Synthetic oligonucleotide
ctgagacagcaaccaagaggcaagaaacctg

SEQ ID NO: 196499 - DNA, 31 bp, Artificial Sequence
  Description of Artificial Sequence: Synthetic oligonucleotide
tgagacagcaaccaagaggcaagaaacctgg

SEQ ID NO: 196500 - DNA, 30 bp, Artificial Sequence
  Description of Artificial Sequence: Synthetic oligonucleotide
gagacagcaaccaagaggcaagaaacctgg

SEQ ID NO: 196501 - DNA, 30 bp, Artificial Sequence
  Description of Artificial Sequence: Synthetic oligonucleotide
agacagcaaccaagaggcaagaaacctggg

SEQ ID NO: 196502 - DNA, 29 bp, Artificial Sequence
  Description of Artificial Sequence: Synthetic oligonucleotide
gacagcaaccaagaggcaagaaacctggg

SEQ ID NO: 196503 - DNA, 32 bp, Artificial Sequence
  Description of Artificial Sequence: Synthetic oligonucleotide
acagcaaccaagaggcaagaaacctgggattg

SEQ ID NO: 196504 - DNA, 31 bp, Artificial Sequence
  Description of Artificial Sequence: Synthetic oligonucleotide
cagcaaccaagaggcaagaaacctgggattg

SEQ ID NO: 196505 - DNA, 31 bp, Artificial Sequence
  Description of Artificial Sequence: Synthetic oligonucleotide
agcaaccaagaggcaagaaacctgggattgg

SEQ ID NO: 196506 - DNA, 30 bp, Artificial Sequence
  Description of Artificial Sequence: Synthetic oligonucleotide
gcaaccaagaggcaagaaacctgggattgg

SEQ ID NO: 196507 - DNA, 34 bp, Artificial Sequence
  Description of Artificial Sequence: Synthetic oligonucleotide
caaccaagaggcaagaaacctgggattggttttc

SEQ ID NO: 196508 - DNA, 36 bp, Artificial Sequence
  Description of Artificial Sequence: Synthetic oligonucleotide
aaccaagaggcaagaaacctgggattggttttcatg

SEQ ID NO: 196509 - DNA, 35 bp, Artificial Sequence
  Description of Artificial Sequence: Synthetic oligonucleotide
accaagaggcaagaaacctgggattggttttcatg

SEQ ID NO: 196510 - DNA, 34 bp, Artificial Sequence
  Description of Artificial Sequence: Synthetic oligonucleotide
ccaagaggcaagaaacctgggattggttttcatg

SEQ ID NO: 196511 - DNA, 34 bp, Artificial Sequence
  Description of Artificial Sequence: Synthetic oligonucleotide
caagaggcaagaaacctgggattggttttcatgg

SEQ ID NO: 196512 - DNA, 36 bp, Artificial Sequence
  Description of Artificial Sequence: Synthetic oligonucleotide
aagaggcaagaaacctgggattggttttcatggttg

SEQ ID NO: 196513 - DNA, 35 bp, Artificial Sequence
  Description of Artificial Sequence: Synthetic oligonucleotide
agaggcaagaaacctgggattggttttcatggttg

SEQ ID NO: 196514 - DNA, 34 bp, Artificial Sequence
  Description of Artificial Sequence: Synthetic oligonucleotide
gaggcaagaaacctgggattggttttcatggttg

SEQ ID NO: 196515 - DNA, 37 bp, Artificial Sequence
  Description of Artificial Sequence: Synthetic oligonucleotide
aggcaagaaacctgggattggttttcatggttgtttc

SEQ ID NO: 196516 - DNA, 36 bp, Artificial Sequence
  Description of Artificial Sequence: Synthetic oligonucleotide
ggcaagaaacctgggattggttttcatggttgtttc

SEQ ID NO: 196517 - DNA, 38 bp, Artificial Sequence
  Description of Artificial Sequence: Synthetic oligonucleotide
gcaagaaacctgggattggttttcatggttgtttctac

SEQ ID NO: 196518 - DNA, 38 bp, Artificial Sequence
  Description of Artificial Sequence: Synthetic oligonucleotide
caagaaacctgggattggttttcatggttgtttctacc

SEQ ID NO: 196519 - DNA, 40 bp, Artificial Sequence
  Description of Artificial Sequence: Synthetic oligonucleotide
aagaaacctgggattggttttcatggttgtttctaccatc

SEQ ID NO: 196520 - DNA, 39 bp, Artificial Sequence
  Description of Artificial Sequence: Synthetic oligonucleotide
agaaacctgggattggttttcatggttgtttctaccatc

SEQ ID NO: 196521 - DNA, 38 bp, Artificial Sequence
  Description of Artificial Sequence: Synthetic oligonucleotide
gaaacctgggattggttttcatggttgtttctaccatc

SEQ ID NO: 196522 - DNA, 39 bp, Artificial Sequence
  Description of Artificial Sequence: Synthetic oligonucleotide
aaacctgggattggttttcatggttgtttctaccatcag

SEQ ID NO: 196523 - DNA, 38 bp, Artificial Sequence
  Description of Artificial Sequence: Synthetic oligonucleotide
aacctgggattggttttcatggttgtttctaccatcag

SEQ ID NO: 196524 - DNA, 37 bp, Artificial Sequence
  Description of Artificial Sequence: Synthetic oligonucleotide
acctgggattggttttcatggttgtttctaccatcag

SEQ ID NO: 196525 - DNA, 36 bp, Artificial Sequence
  Description of Artificial Sequence: Synthetic oligonucleotide
cctgggattggttttcatggttgtttctaccatcag

SEQ ID NO: 196526 - DNA, 37 bp, Artificial Sequence
  Description of Artificial Sequence: Synthetic oligonucleotide
ctgggattggttttcatggttgtttctaccatcagag

SEQ ID NO: 196527 - DNA, 38 bp, Artificial Sequence
  Description of Artificial Sequence: Synthetic oligonucleotide
tgggattggttttcatggttgtttctaccatcagagtc

SEQ ID NO: 196528 - DNA, 37 bp, Artificial Sequence
  Description of Artificial Sequence: Synthetic oligonucleotide
gggattggttttcatggttgtttctaccatcagagtc

SEQ ID NO: 196529 - DNA, 40 bp, Artificial Sequence
  Description of Artificial Sequence: Synthetic oligonucleotide
ggattggttttcatggttgtttctaccatcagagtcaaag

SEQ ID NO: 196530 - DNA, 43 bp, Artificial Sequence
  Description of Artificial Sequence: Synthetic oligonucleotide
gattggttttcatggttgtttctaccatcagagtcaaagaatc

SEQ ID NO: 196531 - DNA, 45 bp, Artificial Sequence
  Description of Artificial Sequence: Synthetic oligonucleotide
attggttttcatggttgtttctaccatcagagtcaaagaatcatc

SEQ ID NO: 196532 - DNA, 44 bp, Artificial Sequence
  Description of Artificial Sequence: Synthetic oligonucleotide
ttggttttcatggttgtttctaccatcagagtcaaagaatcatc

SEQ ID NO: 196533 - DNA, 43 bp, Artificial Sequence
  Description of Artificial Sequence: Synthetic oligonucleotide
tggttttcatggttgtttctaccatcagagtcaaagaatcatc

SEQ ID NO: 196534 - DNA, 42 bp, Artificial Sequence
  Description of Artificial Sequence: Synthetic oligonucleotide
ggttttcatggttgtttctaccatcagagtcaaagaatcatc

SEQ ID NO: 196535 - DNA, 44 bp, Artificial Sequence
  Description of Artificial Sequence: Synthetic oligonucleotide
gttttcatggttgtttctaccatcagagtcaaagaatcatcttc

SEQ ID NO: 196536 - DNA, 45 bp, Artificial Sequence
  Description of Artificial Sequence: Synthetic oligonucleotide
ttttcatggttgtttctaccatcagagtcaaagaatcatcttcac

SEQ ID NO: 196537 - DNA, 44 bp, Artificial Sequence
  Description of Artificial Sequence: Synthetic oligonucleotide
tttcatggttgtttctaccatcagagtcaaagaatcatcttcac

SEQ ID NO: 196538 - DNA, 43 bp, Artificial Sequence
  Description of Artificial Sequence: Synthetic oligonucleotide
ttcatggttgtttctaccatcagagtcaaagaatcatcttcac

SEQ ID NO: 196539 - DNA, 42 bp, Artificial Sequence
  Description of Artificial Sequence: Synthetic oligonucleotide
tcatggttgtttctaccatcagagtcaaagaatcatcttcac

SEQ ID NO: 196540 - DNA, 41 bp, Artificial Sequence
  Description of Artificial Sequence: Synthetic oligonucleotide
catggttgtttctaccatcagagtcaaagaatcatcttcac

SEQ ID NO: 196541 - DNA, 42 bp, Artificial Sequence
  Description of Artificial Sequence: Synthetic oligonucleotide
atggttgtttctaccatcagagtcaaagaatcatcttcacac

SEQ ID NO: 196542 - DNA, 41 bp, Artificial Sequence
  Description of Artificial Sequence: Synthetic oligonucleotide
tggttgtttctaccatcagagtcaaagaatcatcttcacac

SEQ ID NO: 196543 - DNA, 40 bp, Artificial Sequence
  Description of Artificial Sequence: Synthetic oligonucleotide
ggttgtttctaccatcagagtcaaagaatcatcttcacac

SEQ ID NO: 196544 - DNA, 42 bp, Artificial Sequence
  Description of Artificial Sequence: Synthetic oligonucleotide
gttgtttctaccatcagagtcaaagaatcatcttcacacaac

SEQ ID NO: 196545 - DNA, 44 bp, Artificial Sequence
  Description of Artificial Sequence: Synthetic oligonucleotide
ttgtttctaccatcagagtcaaagaatcatcttcacacaacaac

SEQ ID NO: 196546 - DNA, 43 bp, Artificial Sequence
  Description of Artificial Sequence: Synthetic oligonucleotide
tgtttctaccatcagagtcaaagaatcatcttcacacaacaac

SEQ ID NO: 196547 - DNA, 42 bp, Artificial Sequence
  Description of Artificial Sequence: Synthetic oligonucleotide
gtttctaccatcagagtcaaagaatcatcttcacacaacaac

SEQ ID NO: 196548 - DNA, 43 bp, Artificial Sequence
  Description of Artificial Sequence: Synthetic oligonucleotide
tttctaccatcagagtcaaagaatcatcttcacacaacaacac

SEQ ID NO: 196549 - DNA, 42 bp, Artificial Sequence
  Description of Artificial Sequence: Synthetic oligonucleotide
ttctaccatcagagtcaaagaatcatcttcacacaacaacac

SEQ ID NO: 196550 - DNA, 41 bp, Artificial Sequence
  Description of Artificial Sequence: Synthetic oligonucleotide
tctaccatcagagtcaaagaatcatcttcacacaacaacac

SEQ ID NO: 196551 - DNA, 40 bp, Artificial Sequence
  Description of Artificial Sequence: Synthetic oligonucleotide
ctaccatcagagtcaaagaatcatcttcacacaacaacac

SEQ ID NO: 196552 - DNA, 44 bp, Artificial Sequence
  Description of Artificial Sequence: Synthetic oligonucleotide
taccatcagagtcaaagaatcatcttcacacaacaacacaaatg

SEQ ID NO: 196553 - DNA, 43 bp, Artificial Sequence
  Description of Artificial Sequence: Synthetic oligonucleotide
accatcagagtcaaagaatcatcttcacacaacaacacaaatg

SEQ ID NO: 196554 - DNA, 42 bp, Artificial Sequence
  Description of Artificial Sequence: Synthetic oligonucleotide
ccatcagagtcaaagaatcatcttcacacaacaacacaaatg

SEQ ID NO: 196555 - DNA, 42 bp, Artificial Sequence
  Description of Artificial Sequence: Synthetic oligonucleotide
catcagagtcaaagaatcatcttcacacaacaacacaaatgg

SEQ ID NO: 196556 - DNA, 42 bp, Artificial Sequence
  Description of Artificial Sequence: Synthetic oligonucleotide
atcagagtcaaagaatcatcttcacacaacaacacaaatggc

SEQ ID NO: 196557 - DNA, 41 bp, Artificial Sequence
  Description of Artificial Sequence: Synthetic oligonucleotide
tcagagtcaaagaatcatcttcacacaacaacacaaatggc

SEQ ID NO: 196558 - DNA, 40 bp, Artificial Sequence
  Description of Artificial Sequence: Synthetic oligonucleotide
cagagtcaaagaatcatcttcacacaacaacacaaatggc

SEQ ID NO: 196559 - DNA, 41 bp, Artificial Sequence
  Description of Artificial Sequence: Synthetic oligonucleotide
agagtcaaagaatcatcttcacacaacaacacaaatggctg

SEQ ID NO: 196560 - DNA, 40 bp, Artificial Sequence
  Description of Artificial Sequence: Synthetic oligonucleotide
gagtcaaagaatcatcttcacacaacaacacaaatggctg

SEQ ID NO: 196561 - DNA, 40 bp, Artificial Sequence
  Description of Artificial Sequence: Synthetic oligonucleotide
agtcaaagaatcatcttcacacaacaacacaaatggctgg

SEQ ID NO: 196562 - DNA, 39 bp, Artificial Sequence
  Description of Artificial Sequence: Synthetic oligonucleotide
gtcaaagaatcatcttcacacaacaacacaaatggctgg

SEQ ID NO: 196563 - DNA, 41 bp, Artificial Sequence
  Description of Artificial Sequence: Synthetic oligonucleotide
tcaaagaatcatcttcacacaacaacacaaatggctggtac

SEQ ID NO: 196564 - DNA, 40 bp, Artificial Sequence
  Description of Artificial Sequence: Synthetic oligonucleotide
caaagaatcatcttcacacaacaacacaaatggctggtac

SEQ ID NO: 196565 - DNA, 40 bp, Artificial Sequence
  Description of Artificial Sequence: Synthetic oligonucleotide
aaagaatcatcttcacacaacaacacaaatggctggtacg

SEQ ID NO: 196566 - DNA, 39 bp, Artificial Sequence
  Description of Artificial Sequence: Synthetic oligonucleotide
aagaatcatcttcacacaacaacacaaatggctggtacg

SEQ ID NO: 196567 - DNA, 38 bp, Artificial Sequence
  Description of Artificial Sequence: Synthetic oligonucleotide
agaatcatcttcacacaacaacacaaatggctggtacg

SEQ ID NO: 196568 - DNA, 37 bp, Artificial Sequence
  Description of Artificial Sequence: Synthetic oligonucleotide
gaatcatcttcacacaacaacacaaatggctggtacg

SEQ ID NO: 196569 - DNA, 38 bp, Artificial Sequence
  Description of Artificial Sequence: Synthetic oligonucleotide
aatcatcttcacacaacaacacaaatggctggtacgtc

SEQ ID NO: 196570 - DNA, 37 bp, Artificial Sequence
  Description of Artificial Sequence: Synthetic oligonucleotide
atcatcttcacacaacaacacaaatggctggtacgtc

SEQ ID NO: 196571 - DNA, 36 bp, Artificial Sequence
  Description of Artificial Sequence: Synthetic oligonucleotide
tcatcttcacacaacaacacaaatggctggtacgtc

SEQ ID NO: 196572 - DNA, 35 bp, Artificial Sequence
  Description of Artificial Sequence: Synthetic oligonucleotide
catcttcacacaacaacacaaatggctggtacgtc

SEQ ID NO: 196573 - DNA, 37 bp, Artificial Sequence
  Description of Artificial Sequence: Synthetic oligonucleotide
atcttcacacaacaacacaaatggctggtacgtcttc

SEQ ID NO: 196574 - DNA, 36 bp, Artificial Sequence
  Description of Artificial Sequence: Synthetic oligonucleotide
tcttcacacaacaacacaaatggctggtacgtcttc

SEQ ID NO: 196575 - DNA, 35 bp, Artificial Sequence
  Description of Artificial Sequence: Synthetic oligonucleotide
cttcacacaacaacacaaatggctggtacgtcttc

SEQ ID NO: 196576 - DNA, 40 bp, Artificial Sequence
  Description of Artificial Sequence: Synthetic oligonucleotide
ttcacacaacaacacaaatggctggtacgtcttcaaatac

SEQ ID NO: 196577 - DNA, 39 bp, Artificial Sequence
  Description of Artificial Sequence: Synthetic oligonucleotide
tcacacaacaacacaaatggctggtacgtcttcaaatac

SEQ ID NO: 196578 - DNA, 38 bp, Artificial Sequence
  Description of Artificial Sequence: Synthetic oligonucleotide
cacacaacaacacaaatggctggtacgtcttcaaatac

SEQ ID NO: 196579 - DNA, 38 bp, Artificial Sequence
  Description of Artificial Sequence: Synthetic oligonucleotide
acacaacaacacaaatggctggtacgtcttcaaatacc

SEQ ID NO: 196580 - DNA, 37 bp, Artificial Sequence
  Description of Artificial Sequence: Synthetic oligonucleotide
cacaacaacacaaatggctggtacgtcttcaaatacc

SEQ ID NO: 196581 - DNA, 39 bp, Artificial Sequence
  Description of Artificial Sequence: Synthetic oligonucleotide
acaacaacacaaatggctggtacgtcttcaaataccatc

SEQ ID NO: 196582 - DNA, 38 bp, Artificial Sequence
  Description of Artificial Sequence: Synthetic oligonucleotide
caacaacacaaatggctggtacgtcttcaaataccatc

SEQ ID NO: 196583 - DNA, 39 bp, Artificial Sequence
  Description of Artificial Sequence: Synthetic oligonucleotide
aacaacacaaatggctggtacgtcttcaaataccatctc

SEQ ID NO: 196584 - DNA, 38 bp, Artificial Sequence
  Description of Artificial Sequence: Synthetic oligonucleotide
acaacacaaatggctggtacgtcttcaaataccatctc

SEQ ID NO: 196585 - DNA, 37 bp, Artificial Sequence
  Description of Artificial Sequence: Synthetic oligonucleotide
caacacaaatggctggtacgtcttcaaataccatctc

SEQ ID NO: 196586 - DNA, 38 bp, Artificial Sequence
  Description of Artificial Sequence: Synthetic oligonucleotide
aacacaaatggctggtacgtcttcaaataccatctcag

SEQ ID NO: 196587 - DNA, 37 bp, Artificial Sequence
  Description of Artificial Sequence: Synthetic oligonucleotide
acacaaatggctggtacgtcttcaaataccatctcag

SEQ ID NO: 196588 - DNA, 36 bp, Artificial Sequence
  Description of Artificial Sequence: Synthetic oligonucleotide
cacaaatggctggtacgtcttcaaataccatctcag

SEQ ID NO: 196589 - DNA, 36 bp, Artificial Sequence
  Description of Artificial Sequence: Synthetic oligonucleotide
acaaatggctggtacgtcttcaaataccatctcagc

SEQ ID NO: 196590 - DNA, 35 bp, Artificial Sequence
  Description of Artificial Sequence: Synthetic oligonucleotide
caaatggctggtacgtcttcaaataccatctcagc

SEQ ID NO: 196591 - DNA, 36 bp, Artificial Sequence
  Description of Artificial Sequence: Synthetic oligonucleotide
aaatggctggtacgtcttcaaataccatctcagcag

SEQ ID NO: 196592 - DNA, 35 bp, Artificial Sequence
  Description of Artificial Sequence: Synthetic oligonucleotide
aatggctggtacgtcttcaaataccatctcagcag

SEQ ID NO: 196593 - DNA, 34 bp, Artificial Sequence
  Description of Artificial Sequence: Synthetic oligonucleotide
atggctggtacgtcttcaaataccatctcagcag

SEQ ID NO: 196594 - DNA, 33 bp, Artificial Sequence
  Description of Artificial Sequence: Synthetic oligonucleotide
tggctggtacgtcttcaaataccatctcagcag

SEQ ID NO: 196595 - DNA, 32 bp, Artificial Sequence
  Description of Artificial Sequence: Synthetic oligonucleotide
ggctggtacgtcttcaaataccatctcagcag

SEQ ID NO: 196596 - DNA, 32 bp, Artificial Sequence
  Description of Artificial Sequence: Synthetic oligonucleotide
gctggtacgtcttcaaataccatctcagcagg

SEQ ID NO: 196597 - DNA, 32 bp, Artificial Sequence
  Description of Artificial Sequence: Synthetic oligonucleotide
ctggtacgtcttcaaataccatctcagcaggc

SEQ ID NO: 196598 - DNA, 33 bp, Artificial Sequence
  Description of Artificial Sequence: Synthetic oligonucleotide
tggtacgtcttcaaataccatctcagcaggctg

SEQ ID NO: 196599 - DNA, 32 bp, Artificial Sequence
  Description of Artificial Sequence: Synthetic oligonucleotide
ggtacgtcttcaaataccatctcagcaggctg

SEQ ID NO: 196600 - DNA, 32 bp, Artificial Sequence
  Description of Artificial Sequence: Synthetic oligonucleotide
gtacgtcttcaaataccatctcagcaggctgg

SEQ ID NO: 196601 - DNA, 32 bp, Artificial Sequence
  Description of Artificial Sequence: Synthetic oligonucleotide
tacgtcttcaaataccatctcagcaggctggg

SEQ ID NO: 196602 - DNA, 31 bp, Artificial Sequence
  Description of Artificial Sequence: Synthetic oligonucleotide
acgtcttcaaataccatctcagcaggctggg

SEQ ID NO: 196603 - DNA, 30 bp, Artificial Sequence
  Description of Artificial Sequence: Synthetic oligonucleotide
cgtcttcaaataccatctcagcaggctggg

SEQ ID NO: 196604 - DNA, 31 bp, Artificial Sequence
  Description of Artificial Sequence: Synthetic oligonucleotide
gtcttcaaataccatctcagcaggctgggag

SEQ ID NO: 196605 - DNA, 31 bp, Artificial Sequence
  Description of Artificial Sequence: Synthetic oligonucleotide
tcttcaaataccatctcagcaggctgggagc

SEQ ID NO: 196606 - DNA, 30 bp, Artificial Sequence
  Description of Artificial Sequence: Synthetic oligonucleotide
cttcaaataccatctcagcaggctgggagc

SEQ ID NO: 196607 - DNA, 30 bp, Artificial Sequence
  Description of Artificial Sequence: Synthetic oligonucleotide
ttcaaataccatctcagcaggctgggagcc

SEQ ID NO: 196608 - DNA, 29 bp, Artificial Sequence
  Description of Artificial Sequence: Synthetic oligonucleotide
tcaaataccatctcagcaggctgggagcc

SEQ ID NO: 196609 - DNA, 28 bp, Artificial Sequence
  Description of Artificial Sequence: Synthetic oligonucleotide
caaataccatctcagcaggctgggagcc

SEQ ID NO: 196610 - DNA, 32 bp, Artificial Sequence
  Description of Artificial Sequence: Synthetic oligonucleotide
aaataccatctcagcaggctgggagccaaatg

SEQ ID NO: 196611 - DNA, 31 bp, Artificial Sequence
  Description of Artificial Sequence: Synthetic oligonucleotide
aataccatctcagcaggctgggagccaaatg

SEQ ID NO: 196612 - DNA, 30 bp, Artificial Sequence
  Description of Artificial Sequence: Synthetic oligonucleotide
ataccatctcagcaggctgggagccaaatg

SEQ ID NO: 196613 - DNA, 29 bp, Artificial Sequence
  Description of Artificial Sequence: Synthetic oligonucleotide
taccatctcagcaggctgggagccaaatg

SEQ ID NO: 196614 - DNA, 28 bp, Artificial Sequence
  Description of Artificial Sequence: Synthetic oligonucleotide
accatctcagcaggctgggagccaaatg

SEQ ID NO: 196615 - DNA, 27 bp, Artificial Sequence
  Description of Artificial Sequence: Synthetic oligonucleotide
ccatctcagcaggctgggagccaaatg

SEQ ID NO: 196616 - DNA, 29 bp, Artificial Sequence
  Description of Artificial Sequence: Synthetic oligonucleotide
catctcagcaggctgggagccaaatgaag

SEQ ID NO: 196617 - DNA, 34 bp, Artificial Sequence
  Description of Artificial Sequence: Synthetic oligonucleotide
atctcagcaggctgggagccaaatgaagaaaatg

SEQ ID NO: 196618 - DNA, 33 bp, Artificial Sequence
  Description of Artificial Sequence: Synthetic oligonucleotide
tctcagcaggctgggagccaaatgaagaaaatg

SEQ ID NO: 196619 - DNA, 32 bp, Artificial Sequence
  Description of Artificial Sequence: Synthetic oligonucleotide
ctcagcaggctgggagccaaatgaagaaaatg

SEQ ID NO: 196620 - DNA, 34 bp, Artificial Sequence
  Description of Artificial Sequence: Synthetic oligonucleotide
tcagcaggctgggagccaaatgaagaaaatgaag

SEQ ID NO: 196621 - DNA, 33 bp, Artificial Sequence
  Description of Artificial Sequence: Synthetic oligonucleotide
cagcaggctgggagccaaatgaagaaaatgaag

SEQ ID NO: 196622 - DNA, 35 bp, Artificial Sequence
  Description of Artificial Sequence: Synthetic oligonucleotide
agcaggctgggagccaaatgaagaaaatgaagatg

SEQ ID NO: 196623 - DNA, 34 bp, Artificial Sequence
  Description of Artificial Sequence: Synthetic oligonucleotide
gcaggctgggagccaaatgaagaaaatgaagatg

SEQ ID NO: 196624 - DNA, 37 bp, Artificial Sequence
  Description of Artificial Sequence: Synthetic oligonucleotide
caggctgggagccaaatgaagaaaatgaagatgaaag

SEQ ID NO: 196625 - DNA, 38 bp, Artificial Sequence
  Description of Artificial Sequence: Synthetic oligonucleotide
aggctgggagccaaatgaagaaaatgaagatgaaagag

SEQ ID NO: 196626 - DNA, 37 bp, Artificial Sequence
  Description of Artificial Sequence: Synthetic oligonucleotide
ggctgggagccaaatgaagaaaatgaagatgaaagag

SEQ ID NO: 196627 - DNA, 38 bp, Artificial Sequence
  Description of Artificial Sequence: Synthetic oligonucleotide
gctgggagccaaatgaagaaaatgaagatgaaagagac

SEQ ID NO: 196628 - DNA, 39 bp, Artificial Sequence
  Description of Artificial Sequence: Synthetic oligonucleotide
ctgggagccaaatgaagaaaatgaagatgaaagagacag

SEQ ID NO: 196629 - DNA, 40 bp, Artificial Sequence
  Description of Artificial Sequence: Synthetic oligonucleotide
tgggagccaaatgaagaaaatgaagatgaaagagacagac

SEQ ID NO: 196630 - DNA, 39 bp, Artificial Sequence
  Description of Artificial Sequence: Synthetic oligonucleotide
gggagccaaatgaagaaaatgaagatgaaagagacagac

SEQ ID NO: 196631 - DNA, 40 bp, Artificial Sequence
  Description of Artificial Sequence: Synthetic oligonucleotide
ggagccaaatgaagaaaatgaagatgaaagagacagacac

SEQ ID NO: 196632 - DNA, 40 bp, Artificial Sequence
  Description of Artificial Sequence: Synthetic oligonucleotide
gagccaaatgaagaaaatgaagatgaaagagacagacacc

SEQ ID NO: 196633 - DNA, 41 bp, Artificial Sequence
  Description of Artificial Sequence: Synthetic oligonucleotide
agccaaatgaagaaaatgaagatgaaagagacagacacctc

SEQ ID NO: 196634 - DNA, 40 bp, Artificial Sequence
  Description of Artificial Sequence: Synthetic oligonucleotide
gccaaatgaagaaaatgaagatgaaagagacagacacctc

SEQ ID NO: 196635 - DNA, 41 bp, Artificial Sequence
  Description of Artificial Sequence: Synthetic oligonucleotide
ccaaatgaagaaaatgaagatgaaagagacagacacctcag

SEQ ID NO: 196636 - DNA, 46 bp, Artificial Sequence
  Description of Artificial Sequence: Synthetic oligonucleotide
caaatgaagaaaatgaagatgaaagagacagacacctcagtttttc

SEQ ID NO: 196637 - DNA, 47 bp, Artificial Sequence
  Description of Artificial Sequence: Synthetic oligonucleotide
aaatgaagaaaatgaagatgaaagagacagacacctcagtttttctg

SEQ ID NO: 196638 - DNA, 46 bp, Artificial Sequence
  Description of Artificial Sequence: Synthetic oligonucleotide
aatgaagaaaatgaagatgaaagagacagacacctcagtttttctg

SEQ ID NO: 196639 - DNA, 45 bp, Artificial Sequence
  Description of Artificial Sequence: Synthetic oligonucleotide
atgaagaaaatgaagatgaaagagacagacacctcagtttttctg

SEQ ID NO: 196640 - DNA, 44 bp, Artificial Sequence
  Description of Artificial Sequence: Synthetic oligonucleotide
tgaagaaaatgaagatgaaagagacagacacctcagtttttctg

SEQ ID NO: 196641 - DNA, 43 bp, Artificial Sequence
  Description of Artificial Sequence: Synthetic oligonucleotide
gaagaaaatgaagatgaaagagacagacacctcagtttttctg

SEQ ID NO: 196642 - DNA, 43 bp, Artificial Sequence
  Description of Artificial Sequence: Synthetic oligonucleotide
aagaaaatgaagatgaaagagacagacacctcagtttttctgg

SEQ ID NO: 196643 - DNA, 42 bp, Artificial Sequence
  Description of Artificial Sequence: Synthetic oligonucleotide
agaaaatgaagatgaaagagacagacacctcagtttttctgg

SEQ ID NO: 196644 - DNA, 41 bp, Artificial Sequence
  Description of Artificial Sequence: Synthetic oligonucleotide
gaaaatgaagatgaaagagacagacacctcagtttttctgg

SEQ ID NO: 196645 - DNA, 43 bp, Artificial Sequence
  Description of Artificial Sequence: Synthetic oligonucleotide
aaaatgaagatgaaagagacagacacctcagtttttctggatc

SEQ ID NO: 196646 - DNA, 42 bp, Artificial Sequence
  Description of Artificial Sequence: Synthetic oligonucleotide
aaatgaagatgaaagagacagacacctcagtttttctggatc

SEQ ID NO: 196647 - DNA, 41 bp, Artificial Sequence
  Description of Artificial Sequence: Synthetic oligonucleotide
aatgaagatgaaagagacagacacctcagtttttctggatc

SEQ ID NO: 196648 - DNA, 40 bp, Artificial Sequence
  Description of Artificial Sequence: Synthetic oligonucleotide
atgaagatgaaagagacagacacctcagtttttctggatc

SEQ ID NO: 196649 - DNA, 39 bp, Artificial Sequence
  Description of Artificial Sequence: Synthetic oligonucleotide
tgaagatgaaagagacagacacctcagtttttctggatc

SEQ ID NO: 196650 - DNA, 38 bp, Artificial Sequence
  Description of Artificial Sequence: Synthetic oligonucleotide
gaagatgaaagagacagacacctcagtttttctggatc

SEQ ID NO: 196651 - DNA, 39 bp, Artificial Sequence
  Description of Artificial Sequence: Synthetic oligonucleotide
aagatgaaagagacagacacctcagtttttctggatcag

SEQ ID NO: 196652 - DNA, 38 bp, Artificial Sequence
  Description of Artificial Sequence: Synthetic oligonucleotide
agatgaaagagacagacacctcagtttttctggatcag

SEQ ID NO: 196653 - DNA, 37 bp, Artificial Sequence
  Description of Artificial Sequence: Synthetic oligonucleotide
gatgaaagagacagacacctcagtttttctggatcag

SEQ ID NO: 196654 - DNA, 37 bp, Artificial Sequence
  Description of Artificial Sequence: Synthetic oligonucleotide
atgaaagagacagacacctcagtttttctggatcagg

SEQ ID NO: 196655 - DNA, 36 bp, Artificial Sequence
  Description of Artificial Sequence: Synthetic oligonucleotide
tgaaagagacagacacctcagtttttctggatcagg

SEQ ID NO: 196656 - DNA, 35 bp, Artificial Sequence
  Description of Artificial Sequence: Synthetic oligonucleotide
gaaagagacagacacctcagtttttctggatcagg

SEQ ID NO: 196657 - DNA, 35 bp, Artificial Sequence
  Description of Artificial Sequence: Synthetic oligonucleotide
aaagagacagacacctcagtttttctggatcaggc

SEQ ID NO: 196658 - DNA, 34 bp, Artificial Sequence
  Description of Artificial Sequence: Synthetic oligonucleotide
aagagacagacacctcagtttttctggatcaggc

SEQ ID NO: 196659 - DNA, 33 bp, Artificial Sequence
  Description of Artificial Sequence: Synthetic oligonucleotide
agagacagacacctcagtttttctggatcaggc

SEQ ID NO: 196660 - DNA, 32 bp, Artificial Sequence
  Description of Artificial Sequence: Synthetic oligonucleotide
gagacagacacctcagtttttctggatcaggc

SEQ ID NO: 196661 - DNA, 35 bp, Artificial Sequence
  Description of Artificial Sequence: Synthetic oligonucleotide
agacagacacctcagtttttctggatcaggcattg

SEQ ID NO: 196662 - DNA, 34 bp, Artificial Sequence
  Description of Artificial Sequence: Synthetic oligonucleotide
gacagacacctcagtttttctggatcaggcattg

SEQ ID NO: 196663 - DNA, 36 bp, Artificial Sequence
  Description of Artificial Sequence: Synthetic oligonucleotide
acagacacctcagtttttctggatcaggcattgatg

SEQ ID NO: 196664 - DNA, 35 bp, Artificial Sequence
  Description of Artificial Sequence: Synthetic oligonucleotide
cagacacctcagtttttctggatcaggcattgatg

SEQ ID NO: 196665 - DNA, 37 bp, Artificial Sequence
  Description of Artificial Sequence: Synthetic oligonucleotide
agacacctcagtttttctggatcaggcattgatgatg

SEQ ID NO: 196666 - DNA, 36 bp, Artificial Sequence
  Description of Artificial Sequence: Synthetic oligonucleotide
gacacctcagtttttctggatcaggcattgatgatg

SEQ ID NO: 196667 - DNA, 38 bp, Artificial Sequence
  Description of Artificial Sequence: Synthetic oligonucleotide
acacctcagtttttctggatcaggcattgatgatgatg

SEQ ID NO: 196668 - DNA, 37 bp, Artificial Sequence
  Description of Artificial Sequence: Synthetic oligonucleotide
cacctcagtttttctggatcaggcattgatgatgatg

SEQ ID NO: 196669 - DNA, 39 bp, Artificial Sequence
  Description of Artificial Sequence: Synthetic oligonucleotide
acctcagtttttctggatcaggcattgatgatgatgaag

SEQ ID NO: 196670 - DNA, 38 bp, Artificial Sequence
  Description of Artificial Sequence: Synthetic oligonucleotide
cctcagtttttctggatcaggcattgatgatgatgaag

SEQ ID NO: 196671 - DNA, 45 bp, Artificial Sequence
  Description of Artificial Sequence: Synthetic oligonucleotide
ctcagtttttctggatcaggcattgatgatgatgaagattttatc

SEQ ID NO: 196672 - DNA, 46 bp, Artificial Sequence
  Description of Artificial Sequence: Synthetic oligonucleotide
tcagtttttctggatcaggcattgatgatgatgaagattttatctc

SEQ ID NO: 196673 - DNA, 45 bp, Artificial Sequence
  Description of Artificial Sequence: Synthetic oligonucleotide
cagtttttctggatcaggcattgatgatgatgaagattttatctc

SEQ ID NO: 196674 - DNA, 45 bp, Artificial Sequence
  Description of Artificial Sequence: Synthetic oligonucleotide
agtttttctggatcaggcattgatgatgatgaagattttatctcc

SEQ ID NO: 196675 - DNA, 44 bp, Artificial Sequence
  Description of Artificial Sequence: Synthetic oligonucleotide
gtttttctggatcaggcattgatgatgatgaagattttatctcc

SEQ ID NO: 196676 - DNA, 45 bp, Artificial Sequence
  Description of Artificial Sequence: Synthetic oligonucleotide
tttttctggatcaggcattgatgatgatgaagattttatctccag

SEQ ID NO: 196677 - DNA, 44 bp, Artificial Sequence
  Description of Artificial Sequence: Synthetic oligonucleotide
ttttctggatcaggcattgatgatgatgaagattttatctccag

SEQ ID NO: 196678 - DNA, 43 bp, Artificial Sequence
  Description of Artificial Sequence: Synthetic oligonucleotide
tttctggatcaggcattgatgatgatgaagattttatctccag

SEQ ID NO: 196679 - DNA, 42 bp, Artificial Sequence
  Description of Artificial Sequence: Synthetic oligonucleotide
ttctggatcaggcattgatgatgatgaagattttatctccag

SEQ ID NO: 196680 - DNA, 41 bp, Artificial Sequence
  Description of Artificial Sequence: Synthetic oligonucleotide
tctggatcaggcattgatgatgatgaagattttatctccag

SEQ ID NO: 196681 - DNA, 40 bp, Artificial Sequence
  Description of Artificial Sequence: Synthetic oligonucleotide
ctggatcaggcattgatgatgatgaagattttatctccag

SEQ ID NO: 196682 - DNA, 40 bp, Artificial Sequence
  Description of Artificial Sequence: Synthetic oligonucleotide
tggatcaggcattgatgatgatgaagattttatctccagc

SEQ ID NO: 196683 - DNA, 39 bp, Artificial Sequence
  Description of Artificial Sequence: Synthetic oligonucleotide
ggatcaggcattgatgatgatgaagattttatctccagc

SEQ ID NO: 196684 - DNA, 40 bp, Artificial Sequence
  Description of Artificial Sequence: Synthetic oligonucleotide
gatcaggcattgatgatgatgaagattttatctccagcac

SEQ ID NO: 196685 - DNA, 40 bp, Artificial Sequence
  Description of Artificial Sequence: Synthetic oligonucleotide
atcaggcattgatgatgatgaagattttatctccagcacc

SEQ ID NO: 196686 - DNA, 39 bp, Artificial Sequence
  Description of Artificial Sequence: Synthetic oligonucleotide
tcaggcattgatgatgatgaagattttatctccagcacc

SEQ ID NO: 196687 - DNA, 38 bp, Artificial Sequence
  Description of Artificial Sequence: Synthetic oligonucleotide
caggcattgatgatgatgaagattttatctccagcacc

SEQ ID NO: 196688 - DNA, 42 bp, Artificial Sequence
  Description of Artificial Sequence: Synthetic oligonucleotide
aggcattgatgatgatgaagattttatctccagcaccatttc

SEQ ID NO: 196689 - DNA, 41 bp, Artificial Sequence
  Description of Artificial Sequence: Synthetic oligonucleotide
ggcattgatgatgatgaagattttatctccagcaccatttc

SEQ ID NO: 196690 - DNA, 43 bp, Artificial Sequence
  Description of Artificial Sequence: Synthetic oligonucleotide
gcattgatgatgatgaagattttatctccagcaccatttcaac

SEQ ID NO: 196691 - DNA, 43 bp, Artificial Sequence
  Description of Artificial Sequence: Synthetic oligonucleotide
cattgatgatgatgaagattttatctccagcaccatttcaacc

SEQ ID NO: 196692 - DNA, 44 bp, Artificial Sequence
  Description of Artificial Sequence: Synthetic oligonucleotide
attgatgatgatgaagattttatctccagcaccatttcaaccac

SEQ ID NO: 196693 - DNA, 43 bp, Artificial Sequence
  Description of Artificial Sequence: Synthetic oligonucleotide
ttgatgatgatgaagattttatctccagcaccatttcaaccac

SEQ ID NO: 196694 - DNA, 42 bp, Artificial Sequence
  Description of Artificial Sequence: Synthetic oligonucleotide
tgatgatgatgaagattttatctccagcaccatttcaaccac

SEQ ID NO: 196695 - DNA, 41 bp, Artificial Sequence
  Description of Artificial Sequence: Synthetic oligonucleotide
gatgatgatgaagattttatctccagcaccatttcaaccac

SEQ ID NO: 196696 - DNA, 42 bp, Artificial Sequence
  Description of Artificial Sequence: Synthetic oligonucleotide
atgatgatgaagattttatctccagcaccatttcaaccacac

SEQ ID NO: 196697 - DNA, 41 bp, Artificial Sequence
  Description of Artificial Sequence: Synthetic oligonucleotide
tgatgatgaagattttatctccagcaccatttcaaccacac

SEQ ID NO: 196698 - DNA, 40 bp, Artificial Sequence
  Description of Artificial Sequence: Synthetic oligonucleotide
gatgatgaagattttatctccagcaccatttcaaccacac

SEQ ID NO: 196699 - DNA, 40 bp, Artificial Sequence
  Description of Artificial Sequence: Synthetic oligonucleotide
atgatgaagattttatctccagcaccatttcaaccacacc

SEQ ID NO: 196700 - DNA, 39 bp, Artificial Sequence
  Description of Artificial Sequence: Synthetic oligonucleotide
tgatgaagattttatctccagcaccatttcaaccacacc

SEQ ID NO: 196701 - DNA, 38 bp, Artificial Sequence
  Description of Artificial Sequence: Synthetic oligonucleotide
gatgaagattttatctccagcaccatttcaaccacacc

SEQ ID NO: 196702 - DNA, 39 bp, Artificial Sequence
  Description of Artificial Sequence: Synthetic oligonucleotide
atgaagattttatctccagcaccatttcaaccacaccac

SEQ ID NO: 196703 - DNA, 38 bp, Artificial Sequence
  Description of Artificial Sequence: Synthetic oligonucleotide
tgaagattttatctccagcaccatttcaaccacaccac

SEQ ID NO: 196704 - DNA, 37 bp, Artificial Sequence
  Description of Artificial Sequence: Synthetic oligonucleotide
gaagattttatctccagcaccatttcaaccacaccac

SEQ ID NO: 196705 - DNA, 37 bp, Artificial Sequence
  Description of Artificial Sequence: Synthetic oligonucleotide
aagattttatctccagcaccatttcaaccacaccacg

SEQ ID NO: 196706 - DNA, 36 bp, Artificial Sequence
  Description of Artificial Sequence: Synthetic oligonucleotide
agattttatctccagcaccatttcaaccacaccacg

SEQ ID NO: 196707 - DNA, 35 bp, Artificial Sequence
  Description of Artificial Sequence: Synthetic oligonucleotide
gattttatctccagcaccatttcaaccacaccacg

SEQ ID NO: 196708 - DNA, 35 bp, Artificial Sequence
  Description of Artificial Sequence: Synthetic oligonucleotide
attttatctccagcaccatttcaaccacaccacgg

SEQ ID NO: 196709 - DNA, 34 bp, Artificial Sequence
  Description of Artificial Sequence: Synthetic oligonucleotide
ttttatctccagcaccatttcaaccacaccacgg

SEQ ID NO: 196710 - DNA, 33 bp, Artificial Sequence
  Description of Artificial Sequence: Synthetic oligonucleotide
tttatctccagcaccatttcaaccacaccacgg

SEQ ID NO: 196711 - DNA, 32 bp, Artificial Sequence
  Description of Artificial Sequence: Synthetic oligonucleotide
ttatctccagcaccatttcaaccacaccacgg

SEQ ID NO: 196712 - DNA, 31 bp, Artificial Sequence
  Description of Artificial Sequence: Synthetic oligonucleotide
tatctccagcaccatttcaaccacaccacgg

SEQ ID NO: 196713 - DNA, 30 bp, Artificial Sequence
  Description of Artificial Sequence: Synthetic oligonucleotide
atctccagcaccatttcaaccacaccacgg

SEQ ID NO: 196714 - DNA, 29 bp, Artificial Sequence
  Description of Artificial Sequence: Synthetic oligonucleotide
tctccagcaccatttcaaccacaccacgg

SEQ ID NO: 196715 - DNA, 28 bp, Artificial Sequence
  Description of Artificial Sequence: Synthetic oligonucleotide
ctccagcaccatttcaaccacaccacgg

SEQ ID NO: 196716 - DNA, 28 bp, Artificial Sequence
  Description of Artificial Sequence: Synthetic oligonucleotide
tccagcaccatttcaaccacaccacggg

SEQ ID NO: 196717 - DNA, 27 bp, Artificial Sequence
  Description of Artificial Sequence: Synthetic oligonucleotide
ccagcaccatttcaaccacaccacggg

SEQ ID NO: 196718 - DNA, 27 bp, Artificial Sequence
  Description of Artificial Sequence: Synthetic oligonucleotide
cagcaccatttcaaccacaccacgggc

SEQ ID NO: 196719 - DNA, 31 bp, Artificial Sequence
  Description of Artificial Sequence: Synthetic oligonucleotide
agcaccatttcaaccacaccacgggcttttg

SEQ ID NO: 196720 - DNA, 30 bp, Artificial Sequence
  Description of Artificial Sequence: Synthetic oligonucleotide
gcaccatttcaaccacaccacgggcttttg

SEQ ID NO: 196721 - DNA, 31 bp, Artificial Sequence
  Description of Artificial Sequence: Synthetic oligonucleotide
caccatttcaaccacaccacgggcttttgac

SEQ ID NO: 196722 - DNA, 31 bp, Artificial Sequence
  Description of Artificial Sequence: Synthetic oligonucleotide
accatttcaaccacaccacgggcttttgacc

SEQ ID NO: 196723 - DNA, 30 bp, Artificial Sequence
  Description of Artificial Sequence: Synthetic oligonucleotide
ccatttcaaccacaccacgggcttttgacc

SEQ ID NO: 196724 - DNA, 31 bp, Artificial Sequence
  Description of Artificial Sequence: Synthetic oligonucleotide
catttcaaccacaccacgggcttttgaccac

SEQ ID NO: 196725 - DNA, 32 bp, Artificial Sequence
  Description of Artificial Sequence: Synthetic oligonucleotide
atttcaaccacaccacgggcttttgaccacac

SEQ ID NO: 196726 - DNA, 31 bp, Artificial Sequence
  Description of Artificial Sequence: Synthetic oligonucleotide
tttcaaccacaccacgggcttttgaccacac

SEQ ID NO: 196727 - DNA, 30 bp, Artificial Sequence
  Description of Artificial Sequence: Synthetic oligonucleotide
ttcaaccacaccacgggcttttgaccacac

SEQ ID NO: 196728 - DNA, 29 bp, Artificial Sequence
  Description of Artificial Sequence: Synthetic oligonucleotide
tcaaccacaccacgggcttttgaccacac

SEQ ID NO: 196729 - DNA, 28 bp, Artificial Sequence
  Description of Artificial Sequence: Synthetic oligonucleotide
caaccacaccacgggcttttgaccacac

SEQ ID NO: 196730 - DNA, 32 bp, Artificial Sequence
  Description of Artificial Sequence: Synthetic oligonucleotide
aaccacaccacgggcttttgaccacacaaaac

SEQ ID NO: 196731 - DNA, 31 bp, Artificial Sequence
  Description of Artificial Sequence: Synthetic oligonucleotide
accacaccacgggcttttgaccacacaaaac

SEQ ID NO: 196732 - DNA, 30 bp, Artificial Sequence
  Description of Artificial Sequence: Synthetic oligonucleotide
ccacaccacgggcttttgaccacacaaaac

SEQ ID NO: 196733 - DNA, 31 bp, Artificial Sequence
  Description of Artificial Sequence: Synthetic oligonucleotide
cacaccacgggcttttgaccacacaaaacag

SEQ ID NO: 196734 - DNA, 33 bp, Artificial Sequence
  Description of Artificial Sequence: Synthetic oligonucleotide
acaccacgggcttttgaccacacaaaacagaac

SEQ ID NO: 196735 - DNA, 32 bp, Artificial Sequence
  Description of Artificial Sequence: Synthetic oligonucleotide
caccacgggcttttgaccacacaaaacagaac

SEQ ID NO: 196736 - DNA, 32 bp, Artificial Sequence
  Description of Artificial Sequence: Synthetic oligonucleotide
accacgggcttttgaccacacaaaacagaacc

SEQ ID NO: 196737 - DNA, 31 bp, Artificial Sequence
  Description of Artificial Sequence: Synthetic oligonucleotide
ccacgggcttttgaccacacaaaacagaacc

SEQ ID NO: 196738 - DNA, 32 bp, Artificial Sequence
  Description of Artificial Sequence: Synthetic oligonucleotide
cacgggcttttgaccacacaaaacagaaccag

SEQ ID NO: 196739 - DNA, 32 bp, Artificial Sequence
  Description of Artificial Sequence: Synthetic oligonucleotide
acgggcttttgaccacacaaaacagaaccagg

SEQ ID NO: 196740 - DNA, 31 bp, Artificial Sequence
  Description of Artificial Sequence: Synthetic oligonucleotide
cgggcttttgaccacacaaaacagaaccagg

SEQ ID NO: 196741 - DNA, 32 bp, Artificial Sequence
  Description of Artificial Sequence: Synthetic oligonucleotide
gggcttttgaccacacaaaacagaaccaggac

SEQ ID NO: 196742 - DNA, 33 bp, Artificial Sequence
  Description of Artificial Sequence: Synthetic oligonucleotide
ggcttttgaccacacaaaacagaaccaggactg

SEQ ID NO: 196743 - DNA, 33 bp, Artificial Sequence
  Description of Artificial Sequence: Synthetic oligonucleotide
gcttttgaccacacaaaacagaaccaggactgg

SEQ ID NO: 196744 - DNA, 34 bp, Artificial Sequence
  Description of Artificial Sequence: Synthetic oligonucleotide
cttttgaccacacaaaacagaaccaggactggac

SEQ ID NO: 196745 - DNA, 34 bp, Artificial Sequence
  Description of Artificial Sequence: Synthetic oligonucleotide
ttttgaccacacaaaacagaaccaggactggacc

SEQ ID NO: 196746 - DNA, 33 bp, Artificial Sequence
  Description of Artificial Sequence: Synthetic oligonucleotide
tttgaccacacaaaacagaaccaggactggacc

SEQ ID NO: 196747 - DNA, 32 bp, Artificial Sequence
  Description of Artificial Sequence: Synthetic oligonucleotide
ttgaccacacaaaacagaaccaggactggacc

SEQ ID NO: 196748 - DNA, 31 bp, Artificial Sequence
  Description of Artificial Sequence: Synthetic oligonucleotide
tgaccacacaaaacagaaccaggactggacc

SEQ ID NO: 196749 - DNA, 30 bp, Artificial Sequence
  Description of Artificial Sequence: Synthetic oligonucleotide
gaccacacaaaacagaaccaggactggacc

SEQ ID NO: 196750 - DNA, 30 bp, Artificial Sequence
  Description of Artificial Sequence: Synthetic oligonucleotide
accacacaaaacagaaccaggactggaccc

SEQ ID NO: 196751 - DNA, 29 bp, Artificial Sequence
  Description of Artificial Sequence: Synthetic oligonucleotide
ccacacaaaacagaaccaggactggaccc

SEQ ID NO: 196752 - DNA, 30 bp, Artificial Sequence
  Description of Artificial Sequence: Synthetic oligonucleotide
cacacaaaacagaaccaggactggacccag

SEQ ID NO: 196753 - DNA, 31 bp, Artificial Sequence
  Description of Artificial Sequence: Synthetic oligonucleotide
acacaaaacagaaccaggactggacccagtg

SEQ ID NO: 196754 - DNA, 30 bp, Artificial Sequence
  Description of Artificial Sequence: Synthetic oligonucleotide
cacaaaacagaaccaggactggacccagtg

SEQ ID NO: 196755 - DNA, 30 bp, Artificial Sequence
  Description of Artificial Sequence: Synthetic oligonucleotide
acaaaacagaaccaggactggacccagtgg

SEQ ID NO: 196756 - DNA, 29 bp, Artificial Sequence
  Description of Artificial Sequence: Synthetic oligonucleotide
caaaacagaaccaggactggacccagtgg

SEQ ID NO: 196757 - DNA, 31 bp, Artificial Sequence
  Description of Artificial Sequence: Synthetic oligonucleotide
aaaacagaaccaggactggacccagtggaac

SEQ ID NO: 196758 - DNA, 30 bp, Artificial Sequence
  Description of Artificial Sequence: Synthetic oligonucleotide
aaacagaaccaggactggacccagtggaac

SEQ ID NO: 196759 - DNA, 29 bp, Artificial Sequence
  Description of Artificial Sequence: Synthetic oligonucleotide
aacagaaccaggactggacccagtggaac

SEQ ID NO: 196760 - DNA, 28 bp, Artificial Sequence
  Description of Artificial Sequence: Synthetic oligonucleotide
acagaaccaggactggacccagtggaac

SEQ ID NO: 196761 - DNA, 27 bp, Artificial Sequence
  Description of Artificial Sequence: Synthetic oligonucleotide
cagaaccaggactggacccagtggaac

SEQ ID NO: 196762 - DNA, 27 bp, Artificial Sequence
  Description of Artificial Sequence: Synthetic oligonucleotide
agaaccaggactggacccagtggaacc

SEQ ID NO: 196763 - DNA, 26 bp, Artificial Sequence
  Description of Artificial Sequence: Synthetic oligonucleotide
gaaccaggactggacccagtggaacc

SEQ ID NO: 196764 - DNA, 27 bp, Artificial Sequence
  Description of Artificial Sequence: Synthetic oligonucleotide
aaccaggactggacccagtggaaccca

SEQ ID NO: 196765 - DNA, 27 bp, Artificial Sequence
  Description of Artificial Sequence: Synthetic oligonucleotide
accaggactggacccagtggaacccaa

SEQ ID NO: 196766 - DNA, 26 bp, Artificial Sequence
  Description of Artificial Sequence: Synthetic oligonucleotide
ccaggactggacccagtggaacccaa

SEQ ID NO: 196767 - DNA, 26 bp, Artificial Sequence
  Description of Artificial Sequence: Synthetic oligonucleotide
caggactggacccagtggaacccaag

SEQ ID NO: 196768 - DNA, 26 bp, Artificial Sequence
  Description of Artificial Sequence: Synthetic oligonucleotide
aggactggacccagtggaacccaagc

SEQ ID NO: 196769 - DNA, 25 bp, Artificial Sequence
  Description of Artificial Sequence: Synthetic oligonucleotide
ggactggacccagtggaacccaagc

SEQ ID NO: 196770 - DNA, 27 bp, Artificial Sequence
  Description of Artificial Sequence: Synthetic oligonucleotide
gactggacccagtggaacccaagccat

SEQ ID NO: 196771 - DNA, 28 bp, Artificial Sequence
  Description of Artificial Sequence: Synthetic oligonucleotide
actggacccagtggaacccaagccattc

SEQ ID NO: 196772 - DNA, 27 bp, Artificial Sequence
  Description of Artificial Sequence: Synthetic oligonucleotide
ctggacccagtggaacccaagccattc

SEQ ID NO: 196773 - DNA, 31 bp, Artificial Sequence
  Description of Artificial Sequence: Synthetic oligonucleotide
tggacccagtggaacccaagccattcaaatc

SEQ ID NO: 196774 - DNA, 30 bp, Artificial Sequence
  Description of Artificial Sequence: Synthetic oligonucleotide
ggacccagtggaacccaagccattcaaatc

SEQ ID NO: 196775 - DNA, 30 bp, Artificial Sequence
  Description of Artificial Sequence: Synthetic oligonucleotide
gacccagtggaacccaagccattcaaatcc

SEQ ID NO: 196776 - DNA, 30 bp, Artificial Sequence
  Description of Artificial Sequence: Synthetic oligonucleotide
acccagtggaacccaagccattcaaatccg

SEQ ID NO: 196777 - DNA, 29 bp, Artificial Sequence
  Description of Artificial Sequence: Synthetic oligonucleotide
cccagtggaacccaagccattcaaatccg

SEQ ID NO: 196778 - DNA, 29 bp, Artificial Sequence
  Description of Artificial Sequence: Synthetic oligonucleotide
ccagtggaacccaagccattcaaatccgg

SEQ ID NO: 196779 - DNA, 31 bp, Artificial Sequence
  Description of Artificial Sequence: Synthetic oligonucleotide
cagtggaacccaagccattcaaatccggaag

SEQ ID NO: 196780 - DNA, 32 bp, Artificial Sequence
  Description of Artificial Sequence: Synthetic oligonucleotide
agtggaacccaagccattcaaatccggaagtg

SEQ ID NO: 196781 - DNA, 31 bp, Artificial Sequence
  Description of Artificial Sequence: Synthetic oligonucleotide
gtggaacccaagccattcaaatccggaagtg

SEQ ID NO: 196782 - DNA, 31 bp, Artificial Sequence
  Description of Artificial Sequence: Synthetic oligonucleotide
tggaacccaagccattcaaatccggaagtgc

SEQ ID NO: 196783 - DNA, 30 bp, Artificial Sequence
  Description of Artificial Sequence: Synthetic oligonucleotide
ggaacccaagccattcaaatccggaagtgc

SEQ ID NO: 196784 - DNA, 32 bp, Artificial Sequence
  Description of Artificial Sequence: Synthetic oligonucleotide
gaacccaagccattcaaatccggaagtgctac

SEQ ID NO: 196785 - DNA, 34 bp, Artificial Sequence
  Description of Artificial Sequence: Synthetic oligonucleotide
aacccaagccattcaaatccggaagtgctacttc

SEQ ID NO: 196786 - DNA, 33 bp, Artificial Sequence
  Description of Artificial Sequence: Synthetic oligonucleotide
acccaagccattcaaatccggaagtgctacttc

SEQ ID NO: 196787 - DNA, 32 bp, Artificial Sequence
  Description of Artificial Sequence: Synthetic oligonucleotide
cccaagccattcaaatccggaagtgctacttc

SEQ ID NO: 196788 - DNA, 33 bp, Artificial Sequence
  Description of Artificial Sequence: Synthetic oligonucleotide
ccaagccattcaaatccggaagtgctacttcag

SEQ ID NO: 196789 - DNA, 34 bp, Artificial Sequence
  Description of Artificial Sequence: Synthetic oligonucleotide
caagccattcaaatccggaagtgctacttcagac

SEQ ID NO: 196790 - DNA, 36 bp, Artificial Sequence
  Description of Artificial Sequence: Synthetic oligonucleotide
aagccattcaaatccggaagtgctacttcagacaac

SEQ ID NO: 196791 - DNA, 35 bp, Artificial Sequence
  Description of Artificial Sequence: Synthetic oligonucleotide
agccattcaaatccggaagtgctacttcagacaac

SEQ ID NO: 196792 - DNA, 34 bp, Artificial Sequence
  Description of Artificial Sequence: Synthetic oligonucleotide
gccattcaaatccggaagtgctacttcagacaac

SEQ ID NO: 196793 - DNA, 34 bp, Artificial Sequence
  Description of Artificial Sequence: Synthetic oligonucleotide
ccattcaaatccggaagtgctacttcagacaacc

SEQ ID NO: 196794 - DNA, 35 bp, Artificial Sequence
  Description of Artificial Sequence: Synthetic oligonucleotide
cattcaaatccggaagtgctacttcagacaaccac

SEQ ID NO: 196795 - DNA, 37 bp, Artificial Sequence
  Description of Artificial Sequence: Synthetic oligonucleotide
attcaaatccggaagtgctacttcagacaaccacaag

SEQ ID NO: 196796 - DNA, 36 bp, Artificial Sequence
  Description of Artificial Sequence: Synthetic oligonucleotide
ttcaaatccggaagtgctacttcagacaaccacaag

SEQ ID NO: 196797 - DNA, 35 bp, Artificial Sequence
  Description of Artificial Sequence: Synthetic oligonucleotide
tcaaatccggaagtgctacttcagacaaccacaag

SEQ ID NO: 196798 - DNA, 34 bp, Artificial Sequence
  Description of Artificial Sequence: Synthetic oligonucleotide
caaatccggaagtgctacttcagacaaccacaag

SEQ ID NO: 196799 - DNA, 34 bp, Artificial Sequence
  Description of Artificial Sequence: Synthetic oligonucleotide
aaatccggaagtgctacttcagacaaccacaagg

SEQ ID NO: 196800 - DNA, 33 bp, Artificial Sequence
  Description of Artificial Sequence: Synthetic oligonucleotide
aatccggaagtgctacttcagacaaccacaagg

SEQ ID NO: 196801 - DNA, 32 bp, Artificial Sequence
  Description of Artificial Sequence: Synthetic oligonucleotide
atccggaagtgctacttcagacaaccacaagg

SEQ ID NO: 196802 - DNA, 31 bp, Artificial Sequence
  Description of Artificial Sequence: Synthetic oligonucleotide
tccggaagtgctacttcagacaaccacaagg

SEQ ID NO: 196803 - DNA, 30 bp, Artificial Sequence
  Description of Artificial Sequence: Synthetic oligonucleotide
ccggaagtgctacttcagacaaccacaagg

SEQ ID NO: 196804 - DNA, 32 bp, Artificial Sequence
  Description of Artificial Sequence: Synthetic oligonucleotide
cggaagtgctacttcagacaaccacaaggatg

SEQ ID NO: 196805 - DNA, 33 bp, Artificial Sequence
  Description of Artificial Sequence: Synthetic oligonucleotide
ggaagtgctacttcagacaaccacaaggatgac

SEQ ID NO: 196806 - DNA, 34 bp, Artificial Sequence
  Description of Artificial Sequence: Synthetic oligonucleotide
gaagtgctacttcagacaaccacaaggatgactg

SEQ ID NO: 196807 - DNA, 36 bp, Artificial Sequence
  Description of Artificial Sequence: Synthetic oligonucleotide
aagtgctacttcagacaaccacaaggatgactgatg

SEQ ID NO: 196808 - DNA, 35 bp, Artificial Sequence
  Description of Artificial Sequence: Synthetic oligonucleotide
agtgctacttcagacaaccacaaggatgactgatg

SEQ ID NO: 196809 - DNA, 34 bp, Artificial Sequence
  Description of Artificial Sequence: Synthetic oligonucleotide
gtgctacttcagacaaccacaaggatgactgatg

SEQ ID NO: 196810 - DNA, 36 bp, Artificial Sequence
  Description of Artificial Sequence: Synthetic oligonucleotide
tgctacttcagacaaccacaaggatgactgatgtag

SEQ ID NO: 196811 - DNA, 35 bp, Artificial Sequence
  Description of Artificial Sequence: Synthetic oligonucleotide
gctacttcagacaaccacaaggatgactgatgtag

SEQ ID NO: 196812 - DNA, 36 bp, Artificial Sequence
  Description of Artificial Sequence: Synthetic oligonucleotide
ctacttcagacaaccacaaggatgactgatgtagac

SEQ ID NO: 196813 - DNA, 37 bp, Artificial Sequence
  Description of Artificial Sequence: Synthetic oligonucleotide
tacttcagacaaccacaaggatgactgatgtagacag

SEQ ID NO: 196814 - DNA, 36 bp, Artificial Sequence
  Description of Artificial Sequence: Synthetic oligonucleotide
acttcagacaaccacaaggatgactgatgtagacag

SEQ ID NO: 196815 - DNA, 35 bp, Artificial Sequence
  Description of Artificial Sequence: Synthetic oligonucleotide
cttcagacaaccacaaggatgactgatgtagacag

SEQ ID NO: 196816 - DNA, 39 bp, Artificial Sequence
  Description of Artificial Sequence: Synthetic oligonucleotide
ttcagacaaccacaaggatgactgatgtagacagaaatg

SEQ ID NO: 196817 - DNA, 38 bp, Artificial Sequence
  Description of Artificial Sequence: Synthetic oligonucleotide
tcagacaaccacaaggatgactgatgtagacagaaatg

SEQ ID NO: 196818 - DNA, 37 bp, Artificial Sequence
  Description of Artificial Sequence: Synthetic oligonucleotide
cagacaaccacaaggatgactgatgtagacagaaatg

SEQ ID NO: 196819 - DNA, 37 bp, Artificial Sequence
  Description of Artificial Sequence: Synthetic oligonucleotide
agacaaccacaaggatgactgatgtagacagaaatgg

SEQ ID NO: 196820 - DNA, 36 bp, Artificial Sequence
  Description of Artificial Sequence: Synthetic oligonucleotide
gacaaccacaaggatgactgatgtagacagaaatgg

SEQ ID NO: 196821 - DNA, 36 bp, Artificial Sequence
  Description of Artificial Sequence: Synthetic oligonucleotide
acaaccacaaggatgactgatgtagacagaaatggc

SEQ ID NO: 196822 - DNA, 35 bp, Artificial Sequence
  Description of Artificial Sequence: Synthetic oligonucleotide
caaccacaaggatgactgatgtagacagaaatggc

SEQ ID NO: 196823 - DNA, 36 bp, Artificial Sequence
  Description of Artificial Sequence: Synthetic oligonucleotide
aaccacaaggatgactgatgtagacagaaatggcac

SEQ ID NO: 196824 - DNA, 35 bp, Artificial Sequence
  Description of Artificial Sequence: Synthetic oligonucleotide
accacaaggatgactgatgtagacagaaatggcac

SEQ ID NO: 196825 - DNA, 34 bp, Artificial Sequence
  Description of Artificial Sequence: Synthetic oligonucleotide
ccacaaggatgactgatgtagacagaaatggcac

SEQ ID NO: 196826 - DNA, 34 bp, Artificial Sequence
  Description of Artificial Sequence: Synthetic oligonucleotide
cacaaggatgactgatgtagacagaaatggcacc

SEQ ID NO: 196827 - DNA, 35 bp, Artificial Sequence
  Description of Artificial Sequence: Synthetic oligonucleotide
acaaggatgactgatgtagacagaaatggcaccac

SEQ ID NO: 196828 - DNA, 34 bp, Artificial Sequence
  Description of Artificial Sequence: Synthetic oligonucleotide
caaggatgactgatgtagacagaaatggcaccac

SEQ ID NO: 196829 - DNA, 35 bp, Artificial Sequence
  Description of Artificial Sequence: Synthetic oligonucleotide
aaggatgactgatgtagacagaaatggcaccactg

SEQ ID NO: 196830 - DNA, 34 bp, Artificial Sequence
  Description of Artificial Sequence: Synthetic oligonucleotide
aggatgactgatgtagacagaaatggcaccactg

SEQ ID NO: 196831 - DNA, 33 bp, Artificial Sequence
  Description of Artificial Sequence: Synthetic oligonucleotide
ggatgactgatgtagacagaaatggcaccactg

SEQ ID NO: 196832 - DNA, 33 bp, Artificial Sequence
  Description of Artificial Sequence: Synthetic oligonucleotide
gatgactgatgtagacagaaatggcaccactgc

SEQ ID NO: 196833 - DNA, 37 bp, Artificial Sequence
  Description of Artificial Sequence: Synthetic oligonucleotide
atgactgatgtagacagaaatggcaccactgcttatg

SEQ ID NO: 196834 - DNA, 36 bp, Artificial Sequence
  Description of Artificial Sequence: Synthetic oligonucleotide
tgactgatgtagacagaaatggcaccactgcttatg

SEQ ID NO: 196835 - DNA, 35 bp, Artificial Sequence
  Description of Artificial Sequence: Synthetic oligonucleotide
gactgatgtagacagaaatggcaccactgcttatg

SEQ ID NO: 196836 - DNA, 37 bp, Artificial Sequence
  Description of Artificial Sequence: Synthetic oligonucleotide
actgatgtagacagaaatggcaccactgcttatgaag

SEQ ID NO: 196837 - DNA, 36 bp, Artificial Sequence
  Description of Artificial Sequence: Synthetic oligonucleotide
ctgatgtagacagaaatggcaccactgcttatgaag

SEQ ID NO: 196838 - DNA, 36 bp, Artificial Sequence
  Description of Artificial Sequence: Synthetic oligonucleotide
tgatgtagacagaaatggcaccactgcttatgaagg

SEQ ID NO: 196839 - DNA, 35 bp, Artificial Sequence
  Description of Artificial Sequence: Synthetic oligonucleotide
gatgtagacagaaatggcaccactgcttatgaagg

SEQ ID NO: 196840 - DNA, 38 bp, Artificial Sequence
  Description of Artificial Sequence: Synthetic oligonucleotide
atgtagacagaaatggcaccactgcttatgaaggaaac

SEQ ID NO: 196841 - DNA, 37 bp, Artificial Sequence
  Description of Artificial Sequence: Synthetic oligonucleotide
tgtagacagaaatggcaccactgcttatgaaggaaac

SEQ ID NO: 196842 - DNA, 36 bp, Artificial Sequence
  Description of Artificial Sequence: Synthetic oligonucleotide
gtagacagaaatggcaccactgcttatgaaggaaac

SEQ ID NO: 196843 - DNA, 37 bp, Artificial Sequence
  Description of Artificial Sequence: Synthetic oligonucleotide
tagacagaaatggcaccactgcttatgaaggaaactg

SEQ ID NO: 196844 - DNA, 36 bp, Artificial Sequence
  Description of Artificial Sequence: Synthetic oligonucleotide
agacagaaatggcaccactgcttatgaaggaaactg

SEQ ID NO: 196845 - DNA, 35 bp, Artificial Sequence
  Description of Artificial Sequence: Synthetic oligonucleotide
gacagaaatggcaccactgcttatgaaggaaactg

SEQ ID NO: 196846 - DNA, 35 bp, Artificial Sequence
  Description of Artificial Sequence: Synthetic oligonucleotide
acagaaatggcaccactgcttatgaaggaaactgg

SEQ ID NO: 196847 - DNA, 34 bp, Artificial Sequence
  Description of Artificial Sequence: Synthetic oligonucleotide
cagaaatggcaccactgcttatgaaggaaactgg

SEQ ID NO: 196848 - DNA, 36 bp, Artificial Sequence
  Description of Artificial Sequence: Synthetic oligonucleotide
agaaatggcaccactgcttatgaaggaaactggaac

SEQ ID NO: 196849 - DNA, 35 bp, Artificial Sequence
  Description of Artificial Sequence: Synthetic oligonucleotide
gaaatggcaccactgcttatgaaggaaactggaac

SEQ ID NO: 196850 - DNA, 35 bp, Artificial Sequence
  Description of Artificial Sequence: Synthetic oligonucleotide
aaatggcaccactgcttatgaaggaaactggaacc

SEQ ID NO: 196851 - DNA, 34 bp, Artificial Sequence
  Description of Artificial Sequence: Synthetic oligonucleotide
aatggcaccactgcttatgaaggaaactggaacc

SEQ ID NO: 196852 - DNA, 33 bp, Artificial Sequence
  Description of Artificial Sequence: Synthetic oligonucleotide
atggcaccactgcttatgaaggaaactggaacc

SEQ ID NO: 196853 - DNA, 32 bp, Artificial Sequence
  Description of Artificial Sequence: Synthetic oligonucleotide
tggcaccactgcttatgaaggaaactggaacc

SEQ ID NO: 196854 - DNA, 31 bp, Artificial Sequence
  Description of Artificial Sequence: Synthetic oligonucleotide
ggcaccactgcttatgaaggaaactggaacc

SEQ ID NO: 196855 - DNA, 31 bp, Artificial Sequence
  Description of Artificial Sequence: Synthetic oligonucleotide
gcaccactgcttatgaaggaaactggaaccc

SEQ ID NO: 196856 - DNA, 32 bp, Artificial Sequence
  Description of Artificial Sequence: Synthetic oligonucleotide
caccactgcttatgaaggaaactggaacccag

SEQ ID NO: 196857 - DNA, 34 bp, Artificial Sequence
  Description of Artificial Sequence: Synthetic oligonucleotide
accactgcttatgaaggaaactggaacccagaag

SEQ ID NO: 196858 - DNA, 33 bp, Artificial Sequence
  Description of Artificial Sequence: Synthetic oligonucleotide
ccactgcttatgaaggaaactggaacccagaag

SEQ ID NO: 196859 - DNA, 33 bp, Artificial Sequence
  Description of Artificial Sequence: Synthetic oligonucleotide
cactgcttatgaaggaaactggaacccagaagc

SEQ ID NO: 196860 - DNA, 34 bp, Artificial Sequence
  Description of Artificial Sequence: Synthetic oligonucleotide
actgcttatgaaggaaactggaacccagaagcac

SEQ ID NO: 196861 - DNA, 33 bp, Artificial Sequence
  Description of Artificial Sequence: Synthetic oligonucleotide
ctgcttatgaaggaaactggaacccagaagcac

SEQ ID NO: 196862 - DNA, 34 bp, Artificial Sequence
  Description of Artificial Sequence: Synthetic oligonucleotide
tgcttatgaaggaaactggaacccagaagcacac

SEQ ID NO: 196863 - DNA, 33 bp, Artificial Sequence
  Description of Artificial Sequence: Synthetic oligonucleotide
gcttatgaaggaaactggaacccagaagcacac

SEQ ID NO: 196864 - DNA, 33 bp, Artificial Sequence
  Description of Artificial Sequence: Synthetic oligonucleotide
cttatgaaggaaactggaacccagaagcacacc

SEQ ID NO: 196865 - DNA, 33 bp, Artificial Sequence
  Description of Artificial Sequence: Synthetic oligonucleotide
ttatgaaggaaactggaacccagaagcacaccc

SEQ ID NO: 196866 - DNA, 32 bp, Artificial Sequence
  Description of Artificial Sequence: Synthetic oligonucleotide
tatgaaggaaactggaacccagaagcacaccc

SEQ ID NO: 196867 - DNA, 31 bp, Artificial Sequence
  Description of Artificial Sequence: Synthetic oligonucleotide
atgaaggaaactggaacccagaagcacaccc

SEQ ID NO: 196868 - DNA, 30 bp, Artificial Sequence
  Description of Artificial Sequence: Synthetic oligonucleotide
tgaaggaaactggaacccagaagcacaccc

SEQ ID NO: 196869 - DNA, 29 bp, Artificial Sequence
  Description of Artificial Sequence: Synthetic oligonucleotide
gaaggaaactggaacccagaagcacaccc

SEQ ID NO: 196870 - DNA, 30 bp, Artificial Sequence
  Description of Artificial Sequence: Synthetic oligonucleotide
aaggaaactggaacccagaagcacaccctc

SEQ ID NO: 196871 - DNA, 29 bp, Artificial Sequence
  Description of Artificial Sequence: Synthetic oligonucleotide
aggaaactggaacccagaagcacaccctc

SEQ ID NO: 196872 - DNA, 28 bp, Artificial Sequence
  Description of Artificial Sequence: Synthetic oligonucleotide
ggaaactggaacccagaagcacaccctc

SEQ ID NO: 196873 - DNA, 28 bp, Artificial Sequence
  Description of Artificial Sequence: Synthetic oligonucleotide
gaaactggaacccagaagcacaccctcc

SEQ ID NO: 196874 - DNA, 28 bp, Artificial Sequence
  Description of Artificial Sequence: Synthetic oligonucleotide
aaactggaacccagaagcacaccctccc

SEQ ID NO: 196875 - DNA, 27 bp, Artificial Sequence
  Description of Artificial Sequence: Synthetic oligonucleotide
aactggaacccagaagcacaccctccc

SEQ ID NO: 196876 - DNA, 26 bp, Artificial Sequence
  Description of Artificial Sequence: Synthetic oligonucleotide
actggaacccagaagcacaccctccc

SEQ ID NO: 196877 - DNA, 25 bp, Artificial Sequence
  Description of Artificial Sequence: Synthetic oligonucleotide
ctggaacccagaagcacaccctccc

SEQ ID NO: 196878 - DNA, 26 bp, Artificial Sequence
  Description of Artificial Sequence: Synthetic oligonucleotide
tggaacccagaagcacaccctcccct

SEQ ID NO: 196879 - DNA, 25 bp, Artificial Sequence
  Description of Artificial Sequence: Synthetic oligonucleotide
ggaacccagaagcacaccctcccct

SEQ ID NO: 196880 - DNA, 27 bp, Artificial Sequence
  Description of Artificial Sequence: Synthetic oligonucleotide
gaacccagaagcacaccctcccctcat

SEQ ID NO: 196881 - DNA, 28 bp, Artificial Sequence
  Description of Artificial Sequence: Synthetic oligonucleotide
aacccagaagcacaccctcccctcattc

SEQ ID NO: 196882 - DNA, 27 bp, Artificial Sequence
  Description of Artificial Sequence: Synthetic oligonucleotide
acccagaagcacaccctcccctcattc

SEQ ID NO: 196883 - DNA, 27 bp, Artificial Sequence
  Description of Artificial Sequence: Synthetic oligonucleotide
cccagaagcacaccctcccctcattca

SEQ ID NO: 196884 - DNA, 27 bp, Artificial Sequence
  Description of Artificial Sequence: Synthetic oligonucleotide
ccagaagcacaccctcccctcattcac

SEQ ID NO: 196885 - DNA, 27 bp, Artificial Sequence
  Description of Artificial Sequence: Synthetic oligonucleotide
cagaagcacaccctcccctcattcacc

SEQ ID NO: 196886 - DNA, 29 bp, Artificial Sequence
  Description of Artificial Sequence: Synthetic oligonucleotide
agaagcacaccctcccctcattcaccatg

SEQ ID NO: 196887 - DNA, 28 bp, Artificial Sequence
  Description of Artificial Sequence: Synthetic oligonucleotide
gaagcacaccctcccctcattcaccatg

SEQ ID NO: 196888 - DNA, 29 bp, Artificial Sequence
  Description of Artificial Sequence: Synthetic oligonucleotide
aagcacaccctcccctcattcaccatgag

SEQ ID NO: 196889 - DNA, 28 bp, Artificial Sequence
  Description of Artificial Sequence: Synthetic oligonucleotide
agcacaccctcccctcattcaccatgag

SEQ ID NO: 196890 - DNA, 27 bp, Artificial Sequence
  Description of Artificial Sequence: Synthetic oligonucleotide
gcacaccctcccctcattcaccatgag

SEQ ID NO: 196891 - DNA, 27 bp, Artificial Sequence
  Description of Artificial Sequence: Synthetic oligonucleotide
cacaccctcccctcattcaccatgagc

SEQ ID NO: 196892 - DNA, 29 bp, Artificial Sequence
  Description of Artificial Sequence: Synthetic oligonucleotide
acaccctcccctcattcaccatgagcatc

SEQ ID NO: 196893 - DNA, 28 bp, Artificial Sequence
  Description of Artificial Sequence: Synthetic oligonucleotide
caccctcccctcattcaccatgagcatc

SEQ ID NO: 196894 - DNA, 30 bp, Artificial Sequence
  Description of Artificial Sequence: Synthetic oligonucleotide
accctcccctcattcaccatgagcatcatg

SEQ ID NO: 196895 - DNA, 29 bp, Artificial Sequence
  Description of Artificial Sequence: Synthetic oligonucleotide
ccctcccctcattcaccatgagcatcatg

SEQ ID NO: 196896 - DNA, 30 bp, Artificial Sequence
  Description of Artificial Sequence: Synthetic oligonucleotide
cctcccctcattcaccatgagcatcatgag

SEQ ID NO: 196897 - DNA, 30 bp, Artificial Sequence
  Description of Artificial Sequence: Synthetic oligonucleotide
ctcccctcattcaccatgagcatcatgagg

SEQ ID NO: 196898 - DNA, 32 bp, Artificial Sequence
  Description of Artificial Sequence: Synthetic oligonucleotide
tcccctcattcaccatgagcatcatgaggaag

SEQ ID NO: 196899 - DNA, 31 bp, Artificial Sequence
  Description of Artificial Sequence: Synthetic oligonucleotide
cccctcattcaccatgagcatcatgaggaag

SEQ ID NO: 196900 - DNA, 33 bp, Artificial Sequence
  Description of Artificial Sequence: Synthetic oligonucleotide
ccctcattcaccatgagcatcatgaggaagaag

SEQ ID NO: 196901 - DNA, 34 bp, Artificial Sequence
  Description of Artificial Sequence: Synthetic oligonucleotide
cctcattcaccatgagcatcatgaggaagaagag

SEQ ID NO: 196902 - DNA, 35 bp, Artificial Sequence
  Description of Artificial Sequence: Synthetic oligonucleotide
ctcattcaccatgagcatcatgaggaagaagagac

SEQ ID NO: 196903 - DNA, 35 bp, Artificial Sequence
  Description of Artificial Sequence: Synthetic oligonucleotide
tcattcaccatgagcatcatgaggaagaagagacc

SEQ ID NO: 196904 - DNA, 34 bp, Artificial Sequence
  Description of Artificial Sequence: Synthetic oligonucleotide
cattcaccatgagcatcatgaggaagaagagacc

SEQ ID NO: 196905 - DNA, 34 bp, Artificial Sequence
  Description of Artificial Sequence: Synthetic oligonucleotide
attcaccatgagcatcatgaggaagaagagaccc

SEQ ID NO: 196906 - DNA, 33 bp, Artificial Sequence
  Description of Artificial Sequence: Synthetic oligonucleotide
ttcaccatgagcatcatgaggaagaagagaccc

SEQ ID NO: 196907 - DNA, 32 bp, Artificial Sequence
  Description of Artificial Sequence: Synthetic oligonucleotide
tcaccatgagcatcatgaggaagaagagaccc

SEQ ID NO: 196908 - DNA, 31 bp, Artificial Sequence
  Description of Artificial Sequence: Synthetic oligonucleotide
caccatgagcatcatgaggaagaagagaccc

SEQ ID NO: 196909 - DNA, 31 bp, Artificial Sequence
  Description of Artificial Sequence: Synthetic oligonucleotide
accatgagcatcatgaggaagaagagacccc

SEQ ID NO: 196910 - DNA, 30 bp, Artificial Sequence
  Description of Artificial Sequence: Synthetic oligonucleotide
ccatgagcatcatgaggaagaagagacccc

SEQ ID NO: 196911 - DNA, 31 bp, Artificial Sequence
  Description of Artificial Sequence: Synthetic oligonucleotide
catgagcatcatgaggaagaagagaccccac

SEQ ID NO: 196912 - DNA, 34 bp, Artificial Sequence
  Description of Artificial Sequence: Synthetic oligonucleotide
atgagcatcatgaggaagaagagaccccacattc

SEQ ID NO: 196913 - DNA, 33 bp, Artificial Sequence
  Description of Artificial Sequence: Synthetic oligonucleotide
tgagcatcatgaggaagaagagaccccacattc

SEQ ID NO: 196914 - DNA, 32 bp, Artificial Sequence
  Description of Artificial Sequence: Synthetic oligonucleotide
gagcatcatgaggaagaagagaccccacattc

SEQ ID NO: 196915 - DNA, 34 bp, Artificial Sequence
  Description of Artificial Sequence: Synthetic oligonucleotide
agcatcatgaggaagaagagaccccacattctac

SEQ ID NO: 196916 - DNA, 33 bp, Artificial Sequence
  Description of Artificial Sequence: Synthetic oligonucleotide
gcatcatgaggaagaagagaccccacattctac

SEQ ID NO: 196917 - DNA, 35 bp, Artificial Sequence
  Description of Artificial Sequence: Synthetic oligonucleotide
catcatgaggaagaagagaccccacattctacaag

SEQ ID NO: 196918 - DNA, 35 bp, Artificial Sequence
  Description of Artificial Sequence: Synthetic oligonucleotide
atcatgaggaagaagagaccccacattctacaagc

SEQ ID NO: 196919 - DNA, 34 bp, Artificial Sequence
  Description of Artificial Sequence: Synthetic oligonucleotide
tcatgaggaagaagagaccccacattctacaagc

SEQ ID NO: 196920 - DNA, 33 bp, Artificial Sequence
  Description of Artificial Sequence: Synthetic oligonucleotide
catgaggaagaagagaccccacattctacaagc

SEQ ID NO: 196921 - DNA, 34 bp, Artificial Sequence
  Description of Artificial Sequence: Synthetic oligonucleotide
atgaggaagaagagaccccacattctacaagcac

SEQ ID NO: 196922 - DNA, 33 bp, Artificial Sequence
  Description of Artificial Sequence: Synthetic oligonucleotide
tgaggaagaagagaccccacattctacaagcac

SEQ ID NO: 196923 - DNA, 32 bp, Artificial Sequence
  Description of Artificial Sequence: Synthetic oligonucleotide
gaggaagaagagaccccacattctacaagcac

SEQ ID NO: 196924 - DNA, 35 bp, Artificial Sequence
  Description of Artificial Sequence: Synthetic oligonucleotide
aggaagaagagaccccacattctacaagcacaatc

SEQ ID NO: 196925 - DNA, 34 bp, Artificial Sequence
  Description of Artificial Sequence: Synthetic oligonucleotide
ggaagaagagaccccacattctacaagcacaatc

SEQ ID NO: 196926 - DNA, 34 bp, Artificial Sequence
  Description of Artificial Sequence: Synthetic oligonucleotide
gaagaagagaccccacattctacaagcacaatcc

SEQ ID NO: 196927 - DNA, 35 bp, Artificial Sequence
  Description of Artificial Sequence: Synthetic oligonucleotide
aagaagagaccccacattctacaagcacaatccag

SEQ ID NO: 196928 - DNA, 34 bp, Artificial Sequence
  Description of Artificial Sequence: Synthetic oligonucleotide
agaagagaccccacattctacaagcacaatccag

SEQ ID NO: 196929 - DNA, 33 bp, Artificial Sequence
  Description of Artificial Sequence: Synthetic oligonucleotide
gaagagaccccacattctacaagcacaatccag

SEQ ID NO: 196930 - DNA, 33 bp, Artificial Sequence
  Description of Artificial Sequence: Synthetic oligonucleotide
aagagaccccacattctacaagcacaatccagg

SEQ ID NO: 196931 - DNA, 32 bp, Artificial Sequence
  Description of Artificial Sequence: Synthetic oligonucleotide
agagaccccacattctacaagcacaatccagg

SEQ ID NO: 196932 - DNA, 31 bp, Artificial Sequence
  Description of Artificial Sequence: Synthetic oligonucleotide
gagaccccacattctacaagcacaatccagg

SEQ ID NO: 196933 - DNA, 31 bp, Artificial Sequence
  Description of Artificial Sequence: Synthetic oligonucleotide
agaccccacattctacaagcacaatccaggc

SEQ ID NO: 196934 - DNA, 30 bp, Artificial Sequence
  Description of Artificial Sequence: Synthetic oligonucleotide
gaccccacattctacaagcacaatccaggc

SEQ ID NO: 196935 - DNA, 32 bp, Artificial Sequence
  Description of Artificial Sequence: Synthetic oligonucleotide
accccacattctacaagcacaatccaggcaac

SEQ ID NO: 196936 - DNA, 31 bp, Artificial Sequence
  Description of Artificial Sequence: Synthetic oligonucleotide
ccccacattctacaagcacaatccaggcaac

SEQ ID NO: 196937 - DNA, 32 bp, Artificial Sequence
  Description of Artificial Sequence: Synthetic oligonucleotide
cccacattctacaagcacaatccaggcaactc

SEQ ID NO: 196938 - DNA, 32 bp, Artificial Sequence
  Description of Artificial Sequence: Synthetic oligonucleotide
ccacattctacaagcacaatccaggcaactcc

SEQ ID NO: 196939 - DNA, 34 bp, Artificial Sequence
  Description of Artificial Sequence: Synthetic oligonucleotide
cacattctacaagcacaatccaggcaactcctag

SEQ ID NO: 196940 - DNA, 36 bp, Artificial Sequence
  Description of Artificial Sequence: Synthetic oligonucleotide
acattctacaagcacaatccaggcaactcctagtag

SEQ ID NO: 196941 - DNA, 35 bp, Artificial Sequence
  Description of Artificial Sequence: Synthetic oligonucleotide
cattctacaagcacaatccaggcaactcctagtag

SEQ ID NO: 196942 - DNA, 37 bp, Artificial Sequence
  Description of Artificial Sequence: Synthetic oligonucleotide
attctacaagcacaatccaggcaactcctagtagtac

SEQ ID NO: 196943 - DNA, 36 bp, Artificial Sequence
  Description of Artificial Sequence: Synthetic oligonucleotide
ttctacaagcacaatccaggcaactcctagtagtac

SEQ ID NO: 196944 - DNA, 35 bp, Artificial Sequence
  Description of Artificial Sequence: Synthetic oligonucleotide
tctacaagcacaatccaggcaactcctagtagtac

SEQ ID NO: 196945 - DNA, 34 bp, Artificial Sequence
  Description of Artificial Sequence: Synthetic oligonucleotide
ctacaagcacaatccaggcaactcctagtagtac

SEQ ID NO: 196946 - DNA, 36 bp, Artificial Sequence
  Description of Artificial Sequence: Synthetic oligonucleotide
tacaagcacaatccaggcaactcctagtagtacaac

SEQ ID NO: 196947 - DNA, 35 bp, Artificial Sequence
  Description of Artificial Sequence: Synthetic oligonucleotide
acaagcacaatccaggcaactcctagtagtacaac

SEQ ID NO: 196948 - DNA, 34 bp, Artificial Sequence
  Description of Artificial Sequence: Synthetic oligonucleotide
caagcacaatccaggcaactcctagtagtacaac

SEQ ID NO: 196949 - DNA, 34 bp, Artificial Sequence
  Description of Artificial Sequence: Synthetic oligonucleotide
aagcacaatccaggcaactcctagtagtacaacg

SEQ ID NO: 196950 - DNA, 33 bp, Artificial Sequence
  Description of Artificial Sequence: Synthetic oligonucleotide
agcacaatccaggcaactcctagtagtacaacg

SEQ ID NO: 196951 - DNA, 32 bp, Artificial Sequence
  Description of Artificial Sequence: Synthetic oligonucleotide
gcacaatccaggcaactcctagtagtacaacg

SEQ ID NO: 196952 - DNA, 32 bp, Artificial Sequence
  Description of Artificial Sequence: Synthetic oligonucleotide
cacaatccaggcaactcctagtagtacaacgg

SEQ ID NO: 196953 - DNA, 34 bp, Artificial Sequence
  Description of Artificial Sequence: Synthetic oligonucleotide
acaatccaggcaactcctagtagtacaacggaag

SEQ ID NO: 196954 - DNA, 33 bp, Artificial Sequence
  Description of Artificial Sequence: Synthetic oligonucleotide
caatccaggcaactcctagtagtacaacggaag

SEQ ID NO: 196955 - DNA, 36 bp, Artificial Sequence
  Description of Artificial Sequence: Synthetic oligonucleotide
aatccaggcaactcctagtagtacaacggaagaaac

SEQ ID NO: 196956 - DNA, 35 bp, Artificial Sequence
  Description of Artificial Sequence: Synthetic oligonucleotide
atccaggcaactcctagtagtacaacggaagaaac

SEQ ID NO: 196957 - DNA, 34 bp, Artificial Sequence
  Description of Artificial Sequence: Synthetic oligonucleotide
tccaggcaactcctagtagtacaacggaagaaac

SEQ ID NO: 196958 - DNA, 33 bp, Artificial Sequence
  Description of Artificial Sequence: Synthetic oligonucleotide
ccaggcaactcctagtagtacaacggaagaaac

SEQ ID NO: 196959 - DNA, 34 bp, Artificial Sequence
  Description of Artificial Sequence: Synthetic oligonucleotide
caggcaactcctagtagtacaacggaagaaacag

SEQ ID NO: 196960 - DNA, 34 bp, Artificial Sequence
  Description of Artificial Sequence: Synthetic oligonucleotide
aggcaactcctagtagtacaacggaagaaacagc

SEQ ID NO: 196961 - DNA, 33 bp, Artificial Sequence
  Description of Artificial Sequence: Synthetic oligonucleotide
ggcaactcctagtagtacaacggaagaaacagc

SEQ ID NO: 196962 - DNA, 35 bp, Artificial Sequence
  Description of Artificial Sequence: Synthetic oligonucleotide
gcaactcctagtagtacaacggaagaaacagctac

SEQ ID NO: 196963 - DNA, 35 bp, Artificial Sequence
  Description of Artificial Sequence: Synthetic oligonucleotide
caactcctagtagtacaacggaagaaacagctacc

SEQ ID NO: 196964 - DNA, 35 bp, Artificial Sequence
  Description of Artificial Sequence: Synthetic oligonucleotide
aactcctagtagtacaacggaagaaacagctaccc

SEQ ID NO: 196965 - DNA, 34 bp, Artificial Sequence
  Description of Artificial Sequence: Synthetic oligonucleotide
actcctagtagtacaacggaagaaacagctaccc

SEQ ID NO: 196966 - DNA, 33 bp, Artificial Sequence
  Description of Artificial Sequence: Synthetic oligonucleotide
ctcctagtagtacaacggaagaaacagctaccc

SEQ ID NO: 196967 - DNA, 34 bp, Artificial Sequence
  Description of Artificial Sequence: Synthetic oligonucleotide
tcctagtagtacaacggaagaaacagctacccag

SEQ ID NO: 196968 - DNA, 33 bp, Artificial Sequence
  Description of Artificial Sequence: Synthetic oligonucleotide
cctagtagtacaacggaagaaacagctacccag

SEQ ID NO: 196969 - DNA, 35 bp, Artificial Sequence
  Description of Artificial Sequence: Synthetic oligonucleotide
ctagtagtacaacggaagaaacagctacccagaag

SEQ ID NO: 196970 - DNA, 35 bp, Artificial Sequence
  Description of Artificial Sequence: Synthetic oligonucleotide
tagtagtacaacggaagaaacagctacccagaagg

SEQ ID NO: 196971 - DNA, 34 bp, Artificial Sequence
  Description of Artificial Sequence: Synthetic oligonucleotide
agtagtacaacggaagaaacagctacccagaagg

SEQ ID NO: 196972 - DNA, 33 bp, Artificial Sequence
  Description of Artificial Sequence: Synthetic oligonucleotide
gtagtacaacggaagaaacagctacccagaagg

SEQ ID NO: 196973 - DNA, 35 bp, Artificial Sequence
  Description of Artificial Sequence: Synthetic oligonucleotide
tagtacaacggaagaaacagctacccagaaggaac

SEQ ID NO: 196974 - DNA, 34 bp, Artificial Sequence
  Description of Artificial Sequence: Synthetic oligonucleotide
agtacaacggaagaaacagctacccagaaggaac

SEQ ID NO: 196975 - DNA, 33 bp, Artificial Sequence
  Description of Artificial Sequence: Synthetic oligonucleotide
gtacaacggaagaaacagctacccagaaggaac

SEQ ID NO: 196976 - DNA, 34 bp, Artificial Sequence
  Description of Artificial Sequence: Synthetic oligonucleotide
tacaacggaagaaacagctacccagaaggaacag

SEQ ID NO: 196977 - DNA, 33 bp, Artificial Sequence
  Description of Artificial Sequence: Synthetic oligonucleotide
acaacggaagaaacagctacccagaaggaacag

SEQ ID NO: 196978 - DNA, 32 bp, Artificial Sequence
  Description of Artificial Sequence: Synthetic oligonucleotide
caacggaagaaacagctacccagaaggaacag

SEQ ID NO: 196979 - DNA, 33 bp, Artificial Sequence
  Description of Artificial Sequence: Synthetic oligonucleotide
aacggaagaaacagctacccagaaggaacagtg

SEQ ID NO: 196980 - DNA, 32 bp, Artificial Sequence
  Description of Artificial Sequence: Synthetic oligonucleotide
acggaagaaacagctacccagaaggaacagtg

SEQ ID NO: 196981 - DNA, 31 bp, Artificial Sequence
  Description of Artificial Sequence: Synthetic oligonucleotide
cggaagaaacagctacccagaaggaacagtg

SEQ ID NO: 196982 - DNA, 31 bp, Artificial Sequence
  Description of Artificial Sequence: Synthetic oligonucleotide
ggaagaaacagctacccagaaggaacagtgg

SEQ ID NO: 196983 - DNA, 34 bp, Artificial Sequence
  Description of Artificial Sequence: Synthetic oligonucleotide
gaagaaacagctacccagaaggaacagtggtttg

SEQ ID NO: 196984 - DNA, 34 bp, Artificial Sequence
  Description of Artificial Sequence: Synthetic oligonucleotide
aagaaacagctacccagaaggaacagtggtttgg

SEQ ID NO: 196985 - DNA, 33 bp, Artificial Sequence
  Description of Artificial Sequence: Synthetic oligonucleotide
agaaacagctacccagaaggaacagtggtttgg

SEQ ID NO: 196986 - DNA, 32 bp, Artificial Sequence
  Description of Artificial Sequence: Synthetic oligonucleotide
gaaacagctacccagaaggaacagtggtttgg

SEQ ID NO: 196987 - DNA, 32 bp, Artificial Sequence
  Description of Artificial Sequence: Synthetic oligonucleotide
aaacagctacccagaaggaacagtggtttggc

SEQ ID NO: 196988 - DNA, 31 bp, Artificial Sequence
  Description of Artificial Sequence: Synthetic oligonucleotide
aacagctacccagaaggaacagtggtttggc

SEQ ID NO: 196989 - DNA, 30 bp, Artificial Sequence
  Description of Artificial Sequence: Synthetic oligonucleotide
acagctacccagaaggaacagtggtttggc

SEQ ID NO: 196990 - DNA, 29 bp, Artificial Sequence
  Description of Artificial Sequence: Synthetic oligonucleotide
cagctacccagaaggaacagtggtttggc

SEQ ID NO: 196991 - DNA, 31 bp, Artificial Sequence
  Description of Artificial Sequence: Synthetic oligonucleotide
agctacccagaaggaacagtggtttggcaac

SEQ ID NO: 196992 - DNA, 30 bp, Artificial Sequence
  Description of Artificial Sequence: Synthetic oligonucleotide
gctacccagaaggaacagtggtttggcaac

SEQ ID NO: 196993 - DNA, 31 bp, Artificial Sequence
  Description of Artificial Sequence: Synthetic oligonucleotide
ctacccagaaggaacagtggtttggcaacag

SEQ ID NO: 196994 - DNA, 33 bp, Artificial Sequence
  Description of Artificial Sequence: Synthetic oligonucleotide
tacccagaaggaacagtggtttggcaacagatg

SEQ ID NO: 196995 - DNA, 32 bp, Artificial Sequence
  Description of Artificial Sequence: Synthetic oligonucleotide
acccagaaggaacagtggtttggcaacagatg

SEQ ID NO: 196996 - DNA, 31 bp, Artificial Sequence
  Description of Artificial Sequence: Synthetic oligonucleotide
cccagaaggaacagtggtttggcaacagatg

SEQ ID NO: 196997 - DNA, 31 bp, Artificial Sequence
  Description of Artificial Sequence: Synthetic oligonucleotide
ccagaaggaacagtggtttggcaacagatgg

SEQ ID NO: 196998 - DNA, 31 bp, Artificial Sequence
  Description of Artificial Sequence: Synthetic oligonucleotide
cagaaggaacagtggtttggcaacagatggc

SEQ ID NO: 196999 - DNA, 33 bp, Artificial Sequence
  Description of Artificial Sequence: Synthetic oligonucleotide
agaaggaacagtggtttggcaacagatggcatg

SEQ ID NO: 197000 - DNA, 32 bp, Artificial Sequence
  Description of Artificial Sequence: Synthetic oligonucleotide
gaaggaacagtggtttggcaacagatggcatg

SEQ ID NO: 197001 - DNA, 33 bp, Artificial Sequence
  Description of Artificial Sequence: Synthetic oligonucleotide
aaggaacagtggtttggcaacagatggcatgag

SEQ ID NO: 197002 - DNA, 32 bp, Artificial Sequence
  Description of Artificial Sequence: Synthetic oligonucleotide
aggaacagtggtttggcaacagatggcatgag

SEQ ID NO: 197003 - DNA, 31 bp, Artificial Sequence
  Description of Artificial Sequence: Synthetic oligonucleotide
ggaacagtggtttggcaacagatggcatgag

SEQ ID NO: 197004 - DNA, 31 bp, Artificial Sequence
  Description of Artificial Sequence: Synthetic oligonucleotide
gaacagtggtttggcaacagatggcatgagg

SEQ ID NO: 197005 - DNA, 31 bp, Artificial Sequence
  Description of Artificial Sequence: Synthetic oligonucleotide
aacagtggtttggcaacagatggcatgaggg

SEQ ID NO: 197006 - DNA, 30 bp, Artificial Sequence
  Description of Artificial Sequence: Synthetic oligonucleotide
acagtggtttggcaacagatggcatgaggg

SEQ ID NO: 197007 - DNA, 29 bp, Artificial Sequence
  Description of Artificial Sequence: Synthetic oligonucleotide
cagtggtttggcaacagatggcatgaggg

SEQ ID NO: 197008 - DNA, 33 bp, Artificial Sequence
  Description of Artificial Sequence: Synthetic oligonucleotide
agtggtttggcaacagatggcatgagggatatc

SEQ ID NO: 197009 - DNA, 32 bp, Artificial Sequence
  Description of Artificial Sequence: Synthetic oligonucleotide
gtggtttggcaacagatggcatgagggatatc

SEQ ID NO: 197010 - DNA, 32 bp, Artificial Sequence
  Description of Artificial Sequence: Synthetic oligonucleotide
tggtttggcaacagatggcatgagggatatcg

SEQ ID NO: 197011 - DNA, 31 bp, Artificial Sequence
  Description of Artificial Sequence: Synthetic oligonucleotide
ggtttggcaacagatggcatgagggatatcg

SEQ ID NO: 197012 - DNA, 31 bp, Artificial Sequence
  Description of Artificial Sequence: Synthetic oligonucleotide
gtttggcaacagatggcatgagggatatcgc

SEQ ID NO: 197013 - DNA, 31 bp, Artificial Sequence
  Description of Artificial Sequence: Synthetic oligonucleotide
tttggcaacagatggcatgagggatatcgcc

SEQ ID NO: 197014 - DNA, 30 bp, Artificial Sequence
  Description of Artificial Sequence: Synthetic oligonucleotide
ttggcaacagatggcatgagggatatcgcc

SEQ ID NO: 197015 - DNA, 29 bp, Artificial Sequence
  Description of Artificial Sequence: Synthetic oligonucleotide
tggcaacagatggcatgagggatatcgcc

SEQ ID NO: 197016 - DNA, 28 bp, Artificial Sequence
  Description of Artificial Sequence: Synthetic oligonucleotide
ggcaacagatggcatgagggatatcgcc

SEQ ID NO: 197017 - DNA, 31 bp, Artificial Sequence
  Description of Artificial Sequence: Synthetic oligonucleotide
gcaacagatggcatgagggatatcgccaaac

SEQ ID NO: 197018 - DNA, 32 bp, Artificial Sequence
  Description of Artificial Sequence: Synthetic oligonucleotide
caacagatggcatgagggatatcgccaaacac

SEQ ID NO: 197019 - DNA, 32 bp, Artificial Sequence
  Description of Artificial Sequence: Synthetic oligonucleotide
aacagatggcatgagggatatcgccaaacacc

SEQ ID NO: 197020 - DNA, 31 bp, Artificial Sequence
  Description of Artificial Sequence: Synthetic oligonucleotide
acagatggcatgagggatatcgccaaacacc

SEQ ID NO: 197021 - DNA, 30 bp, Artificial Sequence
  Description of Artificial Sequence: Synthetic oligonucleotide
cagatggcatgagggatatcgccaaacacc

SEQ ID NO: 197022 - DNA, 30 bp, Artificial Sequence
  Description of Artificial Sequence: Synthetic oligonucleotide
agatggcatgagggatatcgccaaacaccc

SEQ ID NO: 197023 - DNA, 29 bp, Artificial Sequence
  Description of Artificial Sequence: Synthetic oligonucleotide
gatggcatgagggatatcgccaaacaccc

SEQ ID NO: 197024 - DNA, 32 bp, Artificial Sequence
  Description of Artificial Sequence: Synthetic oligonucleotide
atggcatgagggatatcgccaaacacccaaag

SEQ ID NO: 197025 - DNA, 31 bp, Artificial Sequence
  Description of Artificial Sequence: Synthetic oligonucleotide
tggcatgagggatatcgccaaacacccaaag

SEQ ID NO: 197026 - DNA, 30 bp, Artificial Sequence
  Description of Artificial Sequence: Synthetic oligonucleotide
ggcatgagggatatcgccaaacacccaaag

SEQ ID NO: 197027 - DNA, 32 bp, Artificial Sequence
  Description of Artificial Sequence: Synthetic oligonucleotide
gcatgagggatatcgccaaacacccaaagaag

SEQ ID NO: 197028 - DNA, 33 bp, Artificial Sequence
  Description of Artificial Sequence: Synthetic oligonucleotide
catgagggatatcgccaaacacccaaagaagac

SEQ ID NO: 197029 - DNA, 34 bp, Artificial Sequence
  Description of Artificial Sequence: Synthetic oligonucleotide
atgagggatatcgccaaacacccaaagaagactc

SEQ ID NO: 197030 - DNA, 33 bp, Artificial Sequence
  Description of Artificial Sequence: Synthetic oligonucleotide
tgagggatatcgccaaacacccaaagaagactc

SEQ ID NO: 197031 - DNA, 32 bp, Artificial Sequence
  Description of Artificial Sequence: Synthetic oligonucleotide
gagggatatcgccaaacacccaaagaagactc

SEQ ID NO: 197032 - DNA, 32 bp, Artificial Sequence
  Description of Artificial Sequence: Synthetic oligonucleotide
agggatatcgccaaacacccaaagaagactcc

SEQ ID NO: 197033 - DNA, 31 bp, Artificial Sequence
  Description of Artificial Sequence: Synthetic oligonucleotide
gggatatcgccaaacacccaaagaagactcc

SEQ ID NO: 197034 - DNA, 31 bp, Artificial Sequence
  Description of Artificial Sequence: Synthetic oligonucleotide
ggatatcgccaaacacccaaagaagactccc

SEQ ID NO: 197035 - DNA, 34 bp, Artificial Sequence
  Description of Artificial Sequence: Synthetic oligonucleotide
gatatcgccaaacacccaaagaagactcccattc

SEQ ID NO: 197036 - DNA, 34 bp, Artificial Sequence
  Description of Artificial Sequence: Synthetic oligonucleotide
atatcgccaaacacccaaagaagactcccattcg

SEQ ID NO: 197037 - DNA, 33 bp, Artificial Sequence
  Description of Artificial Sequence: Synthetic oligonucleotide
tatcgccaaacacccaaagaagactcccattcg

SEQ ID NO: 197038 - DNA, 32 bp, Artificial Sequence
  Description of Artificial Sequence: Synthetic oligonucleotide
atcgccaaacacccaaagaagactcccattcg

SEQ ID NO: 197039 - DNA, 31 bp, Artificial Sequence
  Description of Artificial Sequence: Synthetic oligonucleotide
tcgccaaacacccaaagaagactcccattcg

SEQ ID NO: 197040 - DNA, 30 bp, Artificial Sequence
  Description of Artificial Sequence: Synthetic oligonucleotide
cgccaaacacccaaagaagactcccattcg

SEQ ID NO: 197041 - DNA, 31 bp, Artificial Sequence
  Description of Artificial Sequence: Synthetic oligonucleotide
gccaaacacccaaagaagactcccattcgac

SEQ ID NO: 197042 - DNA, 33 bp, Artificial Sequence
  Description of Artificial Sequence: Synthetic oligonucleotide
ccaaacacccaaagaagactcccattcgacaac

SEQ ID NO: 197043 - DNA, 34 bp, Artificial Sequence
  Description of Artificial Sequence: Synthetic oligonucleotide
caaacacccaaagaagactcccattcgacaacag

SEQ ID NO: 197044 - DNA, 34 bp, Artificial Sequence
  Description of Artificial Sequence: Synthetic oligonucleotide
aaacacccaaagaagactcccattcgacaacagg

SEQ ID NO: 197045 - DNA, 33 bp, Artificial Sequence
  Description of Artificial Sequence: Synthetic oligonucleotide
aacacccaaagaagactcccattcgacaacagg

SEQ ID NO: 197046 - DNA, 32 bp, Artificial Sequence
  Description of Artificial Sequence: Synthetic oligonucleotide
acacccaaagaagactcccattcgacaacagg

SEQ ID NO: 197047 - DNA, 31 bp, Artificial Sequence
  Description of Artificial Sequence: Synthetic oligonucleotide
cacccaaagaagactcccattcgacaacagg

SEQ ID NO: 197048 - DNA, 31 bp, Artificial Sequence
  Description of Artificial Sequence: Synthetic oligonucleotide
acccaaagaagactcccattcgacaacaggg

SEQ ID NO: 197049 - DNA, 30 bp, Artificial Sequence
  Description of Artificial Sequence: Synthetic oligonucleotide
cccaaagaagactcccattcgacaacaggg

SEQ ID NO: 197050 - DNA, 31 bp, Artificial Sequence
  Description of Artificial Sequence: Synthetic oligonucleotide
ccaaagaagactcccattcgacaacagggac

SEQ ID NO: 197051 - DNA, 32 bp, Artificial Sequence
  Description of Artificial Sequence: Synthetic oligonucleotide
caaagaagactcccattcgacaacagggacag

SEQ ID NO: 197052 - DNA, 32 bp, Artificial Sequence
  Description of Artificial Sequence: Synthetic oligonucleotide
aaagaagactcccattcgacaacagggacagc

SEQ ID NO: 197053 - DNA, 31 bp, Artificial Sequence
  Description of Artificial Sequence: Synthetic oligonucleotide
aagaagactcccattcgacaacagggacagc

SEQ ID NO: 197054 - DNA, 30 bp, Artificial Sequence
  Description of Artificial Sequence: Synthetic oligonucleotide
agaagactcccattcgacaacagggacagc

SEQ ID NO: 197055 - DNA, 29 bp, Artificial Sequence
  Description of Artificial Sequence: Synthetic oligonucleotide
gaagactcccattcgacaacagggacagc

SEQ ID NO: 197056 - DNA, 30 bp, Artificial Sequence
  Description of Artificial Sequence: Synthetic oligonucleotide
aagactcccattcgacaacagggacagctg

SEQ ID NO: 197057 - DNA, 29 bp, Artificial Sequence
  Description of Artificial Sequence: Synthetic oligonucleotide
agactcccattcgacaacagggacagctg

SEQ ID NO: 197058 - DNA, 28 bp, Artificial Sequence
  Description of Artificial Sequence: Synthetic oligonucleotide
gactcccattcgacaacagggacagctg

SEQ ID NO: 197059 - DNA, 28 bp, Artificial Sequence
  Description of Artificial Sequence: Synthetic oligonucleotide
actcccattcgacaacagggacagctgc

SEQ ID NO: 197060 - DNA, 27 bp, Artificial Sequence
  Description of Artificial Sequence: Synthetic oligonucleotide
ctcccattcgacaacagggacagctgc

SEQ ID NO: 197061 - DNA, 28 bp, Artificial Sequence
  Description of Artificial Sequence: Synthetic oligonucleotide
tcccattcgacaacagggacagctgcag

SEQ ID NO: 197062 - DNA, 27 bp, Artificial Sequence
  Description of Artificial Sequence: Synthetic oligonucleotide
cccattcgacaacagggacagctgcag

SEQ ID NO: 197063 - DNA, 27 bp, Artificial Sequence
  Description of Artificial Sequence: Synthetic oligonucleotide
ccattcgacaacagggacagctgcagc

SEQ ID NO: 197064 - DNA, 27 bp, Artificial Sequence
  Description of Artificial Sequence: Synthetic oligonucleotide
cattcgacaacagggacagctgcagcc

SEQ ID NO: 197065 - DNA, 28 bp, Artificial Sequence
  Description of Artificial Sequence: Synthetic oligonucleotide
attcgacaacagggacagctgcagcctc

SEQ ID NO: 197066 - DNA, 27 bp, Artificial Sequence
  Description of Artificial Sequence: Synthetic oligonucleotide
ttcgacaacagggacagctgcagcctc

SEQ ID NO: 197067 - DNA, 27 bp, Artificial Sequence
  Description of Artificial Sequence: Synthetic oligonucleotide
tcgacaacagggacagctgcagcctca

SEQ ID NO: 197068 - DNA, 26 bp, Artificial Sequence
  Description of Artificial Sequence: Synthetic oligonucleotide
cgacaacagggacagctgcagcctca

SEQ ID NO: 197069 - DNA, 26 bp, Artificial Sequence
  Description of Artificial Sequence: Synthetic oligonucleotide
gacaacagggacagctgcagcctcag

SEQ ID NO: 197070 - DNA, 27 bp, Artificial Sequence
  Description of Artificial Sequence: Synthetic oligonucleotide
acaacagggacagctgcagcctcagct

SEQ ID NO: 197071 - DNA, 26 bp, Artificial Sequence
  Description of Artificial Sequence: Synthetic oligonucleotide
caacagggacagctgcagcctcagct

SEQ ID NO: 197072 - DNA, 27 bp, Artificial Sequence
  Description of Artificial Sequence: Synthetic oligonucleotide
aacagggacagctgcagcctcagctca

SEQ ID NO: 197073 - DNA, 27 bp, Artificial Sequence
  Description of Artificial Sequence: Synthetic oligonucleotide
acagggacagctgcagcctcagctcat

SEQ ID NO: 197074 - DNA, 27 bp, Artificial Sequence
  Description of Artificial Sequence: Synthetic oligonucleotide
cagggacagctgcagcctcagctcata

SEQ ID NO: 197075 - DNA, 27 bp, Artificial Sequence
  Description of Artificial Sequence: Synthetic oligonucleotide
agggacagctgcagcctcagctcatac

SEQ ID NO: 197076 - DNA, 26 bp, Artificial Sequence
  Description of Artificial Sequence: Synthetic oligonucleotide
gggacagctgcagcctcagctcatac

SEQ ID NO: 197077 - DNA, 27 bp, Artificial Sequence
  Description of Artificial Sequence: Synthetic oligonucleotide
ggacagctgcagcctcagctcatacca

SEQ ID NO: 197078 - DNA, 27 bp, Artificial Sequence
  Description of Artificial Sequence: Synthetic oligonucleotide
gacagctgcagcctcagctcataccag

SEQ ID NO: 197079 - DNA, 27 bp, Artificial Sequence
  Description of Artificial Sequence: Synthetic oligonucleotide
acagctgcagcctcagctcataccagc

SEQ ID NO: 197080 - DNA, 26 bp, Artificial Sequence
  Description of Artificial Sequence: Synthetic oligonucleotide
cagctgcagcctcagctcataccagc

SEQ ID NO: 197081 - DNA, 27 bp, Artificial Sequence
  Description of Artificial Sequence: Synthetic oligonucleotide
agctgcagcctcagctcataccagcca

SEQ ID NO: 197082 - DNA, 27 bp, Artificial Sequence
  Description of Artificial Sequence: Synthetic oligonucleotide
gctgcagcctcagctcataccagccat

SEQ ID NO: 197083 - DNA, 27 bp, Artificial Sequence
  Description of Artificial Sequence: Synthetic oligonucleotide
ctgcagcctcagctcataccagccatc

SEQ ID NO: 197084 - DNA, 27 bp, Artificial Sequence
  Description of Artificial Sequence: Synthetic oligonucleotide
tgcagcctcagctcataccagccatcc

SEQ ID NO: 197085 - DNA, 27 bp, Artificial Sequence
  Description of Artificial Sequence: Synthetic oligonucleotide
gcagcctcagctcataccagccatcca

SEQ ID NO: 197086 - DNA, 29 bp, Artificial Sequence
  Description of Artificial Sequence: Synthetic oligonucleotide
cagcctcagctcataccagccatccaatg

SEQ ID NO: 197087 - DNA, 29 bp, Artificial Sequence
  Description of Artificial Sequence: Synthetic oligonucleotide
agcctcagctcataccagccatccaatgc

SEQ ID NO: 197088 - DNA, 28 bp, Artificial Sequence
  Description of Artificial Sequence: Synthetic oligonucleotide
gcctcagctcataccagccatccaatgc

SEQ ID NO: 197089 - DNA, 30 bp, Artificial Sequence
  Description of Artificial Sequence: Synthetic oligonucleotide
cctcagctcataccagccatccaatgcaag

SEQ ID NO: 197090 - DNA, 30 bp, Artificial Sequence
  Description of Artificial Sequence: Synthetic oligonucleotide
ctcagctcataccagccatccaatgcaagg

SEQ ID NO: 197091 - DNA, 32 bp, Artificial Sequence
  Description of Artificial Sequence: Synthetic oligonucleotide
tcagctcataccagccatccaatgcaaggaag

SEQ ID NO: 197092 - DNA, 31 bp, Artificial Sequence
  Description of Artificial Sequence: Synthetic oligonucleotide
cagctcataccagccatccaatgcaaggaag

SEQ ID NO: 197093 - DNA, 31 bp, Artificial Sequence
  Description of Artificial Sequence: Synthetic oligonucleotide
agctcataccagccatccaatgcaaggaagg

SEQ ID NO: 197094 - DNA, 30 bp, Artificial Sequence
  Description of Artificial Sequence: Synthetic oligonucleotide
gctcataccagccatccaatgcaaggaagg

SEQ ID NO: 197095 - DNA, 31 bp, Artificial Sequence
  Description of Artificial Sequence: Synthetic oligonucleotide
ctcataccagccatccaatgcaaggaaggac

SEQ ID NO: 197096 - DNA, 33 bp, Artificial Sequence
  Description of Artificial Sequence: Synthetic oligonucleotide
tcataccagccatccaatgcaaggaaggacaac

SEQ ID NO: 197097 - DNA, 32 bp, Artificial Sequence
  Description of Artificial Sequence: Synthetic oligonucleotide
cataccagccatccaatgcaaggaaggacaac

SEQ ID NO: 197098 - DNA, 33 bp, Artificial Sequence
  Description of Artificial Sequence: Synthetic oligonucleotide
ataccagccatccaatgcaaggaaggacaacac

SEQ ID NO: 197099 - DNA, 32 bp, Artificial Sequence
  Description of Artificial Sequence: Synthetic oligonucleotide
taccagccatccaatgcaaggaaggacaacac

SEQ ID NO: 197100 - DNA, 31 bp, Artificial Sequence
  Description of Artificial Sequence: Synthetic oligonucleotide
accagccatccaatgcaaggaaggacaacac

SEQ ID NO: 197101 - DNA, 30 bp, Artificial Sequence
  Description of Artificial Sequence: Synthetic oligonucleotide
ccagccatccaatgcaaggaaggacaacac

SEQ ID NO: 197102 - DNA, 30 bp, Artificial Sequence
  Description of Artificial Sequence: Synthetic oligonucleotide
cagccatccaatgcaaggaaggacaacacc

SEQ ID NO: 197103 - DNA, 32 bp, Artificial Sequence
  Description of Artificial Sequence: Synthetic oligonucleotide
agccatccaatgcaaggaaggacaacaccaag

SEQ ID NO: 197104 - DNA, 31 bp, Artificial Sequence
  Description of Artificial Sequence: Synthetic oligonucleotide
gccatccaatgcaaggaaggacaacaccaag

SEQ ID NO: 197105 - DNA, 31 bp, Artificial Sequence
  Description of Artificial Sequence: Synthetic oligonucleotide
ccatccaatgcaaggaaggacaacaccaagc

SEQ ID NO: 197106 - DNA, 31 bp, Artificial Sequence
  Description of Artificial Sequence: Synthetic oligonucleotide
catccaatgcaaggaaggacaacaccaagcc

SEQ ID NO: 197107 - DNA, 31 bp, Artificial Sequence
  Description of Artificial Sequence: Synthetic oligonucleotide
atccaatgcaaggaaggacaacaccaagccc

SEQ ID NO: 197108 - DNA, 30 bp, Artificial Sequence
  Description of Artificial Sequence: Synthetic oligonucleotide
tccaatgcaaggaaggacaacaccaagccc

SEQ ID NO: 197109 - DNA, 29 bp, Artificial Sequence
  Description of Artificial Sequence: Synthetic oligonucleotide
ccaatgcaaggaaggacaacaccaagccc

SEQ ID NO: 197110 - DNA, 30 bp, Artificial Sequence
  Description of Artificial Sequence: Synthetic oligonucleotide
caatgcaaggaaggacaacaccaagcccag

SEQ ID NO: 197111 - DNA, 31 bp, Artificial Sequence
  Description of Artificial Sequence: Synthetic oligonucleotide
aatgcaaggaaggacaacaccaagcccagag

SEQ ID NO: 197112 - DNA, 30 bp, Artificial Sequence
  Description of Artificial Sequence: Synthetic oligonucleotide
atgcaaggaaggacaacaccaagcccagag

SEQ ID NO: 197113 - DNA, 29 bp, Artificial Sequence
  Description of Artificial Sequence: Synthetic oligonucleotide
tgcaaggaaggacaacaccaagcccagag

SEQ ID NO: 197114 - DNA, 28 bp, Artificial Sequence
  Description of Artificial Sequence: Synthetic oligonucleotide
gcaaggaaggacaacaccaagcccagag

SEQ ID NO: 197115 - DNA, 28 bp, Artificial Sequence
  Description of Artificial Sequence: Synthetic oligonucleotide
caaggaaggacaacaccaagcccagagg

SEQ ID NO: 197116 - DNA, 29 bp, Artificial Sequence
  Description of Artificial Sequence: Synthetic oligonucleotide
aaggaaggacaacaccaagcccagaggac

SEQ ID NO: 197117 - DNA, 28 bp, Artificial Sequence
  Description of Artificial Sequence: Synthetic oligonucleotide
aggaaggacaacaccaagcccagaggac

SEQ ID NO: 197118 - DNA, 27 bp, Artificial Sequence
  Description of Artificial Sequence: Synthetic oligonucleotide
ggaaggacaacaccaagcccagaggac

SEQ ID NO: 197119 - DNA, 28 bp, Artificial Sequence
  Description of Artificial Sequence: Synthetic oligonucleotide
gaaggacaacaccaagcccagaggacag

SEQ ID NO: 197120 - DNA, 30 bp, Artificial Sequence
  Description of Artificial Sequence: Synthetic oligonucleotide
aaggacaacaccaagcccagaggacagttc

SEQ ID NO: 197121 - DNA, 29 bp, Artificial Sequence
  Description of Artificial Sequence: Synthetic oligonucleotide
aggacaacaccaagcccagaggacagttc

SEQ ID NO: 197122 - DNA, 28 bp, Artificial Sequence
  Description of Artificial Sequence: Synthetic oligonucleotide
ggacaacaccaagcccagaggacagttc

SEQ ID NO: 197123 - DNA, 28 bp, Artificial Sequence
  Description of Artificial Sequence: Synthetic oligonucleotide
gacaacaccaagcccagaggacagttcc

SEQ ID NO: 197124 - DNA, 29 bp, Artificial Sequence
  Description of Artificial Sequence: Synthetic oligonucleotide
acaacaccaagcccagaggacagttcctg

SEQ ID NO: 197125 - DNA, 28 bp, Artificial Sequence
  Description of Artificial Sequence: Synthetic oligonucleotide
caacaccaagcccagaggacagttcctg

SEQ ID NO: 197126 - DNA, 28 bp, Artificial Sequence
  Description of Artificial Sequence: Synthetic oligonucleotide
aacaccaagcccagaggacagttcctgg

SEQ ID NO: 197127 - DNA, 27 bp, Artificial Sequence
  Description of Artificial Sequence: Synthetic oligonucleotide
acaccaagcccagaggacagttcctgg

SEQ ID NO: 197128 - DNA, 27 bp, Artificial Sequence
  Description of Artificial Sequence: Synthetic oligonucleotide
caccaagcccagaggacagttcctgga

SEQ ID NO: 197129 - DNA, 27 bp, Artificial Sequence
  Description of Artificial Sequence: Synthetic oligonucleotide
accaagcccagaggacagttcctggac

SEQ ID NO: 197130 - DNA, 27 bp, Artificial Sequence
  Description of Artificial Sequence: Synthetic oligonucleotide
ccaagcccagaggacagttcctggact

SEQ ID NO: 197131 - DNA, 27 bp, Artificial Sequence
  Description of Artificial Sequence: Synthetic oligonucleotide
caagcccagaggacagttcctggactg

SEQ ID NO: 197132 - DNA, 31 bp, Artificial Sequence
  Description of Artificial Sequence: Synthetic oligonucleotide
aagcccagaggacagttcctggactgatttc

SEQ ID NO: 197133 - DNA, 30 bp, Artificial Sequence
  Description of Artificial Sequence: Synthetic oligonucleotide
agcccagaggacagttcctggactgatttc

SEQ ID NO: 197134 - DNA, 29 bp, Artificial Sequence
  Description of Artificial Sequence: Synthetic oligonucleotide
gcccagaggacagttcctggactgatttc

SEQ ID NO: 197135 - DNA, 31 bp, Artificial Sequence
  Description of Artificial Sequence: Synthetic oligonucleotide
cccagaggacagttcctggactgatttcttc

SEQ ID NO: 197136 - DNA, 33 bp, Artificial Sequence
  Description of Artificial Sequence: Synthetic oligonucleotide
ccagaggacagttcctggactgatttcttcaac

SEQ ID NO: 197137 - DNA, 33 bp, Artificial Sequence
  Description of Artificial Sequence: Synthetic oligonucleotide
cagaggacagttcctggactgatttcttcaacc

SEQ ID NO: 197138 - DNA, 33 bp, Artificial Sequence
  Description of Artificial Sequence: Synthetic oligonucleotide
agaggacagttcctggactgatttcttcaaccc

SEQ ID NO: 197139 - DNA, 32 bp, Artificial Sequence
  Description of Artificial Sequence: Synthetic oligonucleotide
gaggacagttcctggactgatttcttcaaccc

SEQ ID NO: 197140 - DNA, 35 bp, Artificial Sequence
  Description of Artificial Sequence: Synthetic oligonucleotide
aggacagttcctggactgatttcttcaacccaatc

SEQ ID NO: 197141 - DNA, 34 bp, Artificial Sequence
  Description of Artificial Sequence: Synthetic oligonucleotide
ggacagttcctggactgatttcttcaacccaatc

SEQ ID NO: 197142 - DNA, 35 bp, Artificial Sequence
  Description of Artificial Sequence: Synthetic oligonucleotide
gacagttcctggactgatttcttcaacccaatctc

SEQ ID NO: 197143 - DNA, 36 bp, Artificial Sequence
  Description of Artificial Sequence: Synthetic oligonucleotide
acagttcctggactgatttcttcaacccaatctcac

SEQ ID NO: 197144 - DNA, 35 bp, Artificial Sequence
  Description of Artificial Sequence: Synthetic oligonucleotide
cagttcctggactgatttcttcaacccaatctcac

SEQ ID NO: 197145 - DNA, 36 bp, Artificial Sequence
  Description of Artificial Sequence: Synthetic oligonucleotide
agttcctggactgatttcttcaacccaatctcacac

SEQ ID NO: 197146 - DNA, 35 bp, Artificial Sequence
  Description of Artificial Sequence: Synthetic oligonucleotide
gttcctggactgatttcttcaacccaatctcacac

SEQ ID NO: 197147 - DNA, 35 bp, Artificial Sequence
  Description of Artificial Sequence: Synthetic oligonucleotide
ttcctggactgatttcttcaacccaatctcacacc

SEQ ID NO: 197148 - DNA, 34 bp, Artificial Sequence
  Description of Artificial Sequence: Synthetic oligonucleotide
tcctggactgatttcttcaacccaatctcacacc

SEQ ID NO: 197149 - DNA, 33 bp, Artificial Sequence
  Description of Artificial Sequence: Synthetic oligonucleotide
cctggactgatttcttcaacccaatctcacacc

SEQ ID NO: 197150 - DNA, 33 bp, Artificial Sequence
  Description of Artificial Sequence: Synthetic oligonucleotide
ctggactgatttcttcaacccaatctcacaccc

SEQ ID NO: 197151 - DNA, 33 bp, Artificial Sequence
  Description of Artificial Sequence: Synthetic oligonucleotide
tggactgatttcttcaacccaatctcacacccc

SEQ ID NO: 197152 - DNA, 32 bp, Artificial Sequence
  Description of Artificial Sequence: Synthetic oligonucleotide
ggactgatttcttcaacccaatctcacacccc

SEQ ID NO: 197153 - DNA, 34 bp, Artificial Sequence
  Description of Artificial Sequence: Synthetic oligonucleotide
gactgatttcttcaacccaatctcacaccccatg

SEQ ID NO: 197154 - DNA, 34 bp, Artificial Sequence
  Description of Artificial Sequence: Synthetic oligonucleotide
actgatttcttcaacccaatctcacaccccatgg

SEQ ID NO: 197155 - DNA, 33 bp, Artificial Sequence
  Description of Artificial Sequence: Synthetic oligonucleotide
ctgatttcttcaacccaatctcacaccccatgg

SEQ ID NO: 197156 - DNA, 33 bp, Artificial Sequence
  Description of Artificial Sequence: Synthetic oligonucleotide
tgatttcttcaacccaatctcacaccccatggg

SEQ ID NO: 197157 - DNA, 32 bp, Artificial Sequence
  Description of Artificial Sequence: Synthetic oligonucleotide
gatttcttcaacccaatctcacaccccatggg

SEQ ID NO: 197158 - DNA, 33 bp, Artificial Sequence
  Description of Artificial Sequence: Synthetic oligonucleotide
atttcttcaacccaatctcacaccccatgggac

SEQ ID NO: 197159 - DNA, 32 bp, Artificial Sequence
  Description of Artificial Sequence: Synthetic oligonucleotide
tttcttcaacccaatctcacaccccatgggac

SEQ ID NO: 197160 - DNA, 31 bp, Artificial Sequence
  Description of Artificial Sequence: Synthetic oligonucleotide
ttcttcaacccaatctcacaccccatgggac

SEQ ID NO: 197161 - DNA, 30 bp, Artificial Sequence
  Description of Artificial Sequence: Synthetic oligonucleotide
tcttcaacccaatctcacaccccatgggac

SEQ ID NO: 197162 - DNA, 29 bp, Artificial Sequence
  Description of Artificial Sequence: Synthetic oligonucleotide
cttcaacccaatctcacaccccatgggac

SEQ ID NO: 197163 - DNA, 29 bp, Artificial Sequence
  Description of Artificial Sequence: Synthetic oligonucleotide
ttcaacccaatctcacaccccatgggacg

SEQ ID NO: 197164 - DNA, 28 bp, Artificial Sequence
  Description of Artificial Sequence: Synthetic oligonucleotide
tcaacccaatctcacaccccatgggacg

SEQ ID NO: 197165 - DNA, 27 bp, Artificial Sequence
  Description of Artificial Sequence: Synthetic oligonucleotide
caacccaatctcacaccccatgggacg

SEQ ID NO: 197166 - DNA, 28 bp, Artificial Sequence
  Description of Artificial Sequence: Synthetic oligonucleotide
aacccaatctcacaccccatgggacgag

SEQ ID NO: 197167 - DNA, 27 bp, Artificial Sequence
  Description of Artificial Sequence: Synthetic oligonucleotide
acccaatctcacaccccatgggacgag

SEQ ID NO: 197168 - DNA, 26 bp, Artificial Sequence
  Description of Artificial Sequence: Synthetic oligonucleotide
cccaatctcacaccccatgggacgag

SEQ ID NO: 197169 - DNA, 27 bp, Artificial Sequence
  Description of Artificial Sequence: Synthetic oligonucleotide
ccaatctcacaccccatgggacgaggt

SEQ ID NO: 197170 - DNA, 27 bp, Artificial Sequence
  Description of Artificial Sequence: Synthetic oligonucleotide
caatctcacaccccatgggacgaggtc

SEQ ID NO: 197171 - DNA, 29 bp, Artificial Sequence
  Description of Artificial Sequence: Synthetic oligonucleotide
aatctcacaccccatgggacgaggtcatc

SEQ ID NO: 197172 - DNA, 28 bp, Artificial Sequence
  Description of Artificial Sequence: Synthetic oligonucleotide
atctcacaccccatgggacgaggtcatc

SEQ ID NO: 197173 - DNA, 27 bp, Artificial Sequence
  Description of Artificial Sequence: Synthetic oligonucleotide
tctcacaccccatgggacgaggtcatc

SEQ ID NO: 197174 - DNA, 27 bp, Artificial Sequence
  Description of Artificial Sequence: Synthetic oligonucleotide
ctcacaccccatgggacgaggtcatca

SEQ ID NO: 197175 - DNA, 28 bp, Artificial Sequence
  Description of Artificial Sequence: Synthetic oligonucleotide
tcacaccccatgggacgaggtcatcaag

SEQ ID NO: 197176 - DNA, 27 bp, Artificial Sequence
  Description of Artificial Sequence: Synthetic oligonucleotide
cacaccccatgggacgaggtcatcaag

SEQ ID NO: 197177 - DNA, 27 bp, Artificial Sequence
  Description of Artificial Sequence: Synthetic oligonucleotide
acaccccatgggacgaggtcatcaagc

SEQ ID NO: 197178 - DNA, 27 bp, Artificial Sequence
  Description of Artificial Sequence: Synthetic oligonucleotide
caccccatgggacgaggtcatcaagca

SEQ ID NO: 197179 - DNA, 27 bp, Artificial Sequence
  Description of Artificial Sequence: Synthetic oligonucleotide
accccatgggacgaggtcatcaagcag

SEQ ID NO: 197180 - DNA, 26 bp, Artificial Sequence
  Description of Artificial Sequence: Synthetic oligonucleotide
ccccatgggacgaggtcatcaagcag

SEQ ID NO: 197181 - DNA, 27 bp, Artificial Sequence
  Description of Artificial Sequence: Synthetic oligonucleotide
cccatgggacgaggtcatcaagcagga

SEQ ID NO: 197182 - DNA, 28 bp, Artificial Sequence
  Description of Artificial Sequence: Synthetic oligonucleotide
ccatgggacgaggtcatcaagcaggaag

SEQ ID NO: 197183 - DNA, 30 bp, Artificial Sequence
  Description of Artificial Sequence: Synthetic oligonucleotide
catgggacgaggtcatcaagcaggaagaag

SEQ ID NO: 197184 - DNA, 30 bp, Artificial Sequence
  Description of Artificial Sequence: Synthetic oligonucleotide
atgggacgaggtcatcaagcaggaagaagg

SEQ ID NO: 197185 - DNA, 29 bp, Artificial Sequence
  Description of Artificial Sequence: Synthetic oligonucleotide
tgggacgaggtcatcaagcaggaagaagg

SEQ ID NO: 197186 - DNA, 28 bp, Artificial Sequence
  Description of Artificial Sequence: Synthetic oligonucleotide
gggacgaggtcatcaagcaggaagaagg

SEQ ID NO: 197187 - DNA, 30 bp, Artificial Sequence
  Description of Artificial Sequence: Synthetic oligonucleotide
ggacgaggtcatcaagcaggaagaaggatg

SEQ ID NO: 197188 - DNA, 30 bp, Artificial Sequence
  Description of Artificial Sequence: Synthetic oligonucleotide
gacgaggtcatcaagcaggaagaaggatgg

SEQ ID NO: 197189 - DNA, 34 bp, Artificial Sequence
  Description of Artificial Sequence: Synthetic oligonucleotide
acgaggtcatcaagcaggaagaaggatggatatg

SEQ ID NO: 197190 - DNA, 33 bp, Artificial Sequence
  Description of Artificial Sequence: Synthetic oligonucleotide
cgaggtcatcaagcaggaagaaggatggatatg

SEQ ID NO: 197191 - DNA, 33 bp, Artificial Sequence
  Description of Artificial Sequence: Synthetic oligonucleotide
gaggtcatcaagcaggaagaaggatggatatgg

SEQ ID NO: 197192 - DNA, 34 bp, Artificial Sequence
  Description of Artificial Sequence: Synthetic oligonucleotide
aggtcatcaagcaggaagaaggatggatatggac

SEQ ID NO: 197193 - DNA, 33 bp, Artificial Sequence
  Description of Artificial Sequence: Synthetic oligonucleotide
ggtcatcaagcaggaagaaggatggatatggac

SEQ ID NO: 197194 - DNA, 34 bp, Artificial Sequence
  Description of Artificial Sequence: Synthetic oligonucleotide
gtcatcaagcaggaagaaggatggatatggactc

SEQ ID NO: 197195 - DNA, 34 bp, Artificial Sequence
  Description of Artificial Sequence: Synthetic oligonucleotide
tcatcaagcaggaagaaggatggatatggactcc

SEQ ID NO: 197196 - DNA, 33 bp, Artificial Sequence
  Description of Artificial Sequence: Synthetic oligonucleotide
catcaagcaggaagaaggatggatatggactcc

SEQ ID NO: 197197 - DNA, 34 bp, Artificial Sequence
  Description of Artificial Sequence: Synthetic oligonucleotide
atcaagcaggaagaaggatggatatggactccag

SEQ ID NO: 197198 - DNA, 33 bp, Artificial Sequence
  Description of Artificial Sequence: Synthetic oligonucleotide
tcaagcaggaagaaggatggatatggactccag

SEQ ID NO: 197199 - DNA, 32 bp, Artificial Sequence
  Description of Artificial Sequence: Synthetic oligonucleotide
caagcaggaagaaggatggatatggactccag

SEQ ID NO: 197200 - DNA, 33 bp, Artificial Sequence
  Description of Artificial Sequence: Synthetic oligonucleotide
aagcaggaagaaggatggatatggactccagtc

SEQ ID NO: 197201 - DNA, 32 bp, Artificial Sequence
  Description of Artificial Sequence: Synthetic oligonucleotide
agcaggaagaaggatggatatggactccagtc

SEQ ID NO: 197202 - DNA, 31 bp, Artificial Sequence
  Description of Artificial Sequence: Synthetic oligonucleotide
gcaggaagaaggatggatatggactccagtc

SEQ ID NO: 197203 - DNA, 34 bp, Artificial Sequence
  Description of Artificial Sequence: Synthetic oligonucleotide
caggaagaaggatggatatggactccagtcatag

SEQ ID NO: 197204 - DNA, 39 bp, Artificial Sequence
  Description of Artificial Sequence: Synthetic oligonucleotide
aggaagaaggatggatatggactccagtcatagtataac

SEQ ID NO: 197205 - DNA, 38 bp, Artificial Sequence
  Description of Artificial Sequence: Synthetic oligonucleotide
ggaagaaggatggatatggactccagtcatagtataac

SEQ ID NO: 197206 - DNA, 38 bp, Artificial Sequence
  Description of Artificial Sequence: Synthetic oligonucleotide
gaagaaggatggatatggactccagtcatagtataacg

SEQ ID NO: 197207 - DNA, 38 bp, Artificial Sequence
  Description of Artificial Sequence: Synthetic oligonucleotide
aagaaggatggatatggactccagtcatagtataacgc

SEQ ID NO: 197208 - DNA, 37 bp, Artificial Sequence
  Description of Artificial Sequence: Synthetic oligonucleotide
agaaggatggatatggactccagtcatagtataacgc

SEQ ID NO: 197209 - DNA, 36 bp, Artificial Sequence
  Description of Artificial Sequence: Synthetic oligonucleotide
gaaggatggatatggactccagtcatagtataacgc

SEQ ID NO: 197210 - DNA, 38 bp, Artificial Sequence
  Description of Artificial Sequence: Synthetic oligonucleotide
aaggatggatatggactccagtcatagtataacgcttc

SEQ ID NO: 197211 - DNA, 37 bp, Artificial Sequence
  Description of Artificial Sequence: Synthetic oligonucleotide
aggatggatatggactccagtcatagtataacgcttc

SEQ ID NO: 197212 - DNA, 36 bp, Artificial Sequence
  Description of Artificial Sequence: Synthetic oligonucleotide
ggatggatatggactccagtcatagtataacgcttc

SEQ ID NO: 197213 - DNA, 37 bp, Artificial Sequence
  Description of Artificial Sequence: Synthetic oligonucleotide
gatggatatggactccagtcatagtataacgcttcag

SEQ ID NO: 197214 - DNA, 37 bp, Artificial Sequence
  Description of Artificial Sequence: Synthetic oligonucleotide
atggatatggactccagtcatagtataacgcttcagc

SEQ ID NO: 197215 - DNA, 36 bp, Artificial Sequence
  Description of Artificial Sequence: Synthetic oligonucleotide
tggatatggactccagtcatagtataacgcttcagc

SEQ ID NO: 197216 - DNA, 35 bp, Artificial Sequence
  Description of Artificial Sequence: Synthetic oligonucleotide
ggatatggactccagtcatagtataacgcttcagc

SEQ ID NO: 197217 - DNA, 35 bp, Artificial Sequence
  Description of Artificial Sequence: Synthetic oligonucleotide
gatatggactccagtcatagtataacgcttcagcc

SEQ ID NO: 197218 - DNA, 37 bp, Artificial Sequence
  Description of Artificial Sequence: Synthetic oligonucleotide
atatggactccagtcatagtataacgcttcagcctac

SEQ ID NO: 197219 - DNA, 36 bp, Artificial Sequence
  Description of Artificial Sequence: Synthetic oligonucleotide
tatggactccagtcatagtataacgcttcagcctac

SEQ ID NO: 197220 - DNA, 35 bp, Artificial Sequence
  Description of Artificial Sequence: Synthetic oligonucleotide
atggactccagtcatagtataacgcttcagcctac

SEQ ID NO: 197221 - DNA, 34 bp, Artificial Sequence
  Description of Artificial Sequence: Synthetic oligonucleotide
tggactccagtcatagtataacgcttcagcctac

SEQ ID NO: 197222 - DNA, 33 bp, Artificial Sequence
  Description of Artificial Sequence: Synthetic oligonucleotide
ggactccagtcatagtataacgcttcagcctac

SEQ ID NO: 197223 - DNA, 34 bp, Artificial Sequence
  Description of Artificial Sequence: Synthetic oligonucleotide
gactccagtcatagtataacgcttcagcctactg

SEQ ID NO: 197224 - DNA, 34 bp, Artificial Sequence
  Description of Artificial Sequence: Synthetic oligonucleotide
actccagtcatagtataacgcttcagcctactgc

SEQ ID NO: 197225 - DNA, 33 bp, Artificial Sequence
  Description of Artificial Sequence: Synthetic oligonucleotide
ctccagtcatagtataacgcttcagcctactgc

SEQ ID NO: 197226 - DNA, 37 bp, Artificial Sequence
  Description of Artificial Sequence: Synthetic oligonucleotide
tccagtcatagtataacgcttcagcctactgcaaatc

SEQ ID NO: 197227 - DNA, 36 bp, Artificial Sequence
  Description of Artificial Sequence: Synthetic oligonucleotide
ccagtcatagtataacgcttcagcctactgcaaatc

SEQ ID NO: 197228 - DNA, 36 bp, Artificial Sequence
  Description of Artificial Sequence: Synthetic oligonucleotide
cagtcatagtataacgcttcagcctactgcaaatcc

SEQ ID NO: 197229 - DNA, 39 bp, Artificial Sequence
  Description of Artificial Sequence: Synthetic oligonucleotide
agtcatagtataacgcttcagcctactgcaaatccaaac

SEQ ID NO: 197230 - DNA, 38 bp, Artificial Sequence
  Description of Artificial Sequence: Synthetic oligonucleotide
gtcatagtataacgcttcagcctactgcaaatccaaac

SEQ ID NO: 197231 - DNA, 39 bp, Artificial Sequence
  Description of Artificial Sequence: Synthetic oligonucleotide
tcatagtataacgcttcagcctactgcaaatccaaacac

SEQ ID NO: 197232 - DNA, 38 bp, Artificial Sequence
  Description of Artificial Sequence: Synthetic oligonucleotide
catagtataacgcttcagcctactgcaaatccaaacac

SEQ ID NO: 197233 - DNA, 39 bp, Artificial Sequence
  Description of Artificial Sequence: Synthetic oligonucleotide
atagtataacgcttcagcctactgcaaatccaaacacag

SEQ ID NO: 197234 - DNA, 38 bp, Artificial Sequence
  Description of Artificial Sequence: Synthetic oligonucleotide
tagtataacgcttcagcctactgcaaatccaaacacag

SEQ ID NO: 197235 - DNA, 37 bp, Artificial Sequence
  Description of Artificial Sequence: Synthetic oligonucleotide
agtataacgcttcagcctactgcaaatccaaacacag

SEQ ID NO: 197236 - DNA, 36 bp, Artificial Sequence
  Description of Artificial Sequence: Synthetic oligonucleotide
gtataacgcttcagcctactgcaaatccaaacacag

SEQ ID NO: 197237 - DNA, 36 bp, Artificial Sequence
  Description of Artificial Sequence: Synthetic oligonucleotide
tataacgcttcagcctactgcaaatccaaacacagg

SEQ ID NO: 197238 - DNA, 35 bp, Artificial Sequence
  Description of Artificial Sequence: Synthetic oligonucleotide
ataacgcttcagcctactgcaaatccaaacacagg

SEQ ID NO: 197239 - DNA, 34 bp, Artificial Sequence
  Description of Artificial Sequence: Synthetic oligonucleotide
taacgcttcagcctactgcaaatccaaacacagg

SEQ ID NO: 197240 - DNA, 33 bp, Artificial Sequence
  Description of Artificial Sequence: Synthetic oligonucleotide
aacgcttcagcctactgcaaatccaaacacagg

SEQ ID NO: 197241 - DNA, 32 bp, Artificial Sequence
  Description of Artificial Sequence: Synthetic oligonucleotide
acgcttcagcctactgcaaatccaaacacagg

SEQ ID NO: 197242 - DNA, 31 bp, Artificial Sequence
  Description of Artificial Sequence: Synthetic oligonucleotide
cgcttcagcctactgcaaatccaaacacagg

SEQ ID NO: 197243 - DNA, 34 bp, Artificial Sequence
  Description of Artificial Sequence: Synthetic oligonucleotide
gcttcagcctactgcaaatccaaacacaggtttg

SEQ ID NO: 197244 - DNA, 34 bp, Artificial Sequence
  Description of Artificial Sequence: Synthetic oligonucleotide
cttcagcctactgcaaatccaaacacaggtttgg

SEQ ID NO: 197245 - DNA, 35 bp, Artificial Sequence
  Description of Artificial Sequence: Synthetic oligonucleotide
ttcagcctactgcaaatccaaacacaggtttggtg

SEQ ID NO: 197246 - DNA, 34 bp, Artificial Sequence
  Description of Artificial Sequence: Synthetic oligonucleotide
tcagcctactgcaaatccaaacacaggtttggtg

SEQ ID NO: 197247 - DNA, 33 bp, Artificial Sequence
  Description of Artificial Sequence: Synthetic oligonucleotide
cagcctactgcaaatccaaacacaggtttggtg

SEQ ID NO: 197248 - DNA, 33 bp, Artificial Sequence
  Description of Artificial Sequence: Synthetic oligonucleotide
agcctactgcaaatccaaacacaggtttggtgg

SEQ ID NO: 197249 - DNA, 32 bp, Artificial Sequence
  Description of Artificial Sequence: Synthetic oligonucleotide
gcctactgcaaatccaaacacaggtttggtgg

SEQ ID NO: 197250 - DNA, 34 bp, Artificial Sequence
  Description of Artificial Sequence: Synthetic oligonucleotide
cctactgcaaatccaaacacaggtttggtggaag

SEQ ID NO: 197251 - DNA, 38 bp, Artificial Sequence
  Description of Artificial Sequence: Synthetic oligonucleotide
ctactgcaaatccaaacacaggtttggtggaagatttg

SEQ ID NO: 197252 - DNA, 38 bp, Artificial Sequence
  Description of Artificial Sequence: Synthetic oligonucleotide
tactgcaaatccaaacacaggtttggtggaagatttgg

SEQ ID NO: 197253 - DNA, 37 bp, Artificial Sequence
  Description of Artificial Sequence: Synthetic oligonucleotide
actgcaaatccaaacacaggtttggtggaagatttgg

SEQ ID NO: 197254 - DNA, 36 bp, Artificial Sequence
  Description of Artificial Sequence: Synthetic oligonucleotide
ctgcaaatccaaacacaggtttggtggaagatttgg

SEQ ID NO: 197255 - DNA, 37 bp, Artificial Sequence
  Description of Artificial Sequence: Synthetic oligonucleotide
tgcaaatccaaacacaggtttggtggaagatttggac

SEQ ID NO: 197256 - DNA, 36 bp, Artificial Sequence
  Description of Artificial Sequence: Synthetic oligonucleotide
gcaaatccaaacacaggtttggtggaagatttggac

SEQ ID NO: 197257 - DNA, 37 bp, Artificial Sequence
  Description of Artificial Sequence: Synthetic oligonucleotide
caaatccaaacacaggtttggtggaagatttggacag

SEQ ID NO: 197258 - DNA, 37 bp, Artificial Sequence
  Description of Artificial Sequence: Synthetic oligonucleotide
aaatccaaacacaggtttggtggaagatttggacagg

SEQ ID NO: 197259 - DNA, 36 bp, Artificial Sequence
  Description of Artificial Sequence: Synthetic oligonucleotide
aatccaaacacaggtttggtggaagatttggacagg

SEQ ID NO: 197260 - DNA, 35 bp, Artificial Sequence
  Description of Artificial Sequence: Synthetic oligonucleotide
atccaaacacaggtttggtggaagatttggacagg

SEQ ID NO: 197261 - DNA, 34 bp, Artificial Sequence
  Description of Artificial Sequence: Synthetic oligonucleotide
tccaaacacaggtttggtggaagatttggacagg

SEQ ID NO: 197262 - DNA, 33 bp, Artificial Sequence
  Description of Artificial Sequence: Synthetic oligonucleotide
ccaaacacaggtttggtggaagatttggacagg

SEQ ID NO: 197263 - DNA, 34 bp, Artificial Sequence
  Description of Artificial Sequence: Synthetic oligonucleotide
caaacacaggtttggtggaagatttggacaggac

SEQ ID NO: 197264 - DNA, 35 bp, Artificial Sequence
  Description of Artificial Sequence: Synthetic oligonucleotide
aaacacaggtttggtggaagatttggacaggacag

SEQ ID NO: 197265 - DNA, 34 bp, Artificial Sequence
  Description of Artificial Sequence: Synthetic oligonucleotide
aacacaggtttggtggaagatttggacaggacag

SEQ ID NO: 197266 - DNA, 33 bp, Artificial Sequence
  Description of Artificial Sequence: Synthetic oligonucleotide
acacaggtttggtggaagatttggacaggacag

SEQ ID NO: 197267 - DNA, 32 bp, Artificial Sequence
  Description of Artificial Sequence: Synthetic oligonucleotide
cacaggtttggtggaagatttggacaggacag

SEQ ID NO: 197268 - DNA, 32 bp, Artificial Sequence
  Description of Artificial Sequence: Synthetic oligonucleotide
acaggtttggtggaagatttggacaggacagg

SEQ ID NO: 197269 - DNA, 31 bp, Artificial Sequence
  Description of Artificial Sequence: Synthetic oligonucleotide
caggtttggtggaagatttggacaggacagg

SEQ ID NO: 197270 - DNA, 32 bp, Artificial Sequence
  Description of Artificial Sequence: Synthetic oligonucleotide
aggtttggtggaagatttggacaggacaggac

SEQ ID NO: 197271 - DNA, 31 bp, Artificial Sequence
  Description of Artificial Sequence: Synthetic oligonucleotide
ggtttggtggaagatttggacaggacaggac

SEQ ID NO: 197272 - DNA, 31 bp, Artificial Sequence
  Description of Artificial Sequence: Synthetic oligonucleotide
gtttggtggaagatttggacaggacaggacc

SEQ ID NO: 197273 - DNA, 32 bp, Artificial Sequence
  Description of Artificial Sequence: Synthetic oligonucleotide
tttggtggaagatttggacaggacaggacctc

SEQ ID NO: 197274 - DNA, 31 bp, Artificial Sequence
  Description of Artificial Sequence: Synthetic oligonucleotide
ttggtggaagatttggacaggacaggacctc

SEQ ID NO: 197275 - DNA, 30 bp, Artificial Sequence
  Description of Artificial Sequence: Synthetic oligonucleotide
tggtggaagatttggacaggacaggacctc

SEQ ID NO: 197276 - DNA, 29 bp, Artificial Sequence
  Description of Artificial Sequence: Synthetic oligonucleotide
ggtggaagatttggacaggacaggacctc

SEQ ID NO: 197277 - DNA, 32 bp, Artificial Sequence
  Description of Artificial Sequence: Synthetic oligonucleotide
gtggaagatttggacaggacaggacctctttc

SEQ ID NO: 197278 - DNA, 35 bp, Artificial Sequence
  Description of Artificial Sequence: Synthetic oligonucleotide
tggaagatttggacaggacaggacctctttcaatg

SEQ ID NO: 197279 - DNA, 34 bp, Artificial Sequence
  Description of Artificial Sequence: Synthetic oligonucleotide
ggaagatttggacaggacaggacctctttcaatg

SEQ ID NO: 197280 - DNA, 35 bp, Artificial Sequence
  Description of Artificial Sequence: Synthetic oligonucleotide
gaagatttggacaggacaggacctctttcaatgac

SEQ ID NO: 197281 - DNA, 37 bp, Artificial Sequence
  Description of Artificial Sequence: Synthetic oligonucleotide
aagatttggacaggacaggacctctttcaatgacaac

SEQ ID NO: 197282 - DNA, 36 bp, Artificial Sequence
  Description of Artificial Sequence: Synthetic oligonucleotide
agatttggacaggacaggacctctttcaatgacaac

SEQ ID NO: 197283 - DNA, 35 bp, Artificial Sequence
  Description of Artificial Sequence: Synthetic oligonucleotide
gatttggacaggacaggacctctttcaatgacaac

SEQ ID NO: 197284 - DNA, 35 bp, Artificial Sequence
  Description of Artificial Sequence: Synthetic oligonucleotide
atttggacaggacaggacctctttcaatgacaacg

SEQ ID NO: 197285 - DNA, 34 bp, Artificial Sequence
  Description of Artificial Sequence: Synthetic oligonucleotide
tttggacaggacaggacctctttcaatgacaacg

SEQ ID NO: 197286 - DNA, 33 bp, Artificial Sequence
  Description of Artificial Sequence: Synthetic oligonucleotide
ttggacaggacaggacctctttcaatgacaacg

SEQ ID NO: 197287 - DNA, 32 bp, Artificial Sequence
  Description of Artificial Sequence: Synthetic oligonucleotide
tggacaggacaggacctctttcaatgacaacg

SEQ ID NO: 197288 - DNA, 31 bp, Artificial Sequence
  Description of Artificial Sequence: Synthetic oligonucleotide
ggacaggacaggacctctttcaatgacaacg

SEQ ID NO: 197289 - DNA, 31 bp, Artificial Sequence
  Description of Artificial Sequence: Synthetic oligonucleotide
gacaggacaggacctctttcaatgacaacgc

SEQ ID NO: 197290 - DNA, 32 bp, Artificial Sequence
  Description of Artificial Sequence: Synthetic oligonucleotide
acaggacaggacctctttcaatgacaacgcag

SEQ ID NO: 197291 - DNA, 31 bp, Artificial Sequence
  Description of Artificial Sequence: Synthetic oligonucleotide
caggacaggacctctttcaatgacaacgcag

SEQ ID NO: 197292 - DNA, 31 bp, Artificial Sequence
  Description of Artificial Sequence: Synthetic oligonucleotide
aggacaggacctctttcaatgacaacgcagc

SEQ ID NO: 197293 - DNA, 30 bp, Artificial Sequence
  Description of Artificial Sequence: Synthetic oligonucleotide
ggacaggacctctttcaatgacaacgcagc

SEQ ID NO: 197294 - DNA, 31 bp, Artificial Sequence
  Description of Artificial Sequence: Synthetic oligonucleotide
gacaggacctctttcaatgacaacgcagcag

SEQ ID NO: 197295 - DNA, 32 bp, Artificial Sequence
  Description of Artificial Sequence: Synthetic oligonucleotide
acaggacctctttcaatgacaacgcagcagag

SEQ ID NO: 197296 - DNA, 31 bp, Artificial Sequence
  Description of Artificial Sequence: Synthetic oligonucleotide
caggacctctttcaatgacaacgcagcagag

SEQ ID NO: 197297 - DNA, 36 bp, Artificial Sequence
  Description of Artificial Sequence: Synthetic oligonucleotide
aggacctctttcaatgacaacgcagcagagtaattc

SEQ ID NO: 197298 - DNA, 35 bp, Artificial Sequence
  Description of Artificial Sequence: Synthetic oligonucleotide
ggacctctttcaatgacaacgcagcagagtaattc

SEQ ID NO: 197299 - DNA, 36 bp, Artificial Sequence
  Description of Artificial Sequence: Synthetic oligonucleotide
gacctctttcaatgacaacgcagcagagtaattctc

SEQ ID NO: 197300 - DNA, 37 bp, Artificial Sequence
  Description of Artificial Sequence: Synthetic oligonucleotide
acctctttcaatgacaacgcagcagagtaattctcag

SEQ ID NO: 197301 - DNA, 36 bp, Artificial Sequence
  Description of Artificial Sequence: Synthetic oligonucleotide
cctctttcaatgacaacgcagcagagtaattctcag

SEQ ID NO: 197302 - DNA, 37 bp, Artificial Sequence
  Description of Artificial Sequence: Synthetic oligonucleotide
ctctttcaatgacaacgcagcagagtaattctcagag

SEQ ID NO: 197303 - DNA, 37 bp, Artificial Sequence
  Description of Artificial Sequence: Synthetic oligonucleotide
tctttcaatgacaacgcagcagagtaattctcagagc

SEQ ID NO: 197304 - DNA, 36 bp, Artificial Sequence
  Description of Artificial Sequence: Synthetic oligonucleotide
ctttcaatgacaacgcagcagagtaattctcagagc

SEQ ID NO: 197305 - DNA, 38 bp, Artificial Sequence
  Description of Artificial Sequence: Synthetic oligonucleotide
tttcaatgacaacgcagcagagtaattctcagagcttc

SEQ ID NO: 197306 - DNA, 37 bp, Artificial Sequence
  Description of Artificial Sequence: Synthetic oligonucleotide
ttcaatgacaacgcagcagagtaattctcagagcttc

SEQ ID NO: 197307 - DNA, 36 bp, Artificial Sequence
  Description of Artificial Sequence: Synthetic oligonucleotide
tcaatgacaacgcagcagagtaattctcagagcttc

SEQ ID NO: 197308 - DNA, 35 bp, Artificial Sequence
  Description of Artificial Sequence: Synthetic oligonucleotide
caatgacaacgcagcagagtaattctcagagcttc

SEQ ID NO: 197309 - DNA, 36 bp, Artificial Sequence
  Description of Artificial Sequence: Synthetic oligonucleotide
aatgacaacgcagcagagtaattctcagagcttctc

SEQ ID NO: 197310 - DNA, 35 bp, Artificial Sequence
  Description of Artificial Sequence: Synthetic oligonucleotide
atgacaacgcagcagagtaattctcagagcttctc

SEQ ID NO: 197311 - DNA, 34 bp, Artificial Sequence
  Description of Artificial Sequence: Synthetic oligonucleotide
tgacaacgcagcagagtaattctcagagcttctc

SEQ ID NO: 197312 - DNA, 33 bp, Artificial Sequence
  Description of Artificial Sequence: Synthetic oligonucleotide
gacaacgcagcagagtaattctcagagcttctc

SEQ ID NO: 197313 - DNA, 35 bp, Artificial Sequence
  Description of Artificial Sequence: Synthetic oligonucleotide
acaacgcagcagagtaattctcagagcttctctac

SEQ ID NO: 197314 - DNA, 34 bp, Artificial Sequence
  Description of Artificial Sequence: Synthetic oligonucleotide
caacgcagcagagtaattctcagagcttctctac

SEQ ID NO: 197315 - DNA, 36 bp, Artificial Sequence
  Description of Artificial Sequence: Synthetic oligonucleotide
aacgcagcagagtaattctcagagcttctctacatc

SEQ ID NO: 197316 - DNA, 35 bp, Artificial Sequence
  Description of Artificial Sequence: Synthetic oligonucleotide
acgcagcagagtaattctcagagcttctctacatc

SEQ ID NO: 197317 - DNA, 34 bp, Artificial Sequence
  Description of Artificial Sequence: Synthetic oligonucleotide
cgcagcagagtaattctcagagcttctctacatc

SEQ ID NO: 197318 - DNA, 35 bp, Artificial Sequence
  Description of Artificial Sequence: Synthetic oligonucleotide
gcagcagagtaattctcagagcttctctacatcac

SEQ ID NO: 197319 - DNA, 37 bp, Artificial Sequence
  Description of Artificial Sequence: Synthetic oligonucleotide
cagcagagtaattctcagagcttctctacatcacatg

SEQ ID NO: 197320 - DNA, 39 bp, Artificial Sequence
  Description of Artificial Sequence: Synthetic oligonucleotide
agcagagtaattctcagagcttctctacatcacatgaag

SEQ ID NO: 197321 - DNA, 38 bp, Artificial Sequence
  Description of Artificial Sequence: Synthetic oligonucleotide
gcagagtaattctcagagcttctctacatcacatgaag

SEQ ID NO: 197322 - DNA, 38 bp, Artificial Sequence
  Description of Artificial Sequence: Synthetic oligonucleotide
cagagtaattctcagagcttctctacatcacatgaagg

SEQ ID NO: 197323 - DNA, 38 bp, Artificial Sequence
  Description of Artificial Sequence: Synthetic oligonucleotide
agagtaattctcagagcttctctacatcacatgaaggc

SEQ ID NO: 197324 - DNA, 37 bp, Artificial Sequence
  Description of Artificial Sequence: Synthetic oligonucleotide
gagtaattctcagagcttctctacatcacatgaaggc

SEQ ID NO: 197325 - DNA, 39 bp, Artificial Sequence
  Description of Artificial Sequence: Synthetic oligonucleotide
agtaattctcagagcttctctacatcacatgaaggcttg

SEQ ID NO: 197326 - DNA, 38 bp, Artificial Sequence
  Description of Artificial Sequence: Synthetic oligonucleotide
gtaattctcagagcttctctacatcacatgaaggcttg

SEQ ID NO: 197327 - DNA, 38 bp, Artificial Sequence
  Description of Artificial Sequence: Synthetic oligonucleotide
taattctcagagcttctctacatcacatgaaggcttgg

SEQ ID NO: 197328 - DNA, 37 bp, Artificial Sequence
  Description of Artificial Sequence: Synthetic oligonucleotide
aattctcagagcttctctacatcacatgaaggcttgg

SEQ ID NO: 197329 - DNA, 36 bp, Artificial Sequence
  Description of Artificial Sequence: Synthetic oligonucleotide
attctcagagcttctctacatcacatgaaggcttgg

SEQ ID NO: 197330 - DNA, 35 bp, Artificial Sequence
  Description of Artificial Sequence: Synthetic oligonucleotide
ttctcagagcttctctacatcacatgaaggcttgg

SEQ ID NO: 197331 - DNA, 34 bp, Artificial Sequence
  Description of Artificial Sequence: Synthetic oligonucleotide
tctcagagcttctctacatcacatgaaggcttgg

SEQ ID NO: 197332 - DNA, 33 bp, Artificial Sequence
  Description of Artificial Sequence: Synthetic oligonucleotide
ctcagagcttctctacatcacatgaaggcttgg

SEQ ID NO: 197333 - DNA, 35 bp, Artificial Sequence
  Description of Artificial Sequence: Synthetic oligonucleotide
tcagagcttctctacatcacatgaaggcttggaag

SEQ ID NO: 197334 - DNA, 34 bp, Artificial Sequence
  Description of Artificial Sequence: Synthetic oligonucleotide
cagagcttctctacatcacatgaaggcttggaag

SEQ ID NO: 197335 - DNA, 36 bp, Artificial Sequence
  Description of Artificial Sequence: Synthetic oligonucleotide
agagcttctctacatcacatgaaggcttggaagaag

SEQ ID NO: 197336 - DNA, 35 bp, Artificial Sequence
  Description of Artificial Sequence: Synthetic oligonucleotide
gagcttctctacatcacatgaaggcttggaagaag

SEQ ID NO: 197337 - DNA, 40 bp, Artificial Sequence
  Description of Artificial Sequence: Synthetic oligonucleotide
agcttctctacatcacatgaaggcttggaagaagataaag

SEQ ID NO: 197338 - DNA, 39 bp, Artificial Sequence
  Description of Artificial Sequence: Synthetic oligonucleotide
gcttctctacatcacatgaaggcttggaagaagataaag

SEQ ID NO: 197339 - DNA, 40 bp, Artificial Sequence
  Description of Artificial Sequence: Synthetic oligonucleotide
cttctctacatcacatgaaggcttggaagaagataaagac

SEQ ID NO: 197340 - DNA, 40 bp, Artificial Sequence
  Description of Artificial Sequence: Synthetic oligonucleotide
ttctctacatcacatgaaggcttggaagaagataaagacc

SEQ ID NO: 197341 - DNA, 39 bp, Artificial Sequence
  Description of Artificial Sequence: Synthetic oligonucleotide
tctctacatcacatgaaggcttggaagaagataaagacc

SEQ ID NO: 197342 - DNA, 38 bp, Artificial Sequence
  Description of Artificial Sequence: Synthetic oligonucleotide
ctctacatcacatgaaggcttggaagaagataaagacc

SEQ ID NO: 197343 - DNA, 40 bp, Artificial Sequence
  Description of Artificial Sequence: Synthetic oligonucleotide
tctacatcacatgaaggcttggaagaagataaagaccatc

SEQ ID NO: 197344 - DNA, 39 bp, Artificial Sequence
  Description of Artificial Sequence: Synthetic oligonucleotide
ctacatcacatgaaggcttggaagaagataaagaccatc

SEQ ID NO: 197345 - DNA, 39 bp, Artificial Sequence
  Description of Artificial Sequence: Synthetic oligonucleotide
tacatcacatgaaggcttggaagaagataaagaccatcc

SEQ ID NO: 197346 - DNA, 38 bp, Artificial Sequence
  Description of Artificial Sequence: Synthetic oligonucleotide
acatcacatgaaggcttggaagaagataaagaccatcc

SEQ ID NO: 197347 - DNA, 37 bp, Artificial Sequence
  Description of Artificial Sequence: Synthetic oligonucleotide
catcacatgaaggcttggaagaagataaagaccatcc

SEQ ID NO: 197348 - DNA, 39 bp, Artificial Sequence
  Description of Artificial Sequence: Synthetic oligonucleotide
atcacatgaaggcttggaagaagataaagaccatccaac

SEQ ID NO: 197349 - DNA, 38 bp, Artificial Sequence
  Description of Artificial Sequence: Synthetic oligonucleotide
tcacatgaaggcttggaagaagataaagaccatccaac

SEQ ID NO: 197350 - DNA, 37 bp, Artificial Sequence
  Description of Artificial Sequence: Synthetic oligonucleotide
cacatgaaggcttggaagaagataaagaccatccaac

SEQ ID NO: 197351 - DNA, 39 bp, Artificial Sequence
  Description of Artificial Sequence: Synthetic oligonucleotide
acatgaaggcttggaagaagataaagaccatccaacaac

SEQ ID NO: 197352 - DNA, 38 bp, Artificial Sequence
  Description of Artificial Sequence: Synthetic oligonucleotide
catgaaggcttggaagaagataaagaccatccaacaac

SEQ ID NO: 197353 - DNA, 40 bp, Artificial Sequence
  Description of Artificial Sequence: Synthetic oligonucleotide
atgaaggcttggaagaagataaagaccatccaacaacttc

SEQ ID NO: 197354 - DNA, 39 bp, Artificial Sequence
  Description of Artificial Sequence: Synthetic oligonucleotide
tgaaggcttggaagaagataaagaccatccaacaacttc

SEQ ID NO: 197355 - DNA, 38 bp, Artificial Sequence
  Description of Artificial Sequence: Synthetic oligonucleotide
gaaggcttggaagaagataaagaccatccaacaacttc

SEQ ID NO: 197356 - DNA, 40 bp, Artificial Sequence
  Description of Artificial Sequence: Synthetic oligonucleotide
aaggcttggaagaagataaagaccatccaacaacttctac

SEQ ID NO: 197357 - DNA, 39 bp, Artificial Sequence
  Description of Artificial Sequence: Synthetic oligonucleotide
aggcttggaagaagataaagaccatccaacaacttctac

SEQ ID NO: 197358 - DNA, 38 bp, Artificial Sequence
  Description of Artificial Sequence: Synthetic oligonucleotide
ggcttggaagaagataaagaccatccaacaacttctac

SEQ ID NO: 197359 - DNA, 39 bp, Artificial Sequence
  Description of Artificial Sequence: Synthetic oligonucleotide
gcttggaagaagataaagaccatccaacaacttctactc

SEQ ID NO: 197360 - DNA, 40 bp, Artificial Sequence
  Description of Artificial Sequence: Synthetic oligonucleotide
cttggaagaagataaagaccatccaacaacttctactctg

SEQ ID NO: 197361 - DNA, 41 bp, Artificial Sequence
  Description of Artificial Sequence: Synthetic oligonucleotide
ttggaagaagataaagaccatccaacaacttctactctgac

SEQ ID NO: 197362 - DNA, 40 bp, Artificial Sequence
  Description of Artificial Sequence: Synthetic oligonucleotide
tggaagaagataaagaccatccaacaacttctactctgac

SEQ ID NO: 197363 - DNA, 39 bp, Artificial Sequence
  Description of Artificial Sequence: Synthetic oligonucleotide
ggaagaagataaagaccatccaacaacttctactctgac

SEQ ID NO: 197364 - DNA, 41 bp, Artificial Sequence
  Description of Artificial Sequence: Synthetic oligonucleotide
gaagaagataaagaccatccaacaacttctactctgacatc

SEQ ID NO: 197365 - DNA, 43 bp, Artificial Sequence
  Description of Artificial Sequence: Synthetic oligonucleotide
aagaagataaagaccatccaacaacttctactctgacatcaag

SEQ ID NO: 197366 - DNA, 42 bp, Artificial Sequence
  Description of Artificial Sequence: Synthetic oligonucleotide
agaagataaagaccatccaacaacttctactctgacatcaag

SEQ ID NO: 197367 - DNA, 41 bp, Artificial Sequence
  Description of Artificial Sequence: Synthetic oligonucleotide
gaagataaagaccatccaacaacttctactctgacatcaag

SEQ ID NO: 197368 - DNA, 41 bp, Artificial Sequence
  Description of Artificial Sequence: Synthetic oligonucleotide
aagataaagaccatccaacaacttctactctgacatcaagc

SEQ ID NO: 197369 - DNA, 40 bp, Artificial Sequence
  Description of Artificial Sequence: Synthetic oligonucleotide
agataaagaccatccaacaacttctactctgacatcaagc

SEQ ID NO: 197370 - DNA, 39 bp, Artificial Sequence
  Description of Artificial Sequence: Synthetic oligonucleotide
gataaagaccatccaacaacttctactctgacatcaagc

SEQ ID NO: 197371 - DNA, 43 bp, Artificial Sequence
  Description of Artificial Sequence: Synthetic oligonucleotide
ataaagaccatccaacaacttctactctgacatcaagcaatag

SEQ ID NO: 197372 - DNA, 42 bp, Artificial Sequence
  Description of Artificial Sequence: Synthetic oligonucleotide
taaagaccatccaacaacttctactctgacatcaagcaatag

SEQ ID NO: 197373 - DNA, 41 bp, Artificial Sequence
  Description of Artificial Sequence: Synthetic oligonucleotide
aaagaccatccaacaacttctactctgacatcaagcaatag

SEQ ID NO: 197374 - DNA, 40 bp, Artificial Sequence
  Description of Artificial Sequence: Synthetic oligonucleotide
aagaccatccaacaacttctactctgacatcaagcaatag

SEQ ID NO: 197375 - DNA, 39 bp, Artificial Sequence
  Description of Artificial Sequence: Synthetic oligonucleotide
agaccatccaacaacttctactctgacatcaagcaatag

SEQ ID NO: 197376 - DNA, 38 bp, Artificial Sequence
  Description of Artificial Sequence: Synthetic oligonucleotide
gaccatccaacaacttctactctgacatcaagcaatag

SEQ ID NO: 197377 - DNA, 38 bp, Artificial Sequence
  Description of Artificial Sequence: Synthetic oligonucleotide
accatccaacaacttctactctgacatcaagcaatagg

SEQ ID NO: 197378 - DNA, 37 bp, Artificial Sequence
  Description of Artificial Sequence: Synthetic oligonucleotide
ccatccaacaacttctactctgacatcaagcaatagg

SEQ ID NO: 197379 - DNA, 40 bp, Artificial Sequence
  Description of Artificial Sequence: Synthetic oligonucleotide
catccaacaacttctactctgacatcaagcaataggaatg

SEQ ID NO: 197380 - DNA, 42 bp, Artificial Sequence
  Description of Artificial Sequence: Synthetic oligonucleotide
atccaacaacttctactctgacatcaagcaataggaatgatg

SEQ ID NO: 197381 - DNA, 41 bp, Artificial Sequence
  Description of Artificial Sequence: Synthetic oligonucleotide
tccaacaacttctactctgacatcaagcaataggaatgatg

SEQ ID NO: 197382 - DNA, 40 bp, Artificial Sequence
  Description of Artificial Sequence: Synthetic oligonucleotide
ccaacaacttctactctgacatcaagcaataggaatgatg

SEQ ID NO: 197383 - DNA, 41 bp, Artificial Sequence
  Description of Artificial Sequence: Synthetic oligonucleotide
caacaacttctactctgacatcaagcaataggaatgatgtc

SEQ ID NO: 197384 - DNA, 42 bp, Artificial Sequence
  Description of Artificial Sequence: Synthetic oligonucleotide
aacaacttctactctgacatcaagcaataggaatgatgtcac

SEQ ID NO: 197385 - DNA, 41 bp, Artificial Sequence
  Description of Artificial Sequence: Synthetic oligonucleotide
acaacttctactctgacatcaagcaataggaatgatgtcac

SEQ ID NO: 197386 - DNA, 40 bp, Artificial Sequence
  Description of Artificial Sequence: Synthetic oligonucleotide
caacttctactctgacatcaagcaataggaatgatgtcac

SEQ ID NO: 197387 - DNA, 41 bp, Artificial Sequence
  Description of Artificial Sequence: Synthetic oligonucleotide
aacttctactctgacatcaagcaataggaatgatgtcacag

SEQ ID NO: 197388 - DNA, 40 bp, Artificial Sequence
  Description of Artificial Sequence: Synthetic oligonucleotide
acttctactctgacatcaagcaataggaatgatgtcacag

SEQ ID NO: 197389 - DNA, 39 bp, Artificial Sequence
  Description of Artificial Sequence: Synthetic oligonucleotide
cttctactctgacatcaagcaataggaatgatgtcacag

SEQ ID NO: 197390 - DNA, 39 bp, Artificial Sequence
  Description of Artificial Sequence: Synthetic oligonucleotide
ttctactctgacatcaagcaataggaatgatgtcacagg

SEQ ID NO: 197391 - DNA, 38 bp, Artificial Sequence
  Description of Artificial Sequence: Synthetic oligonucleotide
tctactctgacatcaagcaataggaatgatgtcacagg

SEQ ID NO: 197392 - DNA, 37 bp, Artificial Sequence
  Description of Artificial Sequence: Synthetic oligonucleotide
ctactctgacatcaagcaataggaatgatgtcacagg

SEQ ID NO: 197393 - DNA, 38 bp, Artificial Sequence
  Description of Artificial Sequence: Synthetic oligonucleotide
tactctgacatcaagcaataggaatgatgtcacaggtg

SEQ ID NO: 197394 - DNA, 37 bp, Artificial Sequence
  Description of Artificial Sequence: Synthetic oligonucleotide
actctgacatcaagcaataggaatgatgtcacaggtg

SEQ ID NO: 197395 - DNA, 36 bp, Artificial Sequence
  Description of Artificial Sequence: Synthetic oligonucleotide
ctctgacatcaagcaataggaatgatgtcacaggtg

SEQ ID NO: 197396 - DNA, 36 bp, Artificial Sequence
  Description of Artificial Sequence: Synthetic oligonucleotide
tctgacatcaagcaataggaatgatgtcacaggtgg

SEQ ID NO: 197397 - DNA, 35 bp, Artificial Sequence
  Description of Artificial Sequence: Synthetic oligonucleotide
ctgacatcaagcaataggaatgatgtcacaggtgg

SEQ ID NO: 197398 - DNA, 37 bp, Artificial Sequence
  Description of Artificial Sequence: Synthetic oligonucleotide
tgacatcaagcaataggaatgatgtcacaggtggaag

SEQ ID NO: 197399 - DNA, 36 bp, Artificial Sequence
  Description of Artificial Sequence: Synthetic oligonucleotide
gacatcaagcaataggaatgatgtcacaggtggaag

SEQ ID NO: 197400 - DNA, 38 bp, Artificial Sequence
  Description of Artificial Sequence: Synthetic oligonucleotide
acatcaagcaataggaatgatgtcacaggtggaagaag

SEQ ID NO: 197401 - DNA, 37 bp, Artificial Sequence
  Description of Artificial Sequence: Synthetic oligonucleotide
catcaagcaataggaatgatgtcacaggtggaagaag

SEQ ID NO: 197402 - DNA, 38 bp, Artificial Sequence
  Description of Artificial Sequence: Synthetic oligonucleotide
atcaagcaataggaatgatgtcacaggtggaagaagag

SEQ ID NO: 197403 - DNA, 37 bp, Artificial Sequence
  Description of Artificial Sequence: Synthetic oligonucleotide
tcaagcaataggaatgatgtcacaggtggaagaagag

SEQ ID NO: 197404 - DNA, 36 bp, Artificial Sequence
  Description of Artificial Sequence: Synthetic oligonucleotide
caagcaataggaatgatgtcacaggtggaagaagag

SEQ ID NO: 197405 - DNA, 37 bp, Artificial Sequence
  Description of Artificial Sequence: Synthetic oligonucleotide
aagcaataggaatgatgtcacaggtggaagaagagac

SEQ ID NO: 197406 - DNA, 36 bp, Artificial Sequence
  Description of Artificial Sequence: Synthetic oligonucleotide
agcaataggaatgatgtcacaggtggaagaagagac

SEQ ID NO: 197407 - DNA, 35 bp, Artificial Sequence
  Description of Artificial Sequence: Synthetic oligonucleotide
gcaataggaatgatgtcacaggtggaagaagagac

SEQ ID NO: 197408 - DNA, 35 bp, Artificial Sequence
  Description of Artificial Sequence: Synthetic oligonucleotide
caataggaatgatgtcacaggtggaagaagagacc

SEQ ID NO: 197409 - DNA, 35 bp, Artificial Sequence
  Description of Artificial Sequence: Synthetic oligonucleotide
aataggaatgatgtcacaggtggaagaagagaccc

SEQ ID NO: 197410 - DNA, 34 bp, Artificial Sequence
  Description of Artificial Sequence: Synthetic oligonucleotide
ataggaatgatgtcacaggtggaagaagagaccc

SEQ ID NO: 197411 - DNA, 33 bp, Artificial Sequence
  Description of Artificial Sequence: Synthetic oligonucleotide
taggaatgatgtcacaggtggaagaagagaccc

SEQ ID NO: 197412 - DNA, 32 bp, Artificial Sequence
  Description of Artificial Sequence: Synthetic oligonucleotide
aggaatgatgtcacaggtggaagaagagaccc

SEQ ID NO: 197413 - DNA, 31 bp, Artificial Sequence
  Description of Artificial Sequence: Synthetic oligonucleotide
ggaatgatgtcacaggtggaagaagagaccc

SEQ ID NO: 197414 - DNA, 35 bp, Artificial Sequence
  Description of Artificial Sequence: Synthetic oligonucleotide
gaatgatgtcacaggtggaagaagagacccaaatc

SEQ ID NO: 197415 - DNA, 38 bp, Artificial Sequence
  Description of Artificial Sequence: Synthetic oligonucleotide
aatgatgtcacaggtggaagaagagacccaaatcattc

SEQ ID NO: 197416 - DNA, 37 bp, Artificial Sequence
  Description of Artificial Sequence: Synthetic oligonucleotide
atgatgtcacaggtggaagaagagacccaaatcattc

SEQ ID NO: 197417 - DNA, 36 bp, Artificial Sequence
  Description of Artificial Sequence: Synthetic oligonucleotide
tgatgtcacaggtggaagaagagacccaaatcattc

SEQ ID NO: 197418 - DNA, 35 bp, Artificial Sequence
  Description of Artificial Sequence: Synthetic oligonucleotide
gatgtcacaggtggaagaagagacccaaatcattc

SEQ ID NO: 197419 - DNA, 36 bp, Artificial Sequence
  Description of Artificial Sequence: Synthetic oligonucleotide
atgtcacaggtggaagaagagacccaaatcattctg

SEQ ID NO: 197420 - DNA, 35 bp, Artificial Sequence
  Description of Artificial Sequence: Synthetic oligonucleotide
tgtcacaggtggaagaagagacccaaatcattctg

SEQ ID NO: 197421 - DNA, 34 bp, Artificial Sequence
  Description of Artificial Sequence: Synthetic oligonucleotide
gtcacaggtggaagaagagacccaaatcattctg

SEQ ID NO: 197422 - DNA, 36 bp, Artificial Sequence
  Description of Artificial Sequence: Synthetic oligonucleotide
tcacaggtggaagaagagacccaaatcattctgaag

SEQ ID NO: 197423 - DNA, 35 bp, Artificial Sequence
  Description of Artificial Sequence: Synthetic oligonucleotide
cacaggtggaagaagagacccaaatcattctgaag

SEQ ID NO: 197424 - DNA, 35 bp, Artificial Sequence
  Description of Artificial Sequence: Synthetic oligonucleotide
acaggtggaagaagagacccaaatcattctgaagg

SEQ ID NO: 197425 - DNA, 34 bp, Artificial Sequence
  Description of Artificial Sequence: Synthetic oligonucleotide
caggtggaagaagagacccaaatcattctgaagg

SEQ ID NO: 197426 - DNA, 34 bp, Artificial Sequence
  Description of Artificial Sequence: Synthetic oligonucleotide
aggtggaagaagagacccaaatcattctgaaggc

SEQ ID NO: 197427 - DNA, 33 bp, Artificial Sequence
  Description of Artificial Sequence: Synthetic oligonucleotide
ggtggaagaagagacccaaatcattctgaaggc

SEQ ID NO: 197428 - DNA, 34 bp, Artificial Sequence
  Description of Artificial Sequence: Synthetic oligonucleotide
gtggaagaagagacccaaatcattctgaaggctc

SEQ ID NO: 197429 - DNA, 36 bp, Artificial Sequence
  Description of Artificial Sequence: Synthetic oligonucleotide
tggaagaagagacccaaatcattctgaaggctcaac

SEQ ID NO: 197430 - DNA, 35 bp, Artificial Sequence
  Description of Artificial Sequence: Synthetic oligonucleotide
ggaagaagagacccaaatcattctgaaggctcaac

SEQ ID NO: 197431 - DNA, 37 bp, Artificial Sequence
  Description of Artificial Sequence: Synthetic oligonucleotide
gaagaagagacccaaatcattctgaaggctcaactac

SEQ ID NO: 197432 - DNA, 41 bp, Artificial Sequence
  Description of Artificial Sequence: Synthetic oligonucleotide
aagaagagacccaaatcattctgaaggctcaactactttac

SEQ ID NO: 197433 - DNA, 40 bp, Artificial Sequence
  Description of Artificial Sequence: Synthetic oligonucleotide
agaagagacccaaatcattctgaaggctcaactactttac

SEQ ID NO: 197434 - DNA, 39 bp, Artificial Sequence
  Description of Artificial Sequence: Synthetic oligonucleotide
gaagagacccaaatcattctgaaggctcaactactttac

SEQ ID NO: 197435 - DNA, 40 bp, Artificial Sequence
  Description of Artificial Sequence: Synthetic oligonucleotide
aagagacccaaatcattctgaaggctcaactactttactg

SEQ ID NO: 197436 - DNA, 39 bp, Artificial Sequence
  Description of Artificial Sequence: Synthetic oligonucleotide
agagacccaaatcattctgaaggctcaactactttactg

SEQ ID NO: 197437 - DNA, 38 bp, Artificial Sequence
  Description of Artificial Sequence: Synthetic oligonucleotide
gagacccaaatcattctgaaggctcaactactttactg

SEQ ID NO: 197438 - DNA, 38 bp, Artificial Sequence
  Description of Artificial Sequence: Synthetic oligonucleotide
agacccaaatcattctgaaggctcaactactttactgg

SEQ ID NO: 197439 - DNA, 37 bp, Artificial Sequence
  Description of Artificial Sequence: Synthetic oligonucleotide
gacccaaatcattctgaaggctcaactactttactgg

SEQ ID NO: 197440 - DNA, 39 bp, Artificial Sequence
  Description of Artificial Sequence: Synthetic oligonucleotide
acccaaatcattctgaaggctcaactactttactggaag

SEQ ID NO: 197441 - DNA, 38 bp, Artificial Sequence
  Description of Artificial Sequence: Synthetic oligonucleotide
cccaaatcattctgaaggctcaactactttactggaag

SEQ ID NO: 197442 - DNA, 38 bp, Artificial Sequence
  Description of Artificial Sequence: Synthetic oligonucleotide
ccaaatcattctgaaggctcaactactttactggaagg

SEQ ID NO: 197443 - DNA, 43 bp, Artificial Sequence
  Description of Artificial Sequence: Synthetic oligonucleotide
caaatcattctgaaggctcaactactttactggaaggttatac

SEQ ID NO: 197444 - DNA, 43 bp, Artificial Sequence
  Description of Artificial Sequence: Synthetic oligonucleotide
aaatcattctgaaggctcaactactttactggaaggttatacc

SEQ ID NO: 197445 - DNA, 42 bp, Artificial Sequence
  Description of Artificial Sequence: Synthetic oligonucleotide
aatcattctgaaggctcaactactttactggaaggttatacc

SEQ ID NO: 197446 - DNA, 41 bp, Artificial Sequence
  Description of Artificial Sequence: Synthetic oligonucleotide
atcattctgaaggctcaactactttactggaaggttatacc

SEQ ID NO: 197447 - DNA, 40 bp, Artificial Sequence
  Description of Artificial Sequence: Synthetic oligonucleotide
tcattctgaaggctcaactactttactggaaggttatacc

SEQ ID NO: 197448 - DNA, 39 bp, Artificial Sequence
  Description of Artificial Sequence: Synthetic oligonucleotide
cattctgaaggctcaactactttactggaaggttatacc

SEQ ID NO: 197449 - DNA, 40 bp, Artificial Sequence
  Description of Artificial Sequence: Synthetic oligonucleotide
attctgaaggctcaactactttactggaaggttatacctc

SEQ ID NO: 197450 - DNA, 39 bp, Artificial Sequence
  Description of Artificial Sequence: Synthetic oligonucleotide
ttctgaaggctcaactactttactggaaggttatacctc

SEQ ID NO: 197451 - DNA, 38 bp, Artificial Sequence
  Description of Artificial Sequence: Synthetic oligonucleotide
tctgaaggctcaactactttactggaaggttatacctc

SEQ ID NO: 197452 - DNA, 37 bp, Artificial Sequence
  Description of Artificial Sequence: Synthetic oligonucleotide
ctgaaggctcaactactttactggaaggttatacctc

SEQ ID NO: 197453 - DNA, 38 bp, Artificial Sequence
  Description of Artificial Sequence: Synthetic oligonucleotide
tgaaggctcaactactttactggaaggttatacctctc

SEQ ID NO: 197454 - DNA, 37 bp, Artificial Sequence
  Description of Artificial Sequence: Synthetic oligonucleotide
gaaggctcaactactttactggaaggttatacctctc

SEQ ID NO: 197455 - DNA, 41 bp, Artificial Sequence
  Description of Artificial Sequence: Synthetic oligonucleotide
aaggctcaactactttactggaaggttatacctctcattac

SEQ ID NO: 197456 - DNA, 40 bp, Artificial Sequence
  Description of Artificial Sequence: Synthetic oligonucleotide
aggctcaactactttactggaaggttatacctctcattac

SEQ ID NO: 197457 - DNA, 39 bp, Artificial Sequence
  Description of Artificial Sequence: Synthetic oligonucleotide
ggctcaactactttactggaaggttatacctctcattac

SEQ ID NO: 197458 - DNA, 39 bp, Artificial Sequence
  Description of Artificial Sequence: Synthetic oligonucleotide
gctcaactactttactggaaggttatacctctcattacc

SEQ ID NO: 197459 - DNA, 39 bp, Artificial Sequence
  Description of Artificial Sequence: Synthetic oligonucleotide
ctcaactactttactggaaggttatacctctcattaccc

SEQ ID NO: 197460 - DNA, 40 bp, Artificial Sequence
  Description of Artificial Sequence: Synthetic oligonucleotide
tcaactactttactggaaggttatacctctcattacccac

SEQ ID NO: 197461 - DNA, 39 bp, Artificial Sequence
  Description of Artificial Sequence: Synthetic oligonucleotide
caactactttactggaaggttatacctctcattacccac

SEQ ID NO: 197462 - DNA, 40 bp, Artificial Sequence
  Description of Artificial Sequence: Synthetic oligonucleotide
aactactttactggaaggttatacctctcattacccacac

SEQ ID NO: 197463 - DNA, 39 bp, Artificial Sequence
  Description of Artificial Sequence: Synthetic oligonucleotide
actactttactggaaggttatacctctcattacccacac

SEQ ID NO: 197464 - DNA, 38 bp, Artificial Sequence
  Description of Artificial Sequence: Synthetic oligonucleotide
ctactttactggaaggttatacctctcattacccacac

SEQ ID NO: 197465 - DNA, 39 bp, Artificial Sequence
  Description of Artificial Sequence: Synthetic oligonucleotide
tactttactggaaggttatacctctcattacccacacac

SEQ ID NO: 197466 - DNA, 38 bp, Artificial Sequence
  Description of Artificial Sequence: Synthetic oligonucleotide
actttactggaaggttatacctctcattacccacacac

SEQ ID NO: 197467 - DNA, 37 bp, Artificial Sequence
  Description of Artificial Sequence: Synthetic oligonucleotide
ctttactggaaggttatacctctcattacccacacac

SEQ ID NO: 197468 - DNA, 37 bp, Artificial Sequence
  Description of Artificial Sequence: Synthetic oligonucleotide
tttactggaaggttatacctctcattacccacacacg

SEQ ID NO: 197469 - DNA, 36 bp, Artificial Sequence
  Description of Artificial Sequence: Synthetic oligonucleotide
ttactggaaggttatacctctcattacccacacacg

SEQ ID NO: 197470 - DNA, 35 bp, Artificial Sequence
  Description of Artificial Sequence: Synthetic oligonucleotide
tactggaaggttatacctctcattacccacacacg

SEQ ID NO: 197471 - DNA, 34 bp, Artificial Sequence
  Description of Artificial Sequence: Synthetic oligonucleotide
actggaaggttatacctctcattacccacacacg

SEQ ID NO: 197472 - DNA, 33 bp, Artificial Sequence
  Description of Artificial Sequence: Synthetic oligonucleotide
ctggaaggttatacctctcattacccacacacg

SEQ ID NO: 197473 - DNA, 35 bp, Artificial Sequence
  Description of Artificial Sequence: Synthetic oligonucleotide
tggaaggttatacctctcattacccacacacgaag

SEQ ID NO: 197474 - DNA, 34 bp, Artificial Sequence
  Description of Artificial Sequence: Synthetic oligonucleotide
ggaaggttatacctctcattacccacacacgaag

SEQ ID NO: 197475 - DNA, 34 bp, Artificial Sequence
  Description of Artificial Sequence: Synthetic oligonucleotide
gaaggttatacctctcattacccacacacgaagg

SEQ ID NO: 197476 - DNA, 37 bp, Artificial Sequence
  Description of Artificial Sequence: Synthetic oligonucleotide
aaggttatacctctcattacccacacacgaaggaaag

SEQ ID NO: 197477 - DNA, 36 bp, Artificial Sequence
  Description of Artificial Sequence: Synthetic oligonucleotide
aggttatacctctcattacccacacacgaaggaaag

SEQ ID NO: 197478 - DNA, 35 bp, Artificial Sequence
  Description of Artificial Sequence: Synthetic oligonucleotide
ggttatacctctcattacccacacacgaaggaaag

SEQ ID NO: 197479 - DNA, 35 bp, Artificial Sequence
  Description of Artificial Sequence: Synthetic oligonucleotide
gttatacctctcattacccacacacgaaggaaagc

SEQ ID NO: 197480 - DNA, 36 bp, Artificial Sequence
  Description of Artificial Sequence: Synthetic oligonucleotide
ttatacctctcattacccacacacgaaggaaagcag

SEQ ID NO: 197481 - DNA, 35 bp, Artificial Sequence
  Description of Artificial Sequence: Synthetic oligonucleotide
tatacctctcattacccacacacgaaggaaagcag

SEQ ID NO: 197482 - DNA, 34 bp, Artificial Sequence
  Description of Artificial Sequence: Synthetic oligonucleotide
atacctctcattacccacacacgaaggaaagcag

SEQ ID NO: 197483 - DNA, 33 bp, Artificial Sequence
  Description of Artificial Sequence: Synthetic oligonucleotide
tacctctcattacccacacacgaaggaaagcag

SEQ ID NO: 197484 - DNA, 32 bp, Artificial Sequence
  Description of Artificial Sequence: Synthetic oligonucleotide
acctctcattacccacacacgaaggaaagcag

SEQ ID NO: 197485 - DNA, 31 bp, Artificial Sequence
  Description of Artificial Sequence: Synthetic oligonucleotide
cctctcattacccacacacgaaggaaagcag

SEQ ID NO: 197486 - DNA, 31 bp, Artificial Sequence
  Description of Artificial Sequence: Synthetic oligonucleotide
ctctcattacccacacacgaaggaaagcagg

SEQ ID NO: 197487 - DNA, 32 bp, Artificial Sequence
  Description of Artificial Sequence: Synthetic oligonucleotide
tctcattacccacacacgaaggaaagcaggac

SEQ ID NO: 197488 - DNA, 31 bp, Artificial Sequence
  Description of Artificial Sequence: Synthetic oligonucleotide
ctcattacccacacacgaaggaaagcaggac

SEQ ID NO: 197489 - DNA, 31 bp, Artificial Sequence
  Description of Artificial Sequence: Synthetic oligonucleotide
tcattacccacacacgaaggaaagcaggacc

SEQ ID NO: 197490 - DNA, 30 bp, Artificial Sequence
  Description of Artificial Sequence: Synthetic oligonucleotide
cattacccacacacgaaggaaagcaggacc

SEQ ID NO: 197491 - DNA, 32 bp, Artificial Sequence
  Description of Artificial Sequence: Synthetic oligonucleotide
attacccacacacgaaggaaagcaggaccttc

SEQ ID NO: 197492 - DNA, 31 bp, Artificial Sequence
  Description of Artificial Sequence: Synthetic oligonucleotide
ttacccacacacgaaggaaagcaggaccttc

SEQ ID NO: 197493 - DNA, 30 bp, Artificial Sequence
  Description of Artificial Sequence: Synthetic oligonucleotide
tacccacacacgaaggaaagcaggaccttc

SEQ ID NO: 197494 - DNA, 29 bp, Artificial Sequence
  Description of Artificial Sequence: Synthetic oligonucleotide
acccacacacgaaggaaagcaggaccttc

SEQ ID NO: 197495 - DNA, 28 bp, Artificial Sequence
  Description of Artificial Sequence: Synthetic oligonucleotide
cccacacacgaaggaaagcaggaccttc

SEQ ID NO: 197496 - DNA, 30 bp, Artificial Sequence
  Description of Artificial Sequence: Synthetic oligonucleotide
ccacacacgaaggaaagcaggaccttcatc

SEQ ID NO: 197497 - DNA, 30 bp, Artificial Sequence
  Description of Artificial Sequence: Synthetic oligonucleotide
cacacacgaaggaaagcaggaccttcatcc

SEQ ID NO: 197498 - DNA, 30 bp, Artificial Sequence
  Description of Artificial Sequence: Synthetic oligonucleotide
acacacgaaggaaagcaggaccttcatccc

SEQ ID NO: 197499 - DNA, 29 bp, Artificial Sequence
  Description of Artificial Sequence: Synthetic oligonucleotide
cacacgaaggaaagcaggaccttcatccc

SEQ ID NO: 197500 - DNA, 30 bp, Artificial Sequence
  Description of Artificial Sequence: Synthetic oligonucleotide
acacgaaggaaagcaggaccttcatcccag

SEQ ID NO: 197501 - DNA, 29 bp, Artificial Sequence
  Description of Artificial Sequence: Synthetic oligonucleotide
cacgaaggaaagcaggaccttcatcccag

SEQ ID NO: 197502 - DNA, 30 bp, Artificial Sequence
  Description of Artificial Sequence: Synthetic oligonucleotide
acgaaggaaagcaggaccttcatcccagtg

SEQ ID NO: 197503 - DNA, 29 bp, Artificial Sequence
  Description of Artificial Sequence: Synthetic oligonucleotide
cgaaggaaagcaggaccttcatcccagtg

SEQ ID NO: 197504 - DNA, 30 bp, Artificial Sequence
  Description of Artificial Sequence: Synthetic oligonucleotide
gaaggaaagcaggaccttcatcccagtgac

SEQ ID NO: 197505 - DNA, 30 bp, Artificial Sequence
  Description of Artificial Sequence: Synthetic oligonucleotide
aaggaaagcaggaccttcatcccagtgacc

SEQ ID NO: 197506 - DNA, 29 bp, Artificial Sequence
  Description of Artificial Sequence: Synthetic oligonucleotide
aggaaagcaggaccttcatcccagtgacc

SEQ ID NO: 197507 - DNA, 28 bp, Artificial Sequence
  Description of Artificial Sequence: Synthetic oligonucleotide
ggaaagcaggaccttcatcccagtgacc

SEQ ID NO: 197508 - DNA, 29 bp, Artificial Sequence
  Description of Artificial Sequence: Synthetic oligonucleotide
gaaagcaggaccttcatcccagtgacctc

SEQ ID NO: 197509 - DNA, 30 bp, Artificial Sequence
  Description of Artificial Sequence: Synthetic oligonucleotide
aaagcaggaccttcatcccagtgacctcag

SEQ ID NO: 197510 - DNA, 29 bp, Artificial Sequence
  Description of Artificial Sequence: Synthetic oligonucleotide
aagcaggaccttcatcccagtgacctcag

SEQ ID NO: 197511 - DNA, 28 bp, Artificial Sequence
  Description of Artificial Sequence: Synthetic oligonucleotide
agcaggaccttcatcccagtgacctcag

SEQ ID NO: 197512 - DNA, 27 bp, Artificial Sequence
  Description of Artificial Sequence: Synthetic oligonucleotide
gcaggaccttcatcccagtgacctcag

SEQ ID NO: 197513 - DNA, 27 bp, Artificial Sequence
  Description of Artificial Sequence: Synthetic oligonucleotide
caggaccttcatcccagtgacctcagc

SEQ ID NO: 197514 - DNA, 30 bp, Artificial Sequence
  Description of Artificial Sequence: Synthetic oligonucleotide
aggaccttcatcccagtgacctcagctaag

SEQ ID NO: 197515 - DNA, 29 bp, Artificial Sequence
  Description of Artificial Sequence: Synthetic oligonucleotide
ggaccttcatcccagtgacctcagctaag

SEQ ID NO: 197516 - DNA, 30 bp, Artificial Sequence
  Description of Artificial Sequence: Synthetic oligonucleotide
gaccttcatcccagtgacctcagctaagac

SEQ ID NO: 197517 - DNA, 31 bp, Artificial Sequence
  Description of Artificial Sequence: Synthetic oligonucleotide
accttcatcccagtgacctcagctaagactg

SEQ ID NO: 197518 - DNA, 30 bp, Artificial Sequence
  Description of Artificial Sequence: Synthetic oligonucleotide
ccttcatcccagtgacctcagctaagactg

SEQ ID NO: 197519 - DNA, 30 bp, Artificial Sequence
  Description of Artificial Sequence: Synthetic oligonucleotide
cttcatcccagtgacctcagctaagactgg

SEQ ID NO: 197520 - DNA, 30 bp, Artificial Sequence
  Description of Artificial Sequence: Synthetic oligonucleotide
ttcatcccagtgacctcagctaagactggg

SEQ ID NO: 197521 - DNA, 29 bp, Artificial Sequence
  Description of Artificial Sequence: Synthetic oligonucleotide
tcatcccagtgacctcagctaagactggg

SEQ ID NO: 197522 - DNA, 28 bp, Artificial Sequence
  Description of Artificial Sequence: Synthetic oligonucleotide
catcccagtgacctcagctaagactggg

SEQ ID NO: 197523 - DNA, 29 bp, Artificial Sequence
  Description of Artificial Sequence: Synthetic oligonucleotide
atcccagtgacctcagctaagactgggtc

SEQ ID NO: 197524 - DNA, 28 bp, Artificial Sequence
  Description of Artificial Sequence: Synthetic oligonucleotide
tcccagtgacctcagctaagactgggtc

SEQ ID NO: 197525 - DNA, 27 bp, Artificial Sequence
  Description of Artificial Sequence: Synthetic oligonucleotide
cccagtgacctcagctaagactgggtc

SEQ ID NO: 197526 - DNA, 27 bp, Artificial Sequence
  Description of Artificial Sequence: Synthetic oligonucleotide
ccagtgacctcagctaagactgggtcc

SEQ ID NO: 197527 - DNA, 30 bp, Artificial Sequence
  Description of Artificial Sequence: Synthetic oligonucleotide
cagtgacctcagctaagactgggtcctttg

SEQ ID NO: 197528 - DNA, 30 bp, Artificial Sequence
  Description of Artificial Sequence: Synthetic oligonucleotide
agtgacctcagctaagactgggtcctttgg

SEQ ID NO: 197529 - DNA, 29 bp, Artificial Sequence
  Description of Artificial Sequence: Synthetic oligonucleotide
gtgacctcagctaagactgggtcctttgg

SEQ ID NO: 197530 - DNA, 30 bp, Artificial Sequence
  Description of Artificial Sequence: Synthetic oligonucleotide
tgacctcagctaagactgggtcctttggag

SEQ ID NO: 197531 - DNA, 29 bp, Artificial Sequence
  Description of Artificial Sequence: Synthetic oligonucleotide
gacctcagctaagactgggtcctttggag

SEQ ID NO: 197532 - DNA, 32 bp, Artificial Sequence
  Description of Artificial Sequence: Synthetic oligonucleotide
acctcagctaagactgggtcctttggagttac

SEQ ID NO: 197533 - DNA, 31 bp, Artificial Sequence
  Description of Artificial Sequence: Synthetic oligonucleotide
cctcagctaagactgggtcctttggagttac

SEQ ID NO: 197534 - DNA, 32 bp, Artificial Sequence
  Description of Artificial Sequence: Synthetic oligonucleotide
ctcagctaagactgggtcctttggagttactg

SEQ ID NO: 197535 - DNA, 32 bp, Artificial Sequence
  Description of Artificial Sequence: Synthetic oligonucleotide
tcagctaagactgggtcctttggagttactgc

SEQ ID NO: 197536 - DNA, 31 bp, Artificial Sequence
  Description of Artificial Sequence: Synthetic oligonucleotide
cagctaagactgggtcctttggagttactgc

SEQ ID NO: 197537 - DNA, 32 bp, Artificial Sequence
  Description of Artificial Sequence: Synthetic oligonucleotide
agctaagactgggtcctttggagttactgcag

SEQ ID NO: 197538 - DNA, 31 bp, Artificial Sequence
  Description of Artificial Sequence: Synthetic oligonucleotide
gctaagactgggtcctttggagttactgcag

SEQ ID NO: 197539 - DNA, 34 bp, Artificial Sequence
  Description of Artificial Sequence: Synthetic oligonucleotide
ctaagactgggtcctttggagttactgcagttac

SEQ ID NO: 197540 - DNA, 35 bp, Artificial Sequence
  Description of Artificial Sequence: Synthetic oligonucleotide
taagactgggtcctttggagttactgcagttactg

SEQ ID NO: 197541 - DNA, 34 bp, Artificial Sequence
  Description of Artificial Sequence: Synthetic oligonucleotide
aagactgggtcctttggagttactgcagttactg

SEQ ID NO: 197542 - DNA, 33 bp, Artificial Sequence
  Description of Artificial Sequence: Synthetic oligonucleotide
agactgggtcctttggagttactgcagttactg

SEQ ID NO: 197543 - DNA, 32 bp, Artificial Sequence
  Description of Artificial Sequence: Synthetic oligonucleotide
gactgggtcctttggagttactgcagttactg

SEQ ID NO: 197544 - DNA, 34 bp, Artificial Sequence
  Description of Artificial Sequence: Synthetic oligonucleotide
actgggtcctttggagttactgcagttactgttg

SEQ ID NO: 197545 - DNA, 33 bp, Artificial Sequence
  Description of Artificial Sequence: Synthetic oligonucleotide
ctgggtcctttggagttactgcagttactgttg

SEQ ID NO: 197546 - DNA, 33 bp, Artificial Sequence
  Description of Artificial Sequence: Synthetic oligonucleotide
tgggtcctttggagttactgcagttactgttgg

SEQ ID NO: 197547 - DNA, 32 bp, Artificial Sequence
  Description of Artificial Sequence: Synthetic oligonucleotide
gggtcctttggagttactgcagttactgttgg

SEQ ID NO: 197548 - DNA, 33 bp, Artificial Sequence
  Description of Artificial Sequence: Synthetic oligonucleotide
ggtcctttggagttactgcagttactgttggag

SEQ ID NO: 197549 - DNA, 36 bp, Artificial Sequence
  Description of Artificial Sequence: Synthetic oligonucleotide
gtcctttggagttactgcagttactgttggagattc

SEQ ID NO: 197550 - DNA, 36 bp, Artificial Sequence
  Description of Artificial Sequence: Synthetic oligonucleotide
tcctttggagttactgcagttactgttggagattcc

SEQ ID NO: 197551 - DNA, 35 bp, Artificial Sequence
  Description of Artificial Sequence: Synthetic oligonucleotide
cctttggagttactgcagttactgttggagattcc

SEQ ID NO: 197552 - DNA, 37 bp, Artificial Sequence
  Description of Artificial Sequence: Synthetic oligonucleotide
ctttggagttactgcagttactgttggagattccaac

SEQ ID NO: 197553 - DNA, 38 bp, Artificial Sequence
  Description of Artificial Sequence: Synthetic oligonucleotide
tttggagttactgcagttactgttggagattccaactc

SEQ ID NO: 197554 - DNA, 37 bp, Artificial Sequence
  Description of Artificial Sequence: Synthetic oligonucleotide
ttggagttactgcagttactgttggagattccaactc

SEQ ID NO: 197555 - DNA, 36 bp, Artificial Sequence
  Description of Artificial Sequence: Synthetic oligonucleotide
tggagttactgcagttactgttggagattccaactc

SEQ ID NO: 197556 - DNA, 35 bp, Artificial Sequence
  Description of Artificial Sequence: Synthetic oligonucleotide
ggagttactgcagttactgttggagattccaactc

SEQ ID NO: 197557 - DNA, 39 bp, Artificial Sequence
  Description of Artificial Sequence: Synthetic oligonucleotide
gagttactgcagttactgttggagattccaactctaatg

SEQ ID NO: 197558 - DNA, 40 bp, Artificial Sequence
  Description of Artificial Sequence: Synthetic oligonucleotide
agttactgcagttactgttggagattccaactctaatgtc

SEQ ID NO: 197559 - DNA, 39 bp, Artificial Sequence
  Description of Artificial Sequence: Synthetic oligonucleotide
gttactgcagttactgttggagattccaactctaatgtc

SEQ ID NO: 197560 - DNA, 42 bp, Artificial Sequence
  Description of Artificial Sequence: Synthetic oligonucleotide
ttactgcagttactgttggagattccaactctaatgtcaatc

SEQ ID NO: 197561 - DNA, 41 bp, Artificial Sequence
  Description of Artificial Sequence: Synthetic oligonucleotide
tactgcagttactgttggagattccaactctaatgtcaatc

SEQ ID NO: 197562 - DNA, 40 bp, Artificial Sequence
  Description of Artificial Sequence: Synthetic oligonucleotide
actgcagttactgttggagattccaactctaatgtcaatc

SEQ ID NO: 197563 - DNA, 39 bp, Artificial Sequence
  Description of Artificial Sequence: Synthetic oligonucleotide
ctgcagttactgttggagattccaactctaatgtcaatc

SEQ ID NO: 197564 - DNA, 39 bp, Artificial Sequence
  Description of Artificial Sequence: Synthetic oligonucleotide
tgcagttactgttggagattccaactctaatgtcaatcg

SEQ ID NO: 197565 - DNA, 38 bp, Artificial Sequence
  Description of Artificial Sequence: Synthetic oligonucleotide
gcagttactgttggagattccaactctaatgtcaatcg

SEQ ID NO: 197566 - DNA, 40 bp, Artificial Sequence
  Description of Artificial Sequence: Synthetic oligonucleotide
cagttactgttggagattccaactctaatgtcaatcgttc

SEQ ID NO: 197567 - DNA, 40 bp, Artificial Sequence
  Description of Artificial Sequence: Synthetic oligonucleotide
agttactgttggagattccaactctaatgtcaatcgttcc

SEQ ID NO: 197568 - DNA, 39 bp, Artificial Sequence
  Description of Artificial Sequence: Synthetic oligonucleotide
gttactgttggagattccaactctaatgtcaatcgttcc

SEQ ID NO: 197569 - DNA, 43 bp, Artificial Sequence
  Description of Artificial Sequence: Synthetic oligonucleotide
ttactgttggagattccaactctaatgtcaatcgttccttatc

SEQ ID NO: 197570 - DNA, 42 bp, Artificial Sequence
  Description of Artificial Sequence: Synthetic oligonucleotide
tactgttggagattccaactctaatgtcaatcgttccttatc

SEQ ID NO: 197571 - DNA, 41 bp, Artificial Sequence
  Description of Artificial Sequence: Synthetic oligonucleotide
actgttggagattccaactctaatgtcaatcgttccttatc

SEQ ID NO: 197572 - DNA, 40 bp, Artificial Sequence
  Description of Artificial Sequence: Synthetic oligonucleotide
ctgttggagattccaactctaatgtcaatcgttccttatc

SEQ ID NO: 197573 - DNA, 41 bp, Artificial Sequence
  Description of Artificial Sequence: Synthetic oligonucleotide
tgttggagattccaactctaatgtcaatcgttccttatcag

SEQ ID NO: 197574 - DNA, 40 bp, Artificial Sequence
  Description of Artificial Sequence: Synthetic oligonucleotide
gttggagattccaactctaatgtcaatcgttccttatcag

SEQ ID NO: 197575 - DNA, 40 bp, Artificial Sequence
  Description of Artificial Sequence: Synthetic oligonucleotide
ttggagattccaactctaatgtcaatcgttccttatcagg

SEQ ID NO: 197576 - DNA, 39 bp, Artificial Sequence
  Description of Artificial Sequence: Synthetic oligonucleotide
tggagattccaactctaatgtcaatcgttccttatcagg

SEQ ID NO: 197577 - DNA, 38 bp, Artificial Sequence
  Description of Artificial Sequence: Synthetic oligonucleotide
ggagattccaactctaatgtcaatcgttccttatcagg

SEQ ID NO: 197578 - DNA, 39 bp, Artificial Sequence
  Description of Artificial Sequence: Synthetic oligonucleotide
gagattccaactctaatgtcaatcgttccttatcaggag

SEQ ID NO: 197579 - DNA, 40 bp, Artificial Sequence
  Description of Artificial Sequence: Synthetic oligonucleotide
agattccaactctaatgtcaatcgttccttatcaggagac

SEQ ID NO: 197580 - DNA, 39 bp, Artificial Sequence
  Description of Artificial Sequence: Synthetic oligonucleotide
gattccaactctaatgtcaatcgttccttatcaggagac

SEQ ID NO: 197581 - DNA, 39 bp, Artificial Sequence
  Description of Artificial Sequence: Synthetic oligonucleotide
attccaactctaatgtcaatcgttccttatcaggagacc

SEQ ID NO: 197582 - DNA, 38 bp, Artificial Sequence
  Description of Artificial Sequence: Synthetic oligonucleotide
ttccaactctaatgtcaatcgttccttatcaggagacc

SEQ ID NO: 197583 - DNA, 37 bp, Artificial Sequence
  Description of Artificial Sequence: Synthetic oligonucleotide
tccaactctaatgtcaatcgttccttatcaggagacc

SEQ ID NO: 197584 - DNA, 36 bp, Artificial Sequence
  Description of Artificial Sequence: Synthetic oligonucleotide
ccaactctaatgtcaatcgttccttatcaggagacc

SEQ ID NO: 197585 - DNA, 38 bp, Artificial Sequence
  Description of Artificial Sequence: Synthetic oligonucleotide
caactctaatgtcaatcgttccttatcaggagaccaag

SEQ ID NO: 197586 - DNA, 39 bp, Artificial Sequence
  Description of Artificial Sequence: Synthetic oligonucleotide
aactctaatgtcaatcgttccttatcaggagaccaagac

SEQ ID NO: 197587 - DNA, 38 bp, Artificial Sequence
  Description of Artificial Sequence: Synthetic oligonucleotide
actctaatgtcaatcgttccttatcaggagaccaagac

SEQ ID NO: 197588 - DNA, 37 bp, Artificial Sequence
  Description of Artificial Sequence: Synthetic oligonucleotide
ctctaatgtcaatcgttccttatcaggagaccaagac

SEQ ID NO: 197589 - DNA, 38 bp, Artificial Sequence
  Description of Artificial Sequence: Synthetic oligonucleotide
tctaatgtcaatcgttccttatcaggagaccaagacac

SEQ ID NO: 197590 - DNA, 37 bp, Artificial Sequence
  Description of Artificial Sequence: Synthetic oligonucleotide
ctaatgtcaatcgttccttatcaggagaccaagacac

SEQ ID NO: 197591 - DNA, 40 bp, Artificial Sequence
  Description of Artificial Sequence: Synthetic oligonucleotide
taatgtcaatcgttccttatcaggagaccaagacacattc

SEQ ID NO: 197592 - DNA, 39 bp, Artificial Sequence
  Description of Artificial Sequence: Synthetic oligonucleotide
aatgtcaatcgttccttatcaggagaccaagacacattc

SEQ ID NO: 197593 - DNA, 38 bp, Artificial Sequence
  Description of Artificial Sequence: Synthetic oligonucleotide
atgtcaatcgttccttatcaggagaccaagacacattc

SEQ ID NO: 197594 - DNA, 37 bp, Artificial Sequence
  Description of Artificial Sequence: Synthetic oligonucleotide
tgtcaatcgttccttatcaggagaccaagacacattc

SEQ ID NO: 197595 - DNA, 36 bp, Artificial Sequence
  Description of Artificial Sequence: Synthetic oligonucleotide
gtcaatcgttccttatcaggagaccaagacacattc

SEQ ID NO: 197596 - DNA, 36 bp, Artificial Sequence
  Description of Artificial Sequence: Synthetic oligonucleotide
tcaatcgttccttatcaggagaccaagacacattcc

SEQ ID NO: 197597 - DNA, 35 bp, Artificial Sequence
  Description of Artificial Sequence: Synthetic oligonucleotide
caatcgttccttatcaggagaccaagacacattcc

SEQ ID NO: 197598 - DNA, 36 bp, Artificial Sequence
  Description of Artificial Sequence: Synthetic oligonucleotide
aatcgttccttatcaggagaccaagacacattccac

SEQ ID NO: 197599 - DNA, 35 bp, Artificial Sequence
  Description of Artificial Sequence: Synthetic oligonucleotide
atcgttccttatcaggagaccaagacacattccac

SEQ ID NO: 197600 - DNA, 34 bp, Artificial Sequence
  Description of Artificial Sequence: Synthetic oligonucleotide
tcgttccttatcaggagaccaagacacattccac

SEQ ID NO: 197601 - DNA, 33 bp, Artificial Sequence
  Description of Artificial Sequence: Synthetic oligonucleotide
cgttccttatcaggagaccaagacacattccac

SEQ ID NO: 197602 - DNA, 33 bp, Artificial Sequence
  Description of Artificial Sequence: Synthetic oligonucleotide
gttccttatcaggagaccaagacacattccacc

SEQ ID NO: 197603 - DNA, 33 bp, Artificial Sequence
  Description of Artificial Sequence: Synthetic oligonucleotide
ttccttatcaggagaccaagacacattccaccc

SEQ ID NO: 197604 - DNA, 32 bp, Artificial Sequence
  Description of Artificial Sequence: Synthetic oligonucleotide
tccttatcaggagaccaagacacattccaccc

SEQ ID NO: 197605 - DNA, 31 bp, Artificial Sequence
  Description of Artificial Sequence: Synthetic oligonucleotide
ccttatcaggagaccaagacacattccaccc

SEQ ID NO: 197606 - DNA, 31 bp, Artificial Sequence
  Description of Artificial Sequence: Synthetic oligonucleotide
cttatcaggagaccaagacacattccacccc

SEQ ID NO: 197607 - DNA, 32 bp, Artificial Sequence
  Description of Artificial Sequence: Synthetic oligonucleotide
ttatcaggagaccaagacacattccaccccag

SEQ ID NO: 197608 - DNA, 31 bp, Artificial Sequence
  Description of Artificial Sequence: Synthetic oligonucleotide
tatcaggagaccaagacacattccaccccag

SEQ ID NO: 197609 - DNA, 30 bp, Artificial Sequence
  Description of Artificial Sequence: Synthetic oligonucleotide
atcaggagaccaagacacattccaccccag

SEQ ID NO: 197610 - DNA, 29 bp, Artificial Sequence
  Description of Artificial Sequence: Synthetic oligonucleotide
tcaggagaccaagacacattccaccccag

SEQ ID NO: 197611 - DNA, 28 bp, Artificial Sequence
  Description of Artificial Sequence: Synthetic oligonucleotide
caggagaccaagacacattccaccccag

SEQ ID NO: 197612 - DNA, 29 bp, Artificial Sequence
  Description of Artificial Sequence: Synthetic oligonucleotide
aggagaccaagacacattccaccccagtg

SEQ ID NO: 197613 - DNA, 28 bp, Artificial Sequence
  Description of Artificial Sequence: Synthetic oligonucleotide
ggagaccaagacacattccaccccagtg

SEQ ID NO: 197614 - DNA, 28 bp, Artificial Sequence
  Description of Artificial Sequence: Synthetic oligonucleotide
gagaccaagacacattccaccccagtgg

SEQ ID NO: 197615 - DNA, 28 bp, Artificial Sequence
  Description of Artificial Sequence: Synthetic oligonucleotide
agaccaagacacattccaccccagtggg

SEQ ID NO: 197616 - DNA, 27 bp, Artificial Sequence
  Description of Artificial Sequence: Synthetic oligonucleotide
gaccaagacacattccaccccagtggg

SEQ ID NO: 197617 - DNA, 27 bp, Artificial Sequence
  Description of Artificial Sequence: Synthetic oligonucleotide
accaagacacattccaccccagtgggg

SEQ ID NO: 197618 - DNA, 26 bp, Artificial Sequence
  Description of Artificial Sequence: Synthetic oligonucleotide
ccaagacacattccaccccagtgggg

SEQ ID NO: 197619 - DNA, 26 bp, Artificial Sequence
  Description of Artificial Sequence: Synthetic oligonucleotide
caagacacattccaccccagtggggg

SEQ ID NO: 197620 - DNA, 27 bp, Artificial Sequence
  Description of Artificial Sequence: Synthetic oligonucleotide
aagacacattccaccccagtggggggt

SEQ ID NO: 197621 - DNA, 26 bp, Artificial Sequence
  Description of Artificial Sequence: Synthetic oligonucleotide
agacacattccaccccagtggggggt

SEQ ID NO: 197622 - DNA, 25 bp, Artificial Sequence
  Description of Artificial Sequence: Synthetic oligonucleotide
gacacattccaccccagtggggggt

SEQ ID NO: 197623 - DNA, 25 bp, Artificial Sequence
  Description of Artificial Sequence: Synthetic oligonucleotide
acacattccaccccagtggggggtc

SEQ ID NO: 197624 - DNA, 24 bp, Artificial Sequence
  Description of Artificial Sequence: Synthetic oligonucleotide
cacattccaccccagtggggggtc

SEQ ID NO: 197625 - DNA, 24 bp, Artificial Sequence
  Description of Artificial Sequence: Synthetic oligonucleotide
acattccaccccagtggggggtcc

SEQ ID NO: 197626 - DNA, 23 bp, Artificial Sequence
  Description of Artificial Sequence: Synthetic oligonucleotide
cattccaccccagtggggggtcc

SEQ ID NO: 197627 - DNA, 26 bp, Artificial Sequence
  Description of Artificial Sequence: Synthetic oligonucleotide
attccaccccagtggggggtcccata

SEQ ID NO: 197628 - DNA, 25 bp, Artificial Sequence
  Description of Artificial Sequence: Synthetic oligonucleotide
ttccaccccagtggggggtcccata

SEQ ID NO: 197629 - DNA, 24 bp, Artificial Sequence
  Description of Artificial Sequence: Synthetic oligonucleotide
tccaccccagtggggggtcccata

SEQ ID NO: 197630 - DNA, 23 bp, Artificial Sequence
  Description of Artificial Sequence: Synthetic oligonucleotide
ccaccccagtggggggtcccata

SEQ ID NO: 197631 - DNA, 23 bp, Artificial Sequence
  Description of Artificial Sequence: Synthetic oligonucleotide
caccccagtggggggtcccatac

SEQ ID NO: 197632 - DNA, 24 bp, Artificial Sequence
  Description of Artificial Sequence: Synthetic oligonucleotide
accccagtggggggtcccatacca

SEQ ID NO: 197633 - DNA, 23 bp, Artificial Sequence
  Description of Artificial Sequence: Synthetic oligonucleotide
ccccagtggggggtcccatacca

SEQ ID NO: 197634 - DNA, 24 bp, Artificial Sequence
  Description of Artificial Sequence: Synthetic oligonucleotide
cccagtggggggtcccataccact

SEQ ID NO: 197635 - DNA, 26 bp, Artificial Sequence
  Description of Artificial Sequence: Synthetic oligonucleotide
ccagtggggggtcccataccactcat

SEQ ID NO: 197636 - DNA, 26 bp, Artificial Sequence
  Description of Artificial Sequence: Synthetic oligonucleotide
cagtggggggtcccataccactcatg

SEQ ID NO: 197637 - DNA, 27 bp, Artificial Sequence
  Description of Artificial Sequence: Synthetic oligonucleotide
agtggggggtcccataccactcatgga

SEQ ID NO: 197638 - DNA, 27 bp, Artificial Sequence
  Description of Artificial Sequence: Synthetic oligonucleotide
gtggggggtcccataccactcatggat

SEQ ID NO: 197639 - DNA, 27 bp, Artificial Sequence
  Description of Artificial Sequence: Synthetic oligonucleotide
tggggggtcccataccactcatggatc

SEQ ID NO: 197640 - DNA, 27 bp, Artificial Sequence
  Description of Artificial Sequence: Synthetic oligonucleotide
ggggggtcccataccactcatggatct

SEQ ID NO: 197641 - DNA, 27 bp, Artificial Sequence
  Description of Artificial Sequence: Synthetic oligonucleotide
gggggtcccataccactcatggatctg

SEQ ID NO: 197642 - DNA, 30 bp, Artificial Sequence
  Description of Artificial Sequence: Synthetic oligonucleotide
ggggtcccataccactcatggatctgaatc

SEQ ID NO: 197643 - DNA, 31 bp, Artificial Sequence
  Description of Artificial Sequence: Synthetic oligonucleotide
gggtcccataccactcatggatctgaatcag

SEQ ID NO: 197644 - DNA, 33 bp, Artificial Sequence
  Description of Artificial Sequence: Synthetic oligonucleotide
ggtcccataccactcatggatctgaatcagatg

SEQ ID NO: 197645 - DNA, 33 bp, Artificial Sequence
  Description of Artificial Sequence: Synthetic oligonucleotide
gtcccataccactcatggatctgaatcagatgg

SEQ ID NO: 197646 - DNA, 34 bp, Artificial Sequence
  Description of Artificial Sequence: Synthetic oligonucleotide
tcccataccactcatggatctgaatcagatggac

SEQ ID NO: 197647 - DNA, 33 bp, Artificial Sequence
  Description of Artificial Sequence: Synthetic oligonucleotide
cccataccactcatggatctgaatcagatggac

SEQ ID NO: 197648 - DNA, 34 bp, Artificial Sequence
  Description of Artificial Sequence: Synthetic oligonucleotide
ccataccactcatggatctgaatcagatggacac

SEQ ID NO: 197649 - DNA, 35 bp, Artificial Sequence
  Description of Artificial Sequence: Synthetic oligonucleotide
cataccactcatggatctgaatcagatggacactc

SEQ ID NO: 197650 - DNA, 36 bp, Artificial Sequence
  Description of Artificial Sequence: Synthetic oligonucleotide
ataccactcatggatctgaatcagatggacactcac

SEQ ID NO: 197651 - DNA, 35 bp, Artificial Sequence
  Description of Artificial Sequence: Synthetic oligonucleotide
taccactcatggatctgaatcagatggacactcac

SEQ ID NO: 197652 - DNA, 34 bp, Artificial Sequence
  Description of Artificial Sequence: Synthetic oligonucleotide
accactcatggatctgaatcagatggacactcac

SEQ ID NO: 197653 - DNA, 33 bp, Artificial Sequence
  Description of Artificial Sequence: Synthetic oligonucleotide
ccactcatggatctgaatcagatggacactcac

SEQ ID NO: 197654 - DNA, 35 bp, Artificial Sequence
  Description of Artificial Sequence: Synthetic oligonucleotide
cactcatggatctgaatcagatggacactcacatg

SEQ ID NO: 197655 - DNA, 35 bp, Artificial Sequence
  Description of Artificial Sequence: Synthetic oligonucleotide
actcatggatctgaatcagatggacactcacatgg

SEQ ID NO: 197656 - DNA, 34 bp, Artificial Sequence
  Description of Artificial Sequence: Synthetic oligonucleotide
ctcatggatctgaatcagatggacactcacatgg

SEQ ID NO: 197657 - DNA, 34 bp, Artificial Sequence
  Description of Artificial Sequence: Synthetic oligonucleotide
tcatggatctgaatcagatggacactcacatggg

SEQ ID NO: 197658 - DNA, 33 bp, Artificial Sequence
  Description of Artificial Sequence: Synthetic oligonucleotide
catggatctgaatcagatggacactcacatggg

SEQ ID NO: 197659 - DNA, 34 bp, Artificial Sequence
  Description of Artificial Sequence: Synthetic oligonucleotide
atggatctgaatcagatggacactcacatgggag

SEQ ID NO: 197660 - DNA, 33 bp, Artificial Sequence
  Description of Artificial Sequence: Synthetic oligonucleotide
tggatctgaatcagatggacactcacatgggag

SEQ ID NO: 197661 - DNA, 32 bp, Artificial Sequence
  Description of Artificial Sequence: Synthetic oligonucleotide
ggatctgaatcagatggacactcacatgggag

SEQ ID NO: 197662 - DNA, 33 bp, Artificial Sequence
  Description of Artificial Sequence: Synthetic oligonucleotide
gatctgaatcagatggacactcacatgggagtc

SEQ ID NO: 197663 - DNA, 35 bp, Artificial Sequence
  Description of Artificial Sequence: Synthetic oligonucleotide
atctgaatcagatggacactcacatgggagtcaag

SEQ ID NO: 197664 - DNA, 34 bp, Artificial Sequence
  Description of Artificial Sequence: Synthetic oligonucleotide
tctgaatcagatggacactcacatgggagtcaag

SEQ ID NO: 197665 - DNA, 33 bp, Artificial Sequence
  Description of Artificial Sequence: Synthetic oligonucleotide
ctgaatcagatggacactcacatgggagtcaag

SEQ ID NO: 197666 - DNA, 35 bp, Artificial Sequence
  Description of Artificial Sequence: Synthetic oligonucleotide
tgaatcagatggacactcacatgggagtcaagaag

SEQ ID NO: 197667 - DNA, 34 bp, Artificial Sequence
  Description of Artificial Sequence: Synthetic oligonucleotide
gaatcagatggacactcacatgggagtcaagaag

SEQ ID NO: 197668 - DNA, 34 bp, Artificial Sequence
  Description of Artificial Sequence: Synthetic oligonucleotide
aatcagatggacactcacatgggagtcaagaagg

SEQ ID NO: 197669 - DNA, 33 bp, Artificial Sequence
  Description of Artificial Sequence: Synthetic oligonucleotide
atcagatggacactcacatgggagtcaagaagg

SEQ ID NO: 197670 - DNA, 32 bp, Artificial Sequence
  Description of Artificial Sequence: Synthetic oligonucleotide
tcagatggacactcacatgggagtcaagaagg

SEQ ID NO: 197671 - DNA, 31 bp, Artificial Sequence
  Description of Artificial Sequence: Synthetic oligonucleotide
cagatggacactcacatgggagtcaagaagg

SEQ ID NO: 197672 - DNA, 32 bp, Artificial Sequence
  Description of Artificial Sequence: Synthetic oligonucleotide
agatggacactcacatgggagtcaagaaggtg

SEQ ID NO: 197673 - DNA, 31 bp, Artificial Sequence
  Description of Artificial Sequence: Synthetic oligonucleotide
gatggacactcacatgggagtcaagaaggtg

SEQ ID NO: 197674 - DNA, 31 bp, Artificial Sequence
  Description of Artificial Sequence: Synthetic oligonucleotide
atggacactcacatgggagtcaagaaggtgg

SEQ ID NO: 197675 - DNA, 30 bp, Artificial Sequence
  Description of Artificial Sequence: Synthetic oligonucleotide
tggacactcacatgggagtcaagaaggtgg

SEQ ID NO: 197676 - DNA, 29 bp, Artificial Sequence
  Description of Artificial Sequence: Synthetic oligonucleotide
ggacactcacatgggagtcaagaaggtgg

SEQ ID NO: 197677 - DNA, 30 bp, Artificial Sequence
  Description of Artificial Sequence: Synthetic oligonucleotide
gacactcacatgggagtcaagaaggtggag

SEQ ID NO: 197678 - DNA, 30 bp, Artificial Sequence
  Description of Artificial Sequence: Synthetic oligonucleotide
acactcacatgggagtcaagaaggtggagc

SEQ ID NO: 197679 - DNA, 29 bp, Artificial Sequence
  Description of Artificial Sequence: Synthetic oligonucleotide
cactcacatgggagtcaagaaggtggagc

SEQ ID NO: 197680 - DNA, 32 bp, Artificial Sequence
  Description of Artificial Sequence: Synthetic oligonucleotide
actcacatgggagtcaagaaggtggagcaaac

SEQ ID NO: 197681 - DNA, 31 bp, Artificial Sequence
  Description of Artificial Sequence: Synthetic oligonucleotide
ctcacatgggagtcaagaaggtggagcaaac

SEQ ID NO: 197682 - DNA, 32 bp, Artificial Sequence
  Description of Artificial Sequence: Synthetic oligonucleotide
tcacatgggagtcaagaaggtggagcaaacac

SEQ ID NO: 197683 - DNA, 31 bp, Artificial Sequence
  Description of Artificial Sequence: Synthetic oligonucleotide
cacatgggagtcaagaaggtggagcaaacac

SEQ ID NO: 197684 - DNA, 33 bp, Artificial Sequence
  Description of Artificial Sequence: Synthetic oligonucleotide
acatgggagtcaagaaggtggagcaaacacaac

SEQ ID NO: 197685 - DNA, 32 bp, Artificial Sequence
  Description of Artificial Sequence: Synthetic oligonucleotide
catgggagtcaagaaggtggagcaaacacaac

SEQ ID NO: 197686 - DNA, 32 bp, Artificial Sequence
  Description of Artificial Sequence: Synthetic oligonucleotide
atgggagtcaagaaggtggagcaaacacaacc

SEQ ID NO: 197687 - DNA, 31 bp, Artificial Sequence
  Description of Artificial Sequence: Synthetic oligonucleotide
tgggagtcaagaaggtggagcaaacacaacc

SEQ ID NO: 197688 - DNA, 30 bp, Artificial Sequence
  Description of Artificial Sequence: Synthetic oligonucleotide
gggagtcaagaaggtggagcaaacacaacc

SEQ ID NO: 197689 - DNA, 31 bp, Artificial Sequence
  Description of Artificial Sequence: Synthetic oligonucleotide
ggagtcaagaaggtggagcaaacacaacctc

SEQ ID NO: 197690 - DNA, 32 bp, Artificial Sequence
  Description of Artificial Sequence: Synthetic oligonucleotide
gagtcaagaaggtggagcaaacacaacctctg

SEQ ID NO: 197691 - DNA, 32 bp, Artificial Sequence
  Description of Artificial Sequence: Synthetic oligonucleotide
agtcaagaaggtggagcaaacacaacctctgg

SEQ ID NO: 197692 - DNA, 31 bp, Artificial Sequence
  Description of Artificial Sequence: Synthetic oligonucleotide
gtcaagaaggtggagcaaacacaacctctgg

SEQ ID NO: 197693 - DNA, 32 bp, Artificial Sequence
  Description of Artificial Sequence: Synthetic oligonucleotide
tcaagaaggtggagcaaacacaacctctggtc

SEQ ID NO: 197694 - DNA, 31 bp, Artificial Sequence
  Description of Artificial Sequence: Synthetic oligonucleotide
caagaaggtggagcaaacacaacctctggtc

SEQ ID NO: 197695 - DNA, 31 bp, Artificial Sequence
  Description of Artificial Sequence: Synthetic oligonucleotide
aagaaggtggagcaaacacaacctctggtcc

SEQ ID NO: 197696 - DNA, 30 bp, Artificial Sequence
  Description of Artificial Sequence: Synthetic oligonucleotide
agaaggtggagcaaacacaacctctggtcc

SEQ ID NO: 197697 - DNA, 29 bp, Artificial Sequence
  Description of Artificial Sequence: Synthetic oligonucleotide
gaaggtggagcaaacacaacctctggtcc

SEQ ID NO: 197698 - DNA, 34 bp, Artificial Sequence
  Description of Artificial Sequence: Synthetic oligonucleotide
aaggtggagcaaacacaacctctggtcctataag

SEQ ID NO: 197699 - DNA, 33 bp, Artificial Sequence
  Description of Artificial Sequence: Synthetic oligonucleotide
aggtggagcaaacacaacctctggtcctataag

SEQ ID NO: 197700 - DNA, 32 bp, Artificial Sequence
  Description of Artificial Sequence: Synthetic oligonucleotide
ggtggagcaaacacaacctctggtcctataag

SEQ ID NO: 197701 - DNA, 32 bp, Artificial Sequence
  Description of Artificial Sequence: Synthetic oligonucleotide
gtggagcaaacacaacctctggtcctataagg

SEQ ID NO: 197702 - DNA, 33 bp, Artificial Sequence
  Description of Artificial Sequence: Synthetic oligonucleotide
tggagcaaacacaacctctggtcctataaggac

SEQ ID NO: 197703 - DNA, 32 bp, Artificial Sequence
  Description of Artificial Sequence: Synthetic oligonucleotide
ggagcaaacacaacctctggtcctataaggac

SEQ ID NO: 197704 - DNA, 33 bp, Artificial Sequence
  Description of Artificial Sequence: Synthetic oligonucleotide
gagcaaacacaacctctggtcctataaggacac

SEQ ID NO: 197705 - DNA, 33 bp, Artificial Sequence
  Description of Artificial Sequence: Synthetic oligonucleotide
agcaaacacaacctctggtcctataaggacacc

SEQ ID NO: 197706 - DNA, 32 bp, Artificial Sequence
  Description of Artificial Sequence: Synthetic oligonucleotide
gcaaacacaacctctggtcctataaggacacc

SEQ ID NO: 197707 - DNA, 32 bp, Artificial Sequence
  Description of Artificial Sequence: Synthetic oligonucleotide
caaacacaacctctggtcctataaggacaccc

SEQ ID NO: 197708 - DNA, 32 bp, Artificial Sequence
  Description of Artificial Sequence: Synthetic oligonucleotide
aaacacaacctctggtcctataaggacacccc

SEQ ID NO: 197709 - DNA, 31 bp, Artificial Sequence
  Description of Artificial Sequence: Synthetic oligonucleotide
aacacaacctctggtcctataaggacacccc

SEQ ID NO: 197710 - DNA, 30 bp, Artificial Sequence
  Description of Artificial Sequence: Synthetic oligonucleotide
acacaacctctggtcctataaggacacccc

SEQ ID NO: 197711 - DNA, 29 bp, Artificial Sequence
  Description of Artificial Sequence: Synthetic oligonucleotide
cacaacctctggtcctataaggacacccc

SEQ ID NO: 197712 - DNA, 34 bp, Artificial Sequence
  Description of Artificial Sequence: Synthetic oligonucleotide
acaacctctggtcctataaggacaccccaaattc

SEQ ID NO: 197713 - DNA, 33 bp, Artificial Sequence
  Description of Artificial Sequence: Synthetic oligonucleotide
caacctctggtcctataaggacaccccaaattc

SEQ ID NO: 197714 - DNA, 33 bp, Artificial Sequence
  Description of Artificial Sequence: Synthetic oligonucleotide
aacctctggtcctataaggacaccccaaattcc

SEQ ID NO: 197715 - DNA, 32 bp, Artificial Sequence
  Description of Artificial Sequence: Synthetic oligonucleotide
acctctggtcctataaggacaccccaaattcc

SEQ ID NO: 197716 - DNA, 31 bp, Artificial Sequence
  Description of Artificial Sequence: Synthetic oligonucleotide
cctctggtcctataaggacaccccaaattcc

SEQ ID NO: 197717 - DNA, 32 bp, Artificial Sequence
  Description of Artificial Sequence: Synthetic oligonucleotide
ctctggtcctataaggacaccccaaattccag

SEQ ID NO: 197718 - DNA, 35 bp, Artificial Sequence
  Description of Artificial Sequence: Synthetic oligonucleotide
tctggtcctataaggacaccccaaattccagaatg

SEQ ID NO: 197719 - DNA, 34 bp, Artificial Sequence
  Description of Artificial Sequence: Synthetic oligonucleotide
ctggtcctataaggacaccccaaattccagaatg

SEQ ID NO: 197720 - DNA, 34 bp, Artificial Sequence
  Description of Artificial Sequence: Synthetic oligonucleotide
tggtcctataaggacaccccaaattccagaatgg

SEQ ID NO: 197721 - DNA, 33 bp, Artificial Sequence
  Description of Artificial Sequence: Synthetic oligonucleotide
ggtcctataaggacaccccaaattccagaatgg

SEQ ID NO: 197722 - DNA, 33 bp, Artificial Sequence
  Description of Artificial Sequence: Synthetic oligonucleotide
gtcctataaggacaccccaaattccagaatggc

SEQ ID NO: 197723 - DNA, 34 bp, Artificial Sequence
  Description of Artificial Sequence: Synthetic oligonucleotide
tcctataaggacaccccaaattccagaatggctg

SEQ ID NO: 197724 - DNA, 33 bp, Artificial Sequence
  Description of Artificial Sequence: Synthetic oligonucleotide
cctataaggacaccccaaattccagaatggctg

SEQ ID NO: 197725 - DNA, 35 bp, Artificial Sequence
  Description of Artificial Sequence: Synthetic oligonucleotide
ctataaggacaccccaaattccagaatggctgatc

SEQ ID NO: 197726 - DNA, 37 bp, Artificial Sequence
  Description of Artificial Sequence: Synthetic oligonucleotide
tataaggacaccccaaattccagaatggctgatcatc

SEQ ID NO: 197727 - DNA, 36 bp, Artificial Sequence
  Description of Artificial Sequence: Synthetic oligonucleotide
ataaggacaccccaaattccagaatggctgatcatc

SEQ ID NO: 197728 - DNA, 35 bp, Artificial Sequence
  Description of Artificial Sequence: Synthetic oligonucleotide
taaggacaccccaaattccagaatggctgatcatc

SEQ ID NO: 197729 - DNA, 34 bp, Artificial Sequence
  Description of Artificial Sequence: Synthetic oligonucleotide
aaggacaccccaaattccagaatggctgatcatc

SEQ ID NO: 197730 - DNA, 33 bp, Artificial Sequence
  Description of Artificial Sequence: Synthetic oligonucleotide
aggacaccccaaattccagaatggctgatcatc

SEQ ID NO: 197731 - DNA, 32 bp, Artificial Sequence
  Description of Artificial Sequence: Synthetic oligonucleotide
ggacaccccaaattccagaatggctgatcatc

SEQ ID NO: 197732 - DNA, 34 bp, Artificial Sequence
  Description of Artificial Sequence: Synthetic oligonucleotide
gacaccccaaattccagaatggctgatcatcttg

SEQ ID NO: 197733 - DNA, 34 bp, Artificial Sequence
  Description of Artificial Sequence: Synthetic oligonucleotide
acaccccaaattccagaatggctgatcatcttgg

SEQ ID NO: 197734 - DNA, 33 bp, Artificial Sequence
  Description of Artificial Sequence: Synthetic oligonucleotide
caccccaaattccagaatggctgatcatcttgg

SEQ ID NO: 197735 - DNA, 33 bp, Artificial Sequence
  Description of Artificial Sequence: Synthetic oligonucleotide
accccaaattccagaatggctgatcatcttggc

SEQ ID NO: 197736 - DNA, 32 bp, Artificial Sequence
  Description of Artificial Sequence: Synthetic oligonucleotide
ccccaaattccagaatggctgatcatcttggc

SEQ ID NO: 197737 - DNA, 34 bp, Artificial Sequence
  Description of Artificial Sequence: Synthetic oligonucleotide
cccaaattccagaatggctgatcatcttggcatc

SEQ ID NO: 197738 - DNA, 34 bp, Artificial Sequence
  Description of Artificial Sequence: Synthetic oligonucleotide
ccaaattccagaatggctgatcatcttggcatcc

SEQ ID NO: 197739 - DNA, 34 bp, Artificial Sequence
  Description of Artificial Sequence: Synthetic oligonucleotide
caaattccagaatggctgatcatcttggcatccc

SEQ ID NO: 197740 - DNA, 35 bp, Artificial Sequence
  Description of Artificial Sequence: Synthetic oligonucleotide
aaattccagaatggctgatcatcttggcatccctc

SEQ ID NO: 197741 - DNA, 34 bp, Artificial Sequence
  Description of Artificial Sequence: Synthetic oligonucleotide
aattccagaatggctgatcatcttggcatccctc

SEQ ID NO: 197742 - DNA, 33 bp, Artificial Sequence
  Description of Artificial Sequence: Synthetic oligonucleotide
attccagaatggctgatcatcttggcatccctc

SEQ ID NO: 197743 - DNA, 32 bp, Artificial Sequence
  Description of Artificial Sequence: Synthetic oligonucleotide
ttccagaatggctgatcatcttggcatccctc

SEQ ID NO: 197744 - DNA, 31 bp, Artificial Sequence
  Description of Artificial Sequence: Synthetic oligonucleotide
tccagaatggctgatcatcttggcatccctc

SEQ ID NO: 197745 - DNA, 30 bp, Artificial Sequence
  Description of Artificial Sequence: Synthetic oligonucleotide
ccagaatggctgatcatcttggcatccctc

SEQ ID NO: 197746 - DNA, 32 bp, Artificial Sequence
  Description of Artificial Sequence: Synthetic oligonucleotide
cagaatggctgatcatcttggcatccctcttg

SEQ ID NO: 197747 - DNA, 32 bp, Artificial Sequence
  Description of Artificial Sequence: Synthetic oligonucleotide
agaatggctgatcatcttggcatccctcttgg

SEQ ID NO: 197748 - DNA, 31 bp, Artificial Sequence
  Description of Artificial Sequence: Synthetic oligonucleotide
gaatggctgatcatcttggcatccctcttgg

SEQ ID NO: 197749 - DNA, 31 bp, Artificial Sequence
  Description of Artificial Sequence: Synthetic oligonucleotide
aatggctgatcatcttggcatccctcttggc

SEQ ID NO: 197750 - DNA, 30 bp, Artificial Sequence
  Description of Artificial Sequence: Synthetic oligonucleotide
atggctgatcatcttggcatccctcttggc

SEQ ID NO: 197751 - DNA, 29 bp, Artificial Sequence
  Description of Artificial Sequence: Synthetic oligonucleotide
tggctgatcatcttggcatccctcttggc

SEQ ID NO: 197752 - DNA, 28 bp, Artificial Sequence
  Description of Artificial Sequence: Synthetic oligonucleotide
ggctgatcatcttggcatccctcttggc

SEQ ID NO: 197753 - DNA, 28 bp, Artificial Sequence
  Description of Artificial Sequence: Synthetic oligonucleotide
gctgatcatcttggcatccctcttggcc

SEQ ID NO: 197754 - DNA, 30 bp, Artificial Sequence
  Description of Artificial Sequence: Synthetic oligonucleotide
ctgatcatcttggcatccctcttggccttg

SEQ ID NO: 197755 - DNA, 30 bp, Artificial Sequence
  Description of Artificial Sequence: Synthetic oligonucleotide
tgatcatcttggcatccctcttggccttgg

SEQ ID NO: 197756 - DNA, 29 bp, Artificial Sequence
  Description of Artificial Sequence: Synthetic oligonucleotide
gatcatcttggcatccctcttggccttgg

SEQ ID NO: 197757 - DNA, 29 bp, Artificial Sequence
  Description of Artificial Sequence: Synthetic oligonucleotide
atcatcttggcatccctcttggccttggc

SEQ ID NO: 197758 - DNA, 28 bp, Artificial Sequence
  Description of Artificial Sequence: Synthetic oligonucleotide
tcatcttggcatccctcttggccttggc

SEQ ID NO: 197759 - DNA, 27 bp, Artificial Sequence
  Description of Artificial Sequence: Synthetic oligonucleotide
catcttggcatccctcttggccttggc

SEQ ID NO: 197760 - DNA, 30 bp, Artificial Sequence
  Description of Artificial Sequence: Synthetic oligonucleotide
atcttggcatccctcttggccttggctttg

SEQ ID NO: 197761 - DNA, 29 bp, Artificial Sequence
  Description of Artificial Sequence: Synthetic oligonucleotide
tcttggcatccctcttggccttggctttg

SEQ ID NO: 197762 - DNA, 28 bp, Artificial Sequence
  Description of Artificial Sequence: Synthetic oligonucleotide
cttggcatccctcttggccttggctttg

SEQ ID NO: 197763 - DNA, 31 bp, Artificial Sequence
  Description of Artificial Sequence: Synthetic oligonucleotide
ttggcatccctcttggccttggctttgattc

SEQ ID NO: 197764 - DNA, 30 bp, Artificial Sequence
  Description of Artificial Sequence: Synthetic oligonucleotide
tggcatccctcttggccttggctttgattc

SEQ ID NO: 197765 - DNA, 29 bp, Artificial Sequence
  Description of Artificial Sequence: Synthetic oligonucleotide
ggcatccctcttggccttggctttgattc

SEQ ID NO: 197766 - DNA, 31 bp, Artificial Sequence
  Description of Artificial Sequence: Synthetic oligonucleotide
gcatccctcttggccttggctttgattcttg

SEQ ID NO: 197767 - DNA, 31 bp, Artificial Sequence
  Description of Artificial Sequence: Synthetic oligonucleotide
catccctcttggccttggctttgattcttgc

SEQ ID NO: 197768 - DNA, 32 bp, Artificial Sequence
  Description of Artificial Sequence: Synthetic oligonucleotide
atccctcttggccttggctttgattcttgcag

SEQ ID NO: 197769 - DNA, 31 bp, Artificial Sequence
  Description of Artificial Sequence: Synthetic oligonucleotide
tccctcttggccttggctttgattcttgcag

SEQ ID NO: 197770 - DNA, 30 bp, Artificial Sequence
  Description of Artificial Sequence: Synthetic oligonucleotide
ccctcttggccttggctttgattcttgcag

SEQ ID NO: 197771 - DNA, 33 bp, Artificial Sequence
  Description of Artificial Sequence: Synthetic oligonucleotide
cctcttggccttggctttgattcttgcagtttg

SEQ ID NO: 197772 - DNA, 33 bp, Artificial Sequence
  Description of Artificial Sequence: Synthetic oligonucleotide
ctcttggccttggctttgattcttgcagtttgc

SEQ ID NO: 197773 - DNA, 36 bp, Artificial Sequence
  Description of Artificial Sequence: Synthetic oligonucleotide
tcttggccttggctttgattcttgcagtttgcattg

SEQ ID NO: 197774 - DNA, 35 bp, Artificial Sequence
  Description of Artificial Sequence: Synthetic oligonucleotide
cttggccttggctttgattcttgcagtttgcattg

SEQ ID NO: 197775 - DNA, 35 bp, Artificial Sequence
  Description of Artificial Sequence: Synthetic oligonucleotide
ttggccttggctttgattcttgcagtttgcattgc

SEQ ID NO: 197776 - DNA, 34 bp, Artificial Sequence
  Description of Artificial Sequence: Synthetic oligonucleotide
tggccttggctttgattcttgcagtttgcattgc

SEQ ID NO: 197777 - DNA, 33 bp, Artificial Sequence
  Description of Artificial Sequence: Synthetic oligonucleotide
ggccttggctttgattcttgcagtttgcattgc

SEQ ID NO: 197778 - DNA, 34 bp, Artificial Sequence
  Description of Artificial Sequence: Synthetic oligonucleotide
gccttggctttgattcttgcagtttgcattgcag

SEQ ID NO: 197779 - DNA, 35 bp, Artificial Sequence
  Description of Artificial Sequence: Synthetic oligonucleotide
ccttggctttgattcttgcagtttgcattgcagtc

SEQ ID NO: 197780 - DNA, 37 bp, Artificial Sequence
  Description of Artificial Sequence: Synthetic oligonucleotide
cttggctttgattcttgcagtttgcattgcagtcaac

SEQ ID NO: 197781 - DNA, 38 bp, Artificial Sequence
  Description of Artificial Sequence: Synthetic oligonucleotide
ttggctttgattcttgcagtttgcattgcagtcaacag

SEQ ID NO: 197782 - DNA, 37 bp, Artificial Sequence
  Description of Artificial Sequence: Synthetic oligonucleotide
tggctttgattcttgcagtttgcattgcagtcaacag

SEQ ID NO: 197783 - DNA, 36 bp, Artificial Sequence
  Description of Artificial Sequence: Synthetic oligonucleotide
ggctttgattcttgcagtttgcattgcagtcaacag

SEQ ID NO: 197784 - DNA, 37 bp, Artificial Sequence
  Description of Artificial Sequence: Synthetic oligonucleotide
gctttgattcttgcagtttgcattgcagtcaacagtc

SEQ ID NO: 197785 - DNA, 37 bp, Artificial Sequence
  Description of Artificial Sequence: Synthetic oligonucleotide
ctttgattcttgcagtttgcattgcagtcaacagtcg

SEQ ID NO: 197786 - DNA, 39 bp, Artificial Sequence
  Description of Artificial Sequence: Synthetic oligonucleotide
tttgattcttgcagtttgcattgcagtcaacagtcgaag

SEQ ID NO: 197787 - DNA, 38 bp, Artificial Sequence
  Description of Artificial Sequence: Synthetic oligonucleotide
ttgattcttgcagtttgcattgcagtcaacagtcgaag

SEQ ID NO: 197788 - DNA, 37 bp, Artificial Sequence
  Description of Artificial Sequence: Synthetic oligonucleotide
tgattcttgcagtttgcattgcagtcaacagtcgaag

SEQ ID NO: 197789 - DNA, 36 bp, Artificial Sequence
  Description of Artificial Sequence: Synthetic oligonucleotide
gattcttgcagtttgcattgcagtcaacagtcgaag

SEQ ID NO: 197790 - DNA, 38 bp, Artificial Sequence
  Description of Artificial Sequence: Synthetic oligonucleotide
attcttgcagtttgcattgcagtcaacagtcgaagaag

SEQ ID NO: 197791 - DNA, 37 bp, Artificial Sequence
  Description of Artificial Sequence: Synthetic oligonucleotide
ttcttgcagtttgcattgcagtcaacagtcgaagaag

SEQ ID NO: 197792 - DNA, 36 bp, Artificial Sequence
  Description of Artificial Sequence: Synthetic oligonucleotide
tcttgcagtttgcattgcagtcaacagtcgaagaag

SEQ ID NO: 197793 - DNA, 35 bp, Artificial Sequence
  Description of Artificial Sequence: Synthetic oligonucleotide
cttgcagtttgcattgcagtcaacagtcgaagaag

SEQ ID NO: 197794 - DNA, 35 bp, Artificial Sequence
  Description of Artificial Sequence: Synthetic oligonucleotide
ttgcagtttgcattgcagtcaacagtcgaagaagg

SEQ ID NO: 197795 - DNA, 34 bp, Artificial Sequence
  Description of Artificial Sequence: Synthetic oligonucleotide
tgcagtttgcattgcagtcaacagtcgaagaagg

SEQ ID NO: 197796 - DNA, 33 bp, Artificial Sequence
  Description of Artificial Sequence: Synthetic oligonucleotide
gcagtttgcattgcagtcaacagtcgaagaagg

SEQ ID NO: 197797 - DNA, 34 bp, Artificial Sequence
  Description of Artificial Sequence: Synthetic oligonucleotide
cagtttgcattgcagtcaacagtcgaagaaggtg

SEQ ID NO: 197798 - DNA, 35 bp, Artificial Sequence
  Description of Artificial Sequence: Synthetic oligonucleotide
agtttgcattgcagtcaacagtcgaagaaggtgtg

SEQ ID NO: 197799 - DNA, 34 bp, Artificial Sequence
  Description of Artificial Sequence: Synthetic oligonucleotide
gtttgcattgcagtcaacagtcgaagaaggtgtg

SEQ ID NO: 197800 - DNA, 34 bp, Artificial Sequence
  Description of Artificial Sequence: Synthetic oligonucleotide
tttgcattgcagtcaacagtcgaagaaggtgtgg

SEQ ID NO: 197801 - DNA, 33 bp, Artificial Sequence
  Description of Artificial Sequence: Synthetic oligonucleotide
ttgcattgcagtcaacagtcgaagaaggtgtgg

SEQ ID NO: 197802 - DNA, 32 bp, Artificial Sequence
  Description of Artificial Sequence: Synthetic oligonucleotide
tgcattgcagtcaacagtcgaagaaggtgtgg

SEQ ID NO: 197803 - DNA, 31 bp, Artificial Sequence
  Description of Artificial Sequence: Synthetic oligonucleotide
gcattgcagtcaacagtcgaagaaggtgtgg

SEQ ID NO: 197804 - DNA, 31 bp, Artificial Sequence
  Description of Artificial Sequence: Synthetic oligonucleotide
cattgcagtcaacagtcgaagaaggtgtggg

SEQ ID NO: 197805 - DNA, 31 bp, Artificial Sequence
  Description of Artificial Sequence: Synthetic oligonucleotide
attgcagtcaacagtcgaagaaggtgtgggc

SEQ ID NO: 197806 - DNA, 30 bp, Artificial Sequence
  Description of Artificial Sequence: Synthetic oligonucleotide
ttgcagtcaacagtcgaagaaggtgtgggc

SEQ ID NO: 197807 - DNA, 29 bp, Artificial Sequence
  Description of Artificial Sequence: Synthetic oligonucleotide
tgcagtcaacagtcgaagaaggtgtgggc

SEQ ID NO: 197808 - DNA, 28 bp, Artificial Sequence
  Description of Artificial Sequence: Synthetic oligonucleotide
gcagtcaacagtcgaagaaggtgtgggc

SEQ ID NO: 197809 - DNA, 29 bp, Artificial Sequence
  Description of Artificial Sequence: Synthetic oligonucleotide
cagtcaacagtcgaagaaggtgtgggcag

SEQ ID NO: 197810 - DNA, 31 bp, Artificial Sequence
  Description of Artificial Sequence: Synthetic oligonucleotide
agtcaacagtcgaagaaggtgtgggcagaag

SEQ ID NO: 197811 - DNA, 30 bp, Artificial Sequence
  Description of Artificial Sequence: Synthetic oligonucleotide
gtcaacagtcgaagaaggtgtgggcagaag

SEQ ID NO: 197812 - DNA, 35 bp, Artificial Sequence
  Description of Artificial Sequence: Synthetic oligonucleotide
tcaacagtcgaagaaggtgtgggcagaagaaaaag

SEQ ID NO: 197813 - DNA, 34 bp, Artificial Sequence
  Description of Artificial Sequence: Synthetic oligonucleotide
caacagtcgaagaaggtgtgggcagaagaaaaag

SEQ ID NO: 197814 - DNA, 34 bp, Artificial Sequence
  Description of Artificial Sequence: Synthetic oligonucleotide
aacagtcgaagaaggtgtgggcagaagaaaaagc

SEQ ID NO: 197815 - DNA, 33 bp, Artificial Sequence
  Description of Artificial Sequence: Synthetic oligonucleotide
acagtcgaagaaggtgtgggcagaagaaaaagc

SEQ ID NO: 197816 - DNA, 32 bp, Artificial Sequence
  Description of Artificial Sequence: Synthetic oligonucleotide
cagtcgaagaaggtgtgggcagaagaaaaagc

SEQ ID NO: 197817 - DNA, 34 bp, Artificial Sequence
  Description of Artificial Sequence: Synthetic oligonucleotide
agtcgaagaaggtgtgggcagaagaaaaagctag

SEQ ID NO: 197818 - DNA, 33 bp, Artificial Sequence
  Description of Artificial Sequence: Synthetic oligonucleotide
gtcgaagaaggtgtgggcagaagaaaaagctag

SEQ ID NO: 197819 - DNA, 34 bp, Artificial Sequence
  Description of Artificial Sequence: Synthetic oligonucleotide
tcgaagaaggtgtgggcagaagaaaaagctagtg

SEQ ID NO: 197820 - DNA, 33 bp, Artificial Sequence
  Description of Artificial Sequence: Synthetic oligonucleotide
cgaagaaggtgtgggcagaagaaaaagctagtg

SEQ ID NO: 197821 - DNA, 35 bp, Artificial Sequence
  Description of Artificial Sequence: Synthetic oligonucleotide
gaagaaggtgtgggcagaagaaaaagctagtgatc

SEQ ID NO: 197822 - DNA, 37 bp, Artificial Sequence
  Description of Artificial Sequence: Synthetic oligonucleotide
aagaaggtgtgggcagaagaaaaagctagtgatcaac

SEQ ID NO: 197823 - DNA, 36 bp, Artificial Sequence
  Description of Artificial Sequence: Synthetic oligonucleotide
agaaggtgtgggcagaagaaaaagctagtgatcaac

SEQ ID NO: 197824 - DNA, 35 bp, Artificial Sequence
  Description of Artificial Sequence: Synthetic oligonucleotide
gaaggtgtgggcagaagaaaaagctagtgatcaac

SEQ ID NO: 197825 - DNA, 36 bp, Artificial Sequence
  Description of Artificial Sequence: Synthetic oligonucleotide
aaggtgtgggcagaagaaaaagctagtgatcaacag

SEQ ID NO: 197826 - DNA, 35 bp, Artificial Sequence
  Description of Artificial Sequence: Synthetic oligonucleotide
aggtgtgggcagaagaaaaagctagtgatcaacag

SEQ ID NO: 197827 - DNA, 34 bp, Artificial Sequence
  Description of Artificial Sequence: Synthetic oligonucleotide
ggtgtgggcagaagaaaaagctagtgatcaacag

SEQ ID NO: 197828 - DNA, 35 bp, Artificial Sequence
  Description of Artificial Sequence: Synthetic oligonucleotide
gtgtgggcagaagaaaaagctagtgatcaacagtg

SEQ ID NO: 197829 - DNA, 35 bp, Artificial Sequence
  Description of Artificial Sequence: Synthetic oligonucleotide
tgtgggcagaagaaaaagctagtgatcaacagtgg

SEQ ID NO: 197830 - DNA, 34 bp, Artificial Sequence
  Description of Artificial Sequence: Synthetic oligonucleotide
gtgggcagaagaaaaagctagtgatcaacagtgg

SEQ ID NO: 197831 - DNA, 34 bp, Artificial Sequence
  Description of Artificial Sequence: Synthetic oligonucleotide
tgggcagaagaaaaagctagtgatcaacagtggc

SEQ ID NO: 197832 - DNA, 33 bp, Artificial Sequence
  Description of Artificial Sequence: Synthetic oligonucleotide
gggcagaagaaaaagctagtgatcaacagtggc

SEQ ID NO: 197833 - DNA, 36 bp, Artificial Sequence
  Description of Artificial Sequence: Synthetic oligonucleotide
ggcagaagaaaaagctagtgatcaacagtggcaatg

SEQ ID NO: 197834 - DNA, 36 bp, Artificial Sequence
  Description of Artificial Sequence: Synthetic oligonucleotide
gcagaagaaaaagctagtgatcaacagtggcaatgg

SEQ ID NO: 197835 - DNA, 37 bp, Artificial Sequence
  Description of Artificial Sequence: Synthetic oligonucleotide
cagaagaaaaagctagtgatcaacagtggcaatggag

SEQ ID NO: 197836 - DNA, 37 bp, Artificial Sequence
  Description of Artificial Sequence: Synthetic oligonucleotide
agaagaaaaagctagtgatcaacagtggcaatggagc

SEQ ID NO: 197837 - DNA, 36 bp, Artificial Sequence
  Description of Artificial Sequence: Synthetic oligonucleotide
gaagaaaaagctagtgatcaacagtggcaatggagc

SEQ ID NO: 197838 - DNA, 37 bp, Artificial Sequence
  Description of Artificial Sequence: Synthetic oligonucleotide
aagaaaaagctagtgatcaacagtggcaatggagctg

SEQ ID NO: 197839 - DNA, 36 bp, Artificial Sequence
  Description of Artificial Sequence: Synthetic oligonucleotide
agaaaaagctagtgatcaacagtggcaatggagctg

SEQ ID NO: 197840 - DNA, 35 bp, Artificial Sequence
  Description of Artificial Sequence: Synthetic oligonucleotide
gaaaaagctagtgatcaacagtggcaatggagctg

SEQ ID NO: 197841 - DNA, 36 bp, Artificial Sequence
  Description of Artificial Sequence: Synthetic oligonucleotide
aaaaagctagtgatcaacagtggcaatggagctgtg

SEQ ID NO: 197842 - DNA, 35 bp, Artificial Sequence
  Description of Artificial Sequence: Synthetic oligonucleotide
aaaagctagtgatcaacagtggcaatggagctgtg

SEQ ID NO: 197843 - DNA, 34 bp, Artificial Sequence
  Description of Artificial Sequence: Synthetic oligonucleotide
aaagctagtgatcaacagtggcaatggagctgtg

SEQ ID NO: 197844 - DNA, 33 bp, Artificial Sequence
  Description of Artificial Sequence: Synthetic oligonucleotide
aagctagtgatcaacagtggcaatggagctgtg

SEQ ID NO: 197845 - DNA, 32 bp, Artificial Sequence
  Description of Artificial Sequence: Synthetic oligonucleotide
agctagtgatcaacagtggcaatggagctgtg

SEQ ID NO: 197846 - DNA, 31 bp, Artificial Sequence
  Description of Artificial Sequence: Synthetic oligonucleotide
gctagtgatcaacagtggcaatggagctgtg

SEQ ID NO: 197847 - DNA, 31 bp, Artificial Sequence
  Description of Artificial Sequence: Synthetic oligonucleotide
ctagtgatcaacagtggcaatggagctgtgg

SEQ ID NO: 197848 - DNA, 32 bp, Artificial Sequence
  Description of Artificial Sequence: Synthetic oligonucleotide
tagtgatcaacagtggcaatggagctgtggag

SEQ ID NO: 197849 - DNA, 31 bp, Artificial Sequence
  Description of Artificial Sequence: Synthetic oligonucleotide
agtgatcaacagtggcaatggagctgtggag

SEQ ID NO: 197850 - DNA, 30 bp, Artificial Sequence
  Description of Artificial Sequence: Synthetic oligonucleotide
gtgatcaacagtggcaatggagctgtggag

SEQ ID NO: 197851 - DNA, 30 bp, Artificial Sequence
  Description of Artificial Sequence: Synthetic oligonucleotide
tgatcaacagtggcaatggagctgtggagg

SEQ ID NO: 197852 - DNA, 29 bp, Artificial Sequence
  Description of Artificial Sequence: Synthetic oligonucleotide
gatcaacagtggcaatggagctgtggagg

SEQ ID NO: 197853 - DNA, 30 bp, Artificial Sequence
  Description of Artificial Sequence: Synthetic oligonucleotide
atcaacagtggcaatggagctgtggaggac

SEQ ID NO: 197854 - DNA, 29 bp, Artificial Sequence
  Description of Artificial Sequence: Synthetic oligonucleotide
tcaacagtggcaatggagctgtggaggac

SEQ ID NO: 197855 - DNA, 28 bp, Artificial Sequence
  Description of Artificial Sequence: Synthetic oligonucleotide
caacagtggcaatggagctgtggaggac

SEQ ID NO: 197856 - DNA, 29 bp, Artificial Sequence
  Description of Artificial Sequence: Synthetic oligonucleotide
aacagtggcaatggagctgtggaggacag

SEQ ID NO: 197857 - DNA, 28 bp, Artificial Sequence
  Description of Artificial Sequence: Synthetic oligonucleotide
acagtggcaatggagctgtggaggacag

SEQ ID NO: 197858 - DNA, 27 bp, Artificial Sequence
  Description of Artificial Sequence: Synthetic oligonucleotide
cagtggcaatggagctgtggaggacag

SEQ ID NO: 197859 - DNA, 30 bp, Artificial Sequence
  Description of Artificial Sequence: Synthetic oligonucleotide
agtggcaatggagctgtggaggacagaaag

SEQ ID NO: 197860 - DNA, 29 bp, Artificial Sequence
  Description of Artificial Sequence: Synthetic oligonucleotide
gtggcaatggagctgtggaggacagaaag

SEQ ID NO: 197861 - DNA, 29 bp, Artificial Sequence
  Description of Artificial Sequence: Synthetic oligonucleotide
tggcaatggagctgtggaggacagaaagc

SEQ ID NO: 197862 - DNA, 28 bp, Artificial Sequence
  Description of Artificial Sequence: Synthetic oligonucleotide
ggcaatggagctgtggaggacagaaagc

SEQ ID NO: 197863 - DNA, 28 bp, Artificial Sequence
  Description of Artificial Sequence: Synthetic oligonucleotide
gcaatggagctgtggaggacagaaagcc

SEQ ID NO: 197864 - DNA, 30 bp, Artificial Sequence
  Description of Artificial Sequence: Synthetic oligonucleotide
caatggagctgtggaggacagaaagccaag

SEQ ID NO: 197865 - DNA, 31 bp, Artificial Sequence
  Description of Artificial Sequence: Synthetic oligonucleotide
aatggagctgtggaggacagaaagccaagtg

SEQ ID NO: 197866 - DNA, 30 bp, Artificial Sequence
  Description of Artificial Sequence: Synthetic oligonucleotide
atggagctgtggaggacagaaagccaagtg

SEQ ID NO: 197867 - DNA, 29 bp, Artificial Sequence
  Description of Artificial Sequence: Synthetic oligonucleotide
tggagctgtggaggacagaaagccaagtg

SEQ ID NO: 197868 - DNA, 28 bp, Artificial Sequence
  Description of Artificial Sequence: Synthetic oligonucleotide
ggagctgtggaggacagaaagccaagtg

SEQ ID NO: 197869 - DNA, 28 bp, Artificial Sequence
  Description of Artificial Sequence: Synthetic oligonucleotide
gagctgtggaggacagaaagccaagtgg

SEQ ID NO: 197870 - DNA, 29 bp, Artificial Sequence
  Description of Artificial Sequence: Synthetic oligonucleotide
agctgtggaggacagaaagccaagtggac

SEQ ID NO: 197871 - DNA, 28 bp, Artificial Sequence
  Description of Artificial Sequence: Synthetic oligonucleotide
gctgtggaggacagaaagccaagtggac

SEQ ID NO: 197872 - DNA, 29 bp, Artificial Sequence
  Description of Artificial Sequence: Synthetic oligonucleotide
ctgtggaggacagaaagccaagtggactc

SEQ ID NO: 197873 - DNA, 31 bp, Artificial Sequence
  Description of Artificial Sequence: Synthetic oligonucleotide
tgtggaggacagaaagccaagtggactcaac

SEQ ID NO: 197874 - DNA, 30 bp, Artificial Sequence
  Description of Artificial Sequence: Synthetic oligonucleotide
gtggaggacagaaagccaagtggactcaac

SEQ ID NO: 197875 - DNA, 30 bp, Artificial Sequence
  Description of Artificial Sequence: Synthetic oligonucleotide
tggaggacagaaagccaagtggactcaacg

SEQ ID NO: 197876 - DNA, 29 bp, Artificial Sequence
  Description of Artificial Sequence: Synthetic oligonucleotide
ggaggacagaaagccaagtggactcaacg

SEQ ID NO: 197877 - DNA, 29 bp, Artificial Sequence
  Description of Artificial Sequence: Synthetic oligonucleotide
gaggacagaaagccaagtggactcaacgg

SEQ ID NO: 197878 - DNA, 30 bp, Artificial Sequence
  Description of Artificial Sequence: Synthetic oligonucleotide
aggacagaaagccaagtggactcaacggag

SEQ ID NO: 197879 - DNA, 29 bp, Artificial Sequence
  Description of Artificial Sequence: Synthetic oligonucleotide
ggacagaaagccaagtggactcaacggag

SEQ ID NO: 197880 - DNA, 30 bp, Artificial Sequence
  Description of Artificial Sequence: Synthetic oligonucleotide
gacagaaagccaagtggactcaacggagag

SEQ ID NO: 197881 - DNA, 30 bp, Artificial Sequence
  Description of Artificial Sequence: Synthetic oligonucleotide
acagaaagccaagtggactcaacggagagg

SEQ ID NO: 197882 - DNA, 29 bp, Artificial Sequence
  Description of Artificial Sequence: Synthetic oligonucleotide
cagaaagccaagtggactcaacggagagg

SEQ ID NO: 197883 - DNA, 29 bp, Artificial Sequence
  Description of Artificial Sequence: Synthetic oligonucleotide
agaaagccaagtggactcaacggagaggc

SEQ ID NO: 197884 - DNA, 28 bp, Artificial Sequence
  Description of Artificial Sequence: Synthetic oligonucleotide
gaaagccaagtggactcaacggagaggc

SEQ ID NO: 197885 - DNA, 28 bp, Artificial Sequence
  Description of Artificial Sequence: Synthetic oligonucleotide
aaagccaagtggactcaacggagaggcc

SEQ ID NO: 197886 - DNA, 27 bp, Artificial Sequence
  Description of Artificial Sequence: Synthetic oligonucleotide
aagccaagtggactcaacggagaggcc

SEQ ID NO: 197887 - DNA, 27 bp, Artificial Sequence
  Description of Artificial Sequence: Synthetic oligonucleotide
agccaagtggactcaacggagaggcca

SEQ ID NO: 197888 - DNA, 26 bp, Artificial Sequence
  Description of Artificial Sequence: Synthetic oligonucleotide
gccaagtggactcaacggagaggcca

SEQ ID NO: 197889 - DNA, 26 bp, Artificial Sequence
  Description of Artificial Sequence: Synthetic oligonucleotide
ccaagtggactcaacggagaggccag

SEQ ID NO: 197890 - DNA, 27 bp, Artificial Sequence
  Description of Artificial Sequence: Synthetic oligonucleotide
caagtggactcaacggagaggccagca

SEQ ID NO: 197891 - DNA, 28 bp, Artificial Sequence
  Description of Artificial Sequence: Synthetic oligonucleotide
aagtggactcaacggagaggccagcaag

SEQ ID NO: 197892 - DNA, 27 bp, Artificial Sequence
  Description of Artificial Sequence: Synthetic oligonucleotide
agtggactcaacggagaggccagcaag

SEQ ID NO: 197893 - DNA, 27 bp, Artificial Sequence
  Description of Artificial Sequence: Synthetic oligonucleotide
gtggactcaacggagaggccagcaagt

SEQ ID NO: 197894 - DNA, 27 bp, Artificial Sequence
  Description of Artificial Sequence: Synthetic oligonucleotide
tggactcaacggagaggccagcaagtc

SEQ ID NO: 197895 - DNA, 27 bp, Artificial Sequence
  Description of Artificial Sequence: Synthetic oligonucleotide
ggactcaacggagaggccagcaagtct

SEQ ID NO: 197896 - DNA, 27 bp, Artificial Sequence
  Description of Artificial Sequence: Synthetic oligonucleotide
gactcaacggagaggccagcaagtctc

SEQ ID NO: 197897 - DNA, 28 bp, Artificial Sequence
  Description of Artificial Sequence: Synthetic oligonucleotide
actcaacggagaggccagcaagtctcag

SEQ ID NO: 197898 - DNA, 27 bp, Artificial Sequence
  Description of Artificial Sequence: Synthetic oligonucleotide
ctcaacggagaggccagcaagtctcag

SEQ ID NO: 197899 - DNA, 27 bp, Artificial Sequence
  Description of Artificial Sequence: Synthetic oligonucleotide
tcaacggagaggccagcaagtctcagg

SEQ ID NO: 197900 - DNA, 27 bp, Artificial Sequence
  Description of Artificial Sequence: Synthetic oligonucleotide
caacggagaggccagcaagtctcagga

SEQ ID NO: 197901 - DNA, 30 bp, Artificial Sequence
  Description of Artificial Sequence: Synthetic oligonucleotide
aacggagaggccagcaagtctcaggaaatg

SEQ ID NO: 197902 - DNA, 29 bp, Artificial Sequence
  Description of Artificial Sequence: Synthetic oligonucleotide
acggagaggccagcaagtctcaggaaatg

SEQ ID NO: 197903 - DNA, 28 bp, Artificial Sequence
  Description of Artificial Sequence: Synthetic oligonucleotide
cggagaggccagcaagtctcaggaaatg

SEQ ID NO: 197904 - DNA, 28 bp, Artificial Sequence
  Description of Artificial Sequence: Synthetic oligonucleotide
ggagaggccagcaagtctcaggaaatgg

SEQ ID NO: 197905 - DNA, 29 bp, Artificial Sequence
  Description of Artificial Sequence: Synthetic oligonucleotide
gagaggccagcaagtctcaggaaatggtg

SEQ ID NO: 197906 - DNA, 29 bp, Artificial Sequence
  Description of Artificial Sequence: Synthetic oligonucleotide
agaggccagcaagtctcaggaaatggtgc

SEQ ID NO: 197907 - DNA, 28 bp, Artificial Sequence
  Description of Artificial Sequence: Synthetic oligonucleotide
gaggccagcaagtctcaggaaatggtgc

SEQ ID NO: 197908 - DNA, 32 bp, Artificial Sequence
  Description of Artificial Sequence: Synthetic oligonucleotide
aggccagcaagtctcaggaaatggtgcatttg

SEQ ID NO: 197909 - DNA, 31 bp, Artificial Sequence
  Description of Artificial Sequence: Synthetic oligonucleotide
ggccagcaagtctcaggaaatggtgcatttg

SEQ ID NO: 197910 - DNA, 31 bp, Artificial Sequence
  Description of Artificial Sequence: Synthetic oligonucleotide
gccagcaagtctcaggaaatggtgcatttgg

SEQ ID NO: 197911 - DNA, 32 bp, Artificial Sequence
  Description of Artificial Sequence: Synthetic oligonucleotide
ccagcaagtctcaggaaatggtgcatttggtg

SEQ ID NO: 197912 - DNA, 34 bp, Artificial Sequence
  Description of Artificial Sequence: Synthetic oligonucleotide
cagcaagtctcaggaaatggtgcatttggtgaac

SEQ ID NO: 197913 - DNA, 36 bp, Artificial Sequence
  Description of Artificial Sequence: Synthetic oligonucleotide
agcaagtctcaggaaatggtgcatttggtgaacaag

SEQ ID NO: 197914 - DNA, 35 bp, Artificial Sequence
  Description of Artificial Sequence: Synthetic oligonucleotide
gcaagtctcaggaaatggtgcatttggtgaacaag

SEQ ID NO: 197915 - DNA, 35 bp, Artificial Sequence
  Description of Artificial Sequence: Synthetic oligonucleotide
caagtctcaggaaatggtgcatttggtgaacaagg

SEQ ID NO: 197916 - DNA, 36 bp, Artificial Sequence
  Description of Artificial Sequence: Synthetic oligonucleotide
aagtctcaggaaatggtgcatttggtgaacaaggag

SEQ ID NO: 197917 - DNA, 35 bp, Artificial Sequence
  Description of Artificial Sequence: Synthetic oligonucleotide
agtctcaggaaatggtgcatttggtgaacaaggag

SEQ ID NO: 197918 - DNA, 34 bp, Artificial Sequence
  Description of Artificial Sequence: Synthetic oligonucleotide
gtctcaggaaatggtgcatttggtgaacaaggag

SEQ ID NO: 197919 - DNA, 35 bp, Artificial Sequence
  Description of Artificial Sequence: Synthetic oligonucleotide
tctcaggaaatggtgcatttggtgaacaaggagtc

SEQ ID NO: 197920 - DNA, 34 bp, Artificial Sequence
  Description of Artificial Sequence: Synthetic oligonucleotide
ctcaggaaatggtgcatttggtgaacaaggagtc

SEQ ID NO: 197921 - DNA, 34 bp, Artificial Sequence
  Description of Artificial Sequence: Synthetic oligonucleotide
tcaggaaatggtgcatttggtgaacaaggagtcg

SEQ ID NO: 197922 - DNA, 33 bp, Artificial Sequence
  Description of Artificial Sequence: Synthetic oligonucleotide
caggaaatggtgcatttggtgaacaaggagtcg

SEQ ID NO: 197923 - DNA, 34 bp, Artificial Sequence
  Description of Artificial Sequence: Synthetic oligonucleotide
aggaaatggtgcatttggtgaacaaggagtcgtc

SEQ ID NO: 197924 - DNA, 33 bp, Artificial Sequence
  Description of Artificial Sequence: Synthetic oligonucleotide
ggaaatggtgcatttggtgaacaaggagtcgtc

SEQ ID NO: 197925 - DNA, 34 bp, Artificial Sequence
  Description of Artificial Sequence: Synthetic oligonucleotide
gaaatggtgcatttggtgaacaaggagtcgtcag

SEQ ID NO: 197926 - DNA, 37 bp, Artificial Sequence
  Description of Artificial Sequence: Synthetic oligonucleotide
aaatggtgcatttggtgaacaaggagtcgtcagaaac

SEQ ID NO: 197927 - DNA, 36 bp, Artificial Sequence
  Description of Artificial Sequence: Synthetic oligonucleotide
aatggtgcatttggtgaacaaggagtcgtcagaaac

SEQ ID NO: 197928 - DNA, 35 bp, Artificial Sequence
  Description of Artificial Sequence: Synthetic oligonucleotide
atggtgcatttggtgaacaaggagtcgtcagaaac

SEQ ID NO: 197929 - DNA, 34 bp, Artificial Sequence
  Description of Artificial Sequence: Synthetic oligonucleotide
tggtgcatttggtgaacaaggagtcgtcagaaac

SEQ ID NO: 197930 - DNA, 33 bp, Artificial Sequence
  Description of Artificial Sequence: Synthetic oligonucleotide
ggtgcatttggtgaacaaggagtcgtcagaaac

SEQ ID NO: 197931 - DNA, 34 bp, Artificial Sequence
  Description of Artificial Sequence: Synthetic oligonucleotide
gtgcatttggtgaacaaggagtcgtcagaaactc

SEQ ID NO: 197932 - DNA, 34 bp, Artificial Sequence
  Description of Artificial Sequence: Synthetic oligonucleotide
tgcatttggtgaacaaggagtcgtcagaaactcc

SEQ ID NO: 197933 - DNA, 33 bp, Artificial Sequence
  Description of Artificial Sequence: Synthetic oligonucleotide
gcatttggtgaacaaggagtcgtcagaaactcc

SEQ ID NO: 197934 - DNA, 34 bp, Artificial Sequence
  Description of Artificial Sequence: Synthetic oligonucleotide
catttggtgaacaaggagtcgtcagaaactccag

SEQ ID NO: 197935 - DNA, 35 bp, Artificial Sequence
  Description of Artificial Sequence: Synthetic oligonucleotide
atttggtgaacaaggagtcgtcagaaactccagac

SEQ ID NO: 197936 - DNA, 34 bp, Artificial Sequence
  Description of Artificial Sequence: Synthetic oligonucleotide
tttggtgaacaaggagtcgtcagaaactccagac

SEQ ID NO: 197937 - DNA, 33 bp, Artificial Sequence
  Description of Artificial Sequence: Synthetic oligonucleotide
ttggtgaacaaggagtcgtcagaaactccagac

SEQ ID NO: 197938 - DNA, 32 bp, Artificial Sequence
  Description of Artificial Sequence: Synthetic oligonucleotide
tggtgaacaaggagtcgtcagaaactccagac

SEQ ID NO: 197939 - DNA, 31 bp, Artificial Sequence
  Description of Artificial Sequence: Synthetic oligonucleotide
ggtgaacaaggagtcgtcagaaactccagac

SEQ ID NO: 197940 - DNA, 31 bp, Artificial Sequence
  Description of Artificial Sequence: Synthetic oligonucleotide
gtgaacaaggagtcgtcagaaactccagacc

SEQ ID NO: 197941 - DNA, 32 bp, Artificial Sequence
  Description of Artificial Sequence: Synthetic oligonucleotide
tgaacaaggagtcgtcagaaactccagaccag

SEQ ID NO: 197942 - DNA, 31 bp, Artificial Sequence
  Description of Artificial Sequence: Synthetic oligonucleotide
gaacaaggagtcgtcagaaactccagaccag

SEQ ID NO: 197943 - DNA, 36 bp, Artificial Sequence
  Description of Artificial Sequence: Synthetic oligonucleotide
aacaaggagtcgtcagaaactccagaccagtttatg

SEQ ID NO: 197944 - DNA, 35 bp, Artificial Sequence
  Description of Artificial Sequence: Synthetic oligonucleotide
acaaggagtcgtcagaaactccagaccagtttatg

SEQ ID NO: 197945 - DNA, 34 bp, Artificial Sequence
  Description of Artificial Sequence: Synthetic oligonucleotide
caaggagtcgtcagaaactccagaccagtttatg

SEQ ID NO: 197946 - DNA, 35 bp, Artificial Sequence
  Description of Artificial Sequence: Synthetic oligonucleotide
aaggagtcgtcagaaactccagaccagtttatgac

SEQ ID NO: 197947 - DNA, 34 bp, Artificial Sequence
  Description of Artificial Sequence: Synthetic oligonucleotide
aggagtcgtcagaaactccagaccagtttatgac

SEQ ID NO: 197948 - DNA, 33 bp, Artificial Sequence
  Description of Artificial Sequence: Synthetic oligonucleotide
ggagtcgtcagaaactccagaccagtttatgac

SEQ ID NO: 197949 - DNA, 34 bp, Artificial Sequence
  Description of Artificial Sequence: Synthetic oligonucleotide
gagtcgtcagaaactccagaccagtttatgacag

SEQ ID NO: 197950 - DNA, 34 bp, Artificial Sequence
  Description of Artificial Sequence: Synthetic oligonucleotide
agtcgtcagaaactccagaccagtttatgacagc

SEQ ID NO: 197951 - DNA, 33 bp, Artificial Sequence
  Description of Artificial Sequence: Synthetic oligonucleotide
gtcgtcagaaactccagaccagtttatgacagc

SEQ ID NO: 197952 - DNA, 34 bp, Artificial Sequence
  Description of Artificial Sequence: Synthetic oligonucleotide
tcgtcagaaactccagaccagtttatgacagctg

SEQ ID NO: 197953 - DNA, 33 bp, Artificial Sequence
  Description of Artificial Sequence: Synthetic oligonucleotide
cgtcagaaactccagaccagtttatgacagctg

SEQ ID NO: 197954 - DNA, 35 bp, Artificial Sequence
  Description of Artificial Sequence: Synthetic oligonucleotide
gtcagaaactccagaccagtttatgacagctgatg

SEQ ID NO: 197955 - DNA, 36 bp, Artificial Sequence
  Description of Artificial Sequence: Synthetic oligonucleotide
tcagaaactccagaccagtttatgacagctgatgag

SEQ ID NO: 197956 - DNA, 35 bp, Artificial Sequence
  Description of Artificial Sequence: Synthetic oligonucleotide
cagaaactccagaccagtttatgacagctgatgag

SEQ ID NO: 197957 - DNA, 36 bp, Artificial Sequence
  Description of Artificial Sequence: Synthetic oligonucleotide
agaaactccagaccagtttatgacagctgatgagac

SEQ ID NO: 197958 - DNA, 35 bp, Artificial Sequence
  Description of Artificial Sequence: Synthetic oligonucleotide
gaaactccagaccagtttatgacagctgatgagac

SEQ ID NO: 197959 - DNA, 37 bp, Artificial Sequence
  Description of Artificial Sequence: Synthetic oligonucleotide
aaactccagaccagtttatgacagctgatgagacaag

SEQ ID NO: 197960 - DNA, 36 bp, Artificial Sequence
  Description of Artificial Sequence: Synthetic oligonucleotide
aactccagaccagtttatgacagctgatgagacaag

SEQ ID NO: 197961 - DNA, 35 bp, Artificial Sequence
  Description of Artificial Sequence: Synthetic oligonucleotide
actccagaccagtttatgacagctgatgagacaag

SEQ ID NO: 197962 - DNA, 34 bp, Artificial Sequence
  Description of Artificial Sequence: Synthetic oligonucleotide
ctccagaccagtttatgacagctgatgagacaag

SEQ ID NO: 197963 - DNA, 34 bp, Artificial Sequence
  Description of Artificial Sequence: Synthetic oligonucleotide
tccagaccagtttatgacagctgatgagacaagg

SEQ ID NO: 197964 - DNA, 33 bp, Artificial Sequence
  Description of Artificial Sequence: Synthetic oligonucleotide
ccagaccagtttatgacagctgatgagacaagg

SEQ ID NO: 197965 - DNA, 35 bp, Artificial Sequence
  Description of Artificial Sequence: Synthetic oligonucleotide
cagaccagtttatgacagctgatgagacaaggaac

SEQ ID NO: 197966 - DNA, 35 bp, Artificial Sequence
  Description of Artificial Sequence: Synthetic oligonucleotide
agaccagtttatgacagctgatgagacaaggaacc

SEQ ID NO: 197967 - DNA, 34 bp, Artificial Sequence
  Description of Artificial Sequence: Synthetic oligonucleotide
gaccagtttatgacagctgatgagacaaggaacc

SEQ ID NO: 197968 - DNA, 35 bp, Artificial Sequence
  Description of Artificial Sequence: Synthetic oligonucleotide
accagtttatgacagctgatgagacaaggaacctg

SEQ ID NO: 197969 - DNA, 34 bp, Artificial Sequence
  Description of Artificial Sequence: Synthetic oligonucleotide
ccagtttatgacagctgatgagacaaggaacctg

SEQ ID NO: 197970 - DNA, 34 bp, Artificial Sequence
  Description of Artificial Sequence: Synthetic oligonucleotide
cagtttatgacagctgatgagacaaggaacctgc

SEQ ID NO: 197971 - DNA, 35 bp, Artificial Sequence
  Description of Artificial Sequence: Synthetic oligonucleotide
agtttatgacagctgatgagacaaggaacctgcag

SEQ ID NO: 197972 - DNA, 34 bp, Artificial Sequence
  Description of Artificial Sequence: Synthetic oligonucleotide
gtttatgacagctgatgagacaaggaacctgcag

SEQ ID NO: 197973 - DNA, 37 bp, Artificial Sequence
  Description of Artificial Sequence: Synthetic oligonucleotide
tttatgacagctgatgagacaaggaacctgcagaatg

SEQ ID NO: 197974 - DNA, 36 bp, Artificial Sequence
  Description of Artificial Sequence: Synthetic oligonucleotide
ttatgacagctgatgagacaaggaacctgcagaatg

SEQ ID NO: 197975 - DNA, 35 bp, Artificial Sequence
  Description of Artificial Sequence: Synthetic oligonucleotide
tatgacagctgatgagacaaggaacctgcagaatg

SEQ ID NO: 197976 - DNA, 34 bp, Artificial Sequence
  Description of Artificial Sequence: Synthetic oligonucleotide
atgacagctgatgagacaaggaacctgcagaatg

SEQ ID NO: 197977 - DNA, 33 bp, Artificial Sequence
  Description of Artificial Sequence: Synthetic oligonucleotide
tgacagctgatgagacaaggaacctgcagaatg

SEQ ID NO: 197978 - DNA, 32 bp, Artificial Sequence
  Description of Artificial Sequence: Synthetic oligonucleotide
gacagctgatgagacaaggaacctgcagaatg

SEQ ID NO: 197979 - DNA, 33 bp, Artificial Sequence
  Description of Artificial Sequence: Synthetic oligonucleotide
acagctgatgagacaaggaacctgcagaatgtg

SEQ ID NO: 197980 - DNA, 32 bp, Artificial Sequence
  Description of Artificial Sequence: Synthetic oligonucleotide
cagctgatgagacaaggaacctgcagaatgtg

SEQ ID NO: 197981 - DNA, 32 bp, Artificial Sequence
  Description of Artificial Sequence: Synthetic oligonucleotide
agctgatgagacaaggaacctgcagaatgtgg

SEQ ID NO: 197982 - DNA, 31 bp, Artificial Sequence
  Description of Artificial Sequence: Synthetic oligonucleotide
gctgatgagacaaggaacctgcagaatgtgg

SEQ ID NO: 197983 - DNA, 32 bp, Artificial Sequence
  Description of Artificial Sequence: Synthetic oligonucleotide
ctgatgagacaaggaacctgcagaatgtggac

SEQ ID NO: 197984 - DNA, 34 bp, Artificial Sequence
  Description of Artificial Sequence: Synthetic oligonucleotide
tgatgagacaaggaacctgcagaatgtggacatg

SEQ ID NO: 197985 - DNA, 33 bp, Artificial Sequence
  Description of Artificial Sequence: Synthetic oligonucleotide
gatgagacaaggaacctgcagaatgtggacatg

SEQ ID NO: 197986 - DNA, 35 bp, Artificial Sequence
  Description of Artificial Sequence: Synthetic oligonucleotide
atgagacaaggaacctgcagaatgtggacatgaag

SEQ ID NO: 197987 - DNA, 34 bp, Artificial Sequence
  Description of Artificial Sequence: Synthetic oligonucleotide
tgagacaaggaacctgcagaatgtggacatgaag

SEQ ID NO: 197988 - DNA, 33 bp, Artificial Sequence
  Description of Artificial Sequence: Synthetic oligonucleotide
gagacaaggaacctgcagaatgtggacatgaag

SEQ ID NO: 197989 - DNA, 36 bp, Artificial Sequence
  Description of Artificial Sequence: Synthetic oligonucleotide
agacaaggaacctgcagaatgtggacatgaagattg

SEQ ID NO: 197990 - DNA, 35 bp, Artificial Sequence
  Description of Artificial Sequence: Synthetic oligonucleotide
gacaaggaacctgcagaatgtggacatgaagattg

SEQ ID NO: 197991 - DNA, 35 bp, Artificial Sequence
  Description of Artificial Sequence: Synthetic oligonucleotide
acaaggaacctgcagaatgtggacatgaagattgg

SEQ ID NO: 197992 - DNA, 34 bp, Artificial Sequence
  Description of Artificial Sequence: Synthetic oligonucleotide
caaggaacctgcagaatgtggacatgaagattgg

SEQ ID NO: 197993 - DNA, 34 bp, Artificial Sequence
  Description of Artificial Sequence: Synthetic oligonucleotide
aaggaacctgcagaatgtggacatgaagattggg

SEQ ID NO: 197994 - DNA, 33 bp, Artificial Sequence
  Description of Artificial Sequence: Synthetic oligonucleotide
aggaacctgcagaatgtggacatgaagattggg

SEQ ID NO: 197995 - DNA, 32 bp, Artificial Sequence
  Description of Artificial Sequence: Synthetic oligonucleotide
ggaacctgcagaatgtggacatgaagattggg

SEQ ID NO: 197996 - DNA, 32 bp, Artificial Sequence
  Description of Artificial Sequence: Synthetic oligonucleotide
gaacctgcagaatgtggacatgaagattgggg

SEQ ID NO: 197997 - DNA, 33 bp, Artificial Sequence
  Description of Artificial Sequence: Synthetic oligonucleotide
aacctgcagaatgtggacatgaagattggggtg

SEQ ID NO: 197998 - DNA, 32 bp, Artificial Sequence
  Description of Artificial Sequence: Synthetic oligonucleotide
acctgcagaatgtggacatgaagattggggtg

SEQ ID NO: 197999 - DNA, 31 bp, Artificial Sequence
  Description of Artificial Sequence: Synthetic oligonucleotide
cctgcagaatgtggacatgaagattggggtg

SEQ ID NO: 198000 - DNA, 33 bp, Artificial Sequence
  Description of Artificial Sequence: Synthetic oligonucleotide
tatggactccagtcatagtacaacgcttcagcc

SEQ ID NO: 198001 - DNA, 32 bp, Artificial Sequence
  Description of Artificial Sequence: Synthetic oligonucleotide
atggactccagtcatagtacaacgcttcagcc

SEQ ID NO: 198002 - DNA, 31 bp, Artificial Sequence
  Description of Artificial Sequence: Synthetic oligonucleotide
tggactccagtcatagtacaacgcttcagcc

SEQ ID NO: 198003 - DNA, 30 bp, Artificial Sequence
  Description of Artificial Sequence: Synthetic oligonucleotide
ggactccagtcatagtacaacgcttcagcc

SEQ ID NO: 198004 - DNA, 32 bp, Artificial Sequence
  Description of Artificial Sequence: Synthetic oligonucleotide
gactccagtcatagtacaacgcttcagcctac

SEQ ID NO: 198005 - DNA, 33 bp, Artificial Sequence
  Description of Artificial Sequence: Synthetic oligonucleotide
actccagtcatagtacaacgcttcagcctactg

SEQ ID NO: 198006 - DNA, 32 bp, Artificial Sequence
  Description of Artificial Sequence: Synthetic oligonucleotide
ctccagtcatagtacaacgcttcagcctactg

SEQ ID NO: 198007 - DNA, 32 bp, Artificial Sequence
  Description of Artificial Sequence: Synthetic oligonucleotide
tccagtcatagtacaacgcttcagcctactgc

SEQ ID NO: 198008 - DNA, 31 bp, Artificial Sequence
  Description of Artificial Sequence: Synthetic oligonucleotide
ccagtcatagtacaacgcttcagcctactgc

SEQ ID NO: 198009 - DNA, 35 bp, Artificial Sequence
  Description of Artificial Sequence: Synthetic oligonucleotide
cagtcatagtacaacgcttcagcctactgcaaatc

SEQ ID NO: 198010 - DNA, 35 bp, Artificial Sequence
  Description of Artificial Sequence: Synthetic oligonucleotide
agtcatagtacaacgcttcagcctactgcaaatcc

SEQ ID NO: 198011 - DNA, 34 bp, Artificial Sequence
  Description of Artificial Sequence: Synthetic oligonucleotide
gtcatagtacaacgcttcagcctactgcaaatcc

SEQ ID NO: 198012 - DNA, 37 bp, Artificial Sequence
  Description of Artificial Sequence: Synthetic oligonucleotide
tcatagtacaacgcttcagcctactgcaaatccaaac

SEQ ID NO: 198013 - DNA, 36 bp, Artificial Sequence
  Description of Artificial Sequence: Synthetic oligonucleotide
catagtacaacgcttcagcctactgcaaatccaaac

SEQ ID NO: 198014 - DNA, 37 bp, Artificial Sequence
  Description of Artificial Sequence: Synthetic oligonucleotide
atagtacaacgcttcagcctactgcaaatccaaacac

SEQ ID NO: 198015 - DNA, 36 bp, Artificial Sequence
  Description of Artificial Sequence: Synthetic oligonucleotide
tagtacaacgcttcagcctactgcaaatccaaacac

SEQ ID NO: 198016 - DNA, 35 bp, Artificial Sequence
  Description of Artificial Sequence: Synthetic oligonucleotide
agtacaacgcttcagcctactgcaaatccaaacac

SEQ ID NO: 198017 - DNA, 34 bp, Artificial Sequence
  Description of Artificial Sequence: Synthetic oligonucleotide
gtacaacgcttcagcctactgcaaatccaaacac

SEQ ID NO: 198018 - DNA, 35 bp, Artificial Sequence
  Description of Artificial Sequence: Synthetic oligonucleotide
tacaacgcttcagcctactgcaaatccaaacacag

SEQ ID NO: 198019 - DNA, 34 bp, Artificial Sequence
  Description of Artificial Sequence: Synthetic oligonucleotide
acaacgcttcagcctactgcaaatccaaacacag

SEQ ID NO: 198020 - DNA, 33 bp, Artificial Sequence
  Description of Artificial Sequence: Synthetic oligonucleotide
caacgcttcagcctactgcaaatccaaacacag

SEQ ID NO: 198021 - DNA, 31 bp, Artificial Sequence
  Description of Artificial Sequence: Synthetic oligonucleotide
acctgcaggtatgggttcatagaagggcatg

SEQ ID NO: 198022 - DNA, 30 bp, Artificial Sequence
  Description of Artificial Sequence: Synthetic oligonucleotide
cctgcaggtatgggttcatagaagggcatg

SEQ ID NO: 198023 - DNA, 31 bp, Artificial Sequence
  Description of Artificial Sequence: Synthetic oligonucleotide
ctgcaggtatgggttcatagaagggcatgtg

SEQ ID NO: 198024 - DNA, 31 bp, Artificial Sequence
  Description of Artificial Sequence: Synthetic oligonucleotide
tgcaggtatgggttcatagaagggcatgtgg

SEQ ID NO: 198025 - DNA, 30 bp, Artificial Sequence
  Description of Artificial Sequence: Synthetic oligonucleotide
gcaggtatgggttcatagaagggcatgtgg

SEQ ID NO: 198026 - DNA, 31 bp, Artificial Sequence
  Description of Artificial Sequence: Synthetic oligonucleotide
caggtatgggttcatagaagggcatgtggtg

SEQ ID NO: 198027 - DNA, 34 bp, Artificial Sequence
  Description of Artificial Sequence: Synthetic oligonucleotide
aggtatgggttcatagaagggcatgtggtgattc

SEQ ID NO: 198028 - DNA, 33 bp, Artificial Sequence
  Description of Artificial Sequence: Synthetic oligonucleotide
ggtatgggttcatagaagggcatgtggtgattc

SEQ ID NO: 198029 - DNA, 33 bp, Artificial Sequence
  Description of Artificial Sequence: Synthetic oligonucleotide
gtatgggttcatagaagggcatgtggtgattcc

SEQ ID NO: 198030 - DNA, 33 bp, Artificial Sequence
  Description of Artificial Sequence: Synthetic oligonucleotide
tatgggttcatagaagggcatgtggtgattccc

SEQ ID NO: 198031 - DNA, 32 bp, Artificial Sequence
  Description of Artificial Sequence: Synthetic oligonucleotide
atgggttcatagaagggcatgtggtgattccc

SEQ ID NO: 198032 - DNA, 31 bp, Artificial Sequence
  Description of Artificial Sequence: Synthetic oligonucleotide
tgggttcatagaagggcatgtggtgattccc

SEQ ID NO: 198033 - DNA, 30 bp, Artificial Sequence
  Description of Artificial Sequence: Synthetic oligonucleotide
gggttcatagaagggcatgtggtgattccc

SEQ ID NO: 198034 - DNA, 30 bp, Artificial Sequence
  Description of Artificial Sequence: Synthetic oligonucleotide
ggttcatagaagggcatgtggtgattcccc

SEQ ID NO: 198035 - DNA, 30 bp, Artificial Sequence
  Description of Artificial Sequence: Synthetic oligonucleotide
gttcatagaagggcatgtggtgattccccg

SEQ ID NO: 198036 - DNA, 30 bp, Artificial Sequence
  Description of Artificial Sequence: Synthetic oligonucleotide
ttcatagaagggcatgtggtgattccccgg

SEQ ID NO: 198037 - DNA, 29 bp, Artificial Sequence
  Description of Artificial Sequence: Synthetic oligonucleotide
tcatagaagggcatgtggtgattccccgg

SEQ ID NO: 198038 - DNA, 28 bp, Artificial Sequence
  Description of Artificial Sequence: Synthetic oligonucleotide
catagaagggcatgtggtgattccccgg

SEQ ID NO: 198039 - DNA, 30 bp, Artificial Sequence
  Description of Artificial Sequence: Synthetic oligonucleotide
atagaagggcatgtggtgattccccggatc

SEQ ID NO: 198040 - DNA, 29 bp, Artificial Sequence
  Description of Artificial Sequence: Synthetic oligonucleotide
tagaagggcatgtggtgattccccggatc

SEQ ID NO: 198041 - DNA, 28 bp, Artificial Sequence
  Description of Artificial Sequence: Synthetic oligonucleotide
agaagggcatgtggtgattccccggatc

SEQ ID NO: 198042 - DNA, 27 bp, Artificial Sequence
  Description of Artificial Sequence: Synthetic oligonucleotide
gaagggcatgtggtgattccccggatc

SEQ ID NO: 198043 - DNA, 27 bp, Artificial Sequence
  Description of Artificial Sequence: Synthetic oligonucleotide
aagggcatgtggtgattccccggatcc

SEQ ID NO: 198044 - DNA, 27 bp, Artificial Sequence
  Description of Artificial Sequence: Synthetic oligonucleotide
agggcatgtggtgattccccggatcca

SEQ ID NO: 198045 - DNA, 26 bp, Artificial Sequence
  Description of Artificial Sequence: Synthetic oligonucleotide
gggcatgtggtgattccccggatcca

SEQ ID NO: 198046 - DNA, 26 bp, Artificial Sequence
  Description of Artificial Sequence: Synthetic oligonucleotide
ggcatgtggtgattccccggatccac

SEQ ID NO: 198047 - DNA, 26 bp, Artificial Sequence
  Description of Artificial Sequence: Synthetic oligonucleotide
gcatgtggtgattccccggatccacc

SEQ ID NO: 198048 - DNA, 26 bp, Artificial Sequence
  Description of Artificial Sequence: Synthetic oligonucleotide
catgtggtgattccccggatccaccc

SEQ ID NO: 198049 - DNA, 27 bp, Artificial Sequence
  Description of Artificial Sequence: Synthetic oligonucleotide
atgtggtgattccccggatccacccca

SEQ ID NO: 198050 - DNA, 27 bp, Artificial Sequence
  Description of Artificial Sequence: Synthetic oligonucleotide
tgtggtgattccccggatccaccccaa

SEQ ID NO: 198051 - DNA, 34 bp, Artificial Sequence
  Description of Artificial Sequence: Synthetic oligonucleotide
agcaaacaacacaggggtgtacatcctcacatac

SEQ ID NO: 198052 - DNA, 33 bp, Artificial Sequence
  Description of Artificial Sequence: Synthetic oligonucleotide
gcaaacaacacaggggtgtacatcctcacatac

SEQ ID NO: 198053 - DNA, 35 bp, Artificial Sequence
  Description of Artificial Sequence: Synthetic oligonucleotide
caaacaacacaggggtgtacatcctcacatacaac

SEQ ID NO: 198054 - DNA, 36 bp, Artificial Sequence
  Description of Artificial Sequence: Synthetic oligonucleotide
aaacaacacaggggtgtacatcctcacatacaacac

SEQ ID NO: 198055 - DNA, 35 bp, Artificial Sequence
  Description of Artificial Sequence: Synthetic oligonucleotide
aacaacacaggggtgtacatcctcacatacaacac

SEQ ID NO: 198056 - DNA, 34 bp, Artificial Sequence
  Description of Artificial Sequence: Synthetic oligonucleotide
acaacacaggggtgtacatcctcacatacaacac

SEQ ID NO: 198057 - DNA, 33 bp, Artificial Sequence
  Description of Artificial Sequence: Synthetic oligonucleotide
caacacaggggtgtacatcctcacatacaacac

SEQ ID NO: 198058 - DNA, 33 bp, Artificial Sequence
  Description of Artificial Sequence: Synthetic oligonucleotide
aacacaggggtgtacatcctcacatacaacacc

SEQ ID NO: 198059 - DNA, 32 bp, Artificial Sequence
  Description of Artificial Sequence: Synthetic oligonucleotide
acacaggggtgtacatcctcacatacaacacc

SEQ ID NO: 198060 - DNA, 31 bp, Artificial Sequence
  Description of Artificial Sequence: Synthetic oligonucleotide
cacaggggtgtacatcctcacatacaacacc

SEQ ID NO: 198061 - DNA, 32 bp, Artificial Sequence
  Description of Artificial Sequence: Synthetic oligonucleotide
acaggggtgtacatcctcacatacaacacctc

SEQ ID NO: 198062 - DNA, 31 bp, Artificial Sequence
  Description of Artificial Sequence: Synthetic oligonucleotide
caggggtgtacatcctcacatacaacacctc

SEQ ID NO: 198063 - DNA, 31 bp, Artificial Sequence
  Description of Artificial Sequence: Synthetic oligonucleotide
aggggtgtacatcctcacatacaacacctcc

SEQ ID NO: 198064 - DNA, 30 bp, Artificial Sequence
  Description of Artificial Sequence: Synthetic oligonucleotide
ggggtgtacatcctcacatacaacacctcc

SEQ ID NO: 198065 - DNA, 30 bp, Artificial Sequence
  Description of Artificial Sequence: Synthetic oligonucleotide
gggtgtacatcctcacatacaacacctccc

SEQ ID NO: 198066 - DNA, 31 bp, Artificial Sequence
  Description of Artificial Sequence: Synthetic oligonucleotide
ggtgtacatcctcacatacaacacctcccag

SEQ ID NO: 198067 - DNA, 34 bp, Artificial Sequence
  Description of Artificial Sequence: Synthetic oligonucleotide
gtgtacatcctcacatacaacacctcccagtatg

SEQ ID NO: 198068 - DNA, 35 bp, Artificial Sequence
  Description of Artificial Sequence: Synthetic oligonucleotide
tgtacatcctcacatacaacacctcccagtatgac

SEQ ID NO: 198069 - DNA, 34 bp, Artificial Sequence
  Description of Artificial Sequence: Synthetic oligonucleotide
gtacatcctcacatacaacacctcccagtatgac

SEQ ID NO: 198070 - DNA, 35 bp, Artificial Sequence
  Description of Artificial Sequence: Synthetic oligonucleotide
tacatcctcacatacaacacctcccagtatgacac

SEQ ID NO: 198071 - DNA, 34 bp, Artificial Sequence
  Description of Artificial Sequence: Synthetic oligonucleotide
acatcctcacatacaacacctcccagtatgacac

SEQ ID NO: 198072 - DNA, 33 bp, Artificial Sequence
  Description of Artificial Sequence: Synthetic oligonucleotide
catcctcacatacaacacctcccagtatgacac

SEQ ID NO: 198073 - DNA, 38 bp, Artificial Sequence
  Description of Artificial Sequence: Synthetic oligonucleotide
atcctcacatacaacacctcccagtatgacacatattg

SEQ ID NO: 198074 - DNA, 37 bp, Artificial Sequence
  Description of Artificial Sequence: Synthetic oligonucleotide
tcctcacatacaacacctcccagtatgacacatattg

SEQ ID NO: 198075 - DNA, 36 bp, Artificial Sequence
  Description of Artificial Sequence: Synthetic oligonucleotide
cctcacatacaacacctcccagtatgacacatattg

SEQ ID NO: 198076 - DNA, 36 bp, Artificial Sequence
  Description of Artificial Sequence: Synthetic oligonucleotide
ctcacatacaacacctcccagtatgacacatattgc

SEQ ID NO: 198077 - DNA, 38 bp, Artificial Sequence
  Description of Artificial Sequence: Synthetic oligonucleotide
tcacatacaacacctcccagtatgacacatattgcttc

SEQ ID NO: 198078 - DNA, 37 bp, Artificial Sequence
  Description of Artificial Sequence: Synthetic oligonucleotide
cacatacaacacctcccagtatgacacatattgcttc

SEQ ID NO: 198079 - DNA, 40 bp, Artificial Sequence
  Description of Artificial Sequence: Synthetic oligonucleotide
acatacaacacctcccagtatgacacatattgcttcaatg

SEQ ID NO: 198080 - DNA, 39 bp, Artificial Sequence
  Description of Artificial Sequence: Synthetic oligonucleotide
catacaacacctcccagtatgacacatattgcttcaatg

SEQ ID NO: 198081 - DNA, 39 bp, Artificial Sequence
  Description of Artificial Sequence: Synthetic oligonucleotide
atacaacacctcccagtatgacacatattgcttcaatgc

SEQ ID NO: 198082 - DNA, 38 bp, Artificial Sequence
  Description of Artificial Sequence: Synthetic oligonucleotide
tacaacacctcccagtatgacacatattgcttcaatgc

SEQ ID NO: 198083 - DNA, 37 bp, Artificial Sequence
  Description of Artificial Sequence: Synthetic oligonucleotide
acaacacctcccagtatgacacatattgcttcaatgc

SEQ ID NO: 198084 - DNA, 32 bp, Artificial Sequence
  Description of Artificial Sequence: Synthetic oligonucleotide
agcaactgagacagcaaccaagaggcaagaag

SEQ ID NO: 198085 - DNA, 31 bp, Artificial Sequence
  Description of Artificial Sequence: Synthetic oligonucleotide
gcaactgagacagcaaccaagaggcaagaag

SEQ ID NO: 198086 - DNA, 31 bp, Artificial Sequence
  Description of Artificial Sequence: Synthetic oligonucleotide
caactgagacagcaaccaagaggcaagaagc

SEQ ID NO: 198087 - DNA, 31 bp, Artificial Sequence
  Description of Artificial Sequence: Synthetic oligonucleotide
aactgagacagcaaccaagaggcaagaagcc

SEQ ID NO: 198088 - DNA, 30 bp, Artificial Sequence
  Description of Artificial Sequence: Synthetic oligonucleotide
actgagacagcaaccaagaggcaagaagcc

SEQ ID NO: 198089 - DNA, 29 bp, Artificial Sequence
  Description of Artificial Sequence: Synthetic oligonucleotide
ctgagacagcaaccaagaggcaagaagcc

SEQ ID NO: 198090 - DNA, 30 bp, Artificial Sequence
  Description of Artificial Sequence: Synthetic oligonucleotide
tgagacagcaaccaagaggcaagaagcctg

SEQ ID NO: 198091 - DNA, 29 bp, Artificial Sequence
  Description of Artificial Sequence: Synthetic oligonucleotide
gagacagcaaccaagaggcaagaagcctg

SEQ ID NO: 198092 - DNA, 29 bp, Artificial Sequence
  Description of Artificial Sequence: Synthetic oligonucleotide
agacagcaaccaagaggcaagaagcctgg

SEQ ID NO: 198093 - DNA, 28 bp, Artificial Sequence
  Description of Artificial Sequence: Synthetic oligonucleotide
gacagcaaccaagaggcaagaagcctgg

SEQ ID NO: 198094 - DNA, 28 bp, Artificial Sequence
  Description of Artificial Sequence: Synthetic oligonucleotide
acagcaaccaagaggcaagaagcctggg

SEQ ID NO: 198095 - DNA, 27 bp, Artificial Sequence
  Description of Artificial Sequence: Synthetic oligonucleotide
cagcaaccaagaggcaagaagcctggg

SEQ ID NO: 198096 - DNA, 30 bp, Artificial Sequence
  Description of Artificial Sequence: Synthetic oligonucleotide
agcaaccaagaggcaagaagcctgggattg

SEQ ID NO: 198097 - DNA, 29 bp, Artificial Sequence
  Description of Artificial Sequence: Synthetic oligonucleotide
gcaaccaagaggcaagaagcctgggattg

SEQ ID NO: 198098 - DNA, 29 bp, Artificial Sequence
  Description of Artificial Sequence: Synthetic oligonucleotide
caaccaagaggcaagaagcctgggattgg

SEQ ID NO: 198099 - DNA, 33 bp, Artificial Sequence
  Description of Artificial Sequence: Synthetic oligonucleotide
aaccaagaggcaagaagcctgggattggttttc

SEQ ID NO: 198100 - DNA, 32 bp, Artificial Sequence
  Description of Artificial Sequence: Synthetic oligonucleotide
accaagaggcaagaagcctgggattggttttc

SEQ ID NO: 198101 - DNA, 31 bp, Artificial Sequence
  Description of Artificial Sequence: Synthetic oligonucleotide
ccaagaggcaagaagcctgggattggttttc

SEQ ID NO: 198102 - DNA, 33 bp, Artificial Sequence
  Description of Artificial Sequence: Synthetic oligonucleotide
caagaggcaagaagcctgggattggttttcatg

SEQ ID NO: 198103 - DNA, 33 bp, Artificial Sequence
  Description of Artificial Sequence: Synthetic oligonucleotide
aagaggcaagaagcctgggattggttttcatgg

SEQ ID NO: 198104 - DNA, 32 bp, Artificial Sequence
  Description of Artificial Sequence: Synthetic oligonucleotide
agaggcaagaagcctgggattggttttcatgg

SEQ ID NO: 198105 - DNA, 31 bp, Artificial Sequence
  Description of Artificial Sequence: Synthetic oligonucleotide
gaggcaagaagcctgggattggttttcatgg

SEQ ID NO: 198106 - DNA, 33 bp, Artificial Sequence
  Description of Artificial Sequence: Synthetic oligonucleotide
aggcaagaagcctgggattggttttcatggttg

SEQ ID NO: 198107 - DNA, 32 bp, Artificial Sequence
  Description of Artificial Sequence: Synthetic oligonucleotide
ggcaagaagcctgggattggttttcatggttg

SEQ ID NO: 198108 - DNA, 35 bp, Artificial Sequence
  Description of Artificial Sequence: Synthetic oligonucleotide
gcaagaagcctgggattggttttcatggttgtttc

SEQ ID NO: 198109 - DNA, 37 bp, Artificial Sequence
  Description of Artificial Sequence: Synthetic oligonucleotide
caagaagcctgggattggttttcatggttgtttctac

SEQ ID NO: 198110 - DNA, 37 bp, Artificial Sequence
  Description of Artificial Sequence: Synthetic oligonucleotide
aagaagcctgggattggttttcatggttgtttctacc

SEQ ID NO: 198111 - DNA, 36 bp, Artificial Sequence
  Description of Artificial Sequence: Synthetic oligonucleotide
agaagcctgggattggttttcatggttgtttctacc

SEQ ID NO: 198112 - DNA, 35 bp, Artificial Sequence
  Description of Artificial Sequence: Synthetic oligonucleotide
gaagcctgggattggttttcatggttgtttctacc

SEQ ID NO: 198113 - DNA, 37 bp, Artificial Sequence
  Description of Artificial Sequence: Synthetic oligonucleotide
aagcctgggattggttttcatggttgtttctaccatc

SEQ ID NO: 198114 - DNA, 36 bp, Artificial Sequence
  Description of Artificial Sequence: Synthetic oligonucleotide
agcctgggattggttttcatggttgtttctaccatc

SEQ ID NO: 198115 - DNA, 35 bp, Artificial Sequence
  Description of Artificial Sequence: Synthetic oligonucleotide
gcctgggattggttttcatggttgtttctaccatc

SEQ ID NO: 198116 - DNA, 27 bp, Artificial Sequence
  Description of Artificial Sequence: Synthetic oligonucleotide
agcaccatttcaaccacaccacgggcc

SEQ ID NO: 198117 - DNA, 27 bp, Artificial Sequence
  Description of Artificial Sequence: Synthetic oligonucleotide
gcaccatttcaaccacaccacgggcct

SEQ ID NO: 198118 - DNA, 29 bp, Artificial Sequence
  Description of Artificial Sequence: Synthetic oligonucleotide
caccatttcaaccacaccacgggcctttg

SEQ ID NO: 198119 - DNA, 30 bp, Artificial Sequence
  Description of Artificial Sequence: Synthetic oligonucleotide
accatttcaaccacaccacgggcctttgac

SEQ ID NO: 198120 - DNA, 29 bp, Artificial Sequence
  Description of Artificial Sequence: Synthetic oligonucleotide
ccatttcaaccacaccacgggcctttgac

SEQ ID NO: 198121 - DNA, 29 bp, Artificial Sequence
  Description of Artificial Sequence: Synthetic oligonucleotide
catttcaaccacaccacgggcctttgacc

SEQ ID NO: 198122 - DNA, 30 bp, Artificial Sequence
  Description of Artificial Sequence: Synthetic oligonucleotide
atttcaaccacaccacgggcctttgaccac

SEQ ID NO: 198123 - DNA, 29 bp, Artificial Sequence
  Description of Artificial Sequence: Synthetic oligonucleotide
tttcaaccacaccacgggcctttgaccac

SEQ ID NO: 198124 - DNA, 28 bp, Artificial Sequence
  Description of Artificial Sequence: Synthetic oligonucleotide
ttcaaccacaccacgggcctttgaccac

SEQ ID NO: 198125 - DNA, 27 bp, Artificial Sequence
  Description of Artificial Sequence: Synthetic oligonucleotide
tcaaccacaccacgggcctttgaccac

SEQ ID NO: 198126 - DNA, 27 bp, Artificial Sequence
  Description of Artificial Sequence: Synthetic oligonucleotide
caaccacaccacgggcctttgaccaca

SEQ ID NO: 198127 - DNA, 27 bp, Artificial Sequence
  Description of Artificial Sequence: Synthetic oligonucleotide
aaccacaccacgggcctttgaccacac

SEQ ID NO: 198128 - DNA, 27 bp, Artificial Sequence
  Description of Artificial Sequence: Synthetic oligonucleotide
accacaccacgggcctttgaccacaca

SEQ ID NO: 198129 - DNA, 27 bp, Artificial Sequence
  Description of Artificial Sequence: Synthetic oligonucleotide
ccacaccacgggcctttgaccacacaa

SEQ ID NO: 198130 - DNA, 29 bp, Artificial Sequence
  Description of Artificial Sequence: Synthetic oligonucleotide
cacaccacgggcctttgaccacacaaaac

SEQ ID NO: 198131 - DNA, 30 bp, Artificial Sequence
  Description of Artificial Sequence: Synthetic oligonucleotide
acaccacgggcctttgaccacacaaaacag

SEQ ID NO: 198132 - DNA, 29 bp, Artificial Sequence
  Description of Artificial Sequence: Synthetic oligonucleotide
caccacgggcctttgaccacacaaaacag

SEQ ID NO: 198133 - DNA, 31 bp, Artificial Sequence
  Description of Artificial Sequence: Synthetic oligonucleotide
accacgggcctttgaccacacaaaacagaac

SEQ ID NO: 198134 - DNA, 30 bp, Artificial Sequence
  Description of Artificial Sequence: Synthetic oligonucleotide
ccacgggcctttgaccacacaaaacagaac

SEQ ID NO: 198135 - DNA, 30 bp, Artificial Sequence
  Description of Artificial Sequence: Synthetic oligonucleotide
cacgggcctttgaccacacaaaacagaacc

SEQ ID NO: 198136 - DNA, 31 bp, Artificial Sequence
  Description of Artificial Sequence: Synthetic oligonucleotide
acgggcctttgaccacacaaaacagaaccag

SEQ ID NO: 198137 - DNA, 30 bp, Artificial Sequence
  Description of Artificial Sequence: Synthetic oligonucleotide
cgggcctttgaccacacaaaacagaaccag

SEQ ID NO: 198138 - DNA, 30 bp, Artificial Sequence
  Description of Artificial Sequence: Synthetic oligonucleotide
gggcctttgaccacacaaaacagaaccagg

SEQ ID NO: 198139 - DNA, 31 bp, Artificial Sequence
  Description of Artificial Sequence: Synthetic oligonucleotide
ggcctttgaccacacaaaacagaaccaggac

SEQ ID NO: 198140 - DNA, 32 bp, Artificial Sequence
  Description of Artificial Sequence: Synthetic oligonucleotide
gcctttgaccacacaaaacagaaccaggactg

SEQ ID NO: 198141 - DNA, 32 bp, Artificial Sequence
  Description of Artificial Sequence: Synthetic oligonucleotide
cctttgaccacacaaaacagaaccaggactgg

SEQ ID NO: 198142 - DNA, 33 bp, Artificial Sequence
  Description of Artificial Sequence: Synthetic oligonucleotide
ctttgaccacacaaaacagaaccaggactggac

SEQ ID NO: 198143 - DNA, 30 bp, Artificial Sequence
  Description of Artificial Sequence: Synthetic oligonucleotide
atggcatgagggatatcgccaaacacccag

SEQ ID NO: 198144 - DNA, 29 bp, Artificial Sequence
  Description of Artificial Sequence: Synthetic oligonucleotide
tggcatgagggatatcgccaaacacccag

SEQ ID NO: 198145 - DNA, 28 bp, Artificial Sequence
  Description of Artificial Sequence: Synthetic oligonucleotide
ggcatgagggatatcgccaaacacccag

SEQ ID NO: 198146 - DNA, 29 bp, Artificial Sequence
  Description of Artificial Sequence: Synthetic oligonucleotide
gcatgagggatatcgccaaacacccagag

SEQ ID NO: 198147 - DNA, 31 bp, Artificial Sequence
  Description of Artificial Sequence: Synthetic oligonucleotide
catgagggatatcgccaaacacccagagaag

SEQ ID NO: 198148 - DNA, 32 bp, Artificial Sequence
  Description of Artificial Sequence: Synthetic oligonucleotide
atgagggatatcgccaaacacccagagaagac

SEQ ID NO: 198149 - DNA, 31 bp, Artificial Sequence
  Description of Artificial Sequence: Synthetic oligonucleotide
tgagggatatcgccaaacacccagagaagac

SEQ ID NO: 198150 - DNA, 30 bp, Artificial Sequence
  Description of Artificial Sequence: Synthetic oligonucleotide
gagggatatcgccaaacacccagagaagac

SEQ ID NO: 198151 - DNA, 31 bp, Artificial Sequence
  Description of Artificial Sequence: Synthetic oligonucleotide
agggatatcgccaaacacccagagaagactc

SEQ ID NO: 198152 - DNA, 30 bp, Artificial Sequence
  Description of Artificial Sequence: Synthetic oligonucleotide
gggatatcgccaaacacccagagaagactc

SEQ ID NO: 198153 - DNA, 30 bp, Artificial Sequence
  Description of Artificial Sequence: Synthetic oligonucleotide
ggatatcgccaaacacccagagaagactcc

SEQ ID NO: 198154 - DNA, 30 bp, Artificial Sequence
  Description of Artificial Sequence: Synthetic oligonucleotide
gatatcgccaaacacccagagaagactccc

SEQ ID NO: 198155 - DNA, 33 bp, Artificial Sequence
  Description of Artificial Sequence: Synthetic oligonucleotide
atatcgccaaacacccagagaagactcccattc

SEQ ID NO: 198156 - DNA, 32 bp, Artificial Sequence
  Description of Artificial Sequence: Synthetic oligonucleotide
tatcgccaaacacccagagaagactcccattc

SEQ ID NO: 198157 - DNA, 31 bp, Artificial Sequence
  Description of Artificial Sequence: Synthetic oligonucleotide
atcgccaaacacccagagaagactcccattc

SEQ ID NO: 198158 - DNA, 30 bp, Artificial Sequence
  Description of Artificial Sequence: Synthetic oligonucleotide
tcgccaaacacccagagaagactcccattc

SEQ ID NO: 198159 - DNA, 29 bp, Artificial Sequence
  Description of Artificial Sequence: Synthetic oligonucleotide
cgccaaacacccagagaagactcccattc

SEQ ID NO: 198160 - DNA, 29 bp, Artificial Sequence
  Description of Artificial Sequence: Synthetic oligonucleotide
gccaaacacccagagaagactcccattcg

SEQ ID NO: 198161 - DNA, 30 bp, Artificial Sequence
  Description of Artificial Sequence: Synthetic oligonucleotide
ccaaacacccagagaagactcccattcgac

SEQ ID NO: 198162 - DNA, 32 bp, Artificial Sequence
  Description of Artificial Sequence: Synthetic oligonucleotide
caaacacccagagaagactcccattcgacaac

SEQ ID NO: 198163 - DNA, 33 bp, Artificial Sequence
  Description of Artificial Sequence: Synthetic oligonucleotide
aaacacccagagaagactcccattcgacaacag

SEQ ID NO: 198164 - DNA, 32 bp, Artificial Sequence
  Description of Artificial Sequence: Synthetic oligonucleotide
aacacccagagaagactcccattcgacaacag

SEQ ID NO: 198165 - DNA, 31 bp, Artificial Sequence
  Description of Artificial Sequence: Synthetic oligonucleotide
acacccagagaagactcccattcgacaacag

SEQ ID NO: 198166 - DNA, 30 bp, Artificial Sequence
  Description of Artificial Sequence: Synthetic oligonucleotide
cacccagagaagactcccattcgacaacag

SEQ ID NO: 198167 - DNA, 30 bp, Artificial Sequence
  Description of Artificial Sequence: Synthetic oligonucleotide
acccagagaagactcccattcgacaacagg

SEQ ID NO: 198168 - DNA, 29 bp, Artificial Sequence
  Description of Artificial Sequence: Synthetic oligonucleotide
cccagagaagactcccattcgacaacagg

SEQ ID NO: 198169 - DNA, 29 bp, Artificial Sequence
  Description of Artificial Sequence: Synthetic oligonucleotide
ccagagaagactcccattcgacaacaggg

SEQ ID NO: 198170 - DNA, 30 bp, Artificial Sequence
  Description of Artificial Sequence: Synthetic oligonucleotide
cagagaagactcccattcgacaacagggac

SEQ ID NO: 198171 - DNA, 31 bp, Artificial Sequence
  Description of Artificial Sequence: Synthetic oligonucleotide
agagaagactcccattcgacaacagggacag

SEQ ID NO: 198172 - DNA, 30 bp, Artificial Sequence
  Description of Artificial Sequence: Synthetic oligonucleotide
gagaagactcccattcgacaacagggacag

SEQ ID NO: 198173 - DNA, 36 bp, Artificial Sequence
  Description of Artificial Sequence: Synthetic oligonucleotide
aggaagaaggatggatatggactccagtcatagtac

SEQ ID NO: 198174 - DNA, 35 bp, Artificial Sequence
  Description of Artificial Sequence: Synthetic oligonucleotide
ggaagaaggatggatatggactccagtcatagtac

SEQ ID NO: 198175 - DNA, 37 bp, Artificial Sequence
  Description of Artificial Sequence: Synthetic oligonucleotide
gaagaaggatggatatggactccagtcatagtacaac

SEQ ID NO: 198176 - DNA, 37 bp, Artificial Sequence
  Description of Artificial Sequence: Synthetic oligonucleotide
aagaaggatggatatggactccagtcatagtacaacg

SEQ ID NO: 198177 - DNA, 36 bp, Artificial Sequence
  Description of Artificial Sequence: Synthetic oligonucleotide
agaaggatggatatggactccagtcatagtacaacg

SEQ ID NO: 198178 - DNA, 35 bp, Artificial Sequence
  Description of Artificial Sequence: Synthetic oligonucleotide
gaaggatggatatggactccagtcatagtacaacg

SEQ ID NO: 198179 - DNA, 35 bp, Artificial Sequence
  Description of Artificial Sequence: Synthetic oligonucleotide
aaggatggatatggactccagtcatagtacaacgc

SEQ ID NO: 198180 - DNA, 34 bp, Artificial Sequence
  Description of Artificial Sequence: Synthetic oligonucleotide
aggatggatatggactccagtcatagtacaacgc

SEQ ID NO: 198181 - DNA, 33 bp, Artificial Sequence
  Description of Artificial Sequence: Synthetic oligonucleotide
ggatggatatggactccagtcatagtacaacgc

SEQ ID NO: 198182 - DNA, 35 bp, Artificial Sequence
  Description of Artificial Sequence: Synthetic oligonucleotide
gatggatatggactccagtcatagtacaacgcttc

SEQ ID NO: 198183 - DNA, 36 bp, Artificial Sequence
  Description of Artificial Sequence: Synthetic oligonucleotide
atggatatggactccagtcatagtacaacgcttcag

SEQ ID NO: 198184 - DNA, 35 bp, Artificial Sequence
  Description of Artificial Sequence: Synthetic oligonucleotide
tggatatggactccagtcatagtacaacgcttcag

SEQ ID NO: 198185 - DNA, 34 bp, Artificial Sequence
  Description of Artificial Sequence: Synthetic oligonucleotide
ggatatggactccagtcatagtacaacgcttcag

SEQ ID NO: 198186 - DNA, 34 bp, Artificial Sequence
  Description of Artificial Sequence: Synthetic oligonucleotide
gatatggactccagtcatagtacaacgcttcagc

SEQ ID NO: 198187 - DNA, 34 bp, Artificial Sequence
  Description of Artificial Sequence: Synthetic oligonucleotide
atatggactccagtcatagtacaacgcttcagcc

SEQ ID NO: 198188 - DNA, 39 bp, Artificial Sequence
  Description of Artificial Sequence: Synthetic oligonucleotide
cctactgcaaatccaaacacaggtttggtggaaaatttg

SEQ ID NO: 198189 - DNA, 39 bp, Artificial Sequence
  Description of Artificial Sequence: Synthetic oligonucleotide
ctactgcaaatccaaacacaggtttggtggaaaatttgg

SEQ ID NO: 198190 - DNA, 40 bp, Artificial Sequence
  Description of Artificial Sequence: Synthetic oligonucleotide
tactgcaaatccaaacacaggtttggtggaaaatttggac

SEQ ID NO: 198191 - DNA, 39 bp, Artificial Sequence
  Description of Artificial Sequence: Synthetic oligonucleotide
actgcaaatccaaacacaggtttggtggaaaatttggac

SEQ ID NO: 198192 - DNA, 38 bp, Artificial Sequence
  Description of Artificial Sequence: Synthetic oligonucleotide
ctgcaaatccaaacacaggtttggtggaaaatttggac

SEQ ID NO: 198193 - DNA, 39 bp, Artificial Sequence
  Description of Artificial Sequence: Synthetic oligonucleotide
tgcaaatccaaacacaggtttggtggaaaatttggacag

SEQ ID NO: 198194 - DNA, 38 bp, Artificial Sequence
  Description of Artificial Sequence: Synthetic oligonucleotide
gcaaatccaaacacaggtttggtggaaaatttggacag

SEQ ID NO: 198195 - DNA, 38 bp, Artificial Sequence
  Description of Artificial Sequence: Synthetic oligonucleotide
caaatccaaacacaggtttggtggaaaatttggacagg

SEQ ID NO: 198196 - DNA, 39 bp, Artificial Sequence
  Description of Artificial Sequence: Synthetic oligonucleotide
aaatccaaacacaggtttggtggaaaatttggacaggac

SEQ ID NO: 198197 - DNA, 38 bp, Artificial Sequence
  Description of Artificial Sequence: Synthetic oligonucleotide
aatccaaacacaggtttggtggaaaatttggacaggac

SEQ ID NO: 198198 - DNA, 37 bp, Artificial Sequence
  Description of Artificial Sequence: Synthetic oligonucleotide
atccaaacacaggtttggtggaaaatttggacaggac

SEQ ID NO: 198199 - DNA, 36 bp, Artificial Sequence
  Description of Artificial Sequence: Synthetic oligonucleotide
tccaaacacaggtttggtggaaaatttggacaggac

SEQ ID NO: 198200 - DNA, 35 bp, Artificial Sequence
  Description of Artificial Sequence: Synthetic oligonucleotide
ccaaacacaggtttggtggaaaatttggacaggac

SEQ ID NO: 198201 - DNA, 36 bp, Artificial Sequence
  Description of Artificial Sequence: Synthetic oligonucleotide
caaacacaggtttggtggaaaatttggacaggacag

SEQ ID NO: 198202 - DNA, 36 bp, Artificial Sequence
  Description of Artificial Sequence: Synthetic oligonucleotide
aaacacaggtttggtggaaaatttggacaggacagg

SEQ ID NO: 198203 - DNA, 35 bp, Artificial Sequence
  Description of Artificial Sequence: Synthetic oligonucleotide
aacacaggtttggtggaaaatttggacaggacagg

SEQ ID NO: 198204 - DNA, 34 bp, Artificial Sequence
  Description of Artificial Sequence: Synthetic oligonucleotide
acacaggtttggtggaaaatttggacaggacagg

SEQ ID NO: 198205 - DNA, 33 bp, Artificial Sequence
  Description of Artificial Sequence: Synthetic oligonucleotide
cacaggtttggtggaaaatttggacaggacagg

SEQ ID NO: 198206 - DNA, 34 bp, Artificial Sequence
  Description of Artificial Sequence: Synthetic oligonucleotide
acaggtttggtggaaaatttggacaggacaggac

SEQ ID NO: 198207 - DNA, 33 bp, Artificial Sequence
  Description of Artificial Sequence: Synthetic oligonucleotide
caggtttggtggaaaatttggacaggacaggac

SEQ ID NO: 198208 - DNA, 33 bp, Artificial Sequence
  Description of Artificial Sequence: Synthetic oligonucleotide
aggtttggtggaaaatttggacaggacaggacc

SEQ ID NO: 198209 - DNA, 32 bp, Artificial Sequence
  Description of Artificial Sequence: Synthetic oligonucleotide
ggtttggtggaaaatttggacaggacaggacc

SEQ ID NO: 198210 - DNA, 33 bp, Artificial Sequence
  Description of Artificial Sequence: Synthetic oligonucleotide
gtttggtggaaaatttggacaggacaggacctc

SEQ ID NO: 198211 - DNA, 36 bp, Artificial Sequence
  Description of Artificial Sequence: Synthetic oligonucleotide
tttggtggaaaatttggacaggacaggacctctttc

SEQ ID NO: 198212 - DNA, 35 bp, Artificial Sequence
  Description of Artificial Sequence: Synthetic oligonucleotide
ttggtggaaaatttggacaggacaggacctctttc

SEQ ID NO: 198213 - DNA, 34 bp, Artificial Sequence
  Description of Artificial Sequence: Synthetic oligonucleotide
tggtggaaaatttggacaggacaggacctctttc

SEQ ID NO: 198214 - DNA, 33 bp, Artificial Sequence
  Description of Artificial Sequence: Synthetic oligonucleotide
ggtggaaaatttggacaggacaggacctctttc

SEQ ID NO: 198215 - DNA, 36 bp, Artificial Sequence
  Description of Artificial Sequence: Synthetic oligonucleotide
gtggaaaatttggacaggacaggacctctttcaatg

SEQ ID NO: 198216 - DNA, 37 bp, Artificial Sequence
  Description of Artificial Sequence: Synthetic oligonucleotide
tggaaaatttggacaggacaggacctctttcaatgac

SEQ ID NO: 198217 - DNA, 36 bp, Artificial Sequence
  Description of Artificial Sequence: Synthetic oligonucleotide
ggaaaatttggacaggacaggacctctttcaatgac

SEQ ID NO: 198218 - DNA, 38 bp, Artificial Sequence
  Description of Artificial Sequence: Synthetic oligonucleotide
gaaaatttggacaggacaggacctctttcaatgacaac

SEQ ID NO: 198219 - DNA, 38 bp, Artificial Sequence
  Description of Artificial Sequence: Synthetic oligonucleotide
aaaatttggacaggacaggacctctttcaatgacaacg

SEQ ID NO: 198220 - DNA, 37 bp, Artificial Sequence
  Description of Artificial Sequence: Synthetic oligonucleotide
aaatttggacaggacaggacctctttcaatgacaacg

SEQ ID NO: 198221 - DNA, 36 bp, Artificial Sequence
  Description of Artificial Sequence: Synthetic oligonucleotide
aatttggacaggacaggacctctttcaatgacaacg

SEQ ID NO: 198222 - DNA, 29 bp, Artificial Sequence
  Description of Artificial Sequence: Synthetic oligonucleotide
gacagcacagacagaatccctgctaccag

SEQ ID NO: 198223 - DNA, 30 bp, Artificial Sequence
  Description of Artificial Sequence: Synthetic oligonucleotide
acagcacagacagaatccctgctaccagag

SEQ ID NO: 198224 - DNA, 29 bp, Artificial Sequence
  Description of Artificial Sequence: Synthetic oligonucleotide
cagcacagacagaatccctgctaccagag

SEQ ID NO: 198225 - DNA, 30 bp, Artificial Sequence
  Description of Artificial Sequence: Synthetic oligonucleotide
agcacagacagaatccctgctaccagagac

SEQ ID NO: 198226 - DNA, 29 bp, Artificial Sequence
  Description of Artificial Sequence: Synthetic oligonucleotide
gcacagacagaatccctgctaccagagac

SEQ ID NO: 198227 - DNA, 29 bp, Artificial Sequence
  Description of Artificial Sequence: Synthetic oligonucleotide
cacagacagaatccctgctaccagagacc

SEQ ID NO: 198228 - DNA, 31 bp, Artificial Sequence
  Description of Artificial Sequence: Synthetic oligonucleotide
acagacagaatccctgctaccagagaccaag

SEQ ID NO: 198229 - DNA, 30 bp, Artificial Sequence
  Description of Artificial Sequence: Synthetic oligonucleotide
cagacagaatccctgctaccagagaccaag

SEQ ID NO: 198230 - DNA, 31 bp, Artificial Sequence
  Description of Artificial Sequence: Synthetic oligonucleotide
agacagaatccctgctaccagagaccaagac

SEQ ID NO: 198231 - DNA, 30 bp, Artificial Sequence
  Description of Artificial Sequence: Synthetic oligonucleotide
gacagaatccctgctaccagagaccaagac

SEQ ID NO: 198232 - DNA, 31 bp, Artificial Sequence
  Description of Artificial Sequence: Synthetic oligonucleotide
acagaatccctgctaccagagaccaagacac

SEQ ID NO: 198233 - DNA, 30 bp, Artificial Sequence
  Description of Artificial Sequence: Synthetic oligonucleotide
cagaatccctgctaccagagaccaagacac

SEQ ID NO: 198234 - DNA, 33 bp, Artificial Sequence
  Description of Artificial Sequence: Synthetic oligonucleotide
agaatccctgctaccagagaccaagacacattc

SEQ ID NO: 198235 - DNA, 32 bp, Artificial Sequence
  Description of Artificial Sequence: Synthetic oligonucleotide
gaatccctgctaccagagaccaagacacattc

SEQ ID NO: 198236 - DNA, 32 bp, Artificial Sequence
  Description of Artificial Sequence: Synthetic oligonucleotide
aatccctgctaccagagaccaagacacattcc

SEQ ID NO: 198237 - DNA, 31 bp, Artificial Sequence
  Description of Artificial Sequence: Synthetic oligonucleotide
atccctgctaccagagaccaagacacattcc

SEQ ID NO: 198238 - DNA, 30 bp, Artificial Sequence
  Description of Artificial Sequence: Synthetic oligonucleotide
tccctgctaccagagaccaagacacattcc

SEQ ID NO: 198239 - DNA, 29 bp, Artificial Sequence
  Description of Artificial Sequence: Synthetic oligonucleotide
ccctgctaccagagaccaagacacattcc

SEQ ID NO: 198240 - DNA, 30 bp, Artificial Sequence
  Description of Artificial Sequence: Synthetic oligonucleotide
cctgctaccagagaccaagacacattccac

SEQ ID NO: 198241 - DNA, 30 bp, Artificial Sequence
  Description of Artificial Sequence: Synthetic oligonucleotide
ctgctaccagagaccaagacacattccacc

SEQ ID NO: 198242 - DNA, 30 bp, Artificial Sequence
  Description of Artificial Sequence: Synthetic oligonucleotide
tgctaccagagaccaagacacattccaccc

SEQ ID NO: 198243 - DNA, 29 bp, Artificial Sequence
  Description of Artificial Sequence: Synthetic oligonucleotide
gctaccagagaccaagacacattccaccc

SEQ ID NO: 198244 - DNA, 29 bp, Artificial Sequence
  Description of Artificial Sequence: Synthetic oligonucleotide
ctaccagagaccaagacacattccacccc

SEQ ID NO: 198245 - DNA, 30 bp, Artificial Sequence
  Description of Artificial Sequence: Synthetic oligonucleotide
taccagagaccaagacacattccaccccag

SEQ ID NO: 198246 - DNA, 29 bp, Artificial Sequence
  Description of Artificial Sequence: Synthetic oligonucleotide
accagagaccaagacacattccaccccag

SEQ ID NO: 198247 - DNA, 28 bp, Artificial Sequence
  Description of Artificial Sequence: Synthetic oligonucleotide
ccagagaccaagacacattccaccccag

SEQ ID NO: 198248 - DNA, 29 bp, Artificial Sequence
  Description of Artificial Sequence: Synthetic oligonucleotide
cagagaccaagacacattccaccccagtg

SEQ ID NO: 198249 - DNA, 29 bp, Artificial Sequence
  Description of Artificial Sequence: Synthetic oligonucleotide
agagaccaagacacattccaccccagtgg

SEQ ID NO: 198250 - DNA, 31 bp, Artificial Sequence
  Description of Artificial Sequence: Synthetic oligonucleotide
ccagcaagtctcaggaaatggtgcatttggc

SEQ ID NO: 198251 - DNA, 31 bp, Artificial Sequence
  Description of Artificial Sequence: Synthetic oligonucleotide
cagcaagtctcaggaaatggtgcatttggcg

SEQ ID NO: 198252 - DNA, 33 bp, Artificial Sequence
  Description of Artificial Sequence: Synthetic oligonucleotide
agcaagtctcaggaaatggtgcatttggcgaac

SEQ ID NO: 198253 - DNA, 32 bp, Artificial Sequence
  Description of Artificial Sequence: Synthetic oligonucleotide
gcaagtctcaggaaatggtgcatttggcgaac

SEQ ID NO: 198254 - DNA, 34 bp, Artificial Sequence
  Description of Artificial Sequence: Synthetic oligonucleotide
caagtctcaggaaatggtgcatttggcgaacaag

SEQ ID NO: 198255 - DNA, 34 bp, Artificial Sequence
  Description of Artificial Sequence: Synthetic oligonucleotide
aagtctcaggaaatggtgcatttggcgaacaagg

SEQ ID NO: 198256 - DNA, 33 bp, Artificial Sequence
  Description of Artificial Sequence: Synthetic oligonucleotide
agtctcaggaaatggtgcatttggcgaacaagg

SEQ ID NO: 198257 - DNA, 32 bp, Artificial Sequence
  Description of Artificial Sequence: Synthetic oligonucleotide
gtctcaggaaatggtgcatttggcgaacaagg

SEQ ID NO: 198258 - DNA, 33 bp, Artificial Sequence
  Description of Artificial Sequence: Synthetic oligonucleotide
tctcaggaaatggtgcatttggcgaacaaggag

SEQ ID NO: 198259 - DNA, 32 bp, Artificial Sequence
  Description of Artificial Sequence: Synthetic oligonucleotide
ctcaggaaatggtgcatttggcgaacaaggag

SEQ ID NO: 198260 - DNA, 33 bp, Artificial Sequence
  Description of Artificial Sequence: Synthetic oligonucleotide
tcaggaaatggtgcatttggcgaacaaggagtc

SEQ ID NO: 198261 - DNA, 32 bp, Artificial Sequence
  Description of Artificial Sequence: Synthetic oligonucleotide
caggaaatggtgcatttggcgaacaaggagtc

SEQ ID NO: 198262 - DNA, 32 bp, Artificial Sequence
  Description of Artificial Sequence: Synthetic oligonucleotide
aggaaatggtgcatttggcgaacaaggagtcg

SEQ ID NO: 198263 - DNA, 31 bp, Artificial Sequence
  Description of Artificial Sequence: Synthetic oligonucleotide
ggaaatggtgcatttggcgaacaaggagtcg

SEQ ID NO: 198264 - DNA, 32 bp, Artificial Sequence
  Description of Artificial Sequence: Synthetic oligonucleotide
gaaatggtgcatttggcgaacaaggagtcgtc

SEQ ID NO: 198265 - DNA, 33 bp, Artificial Sequence
  Description of Artificial Sequence: Synthetic oligonucleotide
aaatggtgcatttggcgaacaaggagtcgtcag

SEQ ID NO: 198266 - DNA, 32 bp, Artificial Sequence
  Description of Artificial Sequence: Synthetic oligonucleotide
aatggtgcatttggcgaacaaggagtcgtcag

SEQ ID NO: 198267 - DNA, 31 bp, Artificial Sequence
  Description of Artificial Sequence: Synthetic oligonucleotide
atggtgcatttggcgaacaaggagtcgtcag

SEQ ID NO: 198268 - DNA, 30 bp, Artificial Sequence
  Description of Artificial Sequence: Synthetic oligonucleotide
tggtgcatttggcgaacaaggagtcgtcag

SEQ ID NO: 198269 - DNA, 29 bp, Artificial Sequence
  Description of Artificial Sequence: Synthetic oligonucleotide
ggtgcatttggcgaacaaggagtcgtcag

SEQ ID NO: 198270 - DNA, 32 bp, Artificial Sequence
  Description of Artificial Sequence: Synthetic oligonucleotide
gtgcatttggcgaacaaggagtcgtcagaaac

SEQ ID NO: 198271 - DNA, 33 bp, Artificial Sequence
  Description of Artificial Sequence: Synthetic oligonucleotide
tgcatttggcgaacaaggagtcgtcagaaactc

SEQ ID NO: 198272 - DNA, 32 bp, Artificial Sequence
  Description of Artificial Sequence: Synthetic oligonucleotide
gcatttggcgaacaaggagtcgtcagaaactc

SEQ ID NO: 198273 - DNA, 32 bp, Artificial Sequence
  Description of Artificial Sequence: Synthetic oligonucleotide
catttggcgaacaaggagtcgtcagaaactcc

SEQ ID NO: 198274 - DNA, 33 bp, Artificial Sequence
  Description of Artificial Sequence: Synthetic oligonucleotide
atttggcgaacaaggagtcgtcagaaactccag

SEQ ID NO: 198275 - DNA, 32 bp, Artificial Sequence
  Description of Artificial Sequence: Synthetic oligonucleotide
tttggcgaacaaggagtcgtcagaaactccag

SEQ ID NO: 198276 - DNA, 31 bp, Artificial Sequence
  Description of Artificial Sequence: Synthetic oligonucleotide
ttggcgaacaaggagtcgtcagaaactccag

SEQ ID NO: 198277 - DNA, 30 bp, Artificial Sequence
  Description of Artificial Sequence: Synthetic oligonucleotide
tggcgaacaaggagtcgtcagaaactccag

SEQ ID NO: 198278 - DNA, 29 bp, Artificial Sequence
  Description of Artificial Sequence: Synthetic oligonucleotide
ggcgaacaaggagtcgtcagaaactccag

SEQ ID NO: 198279 - DNA, 30 bp, Artificial Sequence
  Description of Artificial Sequence: Synthetic oligonucleotide
gcgaacaaggagtcgtcagaaactccagac

SEQ ID NO: 198280 - DNA, 30 bp, Artificial Sequence
  Description of Artificial Sequence: Synthetic oligonucleotide
cgaacaaggagtcgtcagaaactccagacc

SEQ ID NO: 198281 - DNA, 33 bp, Artificial Sequence
  Description of Artificial Sequence: Synthetic oligonucleotide
gacagcacagacagaatccctgctaccaatatg

SEQ ID NO: 198282 - DNA, 33 bp, Artificial Sequence
  Description of Artificial Sequence: Synthetic oligonucleotide
acagcacagacagaatccctgctaccaatatgg

SEQ ID NO: 198283 - DNA, 32 bp, Artificial Sequence
  Description of Artificial Sequence: Synthetic oligonucleotide
cagcacagacagaatccctgctaccaatatgg

SEQ ID NO: 198284 - DNA, 33 bp, Artificial Sequence
  Description of Artificial Sequence: Synthetic oligonucleotide
agcacagacagaatccctgctaccaatatggac

SEQ ID NO: 198285 - DNA, 32 bp, Artificial Sequence
  Description of Artificial Sequence: Synthetic oligonucleotide
gcacagacagaatccctgctaccaatatggac

SEQ ID NO: 198286 - DNA, 33 bp, Artificial Sequence
  Description of Artificial Sequence: Synthetic oligonucleotide
cacagacagaatccctgctaccaatatggactc

SEQ ID NO: 198287 - DNA, 33 bp, Artificial Sequence
  Description of Artificial Sequence: Synthetic oligonucleotide
acagacagaatccctgctaccaatatggactcc

SEQ ID NO: 198288 - DNA, 32 bp, Artificial Sequence
  Description of Artificial Sequence: Synthetic oligonucleotide
cagacagaatccctgctaccaatatggactcc

SEQ ID NO: 198289 - DNA, 33 bp, Artificial Sequence
  Description of Artificial Sequence: Synthetic oligonucleotide
agacagaatccctgctaccaatatggactccag

SEQ ID NO: 198290 - DNA, 32 bp, Artificial Sequence
  Description of Artificial Sequence: Synthetic oligonucleotide
gacagaatccctgctaccaatatggactccag

SEQ ID NO: 198291 - DNA, 33 bp, Artificial Sequence
  Description of Artificial Sequence: Synthetic oligonucleotide
acagaatccctgctaccaatatggactccagtc

SEQ ID NO: 198292 - DNA, 32 bp, Artificial Sequence
  Description of Artificial Sequence: Synthetic oligonucleotide
cagaatccctgctaccaatatggactccagtc

SEQ ID NO: 198293 - DNA, 35 bp, Artificial Sequence
  Description of Artificial Sequence: Synthetic oligonucleotide
agaatccctgctaccaatatggactccagtcatag

SEQ ID NO: 198294 - DNA, 34 bp, Artificial Sequence
  Description of Artificial Sequence: Synthetic oligonucleotide
gaatccctgctaccaatatggactccagtcatag

SEQ ID NO: 198295 - DNA, 36 bp, Artificial Sequence
  Description of Artificial Sequence: Synthetic oligonucleotide
aatccctgctaccaatatggactccagtcatagtac

SEQ ID NO: 198296 - DNA, 35 bp, Artificial Sequence
  Description of Artificial Sequence: Synthetic oligonucleotide
atccctgctaccaatatggactccagtcatagtac

SEQ ID NO: 198297 - DNA, 34 bp, Artificial Sequence
  Description of Artificial Sequence: Synthetic oligonucleotide
tccctgctaccaatatggactccagtcatagtac

SEQ ID NO: 198298 - DNA, 33 bp, Artificial Sequence
  Description of Artificial Sequence: Synthetic oligonucleotide
ccctgctaccaatatggactccagtcatagtac

SEQ ID NO: 198299 - DNA, 35 bp, Artificial Sequence
  Description of Artificial Sequence: Synthetic oligonucleotide
cctgctaccaatatggactccagtcatagtacaac

SEQ ID NO: 198300 - DNA, 35 bp, Artificial Sequence
  Description of Artificial Sequence: Synthetic oligonucleotide
ctgctaccaatatggactccagtcatagtacaacg

SEQ ID NO: 198301 - DNA, 35 bp, Artificial Sequence
  Description of Artificial Sequence: Synthetic oligonucleotide
tgctaccaatatggactccagtcatagtacaacgc

SEQ ID NO: 198302 - DNA, 34 bp, Artificial Sequence
  Description of Artificial Sequence: Synthetic oligonucleotide
gctaccaatatggactccagtcatagtacaacgc

SEQ ID NO: 198303 - DNA, 36 bp, Artificial Sequence
  Description of Artificial Sequence: Synthetic oligonucleotide
ctaccaatatggactccagtcatagtacaacgcttc

SEQ ID NO: 198304 - DNA, 37 bp, Artificial Sequence
  Description of Artificial Sequence: Synthetic oligonucleotide
taccaatatggactccagtcatagtacaacgcttcag

SEQ ID NO: 198305 - DNA, 36 bp, Artificial Sequence
  Description of Artificial Sequence: Synthetic oligonucleotide
accaatatggactccagtcatagtacaacgcttcag

SEQ ID NO: 198306 - DNA, 35 bp, Artificial Sequence
  Description of Artificial Sequence: Synthetic oligonucleotide
ccaatatggactccagtcatagtacaacgcttcag

SEQ ID NO: 198307 - DNA, 35 bp, Artificial Sequence
  Description of Artificial Sequence: Synthetic oligonucleotide
caatatggactccagtcatagtacaacgcttcagc

SEQ ID NO: 198308 - DNA, 35 bp, Artificial Sequence
  Description of Artificial Sequence: Synthetic oligonucleotide
aatatggactccagtcatagtacaacgcttcagcc

SEQ ID NO: 198309 - DNA, 31 bp, Artificial Sequence
  Description of Artificial Sequence: Synthetic oligonucleotide
acagcacagacagaatccctgctaccagtac

SEQ ID NO: 198310 - DNA, 30 bp, Artificial Sequence
  Description of Artificial Sequence: Synthetic oligonucleotide
cagcacagacagaatccctgctaccagtac

SEQ ID NO: 198311 - DNA, 30 bp, Artificial Sequence
  Description of Artificial Sequence: Synthetic oligonucleotide
agcacagacagaatccctgctaccagtacg

SEQ ID NO: 198312 - DNA, 29 bp, Artificial Sequence
  Description of Artificial Sequence: Synthetic oligonucleotide
gcacagacagaatccctgctaccagtacg

SEQ ID NO: 198313 - DNA, 30 bp, Artificial Sequence
  Description of Artificial Sequence: Synthetic oligonucleotide
cacagacagaatccctgctaccagtacgtc

SEQ ID NO: 198314 - DNA, 32 bp, Artificial Sequence
  Description of Artificial Sequence: Synthetic oligonucleotide
acagacagaatccctgctaccagtacgtcttc

SEQ ID NO: 198315 - DNA, 31 bp, Artificial Sequence
  Description of Artificial Sequence: Synthetic oligonucleotide
cagacagaatccctgctaccagtacgtcttc

SEQ ID NO: 198316 - DNA, 36 bp, Artificial Sequence
  Description of Artificial Sequence: Synthetic oligonucleotide
agacagaatccctgctaccagtacgtcttcaaatac

SEQ ID NO: 198317 - DNA, 35 bp, Artificial Sequence
  Description of Artificial Sequence: Synthetic oligonucleotide
gacagaatccctgctaccagtacgtcttcaaatac

SEQ ID NO: 198318 - DNA, 35 bp, Artificial Sequence
  Description of Artificial Sequence: Synthetic oligonucleotide
acagaatccctgctaccagtacgtcttcaaatacc

SEQ ID NO: 198319 - DNA, 34 bp, Artificial Sequence
  Description of Artificial Sequence: Synthetic oligonucleotide
cagaatccctgctaccagtacgtcttcaaatacc

SEQ ID NO: 198320 - DNA, 36 bp, Artificial Sequence
  Description of Artificial Sequence: Synthetic oligonucleotide
agaatccctgctaccagtacgtcttcaaataccatc

SEQ ID NO: 198321 - DNA, 35 bp, Artificial Sequence
  Description of Artificial Sequence: Synthetic oligonucleotide
gaatccctgctaccagtacgtcttcaaataccatc

SEQ ID NO: 198322 - DNA, 36 bp, Artificial Sequence
  Description of Artificial Sequence: Synthetic oligonucleotide
aatccctgctaccagtacgtcttcaaataccatctc

SEQ ID NO: 198323 - DNA, 35 bp, Artificial Sequence
  Description of Artificial Sequence: Synthetic oligonucleotide
atccctgctaccagtacgtcttcaaataccatctc

SEQ ID NO: 198324 - DNA, 34 bp, Artificial Sequence
  Description of Artificial Sequence: Synthetic oligonucleotide
tccctgctaccagtacgtcttcaaataccatctc

SEQ ID NO: 198325 - DNA, 33 bp, Artificial Sequence
  Description of Artificial Sequence: Synthetic oligonucleotide
ccctgctaccagtacgtcttcaaataccatctc

SEQ ID NO: 198326 - DNA, 34 bp, Artificial Sequence
  Description of Artificial Sequence: Synthetic oligonucleotide
cctgctaccagtacgtcttcaaataccatctcag

SEQ ID NO: 198327 - DNA, 34 bp, Artificial Sequence
  Description of Artificial Sequence: Synthetic oligonucleotide
ctgctaccagtacgtcttcaaataccatctcagc

SEQ ID NO: 198328 - DNA, 35 bp, Artificial Sequence
  Description of Artificial Sequence: Synthetic oligonucleotide
tgctaccagtacgtcttcaaataccatctcagcag

SEQ ID NO: 198329 - DNA, 34 bp, Artificial Sequence
  Description of Artificial Sequence: Synthetic oligonucleotide
gctaccagtacgtcttcaaataccatctcagcag

SEQ ID NO: 198330 - DNA, 34 bp, Artificial Sequence
  Description of Artificial Sequence: Synthetic oligonucleotide
ctaccagtacgtcttcaaataccatctcagcagg

SEQ ID NO: 198331 - DNA, 34 bp, Artificial Sequence
  Description of Artificial Sequence: Synthetic oligonucleotide
taccagtacgtcttcaaataccatctcagcaggc

SEQ ID NO: 198332 - DNA, 33 bp, Artificial Sequence
  Description of Artificial Sequence: Synthetic oligonucleotide
accagtacgtcttcaaataccatctcagcaggc

SEQ ID NO: 198333 - DNA, 32 bp, Artificial Sequence
  Description of Artificial Sequence: Synthetic oligonucleotide
ccagtacgtcttcaaataccatctcagcaggc

SEQ ID NO: 198334 - DNA, 33 bp, Artificial Sequence
  Description of Artificial Sequence: Synthetic oligonucleotide
cagtacgtcttcaaataccatctcagcaggctg

SEQ ID NO: 198335 - DNA, 33 bp, Artificial Sequence
  Description of Artificial Sequence: Synthetic oligonucleotide
agtacgtcttcaaataccatctcagcaggctgg

SEQ ID NO: 198336 - DNA, 29 bp, Artificial Sequence
  Description of Artificial Sequence: Synthetic oligonucleotide
ctctgagcatcggatttgagacctgcagc

SEQ ID NO: 198337 - DNA, 30 bp, Artificial Sequence
  Description of Artificial Sequence: Synthetic oligonucleotide
tctgagcatcggatttgagacctgcagctc

SEQ ID NO: 198338 - DNA, 29 bp, Artificial Sequence
  Description of Artificial Sequence: Synthetic oligonucleotide
ctgagcatcggatttgagacctgcagctc

SEQ ID NO: 198339 - DNA, 29 bp, Artificial Sequence
  Description of Artificial Sequence: Synthetic oligonucleotide
tgagcatcggatttgagacctgcagctcc

SEQ ID NO: 198340 - DNA, 28 bp, Artificial Sequence
  Description of Artificial Sequence: Synthetic oligonucleotide
gagcatcggatttgagacctgcagctcc

SEQ ID NO: 198341 - DNA, 29 bp, Artificial Sequence
  Description of Artificial Sequence: Synthetic oligonucleotide
agcatcggatttgagacctgcagctccac

SEQ ID NO: 198342 - DNA, 28 bp, Artificial Sequence
  Description of Artificial Sequence: Synthetic oligonucleotide
gcatcggatttgagacctgcagctccac

SEQ ID NO: 198343 - DNA, 28 bp, Artificial Sequence
  Description of Artificial Sequence: Synthetic oligonucleotide
catcggatttgagacctgcagctccacc

SEQ ID NO: 198344 - DNA, 29 bp, Artificial Sequence
  Description of Artificial Sequence: Synthetic oligonucleotide
atcggatttgagacctgcagctccacctg

SEQ ID NO: 198345 - DNA, 28 bp, Artificial Sequence
  Description of Artificial Sequence: Synthetic oligonucleotide
tcggatttgagacctgcagctccacctg

SEQ ID NO: 198346 - DNA, 27 bp, Artificial Sequence
  Description of Artificial Sequence: Synthetic oligonucleotide
cggatttgagacctgcagctccacctg

SEQ ID NO: 198347 - DNA, 29 bp, Artificial Sequence
  Description of Artificial Sequence: Synthetic oligonucleotide
ggatttgagacctgcagctccacctgaag

SEQ ID NO: 198348 - DNA, 31 bp, Artificial Sequence
  Description of Artificial Sequence: Synthetic oligonucleotide
gatttgagacctgcagctccacctgaagaag

SEQ ID NO: 198349 - DNA, 34 bp, Artificial Sequence
  Description of Artificial Sequence: Synthetic oligonucleotide
atttgagacctgcagctccacctgaagaagattg

SEQ ID NO: 198350 - DNA, 33 bp, Artificial Sequence
  Description of Artificial Sequence: Synthetic oligonucleotide
tttgagacctgcagctccacctgaagaagattg

SEQ ID NO: 198351 - DNA, 32 bp, Artificial Sequence
  Description of Artificial Sequence: Synthetic oligonucleotide
ttgagacctgcagctccacctgaagaagattg

SEQ ID NO: 198352 - DNA, 31 bp, Artificial Sequence
  Description of Artificial Sequence: Synthetic oligonucleotide
tgagacctgcagctccacctgaagaagattg

SEQ ID NO: 198353 - DNA, 30 bp, Artificial Sequence
  Description of Artificial Sequence: Synthetic oligonucleotide
gagacctgcagctccacctgaagaagattg

SEQ ID NO: 198354 - DNA, 32 bp, Artificial Sequence
  Description of Artificial Sequence: Synthetic oligonucleotide
agacctgcagctccacctgaagaagattgtac

SEQ ID NO: 198355 - DNA, 31 bp, Artificial Sequence
  Description of Artificial Sequence: Synthetic oligonucleotide
gacctgcagctccacctgaagaagattgtac

SEQ ID NO: 198356 - DNA, 33 bp, Artificial Sequence
  Description of Artificial Sequence: Synthetic oligonucleotide
acctgcagctccacctgaagaagattgtacatc

SEQ ID NO: 198357 - DNA, 32 bp, Artificial Sequence
  Description of Artificial Sequence: Synthetic oligonucleotide
cctgcagctccacctgaagaagattgtacatc

SEQ ID NO: 198358 - DNA, 33 bp, Artificial Sequence
  Description of Artificial Sequence: Synthetic oligonucleotide
ctgcagctccacctgaagaagattgtacatcag

SEQ ID NO: 198359 - DNA, 34 bp, Artificial Sequence
  Description of Artificial Sequence: Synthetic oligonucleotide
tgcagctccacctgaagaagattgtacatcagtc

SEQ ID NO: 198360 - DNA, 33 bp, Artificial Sequence
  Description of Artificial Sequence: Synthetic oligonucleotide
gcagctccacctgaagaagattgtacatcagtc

SEQ ID NO: 198361 - DNA, 32 bp, Artificial Sequence
  Description of Artificial Sequence: Synthetic oligonucleotide
caatggagctgtggaggacagaaagccaattg

SEQ ID NO: 198362 - DNA, 32 bp, Artificial Sequence
  Description of Artificial Sequence: Synthetic oligonucleotide
aatggagctgtggaggacagaaagccaattgg

SEQ ID NO: 198363 - DNA, 31 bp, Artificial Sequence
  Description of Artificial Sequence: Synthetic oligonucleotide
atggagctgtggaggacagaaagccaattgg

SEQ ID NO: 198364 - DNA, 30 bp, Artificial Sequence
  Description of Artificial Sequence: Synthetic oligonucleotide
tggagctgtggaggacagaaagccaattgg

SEQ ID NO: 198365 - DNA, 29 bp, Artificial Sequence
  Description of Artificial Sequence: Synthetic oligonucleotide
ggagctgtggaggacagaaagccaattgg

SEQ ID NO: 198366 - DNA, 30 bp, Artificial Sequence
  Description of Artificial Sequence: Synthetic oligonucleotide
gagctgtggaggacagaaagccaattggac

SEQ ID NO: 198367 - DNA, 31 bp, Artificial Sequence
  Description of Artificial Sequence: Synthetic oligonucleotide
agctgtggaggacagaaagccaattggactc

SEQ ID NO: 198368 - DNA, 30 bp, Artificial Sequence
  Description of Artificial Sequence: Synthetic oligonucleotide
gctgtggaggacagaaagccaattggactc

SEQ ID NO: 198369 - DNA, 32 bp, Artificial Sequence
  Description of Artificial Sequence: Synthetic oligonucleotide
ctgtggaggacagaaagccaattggactcaac

SEQ ID NO: 198370 - DNA, 32 bp, Artificial Sequence
  Description of Artificial Sequence: Synthetic oligonucleotide
tgtggaggacagaaagccaattggactcaacg

SEQ ID NO: 198371 - DNA, 31 bp, Artificial Sequence
  Description of Artificial Sequence: Synthetic oligonucleotide
gtggaggacagaaagccaattggactcaacg

SEQ ID NO: 198372 - DNA, 31 bp, Artificial Sequence
  Description of Artificial Sequence: Synthetic oligonucleotide
tggaggacagaaagccaattggactcaacgg

SEQ ID NO: 198373 - DNA, 30 bp, Artificial Sequence
  Description of Artificial Sequence: Synthetic oligonucleotide
ggaggacagaaagccaattggactcaacgg

SEQ ID NO: 198374 - DNA, 31 bp, Artificial Sequence
  Description of Artificial Sequence: Synthetic oligonucleotide
gaggacagaaagccaattggactcaacggag

SEQ ID NO: 198375 - DNA, 32 bp, Artificial Sequence
  Description of Artificial Sequence: Synthetic oligonucleotide
aggacagaaagccaattggactcaacggagag

SEQ ID NO: 198376 - DNA, 31 bp, Artificial Sequence
  Description of Artificial Sequence: Synthetic oligonucleotide
ggacagaaagccaattggactcaacggagag

SEQ ID NO: 198377 - DNA, 31 bp, Artificial Sequence
  Description of Artificial Sequence: Synthetic oligonucleotide
gacagaaagccaattggactcaacggagagg

SEQ ID NO: 198378 - DNA, 31 bp, Artificial Sequence
  Description of Artificial Sequence: Synthetic oligonucleotide
acagaaagccaattggactcaacggagaggc

SEQ ID NO: 198379 - DNA, 30 bp, Artificial Sequence
  Description of Artificial Sequence: Synthetic oligonucleotide
cagaaagccaattggactcaacggagaggc

SEQ ID NO: 198380 - DNA, 30 bp, Artificial Sequence
  Description of Artificial Sequence: Synthetic oligonucleotide
agaaagccaattggactcaacggagaggcc

SEQ ID NO: 198381 - DNA, 29 bp, Artificial Sequence
  Description of Artificial Sequence: Synthetic oligonucleotide
gaaagccaattggactcaacggagaggcc

SEQ ID NO: 198382 - DNA, 30 bp, Artificial Sequence
  Description of Artificial Sequence: Synthetic oligonucleotide
aaagccaattggactcaacggagaggccag

SEQ ID NO: 198383 - DNA, 29 bp, Artificial Sequence
  Description of Artificial Sequence: Synthetic oligonucleotide
aagccaattggactcaacggagaggccag

SEQ ID NO: 198384 - DNA, 28 bp, Artificial Sequence
  Description of Artificial Sequence: Synthetic oligonucleotide
agccaattggactcaacggagaggccag

SEQ ID NO: 198385 - DNA, 27 bp, Artificial Sequence
  Description of Artificial Sequence: Synthetic oligonucleotide
gccaattggactcaacggagaggccag

SEQ ID NO: 198386 - DNA, 27 bp, Artificial Sequence
  Description of Artificial Sequence: Synthetic oligonucleotide
ccaattggactcaacggagaggccagc

SEQ ID NO: 198387 - DNA, 29 bp, Artificial Sequence
  Description of Artificial Sequence: Synthetic oligonucleotide
caattggactcaacggagaggccagcaag

SEQ ID NO: 198388 - DNA, 30 bp, Artificial Sequence
  Description of Artificial Sequence: Synthetic oligonucleotide
aattggactcaacggagaggccagcaagtc

SEQ ID NO: 198389 - DNA, 29 bp, Artificial Sequence
  Description of Artificial Sequence: Synthetic oligonucleotide
attggactcaacggagaggccagcaagtc

SEQ ID NO: 198390 - DNA, 28 bp, Artificial Sequence
  Description of Artificial Sequence: Synthetic oligonucleotide
ttggactcaacggagaggccagcaagtc

SEQ ID NO: 198391 - DNA, 27 bp, Artificial Sequence
  Description of Artificial Sequence: Synthetic oligonucleotide
cagtggggggtcccataccactcatga

SEQ ID NO: 198392 - DNA, 29 bp, Artificial Sequence
  Description of Artificial Sequence: Synthetic oligonucleotide
agtggggggtcccataccactcatgaatc

SEQ ID NO: 198393 - DNA, 28 bp, Artificial Sequence
  Description of Artificial Sequence: Synthetic oligonucleotide
gtggggggtcccataccactcatgaatc

SEQ ID NO: 198394 - DNA, 29 bp, Artificial Sequence
  Description of Artificial Sequence: Synthetic oligonucleotide
tggggggtcccataccactcatgaatctg

SEQ ID NO: 198395 - DNA, 28 bp, Artificial Sequence
  Description of Artificial Sequence: Synthetic oligonucleotide
ggggggtcccataccactcatgaatctg

SEQ ID NO: 198396 - DNA, 31 bp, Artificial Sequence
  Description of Artificial Sequence: Synthetic oligonucleotide
gggggtcccataccactcatgaatctgaatc

SEQ ID NO: 198397 - DNA, 32 bp, Artificial Sequence
  Description of Artificial Sequence: Synthetic oligonucleotide
ggggtcccataccactcatgaatctgaatcag

SEQ ID NO: 198398 - DNA, 34 bp, Artificial Sequence
  Description of Artificial Sequence: Synthetic oligonucleotide
gggtcccataccactcatgaatctgaatcagatg

SEQ ID NO: 198399 - DNA, 34 bp, Artificial Sequence
  Description of Artificial Sequence: Synthetic oligonucleotide
ggtcccataccactcatgaatctgaatcagatgg

SEQ ID NO: 198400 - DNA, 35 bp, Artificial Sequence
  Description of Artificial Sequence: Synthetic oligonucleotide
gtcccataccactcatgaatctgaatcagatggac

SEQ ID NO: 198401 - DNA, 36 bp, Artificial Sequence
  Description of Artificial Sequence: Synthetic oligonucleotide
tcccataccactcatgaatctgaatcagatggacac

SEQ ID NO: 198402 - DNA, 35 bp, Artificial Sequence
  Description of Artificial Sequence: Synthetic oligonucleotide
cccataccactcatgaatctgaatcagatggacac

SEQ ID NO: 198403 - DNA, 36 bp, Artificial Sequence
  Description of Artificial Sequence: Synthetic oligonucleotide
ccataccactcatgaatctgaatcagatggacactc

SEQ ID NO: 198404 - DNA, 37 bp, Artificial Sequence
  Description of Artificial Sequence: Synthetic oligonucleotide
cataccactcatgaatctgaatcagatggacactcac

SEQ ID NO: 198405 - DNA, 39 bp, Artificial Sequence
  Description of Artificial Sequence: Synthetic oligonucleotide
ataccactcatgaatctgaatcagatggacactcacatg

SEQ ID NO: 198406 - DNA, 38 bp, Artificial Sequence
  Description of Artificial Sequence: Synthetic oligonucleotide
taccactcatgaatctgaatcagatggacactcacatg

SEQ ID NO: 198407 - DNA, 37 bp, Artificial Sequence
  Description of Artificial Sequence: Synthetic oligonucleotide
accactcatgaatctgaatcagatggacactcacatg

SEQ ID NO: 198408 - DNA, 36 bp, Artificial Sequence
  Description of Artificial Sequence: Synthetic oligonucleotide
ccactcatgaatctgaatcagatggacactcacatg

SEQ ID NO: 198409 - DNA, 36 bp, Artificial Sequence
  Description of Artificial Sequence: Synthetic oligonucleotide
cactcatgaatctgaatcagatggacactcacatgg

SEQ ID NO: 198410 - DNA, 36 bp, Artificial Sequence
  Description of Artificial Sequence: Synthetic oligonucleotide
actcatgaatctgaatcagatggacactcacatggg

SEQ ID NO: 198411 - DNA, 35 bp, Artificial Sequence
  Description of Artificial Sequence: Synthetic oligonucleotide
ctcatgaatctgaatcagatggacactcacatggg

SEQ ID NO: 198412 - DNA, 36 bp, Artificial Sequence
  Description of Artificial Sequence: Synthetic oligonucleotide
tcatgaatctgaatcagatggacactcacatgggag

SEQ ID NO: 198413 - DNA, 35 bp, Artificial Sequence
  Description of Artificial Sequence: Synthetic oligonucleotide
catgaatctgaatcagatggacactcacatgggag

SEQ ID NO: 198414 - DNA, 36 bp, Artificial Sequence
  Description of Artificial Sequence: Synthetic oligonucleotide
atgaatctgaatcagatggacactcacatgggagtc

SEQ ID NO: 198415 - DNA, 35 bp, Artificial Sequence
  Description of Artificial Sequence: Synthetic oligonucleotide
tgaatctgaatcagatggacactcacatgggagtc

SEQ ID NO: 198416 - DNA, 34 bp, Artificial Sequence
  Description of Artificial Sequence: Synthetic oligonucleotide
gaatctgaatcagatggacactcacatgggagtc

SEQ ID NO: 198417 - DNA, 36 bp, Artificial Sequence
  Description of Artificial Sequence: Synthetic oligonucleotide
aatctgaatcagatggacactcacatgggagtcaag

SEQ ID NO: 198418 - DNA, 32 bp, Artificial Sequence
  Description of Artificial Sequence: Synthetic oligonucleotide
atctcagcaggctgggagccaaatgaagaaag

SEQ ID NO: 198419 - DNA, 31 bp, Artificial Sequence
  Description of Artificial Sequence: Synthetic oligonucleotide
tctcagcaggctgggagccaaatgaagaaag

SEQ ID NO: 198420 - DNA, 30 bp, Artificial Sequence
  Description of Artificial Sequence: Synthetic oligonucleotide
ctcagcaggctgggagccaaatgaagaaag

SEQ ID NO: 198421 - DNA, 31 bp, Artificial Sequence
  Description of Artificial Sequence: Synthetic oligonucleotide
tcagcaggctgggagccaaatgaagaaagtg

SEQ ID NO: 198422 - DNA, 30 bp, Artificial Sequence
  Description of Artificial Sequence: Synthetic oligonucleotide
cagcaggctgggagccaaatgaagaaagtg

SEQ ID NO: 198423 - DNA, 32 bp, Artificial Sequence
  Description of Artificial Sequence: Synthetic oligonucleotide
agcaggctgggagccaaatgaagaaagtgaag

SEQ ID NO: 198424 - DNA, 31 bp, Artificial Sequence
  Description of Artificial Sequence: Synthetic oligonucleotide
gcaggctgggagccaaatgaagaaagtgaag

SEQ ID NO: 198425 - DNA, 33 bp, Artificial Sequence
  Description of Artificial Sequence: Synthetic oligonucleotide
caggctgggagccaaatgaagaaagtgaagatg

SEQ ID NO: 198426 - DNA, 36 bp, Artificial Sequence
  Description of Artificial Sequence: Synthetic oligonucleotide
aggctgggagccaaatgaagaaagtgaagatgaaag

SEQ ID NO: 198427 - DNA, 35 bp, Artificial Sequence
  Description of Artificial Sequence: Synthetic oligonucleotide
ggctgggagccaaatgaagaaagtgaagatgaaag

SEQ ID NO: 198428 - DNA, 36 bp, Artificial Sequence
  Description of Artificial Sequence: Synthetic oligonucleotide
gctgggagccaaatgaagaaagtgaagatgaaagag

SEQ ID NO: 198429 - DNA, 37 bp, Artificial Sequence
  Description of Artificial Sequence: Synthetic oligonucleotide
ctgggagccaaatgaagaaagtgaagatgaaagagac

SEQ ID NO: 198430 - DNA, 38 bp, Artificial Sequence
  Description of Artificial Sequence: Synthetic oligonucleotide
tgggagccaaatgaagaaagtgaagatgaaagagacag

SEQ ID NO: 198431 - DNA, 37 bp, Artificial Sequence
  Description of Artificial Sequence: Synthetic oligonucleotide
gggagccaaatgaagaaagtgaagatgaaagagacag

SEQ ID NO: 198432 - DNA, 38 bp, Artificial Sequence
  Description of Artificial Sequence: Synthetic oligonucleotide
ggagccaaatgaagaaagtgaagatgaaagagacagac

SEQ ID NO: 198433 - DNA, 39 bp, Artificial Sequence
  Description of Artificial Sequence: Synthetic oligonucleotide
gagccaaatgaagaaagtgaagatgaaagagacagacac

SEQ ID NO: 198434 - DNA, 39 bp, Artificial Sequence
  Description of Artificial Sequence: Synthetic oligonucleotide
agccaaatgaagaaagtgaagatgaaagagacagacacc

SEQ ID NO: 198435 - DNA, 38 bp, Artificial Sequence
  Description of Artificial Sequence: Synthetic oligonucleotide
gccaaatgaagaaagtgaagatgaaagagacagacacc

SEQ ID NO: 198436 - DNA, 39 bp, Artificial Sequence
  Description of Artificial Sequence: Synthetic oligonucleotide
ccaaatgaagaaagtgaagatgaaagagacagacacctc

SEQ ID NO: 198437 - DNA, 40 bp, Artificial Sequence
  Description of Artificial Sequence: Synthetic oligonucleotide
caaatgaagaaagtgaagatgaaagagacagacacctcag

SEQ ID NO: 198438 - DNA, 45 bp, Artificial Sequence
  Description of Artificial Sequence: Synthetic oligonucleotide
aaatgaagaaagtgaagatgaaagagacagacacctcagtttttc

SEQ ID NO: 198439 - DNA, 44 bp, Artificial Sequence
  Description of Artificial Sequence: Synthetic oligonucleotide
aatgaagaaagtgaagatgaaagagacagacacctcagtttttc

SEQ ID NO: 198440 - DNA, 43 bp, Artificial Sequence
  Description of Artificial Sequence: Synthetic oligonucleotide
atgaagaaagtgaagatgaaagagacagacacctcagtttttc

SEQ ID NO: 198441 - DNA, 42 bp, Artificial Sequence
  Description of Artificial Sequence: Synthetic oligonucleotide
tgaagaaagtgaagatgaaagagacagacacctcagtttttc

SEQ ID NO: 198442 - DNA, 41 bp, Artificial Sequence
  Description of Artificial Sequence: Synthetic oligonucleotide
gaagaaagtgaagatgaaagagacagacacctcagtttttc

SEQ ID NO: 198443 - DNA, 42 bp, Artificial Sequence
  Description of Artificial Sequence: Synthetic oligonucleotide
aagaaagtgaagatgaaagagacagacacctcagtttttctg

SEQ ID NO: 198444 - DNA, 41 bp, Artificial Sequence
  Description of Artificial Sequence: Synthetic oligonucleotide
agaaagtgaagatgaaagagacagacacctcagtttttctg

SEQ ID NO: 198445 - DNA, 40 bp, Artificial Sequence
  Description of Artificial Sequence: Synthetic oligonucleotide
gaaagtgaagatgaaagagacagacacctcagtttttctg

SEQ ID NO: 198446 - DNA, 40 bp, Artificial Sequence
  Description of Artificial Sequence: Synthetic oligonucleotide
aaagtgaagatgaaagagacagacacctcagtttttctgg

SEQ ID NO: 198447 - DNA, 39 bp, Artificial Sequence
  Description of Artificial Sequence: Synthetic oligonucleotide
aagtgaagatgaaagagacagacacctcagtttttctgg

SEQ ID NO: 198448 - DNA, 38 bp, Artificial Sequence
  Description of Artificial Sequence: Synthetic oligonucleotide
agtgaagatgaaagagacagacacctcagtttttctgg

SEQ ID NO: 198449 - DNA, 37 bp, Artificial Sequence
  Description of Artificial Sequence: Synthetic oligonucleotide
gtgaagatgaaagagacagacacctcagtttttctgg

SEQ ID NO: 198450 - DNA, 43 bp, Artificial Sequence
  Description of Artificial Sequence: Synthetic oligonucleotide
aggcattgatgatgatgaagattttatctccagcaccaatatg

SEQ ID NO: 198451 - DNA, 42 bp, Artificial Sequence
  Description of Artificial Sequence: Synthetic oligonucleotide
ggcattgatgatgatgaagattttatctccagcaccaatatg

SEQ ID NO: 198452 - DNA, 42 bp, Artificial Sequence
  Description of Artificial Sequence: Synthetic oligonucleotide
gcattgatgatgatgaagattttatctccagcaccaatatgg

SEQ ID NO: 198453 - DNA, 43 bp, Artificial Sequence
  Description of Artificial Sequence: Synthetic oligonucleotide
cattgatgatgatgaagattttatctccagcaccaatatggac

SEQ ID NO: 198454 - DNA, 44 bp, Artificial Sequence
  Description of Artificial Sequence: Synthetic oligonucleotide
attgatgatgatgaagattttatctccagcaccaatatggactc

SEQ ID NO: 198455 - DNA, 43 bp, Artificial Sequence
  Description of Artificial Sequence: Synthetic oligonucleotide
ttgatgatgatgaagattttatctccagcaccaatatggactc

SEQ ID NO: 198456 - DNA, 42 bp, Artificial Sequence
  Description of Artificial Sequence: Synthetic oligonucleotide
tgatgatgatgaagattttatctccagcaccaatatggactc

SEQ ID NO: 198457 - DNA, 41 bp, Artificial Sequence
  Description of Artificial Sequence: Synthetic oligonucleotide
gatgatgatgaagattttatctccagcaccaatatggactc

SEQ ID NO: 198458 - DNA, 41 bp, Artificial Sequence
  Description of Artificial Sequence: Synthetic oligonucleotide
atgatgatgaagattttatctccagcaccaatatggactcc

SEQ ID NO: 198459 - DNA, 40 bp, Artificial Sequence
  Description of Artificial Sequence: Synthetic oligonucleotide
tgatgatgaagattttatctccagcaccaatatggactcc

SEQ ID NO: 198460 - DNA, 39 bp, Artificial Sequence
  Description of Artificial Sequence: Synthetic oligonucleotide
gatgatgaagattttatctccagcaccaatatggactcc

SEQ ID NO: 198461 - DNA, 40 bp, Artificial Sequence
  Description of Artificial Sequence: Synthetic oligonucleotide
atgatgaagattttatctccagcaccaatatggactccag

SEQ ID NO: 198462 - DNA, 39 bp, Artificial Sequence
  Description of Artificial Sequence: Synthetic oligonucleotide
tgatgaagattttatctccagcaccaatatggactccag

SEQ ID NO: 198463 - DNA, 38 bp, Artificial Sequence
  Description of Artificial Sequence: Synthetic oligonucleotide
gatgaagattttatctccagcaccaatatggactccag

SEQ ID NO: 198464 - DNA, 39 bp, Artificial Sequence
  Description of Artificial Sequence: Synthetic oligonucleotide
atgaagattttatctccagcaccaatatggactccagtc

SEQ ID NO: 198465 - DNA, 38 bp, Artificial Sequence
  Description of Artificial Sequence: Synthetic oligonucleotide
tgaagattttatctccagcaccaatatggactccagtc

SEQ ID NO: 198466 - DNA, 37 bp, Artificial Sequence
  Description of Artificial Sequence: Synthetic oligonucleotide
gaagattttatctccagcaccaatatggactccagtc

SEQ ID NO: 198467 - DNA, 40 bp, Artificial Sequence
  Description of Artificial Sequence: Synthetic oligonucleotide
aagattttatctccagcaccaatatggactccagtcatag

SEQ ID NO: 198468 - DNA, 39 bp, Artificial Sequence
  Description of Artificial Sequence: Synthetic oligonucleotide
agattttatctccagcaccaatatggactccagtcatag

SEQ ID NO: 198469 - DNA, 38 bp, Artificial Sequence
  Description of Artificial Sequence: Synthetic oligonucleotide
gattttatctccagcaccaatatggactccagtcatag

SEQ ID NO: 198470 - DNA, 40 bp, Artificial Sequence
  Description of Artificial Sequence: Synthetic oligonucleotide
attttatctccagcaccaatatggactccagtcatagtac

SEQ ID NO: 198471 - DNA, 39 bp, Artificial Sequence
  Description of Artificial Sequence: Synthetic oligonucleotide
ttttatctccagcaccaatatggactccagtcatagtac

SEQ ID NO: 198472 - DNA, 38 bp, Artificial Sequence
  Description of Artificial Sequence: Synthetic oligonucleotide
tttatctccagcaccaatatggactccagtcatagtac

SEQ ID NO: 198473 - DNA, 37 bp, Artificial Sequence
  Description of Artificial Sequence: Synthetic oligonucleotide
ttatctccagcaccaatatggactccagtcatagtac

SEQ ID NO: 198474 - DNA, 36 bp, Artificial Sequence
  Description of Artificial Sequence: Synthetic oligonucleotide
tatctccagcaccaatatggactccagtcatagtac

SEQ ID NO: 198475 - DNA, 35 bp, Artificial Sequence
  Description of Artificial Sequence: Synthetic oligonucleotide
atctccagcaccaatatggactccagtcatagtac

SEQ ID NO: 198476 - DNA, 34 bp, Artificial Sequence
  Description of Artificial Sequence: Synthetic oligonucleotide
tctccagcaccaatatggactccagtcatagtac

SEQ ID NO: 198477 - DNA, 33 bp, Artificial Sequence
  Description of Artificial Sequence: Synthetic oligonucleotide
ctccagcaccaatatggactccagtcatagtac

SEQ ID NO: 198478 - DNA, 35 bp, Artificial Sequence
  Description of Artificial Sequence: Synthetic oligonucleotide
tccagcaccaatatggactccagtcatagtacaac

SEQ ID NO: 198479 - DNA, 34 bp, Artificial Sequence
  Description of Artificial Sequence: Synthetic oligonucleotide
ccagcaccaatatggactccagtcatagtacaac

SEQ ID NO: 198480 - DNA, 34 bp, Artificial Sequence
  Description of Artificial Sequence: Synthetic oligonucleotide
cagcaccaatatggactccagtcatagtacaacg

SEQ ID NO: 198481 - DNA, 34 bp, Artificial Sequence
  Description of Artificial Sequence: Synthetic oligonucleotide
agcaccaatatggactccagtcatagtacaacgc

SEQ ID NO: 198482 - DNA, 33 bp, Artificial Sequence
  Description of Artificial Sequence: Synthetic oligonucleotide
gcaccaatatggactccagtcatagtacaacgc

SEQ ID NO: 198483 - DNA, 35 bp, Artificial Sequence
  Description of Artificial Sequence: Synthetic oligonucleotide
caccaatatggactccagtcatagtacaacgcttc

SEQ ID NO: 198484 - DNA, 36 bp, Artificial Sequence
  Description of Artificial Sequence: Synthetic oligonucleotide
gaagaagagacccaaatcattctgaaggctcaactc

SEQ ID NO: 198485 - DNA, 41 bp, Artificial Sequence
  Description of Artificial Sequence: Synthetic oligonucleotide
aagaagagacccaaatcattctgaaggctcaactcatttac

SEQ ID NO: 198486 - DNA, 40 bp, Artificial Sequence
  Description of Artificial Sequence: Synthetic oligonucleotide
agaagagacccaaatcattctgaaggctcaactcatttac

SEQ ID NO: 198487 - DNA, 39 bp, Artificial Sequence
  Description of Artificial Sequence: Synthetic oligonucleotide
gaagagacccaaatcattctgaaggctcaactcatttac

SEQ ID NO: 198488 - DNA, 40 bp, Artificial Sequence
  Description of Artificial Sequence: Synthetic oligonucleotide
aagagacccaaatcattctgaaggctcaactcatttactg

SEQ ID NO: 198489 - DNA, 39 bp, Artificial Sequence
  Description of Artificial Sequence: Synthetic oligonucleotide
agagacccaaatcattctgaaggctcaactcatttactg

SEQ ID NO: 198490 - DNA, 38 bp, Artificial Sequence
  Description of Artificial Sequence: Synthetic oligonucleotide
gagacccaaatcattctgaaggctcaactcatttactg

SEQ ID NO: 198491 - DNA, 38 bp, Artificial Sequence
  Description of Artificial Sequence: Synthetic oligonucleotide
agacccaaatcattctgaaggctcaactcatttactgg

SEQ ID NO: 198492 - DNA, 37 bp, Artificial Sequence
  Description of Artificial Sequence: Synthetic oligonucleotide
gacccaaatcattctgaaggctcaactcatttactgg

SEQ ID NO: 198493 - DNA, 39 bp, Artificial Sequence
  Description of Artificial Sequence: Synthetic oligonucleotide
acccaaatcattctgaaggctcaactcatttactggaag

SEQ ID NO: 198494 - DNA, 38 bp, Artificial Sequence
  Description of Artificial Sequence: Synthetic oligonucleotide
cccaaatcattctgaaggctcaactcatttactggaag

SEQ ID NO: 198495 - DNA, 38 bp, Artificial Sequence
  Description of Artificial Sequence: Synthetic oligonucleotide
ccaaatcattctgaaggctcaactcatttactggaagg

SEQ ID NO: 198496 - DNA, 43 bp, Artificial Sequence
  Description of Artificial Sequence: Synthetic oligonucleotide
caaatcattctgaaggctcaactcatttactggaaggttatac

SEQ ID NO: 198497 - DNA, 43 bp, Artificial Sequence
  Description of Artificial Sequence: Synthetic oligonucleotide
aaatcattctgaaggctcaactcatttactggaaggttatacc

SEQ ID NO: 198498 - DNA, 42 bp, Artificial Sequence
  Description of Artificial Sequence: Synthetic oligonucleotide
aatcattctgaaggctcaactcatttactggaaggttatacc

SEQ ID NO: 198499 - DNA, 41 bp, Artificial Sequence
  Description of Artificial Sequence: Synthetic oligonucleotide
atcattctgaaggctcaactcatttactggaaggttatacc

SEQ ID NO: 198500 - DNA, 40 bp, Artificial Sequence
  Description of Artificial Sequence: Synthetic oligonucleotide
tcattctgaaggctcaactcatttactggaaggttatacc

SEQ ID NO: 198501 - DNA, 39 bp, Artificial Sequence
  Description of Artificial Sequence: Synthetic oligonucleotide
cattctgaaggctcaactcatttactggaaggttatacc

SEQ ID NO: 198502 - DNA, 40 bp, Artificial Sequence
  Description of Artificial Sequence: Synthetic oligonucleotide
attctgaaggctcaactcatttactggaaggttatacctc

SEQ ID NO: 198503 - DNA, 39 bp, Artificial Sequence
  Description of Artificial Sequence: Synthetic oligonucleotide
ttctgaaggctcaactcatttactggaaggttatacctc

SEQ ID NO: 198504 - DNA, 38 bp, Artificial Sequence
  Description of Artificial Sequence: Synthetic oligonucleotide
tctgaaggctcaactcatttactggaaggttatacctc

SEQ ID NO: 198505 - DNA, 37 bp, Artificial Sequence
  Description of Artificial Sequence: Synthetic oligonucleotide
ctgaaggctcaactcatttactggaaggttatacctc

SEQ ID NO: 198506 - DNA, 38 bp, Artificial Sequence
  Description of Artificial Sequence: Synthetic oligonucleotide
tgaaggctcaactcatttactggaaggttatacctctc

SEQ ID NO: 198507 - DNA, 37 bp, Artificial Sequence
  Description of Artificial Sequence: Synthetic oligonucleotide
gaaggctcaactcatttactggaaggttatacctctc

SEQ ID NO: 198508 - DNA, 41 bp, Artificial Sequence
  Description of Artificial Sequence: Synthetic oligonucleotide
aaggctcaactcatttactggaaggttatacctctcattac

SEQ ID NO: 198509 - DNA, 40 bp, Artificial Sequence
  Description of Artificial Sequence: Synthetic oligonucleotide
aggctcaactcatttactggaaggttatacctctcattac

SEQ ID NO: 198510 - DNA, 39 bp, Artificial Sequence
  Description of Artificial Sequence: Synthetic oligonucleotide
ggctcaactcatttactggaaggttatacctctcattac

SEQ ID NO: 198511 - DNA, 39 bp, Artificial Sequence
  Description of Artificial Sequence: Synthetic oligonucleotide
gctcaactcatttactggaaggttatacctctcattacc

SEQ ID NO: 198512 - DNA, 39 bp, Artificial Sequence
  Description of Artificial Sequence: Synthetic oligonucleotide
ctcaactcatttactggaaggttatacctctcattaccc

SEQ ID NO: 198513 - DNA, 40 bp, Artificial Sequence
  Description of Artificial Sequence: Synthetic oligonucleotide
tcaactcatttactggaaggttatacctctcattacccac

SEQ ID NO: 198514 - DNA, 39 bp, Artificial Sequence
  Description of Artificial Sequence: Synthetic oligonucleotide
caactcatttactggaaggttatacctctcattacccac

SEQ ID NO: 198515 - DNA, 40 bp, Artificial Sequence
  Description of Artificial Sequence: Synthetic oligonucleotide
aactcatttactggaaggttatacctctcattacccacac

SEQ ID NO: 198516 - DNA, 39 bp, Artificial Sequence
  Description of Artificial Sequence: Synthetic oligonucleotide
actcatttactggaaggttatacctctcattacccacac

SEQ ID NO: 198517 - DNA, 38 bp, Artificial Sequence
  Description of Artificial Sequence: Synthetic oligonucleotide
ctcatttactggaaggttatacctctcattacccacac

SEQ ID NO: 198518 - DNA, 39 bp, Artificial Sequence
  Description of Artificial Sequence: Synthetic oligonucleotide
tcatttactggaaggttatacctctcattacccacacac

SEQ ID NO: 198519 - DNA, 38 bp, Artificial Sequence
  Description of Artificial Sequence: Synthetic oligonucleotide
catttactggaaggttatacctctcattacccacacac

SEQ ID NO: 198520 - DNA, 38 bp, Artificial Sequence
  Description of Artificial Sequence: Synthetic oligonucleotide
atttactggaaggttatacctctcattacccacacacg

SEQ ID NO: 198521 - DNA, 34 bp, Artificial Sequence
  Description of Artificial Sequence: Synthetic oligonucleotide
ctccacctgaagaagattgtacatcagtcacagg

SEQ ID NO: 198522 - DNA, 35 bp, Artificial Sequence
  Description of Artificial Sequence: Synthetic oligonucleotide
tccacctgaagaagattgtacatcagtcacaggac

SEQ ID NO: 198523 - DNA, 34 bp, Artificial Sequence
  Description of Artificial Sequence: Synthetic oligonucleotide
ccacctgaagaagattgtacatcagtcacaggac

SEQ ID NO: 198524 - DNA, 34 bp, Artificial Sequence
  Description of Artificial Sequence: Synthetic oligonucleotide
cacctgaagaagattgtacatcagtcacaggacc

SEQ ID NO: 198525 - DNA, 35 bp, Artificial Sequence
  Description of Artificial Sequence: Synthetic oligonucleotide
acctgaagaagattgtacatcagtcacaggacctc

SEQ ID NO: 198526 - DNA, 34 bp, Artificial Sequence
  Description of Artificial Sequence: Synthetic oligonucleotide
cctgaagaagattgtacatcagtcacaggacctc

SEQ ID NO: 198527 - DNA, 37 bp, Artificial Sequence
  Description of Artificial Sequence: Synthetic oligonucleotide
ctgaagaagattgtacatcagtcacaggacctctttc

SEQ ID NO: 198528 - DNA, 40 bp, Artificial Sequence
  Description of Artificial Sequence: Synthetic oligonucleotide
tgaagaagattgtacatcagtcacaggacctctttcaatg

SEQ ID NO: 198529 - DNA, 39 bp, Artificial Sequence
  Description of Artificial Sequence: Synthetic oligonucleotide
gaagaagattgtacatcagtcacaggacctctttcaatg

SEQ ID NO: 198530 - DNA, 40 bp, Artificial Sequence
  Description of Artificial Sequence: Synthetic oligonucleotide
aagaagattgtacatcagtcacaggacctctttcaatgac

SEQ ID NO: 198531 - DNA, 39 bp, Artificial Sequence
  Description of Artificial Sequence: Synthetic oligonucleotide
agaagattgtacatcagtcacaggacctctttcaatgac

SEQ ID NO: 198532 - DNA, 38 bp, Artificial Sequence
  Description of Artificial Sequence: Synthetic oligonucleotide
gaagattgtacatcagtcacaggacctctttcaatgac

SEQ ID NO: 198533 - DNA, 40 bp, Artificial Sequence
  Description of Artificial Sequence: Synthetic oligonucleotide
aagattgtacatcagtcacaggacctctttcaatgacaac

SEQ ID NO: 198534 - DNA, 39 bp, Artificial Sequence
  Description of Artificial Sequence: Synthetic oligonucleotide
agattgtacatcagtcacaggacctctttcaatgacaac

SEQ ID NO: 198535 - DNA, 38 bp, Artificial Sequence
  Description of Artificial Sequence: Synthetic oligonucleotide
gattgtacatcagtcacaggacctctttcaatgacaac

SEQ ID NO: 198536 - DNA, 38 bp, Artificial Sequence
  Description of Artificial Sequence: Synthetic oligonucleotide
attgtacatcagtcacaggacctctttcaatgacaacg

SEQ ID NO: 198537 - DNA, 37 bp, Artificial Sequence
  Description of Artificial Sequence: Synthetic oligonucleotide
ttgtacatcagtcacaggacctctttcaatgacaacg

SEQ ID NO: 198538 - DNA, 36 bp, Artificial Sequence
  Description of Artificial Sequence: Synthetic oligonucleotide
tgtacatcagtcacaggacctctttcaatgacaacg

SEQ ID NO: 198539 - DNA, 35 bp, Artificial Sequence
  Description of Artificial Sequence: Synthetic oligonucleotide
gtacatcagtcacaggacctctttcaatgacaacg

SEQ ID NO: 198540 - DNA, 35 bp, Artificial Sequence
  Description of Artificial Sequence: Synthetic oligonucleotide
tacatcagtcacaggacctctttcaatgacaacgc

SEQ ID NO: 198541 - DNA, 34 bp, Artificial Sequence
  Description of Artificial Sequence: Synthetic oligonucleotide
acatcagtcacaggacctctttcaatgacaacgc

SEQ ID NO: 198542 - DNA, 33 bp, Artificial Sequence
  Description of Artificial Sequence: Synthetic oligonucleotide
catcagtcacaggacctctttcaatgacaacgc

SEQ ID NO: 198543 - DNA, 34 bp, Artificial Sequence
  Description of Artificial Sequence: Synthetic oligonucleotide
atcagtcacaggacctctttcaatgacaacgcag

SEQ ID NO: 198544 - DNA, 33 bp, Artificial Sequence
  Description of Artificial Sequence: Synthetic oligonucleotide
tcagtcacaggacctctttcaatgacaacgcag

SEQ ID NO: 198545 - DNA, 32 bp, Artificial Sequence
  Description of Artificial Sequence: Synthetic oligonucleotide
cagtcacaggacctctttcaatgacaacgcag

SEQ ID NO: 198546 - DNA, 32 bp, Artificial Sequence
  Description of Artificial Sequence: Synthetic oligonucleotide
agtcacaggacctctttcaatgacaacgcagc

SEQ ID NO: 198547 - DNA, 31 bp, Artificial Sequence
  Description of Artificial Sequence: Synthetic oligonucleotide
gtcacaggacctctttcaatgacaacgcagc

SEQ ID NO: 198548 - DNA, 32 bp, Artificial Sequence
  Description of Artificial Sequence: Synthetic oligonucleotide
tcacaggacctctttcaatgacaacgcagcag

SEQ ID NO: 198549 - DNA, 31 bp, Artificial Sequence
  Description of Artificial Sequence: Synthetic oligonucleotide
cacaggacctctttcaatgacaacgcagcag

SEQ ID NO: 198550 - DNA, 39 bp, Artificial Sequence
  Description of Artificial Sequence: Synthetic oligonucleotide
atgaaggcttggaagaagataaagaccatccaacaactc

SEQ ID NO: 198551 - DNA, 38 bp, Artificial Sequence
  Description of Artificial Sequence: Synthetic oligonucleotide
tgaaggcttggaagaagataaagaccatccaacaactc

SEQ ID NO: 198552 - DNA, 37 bp, Artificial Sequence
  Description of Artificial Sequence: Synthetic oligonucleotide
gaaggcttggaagaagataaagaccatccaacaactc

SEQ ID NO: 198553 - DNA, 37 bp, Artificial Sequence
  Description of Artificial Sequence: Synthetic oligonucleotide
aaggcttggaagaagataaagaccatccaacaactcc

SEQ ID NO: 198554 - DNA, 36 bp, Artificial Sequence
  Description of Artificial Sequence: Synthetic oligonucleotide
aggcttggaagaagataaagaccatccaacaactcc

SEQ ID NO: 198555 - DNA, 35 bp, Artificial Sequence
  Description of Artificial Sequence: Synthetic oligonucleotide
ggcttggaagaagataaagaccatccaacaactcc

SEQ ID NO: 198556 - DNA, 37 bp, Artificial Sequence
  Description of Artificial Sequence: Synthetic oligonucleotide
gcttggaagaagataaagaccatccaacaactcctac

SEQ ID NO: 198557 - DNA, 38 bp, Artificial Sequence
  Description of Artificial Sequence: Synthetic oligonucleotide
cttggaagaagataaagaccatccaacaactcctactc

SEQ ID NO: 198558 - DNA, 39 bp, Artificial Sequence
  Description of Artificial Sequence: Synthetic oligonucleotide
ttggaagaagataaagaccatccaacaactcctactctg

SEQ ID NO: 198559 - DNA, 38 bp, Artificial Sequence
  Description of Artificial Sequence: Synthetic oligonucleotide
tggaagaagataaagaccatccaacaactcctactctg

SEQ ID NO: 198560 - DNA, 37 bp, Artificial Sequence
  Description of Artificial Sequence: Synthetic oligonucleotide
ggaagaagataaagaccatccaacaactcctactctg

SEQ ID NO: 198561 - DNA, 38 bp, Artificial Sequence
  Description of Artificial Sequence: Synthetic oligonucleotide
gaagaagataaagaccatccaacaactcctactctgac

SEQ ID NO: 198562 - DNA, 40 bp, Artificial Sequence
  Description of Artificial Sequence: Synthetic oligonucleotide
aagaagataaagaccatccaacaactcctactctgacatc

SEQ ID NO: 198563 - DNA, 39 bp, Artificial Sequence
  Description of Artificial Sequence: Synthetic oligonucleotide
agaagataaagaccatccaacaactcctactctgacatc

SEQ ID NO: 198564 - DNA, 38 bp, Artificial Sequence
  Description of Artificial Sequence: Synthetic oligonucleotide
gaagataaagaccatccaacaactcctactctgacatc

SEQ ID NO: 198565 - DNA, 40 bp, Artificial Sequence
  Description of Artificial Sequence: Synthetic oligonucleotide
aagataaagaccatccaacaactcctactctgacatcaag

SEQ ID NO: 198566 - DNA, 39 bp, Artificial Sequence
  Description of Artificial Sequence: Synthetic oligonucleotide
agataaagaccatccaacaactcctactctgacatcaag

SEQ ID NO: 198567 - DNA, 38 bp, Artificial Sequence
  Description of Artificial Sequence: Synthetic oligonucleotide
gataaagaccatccaacaactcctactctgacatcaag

SEQ ID NO: 198568 - DNA, 38 bp, Artificial Sequence
  Description of Artificial Sequence: Synthetic oligonucleotide
ataaagaccatccaacaactcctactctgacatcaagc

SEQ ID NO: 198569 - DNA, 37 bp, Artificial Sequence
  Description of Artificial Sequence: Synthetic oligonucleotide
taaagaccatccaacaactcctactctgacatcaagc

SEQ ID NO: 198570 - DNA, 36 bp, Artificial Sequence
  Description of Artificial Sequence: Synthetic oligonucleotide
aaagaccatccaacaactcctactctgacatcaagc

SEQ ID NO: 198571 - DNA, 35 bp, Artificial Sequence
  Description of Artificial Sequence: Synthetic oligonucleotide
aagaccatccaacaactcctactctgacatcaagc

SEQ ID NO: 198572 - DNA, 34 bp, Artificial Sequence
  Description of Artificial Sequence: Synthetic oligonucleotide
agaccatccaacaactcctactctgacatcaagc

SEQ ID NO: 198573 - DNA, 33 bp, Artificial Sequence
  Description of Artificial Sequence: Synthetic oligonucleotide
gaccatccaacaactcctactctgacatcaagc

SEQ ID NO: 198574 - DNA, 37 bp, Artificial Sequence
  Description of Artificial Sequence: Synthetic oligonucleotide
accatccaacaactcctactctgacatcaagcaatag

SEQ ID NO: 198575 - DNA, 36 bp, Artificial Sequence
  Description of Artificial Sequence: Synthetic oligonucleotide
ccatccaacaactcctactctgacatcaagcaatag

SEQ ID NO: 198576 - DNA, 36 bp, Artificial Sequence
  Description of Artificial Sequence: Synthetic oligonucleotide
catccaacaactcctactctgacatcaagcaatagg

SEQ ID NO: 198577 - DNA, 39 bp, Artificial Sequence
  Description of Artificial Sequence: Synthetic oligonucleotide
atccaacaactcctactctgacatcaagcaataggaatg

SEQ ID NO: 198578 - DNA, 38 bp, Artificial Sequence
  Description of Artificial Sequence: Synthetic oligonucleotide
tccaacaactcctactctgacatcaagcaataggaatg

SEQ ID NO: 198579 - DNA, 37 bp, Artificial Sequence
  Description of Artificial Sequence: Synthetic oligonucleotide
ccaacaactcctactctgacatcaagcaataggaatg

SEQ ID NO: 198580 - DNA, 39 bp, Artificial Sequence
  Description of Artificial Sequence: Synthetic oligonucleotide
caacaactcctactctgacatcaagcaataggaatgatg

SEQ ID NO: 198581 - DNA, 40 bp, Artificial Sequence
  Description of Artificial Sequence: Synthetic oligonucleotide
aacaactcctactctgacatcaagcaataggaatgatgtc

SEQ ID NO: 198582 - DNA, 39 bp, Artificial Sequence
  Description of Artificial Sequence: Synthetic oligonucleotide
acaactcctactctgacatcaagcaataggaatgatgtc

SEQ ID NO: 198583 - DNA, 38 bp, Artificial Sequence
  Description of Artificial Sequence: Synthetic oligonucleotide
caactcctactctgacatcaagcaataggaatgatgtc

SEQ ID NO: 198584 - DNA, 39 bp, Artificial Sequence
  Description of Artificial Sequence: Synthetic oligonucleotide
aactcctactctgacatcaagcaataggaatgatgtcac

SEQ ID NO: 198585 - DNA, 38 bp, Artificial Sequence
  Description of Artificial Sequence: Synthetic oligonucleotide
actcctactctgacatcaagcaataggaatgatgtcac

SEQ ID NO: 198586 - DNA, 37 bp, Artificial Sequence
  Description of Artificial Sequence: Synthetic oligonucleotide
ctcctactctgacatcaagcaataggaatgatgtcac

SEQ ID NO: 198587 - DNA, 38 bp, Artificial Sequence
  Description of Artificial Sequence: Synthetic oligonucleotide
tcctactctgacatcaagcaataggaatgatgtcacag

SEQ ID NO: 198588 - DNA, 37 bp, Artificial Sequence
  Description of Artificial Sequence: Synthetic oligonucleotide
cctactctgacatcaagcaataggaatgatgtcacag

SEQ ID NO: 198589 - DNA, 31 bp, Artificial Sequence
  Description of Artificial Sequence: Synthetic oligonucleotide
gctgagcctggcgcagatcgatttgaatatg

SEQ ID NO: 198590 - DNA, 32 bp, Artificial Sequence
  Description of Artificial Sequence: Synthetic oligonucleotide
ctgagcctggcgcagatcgatttgaatatgac

SEQ ID NO: 198591 - DNA, 32 bp, Artificial Sequence
  Description of Artificial Sequence: Synthetic oligonucleotide
tgagcctggcgcagatcgatttgaatatgacc

SEQ ID NO: 198592 - DNA, 31 bp, Artificial Sequence
  Description of Artificial Sequence: Synthetic oligonucleotide
gagcctggcgcagatcgatttgaatatgacc

SEQ ID NO: 198593 - DNA, 32 bp, Artificial Sequence
  Description of Artificial Sequence: Synthetic oligonucleotide
agcctggcgcagatcgatttgaatatgacctg

SEQ ID NO: 198594 - DNA, 31 bp, Artificial Sequence
  Description of Artificial Sequence: Synthetic oligonucleotide
gcctggcgcagatcgatttgaatatgacctg

SEQ ID NO: 198595 - DNA, 31 bp, Artificial Sequence
  Description of Artificial Sequence: Synthetic oligonucleotide
cctggcgcagatcgatttgaatatgacctgc

SEQ ID NO: 198596 - DNA, 31 bp, Artificial Sequence
  Description of Artificial Sequence: Synthetic oligonucleotide
ctggcgcagatcgatttgaatatgacctgcc

SEQ ID NO: 198597 - DNA, 31 bp, Artificial Sequence
  Description of Artificial Sequence: Synthetic oligonucleotide
tggcgcagatcgatttgaatatgacctgccg

SEQ ID NO: 198598 - DNA, 30 bp, Artificial Sequence
  Description of Artificial Sequence: Synthetic oligonucleotide
ggcgcagatcgatttgaatatgacctgccg

SEQ ID NO: 198599 - DNA, 30 bp, Artificial Sequence
  Description of Artificial Sequence: Synthetic oligonucleotide
gcgcagatcgatttgaatatgacctgccgc

SEQ ID NO: 198600 - DNA, 33 bp, Artificial Sequence
  Description of Artificial Sequence: Synthetic oligonucleotide
cgcagatcgatttgaatatgacctgccgctttg

SEQ ID NO: 198601 - DNA, 33 bp, Artificial Sequence
  Description of Artificial Sequence: Synthetic oligonucleotide
gcagatcgatttgaatatgacctgccgctttgc

SEQ ID NO: 198602 - DNA, 34 bp, Artificial Sequence
  Description of Artificial Sequence: Synthetic oligonucleotide
cagatcgatttgaatatgacctgccgctttgcag

SEQ ID NO: 198603 - DNA, 34 bp, Artificial Sequence
  Description of Artificial Sequence: Synthetic oligonucleotide
agatcgatttgaatatgacctgccgctttgcagg

SEQ ID NO: 198604 - DNA, 33 bp, Artificial Sequence
  Description of Artificial Sequence: Synthetic oligonucleotide
gatcgatttgaatatgacctgccgctttgcagg

SEQ ID NO: 198605 - DNA, 34 bp, Artificial Sequence
  Description of Artificial Sequence: Synthetic oligonucleotide
atcgatttgaatatgacctgccgctttgcaggtg

SEQ ID NO: 198606 - DNA, 33 bp, Artificial Sequence
  Description of Artificial Sequence: Synthetic oligonucleotide
tcgatttgaatatgacctgccgctttgcaggtg

SEQ ID NO: 198607 - DNA, 32 bp, Artificial Sequence
  Description of Artificial Sequence: Synthetic oligonucleotide
cgatttgaatatgacctgccgctttgcaggtg

SEQ ID NO: 198608 - DNA, 36 bp, Artificial Sequence
  Description of Artificial Sequence: Synthetic oligonucleotide
gatttgaatatgacctgccgctttgcaggtgtattc

SEQ ID NO: 198609 - DNA, 36 bp, Artificial Sequence
  Description of Artificial Sequence: Synthetic oligonucleotide
atttgaatatgacctgccgctttgcaggtgtattcc

SEQ ID NO: 198610 - DNA, 35 bp, Artificial Sequence
  Description of Artificial Sequence: Synthetic oligonucleotide
tttgaatatgacctgccgctttgcaggtgtattcc

SEQ ID NO: 198611 - DNA, 34 bp, Artificial Sequence
  Description of Artificial Sequence: Synthetic oligonucleotide
ttgaatatgacctgccgctttgcaggtgtattcc

SEQ ID NO: 198612 - DNA, 33 bp, Artificial Sequence
  Description of Artificial Sequence: Synthetic oligonucleotide
tgaatatgacctgccgctttgcaggtgtattcc

SEQ ID NO: 198613 - DNA, 32 bp, Artificial Sequence
  Description of Artificial Sequence: Synthetic oligonucleotide
gaatatgacctgccgctttgcaggtgtattcc

SEQ ID NO: 198614 - DNA, 33 bp, Artificial Sequence
  Description of Artificial Sequence: Synthetic oligonucleotide
aatatgacctgccgctttgcaggtgtattccac

SEQ ID NO: 198615 - DNA, 32 bp, Artificial Sequence
  Description of Artificial Sequence: Synthetic oligonucleotide
atatgacctgccgctttgcaggtgtattccac

SEQ ID NO: 198616 - DNA, 31 bp, Artificial Sequence
  Description of Artificial Sequence: Synthetic oligonucleotide
tatgacctgccgctttgcaggtgtattccac

SEQ ID NO: 198617 - DNA, 30 bp, Artificial Sequence
  Description of Artificial Sequence: Synthetic oligonucleotide
atgacctgccgctttgcaggtgtattccac

SEQ ID NO: 198618 - DNA, 29 bp, Artificial Sequence
  Description of Artificial Sequence: Synthetic oligonucleotide
tgacctgccgctttgcaggtgtattccac

SEQ ID NO: 198619 - DNA, 28 bp, Artificial Sequence
  Description of Artificial Sequence: Synthetic oligonucleotide
gacctgccgctttgcaggtgtattccac

SEQ ID NO: 198620 - DNA, 29 bp, Artificial Sequence
  Description of Artificial Sequence: Synthetic oligonucleotide
gatcaccgacagcacagacagaatccctc

SEQ ID NO: 198621 - DNA, 29 bp, Artificial Sequence
  Description of Artificial Sequence: Synthetic oligonucleotide
atcaccgacagcacagacagaatccctcg

SEQ ID NO: 198622 - DNA, 28 bp, Artificial Sequence
  Description of Artificial Sequence: Synthetic oligonucleotide
tcaccgacagcacagacagaatccctcg

SEQ ID NO: 198623 - DNA, 27 bp, Artificial Sequence
  Description of Artificial Sequence: Synthetic oligonucleotide
caccgacagcacagacagaatccctcg

SEQ ID NO: 198624 - DNA, 29 bp, Artificial Sequence
  Description of Artificial Sequence: Synthetic oligonucleotide
accgacagcacagacagaatccctcgtac

SEQ ID NO: 198625 - DNA, 28 bp, Artificial Sequence
  Description of Artificial Sequence: Synthetic oligonucleotide
ccgacagcacagacagaatccctcgtac

SEQ ID NO: 198626 - DNA, 28 bp, Artificial Sequence
  Description of Artificial Sequence: Synthetic oligonucleotide
cgacagcacagacagaatccctcgtacc

SEQ ID NO: 198627 - DNA, 33 bp, Artificial Sequence
  Description of Artificial Sequence: Synthetic oligonucleotide
gacagcacagacagaatccctcgtaccaatatg

SEQ ID NO: 198628 - DNA, 33 bp, Artificial Sequence
  Description of Artificial Sequence: Synthetic oligonucleotide
acagcacagacagaatccctcgtaccaatatgg

SEQ ID NO: 198629 - DNA, 32 bp, Artificial Sequence
  Description of Artificial Sequence: Synthetic oligonucleotide
cagcacagacagaatccctcgtaccaatatgg

SEQ ID NO: 198630 - DNA, 33 bp, Artificial Sequence
  Description of Artificial Sequence: Synthetic oligonucleotide
agcacagacagaatccctcgtaccaatatggac

SEQ ID NO: 198631 - DNA, 32 bp, Artificial Sequence
  Description of Artificial Sequence: Synthetic oligonucleotide
gcacagacagaatccctcgtaccaatatggac

SEQ ID NO: 198632 - DNA, 33 bp, Artificial Sequence
  Description of Artificial Sequence: Synthetic oligonucleotide
cacagacagaatccctcgtaccaatatggactc

SEQ ID NO: 198633 - DNA, 33 bp, Artificial Sequence
  Description of Artificial Sequence: Synthetic oligonucleotide
acagacagaatccctcgtaccaatatggactcc

SEQ ID NO: 198634 - DNA, 32 bp, Artificial Sequence
  Description of Artificial Sequence: Synthetic oligonucleotide
cagacagaatccctcgtaccaatatggactcc

SEQ ID NO: 198635 - DNA, 33 bp, Artificial Sequence
  Description of Artificial Sequence: Synthetic oligonucleotide
agacagaatccctcgtaccaatatggactccag

SEQ ID NO: 198636 - DNA, 32 bp, Artificial Sequence
  Description of Artificial Sequence: Synthetic oligonucleotide
gacagaatccctcgtaccaatatggactccag

SEQ ID NO: 198637 - DNA, 33 bp, Artificial Sequence
  Description of Artificial Sequence: Synthetic oligonucleotide
acagaatccctcgtaccaatatggactccagtc

SEQ ID NO: 198638 - DNA, 32 bp, Artificial Sequence
  Description of Artificial Sequence: Synthetic oligonucleotide
cagaatccctcgtaccaatatggactccagtc

SEQ ID NO: 198639 - DNA, 35 bp, Artificial Sequence
  Description of Artificial Sequence: Synthetic oligonucleotide
agaatccctcgtaccaatatggactccagtcatag

SEQ ID NO: 198640 - DNA, 34 bp, Artificial Sequence
  Description of Artificial Sequence: Synthetic oligonucleotide
gaatccctcgtaccaatatggactccagtcatag

SEQ ID NO: 198641 - DNA, 36 bp, Artificial Sequence
  Description of Artificial Sequence: Synthetic oligonucleotide
aatccctcgtaccaatatggactccagtcatagtac

SEQ ID NO: 198642 - DNA, 35 bp, Artificial Sequence
  Description of Artificial Sequence: Synthetic oligonucleotide
atccctcgtaccaatatggactccagtcatagtac

SEQ ID NO: 198643 - DNA, 34 bp, Artificial Sequence
  Description of Artificial Sequence: Synthetic oligonucleotide
tccctcgtaccaatatggactccagtcatagtac

SEQ ID NO: 198644 - DNA, 33 bp, Artificial Sequence
  Description of Artificial Sequence: Synthetic oligonucleotide
ccctcgtaccaatatggactccagtcatagtac

SEQ ID NO: 198645 - DNA, 35 bp, Artificial Sequence
  Description of Artificial Sequence: Synthetic oligonucleotide
cctcgtaccaatatggactccagtcatagtacaac

SEQ ID NO: 198646 - DNA, 35 bp, Artificial Sequence
  Description of Artificial Sequence: Synthetic oligonucleotide
ctcgtaccaatatggactccagtcatagtacaacg

SEQ ID NO: 198647 - DNA, 35 bp, Artificial Sequence
  Description of Artificial Sequence: Synthetic oligonucleotide
tcgtaccaatatggactccagtcatagtacaacgc

SEQ ID NO: 198648 - DNA, 34 bp, Artificial Sequence
  Description of Artificial Sequence: Synthetic oligonucleotide
cgtaccaatatggactccagtcatagtacaacgc

SEQ ID NO: 198649 - DNA, 36 bp, Artificial Sequence
  Description of Artificial Sequence: Synthetic oligonucleotide
gtaccaatatggactccagtcatagtacaacgcttc

SEQ ID NO: 198650 - DNA, 33 bp, Artificial Sequence
  Description of Artificial Sequence: Synthetic oligonucleotide
aaggaacagtggtttggcaacagatggcatgtg

SEQ ID NO: 198651 - DNA, 32 bp, Artificial Sequence
  Description of Artificial Sequence: Synthetic oligonucleotide
aggaacagtggtttggcaacagatggcatgtg

SEQ ID NO: 198652 - DNA, 31 bp, Artificial Sequence
  Description of Artificial Sequence: Synthetic oligonucleotide
ggaacagtggtttggcaacagatggcatgtg

SEQ ID NO: 198653 - DNA, 31 bp, Artificial Sequence
  Description of Artificial Sequence: Synthetic oligonucleotide
gaacagtggtttggcaacagatggcatgtgg

SEQ ID NO: 198654 - DNA, 31 bp, Artificial Sequence
  Description of Artificial Sequence: Synthetic oligonucleotide
aacagtggtttggcaacagatggcatgtggg

SEQ ID NO: 198655 - DNA, 30 bp, Artificial Sequence
  Description of Artificial Sequence: Synthetic oligonucleotide
acagtggtttggcaacagatggcatgtggg

SEQ ID NO: 198656 - DNA, 29 bp, Artificial Sequence
  Description of Artificial Sequence: Synthetic oligonucleotide
cagtggtttggcaacagatggcatgtggg

SEQ ID NO: 198657 - DNA, 33 bp, Artificial Sequence
  Description of Artificial Sequence: Synthetic oligonucleotide
agtggtttggcaacagatggcatgtgggatatc

SEQ ID NO: 198658 - DNA, 32 bp, Artificial Sequence
  Description of Artificial Sequence: Synthetic oligonucleotide
gtggtttggcaacagatggcatgtgggatatc

SEQ ID NO: 198659 - DNA, 32 bp, Artificial Sequence
  Description of Artificial Sequence: Synthetic oligonucleotide
tggtttggcaacagatggcatgtgggatatcg

SEQ ID NO: 198660 - DNA, 31 bp, Artificial Sequence
  Description of Artificial Sequence: Synthetic oligonucleotide
ggtttggcaacagatggcatgtgggatatcg

SEQ ID NO: 198661 - DNA, 31 bp, Artificial Sequence
  Description of Artificial Sequence: Synthetic oligonucleotide
gtttggcaacagatggcatgtgggatatcgc

SEQ ID NO: 198662 - DNA, 31 bp, Artificial Sequence
  Description of Artificial Sequence: Synthetic oligonucleotide
tttggcaacagatggcatgtgggatatcgcc

SEQ ID NO: 198663 - DNA, 30 bp, Artificial Sequence
  Description of Artificial Sequence: Synthetic oligonucleotide
ttggcaacagatggcatgtgggatatcgcc

SEQ ID NO: 198664 - DNA, 29 bp, Artificial Sequence
  Description of Artificial Sequence: Synthetic oligonucleotide
tggcaacagatggcatgtgggatatcgcc

SEQ ID NO: 198665 - DNA, 28 bp, Artificial Sequence
  Description of Artificial Sequence: Synthetic oligonucleotide
ggcaacagatggcatgtgggatatcgcc

SEQ ID NO: 198666 - DNA, 31 bp, Artificial Sequence
  Description of Artificial Sequence: Synthetic oligonucleotide
gcaacagatggcatgtgggatatcgccaaac

SEQ ID NO: 198667 - DNA, 32 bp, Artificial Sequence
  Description of Artificial Sequence: Synthetic oligonucleotide
caacagatggcatgtgggatatcgccaaacac

SEQ ID NO: 198668 - DNA, 32 bp, Artificial Sequence
  Description of Artificial Sequence: Synthetic oligonucleotide
aacagatggcatgtgggatatcgccaaacacc

SEQ ID NO: 198669 - DNA, 31 bp, Artificial Sequence
  Description of Artificial Sequence: Synthetic oligonucleotide
acagatggcatgtgggatatcgccaaacacc

SEQ ID NO: 198670 - DNA, 30 bp, Artificial Sequence
  Description of Artificial Sequence: Synthetic oligonucleotide
cagatggcatgtgggatatcgccaaacacc

SEQ ID NO: 198671 - DNA, 30 bp, Artificial Sequence
  Description of Artificial Sequence: Synthetic oligonucleotide
agatggcatgtgggatatcgccaaacaccc

SEQ ID NO: 198672 - DNA, 29 bp, Artificial Sequence
  Description of Artificial Sequence: Synthetic oligonucleotide
gatggcatgtgggatatcgccaaacaccc

SEQ ID NO: 198673 - DNA, 32 bp, Artificial Sequence
  Description of Artificial Sequence: Synthetic oligonucleotide
atggcatgtgggatatcgccaaacacccaaag

SEQ ID NO: 198674 - DNA, 31 bp, Artificial Sequence
  Description of Artificial Sequence: Synthetic oligonucleotide
tggcatgtgggatatcgccaaacacccaaag

SEQ ID NO: 198675 - DNA, 30 bp, Artificial Sequence
  Description of Artificial Sequence: Synthetic oligonucleotide
ggcatgtgggatatcgccaaacacccaaag

SEQ ID NO: 198676 - DNA, 32 bp, Artificial Sequence
  Description of Artificial Sequence: Synthetic oligonucleotide
gcatgtgggatatcgccaaacacccaaagaag

SEQ ID NO: 198677 - DNA, 33 bp, Artificial Sequence
  Description of Artificial Sequence: Synthetic oligonucleotide
catgtgggatatcgccaaacacccaaagaagac

SEQ ID NO: 198678 - DNA, 34 bp, Artificial Sequence
  Description of Artificial Sequence: Synthetic oligonucleotide
atgtgggatatcgccaaacacccaaagaagactc

SEQ ID NO: 198679 - DNA, 33 bp, Artificial Sequence
  Description of Artificial Sequence: Synthetic oligonucleotide
tgtgggatatcgccaaacacccaaagaagactc

SEQ ID NO: 198680 - DNA, 32 bp, Artificial Sequence
  Description of Artificial Sequence: Synthetic oligonucleotide
gtgggatatcgccaaacacccaaagaagactc

SEQ ID NO: 198681 - DNA, 32 bp, Artificial Sequence
  Description of Artificial Sequence: Synthetic oligonucleotide
tgggatatcgccaaacacccaaagaagactcc

SEQ ID NO: 198682 - DNA, 30 bp, Artificial Sequence
  Description of Artificial Sequence: Synthetic oligonucleotide
atggaggacagccccactatggttagagtg

SEQ ID NO: 198683 - DNA, 29 bp, Artificial Sequence
  Description of Artificial Sequence: Synthetic oligonucleotide
tggaggacagccccactatggttagagtg

SEQ ID NO: 198684 - DNA, 28 bp, Artificial Sequence
  Description of Artificial Sequence: Synthetic oligonucleotide
ggaggacagccccactatggttagagtg

SEQ ID NO: 198685 - DNA, 28 bp, Artificial Sequence
  Description of Artificial Sequence: Synthetic oligonucleotide
gaggacagccccactatggttagagtgg

SEQ ID NO: 198686 - DNA, 29 bp, Artificial Sequence
  Description of Artificial Sequence: Synthetic oligonucleotide
aggacagccccactatggttagagtggac

SEQ ID NO: 198687 - DNA, 28 bp, Artificial Sequence
  Description of Artificial Sequence: Synthetic oligonucleotide
ggacagccccactatggttagagtggac

SEQ ID NO: 198688 - DNA, 29 bp, Artificial Sequence
  Description of Artificial Sequence: Synthetic oligonucleotide
gacagccccactatggttagagtggacag

SEQ ID NO: 198689 - DNA, 29 bp, Artificial Sequence
  Description of Artificial Sequence: Synthetic oligonucleotide
acagccccactatggttagagtggacagc

SEQ ID NO: 198690 - DNA, 28 bp, Artificial Sequence
  Description of Artificial Sequence: Synthetic oligonucleotide
cagccccactatggttagagtggacagc

SEQ ID NO: 198691 - DNA, 28 bp, Artificial Sequence
  Description of Artificial Sequence: Synthetic oligonucleotide
agccccactatggttagagtggacagcc

SEQ ID NO: 198692 - DNA, 27 bp, Artificial Sequence
  Description of Artificial Sequence: Synthetic oligonucleotide
gccccactatggttagagtggacagcc

SEQ ID NO: 198693 - DNA, 27 bp, Artificial Sequence
  Description of Artificial Sequence: Synthetic oligonucleotide
ccccactatggttagagtggacagccc

SEQ ID NO: 198694 - DNA, 27 bp, Artificial Sequence
  Description of Artificial Sequence: Synthetic oligonucleotide
cccactatggttagagtggacagcccc

SEQ ID NO: 198695 - DNA, 28 bp, Artificial Sequence
  Description of Artificial Sequence: Synthetic oligonucleotide
ccactatggttagagtggacagccccac

SEQ ID NO: 198696 - DNA, 31 bp, Artificial Sequence
  Description of Artificial Sequence: Synthetic oligonucleotide
cactatggttagagtggacagccccactatg

SEQ ID NO: 198697 - DNA, 31 bp, Artificial Sequence
  Description of Artificial Sequence: Synthetic oligonucleotide
actatggttagagtggacagccccactatgg

SEQ ID NO: 198698 - DNA, 30 bp, Artificial Sequence
  Description of Artificial Sequence: Synthetic oligonucleotide
ctatggttagagtggacagccccactatgg

SEQ ID NO: 198699 - DNA, 33 bp, Artificial Sequence
  Description of Artificial Sequence: Synthetic oligonucleotide
tatggttagagtggacagccccactatggttag

SEQ ID NO: 198700 - DNA, 32 bp, Artificial Sequence
  Description of Artificial Sequence: Synthetic oligonucleotide
atggttagagtggacagccccactatggttag

SEQ ID NO: 198701 - DNA, 31 bp, Artificial Sequence
  Description of Artificial Sequence: Synthetic oligonucleotide
tggttagagtggacagccccactatggttag

SEQ ID NO: 198702 - DNA, 30 bp, Artificial Sequence
  Description of Artificial Sequence: Synthetic oligonucleotide
ggttagagtggacagccccactatggttag

SEQ ID NO: 198703 - DNA, 30 bp, Artificial Sequence
  Description of Artificial Sequence: Synthetic oligonucleotide
gttagagtggacagccccactatggttagg

SEQ ID NO: 198704 - DNA, 30 bp, Artificial Sequence
  Description of Artificial Sequence: Synthetic oligonucleotide
ttagagtggacagccccactatggttaggg

SEQ ID NO: 198705 - DNA, 29 bp, Artificial Sequence
  Description of Artificial Sequence: Synthetic oligonucleotide
tagagtggacagccccactatggttaggg

SEQ ID NO: 198706 - DNA, 28 bp, Artificial Sequence
  Description of Artificial Sequence: Synthetic oligonucleotide
agagtggacagccccactatggttaggg

SEQ ID NO: 198707 - DNA, 27 bp, Artificial Sequence
  Description of Artificial Sequence: Synthetic oligonucleotide
gagtggacagccccactatggttaggg

SEQ ID NO: 198708 - DNA, 27 bp, Artificial Sequence
  Description of Artificial Sequence: Synthetic oligonucleotide
agtggacagccccactatggttagggg

SEQ ID NO: 198709 - DNA, 27 bp, Artificial Sequence
  Description of Artificial Sequence: Synthetic oligonucleotide
gtggacagccccactatggttaggggt

SEQ ID NO: 198710 - DNA, 27 bp, Artificial Sequence
  Description of Artificial Sequence: Synthetic oligonucleotide
tggacagccccactatggttaggggtg

SEQ ID NO: 198711 - DNA, 27 bp, Artificial Sequence
  Description of Artificial Sequence: Synthetic oligonucleotide
ggacagccccactatggttaggggtga

SEQ ID NO: 198712 - DNA, 30 bp, Artificial Sequence
  Description of Artificial Sequence: Synthetic oligonucleotide
gacagccccactatggttaggggtgaaaac

SEQ ID NO: 198713 - DNA, 30 bp, Artificial Sequence
  Description of Artificial Sequence: Synthetic oligonucleotide
acagccccactatggttaggggtgaaaacc

SEQ ID NO: 198714 - DNA, 29 bp, Artificial Sequence
  Description of Artificial Sequence: Synthetic oligonucleotide
cagccccactatggttaggggtgaaaacc

SEQ ID NO: 198715 - DNA, 30 bp, Artificial Sequence
  Description of Artificial Sequence: Synthetic oligonucleotide
agccccactatggttaggggtgaaaaccag

SEQ ID NO: 198716 - DNA, 29 bp, Artificial Sequence
  Description of Artificial Sequence: Synthetic oligonucleotide
gccccactatggttaggggtgaaaaccag

SEQ ID NO: 198717 - DNA, 29 bp, Artificial Sequence
  Description of Artificial Sequence: Synthetic oligonucleotide
ccccactatggttaggggtgaaaaccagg

SEQ ID NO: 198718 - DNA, 32 bp, Artificial Sequence
  Description of Artificial Sequence: Synthetic oligonucleotide
cccactatggttaggggtgaaaaccaggtttc

SEQ ID NO: 198719 - DNA, 32 bp, Artificial Sequence
  Description of Artificial Sequence: Synthetic oligonucleotide
ccactatggttaggggtgaaaaccaggtttcg

SEQ ID NO: 198720 - DNA, 32 bp, Artificial Sequence
  Description of Artificial Sequence: Synthetic oligonucleotide
cactatggttaggggtgaaaaccaggtttcgc

SEQ ID NO: 198721 - DNA, 32 bp, Artificial Sequence
  Description of Artificial Sequence: Synthetic oligonucleotide
actatggttaggggtgaaaaccaggtttcgcc

SEQ ID NO: 198722 - DNA, 31 bp, Artificial Sequence
  Description of Artificial Sequence: Synthetic oligonucleotide
ctatggttaggggtgaaaaccaggtttcgcc

SEQ ID NO: 198723 - DNA, 33 bp, Artificial Sequence
  Description of Artificial Sequence: Synthetic oligonucleotide
tatggttaggggtgaaaaccaggtttcgccatg

SEQ ID NO: 198724 - DNA, 32 bp, Artificial Sequence
  Description of Artificial Sequence: Synthetic oligonucleotide
atggttaggggtgaaaaccaggtttcgccatg

SEQ ID NO: 198725 - DNA, 31 bp, Artificial Sequence
  Description of Artificial Sequence: Synthetic oligonucleotide
tggttaggggtgaaaaccaggtttcgccatg

SEQ ID NO: 198726 - DNA, 30 bp, Artificial Sequence
  Description of Artificial Sequence: Synthetic oligonucleotide
ggttaggggtgaaaaccaggtttcgccatg

SEQ ID NO: 198727 - DNA, 31 bp, Artificial Sequence
  Description of Artificial Sequence: Synthetic oligonucleotide
gttaggggtgaaaaccaggtttcgccatgtc

SEQ ID NO: 198728 - DNA, 33 bp, Artificial Sequence
  Description of Artificial Sequence: Synthetic oligonucleotide
ttaggggtgaaaaccaggtttcgccatgtcaag

SEQ ID NO: 198729 - DNA, 32 bp, Artificial Sequence
  Description of Artificial Sequence: Synthetic oligonucleotide
taggggtgaaaaccaggtttcgccatgtcaag

SEQ ID NO: 198730 - DNA, 31 bp, Artificial Sequence
  Description of Artificial Sequence: Synthetic oligonucleotide
aggggtgaaaaccaggtttcgccatgtcaag

SEQ ID NO: 198731 - DNA, 30 bp, Artificial Sequence
  Description of Artificial Sequence: Synthetic oligonucleotide
ggggtgaaaaccaggtttcgccatgtcaag

SEQ ID NO: 198732 - DNA, 30 bp, Artificial Sequence
  Description of Artificial Sequence: Synthetic oligonucleotide
gggtgaaaaccaggtttcgccatgtcaagg

SEQ ID NO: 198733 - DNA, 30 bp, Artificial Sequence
  Description of Artificial Sequence: Synthetic oligonucleotide
ggtgaaaaccaggtttcgccatgtcaaggg

SEQ ID NO: 198734 - DNA, 31 bp, Artificial Sequence
  Description of Artificial Sequence: Synthetic oligonucleotide
gtgaaaaccaggtttcgccatgtcaagggag

SEQ ID NO: 198735 - DNA, 33 bp, Artificial Sequence
  Description of Artificial Sequence: Synthetic oligonucleotide
tgaaaaccaggtttcgccatgtcaagggagaag

SEQ ID NO: 198736 - DNA, 32 bp, Artificial Sequence
  Description of Artificial Sequence: Synthetic oligonucleotide
gaaaaccaggtttcgccatgtcaagggagaag

SEQ ID NO: 198737 - DNA, 32 bp, Artificial Sequence
  Description of Artificial Sequence: Synthetic oligonucleotide
aaaaccaggtttcgccatgtcaagggagaagg

SEQ ID NO: 198738 - DNA, 31 bp, Artificial Sequence
  Description of Artificial Sequence: Synthetic oligonucleotide
aaaccaggtttcgccatgtcaagggagaagg

SEQ ID NO: 198739 - DNA, 30 bp, Artificial Sequence
  Description of Artificial Sequence: Synthetic oligonucleotide
aaccaggtttcgccatgtcaagggagaagg

SEQ ID NO: 198740 - DNA, 29 bp, Artificial Sequence
  Description of Artificial Sequence: Synthetic oligonucleotide
accaggtttcgccatgtcaagggagaagg

SEQ ID NO: 198741 - DNA, 28 bp, Artificial Sequence
  Description of Artificial Sequence: Synthetic oligonucleotide
ccaggtttcgccatgtcaagggagaagg

SEQ ID NO: 198742 - DNA, 29 bp, Artificial Sequence
  Description of Artificial Sequence: Synthetic oligonucleotide
caggtttcgccatgtcaagggagaaggtg

SEQ ID NO: 198743 - DNA, 29 bp, Artificial Sequence
  Description of Artificial Sequence: Synthetic oligonucleotide
aggtttcgccatgtcaagggagaaggtgc

SEQ ID NO: 198744 - DNA, 28 bp, Artificial Sequence
  Description of Artificial Sequence: Synthetic oligonucleotide
ggtttcgccatgtcaagggagaaggtgc

SEQ ID NO: 198745 - DNA, 30 bp, Artificial Sequence
  Description of Artificial Sequence: Synthetic oligonucleotide
gtttcgccatgtcaagggagaaggtgcttc

SEQ ID NO: 198746 - DNA, 30 bp, Artificial Sequence
  Description of Artificial Sequence: Synthetic oligonucleotide
tttcgccatgtcaagggagaaggtgcttcc

SEQ ID NO: 198747 - DNA, 29 bp, Artificial Sequence
  Description of Artificial Sequence: Synthetic oligonucleotide
ttcgccatgtcaagggagaaggtgcttcc

SEQ ID NO: 198748 - DNA, 28 bp, Artificial Sequence
  Description of Artificial Sequence: Synthetic oligonucleotide
tcgccatgtcaagggagaaggtgcttcc

SEQ ID NO: 198749 - DNA, 27 bp, Artificial Sequence
  Description of Artificial Sequence: Synthetic oligonucleotide
cgccatgtcaagggagaaggtgcttcc

SEQ ID NO: 198750 - DNA, 27 bp, Artificial Sequence
  Description of Artificial Sequence: Synthetic oligonucleotide
gccatgtcaagggagaaggtgcttccc

SEQ ID NO: 198751 - DNA, 27 bp, Artificial Sequence
  Description of Artificial Sequence: Synthetic oligonucleotide
ccatgtcaagggagaaggtgcttcccc

SEQ ID NO: 198752 - DNA, 30 bp, Artificial Sequence
  Description of Artificial Sequence: Synthetic oligonucleotide
catgtcaagggagaaggtgcttccccaaag

SEQ ID NO: 198753 - DNA, 30 bp, Artificial Sequence
  Description of Artificial Sequence: Synthetic oligonucleotide
atgtcaagggagaaggtgcttccccaaagc

SEQ ID NO: 198754 - DNA, 29 bp, Artificial Sequence
  Description of Artificial Sequence: Synthetic oligonucleotide
tgtcaagggagaaggtgcttccccaaagc

SEQ ID NO: 198755 - DNA, 28 bp, Artificial Sequence
  Description of Artificial Sequence: Synthetic oligonucleotide
gtcaagggagaaggtgcttccccaaagc

SEQ ID NO: 198756 - DNA, 29 bp, Artificial Sequence
  Description of Artificial Sequence: Synthetic oligonucleotide
tcaagggagaaggtgcttccccaaagctc

SEQ ID NO: 198757 - DNA, 28 bp, Artificial Sequence
  Description of Artificial Sequence: Synthetic oligonucleotide
caagggagaaggtgcttccccaaagctc

SEQ ID NO: 198758 - DNA, 30 bp, Artificial Sequence
  Description of Artificial Sequence: Synthetic oligonucleotide
aagggagaaggtgcttccccaaagctcttg

SEQ ID NO: 198759 - DNA, 29 bp, Artificial Sequence
  Description of Artificial Sequence: Synthetic oligonucleotide
agggagaaggtgcttccccaaagctcttg

SEQ ID NO: 198760 - DNA, 28 bp, Artificial Sequence
  Description of Artificial Sequence: Synthetic oligonucleotide
gggagaaggtgcttccccaaagctcttg

SEQ ID NO: 198761 - DNA, 28 bp, Artificial Sequence
  Description of Artificial Sequence: Synthetic oligonucleotide
ggagaaggtgcttccccaaagctcttgg

SEQ ID NO: 198762 - DNA, 28 bp, Artificial Sequence
  Description of Artificial Sequence: Synthetic oligonucleotide
gagaaggtgcttccccaaagctcttggc

SEQ ID NO: 198763 - DNA, 31 bp, Artificial Sequence
  Description of Artificial Sequence: Synthetic oligonucleotide
agaaggtgcttccccaaagctcttggctatg

SEQ ID NO: 198764 - DNA, 30 bp, Artificial Sequence
  Description of Artificial Sequence: Synthetic oligonucleotide
gaaggtgcttccccaaagctcttggctatg

SEQ ID NO: 198765 - DNA, 31 bp, Artificial Sequence
  Description of Artificial Sequence: Synthetic oligonucleotide
aaggtgcttccccaaagctcttggctatgtc

SEQ ID NO: 198766 - DNA, 30 bp, Artificial Sequence
  Description of Artificial Sequence: Synthetic oligonucleotide
aggtgcttccccaaagctcttggctatgtc

SEQ ID NO: 198767 - DNA, 29 bp, Artificial Sequence
  Description of Artificial Sequence: Synthetic oligonucleotide
ggtgcttccccaaagctcttggctatgtc

SEQ ID NO: 198768 - DNA, 30 bp, Artificial Sequence
  Description of Artificial Sequence: Synthetic oligonucleotide
gtgcttccccaaagctcttggctatgtcac

SEQ ID NO: 198769 - DNA, 30 bp, Artificial Sequence
  Description of Artificial Sequence: Synthetic oligonucleotide
tgcttccccaaagctcttggctatgtcacc

SEQ ID NO: 198770 - DNA, 29 bp, Artificial Sequence
  Description of Artificial Sequence: Synthetic oligonucleotide
gcttccccaaagctcttggctatgtcacc

SEQ ID NO: 198771 - DNA, 29 bp, Artificial Sequence
  Description of Artificial Sequence: Synthetic oligonucleotide
cttccccaaagctcttggctatgtcaccg

SEQ ID NO: 198772 - DNA, 29 bp, Artificial Sequence
  Description of Artificial Sequence: Synthetic oligonucleotide
ttccccaaagctcttggctatgtcaccgg

SEQ ID NO: 198773 - DNA, 28 bp, Artificial Sequence
  Description of Artificial Sequence: Synthetic oligonucleotide
tccccaaagctcttggctatgtcaccgg

SEQ ID NO: 198774 - DNA, 27 bp, Artificial Sequence
  Description of Artificial Sequence: Synthetic oligonucleotide
ccccaaagctcttggctatgtcaccgg

SEQ ID NO: 198775 - DNA, 28 bp, Artificial Sequence
  Description of Artificial Sequence: Synthetic oligonucleotide
cccaaagctcttggctatgtcaccggtg

SEQ ID NO: 198776 - DNA, 29 bp, Artificial Sequence
  Description of Artificial Sequence: Synthetic oligonucleotide
ccaaagctcttggctatgtcaccggtgac

SEQ ID NO: 198777 - DNA, 31 bp, Artificial Sequence
  Description of Artificial Sequence: Synthetic oligonucleotide
caaagctcttggctatgtcaccggtgacatg

SEQ ID NO: 198778 - DNA, 34 bp, Artificial Sequence
  Description of Artificial Sequence: Synthetic oligonucleotide
aaagctcttggctatgtcaccggtgacatgaaag

SEQ ID NO: 198779 - DNA, 33 bp, Artificial Sequence
  Description of Artificial Sequence: Synthetic oligonucleotide
aagctcttggctatgtcaccggtgacatgaaag

SEQ ID NO: 198780 - DNA, 32 bp, Artificial Sequence
  Description of Artificial Sequence: Synthetic oligonucleotide
agctcttggctatgtcaccggtgacatgaaag

SEQ ID NO: 198781 - DNA, 31 bp, Artificial Sequence
  Description of Artificial Sequence: Synthetic oligonucleotide
gctcttggctatgtcaccggtgacatgaaag

SEQ ID NO: 198782 - DNA, 33 bp, Artificial Sequence
  Description of Artificial Sequence: Synthetic oligonucleotide
ctcttggctatgtcaccggtgacatgaaagaac

SEQ ID NO: 198783 - DNA, 35 bp, Artificial Sequence
  Description of Artificial Sequence: Synthetic oligonucleotide
tcttggctatgtcaccggtgacatgaaagaacttg

SEQ ID NO: 198784 - DNA, 34 bp, Artificial Sequence
  Description of Artificial Sequence: Synthetic oligonucleotide
cttggctatgtcaccggtgacatgaaagaacttg

SEQ ID NO: 198785 - DNA, 34 bp, Artificial Sequence
  Description of Artificial Sequence: Synthetic oligonucleotide
ttggctatgtcaccggtgacatgaaagaacttgc

SEQ ID NO: 198786 - DNA, 33 bp, Artificial Sequence
  Description of Artificial Sequence: Synthetic oligonucleotide
tggctatgtcaccggtgacatgaaagaacttgc

SEQ ID NO: 198787 - DNA, 32 bp, Artificial Sequence
  Description of Artificial Sequence: Synthetic oligonucleotide
ggctatgtcaccggtgacatgaaagaacttgc

SEQ ID NO: 198788 - DNA, 32 bp, Artificial Sequence
  Description of Artificial Sequence: Synthetic oligonucleotide
gctatgtcaccggtgacatgaaagaacttgcc

SEQ ID NO: 198789 - DNA, 34 bp, Artificial Sequence
  Description of Artificial Sequence: Synthetic oligonucleotide
ctatgtcaccggtgacatgaaagaacttgccaac

SEQ ID NO: 198790 - DNA, 34 bp, Artificial Sequence
  Description of Artificial Sequence: Synthetic oligonucleotide
tatgtcaccggtgacatgaaagaacttgccaacc

SEQ ID NO: 198791 - DNA, 33 bp, Artificial Sequence
  Description of Artificial Sequence: Synthetic oligonucleotide
atgtcaccggtgacatgaaagaacttgccaacc

SEQ ID NO: 198792 - DNA, 32 bp, Artificial Sequence
  Description of Artificial Sequence: Synthetic oligonucleotide
tgtcaccggtgacatgaaagaacttgccaacc

SEQ ID NO: 198793 - DNA, 31 bp, Artificial Sequence
  Description of Artificial Sequence: Synthetic oligonucleotide
gtcaccggtgacatgaaagaacttgccaacc

SEQ ID NO: 198794 - DNA, 32 bp, Artificial Sequence
  Description of Artificial Sequence: Synthetic oligonucleotide
tcaccggtgacatgaaagaacttgccaaccag

SEQ ID NO: 198795 - DNA, 31 bp, Artificial Sequence
  Description of Artificial Sequence: Synthetic oligonucleotide
caccggtgacatgaaagaacttgccaaccag

SEQ ID NO: 198796 - DNA, 31 bp, Artificial Sequence
  Description of Artificial Sequence: Synthetic oligonucleotide
accggtgacatgaaagaacttgccaaccagc

SEQ ID NO: 198797 - DNA, 30 bp, Artificial Sequence
  Description of Artificial Sequence: Synthetic oligonucleotide
ccggtgacatgaaagaacttgccaaccagc

SEQ ID NO: 198798 - DNA, 35 bp, Artificial Sequence
  Description of Artificial Sequence: Synthetic oligonucleotide
cggtgacatgaaagaacttgccaaccagcttaaag

SEQ ID NO: 198799 - DNA, 36 bp, Artificial Sequence
  Description of Artificial Sequence: Synthetic oligonucleotide
ggtgacatgaaagaacttgccaaccagcttaaagac

SEQ ID NO: 198800 - DNA, 39 bp, Artificial Sequence
  Description of Artificial Sequence: Synthetic oligonucleotide
gtgacatgaaagaacttgccaaccagcttaaagacaaac

SEQ ID NO: 198801 - DNA, 39 bp, Artificial Sequence
  Description of Artificial Sequence: Synthetic oligonucleotide
tgacatgaaagaacttgccaaccagcttaaagacaaacc

SEQ ID NO: 198802 - DNA, 38 bp, Artificial Sequence
  Description of Artificial Sequence: Synthetic oligonucleotide
gacatgaaagaacttgccaaccagcttaaagacaaacc

SEQ ID NO: 198803 - DNA, 38 bp, Artificial Sequence
  Description of Artificial Sequence: Synthetic oligonucleotide
acatgaaagaacttgccaaccagcttaaagacaaaccc

SEQ ID NO: 198804 - DNA, 37 bp, Artificial Sequence
  Description of Artificial Sequence: Synthetic oligonucleotide
catgaaagaacttgccaaccagcttaaagacaaaccc

SEQ ID NO: 198805 - DNA, 37 bp, Artificial Sequence
  Description of Artificial Sequence: Synthetic oligonucleotide
atgaaagaacttgccaaccagcttaaagacaaacccg

SEQ ID NO: 198806 - DNA, 36 bp, Artificial Sequence
  Description of Artificial Sequence: Synthetic oligonucleotide
tgaaagaacttgccaaccagcttaaagacaaacccg

SEQ ID NO: 198807 - DNA, 35 bp, Artificial Sequence
  Description of Artificial Sequence: Synthetic oligonucleotide
gaaagaacttgccaaccagcttaaagacaaacccg

SEQ ID NO: 198808 - DNA, 36 bp, Artificial Sequence
  Description of Artificial Sequence: Synthetic oligonucleotide
aaagaacttgccaaccagcttaaagacaaacccgtg

SEQ ID NO: 198809 - DNA, 35 bp, Artificial Sequence
  Description of Artificial Sequence: Synthetic oligonucleotide
aagaacttgccaaccagcttaaagacaaacccgtg

SEQ ID NO: 198810 - DNA, 34 bp, Artificial Sequence
  Description of Artificial Sequence: Synthetic oligonucleotide
agaacttgccaaccagcttaaagacaaacccgtg

SEQ ID NO: 198811 - DNA, 33 bp, Artificial Sequence
  Description of Artificial Sequence: Synthetic oligonucleotide
gaacttgccaaccagcttaaagacaaacccgtg

SEQ ID NO: 198812 - DNA, 33 bp, Artificial Sequence
  Description of Artificial Sequence: Synthetic oligonucleotide
aacttgccaaccagcttaaagacaaacccgtgg

SEQ ID NO: 198813 - DNA, 32 bp, Artificial Sequence
  Description of Artificial Sequence: Synthetic oligonucleotide
acttgccaaccagcttaaagacaaacccgtgg

SEQ ID NO: 198814 - DNA, 31 bp, Artificial Sequence
  Description of Artificial Sequence: Synthetic oligonucleotide
cttgccaaccagcttaaagacaaacccgtgg

SEQ ID NO: 198815 - DNA, 32 bp, Artificial Sequence
  Description of Artificial Sequence: Synthetic oligonucleotide
ttgccaaccagcttaaagacaaacccgtggtg

SEQ ID NO: 198816 - DNA, 31 bp, Artificial Sequence
  Description of Artificial Sequence: Synthetic oligonucleotide
tgccaaccagcttaaagacaaacccgtggtg

SEQ ID NO: 198817 - DNA, 30 bp, Artificial Sequence
  Description of Artificial Sequence: Synthetic oligonucleotide
gccaaccagcttaaagacaaacccgtggtg

SEQ ID NO: 198818 - DNA, 30 bp, Artificial Sequence
  Description of Artificial Sequence: Synthetic oligonucleotide
ccaaccagcttaaagacaaacccgtggtgc

SEQ ID NO: 198819 - DNA, 31 bp, Artificial Sequence
  Description of Artificial Sequence: Synthetic oligonucleotide
caaccagcttaaagacaaacccgtggtgctc

SEQ ID NO: 198820 - DNA, 31 bp, Artificial Sequence
  Description of Artificial Sequence: Synthetic oligonucleotide
aaccagcttaaagacaaacccgtggtgctcc

SEQ ID NO: 198821 - DNA, 30 bp, Artificial Sequence
  Description of Artificial Sequence: Synthetic oligonucleotide
accagcttaaagacaaacccgtggtgctcc

SEQ ID NO: 198822 - DNA, 29 bp, Artificial Sequence
  Description of Artificial Sequence: Synthetic oligonucleotide
ccagcttaaagacaaacccgtggtgctcc

SEQ ID NO: 198823 - DNA, 30 bp, Artificial Sequence
  Description of Artificial Sequence: Synthetic oligonucleotide
cagcttaaagacaaacccgtggtgctccag

SEQ ID NO: 198824 - DNA, 32 bp, Artificial Sequence
  Description of Artificial Sequence: Synthetic oligonucleotide
agcttaaagacaaacccgtggtgctccagttc

SEQ ID NO: 198825 - DNA, 31 bp, Artificial Sequence
  Description of Artificial Sequence: Synthetic oligonucleotide
gcttaaagacaaacccgtggtgctccagttc

SEQ ID NO: 198826 - DNA, 34 bp, Artificial Sequence
  Description of Artificial Sequence: Synthetic oligonucleotide
cttaaagacaaacccgtggtgctccagttcattg

SEQ ID NO: 198827 - DNA, 35 bp, Artificial Sequence
  Description of Artificial Sequence: Synthetic oligonucleotide
ttaaagacaaacccgtggtgctccagttcattgac

SEQ ID NO: 198828 - DNA, 34 bp, Artificial Sequence
  Description of Artificial Sequence: Synthetic oligonucleotide
taaagacaaacccgtggtgctccagttcattgac

SEQ ID NO: 198829 - DNA, 33 bp, Artificial Sequence
  Description of Artificial Sequence: Synthetic oligonucleotide
aaagacaaacccgtggtgctccagttcattgac

SEQ ID NO: 198830 - DNA, 32 bp, Artificial Sequence
  Description of Artificial Sequence: Synthetic oligonucleotide
aagacaaacccgtggtgctccagttcattgac

SEQ ID NO: 198831 - DNA, 31 bp, Artificial Sequence
  Description of Artificial Sequence: Synthetic oligonucleotide
agacaaacccgtggtgctccagttcattgac

SEQ ID NO: 198832 - DNA, 30 bp, Artificial Sequence
  Description of Artificial Sequence: Synthetic oligonucleotide
gacaaacccgtggtgctccagttcattgac

SEQ ID NO: 198833 - DNA, 31 bp, Artificial Sequence
  Description of Artificial Sequence: Synthetic oligonucleotide
acaaacccgtggtgctccagttcattgactg

SEQ ID NO: 198834 - DNA, 30 bp, Artificial Sequence
  Description of Artificial Sequence: Synthetic oligonucleotide
caaacccgtggtgctccagttcattgactg

SEQ ID NO: 198835 - DNA, 30 bp, Artificial Sequence
  Description of Artificial Sequence: Synthetic oligonucleotide
aaacccgtggtgctccagttcattgactgg

SEQ ID NO: 198836 - DNA, 29 bp, Artificial Sequence
  Description of Artificial Sequence: Synthetic oligonucleotide
aacccgtggtgctccagttcattgactgg

SEQ ID NO: 198837 - DNA, 28 bp, Artificial Sequence
  Description of Artificial Sequence: Synthetic oligonucleotide
acccgtggtgctccagttcattgactgg

SEQ ID NO: 198838 - DNA, 27 bp, Artificial Sequence
  Description of Artificial Sequence: Synthetic oligonucleotide
cccgtggtgctccagttcattgactgg

SEQ ID NO: 198839 - DNA, 30 bp, Artificial Sequence
  Description of Artificial Sequence: Synthetic oligonucleotide
ccgtggtgctccagttcattgactggattc

SEQ ID NO: 198840 - DNA, 31 bp, Artificial Sequence
  Description of Artificial Sequence: Synthetic oligonucleotide
cgtggtgctccagttcattgactggattctc

SEQ ID NO: 198841 - DNA, 31 bp, Artificial Sequence
  Description of Artificial Sequence: Synthetic oligonucleotide
gtggtgctccagttcattgactggattctcc

SEQ ID NO: 198842 - DNA, 31 bp, Artificial Sequence
  Description of Artificial Sequence: Synthetic oligonucleotide
tggtgctccagttcattgactggattctccg

SEQ ID NO: 198843 - DNA, 30 bp, Artificial Sequence
  Description of Artificial Sequence: Synthetic oligonucleotide
ggtgctccagttcattgactggattctccg

SEQ ID NO: 198844 - DNA, 30 bp, Artificial Sequence
  Description of Artificial Sequence: Synthetic oligonucleotide
gtgctccagttcattgactggattctccgg

SEQ ID NO: 198845 - DNA, 30 bp, Artificial Sequence
  Description of Artificial Sequence: Synthetic oligonucleotide
tgctccagttcattgactggattctccggg

SEQ ID NO: 198846 - DNA, 29 bp, Artificial Sequence
  Description of Artificial Sequence: Synthetic oligonucleotide
gctccagttcattgactggattctccggg

SEQ ID NO: 198847 - DNA, 29 bp, Artificial Sequence
  Description of Artificial Sequence: Synthetic oligonucleotide
ctccagttcattgactggattctccgggg

SEQ ID NO: 198848 - DNA, 29 bp, Artificial Sequence
  Description of Artificial Sequence: Synthetic oligonucleotide
tccagttcattgactggattctccggggc

SEQ ID NO: 198849 - DNA, 28 bp, Artificial Sequence
  Description of Artificial Sequence: Synthetic oligonucleotide
ccagttcattgactggattctccggggc

SEQ ID NO: 198850 - DNA, 32 bp, Artificial Sequence
  Description of Artificial Sequence: Synthetic oligonucleotide
cagttcattgactggattctccggggcatatc

SEQ ID NO: 198851 - DNA, 32 bp, Artificial Sequence
  Description of Artificial Sequence: Synthetic oligonucleotide
agttcattgactggattctccggggcatatcc

SEQ ID NO: 198852 - DNA, 31 bp, Artificial Sequence
  Description of Artificial Sequence: Synthetic oligonucleotide
gttcattgactggattctccggggcatatcc

SEQ ID NO: 198853 - DNA, 31 bp, Artificial Sequence
  Description of Artificial Sequence: Synthetic oligonucleotide
ttcattgactggattctccggggcatatccc

SEQ ID NO: 198854 - DNA, 30 bp, Artificial Sequence
  Description of Artificial Sequence: Synthetic oligonucleotide
tcattgactggattctccggggcatatccc

SEQ ID NO: 198855 - DNA, 29 bp, Artificial Sequence
  Description of Artificial Sequence: Synthetic oligonucleotide
cattgactggattctccggggcatatccc

SEQ ID NO: 198856 - DNA, 31 bp, Artificial Sequence
  Description of Artificial Sequence: Synthetic oligonucleotide
attgactggattctccggggcatatcccaag

SEQ ID NO: 198857 - DNA, 30 bp, Artificial Sequence
  Description of Artificial Sequence: Synthetic oligonucleotide
ttgactggattctccggggcatatcccaag

SEQ ID NO: 198858 - DNA, 29 bp, Artificial Sequence
  Description of Artificial Sequence: Synthetic oligonucleotide
tgactggattctccggggcatatcccaag

SEQ ID NO: 198859 - DNA, 28 bp, Artificial Sequence
  Description of Artificial Sequence: Synthetic oligonucleotide
gactggattctccggggcatatcccaag

SEQ ID NO: 198860 - DNA, 29 bp, Artificial Sequence
  Description of Artificial Sequence: Synthetic oligonucleotide
actggattctccggggcatatcccaagtg

SEQ ID NO: 198861 - DNA, 28 bp, Artificial Sequence
  Description of Artificial Sequence: Synthetic oligonucleotide
ctggattctccggggcatatcccaagtg

SEQ ID NO: 198862 - DNA, 28 bp, Artificial Sequence
  Description of Artificial Sequence: Synthetic oligonucleotide
tggattctccggggcatatcccaagtgg

SEQ ID NO: 198863 - DNA, 27 bp, Artificial Sequence
  Description of Artificial Sequence: Synthetic oligonucleotide
ggattctccggggcatatcccaagtgg

SEQ ID NO: 198864 - DNA, 28 bp, Artificial Sequence
  Description of Artificial Sequence: Synthetic oligonucleotide
gattctccggggcatatcccaagtggtg

SEQ ID NO: 198865 - DNA, 30 bp, Artificial Sequence
  Description of Artificial Sequence: Synthetic oligonucleotide
attctccggggcatatcccaagtggtgttc

SEQ ID NO: 198866 - DNA, 29 bp, Artificial Sequence
  Description of Artificial Sequence: Synthetic oligonucleotide
ttctccggggcatatcccaagtggtgttc

SEQ ID NO: 198867 - DNA, 28 bp, Artificial Sequence
  Description of Artificial Sequence: Synthetic oligonucleotide
tctccggggcatatcccaagtggtgttc

SEQ ID NO: 198868 - DNA, 27 bp, Artificial Sequence
  Description of Artificial Sequence: Synthetic oligonucleotide
ctccggggcatatcccaagtggtgttc

SEQ ID NO: 198869 - DNA, 27 bp, Artificial Sequence
  Description of Artificial Sequence: Synthetic oligonucleotide
tccggggcatatcccaagtggtgttcg

SEQ ID NO: 198870 - DNA, 27 bp, Artificial Sequence
  Description of Artificial Sequence: Synthetic oligonucleotide
ccggggcatatcccaagtggtgttcgt

SEQ ID NO: 198871 - DNA, 27 bp, Artificial Sequence
  Description of Artificial Sequence: Synthetic oligonucleotide
cggggcatatcccaagtggtgttcgtc

SEQ ID NO: 198872 - DNA, 29 bp, Artificial Sequence
  Description of Artificial Sequence: Synthetic oligonucleotide
ggggcatatcccaagtggtgttcgtcaac

SEQ ID NO: 198873 - DNA, 31 bp, Artificial Sequence
  Description of Artificial Sequence: Synthetic oligonucleotide
gggcatatcccaagtggtgttcgtcaacaac

SEQ ID NO: 198874 - DNA, 31 bp, Artificial Sequence
  Description of Artificial Sequence: Synthetic oligonucleotide
ggcatatcccaagtggtgttcgtcaacaacc

SEQ ID NO: 198875 - DNA, 31 bp, Artificial Sequence
  Description of Artificial Sequence: Synthetic oligonucleotide
gcatatcccaagtggtgttcgtcaacaaccc

SEQ ID NO: 198876 - DNA, 31 bp, Artificial Sequence
  Description of Artificial Sequence: Synthetic oligonucleotide
catatcccaagtggtgttcgtcaacaacccc

SEQ ID NO: 198877 - DNA, 31 bp, Artificial Sequence
  Description of Artificial Sequence: Synthetic oligonucleotide
atatcccaagtggtgttcgtcaacaaccccg

SEQ ID NO: 198878 - DNA, 30 bp, Artificial Sequence
  Description of Artificial Sequence: Synthetic oligonucleotide
tatcccaagtggtgttcgtcaacaaccccg

SEQ ID NO: 198879 - DNA, 29 bp, Artificial Sequence
  Description of Artificial Sequence: Synthetic oligonucleotide
atcccaagtggtgttcgtcaacaaccccg

SEQ ID NO: 198880 - DNA, 28 bp, Artificial Sequence
  Description of Artificial Sequence: Synthetic oligonucleotide
tcccaagtggtgttcgtcaacaaccccg

SEQ ID NO: 198881 - DNA, 27 bp, Artificial Sequence
  Description of Artificial Sequence: Synthetic oligonucleotide
cccaagtggtgttcgtcaacaaccccg

SEQ ID NO: 198882 - DNA, 28 bp, Artificial Sequence
  Description of Artificial Sequence: Synthetic oligonucleotide
ccaagtggtgttcgtcaacaaccccgtc

SEQ ID NO: 198883 - DNA, 29 bp, Artificial Sequence
  Description of Artificial Sequence: Synthetic oligonucleotide
caagtggtgttcgtcaacaaccccgtcag

SEQ ID NO: 198884 - DNA, 30 bp, Artificial Sequence
  Description of Artificial Sequence: Synthetic oligonucleotide
aagtggtgttcgtcaacaaccccgtcagtg

SEQ ID NO: 198885 - DNA, 29 bp, Artificial Sequence
  Description of Artificial Sequence: Synthetic oligonucleotide
agtggtgttcgtcaacaaccccgtcagtg

SEQ ID NO: 198886 - DNA, 28 bp, Artificial Sequence
  Description of Artificial Sequence: Synthetic oligonucleotide
gtggtgttcgtcaacaaccccgtcagtg

SEQ ID NO: 198887 - DNA, 28 bp, Artificial Sequence
  Description of Artificial Sequence: Synthetic oligonucleotide
tggtgttcgtcaacaaccccgtcagtgg

SEQ ID NO: 198888 - DNA, 27 bp, Artificial Sequence
  Description of Artificial Sequence: Synthetic oligonucleotide
ggtgttcgtcaacaaccccgtcagtgg

SEQ ID NO: 198889 - DNA, 30 bp, Artificial Sequence
  Description of Artificial Sequence: Synthetic oligonucleotide
gtgttcgtcaacaaccccgtcagtggaatc

SEQ ID NO: 198890 - DNA, 30 bp, Artificial Sequence
  Description of Artificial Sequence: Synthetic oligonucleotide
tgttcgtcaacaaccccgtcagtggaatcc

SEQ ID NO: 198891 - DNA, 29 bp, Artificial Sequence
  Description of Artificial Sequence: Synthetic oligonucleotide
gttcgtcaacaaccccgtcagtggaatcc

SEQ ID NO: 198892 - DNA, 30 bp, Artificial Sequence
  Description of Artificial Sequence: Synthetic oligonucleotide
ttcgtcaacaaccccgtcagtggaatcctg

SEQ ID NO: 198893 - DNA, 29 bp, Artificial Sequence
  Description of Artificial Sequence: Synthetic oligonucleotide
tcgtcaacaaccccgtcagtggaatcctg

SEQ ID NO: 198894 - DNA, 28 bp, Artificial Sequence
  Description of Artificial Sequence: Synthetic oligonucleotide
cgtcaacaaccccgtcagtggaatcctg

SEQ ID NO: 198895 - DNA, 31 bp, Artificial Sequence
  Description of Artificial Sequence: Synthetic oligonucleotide
gtcaacaaccccgtcagtggaatcctgattc

SEQ ID NO: 198896 - DNA, 32 bp, Artificial Sequence
  Description of Artificial Sequence: Synthetic oligonucleotide
tcaacaaccccgtcagtggaatcctgattctg

SEQ ID NO: 198897 - DNA, 31 bp, Artificial Sequence
  Description of Artificial Sequence: Synthetic oligonucleotide
caacaaccccgtcagtggaatcctgattctg

SEQ ID NO: 198898 - DNA, 31 bp, Artificial Sequence
  Description of Artificial Sequence: Synthetic oligonucleotide
aacaaccccgtcagtggaatcctgattctgg

SEQ ID NO: 198899 - DNA, 30 bp, Artificial Sequence
  Description of Artificial Sequence: Synthetic oligonucleotide
acaaccccgtcagtggaatcctgattctgg

SEQ ID NO: 198900 - DNA, 29 bp, Artificial Sequence
  Description of Artificial Sequence: Synthetic oligonucleotide
caaccccgtcagtggaatcctgattctgg

SEQ ID NO: 198901 - DNA, 31 bp, Artificial Sequence
  Description of Artificial Sequence: Synthetic oligonucleotide
aaccccgtcagtggaatcctgattctggtag

SEQ ID NO: 198902 - DNA, 30 bp, Artificial Sequence
  Description of Artificial Sequence: Synthetic oligonucleotide
accccgtcagtggaatcctgattctggtag

SEQ ID NO: 198903 - DNA, 29 bp, Artificial Sequence
  Description of Artificial Sequence: Synthetic oligonucleotide
ccccgtcagtggaatcctgattctggtag

SEQ ID NO: 198904 - DNA, 29 bp, Artificial Sequence
  Description of Artificial Sequence: Synthetic oligonucleotide
cccgtcagtggaatcctgattctggtagg

SEQ ID NO: 198905 - DNA, 30 bp, Artificial Sequence
  Description of Artificial Sequence: Synthetic oligonucleotide
ccgtcagtggaatcctgattctggtaggac

SEQ ID NO: 198906 - DNA, 32 bp, Artificial Sequence
  Description of Artificial Sequence: Synthetic oligonucleotide
cgtcagtggaatcctgattctggtaggacttc

SEQ ID NO: 198907 - DNA, 34 bp, Artificial Sequence
  Description of Artificial Sequence: Synthetic oligonucleotide
gtcagtggaatcctgattctggtaggacttcttg

SEQ ID NO: 198908 - DNA, 36 bp, Artificial Sequence
  Description of Artificial Sequence: Synthetic oligonucleotide
tcagtggaatcctgattctggtaggacttcttgttc

SEQ ID NO: 198909 - DNA, 35 bp, Artificial Sequence
  Description of Artificial Sequence: Synthetic oligonucleotide
cagtggaatcctgattctggtaggacttcttgttc

SEQ ID NO: 198910 - DNA, 36 bp, Artificial Sequence
  Description of Artificial Sequence: Synthetic oligonucleotide
agtggaatcctgattctggtaggacttcttgttcag

SEQ ID NO: 198911 - DNA, 35 bp, Artificial Sequence
  Description of Artificial Sequence: Synthetic oligonucleotide
gtggaatcctgattctggtaggacttcttgttcag

SEQ ID NO: 198912 - DNA, 37 bp, Artificial Sequence
  Description of Artificial Sequence: Synthetic oligonucleotide
tggaatcctgattctggtaggacttcttgttcagaac

SEQ ID NO: 198913 - DNA, 36 bp, Artificial Sequence
  Description of Artificial Sequence: Synthetic oligonucleotide
ggaatcctgattctggtaggacttcttgttcagaac

SEQ ID NO: 198914 - DNA, 36 bp, Artificial Sequence
  Description of Artificial Sequence: Synthetic oligonucleotide
gaatcctgattctggtaggacttcttgttcagaacc

SEQ ID NO: 198915 - DNA, 36 bp, Artificial Sequence
  Description of Artificial Sequence: Synthetic oligonucleotide
aatcctgattctggtaggacttcttgttcagaaccc

SEQ ID NO: 198916 - DNA, 35 bp, Artificial Sequence
  Description of Artificial Sequence: Synthetic oligonucleotide
atcctgattctggtaggacttcttgttcagaaccc

SEQ ID NO: 198917 - DNA, 34 bp, Artificial Sequence
  Description of Artificial Sequence: Synthetic oligonucleotide
tcctgattctggtaggacttcttgttcagaaccc

SEQ ID NO: 198918 - DNA, 33 bp, Artificial Sequence
  Description of Artificial Sequence: Synthetic oligonucleotide
cctgattctggtaggacttcttgttcagaaccc

SEQ ID NO: 198919 - DNA, 33 bp, Artificial Sequence
  Description of Artificial Sequence: Synthetic oligonucleotide
ctgattctggtaggacttcttgttcagaacccc

SEQ ID NO: 198920 - DNA, 34 bp, Artificial Sequence
  Description of Artificial Sequence: Synthetic oligonucleotide
tgattctggtaggacttcttgttcagaacccctg

SEQ ID NO: 198921 - DNA, 33 bp, Artificial Sequence
  Description of Artificial Sequence: Synthetic oligonucleotide
gattctggtaggacttcttgttcagaacccctg

SEQ ID NO: 198922 - DNA, 33 bp, Artificial Sequence
  Description of Artificial Sequence: Synthetic oligonucleotide
attctggtaggacttcttgttcagaacccctgg

SEQ ID NO: 198923 - DNA, 32 bp, Artificial Sequence
  Description of Artificial Sequence: Synthetic oligonucleotide
ttctggtaggacttcttgttcagaacccctgg

SEQ ID NO: 198924 - DNA, 31 bp, Artificial Sequence
  Description of Artificial Sequence: Synthetic oligonucleotide
tctggtaggacttcttgttcagaacccctgg

SEQ ID NO: 198925 - DNA, 30 bp, Artificial Sequence
  Description of Artificial Sequence: Synthetic oligonucleotide
ctggtaggacttcttgttcagaacccctgg

SEQ ID NO: 198926 - DNA, 31 bp, Artificial Sequence
  Description of Artificial Sequence: Synthetic oligonucleotide
tggtaggacttcttgttcagaacccctggtg

SEQ ID NO: 198927 - DNA, 30 bp, Artificial Sequence
  Description of Artificial Sequence: Synthetic oligonucleotide
ggtaggacttcttgttcagaacccctggtg

SEQ ID NO: 198928 - DNA, 30 bp, Artificial Sequence
  Description of Artificial Sequence: Synthetic oligonucleotide
gtaggacttcttgttcagaacccctggtgg

SEQ ID NO: 198929 - DNA, 30 bp, Artificial Sequence
  Description of Artificial Sequence: Synthetic oligonucleotide
taggacttcttgttcagaacccctggtggg

SEQ ID NO: 198930 - DNA, 29 bp, Artificial Sequence
  Description of Artificial Sequence: Synthetic oligonucleotide
aggacttcttgttcagaacccctggtggg

SEQ ID NO: 198931 - DNA, 28 bp, Artificial Sequence
  Description of Artificial Sequence: Synthetic oligonucleotide
ggacttcttgttcagaacccctggtggg

SEQ ID NO: 198932 - DNA, 28 bp, Artificial Sequence
  Description of Artificial Sequence: Synthetic oligonucleotide
gacttcttgttcagaacccctggtgggc

SEQ ID NO: 198933 - DNA, 29 bp, Artificial Sequence
  Description of Artificial Sequence: Synthetic oligonucleotide
acttcttgttcagaacccctggtgggctc

SEQ ID NO: 198934 - DNA, 28 bp, Artificial Sequence
  Description of Artificial Sequence: Synthetic oligonucleotide
cttcttgttcagaacccctggtgggctc

SEQ ID NO: 198935 - DNA, 29 bp, Artificial Sequence
  Description of Artificial Sequence: Synthetic oligonucleotide
ttcttgttcagaacccctggtgggctctc

SEQ ID NO: 198936 - DNA, 28 bp, Artificial Sequence
  Description of Artificial Sequence: Synthetic oligonucleotide
tcttgttcagaacccctggtgggctctc

SEQ ID NO: 198937 - DNA, 27 bp, Artificial Sequence
  Description of Artificial Sequence: Synthetic oligonucleotide
cttgttcagaacccctggtgggctctc

SEQ ID NO: 198938 - DNA, 28 bp, Artificial Sequence
  Description of Artificial Sequence: Synthetic oligonucleotide
ttgttcagaacccctggtgggctctcac

SEQ ID NO: 198939 - DNA, 27 bp, Artificial Sequence
  Description of Artificial Sequence: Synthetic oligonucleotide
tgttcagaacccctggtgggctctcac

SEQ ID NO: 198940 - DNA, 27 bp, Artificial Sequence
  Description of Artificial Sequence: Synthetic oligonucleotide
gttcagaacccctggtgggctctcact

SEQ ID NO: 198941 - DNA, 27 bp, Artificial Sequence
  Description of Artificial Sequence: Synthetic oligonucleotide
ttcagaacccctggtgggctctcactg

SEQ ID NO: 198942 - DNA, 26 bp, Artificial Sequence
  Description of Artificial Sequence: Synthetic oligonucleotide
tcagaacccctggtgggctctcactg

SEQ ID NO: 198943 - DNA, 25 bp, Artificial Sequence
  Description of Artificial Sequence: Synthetic oligonucleotide
cagaacccctggtgggctctcactg

SEQ ID NO: 198944 - DNA, 25 bp, Artificial Sequence
  Description of Artificial Sequence: Synthetic oligonucleotide
agaacccctggtgggctctcactgg

SEQ ID NO: 198945 - DNA, 24 bp, Artificial Sequence
  Description of Artificial Sequence: Synthetic oligonucleotide
gaacccctggtgggctctcactgg

SEQ ID NO: 198946 - DNA, 25 bp, Artificial Sequence
  Description of Artificial Sequence: Synthetic oligonucleotide
aacccctggtgggctctcactggct

SEQ ID NO: 198947 - DNA, 24 bp, Artificial Sequence
  Description of Artificial Sequence: Synthetic oligonucleotide
acccctggtgggctctcactggct

SEQ ID NO: 198948 - DNA, 23 bp, Artificial Sequence
  Description of Artificial Sequence: Synthetic oligonucleotide
cccctggtgggctctcactggct

SEQ ID NO: 198949 - DNA, 23 bp, Artificial Sequence
  Description of Artificial Sequence: Synthetic oligonucleotide
ccctggtgggctctcactggctg

SEQ ID NO: 198950 - DNA, 23 bp, Artificial Sequence
  Description of Artificial Sequence: Synthetic oligonucleotide
cctggtgggctctcactggctgg

SEQ ID NO: 198951 - DNA, 24 bp, Artificial Sequence
  Description of Artificial Sequence: Synthetic oligonucleotide
ctggtgggctctcactggctggct

SEQ ID NO: 198952 - DNA, 24 bp, Artificial Sequence
  Description of Artificial Sequence: Synthetic oligonucleotide
tggtgggctctcactggctggctg

SEQ ID NO: 198953 - DNA, 23 bp, Artificial Sequence
  Description of Artificial Sequence: Synthetic oligonucleotide
ggtgggctctcactggctggctg

SEQ ID NO: 198954 - DNA, 23 bp, Artificial Sequence
  Description of Artificial Sequence: Synthetic oligonucleotide
gtgggctctcactggctggctgg

SEQ ID NO: 198955 - DNA, 25 bp, Artificial Sequence
  Description of Artificial Sequence: Synthetic oligonucleotide
tgggctctcactggctggctgggaa

SEQ ID NO: 198956 - DNA, 24 bp, Artificial Sequence
  Description of Artificial Sequence: Synthetic oligonucleotide
gggctctcactggctggctgggaa

SEQ ID NO: 198957 - DNA, 25 bp, Artificial Sequence
  Description of Artificial Sequence: Synthetic oligonucleotide
ggctctcactggctggctgggaaca

SEQ ID NO: 198958 - DNA, 26 bp, Artificial Sequence
  Description of Artificial Sequence: Synthetic oligonucleotide
gctctcactggctggctgggaacagt

SEQ ID NO: 198959 - DNA, 26 bp, Artificial Sequence
  Description of Artificial Sequence: Synthetic oligonucleotide
ctctcactggctggctgggaacagtg

SEQ ID NO: 198960 - DNA, 27 bp, Artificial Sequence
  Description of Artificial Sequence: Synthetic oligonucleotide
tctcactggctggctgggaacagtggt

SEQ ID NO: 198961 - DNA, 26 bp, Artificial Sequence
  Description of Artificial Sequence: Synthetic oligonucleotide
ctcactggctggctgggaacagtggt

SEQ ID NO: 198962 - DNA, 27 bp, Artificial Sequence
  Description of Artificial Sequence: Synthetic oligonucleotide
tcactggctggctgggaacagtggtct

SEQ ID NO: 198963 - DNA, 26 bp, Artificial Sequence
  Description of Artificial Sequence: Synthetic oligonucleotide
cactggctggctgggaacagtggtct

SEQ ID NO: 198964 - DNA, 26 bp, Artificial Sequence
  Description of Artificial Sequence: Synthetic oligonucleotide
actggctggctgggaacagtggtctc

SEQ ID NO: 198965 - DNA, 25 bp, Artificial Sequence
  Description of Artificial Sequence: Synthetic oligonucleotide
ctggctggctgggaacagtggtctc

SEQ ID NO: 198966 - DNA, 26 bp, Artificial Sequence
  Description of Artificial Sequence: Synthetic oligonucleotide
tggctggctgggaacagtggtctcca

SEQ ID NO: 198967 - DNA, 25 bp, Artificial Sequence
  Description of Artificial Sequence: Synthetic oligonucleotide
ggctggctgggaacagtggtctcca

SEQ ID NO: 198968 - DNA, 26 bp, Artificial Sequence
  Description of Artificial Sequence: Synthetic oligonucleotide
gctggctgggaacagtggtctccact

SEQ ID NO: 198969 - DNA, 27 bp, Artificial Sequence
  Description of Artificial Sequence: Synthetic oligonucleotide
ctggctgggaacagtggtctccactct

SEQ ID NO: 198970 - DNA, 27 bp, Artificial Sequence
  Description of Artificial Sequence: Synthetic oligonucleotide
tggctgggaacagtggtctccactctg

SEQ ID NO: 198971 - DNA, 27 bp, Artificial Sequence
  Description of Artificial Sequence: Synthetic oligonucleotide
ggctgggaacagtggtctccactctga

SEQ ID NO: 198972 - DNA, 28 bp, Artificial Sequence
  Description of Artificial Sequence: Synthetic oligonucleotide
gctgggaacagtggtctccactctgatg

SEQ ID NO: 198973 - DNA, 28 bp, Artificial Sequence
  Description of Artificial Sequence: Synthetic oligonucleotide
ctgggaacagtggtctccactctgatgg

SEQ ID NO: 198974 - DNA, 28 bp, Artificial Sequence
  Description of Artificial Sequence: Synthetic oligonucleotide
tgggaacagtggtctccactctgatggc

SEQ ID NO: 198975 - DNA, 27 bp, Artificial Sequence
  Description of Artificial Sequence: Synthetic oligonucleotide
gggaacagtggtctccactctgatggc

SEQ ID NO: 198976 - DNA, 27 bp, Artificial Sequence
  Description of Artificial Sequence: Synthetic oligonucleotide
ggaacagtggtctccactctgatggcc

SEQ ID NO: 198977 - DNA, 27 bp, Artificial Sequence
  Description of Artificial Sequence: Synthetic oligonucleotide
gaacagtggtctccactctgatggccc

SEQ ID NO: 198978 - DNA, 28 bp, Artificial Sequence
  Description of Artificial Sequence: Synthetic oligonucleotide
aacagtggtctccactctgatggccctc

SEQ ID NO: 198979 - DNA, 27 bp, Artificial Sequence
  Description of Artificial Sequence: Synthetic oligonucleotide
acagtggtctccactctgatggccctc

SEQ ID NO: 198980 - DNA, 27 bp, Artificial Sequence
  Description of Artificial Sequence: Synthetic oligonucleotide
cagtggtctccactctgatggccctct

SEQ ID NO: 198981 - DNA, 28 bp, Artificial Sequence
  Description of Artificial Sequence: Synthetic oligonucleotide
agtggtctccactctgatggccctcttg

SEQ ID NO: 198982 - DNA, 27 bp, Artificial Sequence
  Description of Artificial Sequence: Synthetic oligonucleotide
gtggtctccactctgatggccctcttg

SEQ ID NO: 198983 - DNA, 27 bp, Artificial Sequence
  Description of Artificial Sequence: Synthetic oligonucleotide
tggtctccactctgatggccctcttgc

SEQ ID NO: 198984 - DNA, 27 bp, Artificial Sequence
  Description of Artificial Sequence: Synthetic oligonucleotide
ggtctccactctgatggccctcttgct

SEQ ID NO: 198985 - DNA, 27 bp, Artificial Sequence
  Description of Artificial Sequence: Synthetic oligonucleotide
gtctccactctgatggccctcttgctc

SEQ ID NO: 198986 - DNA, 28 bp, Artificial Sequence
  Description of Artificial Sequence: Synthetic oligonucleotide
tctccactctgatggccctcttgctcag

SEQ ID NO: 198987 - DNA, 27 bp, Artificial Sequence
  Description of Artificial Sequence: Synthetic oligonucleotide
ctccactctgatggccctcttgctcag

SEQ ID NO: 198988 - DNA, 27 bp, Artificial Sequence
  Description of Artificial Sequence: Synthetic oligonucleotide
tccactctgatggccctcttgctcagc

SEQ ID NO: 198989 - DNA, 26 bp, Artificial Sequence
  Description of Artificial Sequence: Synthetic oligonucleotide
ccactctgatggccctcttgctcagc

SEQ ID NO: 198990 - DNA, 27 bp, Artificial Sequence
  Description of Artificial Sequence: Synthetic oligonucleotide
cactctgatggccctcttgctcagcca

SEQ ID NO: 198991 - DNA, 27 bp, Artificial Sequence
  Description of Artificial Sequence: Synthetic oligonucleotide
actctgatggccctcttgctcagccag

SEQ ID NO: 198992 - DNA, 26 bp, Artificial Sequence
  Description of Artificial Sequence: Synthetic oligonucleotide
ctctgatggccctcttgctcagccag

SEQ ID NO: 198993 - DNA, 27 bp, Artificial Sequence
  Description of Artificial Sequence: Synthetic oligonucleotide
tctgatggccctcttgctcagccagga

SEQ ID NO: 198994 - DNA, 26 bp, Artificial Sequence
  Description of Artificial Sequence: Synthetic oligonucleotide
ctgatggccctcttgctcagccagga

SEQ ID NO: 198995 - DNA, 27 bp, Artificial Sequence
  Description of Artificial Sequence: Synthetic oligonucleotide
tgatggccctcttgctcagccaggaca

SEQ ID NO: 198996 - DNA, 26 bp, Artificial Sequence
  Description of Artificial Sequence: Synthetic oligonucleotide
gatggccctcttgctcagccaggaca

SEQ ID NO: 198997 - DNA, 26 bp, Artificial Sequence
  Description of Artificial Sequence: Synthetic oligonucleotide
atggccctcttgctcagccaggacag

SEQ ID NO: 198998 - DNA, 25 bp, Artificial Sequence
  Description of Artificial Sequence: Synthetic oligonucleotide
tggccctcttgctcagccaggacag

SEQ ID NO: 198999 - DNA, 24 bp, Artificial Sequence
  Description of Artificial Sequence: Synthetic oligonucleotide
ggccctcttgctcagccaggacag

SEQ ID NO: 199000 - DNA, 25 bp, Artificial Sequence
  Description of Artificial Sequence: Synthetic oligonucleotide
gccctcttgctcagccaggacaggt

SEQ ID NO: 199001 - DNA, 27 bp, Artificial Sequence
  Description of Artificial Sequence: Synthetic oligonucleotide
ccctcttgctcagccaggacaggtcat

SEQ ID NO: 199002 - DNA, 32 bp, Artificial Sequence
  Description of Artificial Sequence: Synthetic oligonucleotide
cctcttgctcagccaggacaggtcattaatag

SEQ ID NO: 199003 - DNA, 32 bp, Artificial Sequence
  Description of Artificial Sequence: Synthetic oligonucleotide
ctcttgctcagccaggacaggtcattaatagc

SEQ ID NO: 199004 - DNA, 34 bp, Artificial Sequence
  Description of Artificial Sequence: Synthetic oligonucleotide
tcttgctcagccaggacaggtcattaatagcatc

SEQ ID NO: 199005 - DNA, 33 bp, Artificial Sequence
  Description of Artificial Sequence: Synthetic oligonucleotide
cttgctcagccaggacaggtcattaatagcatc

SEQ ID NO: 199006 - DNA, 34 bp, Artificial Sequence
  Description of Artificial Sequence: Synthetic oligonucleotide
ttgctcagccaggacaggtcattaatagcatctg

SEQ ID NO: 199007 - DNA, 33 bp, Artificial Sequence
  Description of Artificial Sequence: Synthetic oligonucleotide
tgctcagccaggacaggtcattaatagcatctg

SEQ ID NO: 199008 - DNA, 32 bp, Artificial Sequence
  Description of Artificial Sequence: Synthetic oligonucleotide
gctcagccaggacaggtcattaatagcatctg

SEQ ID NO: 199009 - DNA, 32 bp, Artificial Sequence
  Description of Artificial Sequence: Synthetic oligonucleotide
ctcagccaggacaggtcattaatagcatctgg

SEQ ID NO: 199010 - DNA, 32 bp, Artificial Sequence
  Description of Artificial Sequence: Synthetic oligonucleotide
tcagccaggacaggtcattaatagcatctggg

SEQ ID NO: 199011 - DNA, 31 bp, Artificial Sequence
  Description of Artificial Sequence: Synthetic oligonucleotide
cagccaggacaggtcattaatagcatctggg

SEQ ID NO: 199012 - DNA, 31 bp, Artificial Sequence
  Description of Artificial Sequence: Synthetic oligonucleotide
agccaggacaggtcattaatagcatctgggc

SEQ ID NO: 199013 - DNA, 30 bp, Artificial Sequence
  Description of Artificial Sequence: Synthetic oligonucleotide
gccaggacaggtcattaatagcatctgggc

SEQ ID NO: 199014 - DNA, 31 bp, Artificial Sequence
  Description of Artificial Sequence: Synthetic oligonucleotide
ccaggacaggtcattaatagcatctgggctc

SEQ ID NO: 199015 - DNA, 34 bp, Artificial Sequence
  Description of Artificial Sequence: Synthetic oligonucleotide
caggacaggtcattaatagcatctgggctctatg

SEQ ID NO: 199016 - DNA, 34 bp, Artificial Sequence
  Description of Artificial Sequence: Synthetic oligonucleotide
aggacaggtcattaatagcatctgggctctatgg

SEQ ID NO: 199017 - DNA, 33 bp, Artificial Sequence
  Description of Artificial Sequence: Synthetic oligonucleotide
ggacaggtcattaatagcatctgggctctatgg

SEQ ID NO: 199018 - DNA, 33 bp, Artificial Sequence
  Description of Artificial Sequence: Synthetic oligonucleotide
gacaggtcattaatagcatctgggctctatggc

SEQ ID NO: 199019 - DNA, 35 bp, Artificial Sequence
  Description of Artificial Sequence: Synthetic oligonucleotide
acaggtcattaatagcatctgggctctatggctac

SEQ ID NO: 199020 - DNA, 34 bp, Artificial Sequence
  Description of Artificial Sequence: Synthetic oligonucleotide
caggtcattaatagcatctgggctctatggctac

SEQ ID NO: 199021 - DNA, 37 bp, Artificial Sequence
  Description of Artificial Sequence: Synthetic oligonucleotide
aggtcattaatagcatctgggctctatggctacaatg

SEQ ID NO: 199022 - DNA, 36 bp, Artificial Sequence
  Description of Artificial Sequence: Synthetic oligonucleotide
ggtcattaatagcatctgggctctatggctacaatg

SEQ ID NO: 199023 - DNA, 36 bp, Artificial Sequence
  Description of Artificial Sequence: Synthetic oligonucleotide
gtcattaatagcatctgggctctatggctacaatgc

SEQ ID NO: 199024 - DNA, 36 bp, Artificial Sequence
  Description of Artificial Sequence: Synthetic oligonucleotide
tcattaatagcatctgggctctatggctacaatgcc

SEQ ID NO: 199025 - DNA, 35 bp, Artificial Sequence
  Description of Artificial Sequence: Synthetic oligonucleotide
cattaatagcatctgggctctatggctacaatgcc

SEQ ID NO: 199026 - DNA, 36 bp, Artificial Sequence
  Description of Artificial Sequence: Synthetic oligonucleotide
attaatagcatctgggctctatggctacaatgccac

SEQ ID NO: 199027 - DNA, 35 bp, Artificial Sequence
  Description of Artificial Sequence: Synthetic oligonucleotide
ttaatagcatctgggctctatggctacaatgccac

SEQ ID NO: 199028 - DNA, 34 bp, Artificial Sequence
  Description of Artificial Sequence: Synthetic oligonucleotide
taatagcatctgggctctatggctacaatgccac

SEQ ID NO: 199029 - DNA, 33 bp, Artificial Sequence
  Description of Artificial Sequence: Synthetic oligonucleotide
aatagcatctgggctctatggctacaatgccac

SEQ ID NO: 199030 - DNA, 32 bp, Artificial Sequence
  Description of Artificial Sequence: Synthetic oligonucleotide
atagcatctgggctctatggctacaatgccac

SEQ ID NO: 199031 - DNA, 31 bp, Artificial Sequence
  Description of Artificial Sequence: Synthetic oligonucleotide
tagcatctgggctctatggctacaatgccac

SEQ ID NO: 199032 - DNA, 30 bp, Artificial Sequence
  Description of Artificial Sequence: Synthetic oligonucleotide
agcatctgggctctatggctacaatgccac

SEQ ID NO: 199033 - DNA, 29 bp, Artificial Sequence
  Description of Artificial Sequence: Synthetic oligonucleotide
gcatctgggctctatggctacaatgccac

SEQ ID NO: 199034 - DNA, 29 bp, Artificial Sequence
  Description of Artificial Sequence: Synthetic oligonucleotide
catctgggctctatggctacaatgccacc

SEQ ID NO: 199035 - DNA, 29 bp, Artificial Sequence
  Description of Artificial Sequence: Synthetic oligonucleotide
atctgggctctatggctacaatgccaccc

SEQ ID NO: 199036 - DNA, 28 bp, Artificial Sequence
  Description of Artificial Sequence: Synthetic oligonucleotide
tctgggctctatggctacaatgccaccc

SEQ ID NO: 199037 - DNA, 27 bp, Artificial Sequence
  Description of Artificial Sequence: Synthetic oligonucleotide
ctgggctctatggctacaatgccaccc

SEQ ID NO: 199038 - DNA, 28 bp, Artificial Sequence
  Description of Artificial Sequence: Synthetic oligonucleotide
tgggctctatggctacaatgccaccctg

SEQ ID NO: 199039 - DNA, 27 bp, Artificial Sequence
  Description of Artificial Sequence: Synthetic oligonucleotide
gggctctatggctacaatgccaccctg

SEQ ID NO: 199040 - DNA, 27 bp, Artificial Sequence
  Description of Artificial Sequence: Synthetic oligonucleotide
ggctctatggctacaatgccaccctgg

SEQ ID NO: 199041 - DNA, 28 bp, Artificial Sequence
  Description of Artificial Sequence: Synthetic oligonucleotide
gctctatggctacaatgccaccctggtg

SEQ ID NO: 199042 - DNA, 28 bp, Artificial Sequence
  Description of Artificial Sequence: Synthetic oligonucleotide
ctctatggctacaatgccaccctggtgg

SEQ ID NO: 199043 - DNA, 28 bp, Artificial Sequence
  Description of Artificial Sequence: Synthetic oligonucleotide
tctatggctacaatgccaccctggtggg

SEQ ID NO: 199044 - DNA, 27 bp, Artificial Sequence
  Description of Artificial Sequence: Synthetic oligonucleotide
ctatggctacaatgccaccctggtggg

SEQ ID NO: 199045 - DNA, 28 bp, Artificial Sequence
  Description of Artificial Sequence: Synthetic oligonucleotide
tatggctacaatgccaccctggtgggag

SEQ ID NO: 199046 - DNA, 27 bp, Artificial Sequence
  Description of Artificial Sequence: Synthetic oligonucleotide
atggctacaatgccaccctggtgggag

SEQ ID NO: 199047 - DNA, 27 bp, Artificial Sequence
  Description of Artificial Sequence: Synthetic oligonucleotide
tggctacaatgccaccctggtgggagt

SEQ ID NO: 199048 - DNA, 27 bp, Artificial Sequence
  Description of Artificial Sequence: Synthetic oligonucleotide
ggctacaatgccaccctggtgggagta

SEQ ID NO: 199049 - DNA, 27 bp, Artificial Sequence
  Description of Artificial Sequence: Synthetic oligonucleotide
gctacaatgccaccctggtgggagtac

SEQ ID NO: 199050 - DNA, 28 bp, Artificial Sequence
  Description of Artificial Sequence: Synthetic oligonucleotide
ctacaatgccaccctggtgggagtactc

SEQ ID NO: 199051 - DNA, 30 bp, Artificial Sequence
  Description of Artificial Sequence: Synthetic oligonucleotide
tacaatgccaccctggtgggagtactcatg

SEQ ID NO: 199052 - DNA, 29 bp, Artificial Sequence
  Description of Artificial Sequence: Synthetic oligonucleotide
acaatgccaccctggtgggagtactcatg

SEQ ID NO: 199053 - DNA, 28 bp, Artificial Sequence
  Description of Artificial Sequence: Synthetic oligonucleotide
caatgccaccctggtgggagtactcatg

SEQ ID NO: 199054 - DNA, 28 bp, Artificial Sequence
  Description of Artificial Sequence: Synthetic oligonucleotide
aatgccaccctggtgggagtactcatgg

SEQ ID NO: 199055 - DNA, 27 bp, Artificial Sequence
  Description of Artificial Sequence: Synthetic oligonucleotide
atgccaccctggtgggagtactcatgg

SEQ ID NO: 199056 - DNA, 26 bp, Artificial Sequence
  Description of Artificial Sequence: Synthetic oligonucleotide
tgccaccctggtgggagtactcatgg

SEQ ID NO: 199057 - DNA, 25 bp, Artificial Sequence
  Description of Artificial Sequence: Synthetic oligonucleotide
gccaccctggtgggagtactcatgg

SEQ ID NO: 199058 - DNA, 26 bp, Artificial Sequence
  Description of Artificial Sequence: Synthetic oligonucleotide
ccaccctggtgggagtactcatggct

SEQ ID NO: 199059 - DNA, 27 bp, Artificial Sequence
  Description of Artificial Sequence: Synthetic oligonucleotide
caccctggtgggagtactcatggctgt

SEQ ID NO: 199060 - DNA, 27 bp, Artificial Sequence
  Description of Artificial Sequence: Synthetic oligonucleotide
accctggtgggagtactcatggctgtc

SEQ ID NO: 199061 - DNA, 27 bp, Artificial Sequence
  Description of Artificial Sequence: Synthetic oligonucleotide
ccctggtgggagtactcatggctgtct

SEQ ID NO: 199062 - DNA, 30 bp, Artificial Sequence
  Description of Artificial Sequence: Synthetic oligonucleotide
cctggtgggagtactcatggctgtcttttc

SEQ ID NO: 199063 - DNA, 30 bp, Artificial Sequence
  Description of Artificial Sequence: Synthetic oligonucleotide
ctggtgggagtactcatggctgtcttttcg

SEQ ID NO: 199064 - DNA, 30 bp, Artificial Sequence
  Description of Artificial Sequence: Synthetic oligonucleotide
tggtgggagtactcatggctgtcttttcgg

SEQ ID NO: 199065 - DNA, 29 bp, Artificial Sequence
  Description of Artificial Sequence: Synthetic oligonucleotide
ggtgggagtactcatggctgtcttttcgg

SEQ ID NO: 199066 - DNA, 30 bp, Artificial Sequence
  Description of Artificial Sequence: Synthetic oligonucleotide
gtgggagtactcatggctgtcttttcggac

SEQ ID NO: 199067 - DNA, 32 bp, Artificial Sequence
  Description of Artificial Sequence: Synthetic oligonucleotide
tgggagtactcatggctgtcttttcggacaag

SEQ ID NO: 199068 - DNA, 31 bp, Artificial Sequence
  Description of Artificial Sequence: Synthetic oligonucleotide
gggagtactcatggctgtcttttcggacaag

SEQ ID NO: 199069 - DNA, 31 bp, Artificial Sequence
  Description of Artificial Sequence: Synthetic oligonucleotide
ggagtactcatggctgtcttttcggacaagg

SEQ ID NO: 199070 - DNA, 31 bp, Artificial Sequence
  Description of Artificial Sequence: Synthetic oligonucleotide
gagtactcatggctgtcttttcggacaaggg

SEQ ID NO: 199071 - DNA, 32 bp, Artificial Sequence
  Description of Artificial Sequence: Synthetic oligonucleotide
agtactcatggctgtcttttcggacaagggag

SEQ ID NO: 199072 - DNA, 31 bp, Artificial Sequence
  Description of Artificial Sequence: Synthetic oligonucleotide
gtactcatggctgtcttttcggacaagggag

SEQ ID NO: 199073 - DNA, 32 bp, Artificial Sequence
  Description of Artificial Sequence: Synthetic oligonucleotide
tactcatggctgtcttttcggacaagggagac

SEQ ID NO: 199074 - DNA, 31 bp, Artificial Sequence
  Description of Artificial Sequence: Synthetic oligonucleotide
actcatggctgtcttttcggacaagggagac

SEQ ID NO: 199075 - DNA, 30 bp, Artificial Sequence
  Description of Artificial Sequence: Synthetic oligonucleotide
ctcatggctgtcttttcggacaagggagac

SEQ ID NO: 199076 - DNA, 35 bp, Artificial Sequence
  Description of Artificial Sequence: Synthetic oligonucleotide
tcatggctgtcttttcggacaagggagactatttc

SEQ ID NO: 199077 - DNA, 34 bp, Artificial Sequence
  Description of Artificial Sequence: Synthetic oligonucleotide
catggctgtcttttcggacaagggagactatttc

SEQ ID NO: 199078 - DNA, 35 bp, Artificial Sequence
  Description of Artificial Sequence: Synthetic oligonucleotide
atggctgtcttttcggacaagggagactatttctg

SEQ ID NO: 199079 - DNA, 34 bp, Artificial Sequence
  Description of Artificial Sequence: Synthetic oligonucleotide
tggctgtcttttcggacaagggagactatttctg

SEQ ID NO: 199080 - DNA, 33 bp, Artificial Sequence
  Description of Artificial Sequence: Synthetic oligonucleotide
ggctgtcttttcggacaagggagactatttctg

SEQ ID NO: 199081 - DNA, 33 bp, Artificial Sequence
  Description of Artificial Sequence: Synthetic oligonucleotide
gctgtcttttcggacaagggagactatttctgg

SEQ ID NO: 199082 - DNA, 34 bp, Artificial Sequence
  Description of Artificial Sequence: Synthetic oligonucleotide
ctgtcttttcggacaagggagactatttctggtg

SEQ ID NO: 199083 - DNA, 34 bp, Artificial Sequence
  Description of Artificial Sequence: Synthetic oligonucleotide
tgtcttttcggacaagggagactatttctggtgg

SEQ ID NO: 199084 - DNA, 33 bp, Artificial Sequence
  Description of Artificial Sequence: Synthetic oligonucleotide
gtcttttcggacaagggagactatttctggtgg

SEQ ID NO: 199085 - DNA, 33 bp, Artificial Sequence
  Description of Artificial Sequence: Synthetic oligonucleotide
tcttttcggacaagggagactatttctggtggc

SEQ ID NO: 199086 - DNA, 32 bp, Artificial Sequence
  Description of Artificial Sequence: Synthetic oligonucleotide
cttttcggacaagggagactatttctggtggc

SEQ ID NO: 199087 - DNA, 33 bp, Artificial Sequence
  Description of Artificial Sequence: Synthetic oligonucleotide
ttttcggacaagggagactatttctggtggctg

SEQ ID NO: 199088 - DNA, 32 bp, Artificial Sequence
  Description of Artificial Sequence: Synthetic oligonucleotide
tttcggacaagggagactatttctggtggctg

SEQ ID NO: 199089 - DNA, 31 bp, Artificial Sequence
  Description of Artificial Sequence: Synthetic oligonucleotide
ttcggacaagggagactatttctggtggctg

SEQ ID NO: 199090 - DNA, 30 bp, Artificial Sequence
  Description of Artificial Sequence: Synthetic oligonucleotide
tcggacaagggagactatttctggtggctg

SEQ ID NO: 199091 - DNA, 29 bp, Artificial Sequence
  Description of Artificial Sequence: Synthetic oligonucleotide
cggacaagggagactatttctggtggctg

SEQ ID NO: 199092 - DNA, 32 bp, Artificial Sequence
  Description of Artificial Sequence: Synthetic oligonucleotide
ggacaagggagactatttctggtggctgttac

SEQ ID NO: 199093 - DNA, 33 bp, Artificial Sequence
  Description of Artificial Sequence: Synthetic oligonucleotide
gacaagggagactatttctggtggctgttactc

SEQ ID NO: 199094 - DNA, 33 bp, Artificial Sequence
  Description of Artificial Sequence: Synthetic oligonucleotide
acaagggagactatttctggtggctgttactcc

SEQ ID NO: 199095 - DNA, 32 bp, Artificial Sequence
  Description of Artificial Sequence: Synthetic oligonucleotide
caagggagactatttctggtggctgttactcc

SEQ ID NO: 199096 - DNA, 32 bp, Artificial Sequence
  Description of Artificial Sequence: Synthetic oligonucleotide
aagggagactatttctggtggctgttactccc

SEQ ID NO: 199097 - DNA, 31 bp, Artificial Sequence
  Description of Artificial Sequence: Synthetic oligonucleotide
agggagactatttctggtggctgttactccc

SEQ ID NO: 199098 - DNA, 30 bp, Artificial Sequence
  Description of Artificial Sequence: Synthetic oligonucleotide
gggagactatttctggtggctgttactccc

SEQ ID NO: 199099 - DNA, 31 bp, Artificial Sequence
  Description of Artificial Sequence: Synthetic oligonucleotide
ggagactatttctggtggctgttactccctg

SEQ ID NO: 199100 - DNA, 34 bp, Artificial Sequence
  Description of Artificial Sequence: Synthetic oligonucleotide
gagactatttctggtggctgttactccctgtatg

SEQ ID NO: 199101 - DNA, 35 bp, Artificial Sequence
  Description of Artificial Sequence: Synthetic oligonucleotide
agactatttctggtggctgttactccctgtatgtg

SEQ ID NO: 199102 - DNA, 34 bp, Artificial Sequence
  Description of Artificial Sequence: Synthetic oligonucleotide
gactatttctggtggctgttactccctgtatgtg

SEQ ID NO: 199103 - DNA, 34 bp, Artificial Sequence
  Description of Artificial Sequence: Synthetic oligonucleotide
actatttctggtggctgttactccctgtatgtgc

SEQ ID NO: 199104 - DNA, 33 bp, Artificial Sequence
  Description of Artificial Sequence: Synthetic oligonucleotide
ctatttctggtggctgttactccctgtatgtgc

SEQ ID NO: 199105 - DNA, 36 bp, Artificial Sequence
  Description of Artificial Sequence: Synthetic oligonucleotide
tatttctggtggctgttactccctgtatgtgctatg

SEQ ID NO: 199106 - DNA, 35 bp, Artificial Sequence
  Description of Artificial Sequence: Synthetic oligonucleotide
atttctggtggctgttactccctgtatgtgctatg

SEQ ID NO: 199107 - DNA, 34 bp, Artificial Sequence
  Description of Artificial Sequence: Synthetic oligonucleotide
tttctggtggctgttactccctgtatgtgctatg

SEQ ID NO: 199108 - DNA, 33 bp, Artificial Sequence
  Description of Artificial Sequence: Synthetic oligonucleotide
ttctggtggctgttactccctgtatgtgctatg

SEQ ID NO: 199109 - DNA, 32 bp, Artificial Sequence
  Description of Artificial Sequence: Synthetic oligonucleotide
tctggtggctgttactccctgtatgtgctatg

SEQ ID NO: 199110 - DNA, 31 bp, Artificial Sequence
  Description of Artificial Sequence: Synthetic oligonucleotide
ctggtggctgttactccctgtatgtgctatg

SEQ ID NO: 199111 - DNA, 32 bp, Artificial Sequence
  Description of Artificial Sequence: Synthetic oligonucleotide
tggtggctgttactccctgtatgtgctatgtc

SEQ ID NO: 199112 - DNA, 31 bp, Artificial Sequence
  Description of Artificial Sequence: Synthetic oligonucleotide
ggtggctgttactccctgtatgtgctatgtc

SEQ ID NO: 199113 - DNA, 31 bp, Artificial Sequence
  Description of Artificial Sequence: Synthetic oligonucleotide
gtggctgttactccctgtatgtgctatgtcc

SEQ ID NO: 199114 - DNA, 33 bp, Artificial Sequence
  Description of Artificial Sequence: Synthetic oligonucleotide
tggctgttactccctgtatgtgctatgtccatg

SEQ ID NO: 199115 - DNA, 32 bp, Artificial Sequence
  Description of Artificial Sequence: Synthetic oligonucleotide
ggctgttactccctgtatgtgctatgtccatg

SEQ ID NO: 199116 - DNA, 33 bp, Artificial Sequence
  Description of Artificial Sequence: Synthetic oligonucleotide
gctgttactccctgtatgtgctatgtccatgac

SEQ ID NO: 199117 - DNA, 35 bp, Artificial Sequence
  Description of Artificial Sequence: Synthetic oligonucleotide
ctgttactccctgtatgtgctatgtccatgacttg

SEQ ID NO: 199118 - DNA, 35 bp, Artificial Sequence
  Description of Artificial Sequence: Synthetic oligonucleotide
tgttactccctgtatgtgctatgtccatgacttgc

SEQ ID NO: 199119 - DNA, 34 bp, Artificial Sequence
  Description of Artificial Sequence: Synthetic oligonucleotide
gttactccctgtatgtgctatgtccatgacttgc

SEQ ID NO: 199120 - DNA, 34 bp, Artificial Sequence
  Description of Artificial Sequence: Synthetic oligonucleotide
ttactccctgtatgtgctatgtccatgacttgcc

SEQ ID NO: 199121 - DNA, 33 bp, Artificial Sequence
  Description of Artificial Sequence: Synthetic oligonucleotide
tactccctgtatgtgctatgtccatgacttgcc

SEQ ID NO: 199122 - DNA, 32 bp, Artificial Sequence
  Description of Artificial Sequence: Synthetic oligonucleotide
actccctgtatgtgctatgtccatgacttgcc

SEQ ID NO: 199123 - DNA, 31 bp, Artificial Sequence
  Description of Artificial Sequence: Synthetic oligonucleotide
ctccctgtatgtgctatgtccatgacttgcc

SEQ ID NO: 199124 - DNA, 31 bp, Artificial Sequence
  Description of Artificial Sequence: Synthetic oligonucleotide
tccctgtatgtgctatgtccatgacttgccc

SEQ ID NO: 199125 - DNA, 30 bp, Artificial Sequence
  Description of Artificial Sequence: Synthetic oligonucleotide
ccctgtatgtgctatgtccatgacttgccc

SEQ ID NO: 199126 - DNA, 36 bp, Artificial Sequence
  Description of Artificial Sequence: Synthetic oligonucleotide
cctgtatgtgctatgtccatgacttgcccaattttc

SEQ ID NO: 199127 - DNA, 37 bp, Artificial Sequence
  Description of Artificial Sequence: Synthetic oligonucleotide
ctgtatgtgctatgtccatgacttgcccaattttctc

SEQ ID NO: 199128 - DNA, 39 bp, Artificial Sequence
  Description of Artificial Sequence: Synthetic oligonucleotide
tgtatgtgctatgtccatgacttgcccaattttctcaag

SEQ ID NO: 199129 - DNA, 38 bp, Artificial Sequence
  Description of Artificial Sequence: Synthetic oligonucleotide
gtatgtgctatgtccatgacttgcccaattttctcaag

SEQ ID NO: 199130 - DNA, 39 bp, Artificial Sequence
  Description of Artificial Sequence: Synthetic oligonucleotide
tatgtgctatgtccatgacttgcccaattttctcaagtg

SEQ ID NO: 199131 - DNA, 38 bp, Artificial Sequence
  Description of Artificial Sequence: Synthetic oligonucleotide
atgtgctatgtccatgacttgcccaattttctcaagtg

SEQ ID NO: 199132 - DNA, 37 bp, Artificial Sequence
  Description of Artificial Sequence: Synthetic oligonucleotide
tgtgctatgtccatgacttgcccaattttctcaagtg

SEQ ID NO: 199133 - DNA, 36 bp, Artificial Sequence
  Description of Artificial Sequence: Synthetic oligonucleotide
gtgctatgtccatgacttgcccaattttctcaagtg

SEQ ID NO: 199134 - DNA, 36 bp, Artificial Sequence
  Description of Artificial Sequence: Synthetic oligonucleotide
tgctatgtccatgacttgcccaattttctcaagtgc

SEQ ID NO: 199135 - DNA, 35 bp, Artificial Sequence
  Description of Artificial Sequence: Synthetic oligonucleotide
gctatgtccatgacttgcccaattttctcaagtgc

SEQ ID NO: 199136 - DNA, 38 bp, Artificial Sequence
  Description of Artificial Sequence: Synthetic oligonucleotide
ctatgtccatgacttgcccaattttctcaagtgcattg

SEQ ID NO: 199137 - DNA, 42 bp, Artificial Sequence
  Description of Artificial Sequence: Synthetic oligonucleotide
tatgtccatgacttgcccaattttctcaagtgcattgaattc

SEQ ID NO: 199138 - DNA, 41 bp, Artificial Sequence
  Description of Artificial Sequence: Synthetic oligonucleotide
atgtccatgacttgcccaattttctcaagtgcattgaattc

SEQ ID NO: 199139 - DNA, 40 bp, Artificial Sequence
  Description of Artificial Sequence: Synthetic oligonucleotide
tgtccatgacttgcccaattttctcaagtgcattgaattc

SEQ ID NO: 199140 - DNA, 39 bp, Artificial Sequence
  Description of Artificial Sequence: Synthetic oligonucleotide
gtccatgacttgcccaattttctcaagtgcattgaattc

SEQ ID NO: 199141 - DNA, 39 bp, Artificial Sequence
  Description of Artificial Sequence: Synthetic oligonucleotide
tccatgacttgcccaattttctcaagtgcattgaattcc

SEQ ID NO: 199142 - DNA, 38 bp, Artificial Sequence
  Description of Artificial Sequence: Synthetic oligonucleotide
ccatgacttgcccaattttctcaagtgcattgaattcc

SEQ ID NO: 199143 - DNA, 40 bp, Artificial Sequence
  Description of Artificial Sequence: Synthetic oligonucleotide
catgacttgcccaattttctcaagtgcattgaattccatg

SEQ ID NO: 199144 - DNA, 40 bp, Artificial Sequence
  Description of Artificial Sequence: Synthetic oligonucleotide
atgacttgcccaattttctcaagtgcattgaattccatgc

SEQ ID NO: 199145 - DNA, 39 bp, Artificial Sequence
  Description of Artificial Sequence: Synthetic oligonucleotide
tgacttgcccaattttctcaagtgcattgaattccatgc

SEQ ID NO: 199146 - DNA, 38 bp, Artificial Sequence
  Description of Artificial Sequence: Synthetic oligonucleotide
gacttgcccaattttctcaagtgcattgaattccatgc

SEQ ID NO: 199147 - DNA, 39 bp, Artificial Sequence
  Description of Artificial Sequence: Synthetic oligonucleotide
acttgcccaattttctcaagtgcattgaattccatgctc

SEQ ID NO: 199148 - DNA, 38 bp, Artificial Sequence
  Description of Artificial Sequence: Synthetic oligonucleotide
cttgcccaattttctcaagtgcattgaattccatgctc

SEQ ID NO: 199149 - DNA, 39 bp, Artificial Sequence
  Description of Artificial Sequence: Synthetic oligonucleotide
ttgcccaattttctcaagtgcattgaattccatgctcag

SEQ ID NO: 199150 - DNA, 38 bp, Artificial Sequence
  Description of Artificial Sequence: Synthetic oligonucleotide
tgcccaattttctcaagtgcattgaattccatgctcag

SEQ ID NO: 199151 - DNA, 37 bp, Artificial Sequence
  Description of Artificial Sequence: Synthetic oligonucleotide
gcccaattttctcaagtgcattgaattccatgctcag

SEQ ID NO: 199152 - DNA, 37 bp, Artificial Sequence
  Description of Artificial Sequence: Synthetic oligonucleotide
cccaattttctcaagtgcattgaattccatgctcagc

SEQ ID NO: 199153 - DNA, 41 bp, Artificial Sequence
  Description of Artificial Sequence: Synthetic oligonucleotide
ccaattttctcaagtgcattgaattccatgctcagcaaatg

SEQ ID NO: 199154 - DNA, 41 bp, Artificial Sequence
  Description of Artificial Sequence: Synthetic oligonucleotide
caattttctcaagtgcattgaattccatgctcagcaaatgg

SEQ ID NO: 199155 - DNA, 41 bp, Artificial Sequence
  Description of Artificial Sequence: Synthetic oligonucleotide
aattttctcaagtgcattgaattccatgctcagcaaatggg

SEQ ID NO: 199156 - DNA, 40 bp, Artificial Sequence
  Description of Artificial Sequence: Synthetic oligonucleotide
attttctcaagtgcattgaattccatgctcagcaaatggg

SEQ ID NO: 199157 - DNA, 39 bp, Artificial Sequence
  Description of Artificial Sequence: Synthetic oligonucleotide
ttttctcaagtgcattgaattccatgctcagcaaatggg

SEQ ID NO: 199158 - DNA, 38 bp, Artificial Sequence
  Description of Artificial Sequence: Synthetic oligonucleotide
tttctcaagtgcattgaattccatgctcagcaaatggg

SEQ ID NO: 199159 - DNA, 37 bp, Artificial Sequence
  Description of Artificial Sequence: Synthetic oligonucleotide
ttctcaagtgcattgaattccatgctcagcaaatggg

SEQ ID NO: 199160 - DNA, 36 bp, Artificial Sequence
  Description of Artificial Sequence: Synthetic oligonucleotide
tctcaagtgcattgaattccatgctcagcaaatggg

SEQ ID NO: 199161 - DNA, 35 bp, Artificial Sequence
  Description of Artificial Sequence: Synthetic oligonucleotide
ctcaagtgcattgaattccatgctcagcaaatggg

SEQ ID NO: 199162 - DNA, 36 bp, Artificial Sequence
  Description of Artificial Sequence: Synthetic oligonucleotide
tcaagtgcattgaattccatgctcagcaaatgggac

SEQ ID NO: 199163 - DNA, 35 bp, Artificial Sequence
  Description of Artificial Sequence: Synthetic oligonucleotide
caagtgcattgaattccatgctcagcaaatgggac

SEQ ID NO: 199164 - DNA, 35 bp, Artificial Sequence
  Description of Artificial Sequence: Synthetic oligonucleotide
aagtgcattgaattccatgctcagcaaatgggacc

SEQ ID NO: 199165 - DNA, 34 bp, Artificial Sequence
  Description of Artificial Sequence: Synthetic oligonucleotide
agtgcattgaattccatgctcagcaaatgggacc

SEQ ID NO: 199166 - DNA, 33 bp, Artificial Sequence
  Description of Artificial Sequence: Synthetic oligonucleotide
gtgcattgaattccatgctcagcaaatgggacc

SEQ ID NO: 199167 - DNA, 34 bp, Artificial Sequence
  Description of Artificial Sequence: Synthetic oligonucleotide
tgcattgaattccatgctcagcaaatgggacctc

SEQ ID NO: 199168 - DNA, 33 bp, Artificial Sequence
  Description of Artificial Sequence: Synthetic oligonucleotide
gcattgaattccatgctcagcaaatgggacctc

SEQ ID NO: 199169 - DNA, 33 bp, Artificial Sequence
  Description of Artificial Sequence: Synthetic oligonucleotide
cattgaattccatgctcagcaaatgggacctcc

SEQ ID NO: 199170 - DNA, 33 bp, Artificial Sequence
  Description of Artificial Sequence: Synthetic oligonucleotide
attgaattccatgctcagcaaatgggacctccc

SEQ ID NO: 199171 - DNA, 32 bp, Artificial Sequence
  Description of Artificial Sequence: Synthetic oligonucleotide
ttgaattccatgctcagcaaatgggacctccc

SEQ ID NO: 199172 - DNA, 31 bp, Artificial Sequence
  Description of Artificial Sequence: Synthetic oligonucleotide
tgaattccatgctcagcaaatgggacctccc

SEQ ID NO: 199173 - DNA, 30 bp, Artificial Sequence
  Description of Artificial Sequence: Synthetic oligonucleotide
gaattccatgctcagcaaatgggacctccc

SEQ ID NO: 199174 - DNA, 30 bp, Artificial Sequence
  Description of Artificial Sequence: Synthetic oligonucleotide
aattccatgctcagcaaatgggacctcccc

SEQ ID NO: 199175 - DNA, 29 bp, Artificial Sequence
  Description of Artificial Sequence: Synthetic oligonucleotide
attccatgctcagcaaatgggacctcccc

SEQ ID NO: 199176 - DNA, 28 bp, Artificial Sequence
  Description of Artificial Sequence: Synthetic oligonucleotide
ttccatgctcagcaaatgggacctcccc

SEQ ID NO: 199177 - DNA, 27 bp, Artificial Sequence
  Description of Artificial Sequence: Synthetic oligonucleotide
tccatgctcagcaaatgggacctcccc

SEQ ID NO: 199178 - DNA, 26 bp, Artificial Sequence
  Description of Artificial Sequence: Synthetic oligonucleotide
ccatgctcagcaaatgggacctcccc

SEQ ID NO: 199179 - DNA, 27 bp, Artificial Sequence
  Description of Artificial Sequence: Synthetic oligonucleotide
catgctcagcaaatgggacctccccgt

SEQ ID NO: 199180 - DNA, 27 bp, Artificial Sequence
  Description of Artificial Sequence: Synthetic oligonucleotide
atgctcagcaaatgggacctccccgtc

SEQ ID NO: 199181 - DNA, 27 bp, Artificial Sequence
  Description of Artificial Sequence: Synthetic oligonucleotide
tgctcagcaaatgggacctccccgtct

SEQ ID NO: 199182 - DNA, 27 bp, Artificial Sequence
  Description of Artificial Sequence: Synthetic oligonucleotide
gctcagcaaatgggacctccccgtctt

SEQ ID NO: 199183 - DNA, 27 bp, Artificial Sequence
  Description of Artificial Sequence: Synthetic oligonucleotide
ctcagcaaatgggacctccccgtcttc

SEQ ID NO: 199184 - DNA, 28 bp, Artificial Sequence
  Description of Artificial Sequence: Synthetic oligonucleotide
tcagcaaatgggacctccccgtcttcac

SEQ ID NO: 199185 - DNA, 27 bp, Artificial Sequence
  Description of Artificial Sequence: Synthetic oligonucleotide
cagcaaatgggacctccccgtcttcac

SEQ ID NO: 199186 - DNA, 27 bp, Artificial Sequence
  Description of Artificial Sequence: Synthetic oligonucleotide
agcaaatgggacctccccgtcttcacc

SEQ ID NO: 199187 - DNA, 26 bp, Artificial Sequence
  Description of Artificial Sequence: Synthetic oligonucleotide
gcaaatgggacctccccgtcttcacc

SEQ ID NO: 199188 - DNA, 27 bp, Artificial Sequence
  Description of Artificial Sequence: Synthetic oligonucleotide
caaatgggacctccccgtcttcaccct

SEQ ID NO: 199189 - DNA, 27 bp, Artificial Sequence
  Description of Artificial Sequence: Synthetic oligonucleotide
aaatgggacctccccgtcttcaccctc

SEQ ID NO: 199190 - DNA, 26 bp, Artificial Sequence
  Description of Artificial Sequence: Synthetic oligonucleotide
aatgggacctccccgtcttcaccctc

SEQ ID NO: 199191 - DNA, 25 bp, Artificial Sequence
  Description of Artificial Sequence: Synthetic oligonucleotide
atgggacctccccgtcttcaccctc

SEQ ID NO: 199192 - DNA, 24 bp, Artificial Sequence
  Description of Artificial Sequence: Synthetic oligonucleotide
tgggacctccccgtcttcaccctc

SEQ ID NO: 199193 - DNA, 23 bp, Artificial Sequence
  Description of Artificial Sequence: Synthetic oligonucleotide
gggacctccccgtcttcaccctc

SEQ ID NO: 199194 - DNA, 23 bp, Artificial Sequence
  Description of Artificial Sequence: Synthetic oligonucleotide
ggacctccccgtcttcaccctcc

SEQ ID NO: 199195 - DNA, 26 bp, Artificial Sequence
  Description of Artificial Sequence: Synthetic oligonucleotide
gacctccccgtcttcaccctcccttt

SEQ ID NO: 199196 - DNA, 27 bp, Artificial Sequence
  Description of Artificial Sequence: Synthetic oligonucleotide
acctccccgtcttcaccctccctttca

SEQ ID NO: 199197 - DNA, 27 bp, Artificial Sequence
  Description of Artificial Sequence: Synthetic oligonucleotide
cctccccgtcttcaccctccctttcaa

SEQ ID NO: 199198 - DNA, 27 bp, Artificial Sequence
  Description of Artificial Sequence: Synthetic oligonucleotide
ctccccgtcttcaccctccctttcaac

SEQ ID NO: 199199 - DNA, 29 bp, Artificial Sequence
  Description of Artificial Sequence: Synthetic oligonucleotide
tccccgtcttcaccctccctttcaacatg

SEQ ID NO: 199200 - DNA, 28 bp, Artificial Sequence
  Description of Artificial Sequence: Synthetic oligonucleotide
ccccgtcttcaccctccctttcaacatg

SEQ ID NO: 199201 - DNA, 28 bp, Artificial Sequence
  Description of Artificial Sequence: Synthetic oligonucleotide
cccgtcttcaccctccctttcaacatgg

SEQ ID NO: 199202 - DNA, 28 bp, Artificial Sequence
  Description of Artificial Sequence: Synthetic oligonucleotide
ccgtcttcaccctccctttcaacatggc

SEQ ID NO: 199203 - DNA, 28 bp, Artificial Sequence
  Description of Artificial Sequence: Synthetic oligonucleotide
cgtcttcaccctccctttcaacatggcg

SEQ ID NO: 199204 - DNA, 30 bp, Artificial Sequence
  Description of Artificial Sequence: Synthetic oligonucleotide
gtcttcaccctccctttcaacatggcgttg

SEQ ID NO: 199205 - DNA, 31 bp, Artificial Sequence
  Description of Artificial Sequence: Synthetic oligonucleotide
tcttcaccctccctttcaacatggcgttgtc

SEQ ID NO: 199206 - DNA, 30 bp, Artificial Sequence
  Description of Artificial Sequence: Synthetic oligonucleotide
cttcaccctccctttcaacatggcgttgtc

SEQ ID NO: 199207 - DNA, 33 bp, Artificial Sequence
  Description of Artificial Sequence: Synthetic oligonucleotide
ttcaccctccctttcaacatggcgttgtcaatg

SEQ ID NO: 199208 - DNA, 32 bp, Artificial Sequence
  Description of Artificial Sequence: Synthetic oligonucleotide
tcaccctccctttcaacatggcgttgtcaatg

SEQ ID NO: 199209 - DNA, 31 bp, Artificial Sequence
  Description of Artificial Sequence: Synthetic oligonucleotide
caccctccctttcaacatggcgttgtcaatg

SEQ ID NO: 199210 - DNA, 33 bp, Artificial Sequence
  Description of Artificial Sequence: Synthetic oligonucleotide
accctccctttcaacatggcgttgtcaatgtac

SEQ ID NO: 199211 - DNA, 32 bp, Artificial Sequence
  Description of Artificial Sequence: Synthetic oligonucleotide
ccctccctttcaacatggcgttgtcaatgtac

SEQ ID NO: 199212 - DNA, 32 bp, Artificial Sequence
  Description of Artificial Sequence: Synthetic oligonucleotide
cctccctttcaacatggcgttgtcaatgtacc

SEQ ID NO: 199213 - DNA, 35 bp, Artificial Sequence
  Description of Artificial Sequence: Synthetic oligonucleotide
ctccctttcaacatggcgttgtcaatgtacctttc

SEQ ID NO: 199214 - DNA, 36 bp, Artificial Sequence
  Description of Artificial Sequence: Synthetic oligonucleotide
tccctttcaacatggcgttgtcaatgtacctttcag

SEQ ID NO: 199215 - DNA, 35 bp, Artificial Sequence
  Description of Artificial Sequence: Synthetic oligonucleotide
ccctttcaacatggcgttgtcaatgtacctttcag

SEQ ID NO: 199216 - DNA, 35 bp, Artificial Sequence
  Description of Artificial Sequence: Synthetic oligonucleotide
cctttcaacatggcgttgtcaatgtacctttcagc

SEQ ID NO: 199217 - DNA, 35 bp, Artificial Sequence
  Description of Artificial Sequence: Synthetic oligonucleotide
ctttcaacatggcgttgtcaatgtacctttcagcc

SEQ ID NO: 199218 - DNA, 36 bp, Artificial Sequence
  Description of Artificial Sequence: Synthetic oligonucleotide
tttcaacatggcgttgtcaatgtacctttcagccac

SEQ ID NO: 199219 - DNA, 35 bp, Artificial Sequence
  Description of Artificial Sequence: Synthetic oligonucleotide
ttcaacatggcgttgtcaatgtacctttcagccac

SEQ ID NO: 199220 - DNA, 34 bp, Artificial Sequence
  Description of Artificial Sequence: Synthetic oligonucleotide
tcaacatggcgttgtcaatgtacctttcagccac

SEQ ID NO: 199221 - DNA, 33 bp, Artificial Sequence
  Description of Artificial Sequence: Synthetic oligonucleotide
caacatggcgttgtcaatgtacctttcagccac

SEQ ID NO: 199222 - DNA, 34 bp, Artificial Sequence
  Description of Artificial Sequence: Synthetic oligonucleotide
aacatggcgttgtcaatgtacctttcagccacag

SEQ ID NO: 199223 - DNA, 33 bp, Artificial Sequence
  Description of Artificial Sequence: Synthetic oligonucleotide
acatggcgttgtcaatgtacctttcagccacag

SEQ ID NO: 199224 - DNA, 32 bp, Artificial Sequence
  Description of Artificial Sequence: Synthetic oligonucleotide
catggcgttgtcaatgtacctttcagccacag

SEQ ID NO: 199225 - DNA, 32 bp, Artificial Sequence
  Description of Artificial Sequence: Synthetic oligonucleotide
atggcgttgtcaatgtacctttcagccacagg

SEQ ID NO: 199226 - DNA, 31 bp, Artificial Sequence
  Description of Artificial Sequence: Synthetic oligonucleotide
tggcgttgtcaatgtacctttcagccacagg

SEQ ID NO: 199227 - DNA, 30 bp, Artificial Sequence
  Description of Artificial Sequence: Synthetic oligonucleotide
ggcgttgtcaatgtacctttcagccacagg

SEQ ID NO: 199228 - DNA, 31 bp, Artificial Sequence
  Description of Artificial Sequence: Synthetic oligonucleotide
gcgttgtcaatgtacctttcagccacaggac

SEQ ID NO: 199229 - DNA, 35 bp, Artificial Sequence
  Description of Artificial Sequence: Synthetic oligonucleotide
cgttgtcaatgtacctttcagccacaggacattac

SEQ ID NO: 199230 - DNA, 38 bp, Artificial Sequence
  Description of Artificial Sequence: Synthetic oligonucleotide
gttgtcaatgtacctttcagccacaggacattacaatc

SEQ ID NO: 199231 - DNA, 38 bp, Artificial Sequence
  Description of Artificial Sequence: Synthetic oligonucleotide
ttgtcaatgtacctttcagccacaggacattacaatcc

SEQ ID NO: 199232 - DNA, 37 bp, Artificial Sequence
  Description of Artificial Sequence: Synthetic oligonucleotide
tgtcaatgtacctttcagccacaggacattacaatcc

SEQ ID NO: 199233 - DNA, 36 bp, Artificial Sequence
  Description of Artificial Sequence: Synthetic oligonucleotide
gtcaatgtacctttcagccacaggacattacaatcc

SEQ ID NO: 199234 - DNA, 39 bp, Artificial Sequence
  Description of Artificial Sequence: Synthetic oligonucleotide
tcaatgtacctttcagccacaggacattacaatccattc

SEQ ID NO: 199235 - DNA, 38 bp, Artificial Sequence
  Description of Artificial Sequence: Synthetic oligonucleotide
caatgtacctttcagccacaggacattacaatccattc

SEQ ID NO: 199236 - DNA, 41 bp, Artificial Sequence
  Description of Artificial Sequence: Synthetic oligonucleotide
aatgtacctttcagccacaggacattacaatccattctttc

SEQ ID NO: 199237 - DNA, 40 bp, Artificial Sequence
  Description of Artificial Sequence: Synthetic oligonucleotide
atgtacctttcagccacaggacattacaatccattctttc

SEQ ID NO: 199238 - DNA, 39 bp, Artificial Sequence
  Description of Artificial Sequence: Synthetic oligonucleotide
tgtacctttcagccacaggacattacaatccattctttc

SEQ ID NO: 199239 - DNA, 38 bp, Artificial Sequence
  Description of Artificial Sequence: Synthetic oligonucleotide
gtacctttcagccacaggacattacaatccattctttc

SEQ ID NO: 199240 - DNA, 38 bp, Artificial Sequence
  Description of Artificial Sequence: Synthetic oligonucleotide
tacctttcagccacaggacattacaatccattctttcc

SEQ ID NO: 199241 - DNA, 37 bp, Artificial Sequence
  Description of Artificial Sequence: Synthetic oligonucleotide
acctttcagccacaggacattacaatccattctttcc

SEQ ID NO: 199242 - DNA, 36 bp, Artificial Sequence
  Description of Artificial Sequence: Synthetic oligonucleotide
cctttcagccacaggacattacaatccattctttcc

SEQ ID NO: 199243 - DNA, 37 bp, Artificial Sequence
  Description of Artificial Sequence: Synthetic oligonucleotide
ctttcagccacaggacattacaatccattctttccag

SEQ ID NO: 199244 - DNA, 37 bp, Artificial Sequence
  Description of Artificial Sequence: Synthetic oligonucleotide
tttcagccacaggacattacaatccattctttccagc

SEQ ID NO: 199245 - DNA, 36 bp, Artificial Sequence
  Description of Artificial Sequence: Synthetic oligonucleotide
ttcagccacaggacattacaatccattctttccagc

SEQ ID NO: 199246 - DNA, 35 bp, Artificial Sequence
  Description of Artificial Sequence: Synthetic oligonucleotide
tcagccacaggacattacaatccattctttccagc

SEQ ID NO: 199247 - DNA, 34 bp, Artificial Sequence
  Description of Artificial Sequence: Synthetic oligonucleotide
cagccacaggacattacaatccattctttccagc

SEQ ID NO: 199248 - DNA, 34 bp, Artificial Sequence
  Description of Artificial Sequence: Synthetic oligonucleotide
agccacaggacattacaatccattctttccagcc

SEQ ID NO: 199249 - DNA, 33 bp, Artificial Sequence
  Description of Artificial Sequence: Synthetic oligonucleotide
gccacaggacattacaatccattctttccagcc

SEQ ID NO: 199250 - DNA, 36 bp, Artificial Sequence
  Description of Artificial Sequence: Synthetic oligonucleotide
ccacaggacattacaatccattctttccagccaaac

SEQ ID NO: 199251 - DNA, 37 bp, Artificial Sequence
  Description of Artificial Sequence: Synthetic oligonucleotide
cacaggacattacaatccattctttccagccaaactg

SEQ ID NO: 199252 - DNA, 37 bp, Artificial Sequence
  Description of Artificial Sequence: Synthetic oligonucleotide
acaggacattacaatccattctttccagccaaactgg

SEQ ID NO: 199253 - DNA, 36 bp, Artificial Sequence
  Description of Artificial Sequence: Synthetic oligonucleotide
caggacattacaatccattctttccagccaaactgg

SEQ ID NO: 199254 - DNA, 37 bp, Artificial Sequence
  Description of Artificial Sequence: Synthetic oligonucleotide
aggacattacaatccattctttccagccaaactggtc

SEQ ID NO: 199255 - DNA, 36 bp, Artificial Sequence
  Description of Artificial Sequence: Synthetic oligonucleotide
ggacattacaatccattctttccagccaaactggtc

SEQ ID NO: 199256 - DNA, 39 bp, Artificial Sequence
  Description of Artificial Sequence: Synthetic oligonucleotide
gacattacaatccattctttccagccaaactggtcatac

SEQ ID NO: 199257 - DNA, 39 bp, Artificial Sequence
  Description of Artificial Sequence: Synthetic oligonucleotide
acattacaatccattctttccagccaaactggtcatacc

SEQ ID NO: 199258 - DNA, 38 bp, Artificial Sequence
  Description of Artificial Sequence: Synthetic oligonucleotide
cattacaatccattctttccagccaaactggtcatacc

SEQ ID NO: 199259 - DNA, 43 bp, Artificial Sequence
  Description of Artificial Sequence: Synthetic oligonucleotide
attacaatccattctttccagccaaactggtcatacctataac

SEQ ID NO: 199260 - DNA, 42 bp, Artificial Sequence
  Description of Artificial Sequence: Synthetic oligonucleotide
ttacaatccattctttccagccaaactggtcatacctataac

SEQ ID NO: 199261 - DNA, 41 bp, Artificial Sequence
  Description of Artificial Sequence: Synthetic oligonucleotide
tacaatccattctttccagccaaactggtcatacctataac

SEQ ID NO: 199262 - DNA, 40 bp, Artificial Sequence
  Description of Artificial Sequence: Synthetic oligonucleotide
acaatccattctttccagccaaactggtcatacctataac

SEQ ID NO: 199263 - DNA, 39 bp, Artificial Sequence
  Description of Artificial Sequence: Synthetic oligonucleotide
caatccattctttccagccaaactggtcatacctataac

SEQ ID NO: 199264 - DNA, 41 bp, Artificial Sequence
  Description of Artificial Sequence: Synthetic oligonucleotide
aatccattctttccagccaaactggtcatacctataactac

SEQ ID NO: 199265 - DNA, 40 bp, Artificial Sequence
  Description of Artificial Sequence: Synthetic oligonucleotide
atccattctttccagccaaactggtcatacctataactac

SEQ ID NO: 199266 - DNA, 39 bp, Artificial Sequence
  Description of Artificial Sequence: Synthetic oligonucleotide
tccattctttccagccaaactggtcatacctataactac

SEQ ID NO: 199267 - DNA, 38 bp, Artificial Sequence
  Description of Artificial Sequence: Synthetic oligonucleotide
ccattctttccagccaaactggtcatacctataactac

SEQ ID NO: 199268 - DNA, 39 bp, Artificial Sequence
  Description of Artificial Sequence: Synthetic oligonucleotide
cattctttccagccaaactggtcatacctataactacag

SEQ ID NO: 199269 - DNA, 39 bp, Artificial Sequence
  Description of Artificial Sequence: Synthetic oligonucleotide
attctttccagccaaactggtcatacctataactacagc

SEQ ID NO: 199270 - DNA, 38 bp, Artificial Sequence
  Description of Artificial Sequence: Synthetic oligonucleotide
ttctttccagccaaactggtcatacctataactacagc

SEQ ID NO: 199271 - DNA, 37 bp, Artificial Sequence
  Description of Artificial Sequence: Synthetic oligonucleotide
tctttccagccaaactggtcatacctataactacagc

SEQ ID NO: 199272 - DNA, 36 bp, Artificial Sequence
  Description of Artificial Sequence: Synthetic oligonucleotide
ctttccagccaaactggtcatacctataactacagc

SEQ ID NO: 199273 - DNA, 37 bp, Artificial Sequence
  Description of Artificial Sequence: Synthetic oligonucleotide
tttccagccaaactggtcatacctataactacagctc

SEQ ID NO: 199274 - DNA, 36 bp, Artificial Sequence
  Description of Artificial Sequence: Synthetic oligonucleotide
ttccagccaaactggtcatacctataactacagctc

SEQ ID NO: 199275 - DNA, 35 bp, Artificial Sequence
  Description of Artificial Sequence: Synthetic oligonucleotide
tccagccaaactggtcatacctataactacagctc

SEQ ID NO: 199276 - DNA, 34 bp, Artificial Sequence
  Description of Artificial Sequence: Synthetic oligonucleotide
ccagccaaactggtcatacctataactacagctc

SEQ ID NO: 199277 - DNA, 34 bp, Artificial Sequence
  Description of Artificial Sequence: Synthetic oligonucleotide
cagccaaactggtcatacctataactacagctcc

SEQ ID NO: 199278 - DNA, 40 bp, Artificial Sequence
  Description of Artificial Sequence: Synthetic oligonucleotide
agccaaactggtcatacctataactacagctccaaatatc

SEQ ID NO: 199279 - DNA, 39 bp, Artificial Sequence
  Description of Artificial Sequence: Synthetic oligonucleotide
gccaaactggtcatacctataactacagctccaaatatc

SEQ ID NO: 199280 - DNA, 40 bp, Artificial Sequence
  Description of Artificial Sequence: Synthetic oligonucleotide
ccaaactggtcatacctataactacagctccaaatatctc

SEQ ID NO: 199281 - DNA, 40 bp, Artificial Sequence
  Description of Artificial Sequence: Synthetic oligonucleotide
caaactggtcatacctataactacagctccaaatatctcc

SEQ ID NO: 199282 - DNA, 41 bp, Artificial Sequence
  Description of Artificial Sequence: Synthetic oligonucleotide
aaactggtcatacctataactacagctccaaatatctcctg

SEQ ID NO: 199283 - DNA, 40 bp, Artificial Sequence
  Description of Artificial Sequence: Synthetic oligonucleotide
aactggtcatacctataactacagctccaaatatctcctg

SEQ ID NO: 199284 - DNA, 39 bp, Artificial Sequence
  Description of Artificial Sequence: Synthetic oligonucleotide
actggtcatacctataactacagctccaaatatctcctg

SEQ ID NO: 199285 - DNA, 38 bp, Artificial Sequence
  Description of Artificial Sequence: Synthetic oligonucleotide
ctggtcatacctataactacagctccaaatatctcctg

SEQ ID NO: 199286 - DNA, 38 bp, Artificial Sequence
  Description of Artificial Sequence: Synthetic oligonucleotide
tggtcatacctataactacagctccaaatatctcctgg

SEQ ID NO: 199287 - DNA, 37 bp, Artificial Sequence
  Description of Artificial Sequence: Synthetic oligonucleotide
ggtcatacctataactacagctccaaatatctcctgg

SEQ ID NO: 199288 - DNA, 38 bp, Artificial Sequence
  Description of Artificial Sequence: Synthetic oligonucleotide
gtcatacctataactacagctccaaatatctcctggtc

SEQ ID NO: 199289 - DNA, 39 bp, Artificial Sequence
  Description of Artificial Sequence: Synthetic oligonucleotide
tcatacctataactacagctccaaatatctcctggtctg

SEQ ID NO: 199290 - DNA, 38 bp, Artificial Sequence
  Description of Artificial Sequence: Synthetic oligonucleotide
catacctataactacagctccaaatatctcctggtctg

SEQ ID NO: 199291 - DNA, 39 bp, Artificial Sequence
  Description of Artificial Sequence: Synthetic oligonucleotide
atacctataactacagctccaaatatctcctggtctgac

SEQ ID NO: 199292 - DNA, 38 bp, Artificial Sequence
  Description of Artificial Sequence: Synthetic oligonucleotide
tacctataactacagctccaaatatctcctggtctgac

SEQ ID NO: 199293 - DNA, 37 bp, Artificial Sequence
  Description of Artificial Sequence: Synthetic oligonucleotide
acctataactacagctccaaatatctcctggtctgac

SEQ ID NO: 199294 - DNA, 36 bp, Artificial Sequence
  Description of Artificial Sequence: Synthetic oligonucleotide
cctataactacagctccaaatatctcctggtctgac

SEQ ID NO: 199295 - DNA, 36 bp, Artificial Sequence
  Description of Artificial Sequence: Synthetic oligonucleotide
ctataactacagctccaaatatctcctggtctgacc

SEQ ID NO: 199296 - DNA, 37 bp, Artificial Sequence
  Description of Artificial Sequence: Synthetic oligonucleotide
tataactacagctccaaatatctcctggtctgacctc

SEQ ID NO: 199297 - DNA, 36 bp, Artificial Sequence
  Description of Artificial Sequence: Synthetic oligonucleotide
ataactacagctccaaatatctcctggtctgacctc

SEQ ID NO: 199298 - DNA, 35 bp, Artificial Sequence
  Description of Artificial Sequence: Synthetic oligonucleotide
taactacagctccaaatatctcctggtctgacctc

SEQ ID NO: 199299 - DNA, 34 bp, Artificial Sequence
  Description of Artificial Sequence: Synthetic oligonucleotide
aactacagctccaaatatctcctggtctgacctc

SEQ ID NO: 199300 - DNA, 33 bp, Artificial Sequence
  Description of Artificial Sequence: Synthetic oligonucleotide
actacagctccaaatatctcctggtctgacctc

SEQ ID NO: 199301 - DNA, 32 bp, Artificial Sequence
  Description of Artificial Sequence: Synthetic oligonucleotide
ctacagctccaaatatctcctggtctgacctc

SEQ ID NO: 199302 - DNA, 33 bp, Artificial Sequence
  Description of Artificial Sequence: Synthetic oligonucleotide
tacagctccaaatatctcctggtctgacctcag

SEQ ID NO: 199303 - DNA, 32 bp, Artificial Sequence
  Description of Artificial Sequence: Synthetic oligonucleotide
acagctccaaatatctcctggtctgacctcag

SEQ ID NO: 199304 - DNA, 31 bp, Artificial Sequence
  Description of Artificial Sequence: Synthetic oligonucleotide
cagctccaaatatctcctggtctgacctcag

SEQ ID NO: 199305 - DNA, 32 bp, Artificial Sequence
  Description of Artificial Sequence: Synthetic oligonucleotide
agctccaaatatctcctggtctgacctcagtg

SEQ ID NO: 199306 - DNA, 31 bp, Artificial Sequence
  Description of Artificial Sequence: Synthetic oligonucleotide
gctccaaatatctcctggtctgacctcagtg

SEQ ID NO: 199307 - DNA, 31 bp, Artificial Sequence
  Description of Artificial Sequence: Synthetic oligonucleotide
ctccaaatatctcctggtctgacctcagtgc

SEQ ID NO: 199308 - DNA, 31 bp, Artificial Sequence
  Description of Artificial Sequence: Synthetic oligonucleotide
tccaaatatctcctggtctgacctcagtgcc

SEQ ID NO: 199309 - DNA, 30 bp, Artificial Sequence
  Description of Artificial Sequence: Synthetic oligonucleotide
ccaaatatctcctggtctgacctcagtgcc

SEQ ID NO: 199310 - DNA, 30 bp, Artificial Sequence
  Description of Artificial Sequence: Synthetic oligonucleotide
caaatatctcctggtctgacctcagtgccc

SEQ ID NO: 199311 - DNA, 31 bp, Artificial Sequence
  Description of Artificial Sequence: Synthetic oligonucleotide
aaatatctcctggtctgacctcagtgccctg

SEQ ID NO: 199312 - DNA, 30 bp, Artificial Sequence
  Description of Artificial Sequence: Synthetic oligonucleotide
aatatctcctggtctgacctcagtgccctg

SEQ ID NO: 199313 - DNA, 29 bp, Artificial Sequence
  Description of Artificial Sequence: Synthetic oligonucleotide
atatctcctggtctgacctcagtgccctg

SEQ ID NO: 199314 - DNA, 28 bp, Artificial Sequence
  Description of Artificial Sequence: Synthetic oligonucleotide
tatctcctggtctgacctcagtgccctg

SEQ ID NO: 199315 - DNA, 27 bp, Artificial Sequence
  Description of Artificial Sequence: Synthetic oligonucleotide
atctcctggtctgacctcagtgccctg

SEQ ID NO: 199316 - DNA, 26 bp, Artificial Sequence
  Description of Artificial Sequence: Synthetic oligonucleotide
tctcctggtctgacctcagtgccctg

SEQ ID NO: 199317 - DNA, 25 bp, Artificial Sequence
  Description of Artificial Sequence: Synthetic oligonucleotide
ctcctggtctgacctcagtgccctg

SEQ ID NO: 199318 - DNA, 26 bp, Artificial Sequence
  Description of Artificial Sequence: Synthetic oligonucleotide
tcctggtctgacctcagtgccctgga

SEQ ID NO: 199319 - DNA, 25 bp, Artificial Sequence
  Description of Artificial Sequence: Synthetic oligonucleotide
cctggtctgacctcagtgccctgga

SEQ ID NO: 199320 - DNA, 27 bp, Artificial Sequence
  Description of Artificial Sequence: Synthetic oligonucleotide
ctggtctgacctcagtgccctggagtt

SEQ ID NO: 199321 - DNA, 27 bp, Artificial Sequence
  Description of Artificial Sequence: Synthetic oligonucleotide
tggtctgacctcagtgccctggagttg

SEQ ID NO: 199322 - DNA, 27 bp, Artificial Sequence
  Description of Artificial Sequence: Synthetic oligonucleotide
ggtctgacctcagtgccctggagttgt

SEQ ID NO: 199323 - DNA, 28 bp, Artificial Sequence
  Description of Artificial Sequence: Synthetic oligonucleotide
gtctgacctcagtgccctggagttgttg

SEQ ID NO: 199324 - DNA, 32 bp, Artificial Sequence
  Description of Artificial Sequence: Synthetic oligonucleotide
tctgacctcagtgccctggagttgttgaaatc

SEQ ID NO: 199325 - DNA, 31 bp, Artificial Sequence
  Description of Artificial Sequence: Synthetic oligonucleotide
ctgacctcagtgccctggagttgttgaaatc

SEQ ID NO: 199326 - DNA, 35 bp, Artificial Sequence
  Description of Artificial Sequence: Synthetic oligonucleotide
tgacctcagtgccctggagttgttgaaatctatac

SEQ ID NO: 199327 - DNA, 34 bp, Artificial Sequence
  Description of Artificial Sequence: Synthetic oligonucleotide
gacctcagtgccctggagttgttgaaatctatac

SEQ ID NO: 199328 - DNA, 34 bp, Artificial Sequence
  Description of Artificial Sequence: Synthetic oligonucleotide
acctcagtgccctggagttgttgaaatctatacc

SEQ ID NO: 199329 - DNA, 33 bp, Artificial Sequence
  Description of Artificial Sequence: Synthetic oligonucleotide
cctcagtgccctggagttgttgaaatctatacc

SEQ ID NO: 199330 - DNA, 34 bp, Artificial Sequence
  Description of Artificial Sequence: Synthetic oligonucleotide
ctcagtgccctggagttgttgaaatctataccag

SEQ ID NO: 199331 - DNA, 35 bp, Artificial Sequence
  Description of Artificial Sequence: Synthetic oligonucleotide
tcagtgccctggagttgttgaaatctataccagtg

SEQ ID NO: 199332 - DNA, 34 bp, Artificial Sequence
  Description of Artificial Sequence: Synthetic oligonucleotide
cagtgccctggagttgttgaaatctataccagtg

SEQ ID NO: 199333 - DNA, 34 bp, Artificial Sequence
  Description of Artificial Sequence: Synthetic oligonucleotide
agtgccctggagttgttgaaatctataccagtgg

SEQ ID NO: 199334 - DNA, 33 bp, Artificial Sequence
  Description of Artificial Sequence: Synthetic oligonucleotide
gtgccctggagttgttgaaatctataccagtgg

SEQ ID NO: 199335 - DNA, 33 bp, Artificial Sequence
  Description of Artificial Sequence: Synthetic oligonucleotide
tgccctggagttgttgaaatctataccagtggg

SEQ ID NO: 199336 - DNA, 32 bp, Artificial Sequence
  Description of Artificial Sequence: Synthetic oligonucleotide
gccctggagttgttgaaatctataccagtggg

SEQ ID NO: 199337 - DNA, 33 bp, Artificial Sequence
  Description of Artificial Sequence: Synthetic oligonucleotide
ccctggagttgttgaaatctataccagtgggag

SEQ ID NO: 199338 - DNA, 35 bp, Artificial Sequence
  Description of Artificial Sequence: Synthetic oligonucleotide
cctggagttgttgaaatctataccagtgggagttg

SEQ ID NO: 199339 - DNA, 35 bp, Artificial Sequence
  Description of Artificial Sequence: Synthetic oligonucleotide
ctggagttgttgaaatctataccagtgggagttgg

SEQ ID NO: 199340 - DNA, 36 bp, Artificial Sequence
  Description of Artificial Sequence: Synthetic oligonucleotide
tggagttgttgaaatctataccagtgggagttggtc

SEQ ID NO: 199341 - DNA, 35 bp, Artificial Sequence
  Description of Artificial Sequence: Synthetic oligonucleotide
ggagttgttgaaatctataccagtgggagttggtc

SEQ ID NO: 199342 - DNA, 36 bp, Artificial Sequence
  Description of Artificial Sequence: Synthetic oligonucleotide
gagttgttgaaatctataccagtgggagttggtcag

SEQ ID NO: 199343 - DNA, 38 bp, Artificial Sequence
  Description of Artificial Sequence: Synthetic oligonucleotide
agttgttgaaatctataccagtgggagttggtcagatc

SEQ ID NO: 199344 - DNA, 37 bp, Artificial Sequence
  Description of Artificial Sequence: Synthetic oligonucleotide
gttgttgaaatctataccagtgggagttggtcagatc

SEQ ID NO: 199345 - DNA, 40 bp, Artificial Sequence
  Description of Artificial Sequence: Synthetic oligonucleotide
ttgttgaaatctataccagtgggagttggtcagatctatg

SEQ ID NO: 199346 - DNA, 39 bp, Artificial Sequence
  Description of Artificial Sequence: Synthetic oligonucleotide
tgttgaaatctataccagtgggagttggtcagatctatg

SEQ ID NO: 199347 - DNA, 38 bp, Artificial Sequence
  Description of Artificial Sequence: Synthetic oligonucleotide
gttgaaatctataccagtgggagttggtcagatctatg

SEQ ID NO: 199348 - DNA, 38 bp, Artificial Sequence
  Description of Artificial Sequence: Synthetic oligonucleotide
ttgaaatctataccagtgggagttggtcagatctatgg

SEQ ID NO: 199349 - DNA, 37 bp, Artificial Sequence
  Description of Artificial Sequence: Synthetic oligonucleotide
tgaaatctataccagtgggagttggtcagatctatgg

SEQ ID NO: 199350 - DNA, 36 bp, Artificial Sequence
  Description of Artificial Sequence: Synthetic oligonucleotide
gaaatctataccagtgggagttggtcagatctatgg

SEQ ID NO: 199351 - DNA, 36 bp, Artificial Sequence
  Description of Artificial Sequence: Synthetic oligonucleotide
aaatctataccagtgggagttggtcagatctatggc

SEQ ID NO: 199352 - DNA, 35 bp, Artificial Sequence
  Description of Artificial Sequence: Synthetic oligonucleotide
aatctataccagtgggagttggtcagatctatggc

SEQ ID NO: 199353 - DNA, 34 bp, Artificial Sequence
  Description of Artificial Sequence: Synthetic oligonucleotide
atctataccagtgggagttggtcagatctatggc

SEQ ID NO: 199354 - DNA, 33 bp, Artificial Sequence
  Description of Artificial Sequence: Synthetic oligonucleotide
tctataccagtgggagttggtcagatctatggc

SEQ ID NO: 199355 - DNA, 32 bp, Artificial Sequence
  Description of Artificial Sequence: Synthetic oligonucleotide
ctataccagtgggagttggtcagatctatggc

SEQ ID NO: 199356 - DNA, 33 bp, Artificial Sequence
  Description of Artificial Sequence: Synthetic oligonucleotide
tataccagtgggagttggtcagatctatggctg

SEQ ID NO: 199357 - DNA, 32 bp, Artificial Sequence
  Description of Artificial Sequence: Synthetic oligonucleotide
ataccagtgggagttggtcagatctatggctg

SEQ ID NO: 199358 - DNA, 31 bp, Artificial Sequence
  Description of Artificial Sequence: Synthetic oligonucleotide
taccagtgggagttggtcagatctatggctg

SEQ ID NO: 199359 - DNA, 30 bp, Artificial Sequence
  Description of Artificial Sequence: Synthetic oligonucleotide
accagtgggagttggtcagatctatggctg

SEQ ID NO: 199360 - DNA, 29 bp, Artificial Sequence
  Description of Artificial Sequence: Synthetic oligonucleotide
ccagtgggagttggtcagatctatggctg

SEQ ID NO: 199361 - DNA, 30 bp, Artificial Sequence
  Description of Artificial Sequence: Synthetic oligonucleotide
cagtgggagttggtcagatctatggctgtg

SEQ ID NO: 199362 - DNA, 35 bp, Artificial Sequence
  Description of Artificial Sequence: Synthetic oligonucleotide
agtgggagttggtcagatctatggctgtgataatc

SEQ ID NO: 199363 - DNA, 34 bp, Artificial Sequence
  Description of Artificial Sequence: Synthetic oligonucleotide
gtgggagttggtcagatctatggctgtgataatc

SEQ ID NO: 199364 - DNA, 34 bp, Artificial Sequence
  Description of Artificial Sequence: Synthetic oligonucleotide
tgggagttggtcagatctatggctgtgataatcc

SEQ ID NO: 199365 - DNA, 33 bp, Artificial Sequence
  Description of Artificial Sequence: Synthetic oligonucleotide
gggagttggtcagatctatggctgtgataatcc

SEQ ID NO: 199366 - DNA, 35 bp, Artificial Sequence
  Description of Artificial Sequence: Synthetic oligonucleotide
ggagttggtcagatctatggctgtgataatccatg

SEQ ID NO: 199367 - DNA, 35 bp, Artificial Sequence
  Description of Artificial Sequence: Synthetic oligonucleotide
gagttggtcagatctatggctgtgataatccatgg

SEQ ID NO: 199368 - DNA, 36 bp, Artificial Sequence
  Description of Artificial Sequence: Synthetic oligonucleotide
agttggtcagatctatggctgtgataatccatggac

SEQ ID NO: 199369 - DNA, 35 bp, Artificial Sequence
  Description of Artificial Sequence: Synthetic oligonucleotide
gttggtcagatctatggctgtgataatccatggac

SEQ ID NO: 199370 - DNA, 36 bp, Artificial Sequence
  Description of Artificial Sequence: Synthetic oligonucleotide
ttggtcagatctatggctgtgataatccatggacag

SEQ ID NO: 199371 - DNA, 35 bp, Artificial Sequence
  Description of Artificial Sequence: Synthetic oligonucleotide
tggtcagatctatggctgtgataatccatggacag

SEQ ID NO: 199372 - DNA, 34 bp, Artificial Sequence
  Description of Artificial Sequence: Synthetic oligonucleotide
ggtcagatctatggctgtgataatccatggacag

SEQ ID NO: 199373 - DNA, 34 bp, Artificial Sequence
  Description of Artificial Sequence: Synthetic oligonucleotide
gtcagatctatggctgtgataatccatggacagg

SEQ ID NO: 199374 - DNA, 34 bp, Artificial Sequence
  Description of Artificial Sequence: Synthetic oligonucleotide
tcagatctatggctgtgataatccatggacaggg

SEQ ID NO: 199375 - DNA, 33 bp, Artificial Sequence
  Description of Artificial Sequence: Synthetic oligonucleotide
cagatctatggctgtgataatccatggacaggg

SEQ ID NO: 199376 - DNA, 33 bp, Artificial Sequence
  Description of Artificial Sequence: Synthetic oligonucleotide
agatctatggctgtgataatccatggacagggg

SEQ ID NO: 199377 - DNA, 32 bp, Artificial Sequence
  Description of Artificial Sequence: Synthetic oligonucleotide
gatctatggctgtgataatccatggacagggg

SEQ ID NO: 199378 - DNA, 32 bp, Artificial Sequence
  Description of Artificial Sequence: Synthetic oligonucleotide
atctatggctgtgataatccatggacaggggg

SEQ ID NO: 199379 - DNA, 31 bp, Artificial Sequence
  Description of Artificial Sequence: Synthetic oligonucleotide
tctatggctgtgataatccatggacaggggg

SEQ ID NO: 199380 - DNA, 30 bp, Artificial Sequence
  Description of Artificial Sequence: Synthetic oligonucleotide
ctatggctgtgataatccatggacaggggg

SEQ ID NO: 199381 - DNA, 30 bp, Artificial Sequence
  Description of Artificial Sequence: Synthetic oligonucleotide
tatggctgtgataatccatggacagggggc

SEQ ID NO: 199382 - DNA, 29 bp, Artificial Sequence
  Description of Artificial Sequence: Synthetic oligonucleotide
atggctgtgataatccatggacagggggc

SEQ ID NO: 199383 - DNA, 28 bp, Artificial Sequence
  Description of Artificial Sequence: Synthetic oligonucleotide
tggctgtgataatccatggacagggggc

SEQ ID NO: 199384 - DNA, 27 bp, Artificial Sequence
  Description of Artificial Sequence: Synthetic oligonucleotide
ggctgtgataatccatggacagggggc

SEQ ID NO: 199385 - DNA, 32 bp, Artificial Sequence
  Description of Artificial Sequence: Synthetic oligonucleotide
gctgtgataatccatggacagggggcattttc

SEQ ID NO: 199386 - DNA, 32 bp, Artificial Sequence
  Description of Artificial Sequence: Synthetic oligonucleotide
ctgtgataatccatggacagggggcattttcc

SEQ ID NO: 199387 - DNA, 33 bp, Artificial Sequence
  Description of Artificial Sequence: Synthetic oligonucleotide
tgtgataatccatggacagggggcattttcctg

SEQ ID NO: 199388 - DNA, 32 bp, Artificial Sequence
  Description of Artificial Sequence: Synthetic oligonucleotide
gtgataatccatggacagggggcattttcctg

SEQ ID NO: 199389 - DNA, 32 bp, Artificial Sequence
  Description of Artificial Sequence: Synthetic oligonucleotide
tgataatccatggacagggggcattttcctgg

SEQ ID NO: 199390 - DNA, 31 bp, Artificial Sequence
  Description of Artificial Sequence: Synthetic oligonucleotide
gataatccatggacagggggcattttcctgg

SEQ ID NO: 199391 - DNA, 31 bp, Artificial Sequence
  Description of Artificial Sequence: Synthetic oligonucleotide
ataatccatggacagggggcattttcctggg

SEQ ID NO: 199392 - DNA, 30 bp, Artificial Sequence
  Description of Artificial Sequence: Synthetic oligonucleotide
taatccatggacagggggcattttcctggg

SEQ ID NO: 199393 - DNA, 29 bp, Artificial Sequence
  Description of Artificial Sequence: Synthetic oligonucleotide
aatccatggacagggggcattttcctggg

SEQ ID NO: 199394 - DNA, 28 bp, Artificial Sequence
  Description of Artificial Sequence: Synthetic oligonucleotide
atccatggacagggggcattttcctggg

SEQ ID NO: 199395 - DNA, 27 bp, Artificial Sequence
  Description of Artificial Sequence: Synthetic oligonucleotide
tccatggacagggggcattttcctggg

SEQ ID NO: 199396 - DNA, 27 bp, Artificial Sequence
  Description of Artificial Sequence: Synthetic oligonucleotide
ccatggacagggggcattttcctggga

SEQ ID NO: 199397 - DNA, 27 bp, Artificial Sequence
  Description of Artificial Sequence: Synthetic oligonucleotide
catggacagggggcattttcctgggag

SEQ ID NO: 199398 - DNA, 27 bp, Artificial Sequence
  Description of Artificial Sequence: Synthetic oligonucleotide
atggacagggggcattttcctgggagc

SEQ ID NO: 199399 - DNA, 26 bp, Artificial Sequence
  Description of Artificial Sequence: Synthetic oligonucleotide
tggacagggggcattttcctgggagc

SEQ ID NO: 199400 - DNA, 25 bp, Artificial Sequence
  Description of Artificial Sequence: Synthetic oligonucleotide
ggacagggggcattttcctgggagc

SEQ ID NO: 199401 - DNA, 27 bp, Artificial Sequence
  Description of Artificial Sequence: Synthetic oligonucleotide
gacagggggcattttcctgggagccat

SEQ ID NO: 199402 - DNA, 27 bp, Artificial Sequence
  Description of Artificial Sequence: Synthetic oligonucleotide
acagggggcattttcctgggagccatc

SEQ ID NO: 199403 - DNA, 26 bp, Artificial Sequence
  Description of Artificial Sequence: Synthetic oligonucleotide
cagggggcattttcctgggagccatc

SEQ ID NO: 199404 - DNA, 27 bp, Artificial Sequence
  Description of Artificial Sequence: Synthetic oligonucleotide
agggggcattttcctgggagccatcct

SEQ ID NO: 199405 - DNA, 27 bp, Artificial Sequence
  Description of Artificial Sequence: Synthetic oligonucleotide
gggggcattttcctgggagccatccta

SEQ ID NO: 199406 - DNA, 27 bp, Artificial Sequence
  Description of Artificial Sequence: Synthetic oligonucleotide
ggggcattttcctgggagccatcctac

SEQ ID NO: 199407 - DNA, 28 bp, Artificial Sequence
  Description of Artificial Sequence: Synthetic oligonucleotide
gggcattttcctgggagccatcctactc

SEQ ID NO: 199408 - DNA, 29 bp, Artificial Sequence
  Description of Artificial Sequence: Synthetic oligonucleotide
ggcattttcctgggagccatcctactctc

SEQ ID NO: 199409 - DNA, 29 bp, Artificial Sequence
  Description of Artificial Sequence: Synthetic oligonucleotide
gcattttcctgggagccatcctactctcc

SEQ ID NO: 199410 - DNA, 30 bp, Artificial Sequence
  Description of Artificial Sequence: Synthetic oligonucleotide
cattttcctgggagccatcctactctcctc

SEQ ID NO: 199411 - DNA, 30 bp, Artificial Sequence
  Description of Artificial Sequence: Synthetic oligonucleotide
attttcctgggagccatcctactctcctcc

SEQ ID NO: 199412 - DNA, 29 bp, Artificial Sequence
  Description of Artificial Sequence: Synthetic oligonucleotide
ttttcctgggagccatcctactctcctcc

SEQ ID NO: 199413 - DNA, 28 bp, Artificial Sequence
  Description of Artificial Sequence: Synthetic oligonucleotide
tttcctgggagccatcctactctcctcc

SEQ ID NO: 199414 - DNA, 27 bp, Artificial Sequence
  Description of Artificial Sequence: Synthetic oligonucleotide
ttcctgggagccatcctactctcctcc

SEQ ID NO: 199415 - DNA, 26 bp, Artificial Sequence
  Description of Artificial Sequence: Synthetic oligonucleotide
tcctgggagccatcctactctcctcc

SEQ ID NO: 199416 - DNA, 25 bp, Artificial Sequence
  Description of Artificial Sequence: Synthetic oligonucleotide
cctgggagccatcctactctcctcc

SEQ ID NO: 199417 - DNA, 25 bp, Artificial Sequence
  Description of Artificial Sequence: Synthetic oligonucleotide
ctgggagccatcctactctcctccc

SEQ ID NO: 199418 - DNA, 26 bp, Artificial Sequence
  Description of Artificial Sequence: Synthetic oligonucleotide
tgggagccatcctactctcctcccca

SEQ ID NO: 199419 - DNA, 25 bp, Artificial Sequence
  Description of Artificial Sequence: Synthetic oligonucleotide
gggagccatcctactctcctcccca

SEQ ID NO: 199420 - DNA, 26 bp, Artificial Sequence
  Description of Artificial Sequence: Synthetic oligonucleotide
ggagccatcctactctcctccccact

SEQ ID NO: 199421 - DNA, 27 bp, Artificial Sequence
  Description of Artificial Sequence: Synthetic oligonucleotide
gagccatcctactctcctccccactca

SEQ ID NO: 199422 - DNA, 28 bp, Artificial Sequence
  Description of Artificial Sequence: Synthetic oligonucleotide
agccatcctactctcctccccactcatg

SEQ ID NO: 199423 - DNA, 27 bp, Artificial Sequence
  Description of Artificial Sequence: Synthetic oligonucleotide
gccatcctactctcctccccactcatg

SEQ ID NO: 199424 - DNA, 28 bp, Artificial Sequence
  Description of Artificial Sequence: Synthetic oligonucleotide
ccatcctactctcctccccactcatgtg

SEQ ID NO: 199425 - DNA, 28 bp, Artificial Sequence
  Description of Artificial Sequence: Synthetic oligonucleotide
catcctactctcctccccactcatgtgc

SEQ ID NO: 199426 - DNA, 28 bp, Artificial Sequence
  Description of Artificial Sequence: Synthetic oligonucleotide
atcctactctcctccccactcatgtgcc

SEQ ID NO: 199427 - DNA, 27 bp, Artificial Sequence
  Description of Artificial Sequence: Synthetic oligonucleotide
tcctactctcctccccactcatgtgcc

SEQ ID NO: 199428 - DNA, 27 bp, Artificial Sequence
  Description of Artificial Sequence: Synthetic oligonucleotide
cctactctcctccccactcatgtgcct

SEQ ID NO: 199429 - DNA, 27 bp, Artificial Sequence
  Description of Artificial Sequence: Synthetic oligonucleotide
ctactctcctccccactcatgtgcctg

SEQ ID NO: 199430 - DNA, 27 bp, Artificial Sequence
  Description of Artificial Sequence: Synthetic oligonucleotide
tactctcctccccactcatgtgcctgc

SEQ ID NO: 199431 - DNA, 27 bp, Artificial Sequence
  Description of Artificial Sequence: Synthetic oligonucleotide
actctcctccccactcatgtgcctgca

SEQ ID NO: 199432 - DNA, 27 bp, Artificial Sequence
  Description of Artificial Sequence: Synthetic oligonucleotide
ctctcctccccactcatgtgcctgcat

SEQ ID NO: 199433 - DNA, 27 bp, Artificial Sequence
  Description of Artificial Sequence: Synthetic oligonucleotide
tctcctccccactcatgtgcctgcatg

SEQ ID NO: 199434 - DNA, 26 bp, Artificial Sequence
  Description of Artificial Sequence: Synthetic oligonucleotide
ctcctccccactcatgtgcctgcatg

SEQ ID NO: 199435 - DNA, 27 bp, Artificial Sequence
  Description of Artificial Sequence: Synthetic oligonucleotide
tcctccccactcatgtgcctgcatgct

SEQ ID NO: 199436 - DNA, 26 bp, Artificial Sequence
  Description of Artificial Sequence: Synthetic oligonucleotide
cctccccactcatgtgcctgcatgct

SEQ ID NO: 199437 - DNA, 26 bp, Artificial Sequence
  Description of Artificial Sequence: Synthetic oligonucleotide
ctccccactcatgtgcctgcatgctg

SEQ ID NO: 199438 - DNA, 26 bp, Artificial Sequence
  Description of Artificial Sequence: Synthetic oligonucleotide
tccccactcatgtgcctgcatgctgc

SEQ ID NO: 199439 - DNA, 25 bp, Artificial Sequence
  Description of Artificial Sequence: Synthetic oligonucleotide
ccccactcatgtgcctgcatgctgc

SEQ ID NO: 199440 - DNA, 27 bp, Artificial Sequence
  Description of Artificial Sequence: Synthetic oligonucleotide
cccactcatgtgcctgcatgctgccat

SEQ ID NO: 199441 - DNA, 28 bp, Artificial Sequence
  Description of Artificial Sequence: Synthetic oligonucleotide
ccactcatgtgcctgcatgctgccatag

SEQ ID NO: 199442 - DNA, 28 bp, Artificial Sequence
  Description of Artificial Sequence: Synthetic oligonucleotide
cactcatgtgcctgcatgctgccatagg

SEQ ID NO: 199443 - DNA, 30 bp, Artificial Sequence
  Description of Artificial Sequence: Synthetic oligonucleotide
actcatgtgcctgcatgctgccataggatc

SEQ ID NO: 199444 - DNA, 29 bp, Artificial Sequence
  Description of Artificial Sequence: Synthetic oligonucleotide
ctcatgtgcctgcatgctgccataggatc

SEQ ID NO: 199445 - DNA, 32 bp, Artificial Sequence
  Description of Artificial Sequence: Synthetic oligonucleotide
tcatgtgcctgcatgctgccataggatcattg

SEQ ID NO: 199446 - DNA, 31 bp, Artificial Sequence
  Description of Artificial Sequence: Synthetic oligonucleotide
catgtgcctgcatgctgccataggatcattg

SEQ ID NO: 199447 - DNA, 31 bp, Artificial Sequence
  Description of Artificial Sequence: Synthetic oligonucleotide
atgtgcctgcatgctgccataggatcattgc

SEQ ID NO: 199448 - DNA, 30 bp, Artificial Sequence
  Description of Artificial Sequence: Synthetic oligonucleotide
tgtgcctgcatgctgccataggatcattgc

SEQ ID NO: 199449 - DNA, 29 bp, Artificial Sequence
  Description of Artificial Sequence: Synthetic oligonucleotide
gtgcctgcatgctgccataggatcattgc

SEQ ID NO: 199450 - DNA, 30 bp, Artificial Sequence
  Description of Artificial Sequence: Synthetic oligonucleotide
tgcctgcatgctgccataggatcattgctg

SEQ ID NO: 199451 - DNA, 29 bp, Artificial Sequence
  Description of Artificial Sequence: Synthetic oligonucleotide
gcctgcatgctgccataggatcattgctg

SEQ ID NO: 199452 - DNA, 29 bp, Artificial Sequence
  Description of Artificial Sequence: Synthetic oligonucleotide
cctgcatgctgccataggatcattgctgg

SEQ ID NO: 199453 - DNA, 29 bp, Artificial Sequence
  Description of Artificial Sequence: Synthetic oligonucleotide
ctgcatgctgccataggatcattgctggg

SEQ ID NO: 199454 - DNA, 29 bp, Artificial Sequence
  Description of Artificial Sequence: Synthetic oligonucleotide
tgcatgctgccataggatcattgctgggc

SEQ ID NO: 199455 - DNA, 28 bp, Artificial Sequence
  Description of Artificial Sequence: Synthetic oligonucleotide
gcatgctgccataggatcattgctgggc

SEQ ID NO: 199456 - DNA, 31 bp, Artificial Sequence
  Description of Artificial Sequence: Synthetic oligonucleotide
catgctgccataggatcattgctgggcatag

SEQ ID NO: 199457 - DNA, 31 bp, Artificial Sequence
  Description of Artificial Sequence: Synthetic oligonucleotide
atgctgccataggatcattgctgggcatagc

SEQ ID NO: 199458 - DNA, 30 bp, Artificial Sequence
  Description of Artificial Sequence: Synthetic oligonucleotide
tgctgccataggatcattgctgggcatagc

SEQ ID NO: 199459 - DNA, 29 bp, Artificial Sequence
  Description of Artificial Sequence: Synthetic oligonucleotide
gctgccataggatcattgctgggcatagc

SEQ ID NO: 199460 - DNA, 30 bp, Artificial Sequence
  Description of Artificial Sequence: Synthetic oligonucleotide
ctgccataggatcattgctgggcatagcag

SEQ ID NO: 199461 - DNA, 30 bp, Artificial Sequence
  Description of Artificial Sequence: Synthetic oligonucleotide
tgccataggatcattgctgggcatagcagc

SEQ ID NO: 199462 - DNA, 29 bp, Artificial Sequence
  Description of Artificial Sequence: Synthetic oligonucleotide
gccataggatcattgctgggcatagcagc

SEQ ID NO: 199463 - DNA, 29 bp, Artificial Sequence
  Description of Artificial Sequence: Synthetic oligonucleotide
ccataggatcattgctgggcatagcagcg

SEQ ID NO: 199464 - DNA, 29 bp, Artificial Sequence
  Description of Artificial Sequence: Synthetic oligonucleotide
cataggatcattgctgggcatagcagcgg

SEQ ID NO: 199465 - DNA, 29 bp, Artificial Sequence
  Description of Artificial Sequence: Synthetic oligonucleotide
ataggatcattgctgggcatagcagcggg

SEQ ID NO: 199466 - DNA, 28 bp, Artificial Sequence
  Description of Artificial Sequence: Synthetic oligonucleotide
taggatcattgctgggcatagcagcggg

SEQ ID NO: 199467 - DNA, 27 bp, Artificial Sequence
  Description of Artificial Sequence: Synthetic oligonucleotide
aggatcattgctgggcatagcagcggg

SEQ ID NO: 199468 - DNA, 27 bp, Artificial Sequence
  Description of Artificial Sequence: Synthetic oligonucleotide
ggatcattgctgggcatagcagcggga

SEQ ID NO: 199469 - DNA, 27 bp, Artificial Sequence
  Description of Artificial Sequence: Synthetic oligonucleotide
gatcattgctgggcatagcagcgggac

SEQ ID NO: 199470 - DNA, 28 bp, Artificial Sequence
  Description of Artificial Sequence: Synthetic oligonucleotide
atcattgctgggcatagcagcgggactc

SEQ ID NO: 199471 - DNA, 27 bp, Artificial Sequence
  Description of Artificial Sequence: Synthetic oligonucleotide
tcattgctgggcatagcagcgggactc

SEQ ID NO: 199472 - DNA, 27 bp, Artificial Sequence
  Description of Artificial Sequence: Synthetic oligonucleotide
cattgctgggcatagcagcgggactca

SEQ ID NO: 199473 - DNA, 27 bp, Artificial Sequence
  Description of Artificial Sequence: Synthetic oligonucleotide
attgctgggcatagcagcgggactcag

SEQ ID NO: 199474 - DNA, 27 bp, Artificial Sequence
  Description of Artificial Sequence: Synthetic oligonucleotide
ttgctgggcatagcagcgggactcagt

SEQ ID NO: 199475 - DNA, 26 bp, Artificial Sequence
  Description of Artificial Sequence: Synthetic oligonucleotide
tgctgggcatagcagcgggactcagt

SEQ ID NO: 199476 - DNA, 25 bp, Artificial Sequence
  Description of Artificial Sequence: Synthetic oligonucleotide
gctgggcatagcagcgggactcagt

SEQ ID NO: 199477 - DNA, 27 bp, Artificial Sequence
  Description of Artificial Sequence: Synthetic oligonucleotide
ctgggcatagcagcgggactcagtctt

SEQ ID NO: 199478 - DNA, 28 bp, Artificial Sequence
  Description of Artificial Sequence: Synthetic oligonucleotide
tgggcatagcagcgggactcagtctttc

SEQ ID NO: 199479 - DNA, 27 bp, Artificial Sequence
  Description of Artificial Sequence: Synthetic oligonucleotide
gggcatagcagcgggactcagtctttc

SEQ ID NO: 199480 - DNA, 28 bp, Artificial Sequence
  Description of Artificial Sequence: Synthetic oligonucleotide
ggcatagcagcgggactcagtctttcag

SEQ ID NO: 199481 - DNA, 28 bp, Artificial Sequence
  Description of Artificial Sequence: Synthetic oligonucleotide
gcatagcagcgggactcagtctttcagc

SEQ ID NO: 199482 - DNA, 28 bp, Artificial Sequence
  Description of Artificial Sequence: Synthetic oligonucleotide
catagcagcgggactcagtctttcagcc

SEQ ID NO: 199483 - DNA, 28 bp, Artificial Sequence
  Description of Artificial Sequence: Synthetic oligonucleotide
atagcagcgggactcagtctttcagccc

SEQ ID NO: 199484 - DNA, 27 bp, Artificial Sequence
  Description of Artificial Sequence: Synthetic oligonucleotide
tagcagcgggactcagtctttcagccc

SEQ ID NO: 199485 - DNA, 26 bp, Artificial Sequence
  Description of Artificial Sequence: Synthetic oligonucleotide
agcagcgggactcagtctttcagccc

SEQ ID NO: 199486 - DNA, 25 bp, Artificial Sequence
  Description of Artificial Sequence: Synthetic oligonucleotide
gcagcgggactcagtctttcagccc

SEQ ID NO: 199487 - DNA, 27 bp, Artificial Sequence
  Description of Artificial Sequence: Synthetic oligonucleotide
cagcgggactcagtctttcagccccat

SEQ ID NO: 199488 - DNA, 29 bp, Artificial Sequence
  Description of Artificial Sequence: Synthetic oligonucleotide
agcgggactcagtctttcagccccatttg

SEQ ID NO: 199489 - DNA, 28 bp, Artificial Sequence
  Description of Artificial Sequence: Synthetic oligonucleotide
gcgggactcagtctttcagccccatttg

SEQ ID NO: 199490 - DNA, 29 bp, Artificial Sequence
  Description of Artificial Sequence: Synthetic oligonucleotide
cgggactcagtctttcagccccatttgag

SEQ ID NO: 199491 - DNA, 29 bp, Artificial Sequence
  Description of Artificial Sequence: Synthetic oligonucleotide
gggactcagtctttcagccccatttgagg

SEQ ID NO: 199492 - DNA, 30 bp, Artificial Sequence
  Description of Artificial Sequence: Synthetic oligonucleotide
ggactcagtctttcagccccatttgaggac

SEQ ID NO: 199493 - DNA, 32 bp, Artificial Sequence
  Description of Artificial Sequence: Synthetic oligonucleotide
gactcagtctttcagccccatttgaggacatc

SEQ ID NO: 199494 - DNA, 34 bp, Artificial Sequence
  Description of Artificial Sequence: Synthetic oligonucleotide
actcagtctttcagccccatttgaggacatctac

SEQ ID NO: 199495 - DNA, 33 bp, Artificial Sequence
  Description of Artificial Sequence: Synthetic oligonucleotide
ctcagtctttcagccccatttgaggacatctac

SEQ ID NO: 199496 - DNA, 36 bp, Artificial Sequence
  Description of Artificial Sequence: Synthetic oligonucleotide
tcagtctttcagccccatttgaggacatctactttg

SEQ ID NO: 199497 - DNA, 35 bp, Artificial Sequence
  Description of Artificial Sequence: Synthetic oligonucleotide
cagtctttcagccccatttgaggacatctactttg

SEQ ID NO: 199498 - DNA, 35 bp, Artificial Sequence
  Description of Artificial Sequence: Synthetic oligonucleotide
agtctttcagccccatttgaggacatctactttgg

SEQ ID NO: 199499 - DNA, 34 bp, Artificial Sequence
  Description of Artificial Sequence: Synthetic oligonucleotide
gtctttcagccccatttgaggacatctactttgg

SEQ ID NO: 199500 - DNA, 35 bp, Artificial Sequence
  Description of Artificial Sequence: Synthetic oligonucleotide
tctttcagccccatttgaggacatctactttggac

SEQ ID NO: 199501 - DNA, 34 bp, Artificial Sequence
  Description of Artificial Sequence: Synthetic oligonucleotide
ctttcagccccatttgaggacatctactttggac

SEQ ID NO: 199502 - DNA, 35 bp, Artificial Sequence
  Description of Artificial Sequence: Synthetic oligonucleotide
tttcagccccatttgaggacatctactttggactc

SEQ ID NO: 199503 - DNA, 34 bp, Artificial Sequence
  Description of Artificial Sequence: Synthetic oligonucleotide
ttcagccccatttgaggacatctactttggactc

SEQ ID NO: 199504 - DNA, 33 bp, Artificial Sequence
  Description of Artificial Sequence: Synthetic oligonucleotide
tcagccccatttgaggacatctactttggactc

SEQ ID NO: 199505 - DNA, 32 bp, Artificial Sequence
  Description of Artificial Sequence: Synthetic oligonucleotide
cagccccatttgaggacatctactttggactc

SEQ ID NO: 199506 - DNA, 33 bp, Artificial Sequence
  Description of Artificial Sequence: Synthetic oligonucleotide
agccccatttgaggacatctactttggactctg

SEQ ID NO: 199507 - DNA, 32 bp, Artificial Sequence
  Description of Artificial Sequence: Synthetic oligonucleotide
gccccatttgaggacatctactttggactctg

SEQ ID NO: 199508 - DNA, 32 bp, Artificial Sequence
  Description of Artificial Sequence: Synthetic oligonucleotide
ccccatttgaggacatctactttggactctgg

SEQ ID NO: 199509 - DNA, 32 bp, Artificial Sequence
  Description of Artificial Sequence: Synthetic oligonucleotide
cccatttgaggacatctactttggactctggg

SEQ ID NO: 199510 - DNA, 32 bp, Artificial Sequence
  Description of Artificial Sequence: Synthetic oligonucleotide
ccatttgaggacatctactttggactctgggg

SEQ ID NO: 199511 - DNA, 35 bp, Artificial Sequence
  Description of Artificial Sequence: Synthetic oligonucleotide
catttgaggacatctactttggactctggggtttc

SEQ ID NO: 199512 - DNA, 37 bp, Artificial Sequence
  Description of Artificial Sequence: Synthetic oligonucleotide
atttgaggacatctactttggactctggggtttcaac

SEQ ID NO: 199513 - DNA, 36 bp, Artificial Sequence
  Description of Artificial Sequence: Synthetic oligonucleotide
tttgaggacatctactttggactctggggtttcaac

SEQ ID NO: 199514 - DNA, 35 bp, Artificial Sequence
  Description of Artificial Sequence: Synthetic oligonucleotide
ttgaggacatctactttggactctggggtttcaac

SEQ ID NO: 199515 - DNA, 34 bp, Artificial Sequence
  Description of Artificial Sequence: Synthetic oligonucleotide
tgaggacatctactttggactctggggtttcaac

SEQ ID NO: 199516 - DNA, 33 bp, Artificial Sequence
  Description of Artificial Sequence: Synthetic oligonucleotide
gaggacatctactttggactctggggtttcaac

SEQ ID NO: 199517 - DNA, 34 bp, Artificial Sequence
  Description of Artificial Sequence: Synthetic oligonucleotide
aggacatctactttggactctggggtttcaacag

SEQ ID NO: 199518 - DNA, 33 bp, Artificial Sequence
  Description of Artificial Sequence: Synthetic oligonucleotide
ggacatctactttggactctggggtttcaacag

SEQ ID NO: 199519 - DNA, 33 bp, Artificial Sequence
  Description of Artificial Sequence: Synthetic oligonucleotide
gacatctactttggactctggggtttcaacagc

SEQ ID NO: 199520 - DNA, 34 bp, Artificial Sequence
  Description of Artificial Sequence: Synthetic oligonucleotide
acatctactttggactctggggtttcaacagctc

SEQ ID NO: 199521 - DNA, 33 bp, Artificial Sequence
  Description of Artificial Sequence: Synthetic oligonucleotide
catctactttggactctggggtttcaacagctc

SEQ ID NO: 199522 - DNA, 34 bp, Artificial Sequence
  Description of Artificial Sequence: Synthetic oligonucleotide
atctactttggactctggggtttcaacagctctc

SEQ ID NO: 199523 - DNA, 33 bp, Artificial Sequence
  Description of Artificial Sequence: Synthetic oligonucleotide
tctactttggactctggggtttcaacagctctc

SEQ ID NO: 199524 - DNA, 32 bp, Artificial Sequence
  Description of Artificial Sequence: Synthetic oligonucleotide
ctactttggactctggggtttcaacagctctc

SEQ ID NO: 199525 - DNA, 33 bp, Artificial Sequence
  Description of Artificial Sequence: Synthetic oligonucleotide
tactttggactctggggtttcaacagctctctg

SEQ ID NO: 199526 - DNA, 32 bp, Artificial Sequence
  Description of Artificial Sequence: Synthetic oligonucleotide
actttggactctggggtttcaacagctctctg

SEQ ID NO: 199527 - DNA, 31 bp, Artificial Sequence
  Description of Artificial Sequence: Synthetic oligonucleotide
ctttggactctggggtttcaacagctctctg

SEQ ID NO: 199528 - DNA, 31 bp, Artificial Sequence
  Description of Artificial Sequence: Synthetic oligonucleotide
tttggactctggggtttcaacagctctctgg

SEQ ID NO: 199529 - DNA, 30 bp, Artificial Sequence
  Description of Artificial Sequence: Synthetic oligonucleotide
ttggactctggggtttcaacagctctctgg

SEQ ID NO: 199530 - DNA, 29 bp, Artificial Sequence
  Description of Artificial Sequence: Synthetic oligonucleotide
tggactctggggtttcaacagctctctgg

SEQ ID NO: 199531 - DNA, 28 bp, Artificial Sequence
  Description of Artificial Sequence: Synthetic oligonucleotide
ggactctggggtttcaacagctctctgg

SEQ ID NO: 199532 - DNA, 28 bp, Artificial Sequence
  Description of Artificial Sequence: Synthetic oligonucleotide
gactctggggtttcaacagctctctggc

SEQ ID NO: 199533 - DNA, 28 bp, Artificial Sequence
  Description of Artificial Sequence: Synthetic oligonucleotide
actctggggtttcaacagctctctggcc

SEQ ID NO: 199534 - DNA, 27 bp, Artificial Sequence
  Description of Artificial Sequence: Synthetic oligonucleotide
ctctggggtttcaacagctctctggcc

SEQ ID NO: 199535 - DNA, 28 bp, Artificial Sequence
  Description of Artificial Sequence: Synthetic oligonucleotide
tctggggtttcaacagctctctggcctg

SEQ ID NO: 199536 - DNA, 27 bp, Artificial Sequence
  Description of Artificial Sequence: Synthetic oligonucleotide
ctggggtttcaacagctctctggcctg

SEQ ID NO: 199537 - DNA, 27 bp, Artificial Sequence
  Description of Artificial Sequence: Synthetic oligonucleotide
tggggtttcaacagctctctggcctgc

SEQ ID NO: 199538 - DNA, 27 bp, Artificial Sequence
  Description of Artificial Sequence: Synthetic oligonucleotide
ggggtttcaacagctctctggcctgca

SEQ ID NO: 199539 - DNA, 29 bp, Artificial Sequence
  Description of Artificial Sequence: Synthetic oligonucleotide
gggtttcaacagctctctggcctgcattg

SEQ ID NO: 199540 - DNA, 29 bp, Artificial Sequence
  Description of Artificial Sequence: Synthetic oligonucleotide
ggtttcaacagctctctggcctgcattgc

SEQ ID NO: 199541 - DNA, 32 bp, Artificial Sequence
  Description of Artificial Sequence: Synthetic oligonucleotide
gtttcaacagctctctggcctgcattgcaatg

SEQ ID NO: 199542 - DNA, 32 bp, Artificial Sequence
  Description of Artificial Sequence: Synthetic oligonucleotide
tttcaacagctctctggcctgcattgcaatgg

SEQ ID NO: 199543 - DNA, 31 bp, Artificial Sequence
  Description of Artificial Sequence: Synthetic oligonucleotide
ttcaacagctctctggcctgcattgcaatgg

SEQ ID NO: 199544 - DNA, 30 bp, Artificial Sequence
  Description of Artificial Sequence: Synthetic oligonucleotide
tcaacagctctctggcctgcattgcaatgg

SEQ ID NO: 199545 - DNA, 29 bp, Artificial Sequence
  Description of Artificial Sequence: Synthetic oligonucleotide
caacagctctctggcctgcattgcaatgg

SEQ ID NO: 199546 - DNA, 29 bp, Artificial Sequence
  Description of Artificial Sequence: Synthetic oligonucleotide
aacagctctctggcctgcattgcaatggg

SEQ ID NO: 199547 - DNA, 28 bp, Artificial Sequence
  Description of Artificial Sequence: Synthetic oligonucleotide
acagctctctggcctgcattgcaatggg

SEQ ID NO: 199548 - DNA, 27 bp, Artificial Sequence
  Description of Artificial Sequence: Synthetic oligonucleotide
cagctctctggcctgcattgcaatggg

SEQ ID NO: 199549 - DNA, 28 bp, Artificial Sequence
  Description of Artificial Sequence: Synthetic oligonucleotide
agctctctggcctgcattgcaatgggag

SEQ ID NO: 199550 - DNA, 27 bp, Artificial Sequence
  Description of Artificial Sequence: Synthetic oligonucleotide
gctctctggcctgcattgcaatgggag

SEQ ID NO: 199551 - DNA, 27 bp, Artificial Sequence
  Description of Artificial Sequence: Synthetic oligonucleotide
ctctctggcctgcattgcaatgggagg

SEQ ID NO: 199552 - DNA, 30 bp, Artificial Sequence
  Description of Artificial Sequence: Synthetic oligonucleotide
tctctggcctgcattgcaatgggaggaatg

SEQ ID NO: 199553 - DNA, 29 bp, Artificial Sequence
  Description of Artificial Sequence: Synthetic oligonucleotide
ctctggcctgcattgcaatgggaggaatg

SEQ ID NO: 199554 - DNA, 31 bp, Artificial Sequence
  Description of Artificial Sequence: Synthetic oligonucleotide
tctggcctgcattgcaatgggaggaatgttc

SEQ ID NO: 199555 - DNA, 30 bp, Artificial Sequence
  Description of Artificial Sequence: Synthetic oligonucleotide
ctggcctgcattgcaatgggaggaatgttc

SEQ ID NO: 199556 - DNA, 32 bp, Artificial Sequence
  Description of Artificial Sequence: Synthetic oligonucleotide
tggcctgcattgcaatgggaggaatgttcatg

SEQ ID NO: 199557 - DNA, 31 bp, Artificial Sequence
  Description of Artificial Sequence: Synthetic oligonucleotide
ggcctgcattgcaatgggaggaatgttcatg

SEQ ID NO: 199558 - DNA, 31 bp, Artificial Sequence
  Description of Artificial Sequence: Synthetic oligonucleotide
gcctgcattgcaatgggaggaatgttcatgg

SEQ ID NO: 199559 - DNA, 31 bp, Artificial Sequence
  Description of Artificial Sequence: Synthetic oligonucleotide
cctgcattgcaatgggaggaatgttcatggc

SEQ ID NO: 199560 - DNA, 31 bp, Artificial Sequence
  Description of Artificial Sequence: Synthetic oligonucleotide
ctgcattgcaatgggaggaatgttcatggcg

SEQ ID NO: 199561 - DNA, 31 bp, Artificial Sequence
  Description of Artificial Sequence: Synthetic oligonucleotide
tgcattgcaatgggaggaatgttcatggcgc

SEQ ID NO: 199562 - DNA, 30 bp, Artificial Sequence
  Description of Artificial Sequence: Synthetic oligonucleotide
gcattgcaatgggaggaatgttcatggcgc

SEQ ID NO: 199563 - DNA, 31 bp, Artificial Sequence
  Description of Artificial Sequence: Synthetic oligonucleotide
cattgcaatgggaggaatgttcatggcgctc

SEQ ID NO: 199564 - DNA, 32 bp, Artificial Sequence
  Description of Artificial Sequence: Synthetic oligonucleotide
attgcaatgggaggaatgttcatggcgctcac

SEQ ID NO: 199565 - DNA, 31 bp, Artificial Sequence
  Description of Artificial Sequence: Synthetic oligonucleotide
ttgcaatgggaggaatgttcatggcgctcac

SEQ ID NO: 199566 - DNA, 30 bp, Artificial Sequence
  Description of Artificial Sequence: Synthetic oligonucleotide
tgcaatgggaggaatgttcatggcgctcac

SEQ ID NO: 199567 - DNA, 29 bp, Artificial Sequence
  Description of Artificial Sequence: Synthetic oligonucleotide
gcaatgggaggaatgttcatggcgctcac

SEQ ID NO: 199568 - DNA, 29 bp, Artificial Sequence
  Description of Artificial Sequence: Synthetic oligonucleotide
caatgggaggaatgttcatggcgctcacc

SEQ ID NO: 199569 - DNA, 30 bp, Artificial Sequence
  Description of Artificial Sequence: Synthetic oligonucleotide
aatgggaggaatgttcatggcgctcacctg

SEQ ID NO: 199570 - DNA, 29 bp, Artificial Sequence
  Description of Artificial Sequence: Synthetic oligonucleotide
atgggaggaatgttcatggcgctcacctg

SEQ ID NO: 199571 - DNA, 28 bp, Artificial Sequence
  Description of Artificial Sequence: Synthetic oligonucleotide
tgggaggaatgttcatggcgctcacctg

SEQ ID NO: 199572 - DNA, 27 bp, Artificial Sequence
  Description of Artificial Sequence: Synthetic oligonucleotide
gggaggaatgttcatggcgctcacctg

SEQ ID NO: 199573 - DNA, 27 bp, Artificial Sequence
  Description of Artificial Sequence: Synthetic oligonucleotide
ggaggaatgttcatggcgctcacctgg

SEQ ID NO: 199574 - DNA, 27 bp, Artificial Sequence
  Description of Artificial Sequence: Synthetic oligonucleotide
gaggaatgttcatggcgctcacctggc

SEQ ID NO: 199575 - DNA, 30 bp, Artificial Sequence
  Description of Artificial Sequence: Synthetic oligonucleotide
aggaatgttcatggcgctcacctggcaaac

SEQ ID NO: 199576 - DNA, 29 bp, Artificial Sequence
  Description of Artificial Sequence: Synthetic oligonucleotide
ggaatgttcatggcgctcacctggcaaac

SEQ ID NO: 199577 - DNA, 29 bp, Artificial Sequence
  Description of Artificial Sequence: Synthetic oligonucleotide
gaatgttcatggcgctcacctggcaaacc

SEQ ID NO: 199578 - DNA, 29 bp, Artificial Sequence
  Description of Artificial Sequence: Synthetic oligonucleotide
aatgttcatggcgctcacctggcaaaccc

SEQ ID NO: 199579 - DNA, 28 bp, Artificial Sequence
  Description of Artificial Sequence: Synthetic oligonucleotide
atgttcatggcgctcacctggcaaaccc

SEQ ID NO: 199580 - DNA, 27 bp, Artificial Sequence
  Description of Artificial Sequence: Synthetic oligonucleotide
tgttcatggcgctcacctggcaaaccc

SEQ ID NO: 199581 - DNA, 27 bp, Artificial Sequence
  Description of Artificial Sequence: Synthetic oligonucleotide
gttcatggcgctcacctggcaaaccca

SEQ ID NO: 199582 - DNA, 27 bp, Artificial Sequence
  Description of Artificial Sequence: Synthetic oligonucleotide
ttcatggcgctcacctggcaaacccac

SEQ ID NO: 199583 - DNA, 26 bp, Artificial Sequence
  Description of Artificial Sequence: Synthetic oligonucleotide
tcatggcgctcacctggcaaacccac

SEQ ID NO: 199584 - DNA, 25 bp, Artificial Sequence
  Description of Artificial Sequence: Synthetic oligonucleotide
catggcgctcacctggcaaacccac

SEQ ID NO: 199585 - DNA, 26 bp, Artificial Sequence
  Description of Artificial Sequence: Synthetic oligonucleotide
atggcgctcacctggcaaacccacct

SEQ ID NO: 199586 - DNA, 25 bp, Artificial Sequence
  Description of Artificial Sequence: Synthetic oligonucleotide
tggcgctcacctggcaaacccacct

SEQ ID NO: 199587 - DNA, 24 bp, Artificial Sequence
  Description of Artificial Sequence: Synthetic oligonucleotide
ggcgctcacctggcaaacccacct

SEQ ID NO: 199588 - DNA, 24 bp, Artificial Sequence
  Description of Artificial Sequence: Synthetic oligonucleotide
gcgctcacctggcaaacccacctc

SEQ ID NO: 199589 - DNA, 25 bp, Artificial Sequence
  Description of Artificial Sequence: Synthetic oligonucleotide
cgctcacctggcaaacccacctcct

SEQ ID NO: 199590 - DNA, 25 bp, Artificial Sequence
  Description of Artificial Sequence: Synthetic oligonucleotide
gctcacctggcaaacccacctcctg

SEQ ID NO: 199591 - DNA, 25 bp, Artificial Sequence
  Description of Artificial Sequence: Synthetic oligonucleotide
ctcacctggcaaacccacctcctgg

SEQ ID NO: 199592 - DNA, 26 bp, Artificial Sequence
  Description of Artificial Sequence: Synthetic oligonucleotide
tcacctggcaaacccacctcctggct

SEQ ID NO: 199593 - DNA, 25 bp, Artificial Sequence
  Description of Artificial Sequence: Synthetic oligonucleotide
cacctggcaaacccacctcctggct

SEQ ID NO: 199594 - DNA, 27 bp, Artificial Sequence
  Description of Artificial Sequence: Synthetic oligonucleotide
acctggcaaacccacctcctggctctt

SEQ ID NO: 199595 - DNA, 26 bp, Artificial Sequence
  Description of Artificial Sequence: Synthetic oligonucleotide
cctggcaaacccacctcctggctctt

SEQ ID NO: 199596 - DNA, 26 bp, Artificial Sequence
  Description of Artificial Sequence: Synthetic oligonucleotide
ctggcaaacccacctcctggctcttg

SEQ ID NO: 199597 - DNA, 26 bp, Artificial Sequence
  Description of Artificial Sequence: Synthetic oligonucleotide
tggcaaacccacctcctggctcttgg

SEQ ID NO: 199598 - DNA, 25 bp, Artificial Sequence
  Description of Artificial Sequence: Synthetic oligonucleotide
ggcaaacccacctcctggctcttgg

SEQ ID NO: 199599 - DNA, 26 bp, Artificial Sequence
  Description of Artificial Sequence: Synthetic oligonucleotide
gcaaacccacctcctggctcttggct

SEQ ID NO: 199600 - DNA, 27 bp, Artificial Sequence
  Description of Artificial Sequence: Synthetic oligonucleotide
caaacccacctcctggctcttggctgt

SEQ ID NO: 199601 - DNA, 27 bp, Artificial Sequence
  Description of Artificial Sequence: Synthetic oligonucleotide
aaacccacctcctggctcttggctgtg

SEQ ID NO: 199602 - DNA, 26 bp, Artificial Sequence
  Description of Artificial Sequence: Synthetic oligonucleotide
aacccacctcctggctcttggctgtg

SEQ ID NO: 199603 - DNA, 25 bp, Artificial Sequence
  Description of Artificial Sequence: Synthetic oligonucleotide
acccacctcctggctcttggctgtg

SEQ ID NO: 199604 - DNA, 24 bp, Artificial Sequence
  Description of Artificial Sequence: Synthetic oligonucleotide
cccacctcctggctcttggctgtg

SEQ ID NO: 199605 - DNA, 24 bp, Artificial Sequence
  Description of Artificial Sequence: Synthetic oligonucleotide
ccacctcctggctcttggctgtgc

SEQ ID NO: 199606 - DNA, 24 bp, Artificial Sequence
  Description of Artificial Sequence: Synthetic oligonucleotide
cacctcctggctcttggctgtgcc

SEQ ID NO: 199607 - DNA, 25 bp, Artificial Sequence
  Description of Artificial Sequence: Synthetic oligonucleotide
acctcctggctcttggctgtgccct

SEQ ID NO: 199608 - DNA, 24 bp, Artificial Sequence
  Description of Artificial Sequence: Synthetic oligonucleotide
cctcctggctcttggctgtgccct

SEQ ID NO: 199609 - DNA, 26 bp, Artificial Sequence
  Description of Artificial Sequence: Synthetic oligonucleotide
ctcctggctcttggctgtgccctgtt

SEQ ID NO: 199610 - DNA, 27 bp, Artificial Sequence
  Description of Artificial Sequence: Synthetic oligonucleotide
tcctggctcttggctgtgccctgttca

SEQ ID NO: 199611 - DNA, 26 bp, Artificial Sequence
  Description of Artificial Sequence: Synthetic oligonucleotide
cctggctcttggctgtgccctgttca

SEQ ID NO: 199612 - DNA, 26 bp, Artificial Sequence
  Description of Artificial Sequence: Synthetic oligonucleotide
ctggctcttggctgtgccctgttcac

SEQ ID NO: 199613 - DNA, 26 bp, Artificial Sequence
  Description of Artificial Sequence: Synthetic oligonucleotide
tggctcttggctgtgccctgttcacg

SEQ ID NO: 199614 - DNA, 25 bp, Artificial Sequence
  Description of Artificial Sequence: Synthetic oligonucleotide
ggctcttggctgtgccctgttcacg

SEQ ID NO: 199615 - DNA, 25 bp, Artificial Sequence
  Description of Artificial Sequence: Synthetic oligonucleotide
gctcttggctgtgccctgttcacgg

SEQ ID NO: 199616 - DNA, 25 bp, Artificial Sequence
  Description of Artificial Sequence: Synthetic oligonucleotide
ctcttggctgtgccctgttcacggc

SEQ ID NO: 199617 - DNA, 27 bp, Artificial Sequence
  Description of Artificial Sequence: Synthetic oligonucleotide
tcttggctgtgccctgttcacggccta

SEQ ID NO: 199618 - DNA, 27 bp, Artificial Sequence
  Description of Artificial Sequence: Synthetic oligonucleotide
cttggctgtgccctgttcacggcctat

SEQ ID NO: 199619 - DNA, 27 bp, Artificial Sequence
  Description of Artificial Sequence: Synthetic oligonucleotide
ttggctgtgccctgttcacggcctatc

SEQ ID NO: 199620 - DNA, 27 bp, Artificial Sequence
  Description of Artificial Sequence: Synthetic oligonucleotide
tggctgtgccctgttcacggcctatct

SEQ ID NO: 199621 - DNA, 27 bp, Artificial Sequence
  Description of Artificial Sequence: Synthetic oligonucleotide
ggctgtgccctgttcacggcctatctt

SEQ ID NO: 199622 - DNA, 27 bp, Artificial Sequence
  Description of Artificial Sequence: Synthetic oligonucleotide
gctgtgccctgttcacggcctatcttg

SEQ ID NO: 199623 - DNA, 27 bp, Artificial Sequence
  Description of Artificial Sequence: Synthetic oligonucleotide
ctgtgccctgttcacggcctatcttgg

SEQ ID NO: 199624 - DNA, 28 bp, Artificial Sequence
  Description of Artificial Sequence: Synthetic oligonucleotide
tgtgccctgttcacggcctatcttggag

SEQ ID NO: 199625 - DNA, 27 bp, Artificial Sequence
  Description of Artificial Sequence: Synthetic oligonucleotide
gtgccctgttcacggcctatcttggag

SEQ ID NO: 199626 - DNA, 28 bp, Artificial Sequence
  Description of Artificial Sequence: Synthetic oligonucleotide
tgccctgttcacggcctatcttggagtc

SEQ ID NO: 199627 - DNA, 27 bp, Artificial Sequence
  Description of Artificial Sequence: Synthetic oligonucleotide
gccctgttcacggcctatcttggagtc

SEQ ID NO: 199628 - DNA, 27 bp, Artificial Sequence
  Description of Artificial Sequence: Synthetic oligonucleotide
ccctgttcacggcctatcttggagtcg

SEQ ID NO: 199629 - DNA, 27 bp, Artificial Sequence
  Description of Artificial Sequence: Synthetic oligonucleotide
cctgttcacggcctatcttggagtcgg

SEQ ID NO: 199630 - DNA, 27 bp, Artificial Sequence
  Description of Artificial Sequence: Synthetic oligonucleotide
ctgttcacggcctatcttggagtcggc

SEQ ID NO: 199631 - DNA, 29 bp, Artificial Sequence
  Description of Artificial Sequence: Synthetic oligonucleotide
tgttcacggcctatcttggagtcggcatg

SEQ ID NO: 199632 - DNA, 28 bp, Artificial Sequence
  Description of Artificial Sequence: Synthetic oligonucleotide
gttcacggcctatcttggagtcggcatg

SEQ ID NO: 199633 - DNA, 28 bp, Artificial Sequence
  Description of Artificial Sequence: Synthetic oligonucleotide
ttcacggcctatcttggagtcggcatgg

SEQ ID NO: 199634 - DNA, 27 bp, Artificial Sequence
  Description of Artificial Sequence: Synthetic oligonucleotide
tcacggcctatcttggagtcggcatgg

SEQ ID NO: 199635 - DNA, 26 bp, Artificial Sequence
  Description of Artificial Sequence: Synthetic oligonucleotide
cacggcctatcttggagtcggcatgg

SEQ ID NO: 199636 - DNA, 27 bp, Artificial Sequence
  Description of Artificial Sequence: Synthetic oligonucleotide
acggcctatcttggagtcggcatggca

SEQ ID NO: 199637 - DNA, 27 bp, Artificial Sequence
  Description of Artificial Sequence: Synthetic oligonucleotide
cggcctatcttggagtcggcatggcaa

SEQ ID NO: 199638 - DNA, 28 bp, Artificial Sequence
  Description of Artificial Sequence: Synthetic oligonucleotide
ggcctatcttggagtcggcatggcaaac

SEQ ID NO: 199639 - DNA, 33 bp, Artificial Sequence
  Description of Artificial Sequence: Synthetic oligonucleotide
gcctatcttggagtcggcatggcaaactttatg

SEQ ID NO: 199640 - DNA, 33 bp, Artificial Sequence
  Description of Artificial Sequence: Synthetic oligonucleotide
cctatcttggagtcggcatggcaaactttatgg

SEQ ID NO: 199641 - DNA, 33 bp, Artificial Sequence
  Description of Artificial Sequence: Synthetic oligonucleotide
ctatcttggagtcggcatggcaaactttatggc

SEQ ID NO: 199642 - DNA, 34 bp, Artificial Sequence
  Description of Artificial Sequence: Synthetic oligonucleotide
tatcttggagtcggcatggcaaactttatggctg

SEQ ID NO: 199643 - DNA, 33 bp, Artificial Sequence
  Description of Artificial Sequence: Synthetic oligonucleotide
atcttggagtcggcatggcaaactttatggctg

SEQ ID NO: 199644 - DNA, 32 bp, Artificial Sequence
  Description of Artificial Sequence: Synthetic oligonucleotide
tcttggagtcggcatggcaaactttatggctg

SEQ ID NO: 199645 - DNA, 31 bp, Artificial Sequence
  Description of Artificial Sequence: Synthetic oligonucleotide
cttggagtcggcatggcaaactttatggctg

SEQ ID NO: 199646 - DNA, 32 bp, Artificial Sequence
  Description of Artificial Sequence: Synthetic oligonucleotide
ttggagtcggcatggcaaactttatggctgag

SEQ ID NO: 199647 - DNA, 31 bp, Artificial Sequence
  Description of Artificial Sequence: Synthetic oligonucleotide
tggagtcggcatggcaaactttatggctgag

SEQ ID NO: 199648 - DNA, 30 bp, Artificial Sequence
  Description of Artificial Sequence: Synthetic oligonucleotide
ggagtcggcatggcaaactttatggctgag

SEQ ID NO: 199649 - DNA, 30 bp, Artificial Sequence
  Description of Artificial Sequence: Synthetic oligonucleotide
gagtcggcatggcaaactttatggctgagg

SEQ ID NO: 199650 - DNA, 32 bp, Artificial Sequence
  Description of Artificial Sequence: Synthetic oligonucleotide
agtcggcatggcaaactttatggctgaggttg

SEQ ID NO: 199651 - DNA, 31 bp, Artificial Sequence
  Description of Artificial Sequence: Synthetic oligonucleotide
gtcggcatggcaaactttatggctgaggttg

SEQ ID NO: 199652 - DNA, 31 bp, Artificial Sequence
  Description of Artificial Sequence: Synthetic oligonucleotide
tcggcatggcaaactttatggctgaggttgg

SEQ ID NO: 199653 - DNA, 30 bp, Artificial Sequence
  Description of Artificial Sequence: Synthetic oligonucleotide
cggcatggcaaactttatggctgaggttgg

SEQ ID NO: 199654 - DNA, 33 bp, Artificial Sequence
  Description of Artificial Sequence: Synthetic oligonucleotide
ggcatggcaaactttatggctgaggttggattg

SEQ ID NO: 199655 - DNA, 33 bp, Artificial Sequence
  Description of Artificial Sequence: Synthetic oligonucleotide
gcatggcaaactttatggctgaggttggattgc

SEQ ID NO: 199656 - DNA, 33 bp, Artificial Sequence
  Description of Artificial Sequence: Synthetic oligonucleotide
catggcaaactttatggctgaggttggattgcc

SEQ ID NO: 199657 - DNA, 34 bp, Artificial Sequence
  Description of Artificial Sequence: Synthetic oligonucleotide
atggcaaactttatggctgaggttggattgccag

SEQ ID NO: 199658 - DNA, 33 bp, Artificial Sequence
  Description of Artificial Sequence: Synthetic oligonucleotide
tggcaaactttatggctgaggttggattgccag

SEQ ID NO: 199659 - DNA, 32 bp, Artificial Sequence
  Description of Artificial Sequence: Synthetic oligonucleotide
ggcaaactttatggctgaggttggattgccag

SEQ ID NO: 199660 - DNA, 32 bp, Artificial Sequence
  Description of Artificial Sequence: Synthetic oligonucleotide
gcaaactttatggctgaggttggattgccagc

SEQ ID NO: 199661 - DNA, 34 bp, Artificial Sequence
  Description of Artificial Sequence: Synthetic oligonucleotide
caaactttatggctgaggttggattgccagcttg

SEQ ID NO: 199662 - DNA, 36 bp, Artificial Sequence
  Description of Artificial Sequence: Synthetic oligonucleotide
aaactttatggctgaggttggattgccagcttgtac

SEQ ID NO: 199663 - DNA, 35 bp, Artificial Sequence
  Description of Artificial Sequence: Synthetic oligonucleotide
aactttatggctgaggttggattgccagcttgtac

SEQ ID NO: 199664 - DNA, 34 bp, Artificial Sequence
  Description of Artificial Sequence: Synthetic oligonucleotide
actttatggctgaggttggattgccagcttgtac

SEQ ID NO: 199665 - DNA, 33 bp, Artificial Sequence
  Description of Artificial Sequence: Synthetic oligonucleotide
ctttatggctgaggttggattgccagcttgtac

SEQ ID NO: 199666 - DNA, 33 bp, Artificial Sequence
  Description of Artificial Sequence: Synthetic oligonucleotide
tttatggctgaggttggattgccagcttgtacc

SEQ ID NO: 199667 - DNA, 32 bp, Artificial Sequence
  Description of Artificial Sequence: Synthetic oligonucleotide
ttatggctgaggttggattgccagcttgtacc

SEQ ID NO: 199668 - DNA, 31 bp, Artificial Sequence
  Description of Artificial Sequence: Synthetic oligonucleotide
tatggctgaggttggattgccagcttgtacc

SEQ ID NO: 199669 - DNA, 30 bp, Artificial Sequence
  Description of Artificial Sequence: Synthetic oligonucleotide
atggctgaggttggattgccagcttgtacc

SEQ ID NO: 199670 - DNA, 29 bp, Artificial Sequence
  Description of Artificial Sequence: Synthetic oligonucleotide
tggctgaggttggattgccagcttgtacc

SEQ ID NO: 199671 - DNA, 28 bp, Artificial Sequence
  Description of Artificial Sequence: Synthetic oligonucleotide
ggctgaggttggattgccagcttgtacc

SEQ ID NO: 199672 - DNA, 29 bp, Artificial Sequence
  Description of Artificial Sequence: Synthetic oligonucleotide
gctgaggttggattgccagcttgtacctg

SEQ ID NO: 199673 - DNA, 29 bp, Artificial Sequence
  Description of Artificial Sequence: Synthetic oligonucleotide
ctgaggttggattgccagcttgtacctgg

SEQ ID NO: 199674 - DNA, 29 bp, Artificial Sequence
  Description of Artificial Sequence: Synthetic oligonucleotide
tgaggttggattgccagcttgtacctggc

SEQ ID NO: 199675 - DNA, 28 bp, Artificial Sequence
  Description of Artificial Sequence: Synthetic oligonucleotide
gaggttggattgccagcttgtacctggc

SEQ ID NO: 199676 - DNA, 28 bp, Artificial Sequence
  Description of Artificial Sequence: Synthetic oligonucleotide
aggttggattgccagcttgtacctggcc

SEQ ID NO: 199677 - DNA, 27 bp, Artificial Sequence
  Description of Artificial Sequence: Synthetic oligonucleotide
ggttggattgccagcttgtacctggcc

SEQ ID NO: 199678 - DNA, 27 bp, Artificial Sequence
  Description of Artificial Sequence: Synthetic oligonucleotide
gttggattgccagcttgtacctggccc

SEQ ID NO: 199679 - DNA, 29 bp, Artificial Sequence
  Description of Artificial Sequence: Synthetic oligonucleotide
ttggattgccagcttgtacctggcccttc

SEQ ID NO: 199680 - DNA, 28 bp, Artificial Sequence
  Description of Artificial Sequence: Synthetic oligonucleotide
tggattgccagcttgtacctggcccttc

SEQ ID NO: 199681 - DNA, 27 bp, Artificial Sequence
  Description of Artificial Sequence: Synthetic oligonucleotide
ggattgccagcttgtacctggcccttc

SEQ ID NO: 199682 - DNA, 28 bp, Artificial Sequence
  Description of Artificial Sequence: Synthetic oligonucleotide
gattgccagcttgtacctggcccttctg

SEQ ID NO: 199683 - DNA, 31 bp, Artificial Sequence
  Description of Artificial Sequence: Synthetic oligonucleotide
attgccagcttgtacctggcccttctgtttg

SEQ ID NO: 199684 - DNA, 30 bp, Artificial Sequence
  Description of Artificial Sequence: Synthetic oligonucleotide
ttgccagcttgtacctggcccttctgtttg

SEQ ID NO: 199685 - DNA, 29 bp, Artificial Sequence
  Description of Artificial Sequence: Synthetic oligonucleotide
tgccagcttgtacctggcccttctgtttg

SEQ ID NO: 199686 - DNA, 28 bp, Artificial Sequence
  Description of Artificial Sequence: Synthetic oligonucleotide
gccagcttgtacctggcccttctgtttg

SEQ ID NO: 199687 - DNA, 28 bp, Artificial Sequence
  Description of Artificial Sequence: Synthetic oligonucleotide
ccagcttgtacctggcccttctgtttgg

SEQ ID NO: 199688 - DNA, 28 bp, Artificial Sequence
  Description of Artificial Sequence: Synthetic oligonucleotide
cagcttgtacctggcccttctgtttggc

SEQ ID NO: 199689 - DNA, 28 bp, Artificial Sequence
  Description of Artificial Sequence: Synthetic oligonucleotide
agcttgtacctggcccttctgtttggcc

SEQ ID NO: 199690 - DNA, 27 bp, Artificial Sequence
  Description of Artificial Sequence: Synthetic oligonucleotide
gcttgtacctggcccttctgtttggcc

SEQ ID NO: 199691 - DNA, 28 bp, Artificial Sequence
  Description of Artificial Sequence: Synthetic oligonucleotide
cttgtacctggcccttctgtttggccac

SEQ ID NO: 199692 - DNA, 28 bp, Artificial Sequence
  Description of Artificial Sequence: Synthetic oligonucleotide
ttgtacctggcccttctgtttggccacg

SEQ ID NO: 199693 - DNA, 27 bp, Artificial Sequence
  Description of Artificial Sequence: Synthetic oligonucleotide
tgtacctggcccttctgtttggccacg

SEQ ID NO: 199694 - DNA, 26 bp, Artificial Sequence
  Description of Artificial Sequence: Synthetic oligonucleotide
gtacctggcccttctgtttggccacg

SEQ ID NO: 199695 - DNA, 27 bp, Artificial Sequence
  Description of Artificial Sequence: Synthetic oligonucleotide
tacctggcccttctgtttggccacgct

SEQ ID NO: 199696 - DNA, 27 bp, Artificial Sequence
  Description of Artificial Sequence: Synthetic oligonucleotide
acctggcccttctgtttggccacgcta

SEQ ID NO: 199697 - DNA, 27 bp, Artificial Sequence
  Description of Artificial Sequence: Synthetic oligonucleotide
cctggcccttctgtttggccacgctat

SEQ ID NO: 199698 - DNA, 28 bp, Artificial Sequence
  Description of Artificial Sequence: Synthetic oligonucleotide
ctggcccttctgtttggccacgctattg

SEQ ID NO: 199699 - DNA, 30 bp, Artificial Sequence
  Description of Artificial Sequence: Synthetic oligonucleotide
tggcccttctgtttggccacgctattgttc

SEQ ID NO: 199700 - DNA, 29 bp, Artificial Sequence
  Description of Artificial Sequence: Synthetic oligonucleotide
ggcccttctgtttggccacgctattgttc

SEQ ID NO: 199701 - DNA, 29 bp, Artificial Sequence
  Description of Artificial Sequence: Synthetic oligonucleotide
gcccttctgtttggccacgctattgttcc

SEQ ID NO: 199702 - DNA, 30 bp, Artificial Sequence
  Description of Artificial Sequence: Synthetic oligonucleotide
cccttctgtttggccacgctattgttcctc

SEQ ID NO: 199703 - DNA, 32 bp, Artificial Sequence
  Description of Artificial Sequence: Synthetic oligonucleotide
ccttctgtttggccacgctattgttcctcatc

SEQ ID NO: 199704 - DNA, 34 bp, Artificial Sequence
  Description of Artificial Sequence: Synthetic oligonucleotide
cttctgtttggccacgctattgttcctcatcatg

SEQ ID NO: 199705 - DNA, 35 bp, Artificial Sequence
  Description of Artificial Sequence: Synthetic oligonucleotide
ttctgtttggccacgctattgttcctcatcatgac

SEQ ID NO: 199706 - DNA, 34 bp, Artificial Sequence
  Description of Artificial Sequence: Synthetic oligonucleotide
tctgtttggccacgctattgttcctcatcatgac

SEQ ID NO: 199707 - DNA, 33 bp, Artificial Sequence
  Description of Artificial Sequence: Synthetic oligonucleotide
ctgtttggccacgctattgttcctcatcatgac

SEQ ID NO: 199708 - DNA, 33 bp, Artificial Sequence
  Description of Artificial Sequence: Synthetic oligonucleotide
tgtttggccacgctattgttcctcatcatgacc

SEQ ID NO: 199709 - DNA, 32 bp, Artificial Sequence
  Description of Artificial Sequence: Synthetic oligonucleotide
gtttggccacgctattgttcctcatcatgacc

SEQ ID NO: 199710 - DNA, 33 bp, Artificial Sequence
  Description of Artificial Sequence: Synthetic oligonucleotide
tttggccacgctattgttcctcatcatgaccac

SEQ ID NO: 199711 - DNA, 32 bp, Artificial Sequence
  Description of Artificial Sequence: Synthetic oligonucleotide
ttggccacgctattgttcctcatcatgaccac

SEQ ID NO: 199712 - DNA, 31 bp, Artificial Sequence
  Description of Artificial Sequence: Synthetic oligonucleotide
tggccacgctattgttcctcatcatgaccac

SEQ ID NO: 199713 - DNA, 30 bp, Artificial Sequence
  Description of Artificial Sequence: Synthetic oligonucleotide
ggccacgctattgttcctcatcatgaccac

SEQ ID NO: 199714 - DNA, 38 bp, Artificial Sequence
  Description of Artificial Sequence: Synthetic oligonucleotide
gccacgctattgttcctcatcatgaccacaaaaaattc

SEQ ID NO: 199715 - DNA, 38 bp, Artificial Sequence
  Description of Artificial Sequence: Synthetic oligonucleotide
ccacgctattgttcctcatcatgaccacaaaaaattcc

SEQ ID NO: 199716 - DNA, 40 bp, Artificial Sequence
  Description of Artificial Sequence: Synthetic oligonucleotide
cacgctattgttcctcatcatgaccacaaaaaattccaac

SEQ ID NO: 199717 - DNA, 42 bp, Artificial Sequence
  Description of Artificial Sequence: Synthetic oligonucleotide
acgctattgttcctcatcatgaccacaaaaaattccaacatc

SEQ ID NO: 199718 - DNA, 41 bp, Artificial Sequence
  Description of Artificial Sequence: Synthetic oligonucleotide
cgctattgttcctcatcatgaccacaaaaaattccaacatc

SEQ ID NO: 199719 - DNA, 43 bp, Artificial Sequence
  Description of Artificial Sequence: Synthetic oligonucleotide
gctattgttcctcatcatgaccacaaaaaattccaacatctac

SEQ ID NO: 199720 - DNA, 45 bp, Artificial Sequence
  Description of Artificial Sequence: Synthetic oligonucleotide
ctattgttcctcatcatgaccacaaaaaattccaacatctacaag

SEQ ID NO: 199721 - DNA, 47 bp, Artificial Sequence
  Description of Artificial Sequence: Synthetic oligonucleotide
tattgttcctcatcatgaccacaaaaaattccaacatctacaagatg

SEQ ID NO: 199722 - DNA, 46 bp, Artificial Sequence
  Description of Artificial Sequence: Synthetic oligonucleotide
attgttcctcatcatgaccacaaaaaattccaacatctacaagatg

SEQ ID NO: 199723 - DNA, 45 bp, Artificial Sequence
  Description of Artificial Sequence: Synthetic oligonucleotide
ttgttcctcatcatgaccacaaaaaattccaacatctacaagatg

SEQ ID NO: 199724 - DNA, 44 bp, Artificial Sequence
  Description of Artificial Sequence: Synthetic oligonucleotide
tgttcctcatcatgaccacaaaaaattccaacatctacaagatg

SEQ ID NO: 199725 - DNA, 43 bp, Artificial Sequence
  Description of Artificial Sequence: Synthetic oligonucleotide
gttcctcatcatgaccacaaaaaattccaacatctacaagatg

SEQ ID NO: 199726 - DNA, 43 bp, Artificial Sequence
  Description of Artificial Sequence: Synthetic oligonucleotide
ttcctcatcatgaccacaaaaaattccaacatctacaagatgc

SEQ ID NO: 199727 - DNA, 42 bp, Artificial Sequence
  Description of Artificial Sequence: Synthetic oligonucleotide
tcctcatcatgaccacaaaaaattccaacatctacaagatgc

SEQ ID NO: 199728 - DNA, 41 bp, Artificial Sequence
  Description of Artificial Sequence: Synthetic oligonucleotide
cctcatcatgaccacaaaaaattccaacatctacaagatgc

SEQ ID NO: 199729 - DNA, 41 bp, Artificial Sequence
  Description of Artificial Sequence: Synthetic oligonucleotide
ctcatcatgaccacaaaaaattccaacatctacaagatgcc

SEQ ID NO: 199730 - DNA, 41 bp, Artificial Sequence
  Description of Artificial Sequence: Synthetic oligonucleotide
tcatcatgaccacaaaaaattccaacatctacaagatgccc

SEQ ID NO: 199731 - DNA, 40 bp, Artificial Sequence
  Description of Artificial Sequence: Synthetic oligonucleotide
catcatgaccacaaaaaattccaacatctacaagatgccc

SEQ ID NO: 199732 - DNA, 40 bp, Artificial Sequence
  Description of Artificial Sequence: Synthetic oligonucleotide
atcatgaccacaaaaaattccaacatctacaagatgcccc

SEQ ID NO: 199733 - DNA, 39 bp, Artificial Sequence
  Description of Artificial Sequence: Synthetic oligonucleotide
tcatgaccacaaaaaattccaacatctacaagatgcccc

SEQ ID NO: 199734 - DNA, 38 bp, Artificial Sequence
  Description of Artificial Sequence: Synthetic oligonucleotide
catgaccacaaaaaattccaacatctacaagatgcccc

SEQ ID NO: 199735 - DNA, 39 bp, Artificial Sequence
  Description of Artificial Sequence: Synthetic oligonucleotide
atgaccacaaaaaattccaacatctacaagatgcccctc

SEQ ID NO: 199736 - DNA, 38 bp, Artificial Sequence
  Description of Artificial Sequence: Synthetic oligonucleotide
tgaccacaaaaaattccaacatctacaagatgcccctc

SEQ ID NO: 199737 - DNA, 37 bp, Artificial Sequence
  Description of Artificial Sequence: Synthetic oligonucleotide
gaccacaaaaaattccaacatctacaagatgcccctc

SEQ ID NO: 199738 - DNA, 38 bp, Artificial Sequence
  Description of Artificial Sequence: Synthetic oligonucleotide
accacaaaaaattccaacatctacaagatgcccctcag

SEQ ID NO: 199739 - DNA, 37 bp, Artificial Sequence
  Description of Artificial Sequence: Synthetic oligonucleotide
ccacaaaaaattccaacatctacaagatgcccctcag

SEQ ID NO: 199740 - DNA, 41 bp, Artificial Sequence
  Description of Artificial Sequence: Synthetic oligonucleotide
cacaaaaaattccaacatctacaagatgcccctcagtaaag

SEQ ID NO: 199741 - DNA, 44 bp, Artificial Sequence
  Description of Artificial Sequence: Synthetic oligonucleotide
acaaaaaattccaacatctacaagatgcccctcagtaaagttac

SEQ ID NO: 199742 - DNA, 43 bp, Artificial Sequence
  Description of Artificial Sequence: Synthetic oligonucleotide
caaaaaattccaacatctacaagatgcccctcagtaaagttac

SEQ ID NO: 199743 - DNA, 47 bp, Artificial Sequence
  Description of Artificial Sequence: Synthetic oligonucleotide
aaaaaattccaacatctacaagatgcccctcagtaaagttacttatc

SEQ ID NO: 199744 - DNA, 46 bp, Artificial Sequence
  Description of Artificial Sequence: Synthetic oligonucleotide
aaaaattccaacatctacaagatgcccctcagtaaagttacttatc

SEQ ID NO: 199745 - DNA, 45 bp, Artificial Sequence
  Description of Artificial Sequence: Synthetic oligonucleotide
aaaattccaacatctacaagatgcccctcagtaaagttacttatc

SEQ ID NO: 199746 - DNA, 44 bp, Artificial Sequence
  Description of Artificial Sequence: Synthetic oligonucleotide
aaattccaacatctacaagatgcccctcagtaaagttacttatc

SEQ ID NO: 199747 - DNA, 43 bp, Artificial Sequence
  Description of Artificial Sequence: Synthetic oligonucleotide
aattccaacatctacaagatgcccctcagtaaagttacttatc

SEQ ID NO: 199748 - DNA, 42 bp, Artificial Sequence
  Description of Artificial Sequence: Synthetic oligonucleotide
attccaacatctacaagatgcccctcagtaaagttacttatc

SEQ ID NO: 199749 - DNA, 41 bp, Artificial Sequence
  Description of Artificial Sequence: Synthetic oligonucleotide
ttccaacatctacaagatgcccctcagtaaagttacttatc

SEQ ID NO: 199750 - DNA, 40 bp, Artificial Sequence
  Description of Artificial Sequence: Synthetic oligonucleotide
tccaacatctacaagatgcccctcagtaaagttacttatc

SEQ ID NO: 199751 - DNA, 39 bp, Artificial Sequence
  Description of Artificial Sequence: Synthetic oligonucleotide
ccaacatctacaagatgcccctcagtaaagttacttatc

SEQ ID NO: 199752 - DNA, 39 bp, Artificial Sequence
  Description of Artificial Sequence: Synthetic oligonucleotide
caacatctacaagatgcccctcagtaaagttacttatcc

SEQ ID NO: 199753 - DNA, 40 bp, Artificial Sequence
  Description of Artificial Sequence: Synthetic oligonucleotide
aacatctacaagatgcccctcagtaaagttacttatcctg

SEQ ID NO: 199754 - DNA, 39 bp, Artificial Sequence
  Description of Artificial Sequence: Synthetic oligonucleotide
acatctacaagatgcccctcagtaaagttacttatcctg

SEQ ID NO: 199755 - DNA, 38 bp, Artificial Sequence
  Description of Artificial Sequence: Synthetic oligonucleotide
catctacaagatgcccctcagtaaagttacttatcctg

SEQ ID NO: 199756 - DNA, 40 bp, Artificial Sequence
  Description of Artificial Sequence: Synthetic oligonucleotide
atctacaagatgcccctcagtaaagttacttatcctgaag

SEQ ID NO: 199757 - DNA, 39 bp, Artificial Sequence
  Description of Artificial Sequence: Synthetic oligonucleotide
tctacaagatgcccctcagtaaagttacttatcctgaag

SEQ ID NO: 199758 - DNA, 38 bp, Artificial Sequence
  Description of Artificial Sequence: Synthetic oligonucleotide
ctacaagatgcccctcagtaaagttacttatcctgaag

SEQ ID NO: 199759 - DNA, 42 bp, Artificial Sequence
  Description of Artificial Sequence: Synthetic oligonucleotide
tacaagatgcccctcagtaaagttacttatcctgaagaaaac

SEQ ID NO: 199760 - DNA, 41 bp, Artificial Sequence
  Description of Artificial Sequence: Synthetic oligonucleotide
acaagatgcccctcagtaaagttacttatcctgaagaaaac

SEQ ID NO: 199761 - DNA, 40 bp, Artificial Sequence
  Description of Artificial Sequence: Synthetic oligonucleotide
caagatgcccctcagtaaagttacttatcctgaagaaaac

SEQ ID NO: 199762 - DNA, 40 bp, Artificial Sequence
  Description of Artificial Sequence: Synthetic oligonucleotide
aagatgcccctcagtaaagttacttatcctgaagaaaacc

SEQ ID NO: 199763 - DNA, 39 bp, Artificial Sequence
  Description of Artificial Sequence: Synthetic oligonucleotide
agatgcccctcagtaaagttacttatcctgaagaaaacc

SEQ ID NO: 199764 - DNA, 38 bp, Artificial Sequence
  Description of Artificial Sequence: Synthetic oligonucleotide
gatgcccctcagtaaagttacttatcctgaagaaaacc

SEQ ID NO: 199765 - DNA, 38 bp, Artificial Sequence
  Description of Artificial Sequence: Synthetic oligonucleotide
atgcccctcagtaaagttacttatcctgaagaaaaccg

SEQ ID NO: 199766 - DNA, 37 bp, Artificial Sequence
  Description of Artificial Sequence: Synthetic oligonucleotide
tgcccctcagtaaagttacttatcctgaagaaaaccg

SEQ ID NO: 199767 - DNA, 36 bp, Artificial Sequence
  Description of Artificial Sequence: Synthetic oligonucleotide
gcccctcagtaaagttacttatcctgaagaaaaccg

SEQ ID NO: 199768 - DNA, 36 bp, Artificial Sequence
  Description of Artificial Sequence: Synthetic oligonucleotide
cccctcagtaaagttacttatcctgaagaaaaccgc

SEQ ID NO: 199769 - DNA, 38 bp, Artificial Sequence
  Description of Artificial Sequence: Synthetic oligonucleotide
ccctcagtaaagttacttatcctgaagaaaaccgcatc

SEQ ID NO: 199770 - DNA, 40 bp, Artificial Sequence
  Description of Artificial Sequence: Synthetic oligonucleotide
cctcagtaaagttacttatcctgaagaaaaccgcatcttc

SEQ ID NO: 199771 - DNA, 42 bp, Artificial Sequence
  Description of Artificial Sequence: Synthetic oligonucleotide
ctcagtaaagttacttatcctgaagaaaaccgcatcttctac

SEQ ID NO: 199772 - DNA, 42 bp, Artificial Sequence
  Description of Artificial Sequence: Synthetic oligonucleotide
tcagtaaagttacttatcctgaagaaaaccgcatcttctacc

SEQ ID NO: 199773 - DNA, 41 bp, Artificial Sequence
  Description of Artificial Sequence: Synthetic oligonucleotide
cagtaaagttacttatcctgaagaaaaccgcatcttctacc

SEQ ID NO: 199774 - DNA, 42 bp, Artificial Sequence
  Description of Artificial Sequence: Synthetic oligonucleotide
agtaaagttacttatcctgaagaaaaccgcatcttctacctg

SEQ ID NO: 199775 - DNA, 41 bp, Artificial Sequence
  Description of Artificial Sequence: Synthetic oligonucleotide
gtaaagttacttatcctgaagaaaaccgcatcttctacctg

SEQ ID NO: 199776 - DNA, 41 bp, Artificial Sequence
  Description of Artificial Sequence: Synthetic oligonucleotide
taaagttacttatcctgaagaaaaccgcatcttctacctgc

SEQ ID NO: 199777 - DNA, 40 bp, Artificial Sequence
  Description of Artificial Sequence: Synthetic oligonucleotide
aaagttacttatcctgaagaaaaccgcatcttctacctgc

SEQ ID NO: 199778 - DNA, 39 bp, Artificial Sequence
  Description of Artificial Sequence: Synthetic oligonucleotide
aagttacttatcctgaagaaaaccgcatcttctacctgc

SEQ ID NO: 199779 - DNA, 38 bp, Artificial Sequence
  Description of Artificial Sequence: Synthetic oligonucleotide
agttacttatcctgaagaaaaccgcatcttctacctgc

SEQ ID NO: 199780 - DNA, 37 bp, Artificial Sequence
  Description of Artificial Sequence: Synthetic oligonucleotide
gttacttatcctgaagaaaaccgcatcttctacctgc

SEQ ID NO: 199781 - DNA, 39 bp, Artificial Sequence
  Description of Artificial Sequence: Synthetic oligonucleotide
ttacttatcctgaagaaaaccgcatcttctacctgcaag

SEQ ID NO: 199782 - DNA, 38 bp, Artificial Sequence
  Description of Artificial Sequence: Synthetic oligonucleotide
tacttatcctgaagaaaaccgcatcttctacctgcaag

SEQ ID NO: 199783 - DNA, 37 bp, Artificial Sequence
  Description of Artificial Sequence: Synthetic oligonucleotide
acttatcctgaagaaaaccgcatcttctacctgcaag

SEQ ID NO: 199784 - DNA, 36 bp, Artificial Sequence
  Description of Artificial Sequence: Synthetic oligonucleotide
cttatcctgaagaaaaccgcatcttctacctgcaag

SEQ ID NO: 199785 - DNA, 36 bp, Artificial Sequence
  Description of Artificial Sequence: Synthetic oligonucleotide
ttatcctgaagaaaaccgcatcttctacctgcaagc

SEQ ID NO: 199786 - DNA, 35 bp, Artificial Sequence
  Description of Artificial Sequence: Synthetic oligonucleotide
tatcctgaagaaaaccgcatcttctacctgcaagc

SEQ ID NO: 199787 - DNA, 34 bp, Artificial Sequence
  Description of Artificial Sequence: Synthetic oligonucleotide
atcctgaagaaaaccgcatcttctacctgcaagc

SEQ ID NO: 199788 - DNA, 33 bp, Artificial Sequence
  Description of Artificial Sequence: Synthetic oligonucleotide
tcctgaagaaaaccgcatcttctacctgcaagc

SEQ ID NO: 199789 - DNA, 32 bp, Artificial Sequence
  Description of Artificial Sequence: Synthetic oligonucleotide
cctgaagaaaaccgcatcttctacctgcaagc

SEQ ID NO: 199790 - DNA, 32 bp, Artificial Sequence
  Description of Artificial Sequence: Synthetic oligonucleotide
ctgaagaaaaccgcatcttctacctgcaagcc

SEQ ID NO: 199791 - DNA, 34 bp, Artificial Sequence
  Description of Artificial Sequence: Synthetic oligonucleotide
tgaagaaaaccgcatcttctacctgcaagccaag

SEQ ID NO: 199792 - DNA, 33 bp, Artificial Sequence
  Description of Artificial Sequence: Synthetic oligonucleotide
gaagaaaaccgcatcttctacctgcaagccaag

SEQ ID NO: 199793 - DNA, 37 bp, Artificial Sequence
  Description of Artificial Sequence: Synthetic oligonucleotide
aagaaaaccgcatcttctacctgcaagccaagaaaag

SEQ ID NO: 199794 - DNA, 36 bp, Artificial Sequence
  Description of Artificial Sequence: Synthetic oligonucleotide
agaaaaccgcatcttctacctgcaagccaagaaaag

SEQ ID NO: 199795 - DNA, 35 bp, Artificial Sequence
  Description of Artificial Sequence: Synthetic oligonucleotide
gaaaaccgcatcttctacctgcaagccaagaaaag

SEQ ID NO: 199796 - DNA, 38 bp, Artificial Sequence
  Description of Artificial Sequence: Synthetic oligonucleotide
aaaaccgcatcttctacctgcaagccaagaaaagaatg

SEQ ID NO: 199797 - DNA, 37 bp, Artificial Sequence
  Description of Artificial Sequence: Synthetic oligonucleotide
aaaccgcatcttctacctgcaagccaagaaaagaatg

SEQ ID NO: 199798 - DNA, 36 bp, Artificial Sequence
  Description of Artificial Sequence: Synthetic oligonucleotide
aaccgcatcttctacctgcaagccaagaaaagaatg

SEQ ID NO: 199799 - DNA, 35 bp, Artificial Sequence
  Description of Artificial Sequence: Synthetic oligonucleotide
accgcatcttctacctgcaagccaagaaaagaatg

SEQ ID NO: 199800 - DNA, 34 bp, Artificial Sequence
  Description of Artificial Sequence: Synthetic oligonucleotide
ccgcatcttctacctgcaagccaagaaaagaatg

SEQ ID NO: 199801 - DNA, 34 bp, Artificial Sequence
  Description of Artificial Sequence: Synthetic oligonucleotide
cgcatcttctacctgcaagccaagaaaagaatgg

SEQ ID NO: 199802 - DNA, 35 bp, Artificial Sequence
  Description of Artificial Sequence: Synthetic oligonucleotide
gcatcttctacctgcaagccaagaaaagaatggtg

SEQ ID NO: 199803 - DNA, 35 bp, Artificial Sequence
  Description of Artificial Sequence: Synthetic oligonucleotide
catcttctacctgcaagccaagaaaagaatggtgg

SEQ ID NO: 199804 - DNA, 38 bp, Artificial Sequence
  Description of Artificial Sequence: Synthetic oligonucleotide
atcttctacctgcaagccaagaaaagaatggtggaaag

SEQ ID NO: 199805 - DNA, 37 bp, Artificial Sequence
  Description of Artificial Sequence: Synthetic oligonucleotide
tcttctacctgcaagccaagaaaagaatggtggaaag

SEQ ID NO: 199806 - DNA, 36 bp, Artificial Sequence
  Description of Artificial Sequence: Synthetic oligonucleotide
cttctacctgcaagccaagaaaagaatggtggaaag

SEQ ID NO: 199807 - DNA, 36 bp, Artificial Sequence
  Description of Artificial Sequence: Synthetic oligonucleotide
ttctacctgcaagccaagaaaagaatggtggaaagc

SEQ ID NO: 199808 - DNA, 35 bp, Artificial Sequence
  Description of Artificial Sequence: Synthetic oligonucleotide
tctacctgcaagccaagaaaagaatggtggaaagc

SEQ ID NO: 199809 - DNA, 34 bp, Artificial Sequence
  Description of Artificial Sequence: Synthetic oligonucleotide
ctacctgcaagccaagaaaagaatggtggaaagc

SEQ ID NO: 199810 - DNA, 34 bp, Artificial Sequence
  Description of Artificial Sequence: Synthetic oligonucleotide
tacctgcaagccaagaaaagaatggtggaaagcc

SEQ ID NO: 199811 - DNA, 33 bp, Artificial Sequence
  Description of Artificial Sequence: Synthetic oligonucleotide
acctgcaagccaagaaaagaatggtggaaagcc

SEQ ID NO: 199812 - DNA, 32 bp, Artificial Sequence
  Description of Artificial Sequence: Synthetic oligonucleotide
cctgcaagccaagaaaagaatggtggaaagcc

SEQ ID NO: 199813 - DNA, 32 bp, Artificial Sequence
  Description of Artificial Sequence: Synthetic oligonucleotide
ctgcaagccaagaaaagaatggtggaaagccc

SEQ ID NO: 199814 - DNA, 35 bp, Artificial Sequence
  Description of Artificial Sequence: Synthetic oligonucleotide
tgcaagccaagaaaagaatggtggaaagccctttg

SEQ ID NO: 199815 - DNA, 34 bp, Artificial Sequence
  Description of Artificial Sequence: Synthetic oligonucleotide
gcaagccaagaaaagaatggtggaaagccctttg

SEQ ID NO: 199816 - DNA, 35 bp, Artificial Sequence
  Description of Artificial Sequence: Synthetic oligonucleotide
caagccaagaaaagaatggtggaaagccctttgtg

SEQ ID NO: 199817 - DNA, 35 bp, Artificial Sequence
  Description of Artificial Sequence: Synthetic oligonucleotide
cgttgtcaatgtacctttcagccacaggacattag

SEQ ID NO: 199818 - DNA, 38 bp, Artificial Sequence
  Description of Artificial Sequence: Synthetic oligonucleotide
gttgtcaatgtacctttcagccacaggacattagaatc

SEQ ID NO: 199819 - DNA, 38 bp, Artificial Sequence
  Description of Artificial Sequence: Synthetic oligonucleotide
ttgtcaatgtacctttcagccacaggacattagaatcc

SEQ ID NO: 199820 - DNA, 37 bp, Artificial Sequence
  Description of Artificial Sequence: Synthetic oligonucleotide
tgtcaatgtacctttcagccacaggacattagaatcc

SEQ ID NO: 199821 - DNA, 36 bp, Artificial Sequence
  Description of Artificial Sequence: Synthetic oligonucleotide
gtcaatgtacctttcagccacaggacattagaatcc

SEQ ID NO: 199822 - DNA, 39 bp, Artificial Sequence
  Description of Artificial Sequence: Synthetic oligonucleotide
tcaatgtacctttcagccacaggacattagaatccattc

SEQ ID NO: 199823 - DNA, 38 bp, Artificial Sequence
  Description of Artificial Sequence: Synthetic oligonucleotide
caatgtacctttcagccacaggacattagaatccattc

SEQ ID NO: 199824 - DNA, 41 bp, Artificial Sequence
  Description of Artificial Sequence: Synthetic oligonucleotide
aatgtacctttcagccacaggacattagaatccattctttc

SEQ ID NO: 199825 - DNA, 40 bp, Artificial Sequence
  Description of Artificial Sequence: Synthetic oligonucleotide
atgtacctttcagccacaggacattagaatccattctttc

SEQ ID NO: 199826 - DNA, 39 bp, Artificial Sequence
  Description of Artificial Sequence: Synthetic oligonucleotide
tgtacctttcagccacaggacattagaatccattctttc

SEQ ID NO: 199827 - DNA, 38 bp, Artificial Sequence
  Description of Artificial Sequence: Synthetic oligonucleotide
gtacctttcagccacaggacattagaatccattctttc

SEQ ID NO: 199828 - DNA, 38 bp, Artificial Sequence
  Description of Artificial Sequence: Synthetic oligonucleotide
tacctttcagccacaggacattagaatccattctttcc

SEQ ID NO: 199829 - DNA, 37 bp, Artificial Sequence
  Description of Artificial Sequence: Synthetic oligonucleotide
acctttcagccacaggacattagaatccattctttcc

SEQ ID NO: 199830 - DNA, 36 bp, Artificial Sequence
  Description of Artificial Sequence: Synthetic oligonucleotide
cctttcagccacaggacattagaatccattctttcc

SEQ ID NO: 199831 - DNA, 37 bp, Artificial Sequence
  Description of Artificial Sequence: Synthetic oligonucleotide
ctttcagccacaggacattagaatccattctttccag

SEQ ID NO: 199832 - DNA, 37 bp, Artificial Sequence
  Description of Artificial Sequence: Synthetic oligonucleotide
tttcagccacaggacattagaatccattctttccagc

SEQ ID NO: 199833 - DNA, 36 bp, Artificial Sequence
  Description of Artificial Sequence: Synthetic oligonucleotide
ttcagccacaggacattagaatccattctttccagc

SEQ ID NO: 199834 - DNA, 35 bp, Artificial Sequence
  Description of Artificial Sequence: Synthetic oligonucleotide
tcagccacaggacattagaatccattctttccagc

SEQ ID NO: 199835 - DNA, 34 bp, Artificial Sequence
  Description of Artificial Sequence: Synthetic oligonucleotide
cagccacaggacattagaatccattctttccagc

SEQ ID NO: 199836 - DNA, 34 bp, Artificial Sequence
  Description of Artificial Sequence: Synthetic oligonucleotide
agccacaggacattagaatccattctttccagcc

SEQ ID NO: 199837 - DNA, 33 bp, Artificial Sequence
  Description of Artificial Sequence: Synthetic oligonucleotide
gccacaggacattagaatccattctttccagcc

SEQ ID NO: 199838 - DNA, 36 bp, Artificial Sequence
  Description of Artificial Sequence: Synthetic oligonucleotide
ccacaggacattagaatccattctttccagccaaac

SEQ ID NO: 199839 - DNA, 37 bp, Artificial Sequence
  Description of Artificial Sequence: Synthetic oligonucleotide
cacaggacattagaatccattctttccagccaaactg

SEQ ID NO: 199840 - DNA, 37 bp, Artificial Sequence
  Description of Artificial Sequence: Synthetic oligonucleotide
acaggacattagaatccattctttccagccaaactgg

SEQ ID NO: 199841 - DNA, 36 bp, Artificial Sequence
  Description of Artificial Sequence: Synthetic oligonucleotide
caggacattagaatccattctttccagccaaactgg

SEQ ID NO: 199842 - DNA, 37 bp, Artificial Sequence
  Description of Artificial Sequence: Synthetic oligonucleotide
aggacattagaatccattctttccagccaaactggtc

SEQ ID NO: 199843 - DNA, 36 bp, Artificial Sequence
  Description of Artificial Sequence: Synthetic oligonucleotide
ggacattagaatccattctttccagccaaactggtc

SEQ ID NO: 199844 - DNA, 39 bp, Artificial Sequence
  Description of Artificial Sequence: Synthetic oligonucleotide
gacattagaatccattctttccagccaaactggtcatac

SEQ ID NO: 199845 - DNA, 39 bp, Artificial Sequence
  Description of Artificial Sequence: Synthetic oligonucleotide
acattagaatccattctttccagccaaactggtcatacc

SEQ ID NO: 199846 - DNA, 38 bp, Artificial Sequence
  Description of Artificial Sequence: Synthetic oligonucleotide
cattagaatccattctttccagccaaactggtcatacc

SEQ ID NO: 199847 - DNA, 43 bp, Artificial Sequence
  Description of Artificial Sequence: Synthetic oligonucleotide
attagaatccattctttccagccaaactggtcatacctataac

SEQ ID NO: 199848 - DNA, 42 bp, Artificial Sequence
  Description of Artificial Sequence: Synthetic oligonucleotide
ttagaatccattctttccagccaaactggtcatacctataac

SEQ ID NO: 199849 - DNA, 41 bp, Artificial Sequence
  Description of Artificial Sequence: Synthetic oligonucleotide
tagaatccattctttccagccaaactggtcatacctataac

SEQ ID NO: 199850 - DNA, 40 bp, Artificial Sequence
  Description of Artificial Sequence: Synthetic oligonucleotide
agaatccattctttccagccaaactggtcatacctataac

SEQ ID NO: 199851 - DNA, 39 bp, Artificial Sequence
  Description of Artificial Sequence: Synthetic oligonucleotide
gaatccattctttccagccaaactggtcatacctataac

SEQ ID NO: 199852 - DNA, 25 bp, Artificial Sequence
  Description of Artificial Sequence: Synthetic oligonucleotide
ctggtctgacctcagtgccctggag

SEQ ID NO: 199853 - DNA, 34 bp, Artificial Sequence
  Description of Artificial Sequence: Synthetic oligonucleotide
ttcgtcaacaaccccgtcagtggaatcctaattc

SEQ ID NO: 199854 - DNA, 33 bp, Artificial Sequence
  Description of Artificial Sequence: Synthetic oligonucleotide
tcgtcaacaaccccgtcagtggaatcctaattc

SEQ ID NO: 199855 - DNA, 32 bp, Artificial Sequence
  Description of Artificial Sequence: Synthetic oligonucleotide
cgtcaacaaccccgtcagtggaatcctaattc

SEQ ID NO: 199856 - DNA, 33 bp, Artificial Sequence
  Description of Artificial Sequence: Synthetic oligonucleotide
gtcaacaaccccgtcagtggaatcctaattctg

SEQ ID NO: 199857 - DNA, 33 bp, Artificial Sequence
  Description of Artificial Sequence: Synthetic oligonucleotide
tcaacaaccccgtcagtggaatcctaattctgg

SEQ ID NO: 199858 - DNA, 32 bp, Artificial Sequence
  Description of Artificial Sequence: Synthetic oligonucleotide
caacaaccccgtcagtggaatcctaattctgg

SEQ ID NO: 199859 - DNA, 34 bp, Artificial Sequence
  Description of Artificial Sequence: Synthetic oligonucleotide
aacaaccccgtcagtggaatcctaattctggtag

SEQ ID NO: 199860 - DNA, 33 bp, Artificial Sequence
  Description of Artificial Sequence: Synthetic oligonucleotide
acaaccccgtcagtggaatcctaattctggtag

SEQ ID NO: 199861 - DNA, 32 bp, Artificial Sequence
  Description of Artificial Sequence: Synthetic oligonucleotide
caaccccgtcagtggaatcctaattctggtag

SEQ ID NO: 199862 - DNA, 32 bp, Artificial Sequence
  Description of Artificial Sequence: Synthetic oligonucleotide
aaccccgtcagtggaatcctaattctggtagg

SEQ ID NO: 199863 - DNA, 31 bp, Artificial Sequence
  Description of Artificial Sequence: Synthetic oligonucleotide
accccgtcagtggaatcctaattctggtagg

SEQ ID NO: 199864 - DNA, 30 bp, Artificial Sequence
  Description of Artificial Sequence: Synthetic oligonucleotide
ccccgtcagtggaatcctaattctggtagg

SEQ ID NO: 199865 - DNA, 31 bp, Artificial Sequence
  Description of Artificial Sequence: Synthetic oligonucleotide
cccgtcagtggaatcctaattctggtaggac

SEQ ID NO: 199866 - DNA, 33 bp, Artificial Sequence
  Description of Artificial Sequence: Synthetic oligonucleotide
ccgtcagtggaatcctaattctggtaggacttc

SEQ ID NO: 199867 - DNA, 35 bp, Artificial Sequence
  Description of Artificial Sequence: Synthetic oligonucleotide
cgtcagtggaatcctaattctggtaggacttcttg

SEQ ID NO: 199868 - DNA, 37 bp, Artificial Sequence
  Description of Artificial Sequence: Synthetic oligonucleotide
gtcagtggaatcctaattctggtaggacttcttgttc

SEQ ID NO: 199869 - DNA, 38 bp, Artificial Sequence
  Description of Artificial Sequence: Synthetic oligonucleotide
tcagtggaatcctaattctggtaggacttcttgttcag

SEQ ID NO: 199870 - DNA, 37 bp, Artificial Sequence
  Description of Artificial Sequence: Synthetic oligonucleotide
cagtggaatcctaattctggtaggacttcttgttcag

SEQ ID NO: 199871 - DNA, 39 bp, Artificial Sequence
  Description of Artificial Sequence: Synthetic oligonucleotide
agtggaatcctaattctggtaggacttcttgttcagaac

SEQ ID NO: 199872 - DNA, 38 bp, Artificial Sequence
  Description of Artificial Sequence: Synthetic oligonucleotide
gtggaatcctaattctggtaggacttcttgttcagaac

SEQ ID NO: 199873 - DNA, 38 bp, Artificial Sequence
  Description of Artificial Sequence: Synthetic oligonucleotide
tggaatcctaattctggtaggacttcttgttcagaacc

SEQ ID NO: 199874 - DNA, 37 bp, Artificial Sequence
  Description of Artificial Sequence: Synthetic oligonucleotide
ggaatcctaattctggtaggacttcttgttcagaacc

SEQ ID NO: 199875 - DNA, 37 bp, Artificial Sequence
  Description of Artificial Sequence: Synthetic oligonucleotide
gaatcctaattctggtaggacttcttgttcagaaccc

SEQ ID NO: 199876 - DNA, 37 bp, Artificial Sequence
  Description of Artificial Sequence: Synthetic oligonucleotide
aatcctaattctggtaggacttcttgttcagaacccc

SEQ ID NO: 199877 - DNA, 36 bp, Artificial Sequence
  Description of Artificial Sequence: Synthetic oligonucleotide
atcctaattctggtaggacttcttgttcagaacccc

SEQ ID NO: 199878 - DNA, 35 bp, Artificial Sequence
  Description of Artificial Sequence: Synthetic oligonucleotide
tcctaattctggtaggacttcttgttcagaacccc

SEQ ID NO: 199879 - DNA, 34 bp, Artificial Sequence
  Description of Artificial Sequence: Synthetic oligonucleotide
cctaattctggtaggacttcttgttcagaacccc

SEQ ID NO: 199880 - DNA, 35 bp, Artificial Sequence
  Description of Artificial Sequence: Synthetic oligonucleotide
ctaattctggtaggacttcttgttcagaacccctg

SEQ ID NO: 199881 - DNA, 35 bp, Artificial Sequence
  Description of Artificial Sequence: Synthetic oligonucleotide
taattctggtaggacttcttgttcagaacccctgg

SEQ ID NO: 199882 - DNA, 34 bp, Artificial Sequence
  Description of Artificial Sequence: Synthetic oligonucleotide
aattctggtaggacttcttgttcagaacccctgg

SEQ ID NO: 199883 - DNA, 37 bp, Artificial Sequence
  Description of Artificial Sequence: Synthetic oligonucleotide
aaagctcttggctatgtcaccggtgacatgaaaaaac

SEQ ID NO: 199884 - DNA, 36 bp, Artificial Sequence
  Description of Artificial Sequence: Synthetic oligonucleotide
aagctcttggctatgtcaccggtgacatgaaaaaac

SEQ ID NO: 199885 - DNA, 35 bp, Artificial Sequence
  Description of Artificial Sequence: Synthetic oligonucleotide
agctcttggctatgtcaccggtgacatgaaaaaac

SEQ ID NO: 199886 - DNA, 34 bp, Artificial Sequence
  Description of Artificial Sequence: Synthetic oligonucleotide
gctcttggctatgtcaccggtgacatgaaaaaac

SEQ ID NO: 199887 - DNA, 36 bp, Artificial Sequence
  Description of Artificial Sequence: Synthetic oligonucleotide
ctcttggctatgtcaccggtgacatgaaaaaacttg

SEQ ID NO: 199888 - DNA, 36 bp, Artificial Sequence
  Description of Artificial Sequence: Synthetic oligonucleotide
tcttggctatgtcaccggtgacatgaaaaaacttgc

SEQ ID NO: 199889 - DNA, 35 bp, Artificial Sequence
  Description of Artificial Sequence: Synthetic oligonucleotide
cttggctatgtcaccggtgacatgaaaaaacttgc

SEQ ID NO: 199890 - DNA, 35 bp, Artificial Sequence
  Description of Artificial Sequence: Synthetic oligonucleotide
ttggctatgtcaccggtgacatgaaaaaacttgcc

SEQ ID NO: 199891 - DNA, 34 bp, Artificial Sequence
  Description of Artificial Sequence: Synthetic oligonucleotide
tggctatgtcaccggtgacatgaaaaaacttgcc

SEQ ID NO: 199892 - DNA, 33 bp, Artificial Sequence
  Description of Artificial Sequence: Synthetic oligonucleotide
ggctatgtcaccggtgacatgaaaaaacttgcc

SEQ ID NO: 199893 - DNA, 35 bp, Artificial Sequence
  Description of Artificial Sequence: Synthetic oligonucleotide
gctatgtcaccggtgacatgaaaaaacttgccaac

SEQ ID NO: 199894 - DNA, 35 bp, Artificial Sequence
  Description of Artificial Sequence: Synthetic oligonucleotide
ctatgtcaccggtgacatgaaaaaacttgccaacc

SEQ ID NO: 199895 - DNA, 36 bp, Artificial Sequence
  Description of Artificial Sequence: Synthetic oligonucleotide
tatgtcaccggtgacatgaaaaaacttgccaaccag

SEQ ID NO: 199896 - DNA, 35 bp, Artificial Sequence
  Description of Artificial Sequence: Synthetic oligonucleotide
atgtcaccggtgacatgaaaaaacttgccaaccag

SEQ ID NO: 199897 - DNA, 34 bp, Artificial Sequence
  Description of Artificial Sequence: Synthetic oligonucleotide
tgtcaccggtgacatgaaaaaacttgccaaccag

SEQ ID NO: 199898 - DNA, 33 bp, Artificial Sequence
  Description of Artificial Sequence: Synthetic oligonucleotide
gtcaccggtgacatgaaaaaacttgccaaccag

SEQ ID NO: 199899 - DNA, 33 bp, Artificial Sequence
  Description of Artificial Sequence: Synthetic oligonucleotide
tcaccggtgacatgaaaaaacttgccaaccagc

SEQ ID NO: 199900 - DNA, 32 bp, Artificial Sequence
  Description of Artificial Sequence: Synthetic oligonucleotide
caccggtgacatgaaaaaacttgccaaccagc

SEQ ID NO: 199901 - DNA, 37 bp, Artificial Sequence
  Description of Artificial Sequence: Synthetic oligonucleotide
accggtgacatgaaaaaacttgccaaccagcttaaag

SEQ ID NO: 199902 - DNA, 36 bp, Artificial Sequence
  Description of Artificial Sequence: Synthetic oligonucleotide
ccggtgacatgaaaaaacttgccaaccagcttaaag

SEQ ID NO: 199903 - DNA, 37 bp, Artificial Sequence
  Description of Artificial Sequence: Synthetic oligonucleotide
cggtgacatgaaaaaacttgccaaccagcttaaagac

SEQ ID NO: 199904 - DNA, 40 bp, Artificial Sequence
  Description of Artificial Sequence: Synthetic oligonucleotide
ggtgacatgaaaaaacttgccaaccagcttaaagacaaac

SEQ ID NO: 199905 - DNA, 40 bp, Artificial Sequence
  Description of Artificial Sequence: Synthetic oligonucleotide
gtgacatgaaaaaacttgccaaccagcttaaagacaaacc

SEQ ID NO: 199906 - DNA, 40 bp, Artificial Sequence
  Description of Artificial Sequence: Synthetic oligonucleotide
tgacatgaaaaaacttgccaaccagcttaaagacaaaccc

SEQ ID NO: 199907 - DNA, 39 bp, Artificial Sequence
  Description of Artificial Sequence: Synthetic oligonucleotide
gacatgaaaaaacttgccaaccagcttaaagacaaaccc

SEQ ID NO: 199908 - DNA, 39 bp, Artificial Sequence
  Description of Artificial Sequence: Synthetic oligonucleotide
acatgaaaaaacttgccaaccagcttaaagacaaacccg

SEQ ID NO: 199909 - DNA, 38 bp, Artificial Sequence
  Description of Artificial Sequence: Synthetic oligonucleotide
catgaaaaaacttgccaaccagcttaaagacaaacccg

SEQ ID NO: 199910 - DNA, 39 bp, Artificial Sequence
  Description of Artificial Sequence: Synthetic oligonucleotide
atgaaaaaacttgccaaccagcttaaagacaaacccgtg

SEQ ID NO: 199911 - DNA, 38 bp, Artificial Sequence
  Description of Artificial Sequence: Synthetic oligonucleotide
tgaaaaaacttgccaaccagcttaaagacaaacccgtg

SEQ ID NO: 199912 - DNA, 37 bp, Artificial Sequence
  Description of Artificial Sequence: Synthetic oligonucleotide
gaaaaaacttgccaaccagcttaaagacaaacccgtg

SEQ ID NO: 199913 - DNA, 37 bp, Artificial Sequence
  Description of Artificial Sequence: Synthetic oligonucleotide
aaaaaacttgccaaccagcttaaagacaaacccgtgg

SEQ ID NO: 199914 - DNA, 36 bp, Artificial Sequence
  Description of Artificial Sequence: Synthetic oligonucleotide
aaaaacttgccaaccagcttaaagacaaacccgtgg

SEQ ID NO: 199915 - DNA, 35 bp, Artificial Sequence
  Description of Artificial Sequence: Synthetic oligonucleotide
aaaacttgccaaccagcttaaagacaaacccgtgg

SEQ ID NO: 199916 - DNA, 34 bp, Artificial Sequence
  Description of Artificial Sequence: Synthetic oligonucleotide
aaacttgccaaccagcttaaagacaaacccgtgg

SEQ ID NO: 199917 - DNA, 36 bp, Artificial Sequence
  Description of Artificial Sequence: Synthetic oligonucleotide
tcaatgtacctttcagccacaggacattacaatccg

SEQ ID NO: 199918 - DNA, 35 bp, Artificial Sequence
  Description of Artificial Sequence: Synthetic oligonucleotide
caatgtacctttcagccacaggacattacaatccg

SEQ ID NO: 199919 - DNA, 37 bp, Artificial Sequence
  Description of Artificial Sequence: Synthetic oligonucleotide
aatgtacctttcagccacaggacattacaatccgttc

SEQ ID NO: 199920 - DNA, 36 bp, Artificial Sequence
  Description of Artificial Sequence: Synthetic oligonucleotide
atgtacctttcagccacaggacattacaatccgttc

SEQ ID NO: 199921 - DNA, 35 bp, Artificial Sequence
  Description of Artificial Sequence: Synthetic oligonucleotide
tgtacctttcagccacaggacattacaatccgttc

SEQ ID NO: 199922 - DNA, 34 bp, Artificial Sequence
  Description of Artificial Sequence: Synthetic oligonucleotide
gtacctttcagccacaggacattacaatccgttc

SEQ ID NO: 199923 - DNA, 37 bp, Artificial Sequence
  Description of Artificial Sequence: Synthetic oligonucleotide
tacctttcagccacaggacattacaatccgttctttc

SEQ ID NO: 199924 - DNA, 36 bp, Artificial Sequence
  Description of Artificial Sequence: Synthetic oligonucleotide
acctttcagccacaggacattacaatccgttctttc

SEQ ID NO: 199925 - DNA, 35 bp, Artificial Sequence
  Description of Artificial Sequence: Synthetic oligonucleotide
cctttcagccacaggacattacaatccgttctttc

SEQ ID NO: 199926 - DNA, 35 bp, Artificial Sequence
  Description of Artificial Sequence: Synthetic oligonucleotide
ctttcagccacaggacattacaatccgttctttcc

SEQ ID NO: 199927 - DNA, 36 bp, Artificial Sequence
  Description of Artificial Sequence: Synthetic oligonucleotide
tttcagccacaggacattacaatccgttctttccag

SEQ ID NO: 199928 - DNA, 35 bp, Artificial Sequence
  Description of Artificial Sequence: Synthetic oligonucleotide
ttcagccacaggacattacaatccgttctttccag

SEQ ID NO: 199929 - DNA, 34 bp, Artificial Sequence
  Description of Artificial Sequence: Synthetic oligonucleotide
tcagccacaggacattacaatccgttctttccag

SEQ ID NO: 199930 - DNA, 33 bp, Artificial Sequence
  Description of Artificial Sequence: Synthetic oligonucleotide
cagccacaggacattacaatccgttctttccag

SEQ ID NO: 199931 - DNA, 33 bp, Artificial Sequence
  Description of Artificial Sequence: Synthetic oligonucleotide
agccacaggacattacaatccgttctttccagc

SEQ ID NO: 199932 - DNA, 32 bp, Artificial Sequence
  Description of Artificial Sequence: Synthetic oligonucleotide
gccacaggacattacaatccgttctttccagc

SEQ ID NO: 199933 - DNA, 32 bp, Artificial Sequence
  Description of Artificial Sequence: Synthetic oligonucleotide
ccacaggacattacaatccgttctttccagcc

SEQ ID NO: 199934 - DNA, 35 bp, Artificial Sequence
  Description of Artificial Sequence: Synthetic oligonucleotide
cacaggacattacaatccgttctttccagccaaac

SEQ ID NO: 199935 - DNA, 36 bp, Artificial Sequence
  Description of Artificial Sequence: Synthetic oligonucleotide
acaggacattacaatccgttctttccagccaaactg

SEQ ID NO: 199936 - DNA, 35 bp, Artificial Sequence
  Description of Artificial Sequence: Synthetic oligonucleotide
caggacattacaatccgttctttccagccaaactg

SEQ ID NO: 199937 - DNA, 35 bp, Artificial Sequence
  Description of Artificial Sequence: Synthetic oligonucleotide
aggacattacaatccgttctttccagccaaactgg

SEQ ID NO: 199938 - DNA, 34 bp, Artificial Sequence
  Description of Artificial Sequence: Synthetic oligonucleotide
ggacattacaatccgttctttccagccaaactgg

SEQ ID NO: 199939 - DNA, 35 bp, Artificial Sequence
  Description of Artificial Sequence: Synthetic oligonucleotide
gacattacaatccgttctttccagccaaactggtc

SEQ ID NO: 199940 - DNA, 38 bp, Artificial Sequence
  Description of Artificial Sequence: Synthetic oligonucleotide
acattacaatccgttctttccagccaaactggtcatac

SEQ ID NO: 199941 - DNA, 37 bp, Artificial Sequence
  Description of Artificial Sequence: Synthetic oligonucleotide
cattacaatccgttctttccagccaaactggtcatac

SEQ ID NO: 199942 - DNA, 37 bp, Artificial Sequence
  Description of Artificial Sequence: Synthetic oligonucleotide
attacaatccgttctttccagccaaactggtcatacc

SEQ ID NO: 199943 - DNA, 36 bp, Artificial Sequence
  Description of Artificial Sequence: Synthetic oligonucleotide
ttacaatccgttctttccagccaaactggtcatacc

SEQ ID NO: 199944 - DNA, 35 bp, Artificial Sequence
  Description of Artificial Sequence: Synthetic oligonucleotide
tacaatccgttctttccagccaaactggtcatacc

SEQ ID NO: 199945 - DNA, 34 bp, Artificial Sequence
  Description of Artificial Sequence: Synthetic oligonucleotide
acaatccgttctttccagccaaactggtcatacc

SEQ ID NO: 199946 - DNA, 33 bp, Artificial Sequence
  Description of Artificial Sequence: Synthetic oligonucleotide
caatccgttctttccagccaaactggtcatacc

SEQ ID NO: 199947 - DNA, 38 bp, Artificial Sequence
  Description of Artificial Sequence: Synthetic oligonucleotide
aatccgttctttccagccaaactggtcatacctataac

SEQ ID NO: 199948 - DNA, 37 bp, Artificial Sequence
  Description of Artificial Sequence: Synthetic oligonucleotide
atccgttctttccagccaaactggtcatacctataac

SEQ ID NO: 199949 - DNA, 36 bp, Artificial Sequence
  Description of Artificial Sequence: Synthetic oligonucleotide
tccgttctttccagccaaactggtcatacctataac

SEQ ID NO: 199950 - DNA, 35 bp, Artificial Sequence
  Description of Artificial Sequence: Synthetic oligonucleotide
ccgttctttccagccaaactggtcatacctataac

SEQ ID NO: 199951 - DNA, 37 bp, Artificial Sequence
  Description of Artificial Sequence: Synthetic oligonucleotide
cgttctttccagccaaactggtcatacctataactac

SEQ ID NO: 199952 - DNA, 38 bp, Artificial Sequence
  Description of Artificial Sequence: Synthetic oligonucleotide
gttctttccagccaaactggtcatacctataactacag

SEQ ID NO: 199953 - DNA, 37 bp, Artificial Sequence
  Description of Artificial Sequence: Synthetic oligonucleotide
tgttactccctgtatgtgctatgtccatgacttgttg

SEQ ID NO: 199954 - DNA, 36 bp, Artificial Sequence
  Description of Artificial Sequence: Synthetic oligonucleotide
gttactccctgtatgtgctatgtccatgacttgttg

SEQ ID NO: 199955 - DNA, 38 bp, Artificial Sequence
  Description of Artificial Sequence: Synthetic oligonucleotide
ttactccctgtatgtgctatgtccatgacttgttgttg

SEQ ID NO: 199956 - DNA, 37 bp, Artificial Sequence
  Description of Artificial Sequence: Synthetic oligonucleotide
tactccctgtatgtgctatgtccatgacttgttgttg

SEQ ID NO: 199957 - DNA, 36 bp, Artificial Sequence
  Description of Artificial Sequence: Synthetic oligonucleotide
actccctgtatgtgctatgtccatgacttgttgttg

SEQ ID NO: 199958 - DNA, 35 bp, Artificial Sequence
  Description of Artificial Sequence: Synthetic oligonucleotide
ctccctgtatgtgctatgtccatgacttgttgttg

SEQ ID NO: 199959 - DNA, 39 bp, Artificial Sequence
  Description of Artificial Sequence: Synthetic oligonucleotide
tccctgtatgtgctatgtccatgacttgttgttgaaatc

SEQ ID NO: 199960 - DNA, 38 bp, Artificial Sequence
  Description of Artificial Sequence: Synthetic oligonucleotide
ccctgtatgtgctatgtccatgacttgttgttgaaatc

SEQ ID NO: 199961 - DNA, 42 bp, Artificial Sequence
  Description of Artificial Sequence: Synthetic oligonucleotide
cctgtatgtgctatgtccatgacttgttgttgaaatctatac

SEQ ID NO: 199962 - DNA, 42 bp, Artificial Sequence
  Description of Artificial Sequence: Synthetic oligonucleotide
ctgtatgtgctatgtccatgacttgttgttgaaatctatacc

SEQ ID NO: 199963 - DNA, 43 bp, Artificial Sequence
  Description of Artificial Sequence: Synthetic oligonucleotide
tgtatgtgctatgtccatgacttgttgttgaaatctataccag

SEQ ID NO: 199964 - DNA, 42 bp, Artificial Sequence
  Description of Artificial Sequence: Synthetic oligonucleotide
gtatgtgctatgtccatgacttgttgttgaaatctataccag

SEQ ID NO: 199965 - DNA, 43 bp, Artificial Sequence
  Description of Artificial Sequence: Synthetic oligonucleotide
tatgtgctatgtccatgacttgttgttgaaatctataccagtg

SEQ ID NO: 199966 - DNA, 42 bp, Artificial Sequence
  Description of Artificial Sequence: Synthetic oligonucleotide
atgtgctatgtccatgacttgttgttgaaatctataccagtg

SEQ ID NO: 199967 - DNA, 41 bp, Artificial Sequence
  Description of Artificial Sequence: Synthetic oligonucleotide
tgtgctatgtccatgacttgttgttgaaatctataccagtg

SEQ ID NO: 199968 - DNA, 40 bp, Artificial Sequence
  Description of Artificial Sequence: Synthetic oligonucleotide
gtgctatgtccatgacttgttgttgaaatctataccagtg

SEQ ID NO: 199969 - DNA, 40 bp, Artificial Sequence
  Description of Artificial Sequence: Synthetic oligonucleotide
tgctatgtccatgacttgttgttgaaatctataccagtgg

SEQ ID NO: 199970 - DNA, 39 bp, Artificial Sequence
  Description of Artificial Sequence: Synthetic oligonucleotide
gctatgtccatgacttgttgttgaaatctataccagtgg

SEQ ID NO: 199971 - DNA, 39 bp, Artificial Sequence
  Description of Artificial Sequence: Synthetic oligonucleotide
ctatgtccatgacttgttgttgaaatctataccagtggg

SEQ ID NO: 199972 - DNA, 40 bp, Artificial Sequence
  Description of Artificial Sequence: Synthetic oligonucleotide
tatgtccatgacttgttgttgaaatctataccagtgggag

SEQ ID NO: 199973 - DNA, 39 bp, Artificial Sequence
  Description of Artificial Sequence: Synthetic oligonucleotide
atgtccatgacttgttgttgaaatctataccagtgggag

SEQ ID NO: 199974 - DNA, 38 bp, Artificial Sequence
  Description of Artificial Sequence: Synthetic oligonucleotide
tgtccatgacttgttgttgaaatctataccagtgggag

SEQ ID NO: 199975 - DNA, 37 bp, Artificial Sequence
  Description of Artificial Sequence: Synthetic oligonucleotide
gtccatgacttgttgttgaaatctataccagtgggag

SEQ ID NO: 199976 - DNA, 39 bp, Artificial Sequence
  Description of Artificial Sequence: Synthetic oligonucleotide
tccatgacttgttgttgaaatctataccagtgggagttg

SEQ ID NO: 199977 - DNA, 38 bp, Artificial Sequence
  Description of Artificial Sequence: Synthetic oligonucleotide
ccatgacttgttgttgaaatctataccagtgggagttg

SEQ ID NO: 199978 - DNA, 38 bp, Artificial Sequence
  Description of Artificial Sequence: Synthetic oligonucleotide
catgacttgttgttgaaatctataccagtgggagttgg

SEQ ID NO: 199979 - DNA, 39 bp, Artificial Sequence
  Description of Artificial Sequence: Synthetic oligonucleotide
atgacttgttgttgaaatctataccagtgggagttggtc

SEQ ID NO: 199980 - DNA, 38 bp, Artificial Sequence
  Description of Artificial Sequence: Synthetic oligonucleotide
tgacttgttgttgaaatctataccagtgggagttggtc

SEQ ID NO: 199981 - DNA, 37 bp, Artificial Sequence
  Description of Artificial Sequence: Synthetic oligonucleotide
gacttgttgttgaaatctataccagtgggagttggtc

SEQ ID NO: 199982 - DNA, 38 bp, Artificial Sequence
  Description of Artificial Sequence: Synthetic oligonucleotide
acttgttgttgaaatctataccagtgggagttggtcag

SEQ ID NO: 199983 - DNA, 37 bp, Artificial Sequence
  Description of Artificial Sequence: Synthetic oligonucleotide
cttgttgttgaaatctataccagtgggagttggtcag

SEQ ID NO: 199984 - DNA, 39 bp, Artificial Sequence
  Description of Artificial Sequence: Synthetic oligonucleotide
ttgttgttgaaatctataccagtgggagttggtcagatc

SEQ ID NO: 199985 - DNA, 38 bp, Artificial Sequence
  Description of Artificial Sequence: Synthetic oligonucleotide
tgttgttgaaatctataccagtgggagttggtcagatc

SEQ ID NO: 199986 - DNA, 38 bp, Artificial Sequence
  Description of Artificial Sequence: Synthetic oligonucleotide
catgacttgcccaattttctcaagtgcattgaattccg

SEQ ID NO: 199987 - DNA, 39 bp, Artificial Sequence
  Description of Artificial Sequence: Synthetic oligonucleotide
atgacttgcccaattttctcaagtgcattgaattccgtg

SEQ ID NO: 199988 - DNA, 38 bp, Artificial Sequence
  Description of Artificial Sequence: Synthetic oligonucleotide
tgacttgcccaattttctcaagtgcattgaattccgtg

SEQ ID NO: 199989 - DNA, 37 bp, Artificial Sequence
  Description of Artificial Sequence: Synthetic oligonucleotide
gacttgcccaattttctcaagtgcattgaattccgtg

SEQ ID NO: 199990 - DNA, 37 bp, Artificial Sequence
  Description of Artificial Sequence: Synthetic oligonucleotide
acttgcccaattttctcaagtgcattgaattccgtgc

SEQ ID NO: 199991 - DNA, 36 bp, Artificial Sequence
  Description of Artificial Sequence: Synthetic oligonucleotide
cttgcccaattttctcaagtgcattgaattccgtgc

SEQ ID NO: 199992 - DNA, 37 bp, Artificial Sequence
  Description of Artificial Sequence: Synthetic oligonucleotide
ttgcccaattttctcaagtgcattgaattccgtgctc

SEQ ID NO: 199993 - DNA, 36 bp, Artificial Sequence
  Description of Artificial Sequence: Synthetic oligonucleotide
tgcccaattttctcaagtgcattgaattccgtgctc

SEQ ID NO: 199994 - DNA, 35 bp, Artificial Sequence
  Description of Artificial Sequence: Synthetic oligonucleotide
gcccaattttctcaagtgcattgaattccgtgctc

SEQ ID NO: 199995 - DNA, 36 bp, Artificial Sequence
  Description of Artificial Sequence: Synthetic oligonucleotide
cccaattttctcaagtgcattgaattccgtgctcag

SEQ ID NO: 199996 - DNA, 36 bp, Artificial Sequence
  Description of Artificial Sequence: Synthetic oligonucleotide
ccaattttctcaagtgcattgaattccgtgctcagc

SEQ ID NO: 199997 - DNA, 40 bp, Artificial Sequence
  Description of Artificial Sequence: Synthetic oligonucleotide
caattttctcaagtgcattgaattccgtgctcagcaaatg

SEQ ID NO: 199998 - DNA, 40 bp, Artificial Sequence
  Description of Artificial Sequence: Synthetic oligonucleotide
aattttctcaagtgcattgaattccgtgctcagcaaatgg

SEQ ID NO: 199999 - DNA, 39 bp, Artificial Sequence
  Description of Artificial Sequence: Synthetic oligonucleotide
attttctcaagtgcattgaattccgtgctcagcaaatgg

SEQ ID NO: 200000 - DNA, 38 bp, Artificial Sequence
  Description of Artificial Sequence: Synthetic oligonucleotide
ttttctcaagtgcattgaattccgtgctcagcaaatgg

SEQ ID NO: 200001 - DNA, 37 bp, Artificial Sequence
  Description of Artificial Sequence: Synthetic oligonucleotide
tttctcaagtgcattgaattccgtgctcagcaaatgg

SEQ ID NO: 200002 - DNA, 36 bp, Artificial Sequence
  Description of Artificial Sequence: Synthetic oligonucleotide
ttctcaagtgcattgaattccgtgctcagcaaatgg

SEQ ID NO: 200003 - DNA, 35 bp, Artificial Sequence
  Description of Artificial Sequence: Synthetic oligonucleotide
tctcaagtgcattgaattccgtgctcagcaaatgg

SEQ ID NO: 200004 - DNA, 34 bp, Artificial Sequence
  Description of Artificial Sequence: Synthetic oligonucleotide
ctcaagtgcattgaattccgtgctcagcaaatgg

SEQ ID NO: 200005 - DNA, 34 bp, Artificial Sequence
  Description of Artificial Sequence: Synthetic oligonucleotide
tcaagtgcattgaattccgtgctcagcaaatggg

SEQ ID NO: 200006 - DNA, 33 bp, Artificial Sequence
  Description of Artificial Sequence: Synthetic oligonucleotide
caagtgcattgaattccgtgctcagcaaatggg

SEQ ID NO: 200007 - DNA, 34 bp, Artificial Sequence
  Description of Artificial Sequence: Synthetic oligonucleotide
aagtgcattgaattccgtgctcagcaaatgggac

SEQ ID NO: 200008 - DNA, 33 bp, Artificial Sequence
  Description of Artificial Sequence: Synthetic oligonucleotide
agtgcattgaattccgtgctcagcaaatgggac

SEQ ID NO: 200009 - DNA, 32 bp, Artificial Sequence
  Description of Artificial Sequence: Synthetic oligonucleotide
gtgcattgaattccgtgctcagcaaatgggac

SEQ ID NO: 200010 - DNA, 32 bp, Artificial Sequence
  Description of Artificial Sequence: Synthetic oligonucleotide
tgcattgaattccgtgctcagcaaatgggacc

SEQ ID NO: 200011 - DNA, 31 bp, Artificial Sequence
  Description of Artificial Sequence: Synthetic oligonucleotide
gcattgaattccgtgctcagcaaatgggacc

SEQ ID NO: 200012 - DNA, 32 bp, Artificial Sequence
  Description of Artificial Sequence: Synthetic oligonucleotide
cattgaattccgtgctcagcaaatgggacctc

SEQ ID NO: 200013 - DNA, 32 bp, Artificial Sequence
  Description of Artificial Sequence: Synthetic oligonucleotide
attgaattccgtgctcagcaaatgggacctcc

SEQ ID NO: 200014 - DNA, 31 bp, Artificial Sequence
  Description of Artificial Sequence: Synthetic oligonucleotide
ttgaattccgtgctcagcaaatgggacctcc

SEQ ID NO: 200015 - DNA, 30 bp, Artificial Sequence
  Description of Artificial Sequence: Synthetic oligonucleotide
tgaattccgtgctcagcaaatgggacctcc

SEQ ID NO: 200016 - DNA, 29 bp, Artificial Sequence
  Description of Artificial Sequence: Synthetic oligonucleotide
gaattccgtgctcagcaaatgggacctcc

SEQ ID NO: 200017 - DNA, 29 bp, Artificial Sequence
  Description of Artificial Sequence: Synthetic oligonucleotide
aattccgtgctcagcaaatgggacctccc

SEQ ID NO: 200018 - DNA, 28 bp, Artificial Sequence
  Description of Artificial Sequence: Synthetic oligonucleotide
attccgtgctcagcaaatgggacctccc

SEQ ID NO: 200019 - DNA, 27 bp, Artificial Sequence
  Description of Artificial Sequence: Synthetic oligonucleotide
ttccgtgctcagcaaatgggacctccc

SEQ ID NO: 200020 - DNA, 26 bp, Artificial Sequence
  Description of Artificial Sequence: Synthetic oligonucleotide
tccgtgctcagcaaatgggacctccc

SEQ ID NO: 200021 - DNA, 25 bp, Artificial Sequence
  Description of Artificial Sequence: Synthetic oligonucleotide
ccgtgctcagcaaatgggacctccc

SEQ ID NO: 200022 - DNA, 25 bp, Artificial Sequence
  Description of Artificial Sequence: Synthetic oligonucleotide
cgtgctcagcaaatgggacctcccc

SEQ ID NO: 200023 - DNA, 26 bp, Artificial Sequence
  Description of Artificial Sequence: Synthetic oligonucleotide
gtgctcagcaaatgggacctccccgt

SEQ ID NO: 200024 - DNA, 31 bp, Artificial Sequence
  Description of Artificial Sequence: Synthetic oligonucleotide
gggactcagtctttcagccccatttgagaac

SEQ ID NO: 200025 - DNA, 33 bp, Artificial Sequence
  Description of Artificial Sequence: Synthetic oligonucleotide
ggactcagtctttcagccccatttgagaacatc

SEQ ID NO: 200026 - DNA, 35 bp, Artificial Sequence
  Description of Artificial Sequence: Synthetic oligonucleotide
gactcagtctttcagccccatttgagaacatctac

SEQ ID NO: 200027 - DNA, 38 bp, Artificial Sequence
  Description of Artificial Sequence: Synthetic oligonucleotide
actcagtctttcagccccatttgagaacatctactttg

SEQ ID NO: 200028 - DNA, 37 bp, Artificial Sequence
  Description of Artificial Sequence: Synthetic oligonucleotide
ctcagtctttcagccccatttgagaacatctactttg

SEQ ID NO: 200029 - DNA, 37 bp, Artificial Sequence
  Description of Artificial Sequence: Synthetic oligonucleotide
tcagtctttcagccccatttgagaacatctactttgg

SEQ ID NO: 200030 - DNA, 36 bp, Artificial Sequence
  Description of Artificial Sequence: Synthetic oligonucleotide
cagtctttcagccccatttgagaacatctactttgg

SEQ ID NO: 200031 - DNA, 37 bp, Artificial Sequence
  Description of Artificial Sequence: Synthetic oligonucleotide
agtctttcagccccatttgagaacatctactttggac

SEQ ID NO: 200032 - DNA, 36 bp, Artificial Sequence
  Description of Artificial Sequence: Synthetic oligonucleotide
gtctttcagccccatttgagaacatctactttggac

SEQ ID NO: 200033 - DNA, 37 bp, Artificial Sequence
  Description of Artificial Sequence: Synthetic oligonucleotide
tctttcagccccatttgagaacatctactttggactc

SEQ ID NO: 200034 - DNA, 36 bp, Artificial Sequence
  Description of Artificial Sequence: Synthetic oligonucleotide
ctttcagccccatttgagaacatctactttggactc

SEQ ID NO: 200035 - DNA, 37 bp, Artificial Sequence
  Description of Artificial Sequence: Synthetic oligonucleotide
tttcagccccatttgagaacatctactttggactctg

SEQ ID NO: 200036 - DNA, 36 bp, Artificial Sequence
  Description of Artificial Sequence: Synthetic oligonucleotide
ttcagccccatttgagaacatctactttggactctg

SEQ ID NO: 200037 - DNA, 35 bp, Artificial Sequence
  Description of Artificial Sequence: Synthetic oligonucleotide
tcagccccatttgagaacatctactttggactctg

SEQ ID NO: 200038 - DNA, 34 bp, Artificial Sequence
  Description of Artificial Sequence: Synthetic oligonucleotide
cagccccatttgagaacatctactttggactctg

SEQ ID NO: 200039 - DNA, 34 bp, Artificial Sequence
  Description of Artificial Sequence: Synthetic oligonucleotide
agccccatttgagaacatctactttggactctgg

SEQ ID NO: 200040 - DNA, 33 bp, Artificial Sequence
  Description of Artificial Sequence: Synthetic oligonucleotide
gccccatttgagaacatctactttggactctgg

SEQ ID NO: 200041 - DNA, 33 bp, Artificial Sequence
  Description of Artificial Sequence: Synthetic oligonucleotide
ccccatttgagaacatctactttggactctggg

SEQ ID NO: 200042 - DNA, 33 bp, Artificial Sequence
  Description of Artificial Sequence: Synthetic oligonucleotide
cccatttgagaacatctactttggactctgggg

SEQ ID NO: 200043 - DNA, 36 bp, Artificial Sequence
  Description of Artificial Sequence: Synthetic oligonucleotide
ccatttgagaacatctactttggactctggggtttc

SEQ ID NO: 200044 - DNA, 38 bp, Artificial Sequence
  Description of Artificial Sequence: Synthetic oligonucleotide
catttgagaacatctactttggactctggggtttcaac

SEQ ID NO: 200045 - DNA, 39 bp, Artificial Sequence
  Description of Artificial Sequence: Synthetic oligonucleotide
atttgagaacatctactttggactctggggtttcaacag

SEQ ID NO: 200046 - DNA, 38 bp, Artificial Sequence
  Description of Artificial Sequence: Synthetic oligonucleotide
tttgagaacatctactttggactctggggtttcaacag

SEQ ID NO: 200047 - DNA, 37 bp, Artificial Sequence
  Description of Artificial Sequence: Synthetic oligonucleotide
ttgagaacatctactttggactctggggtttcaacag

SEQ ID NO: 200048 - DNA, 36 bp, Artificial Sequence
  Description of Artificial Sequence: Synthetic oligonucleotide
tgagaacatctactttggactctggggtttcaacag

SEQ ID NO: 200049 - DNA, 35 bp, Artificial Sequence
  Description of Artificial Sequence: Synthetic oligonucleotide
gagaacatctactttggactctggggtttcaacag

SEQ ID NO: 200050 - DNA, 35 bp, Artificial Sequence
  Description of Artificial Sequence: Synthetic oligonucleotide
agaacatctactttggactctggggtttcaacagc

SEQ ID NO: 200051 - DNA, 34 bp, Artificial Sequence
  Description of Artificial Sequence: Synthetic oligonucleotide
gaacatctactttggactctggggtttcaacagc

SEQ ID NO: 200052 - DNA, 35 bp, Artificial Sequence
  Description of Artificial Sequence: Synthetic oligonucleotide
aacatctactttggactctggggtttcaacagctc

SEQ ID NO: 200053 - DNA, 34 bp, Artificial Sequence
  Description of Artificial Sequence: Synthetic oligonucleotide
cctggagttgttgaaatctataccagtgggagtg

SEQ ID NO: 200054 - DNA, 34 bp, Artificial Sequence
  Description of Artificial Sequence: Synthetic oligonucleotide
ctggagttgttgaaatctataccagtgggagtgg

SEQ ID NO: 200055 - DNA, 34 bp, Artificial Sequence
  Description of Artificial Sequence: Synthetic oligonucleotide
tggagttgttgaaatctataccagtgggagtggg

SEQ ID NO: 200056 - DNA, 33 bp, Artificial Sequence
  Description of Artificial Sequence: Synthetic oligonucleotide
ggagttgttgaaatctataccagtgggagtggg

SEQ ID NO: 200057 - DNA, 34 bp, Artificial Sequence
  Description of Artificial Sequence: Synthetic oligonucleotide
gagttgttgaaatctataccagtgggagtgggag

SEQ ID NO: 200058 - DNA, 36 bp, Artificial Sequence
  Description of Artificial Sequence: Synthetic oligonucleotide
agttgttgaaatctataccagtgggagtgggagttg

SEQ ID NO: 200059 - DNA, 35 bp, Artificial Sequence
  Description of Artificial Sequence: Synthetic oligonucleotide
gttgttgaaatctataccagtgggagtgggagttg

SEQ ID NO: 200060 - DNA, 35 bp, Artificial Sequence
  Description of Artificial Sequence: Synthetic oligonucleotide
ttgttgaaatctataccagtgggagtgggagttgg

SEQ ID NO: 200061 - DNA, 34 bp, Artificial Sequence
  Description of Artificial Sequence: Synthetic oligonucleotide
tgttgaaatctataccagtgggagtgggagttgg

SEQ ID NO: 200062 - DNA, 33 bp, Artificial Sequence
  Description of Artificial Sequence: Synthetic oligonucleotide
gttgaaatctataccagtgggagtgggagttgg

SEQ ID NO: 200063 - DNA, 34 bp, Artificial Sequence
  Description of Artificial Sequence: Synthetic oligonucleotide
ttgaaatctataccagtgggagtgggagttggtc

SEQ ID NO: 200064 - DNA, 33 bp, Artificial Sequence
  Description of Artificial Sequence: Synthetic oligonucleotide
tgaaatctataccagtgggagtgggagttggtc

SEQ ID NO: 200065 - DNA, 32 bp, Artificial Sequence
  Description of Artificial Sequence: Synthetic oligonucleotide
gaaatctataccagtgggagtgggagttggtc

SEQ ID NO: 200066 - DNA, 33 bp, Artificial Sequence
  Description of Artificial Sequence: Synthetic oligonucleotide
aaatctataccagtgggagtgggagttggtcag

SEQ ID NO: 200067 - DNA, 32 bp, Artificial Sequence
  Description of Artificial Sequence: Synthetic oligonucleotide
aatctataccagtgggagtgggagttggtcag

SEQ ID NO: 200068 - DNA, 31 bp, Artificial Sequence
  Description of Artificial Sequence: Synthetic oligonucleotide
atctataccagtgggagtgggagttggtcag

SEQ ID NO: 200069 - DNA, 30 bp, Artificial Sequence
  Description of Artificial Sequence: Synthetic oligonucleotide
tctataccagtgggagtgggagttggtcag

SEQ ID NO: 200070 - DNA, 29 bp, Artificial Sequence
  Description of Artificial Sequence: Synthetic oligonucleotide
ctataccagtgggagtgggagttggtcag

SEQ ID NO: 200071 - DNA, 31 bp, Artificial Sequence
  Description of Artificial Sequence: Synthetic oligonucleotide
tataccagtgggagtgggagttggtcagatc

SEQ ID NO: 200072 - DNA, 30 bp, Artificial Sequence
  Description of Artificial Sequence: Synthetic oligonucleotide
ataccagtgggagtgggagttggtcagatc

SEQ ID NO: 200073 - DNA, 29 bp, Artificial Sequence
  Description of Artificial Sequence: Synthetic oligonucleotide
taccagtgggagtgggagttggtcagatc

SEQ ID NO: 200074 - DNA, 28 bp, Artificial Sequence
  Description of Artificial Sequence: Synthetic oligonucleotide
accagtgggagtgggagttggtcagatc

SEQ ID NO: 200075 - DNA, 27 bp, Artificial Sequence
  Description of Artificial Sequence: Synthetic oligonucleotide
ccagtgggagtgggagttggtcagatc

SEQ ID NO: 200076 - DNA, 30 bp, Artificial Sequence
  Description of Artificial Sequence: Synthetic oligonucleotide
cagtgggagtgggagttggtcagatctatg

SEQ ID NO: 200077 - DNA, 30 bp, Artificial Sequence
  Description of Artificial Sequence: Synthetic oligonucleotide
agtgggagtgggagttggtcagatctatgg

SEQ ID NO: 200078 - DNA, 29 bp, Artificial Sequence
  Description of Artificial Sequence: Synthetic oligonucleotide
gtgggagtgggagttggtcagatctatgg

SEQ ID NO: 200079 - DNA, 29 bp, Artificial Sequence
  Description of Artificial Sequence: Synthetic oligonucleotide
tgggagtgggagttggtcagatctatggc

SEQ ID NO: 200080 - DNA, 28 bp, Artificial Sequence
  Description of Artificial Sequence: Synthetic oligonucleotide
gggagtgggagttggtcagatctatggc

SEQ ID NO: 200081 - DNA, 29 bp, Artificial Sequence
  Description of Artificial Sequence: Synthetic oligonucleotide
ggagtgggagttggtcagatctatggctg

SEQ ID NO: 200082 - DNA, 30 bp, Artificial Sequence
  Description of Artificial Sequence: Synthetic oligonucleotide
gagtgggagttggtcagatctatggctgtg

SEQ ID NO: 200083 - DNA, 22 bp, Artificial Sequence
  Description of Artificial Sequence: Synthetic oligonucleotide
atgacgcctcctccgcccggac

SEQ ID NO: 200084 - DNA, 21 bp, Artificial Sequence
  Description of Artificial Sequence: Synthetic oligonucleotide
tgacgcctcctccgcccggac

SEQ ID NO: 200085 - DNA, 20 bp, Artificial Sequence
  Description of Artificial Sequence: Synthetic oligonucleotide
gacgcctcctccgcccggac

SEQ ID NO: 200086 - DNA, 21 bp, Artificial Sequence
  Description of Artificial Sequence: Synthetic oligonucleotide
acgcctcctccgcccggacgt

SEQ ID NO: 200087 - DNA, 20 bp, Artificial Sequence
  Description of Artificial Sequence: Synthetic oligonucleotide
cgcctcctccgcccggacgt

SEQ ID NO: 200088 - DNA, 20 bp, Artificial Sequence
  Description of Artificial Sequence: Synthetic oligonucleotide
gcctcctccgcccggacgtg

SEQ ID NO: 200089 - DNA, 20 bp, Artificial Sequence
  Description of Artificial Sequence: Synthetic oligonucleotide
cctcctccgcccggacgtgc

SEQ ID NO: 200090 - DNA, 20 bp, Artificial Sequence
  Description of Artificial Sequence: Synthetic oligonucleotide
ctcctccgcccggacgtgcc

SEQ ID NO: 200091 - DNA, 20 bp, Artificial Sequence
  Description of Artificial Sequence: Synthetic oligonucleotide
tcctccgcccggacgtgccg

SEQ ID NO: 200092 - DNA, 20 bp, Artificial Sequence
  Description of Artificial Sequence: Synthetic oligonucleotide
cctccgcccggacgtgccgt

SEQ ID NO: 200093 - DNA, 20 bp, Artificial Sequence
  Description of Artificial Sequence: Synthetic oligonucleotide
ctccgcccggacgtgccgct

SEQ ID NO: 200094 - DNA, 20 bp, Artificial Sequence
  Description of Artificial Sequence: Synthetic oligonucleotide
tccgcccggacgtgccgcct

SEQ ID NO: 200095 - DNA, 20 bp, Artificial Sequence
  Description of Artificial Sequence: Synthetic oligonucleotide
ccgcccggacgtgccgcctt

SEQ ID NO: 200096 - DNA, 20 bp, Artificial Sequence
  Description of Artificial Sequence: Synthetic oligonucleotide
cgcccggacgtgccgccctt

SEQ ID NO: 200097 - DNA, 20 bp, Artificial Sequence
  Description of Artificial Sequence: Synthetic oligonucleotide
gcccggacgtgccgcccctt

SEQ ID NO: 200098 - DNA, 20 bp, Artificial Sequence
  Description of Artificial Sequence: Synthetic oligonucleotide
cccggacgtgccgcccccat

SEQ ID NO: 200099 - DNA, 20 bp, Artificial Sequence
  Description of Artificial Sequence: Synthetic oligonucleotide
ccggacgtgccgcccccagt

SEQ ID NO: 200100 - DNA, 20 bp, Artificial Sequence
  Description of Artificial Sequence: Synthetic oligonucleotide
cggacgtgccgcccccagct

SEQ ID NO: 200101 - DNA, 20 bp, Artificial Sequence
  Description of Artificial Sequence: Synthetic oligonucleotide
ggacgtgccgcccccagcgt

SEQ ID NO: 200102 - DNA, 20 bp, Artificial Sequence
  Description of Artificial Sequence: Synthetic oligonucleotide
gacgtgccgcccccagcgca

SEQ ID NO: 200103 - DNA, 20 bp, Artificial Sequence
  Description of Artificial Sequence: Synthetic oligonucleotide
acgtgccgcccccagcgcac

SEQ ID NO: 200104 - DNA, 20 bp, Artificial Sequence
  Description of Artificial Sequence: Synthetic oligonucleotide
cgtgccgcccccagcgcact

SEQ ID NO: 200105 - DNA, 20 bp, Artificial Sequence
  Description of Artificial Sequence: Synthetic oligonucleotide
gtgccgcccccagcgcacct

SEQ ID NO: 200106 - DNA, 20 bp, Artificial Sequence
  Description of Artificial Sequence: Synthetic oligonucleotide
tgccgcccccagcgcaccgt

SEQ ID NO: 200107 - DNA, 20 bp, Artificial Sequence
  Description of Artificial Sequence: Synthetic oligonucleotide
gccgcccccagcgcaccgtt

SEQ ID NO: 200108 - DNA, 20 bp, Artificial Sequence
  Description of Artificial Sequence: Synthetic oligonucleotide
ccgcccccagcgcaccgctt

SEQ ID NO: 200109 - DNA, 20 bp, Artificial Sequence
  Description of Artificial Sequence: Synthetic oligonucleotide
cgcccccagcgcaccgcgtt

SEQ ID NO: 200110 - DNA, 20 bp, Artificial Sequence
  Description of Artificial Sequence: Synthetic oligonucleotide
gcccccagcgcaccgcgctt

SEQ ID NO: 200111 - DNA, 20 bp, Artificial Sequence
  Description of Artificial Sequence: Synthetic oligonucleotide
cccccagcgcaccgcgcgtt

SEQ ID NO: 200112 - DNA, 20 bp, Artificial Sequence
  Description of Artificial Sequence: Synthetic oligonucleotide
ccccagcgcaccgcgcgctt

SEQ ID NO: 200113 - DNA, 20 bp, Artificial Sequence
  Description of Artificial Sequence: Synthetic oligonucleotide
cccagcgcaccgcgcgcctt

SEQ ID NO: 200114 - DNA, 20 bp, Artificial Sequence
  Description of Artificial Sequence: Synthetic oligonucleotide
ccagcgcaccgcgcgccctt

SEQ ID NO: 200115 - DNA, 20 bp, Artificial Sequence
  Description of Artificial Sequence: Synthetic oligonucleotide
cagcgcaccgcgcgcccgtt

SEQ ID NO: 200116 - DNA, 20 bp, Artificial Sequence
  Description of Artificial Sequence: Synthetic oligonucleotide
agcgcaccgcgcgcccgctt

SEQ ID NO: 200117 - DNA, 20 bp, Artificial Sequence
  Description of Artificial Sequence: Synthetic oligonucleotide
gcgcaccgcgcgcccgcttt

SEQ ID NO: 200118 - DNA, 20 bp, Artificial Sequence
  Description of Artificial Sequence: Synthetic oligonucleotide
cgcaccgcgcgcccgcgttt

SEQ ID NO: 200119 - DNA, 20 bp, Artificial Sequence
  Description of Artificial Sequence: Synthetic oligonucleotide
gcaccgcgcgcccgcgtctt

SEQ ID NO: 200120 - DNA, 20 bp, Artificial Sequence
  Description of Artificial Sequence: Synthetic oligonucleotide
caccgcgcgcccgcgtcctt

SEQ ID NO: 200121 - DNA, 20 bp, Artificial Sequence
  Description of Artificial Sequence: Synthetic oligonucleotide
accgcgcgcccgcgtccctt

SEQ ID NO: 200122 - DNA, 20 bp, Artificial Sequence
  Description of Artificial Sequence: Synthetic oligonucleotide
ccgcgcgcccgcgtcccttt

SEQ ID NO: 200123 - DNA, 20 bp, Artificial Sequence
  Description of Artificial Sequence: Synthetic oligonucleotide
cgcgcgcccgcgtccctgtt

SEQ ID NO: 200124 - DNA, 20 bp, Artificial Sequence
  Description of Artificial Sequence: Synthetic oligonucleotide
gcgcgcccgcgtccctggtt

SEQ ID NO: 200125 - DNA, 20 bp, Artificial Sequence
  Description of Artificial Sequence: Synthetic oligonucleotide
cgcgcccgcgtccctggctt

SEQ ID NO: 200126 - DNA, 20 bp, Artificial Sequence
  Description of Artificial Sequence: Synthetic oligonucleotide
gcgcccgcgtccctggcctt

SEQ ID NO: 200127 - DNA, 20 bp, Artificial Sequence
  Description of Artificial Sequence: Synthetic oligonucleotide
cgcccgcgtccctggccctt

SEQ ID NO: 200128 - DNA, 20 bp, Artificial Sequence
  Description of Artificial Sequence: Synthetic oligonucleotide
gcccgcgtccctggcccgtt

SEQ ID NO: 200129 - DNA, 20 bp, Artificial Sequence
  Description of Artificial Sequence: Synthetic oligonucleotide
cccgcgtccctggcccgctt

SEQ ID NO: 200130 - DNA, 20 bp, Artificial Sequence
  Description of Artificial Sequence: Synthetic oligonucleotide
ccgcgtccctggcccgcctt

SEQ ID NO: 200131 - DNA, 20 bp, Artificial Sequence
  Description of Artificial Sequence: Synthetic oligonucleotide
cgcgtccctggcccgccgtt

SEQ ID NO: 200132 - DNA, 20 bp, Artificial Sequence
  Description of Artificial Sequence: Synthetic oligonucleotide
gcgtccctggcccgccggtt

SEQ ID NO: 200133 - DNA, 20 bp, Artificial Sequence
  Description of Artificial Sequence: Synthetic oligonucleotide
cgtccctggcccgccggctt

SEQ ID NO: 200134 - DNA, 20 bp, Artificial Sequence
  Description of Artificial Sequence: Synthetic oligonucleotide
gtccctggcccgccggctct

SEQ ID NO: 200135 - DNA, 20 bp, Artificial Sequence
  Description of Artificial Sequence: Synthetic oligonucleotide
tccctggcccgccggctcgt

SEQ ID NO: 200136 - DNA, 20 bp, Artificial Sequence
  Description of Artificial Sequence: Synthetic oligonucleotide
ccctggcccgccggctcgtt

SEQ ID NO: 200137 - DNA, 20 bp, Artificial Sequence
  Description of Artificial Sequence: Synthetic oligonucleotide
cctggcccgccggctcggtt

SEQ ID NO: 200138 - DNA, 20 bp, Artificial Sequence
  Description of Artificial Sequence: Synthetic oligonucleotide
ctggcccgccggctcggttg

SEQ ID NO: 200139 - DNA, 20 bp, Artificial Sequence
  Description of Artificial Sequence: Synthetic oligonucleotide
tggcccgccggctcggttgg

SEQ ID NO: 200140 - DNA, 20 bp, Artificial Sequence
  Description of Artificial Sequence: Synthetic oligonucleotide
ggcccgccggctcggttggt

SEQ ID NO: 200141 - DNA, 20 bp, Artificial Sequence
  Description of Artificial Sequence: Synthetic oligonucleotide
gcccgccggctcggttgggt

SEQ ID NO: 200142 - DNA, 20 bp, Artificial Sequence
  Description of Artificial Sequence: Synthetic oligonucleotide
cccgccggctcggttggggt

SEQ ID NO: 200143 - DNA, 21 bp, Artificial Sequence
  Description of Artificial Sequence: Synthetic oligonucleotide
ccgccggctcggttggggctt

SEQ ID NO: 200144 - DNA, 21 bp, Artificial Sequence
  Description of Artificial Sequence: Synthetic oligonucleotide
cgccggctcggttggggcttc

SEQ ID NO: 200145 - DNA, 21 bp, Artificial Sequence
  Description of Artificial Sequence: Synthetic oligonucleotide
gccggctcggttggggcttcc

SEQ ID NO: 200146 - DNA, 21 bp, Artificial Sequence
  Description of Artificial Sequence: Synthetic oligonucleotide
ccggctcggttggggcttccg

SEQ ID NO: 200147 - DNA, 22 bp, Artificial Sequence
  Description of Artificial Sequence: Synthetic oligonucleotide
cggctcggttggggcttccgct

SEQ ID NO: 200148 - DNA, 22 bp, Artificial Sequence
  Description of Artificial Sequence: Synthetic oligonucleotide
ggctcggttggggcttccgctg

SEQ ID NO: 200149 - DNA, 22 bp, Artificial Sequence
  Description of Artificial Sequence: Synthetic oligonucleotide
gctcggttggggcttccgctgc

SEQ ID NO: 200150 - DNA, 22 bp, Artificial Sequence
  Description of Artificial Sequence: Synthetic oligonucleotide
ctcggttggggcttccgctgcg

SEQ ID NO: 200151 - DNA, 22 bp, Artificial Sequence
  Description of Artificial Sequence: Synthetic oligonucleotide
tcggttggggcttccgctgcgg

SEQ ID NO: 200152 - DNA, 21 bp, Artificial Sequence
  Description of Artificial Sequence: Synthetic oligonucleotide
cggttggggcttccgctgcgg

SEQ ID NO: 200153 - DNA, 22 bp, Artificial Sequence
  Description of Artificial Sequence: Synthetic oligonucleotide
ggttggggcttccgctgcggct

SEQ ID NO: 200154 - DNA, 22 bp, Artificial Sequence
  Description of Artificial Sequence: Synthetic oligonucleotide
gttggggcttccgctgcggctg

SEQ ID NO: 200155 - DNA, 22 bp, Artificial Sequence
  Description of Artificial Sequence: Synthetic oligonucleotide
ttggggcttccgctgcggctgc

SEQ ID NO: 200156 - DNA, 21 bp, Artificial Sequence
  Description of Artificial Sequence: Synthetic oligonucleotide
tggggcttccgctgcggctgc

SEQ ID NO: 200157 - DNA, 20 bp, Artificial Sequence
  Description of Artificial Sequence: Synthetic oligonucleotide
ggggcttccgctgcggctgc

SEQ ID NO: 200158 - DNA, 20 bp, Artificial Sequence
  Description of Artificial Sequence: Synthetic oligonucleotide
gggcttccgctgcggctgcg

SEQ ID NO: 200159 - DNA, 20 bp, Artificial Sequence
  Description of Artificial Sequence: Synthetic oligonucleotide
ggcttccgctgcggctgcgg

SEQ ID NO: 200160 - DNA, 21 bp, Artificial Sequence
  Description of Artificial Sequence: Synthetic oligonucleotide
gcttccgctgcggctgcggct

SEQ ID NO: 200161 - DNA, 21 bp, Artificial Sequence
  Description of Artificial Sequence: Synthetic oligonucleotide
cttccgctgcggctgcggctg

SEQ ID NO: 200162 - DNA, 22 bp, Artificial Sequence
  Description of Artificial Sequence: Synthetic oligonucleotide
ttccgctgcggctgcggctgct

SEQ ID NO: 200163 - DNA, 21 bp, Artificial Sequence
  Description of Artificial Sequence: Synthetic oligonucleotide
tccgctgcggctgcggctgct

SEQ ID NO: 200164 - DNA, 20 bp, Artificial Sequence
  Description of Artificial Sequence: Synthetic oligonucleotide
ccgctgcggctgcggctgct

SEQ ID NO: 200165 - DNA, 20 bp, Artificial Sequence
  Description of Artificial Sequence: Synthetic oligonucleotide
cgctgcggctgcggctgctg

SEQ ID NO: 200166 - DNA, 21 bp, Artificial Sequence
  Description of Artificial Sequence: Synthetic oligonucleotide
gctgcggctgcggctgctgct

SEQ ID NO: 200167 - DNA, 21 bp, Artificial Sequence
  Description of Artificial Sequence: Synthetic oligonucleotide
ctgcggctgcggctgctgctg

SEQ ID NO: 200168 - DNA, 22 bp, Artificial Sequence
  Description of Artificial Sequence: Synthetic oligonucleotide
tgcggctgcggctgctgctgct

SEQ ID NO: 200169 - DNA, 21 bp, Artificial Sequence
  Description of Artificial Sequence: Synthetic oligonucleotide
gcggctgcggctgctgctgct

SEQ ID NO: 200170 - DNA, 21 bp, Artificial Sequence
  Description of Artificial Sequence: Synthetic oligonucleotide
cggctgcggctgctgctgctg

SEQ ID NO: 200171 - DNA, 22 bp, Artificial Sequence
  Description of Artificial Sequence: Synthetic oligonucleotide
ggctgcggctgctgctgctgct

SEQ ID NO: 200172 - DNA, 23 bp, Artificial Sequence
  Description of Artificial Sequence: Synthetic oligonucleotide
gctgcggctgctgctgctgctct

SEQ ID NO: 200173 - DNA, 23 bp, Artificial Sequence
  Description of Artificial Sequence: Synthetic oligonucleotide
ctgcggctgctgctgctgctctg

SEQ ID NO: 200174 - DNA, 23 bp, Artificial Sequence
  Description of Artificial Sequence: Synthetic oligonucleotide
tgcggctgctgctgctgctctgg

SEQ ID NO: 200175 - DNA, 22 bp, Artificial Sequence
  Description of Artificial Sequence: Synthetic oligonucleotide
gcggctgctgctgctgctctgg

SEQ ID NO: 200176 - DNA, 22 bp, Artificial Sequence
  Description of Artificial Sequence: Synthetic oligonucleotide
cggctgctgctgctgctctggg

SEQ ID NO: 200177 - DNA, 22 bp, Artificial Sequence
  Description of Artificial Sequence: Synthetic oligonucleotide
ggctgctgctgctgctctgggc

SEQ ID NO: 200178 - DNA, 22 bp, Artificial Sequence
  Description of Artificial Sequence: Synthetic oligonucleotide
gctgctgctgctgctctgggcg

SEQ ID NO: 200179 - DNA, 22 bp, Artificial Sequence
  Description of Artificial Sequence: Synthetic oligonucleotide
ctgctgctgctgctctgggcgg

SEQ ID NO: 200180 - DNA, 22 bp, Artificial Sequence
  Description of Artificial Sequence: Synthetic oligonucleotide
tgctgctgctgctctgggcggc

SEQ ID NO: 200181 - DNA, 21 bp, Artificial Sequence
  Description of Artificial Sequence: Synthetic oligonucleotide
gctgctgctgctctgggcggc

SEQ ID NO: 200182 - DNA, 21 bp, Artificial Sequence
  Description of Artificial Sequence: Synthetic oligonucleotide
ctgctgctgctctgggcggcc

SEQ ID NO: 200183 - DNA, 21 bp, Artificial Sequence
  Description of Artificial Sequence: Synthetic oligonucleotide
tgctgctgctctgggcggccg

SEQ ID NO: 200184 - DNA, 20 bp, Artificial Sequence
  Description of Artificial Sequence: Synthetic oligonucleotide
gctgctgctctgggcggccg

SEQ ID NO: 200185 - DNA, 20 bp, Artificial Sequence
  Description of Artificial Sequence: Synthetic oligonucleotide
ctgctgctctgggcggccgc

SEQ ID NO: 200186 - DNA, 20 bp, Artificial Sequence
  Description of Artificial Sequence: Synthetic oligonucleotide
tgctgctctgggcggccgcc

SEQ ID NO: 200187 - DNA, 20 bp, Artificial Sequence
  Description of Artificial Sequence: Synthetic oligonucleotide
gctgctctgggcggccgcct

SEQ ID NO: 200188 - DNA, 20 bp, Artificial Sequence
  Description of Artificial Sequence: Synthetic oligonucleotide
ctgctctgggcggccgccgt

SEQ ID NO: 200189 - DNA, 20 bp, Artificial Sequence
  Description of Artificial Sequence: Synthetic oligonucleotide
tgctctgggcggccgccgct

SEQ ID NO: 200190 - DNA, 20 bp, Artificial Sequence
  Description of Artificial Sequence: Synthetic oligonucleotide
gctctgggcggccgccgctt

SEQ ID NO: 200191 - DNA, 20 bp, Artificial Sequence
  Description of Artificial Sequence: Synthetic oligonucleotide
ctctgggcggccgccgcctt

SEQ ID NO: 200192 - DNA, 20 bp, Artificial Sequence
  Description of Artificial Sequence: Synthetic oligonucleotide
tctgggcggccgccgcctct

SEQ ID NO: 200193 - DNA, 20 bp, Artificial Sequence
  Description of Artificial Sequence: Synthetic oligonucleotide
ctgggcggccgccgcctctt

SEQ ID NO: 200194 - DNA, 20 bp, Artificial Sequence
  Description of Artificial Sequence: Synthetic oligonucleotide
tgggcggccgccgcctcctt

SEQ ID NO: 200195 - DNA, 20 bp, Artificial Sequence
  Description of Artificial Sequence: Synthetic oligonucleotide
gggcggccgccgcctccttt

SEQ ID NO: 200196 - DNA, 20 bp, Artificial Sequence
  Description of Artificial Sequence: Synthetic oligonucleotide
ggcggccgccgcctccgttt

SEQ ID NO: 200197 - DNA, 20 bp, Artificial Sequence
  Description of Artificial Sequence: Synthetic oligonucleotide
gcggccgccgcctccgcttt

SEQ ID NO: 200198 - DNA, 20 bp, Artificial Sequence
  Description of Artificial Sequence: Synthetic oligonucleotide
cggccgccgcctccgccttt

SEQ ID NO: 200199 - DNA, 20 bp, Artificial Sequence
  Description of Artificial Sequence: Synthetic oligonucleotide
ggccgccgcctccgcccatt

SEQ ID NO: 200200 - DNA, 20 bp, Artificial Sequence
  Description of Artificial Sequence: Synthetic oligonucleotide
gccgccgcctccgcccagtt

SEQ ID NO: 200201 - DNA, 20 bp, Artificial Sequence
  Description of Artificial Sequence: Synthetic oligonucleotide
ccgccgcctccgcccaggtt

SEQ ID NO: 200202 - DNA, 20 bp, Artificial Sequence
  Description of Artificial Sequence: Synthetic oligonucleotide
cgccgcctccgcccagggtt

SEQ ID NO: 200203 - DNA, 20 bp, Artificial Sequence
  Description of Artificial Sequence: Synthetic oligonucleotide
gccgcctccgcccagggctt

SEQ ID NO: 200204 - DNA, 20 bp, Artificial Sequence
  Description of Artificial Sequence: Synthetic oligonucleotide
ccgcctccgcccagggccat

SEQ ID NO: 200205 - DNA, 20 bp, Artificial Sequence
  Description of Artificial Sequence: Synthetic oligonucleotide
cgcctccgcccagggccact

SEQ ID NO: 200206 - DNA, 22 bp, Artificial Sequence
  Description of Artificial Sequence: Synthetic oligonucleotide
gcctccgcccagggccacctaa

SEQ ID NO: 200207 - DNA, 22 bp, Artificial Sequence
  Description of Artificial Sequence: Synthetic oligonucleotide
cctccgcccagggccacctaag

SEQ ID NO: 200208 - DNA, 23 bp, Artificial Sequence
  Description of Artificial Sequence: Synthetic oligonucleotide
ctccgcccagggccacctaagga

SEQ ID NO: 200209 - DNA, 23 bp, Artificial Sequence
  Description of Artificial Sequence: Synthetic oligonucleotide
tccgcccagggccacctaaggag

SEQ ID NO: 200210 - DNA, 22 bp, Artificial Sequence
  Description of Artificial Sequence: Synthetic oligonucleotide
ccgcccagggccacctaaggag

SEQ ID NO: 200211 - DNA, 22 bp, Artificial Sequence
  Description of Artificial Sequence: Synthetic oligonucleotide
cgcccagggccacctaaggagc

SEQ ID NO: 200212 - DNA, 22 bp, Artificial Sequence
  Description of Artificial Sequence: Synthetic oligonucleotide
gcccagggccacctaaggagcg

SEQ ID NO: 200213 - DNA, 23 bp, Artificial Sequence
  Description of Artificial Sequence: Synthetic oligonucleotide
cccagggccacctaaggagcgga

SEQ ID NO: 200214 - DNA, 23 bp, Artificial Sequence
  Description of Artificial Sequence: Synthetic oligonucleotide
ccagggccacctaaggagcggac

SEQ ID NO: 200215 - DNA, 23 bp, Artificial Sequence
  Description of Artificial Sequence: Synthetic oligonucleotide
cagggccacctaaggagcggacc

SEQ ID NO: 200216 - DNA, 23 bp, Artificial Sequence
  Description of Artificial Sequence: Synthetic oligonucleotide
agggccacctaaggagcggaccc

SEQ ID NO: 200217 - DNA, 22 bp, Artificial Sequence
  Description of Artificial Sequence: Synthetic oligonucleotide
gggccacctaaggagcggaccc

SEQ ID NO: 200218 - DNA, 22 bp, Artificial Sequence
  Description of Artificial Sequence: Synthetic oligonucleotide
ggccacctaaggagcggacccc

SEQ ID NO: 200219 - DNA, 22 bp, Artificial Sequence
  Description of Artificial Sequence: Synthetic oligonucleotide
gccacctaaggagcggaccccg

SEQ ID NO: 200220 - DNA, 24 bp, Artificial Sequence
  Description of Artificial Sequence: Synthetic oligonucleotide
ccacctaaggagcggaccccgcat

SEQ ID NO: 200221 - DNA, 26 bp, Artificial Sequence
  Description of Artificial Sequence: Synthetic oligonucleotide
cacctaaggagcggaccccgcatctt

SEQ ID NO: 200222 - DNA, 26 bp, Artificial Sequence
  Description of Artificial Sequence: Synthetic oligonucleotide
acctaaggagcggaccccgcatcttc

SEQ ID NO: 200223 - DNA, 25 bp, Artificial Sequence
  Description of Artificial Sequence: Synthetic oligonucleotide
cctaaggagcggaccccgcatcttc

SEQ ID NO: 200224 - DNA, 25 bp, Artificial Sequence
  Description of Artificial Sequence: Synthetic oligonucleotide
ctaaggagcggaccccgcatcttcg

SEQ ID NO: 200225 - DNA, 25 bp, Artificial Sequence
  Description of Artificial Sequence: Synthetic oligonucleotide
taaggagcggaccccgcatcttcgc

SEQ ID NO: 200226 - DNA, 24 bp, Artificial Sequence
  Description of Artificial Sequence: Synthetic oligonucleotide
aaggagcggaccccgcatcttcgc

SEQ ID NO: 200227 - DNA, 23 bp, Artificial Sequence
  Description of Artificial Sequence: Synthetic oligonucleotide
aggagcggaccccgcatcttcgc

SEQ ID NO: 200228 - DNA, 22 bp, Artificial Sequence
  Description of Artificial Sequence: Synthetic oligonucleotide
ggagcggaccccgcatcttcgc

SEQ ID NO: 200229 - DNA, 22 bp, Artificial Sequence
  Description of Artificial Sequence: Synthetic oligonucleotide
gagcggaccccgcatcttcgcc

SEQ ID NO: 200230 - DNA, 23 bp, Artificial Sequence
  Description of Artificial Sequence: Synthetic oligonucleotide
agcggaccccgcatcttcgccgt

SEQ ID NO: 200231 - DNA, 22 bp, Artificial Sequence
  Description of Artificial Sequence: Synthetic oligonucleotide
gcggaccccgcatcttcgccgt

SEQ ID NO: 200232 - DNA, 23 bp, Artificial Sequence
  Description of Artificial Sequence: Synthetic oligonucleotide
cggaccccgcatcttcgccgtct

SEQ ID NO: 200233 - DNA, 23 bp, Artificial Sequence
  Description of Artificial Sequence: Synthetic oligonucleotide
ggaccccgcatcttcgccgtctg

SEQ ID NO: 200234 - DNA, 26 bp, Artificial Sequence
  Description of Artificial Sequence: Synthetic oligonucleotide
gaccccgcatcttcgccgtctggaaa

SEQ ID NO: 200235 - DNA, 26 bp, Artificial Sequence
  Description of Artificial Sequence: Synthetic oligonucleotide
accccgcatcttcgccgtctggaaag

SEQ ID NO: 200236 - DNA, 25 bp, Artificial Sequence
  Description of Artificial Sequence: Synthetic oligonucleotide
ccccgcatcttcgccgtctggaaag

SEQ ID NO: 200237 - DNA, 25 bp, Artificial Sequence
  Description of Artificial Sequence: Synthetic oligonucleotide
cccgcatcttcgccgtctggaaagg

SEQ ID NO: 200238 - DNA, 25 bp, Artificial Sequence
  Description of Artificial Sequence: Synthetic oligonucleotide
ccgcatcttcgccgtctggaaaggc

SEQ ID NO: 200239 - DNA, 27 bp, Artificial Sequence
  Description of Artificial Sequence: Synthetic oligonucleotide
cgcatcttcgccgtctggaaaggccat

SEQ ID NO: 200240 - DNA, 27 bp, Artificial Sequence
  Description of Artificial Sequence: Synthetic oligonucleotide
gcatcttcgccgtctggaaaggccatg

SEQ ID NO: 200241 - DNA, 29 bp, Artificial Sequence
  Description of Artificial Sequence: Synthetic oligonucleotide
catcttcgccgtctggaaaggccatgtag

SEQ ID NO: 200242 - DNA, 29 bp, Artificial Sequence
  Description of Artificial Sequence: Synthetic oligonucleotide
atcttcgccgtctggaaaggccatgtagg

SEQ ID NO: 200243 - DNA, 28 bp, Artificial Sequence
  Description of Artificial Sequence: Synthetic oligonucleotide
tcttcgccgtctggaaaggccatgtagg

SEQ ID NO: 200244 - DNA, 27 bp, Artificial Sequence
  Description of Artificial Sequence: Synthetic oligonucleotide
cttcgccgtctggaaaggccatgtagg

SEQ ID NO: 200245 - DNA, 27 bp, Artificial Sequence
  Description of Artificial Sequence: Synthetic oligonucleotide
ttcgccgtctggaaaggccatgtaggg

SEQ ID NO: 200246 - DNA, 26 bp, Artificial Sequence
  Description of Artificial Sequence: Synthetic oligonucleotide
tcgccgtctggaaaggccatgtaggg

SEQ ID NO: 200247 - DNA, 25 bp, Artificial Sequence
  Description of Artificial Sequence: Synthetic oligonucleotide
cgccgtctggaaaggccatgtaggg

SEQ ID NO: 200248 - DNA, 26 bp, Artificial Sequence
  Description of Artificial Sequence: Synthetic oligonucleotide
gccgtctggaaaggccatgtagggca

SEQ ID NO: 200249 - DNA, 26 bp, Artificial Sequence
  Description of Artificial Sequence: Synthetic oligonucleotide
ccgtctggaaaggccatgtagggcag

SEQ ID NO: 200250 - DNA, 27 bp, Artificial Sequence
  Description of Artificial Sequence: Synthetic oligonucleotide
cgtctggaaaggccatgtagggcagga

SEQ ID NO: 200251 - DNA, 27 bp, Artificial Sequence
  Description of Artificial Sequence: Synthetic oligonucleotide
gtctggaaaggccatgtagggcaggac

SEQ ID NO: 200252 - DNA, 27 bp, Artificial Sequence
  Description of Artificial Sequence: Synthetic oligonucleotide
tctggaaaggccatgtagggcaggacc

SEQ ID NO: 200253 - DNA, 26 bp, Artificial Sequence
  Description of Artificial Sequence: Synthetic oligonucleotide
ctggaaaggccatgtagggcaggacc

SEQ ID NO: 200254 - DNA, 26 bp, Artificial Sequence
  Description of Artificial Sequence: Synthetic oligonucleotide
tggaaaggccatgtagggcaggaccg

SEQ ID NO: 200255 - DNA, 25 bp, Artificial Sequence
  Description of Artificial Sequence: Synthetic oligonucleotide
ggaaaggccatgtagggcaggaccg

SEQ ID NO: 200256 - DNA, 25 bp, Artificial Sequence
  Description of Artificial Sequence: Synthetic oligonucleotide
gaaaggccatgtagggcaggaccgg

SEQ ID NO: 200257 - DNA, 26 bp, Artificial Sequence
  Description of Artificial Sequence: Synthetic oligonucleotide
aaaggccatgtagggcaggaccgggt

SEQ ID NO: 200258 - DNA, 25 bp, Artificial Sequence
  Description of Artificial Sequence: Synthetic oligonucleotide
aaggccatgtagggcaggaccgggt

SEQ ID NO: 200259 - DNA, 24 bp, Artificial Sequence
  Description of Artificial Sequence: Synthetic oligonucleotide
aggccatgtagggcaggaccgggt

SEQ ID NO: 200260 - DNA, 23 bp, Artificial Sequence
  Description of Artificial Sequence: Synthetic oligonucleotide
ggccatgtagggcaggaccgggt

SEQ ID NO: 200261 - DNA, 23 bp, Artificial Sequence
  Description of Artificial Sequence: Synthetic oligonucleotide
gccatgtagggcaggaccgggtg

SEQ ID NO: 200262 - DNA, 24 bp, Artificial Sequence
  Description of Artificial Sequence: Synthetic oligonucleotide
ccatgtagggcaggaccgggtgga

SEQ ID NO: 200263 - DNA, 27 bp, Artificial Sequence
  Description of Artificial Sequence: Synthetic oligonucleotide
catgtagggcaggaccgggtggacttt

SEQ ID NO: 200264 - DNA, 27 bp, Artificial Sequence
  Description of Artificial Sequence: Synthetic oligonucleotide
atgtagggcaggaccgggtggactttg

SEQ ID NO: 200265 - DNA, 26 bp, Artificial Sequence
  Description of Artificial Sequence: Synthetic oligonucleotide
tgtagggcaggaccgggtggactttg

SEQ ID NO: 200266 - DNA, 25 bp, Artificial Sequence
  Description of Artificial Sequence: Synthetic oligonucleotide
gtagggcaggaccgggtggactttg

SEQ ID NO: 200267 - DNA, 25 bp, Artificial Sequence
  Description of Artificial Sequence: Synthetic oligonucleotide
tagggcaggaccgggtggactttgg

SEQ ID NO: 200268 - DNA, 24 bp, Artificial Sequence
  Description of Artificial Sequence: Synthetic oligonucleotide
agggcaggaccgggtggactttgg

SEQ ID NO: 200269 - DNA, 23 bp, Artificial Sequence
  Description of Artificial Sequence: Synthetic oligonucleotide
gggcaggaccgggtggactttgg

SEQ ID NO: 200270 - DNA, 23 bp, Artificial Sequence
  Description of Artificial Sequence: Synthetic oligonucleotide
ggcaggaccgggtggactttggc

SEQ ID NO: 200271 - DNA, 24 bp, Artificial Sequence
  Description of Artificial Sequence: Synthetic oligonucleotide
gcaggaccgggtggactttggcca

SEQ ID NO: 200272 - DNA, 25 bp, Artificial Sequence
  Description of Artificial Sequence: Synthetic oligonucleotide
caggaccgggtggactttggccaga

SEQ ID NO: 200273 - DNA, 26 bp, Artificial Sequence
  Description of Artificial Sequence: Synthetic oligonucleotide
aggaccgggtggactttggccagact

SEQ ID NO: 200274 - DNA, 25 bp, Artificial Sequence
  Description of Artificial Sequence: Synthetic oligonucleotide
ggaccgggtggactttggccagact

SEQ ID NO: 200275 - DNA, 26 bp, Artificial Sequence
  Description of Artificial Sequence: Synthetic oligonucleotide
gaccgggtggactttggccagactga

SEQ ID NO: 200276 - DNA, 26 bp, Artificial Sequence
  Description of Artificial Sequence: Synthetic oligonucleotide
accgggtggactttggccagactgag

SEQ ID NO: 200277 - DNA, 25 bp, Artificial Sequence
  Description of Artificial Sequence: Synthetic oligonucleotide
ccgggtggactttggccagactgag

SEQ ID NO: 200278 - DNA, 25 bp, Artificial Sequence
  Description of Artificial Sequence: Synthetic oligonucleotide
cgggtggactttggccagactgagc

SEQ ID NO: 200279 - DNA, 25 bp, Artificial Sequence
  Description of Artificial Sequence: Synthetic oligonucleotide
gggtggactttggccagactgagcc

SEQ ID NO: 200280 - DNA, 25 bp, Artificial Sequence
  Description of Artificial Sequence: Synthetic oligonucleotide
ggtggactttggccagactgagccg

SEQ ID NO: 200281 - DNA, 26 bp, Artificial Sequence
  Description of Artificial Sequence: Synthetic oligonucleotide
gtggactttggccagactgagccgca

SEQ ID NO: 200282 - DNA, 27 bp, Artificial Sequence
  Description of Artificial Sequence: Synthetic oligonucleotide
tggactttggccagactgagccgcaca

SEQ ID NO: 200283 - DNA, 26 bp, Artificial Sequence
  Description of Artificial Sequence: Synthetic oligonucleotide
ggactttggccagactgagccgcaca

SEQ ID NO: 200284 - DNA, 26 bp, Artificial Sequence
  Description of Artificial Sequence: Synthetic oligonucleotide
gactttggccagactgagccgcacac

SEQ ID NO: 200285 - DNA, 26 bp, Artificial Sequence
  Description of Artificial Sequence: Synthetic oligonucleotide
actttggccagactgagccgcacacg

SEQ ID NO: 200286 - DNA, 25 bp, Artificial Sequence
  Description of Artificial Sequence: Synthetic oligonucleotide
ctttggccagactgagccgcacacg

SEQ ID NO: 200287 - DNA, 26 bp, Artificial Sequence
  Description of Artificial Sequence: Synthetic oligonucleotide
tttggccagactgagccgcacacggt

SEQ ID NO: 200288 - DNA, 25 bp, Artificial Sequence
  Description of Artificial Sequence: Synthetic oligonucleotide
ttggccagactgagccgcacacggt

SEQ ID NO: 200289 - DNA, 24 bp, Artificial Sequence
  Description of Artificial Sequence: Synthetic oligonucleotide
tggccagactgagccgcacacggt

SEQ ID NO: 200290 - DNA, 23 bp, Artificial Sequence
  Description of Artificial Sequence: Synthetic oligonucleotide
ggccagactgagccgcacacggt

SEQ ID NO: 200291 - DNA, 23 bp, Artificial Sequence
  Description of Artificial Sequence: Synthetic oligonucleotide
gccagactgagccgcacacggtg

SEQ ID NO: 200292 - DNA, 27 bp, Artificial Sequence
  Description of Artificial Sequence: Synthetic oligonucleotide
ccagactgagccgcacacggtgctttt

SEQ ID NO: 200293 - DNA, 27 bp, Artificial Sequence
  Description of Artificial Sequence: Synthetic oligonucleotide
cagactgagccgcacacggtgcttttc

SEQ ID NO: 200294 - DNA, 27 bp, Artificial Sequence
  Description of Artificial Sequence: Synthetic oligonucleotide
agactgagccgcacacggtgcttttcc

SEQ ID NO: 200295 - DNA, 27 bp, Artificial Sequence
  Description of Artificial Sequence: Synthetic oligonucleotide
gactgagccgcacacggtgcttttcca

SEQ ID NO: 200296 - DNA, 27 bp, Artificial Sequence
  Description of Artificial Sequence: Synthetic oligonucleotide
actgagccgcacacggtgcttttccac

SEQ ID NO: 200297 - DNA, 26 bp, Artificial Sequence
  Description of Artificial Sequence: Synthetic oligonucleotide
ctgagccgcacacggtgcttttccac

SEQ ID NO: 200298 - DNA, 27 bp, Artificial Sequence
  Description of Artificial Sequence: Synthetic oligonucleotide
tgagccgcacacggtgcttttccacga

SEQ ID NO: 200299 - DNA, 26 bp, Artificial Sequence
  Description of Artificial Sequence: Synthetic oligonucleotide
gagccgcacacggtgcttttccacga

SEQ ID NO: 200300 - DNA, 26 bp, Artificial Sequence
  Description of Artificial Sequence: Synthetic oligonucleotide
agccgcacacggtgcttttccacgag

SEQ ID NO: 200301 - DNA, 25 bp, Artificial Sequence
  Description of Artificial Sequence: Synthetic oligonucleotide
gccgcacacggtgcttttccacgag

SEQ ID NO: 200302 - DNA, 25 bp, Artificial Sequence
  Description of Artificial Sequence: Synthetic oligonucleotide
ccgcacacggtgcttttccacgagc

SEQ ID NO: 200303 - DNA, 26 bp, Artificial Sequence
  Description of Artificial Sequence: Synthetic oligonucleotide
cgcacacggtgcttttccacgagcca

SEQ ID NO: 200304 - DNA, 26 bp, Artificial Sequence
  Description of Artificial Sequence: Synthetic oligonucleotide
gcacacggtgcttttccacgagccag

SEQ ID NO: 200305 - DNA, 26 bp, Artificial Sequence
  Description of Artificial Sequence: Synthetic oligonucleotide
cacacggtgcttttccacgagccagg

SEQ ID NO: 200306 - DNA, 27 bp, Artificial Sequence
  Description of Artificial Sequence: Synthetic oligonucleotide
acacggtgcttttccacgagccaggca

SEQ ID NO: 200307 - DNA, 26 bp, Artificial Sequence
  Description of Artificial Sequence: Synthetic oligonucleotide
cacggtgcttttccacgagccaggca

SEQ ID NO: 200308 - DNA, 26 bp, Artificial Sequence
  Description of Artificial Sequence: Synthetic oligonucleotide
acggtgcttttccacgagccaggcag

SEQ ID NO: 200309 - DNA, 25 bp, Artificial Sequence
  Description of Artificial Sequence: Synthetic oligonucleotide
cggtgcttttccacgagccaggcag

SEQ ID NO: 200310 - DNA, 26 bp, Artificial Sequence
  Description of Artificial Sequence: Synthetic oligonucleotide
ggtgcttttccacgagccaggcagct

SEQ ID NO: 200311 - DNA, 26 bp, Artificial Sequence
  Description of Artificial Sequence: Synthetic oligonucleotide
gtgcttttccacgagccaggcagctc

SEQ ID NO: 200312 - DNA, 27 bp, Artificial Sequence
  Description of Artificial Sequence: Synthetic oligonucleotide
tgcttttccacgagccaggcagctcct

SEQ ID NO: 200313 - DNA, 26 bp, Artificial Sequence
  Description of Artificial Sequence: Synthetic oligonucleotide
gcttttccacgagccaggcagctcct

SEQ ID NO: 200314 - DNA, 27 bp, Artificial Sequence
  Description of Artificial Sequence: Synthetic oligonucleotide
cttttccacgagccaggcagctcctct

SEQ ID NO: 200315 - DNA, 27 bp, Artificial Sequence
  Description of Artificial Sequence: Synthetic oligonucleotide
ttttccacgagccaggcagctcctctg

SEQ ID NO: 200316 - DNA, 27 bp, Artificial Sequence
  Description of Artificial Sequence: Synthetic oligonucleotide
tttccacgagccaggcagctcctctgt

SEQ ID NO: 200317 - DNA, 26 bp, Artificial Sequence
  Description of Artificial Sequence: Synthetic oligonucleotide
ttccacgagccaggcagctcctctgt

SEQ ID NO: 200318 - DNA, 25 bp, Artificial Sequence
  Description of Artificial Sequence: Synthetic oligonucleotide
tccacgagccaggcagctcctctgt

SEQ ID NO: 200319 - DNA, 24 bp, Artificial Sequence
  Description of Artificial Sequence: Synthetic oligonucleotide
ccacgagccaggcagctcctctgt

SEQ ID NO: 200320 - DNA, 25 bp, Artificial Sequence
  Description of Artificial Sequence: Synthetic oligonucleotide
cacgagccaggcagctcctctgtgt

SEQ ID NO: 200321 - DNA, 25 bp, Artificial Sequence
  Description of Artificial Sequence: Synthetic oligonucleotide
acgagccaggcagctcctctgtgtg

SEQ ID NO: 200322 - DNA, 24 bp, Artificial Sequence
  Description of Artificial Sequence: Synthetic oligonucleotide
cgagccaggcagctcctctgtgtg

SEQ ID NO: 200323 - DNA, 24 bp, Artificial Sequence
  Description of Artificial Sequence: Synthetic oligonucleotide
gagccaggcagctcctctgtgtgg

SEQ ID NO: 200324 - DNA, 25 bp, Artificial Sequence
  Description of Artificial Sequence: Synthetic oligonucleotide
agccaggcagctcctctgtgtgggt

SEQ ID NO: 200325 - DNA, 24 bp, Artificial Sequence
  Description of Artificial Sequence: Synthetic oligonucleotide
gccaggcagctcctctgtgtgggt

SEQ ID NO: 200326 - DNA, 24 bp, Artificial Sequence
  Description of Artificial Sequence: Synthetic oligonucleotide
ccaggcagctcctctgtgtgggtg

SEQ ID NO: 200327 - DNA, 24 bp, Artificial Sequence
  Description of Artificial Sequence: Synthetic oligonucleotide
caggcagctcctctgtgtgggtgg

SEQ ID NO: 200328 - DNA, 25 bp, Artificial Sequence
  Description of Artificial Sequence: Synthetic oligonucleotide
aggcagctcctctgtgtgggtggga

SEQ ID NO: 200329 - DNA, 24 bp, Artificial Sequence
  Description of Artificial Sequence: Synthetic oligonucleotide
ggcagctcctctgtgtgggtggga

SEQ ID NO: 200330 - DNA, 24 bp, Artificial Sequence
  Description of Artificial Sequence: Synthetic oligonucleotide
gcagctcctctgtgtgggtgggag

SEQ ID NO: 200331 - DNA, 25 bp, Artificial Sequence
  Description of Artificial Sequence: Synthetic oligonucleotide
cagctcctctgtgtgggtgggagga

SEQ ID NO: 200332 - DNA, 25 bp, Artificial Sequence
  Description of Artificial Sequence: Synthetic oligonucleotide
agctcctctgtgtgggtgggaggac

SEQ ID NO: 200333 - DNA, 24 bp, Artificial Sequence
  Description of Artificial Sequence: Synthetic oligonucleotide
gctcctctgtgtgggtgggaggac

SEQ ID NO: 200334 - DNA, 25 bp, Artificial Sequence
  Description of Artificial Sequence: Synthetic oligonucleotide
ctcctctgtgtgggtgggaggacgt

SEQ ID NO: 200335 - DNA, 25 bp, Artificial Sequence
  Description of Artificial Sequence: Synthetic oligonucleotide
tcctctgtgtgggtgggaggacgtg

SEQ ID NO: 200336 - DNA, 24 bp, Artificial Sequence
  Description of Artificial Sequence: Synthetic oligonucleotide
cctctgtgtgggtgggaggacgtg

SEQ ID NO: 200337 - DNA, 24 bp, Artificial Sequence
  Description of Artificial Sequence: Synthetic oligonucleotide
ctctgtgtgggtgggaggacgtgg

SEQ ID NO: 200338 - DNA, 26 bp, Artificial Sequence
  Description of Artificial Sequence: Synthetic oligonucleotide
tctgtgtgggtgggaggacgtggcaa

SEQ ID NO: 200339 - DNA, 25 bp, Artificial Sequence
  Description of Artificial Sequence: Synthetic oligonucleotide
ctgtgtgggtgggaggacgtggcaa

SEQ ID NO: 200340 - DNA, 25 bp, Artificial Sequence
  Description of Artificial Sequence: Synthetic oligonucleotide
tgtgtgggtgggaggacgtggcaag

SEQ ID NO: 200341 - DNA, 24 bp, Artificial Sequence
  Description of Artificial Sequence: Synthetic oligonucleotide
gtgtgggtgggaggacgtggcaag

SEQ ID NO: 200342 - DNA, 25 bp, Artificial Sequence
  Description of Artificial Sequence: Synthetic oligonucleotide
tgtgggtgggaggacgtggcaaggt

SEQ ID NO: 200343 - DNA, 24 bp, Artificial Sequence
  Description of Artificial Sequence: Synthetic oligonucleotide
gtgggtgggaggacgtggcaaggt

SEQ ID NO: 200344 - DNA, 26 bp, Artificial Sequence
  Description of Artificial Sequence: Synthetic oligonucleotide
tgggtgggaggacgtggcaaggtcta

SEQ ID NO: 200345 - DNA, 25 bp, Artificial Sequence
  Description of Artificial Sequence: Synthetic oligonucleotide
gggtgggaggacgtggcaaggtcta

SEQ ID NO: 200346 - DNA, 25 bp, Artificial Sequence
  Description of Artificial Sequence: Synthetic oligonucleotide
ggtgggaggacgtggcaaggtctac

SEQ ID NO: 200347 - DNA, 26 bp, Artificial Sequence
  Description of Artificial Sequence: Synthetic oligonucleotide
gtgggaggacgtggcaaggtctacct

SEQ ID NO: 200348 - DNA, 27 bp, Artificial Sequence
  Description of Artificial Sequence: Synthetic oligonucleotide
tgggaggacgtggcaaggtctacctct

SEQ ID NO: 200349 - DNA, 27 bp, Artificial Sequence
  Description of Artificial Sequence: Synthetic oligonucleotide
gggaggacgtggcaaggtctacctctt

SEQ ID NO: 200350 - DNA, 28 bp, Artificial Sequence
  Description of Artificial Sequence: Synthetic oligonucleotide
ggaggacgtggcaaggtctacctctttg

SEQ ID NO: 200351 - DNA, 29 bp, Artificial Sequence
  Description of Artificial Sequence: Synthetic oligonucleotide
gaggacgtggcaaggtctacctctttgac

SEQ ID NO: 200352 - DNA, 31 bp, Artificial Sequence
  Description of Artificial Sequence: Synthetic oligonucleotide
aggacgtggcaaggtctacctctttgacttc

SEQ ID NO: 200353 - DNA, 30 bp, Artificial Sequence
  Description of Artificial Sequence: Synthetic oligonucleotide
ggacgtggcaaggtctacctctttgacttc

SEQ ID NO: 200354 - DNA, 30 bp, Artificial Sequence
  Description of Artificial Sequence: Synthetic oligonucleotide
gacgtggcaaggtctacctctttgacttcc

SEQ ID NO: 200355 - DNA, 30 bp, Artificial Sequence
  Description of Artificial Sequence: Synthetic oligonucleotide
acgtggcaaggtctacctctttgacttccc

SEQ ID NO: 200356 - DNA, 29 bp, Artificial Sequence
  Description of Artificial Sequence: Synthetic oligonucleotide
cgtggcaaggtctacctctttgacttccc

SEQ ID NO: 200357 - DNA, 29 bp, Artificial Sequence
  Description of Artificial Sequence: Synthetic oligonucleotide
gtggcaaggtctacctctttgacttcccc

SEQ ID NO: 200358 - DNA, 29 bp, Artificial Sequence
  Description of Artificial Sequence: Synthetic oligonucleotide
tggcaaggtctacctctttgacttccccg

SEQ ID NO: 200359 - DNA, 28 bp, Artificial Sequence
  Description of Artificial Sequence: Synthetic oligonucleotide
ggcaaggtctacctctttgacttccccg

SEQ ID NO: 200360 - DNA, 29 bp, Artificial Sequence
  Description of Artificial Sequence: Synthetic oligonucleotide
gcaaggtctacctctttgacttccccgag

SEQ ID NO: 200361 - DNA, 29 bp, Artificial Sequence
  Description of Artificial Sequence: Synthetic oligonucleotide
caaggtctacctctttgacttccccgagg

SEQ ID NO: 200362 - DNA, 29 bp, Artificial Sequence
  Description of Artificial Sequence: Synthetic oligonucleotide
aaggtctacctctttgacttccccgaggg

SEQ ID NO: 200363 - DNA, 28 bp, Artificial Sequence
  Description of Artificial Sequence: Synthetic oligonucleotide
aggtctacctctttgacttccccgaggg

SEQ ID NO: 200364 - DNA, 27 bp, Artificial Sequence
  Description of Artificial Sequence: Synthetic oligonucleotide
ggtctacctctttgacttccccgaggg

SEQ ID NO: 200365 - DNA, 27 bp, Artificial Sequence
  Description of Artificial Sequence: Synthetic oligonucleotide
gtctacctctttgacttccccgagggc

SEQ ID NO: 200366 - DNA, 29 bp, Artificial Sequence
  Description of Artificial Sequence: Synthetic oligonucleotide
tctacctctttgacttccccgagggcaag

SEQ ID NO: 200367 - DNA, 28 bp, Artificial Sequence
  Description of Artificial Sequence: Synthetic oligonucleotide
ctacctctttgacttccccgagggcaag

SEQ ID NO: 200368 - DNA, 30 bp, Artificial Sequence
  Description of Artificial Sequence: Synthetic oligonucleotide
tacctctttgacttccccgagggcaagaac

SEQ ID NO: 200369 - DNA, 29 bp, Artificial Sequence
  Description of Artificial Sequence: Synthetic oligonucleotide
acctctttgacttccccgagggcaagaac

SEQ ID NO: 200370 - DNA, 28 bp, Artificial Sequence
  Description of Artificial Sequence: Synthetic oligonucleotide
cctctttgacttccccgagggcaagaac

SEQ ID NO: 200371 - DNA, 28 bp, Artificial Sequence
  Description of Artificial Sequence: Synthetic oligonucleotide
ctctttgacttccccgagggcaagaacg

SEQ ID NO: 200372 - DNA, 28 bp, Artificial Sequence
  Description of Artificial Sequence: Synthetic oligonucleotide
tctttgacttccccgagggcaagaacgc

SEQ ID NO: 200373 - DNA, 27 bp, Artificial Sequence
  Description of Artificial Sequence: Synthetic oligonucleotide
ctttgacttccccgagggcaagaacgc

SEQ ID NO: 200374 - DNA, 29 bp, Artificial Sequence
  Description of Artificial Sequence: Synthetic oligonucleotide
tttgacttccccgagggcaagaacgcatc

SEQ ID NO: 200375 - DNA, 28 bp, Artificial Sequence
  Description of Artificial Sequence: Synthetic oligonucleotide
ttgacttccccgagggcaagaacgcatc

SEQ ID NO: 200376 - DNA, 27 bp, Artificial Sequence
  Description of Artificial Sequence: Synthetic oligonucleotide
tgacttccccgagggcaagaacgcatc

SEQ ID NO: 200377 - DNA, 27 bp, Artificial Sequence
  Description of Artificial Sequence: Synthetic oligonucleotide
gacttccccgagggcaagaacgcatct

SEQ ID NO: 200378 - DNA, 27 bp, Artificial Sequence
  Description of Artificial Sequence: Synthetic oligonucleotide
acttccccgagggcaagaacgcatctg

SEQ ID NO: 200379 - DNA, 27 bp, Artificial Sequence
  Description of Artificial Sequence: Synthetic oligonucleotide
cttccccgagggcaagaacgcatctgt

SEQ ID NO: 200380 - DNA, 27 bp, Artificial Sequence
  Description of Artificial Sequence: Synthetic oligonucleotide
ttccccgagggcaagaacgcatctgtg

SEQ ID NO: 200381 - DNA, 26 bp, Artificial Sequence
  Description of Artificial Sequence: Synthetic oligonucleotide
tccccgagggcaagaacgcatctgtg

SEQ ID NO: 200382 - DNA, 25 bp, Artificial Sequence
  Description of Artificial Sequence: Synthetic oligonucleotide
ccccgagggcaagaacgcatctgtg

SEQ ID NO: 200383 - DNA, 25 bp, Artificial Sequence
  Description of Artificial Sequence: Synthetic oligonucleotide
cccgagggcaagaacgcatctgtgc

SEQ ID NO: 200384 - DNA, 25 bp, Artificial Sequence
  Description of Artificial Sequence: Synthetic oligonucleotide
ccgagggcaagaacgcatctgtgcg

SEQ ID NO: 200385 - DNA, 26 bp, Artificial Sequence
  Description of Artificial Sequence: Synthetic oligonucleotide
cgagggcaagaacgcatctgtgcgca

SEQ ID NO: 200386 - DNA, 26 bp, Artificial Sequence
  Description of Artificial Sequence: Synthetic oligonucleotide
gagggcaagaacgcatctgtgcgcac

SEQ ID NO: 200387 - DNA, 26 bp, Artificial Sequence
  Description of Artificial Sequence: Synthetic oligonucleotide
agggcaagaacgcatctgtgcgcacg

SEQ ID NO: 200388 - DNA, 25 bp, Artificial Sequence
  Description of Artificial Sequence: Synthetic oligonucleotide
gggcaagaacgcatctgtgcgcacg

SEQ ID NO: 200389 - DNA, 26 bp, Artificial Sequence
  Description of Artificial Sequence: Synthetic oligonucleotide
ggcaagaacgcatctgtgcgcacggt

SEQ ID NO: 200390 - DNA, 27 bp, Artificial Sequence
  Description of Artificial Sequence: Synthetic oligonucleotide
gcaagaacgcatctgtgcgcacggtga

SEQ ID NO: 200391 - DNA, 31 bp, Artificial Sequence
  Description of Artificial Sequence: Synthetic oligonucleotide
caagaacgcatctgtgcgcacggtgaatatc

SEQ ID NO: 200392 - DNA, 31 bp, Artificial Sequence
  Description of Artificial Sequence: Synthetic oligonucleotide
aagaacgcatctgtgcgcacggtgaatatcg

SEQ ID NO: 200393 - DNA, 30 bp, Artificial Sequence
  Description of Artificial Sequence: Synthetic oligonucleotide
agaacgcatctgtgcgcacggtgaatatcg

SEQ ID NO: 200394 - DNA, 29 bp, Artificial Sequence
  Description of Artificial Sequence: Synthetic oligonucleotide
gaacgcatctgtgcgcacggtgaatatcg

SEQ ID NO: 200395 - DNA, 29 bp, Artificial Sequence
  Description of Artificial Sequence: Synthetic oligonucleotide
aacgcatctgtgcgcacggtgaatatcgg

SEQ ID NO: 200396 - DNA, 28 bp, Artificial Sequence
  Description of Artificial Sequence: Synthetic oligonucleotide
acgcatctgtgcgcacggtgaatatcgg

SEQ ID NO: 200397 - DNA, 27 bp, Artificial Sequence
  Description of Artificial Sequence: Synthetic oligonucleotide
cgcatctgtgcgcacggtgaatatcgg

SEQ ID NO: 200398 - DNA, 27 bp, Artificial Sequence
  Description of Artificial Sequence: Synthetic oligonucleotide
gcatctgtgcgcacggtgaatatcggc

SEQ ID NO: 200399 - DNA, 28 bp, Artificial Sequence
  Description of Artificial Sequence: Synthetic oligonucleotide
catctgtgcgcacggtgaatatcggctc

SEQ ID NO: 200400 - DNA, 28 bp, Artificial Sequence
  Description of Artificial Sequence: Synthetic oligonucleotide
atctgtgcgcacggtgaatatcggctcc

SEQ ID NO: 200401 - DNA, 27 bp, Artificial Sequence
  Description of Artificial Sequence: Synthetic oligonucleotide
tctgtgcgcacggtgaatatcggctcc

SEQ ID NO: 200402 - DNA, 27 bp, Artificial Sequence
  Description of Artificial Sequence: Synthetic oligonucleotide
ctgtgcgcacggtgaatatcggctcca

SEQ ID NO: 200403 - DNA, 27 bp, Artificial Sequence
  Description of Artificial Sequence: Synthetic oligonucleotide
tgtgcgcacggtgaatatcggctccac

SEQ ID NO: 200404 - DNA, 27 bp, Artificial Sequence
  Description of Artificial Sequence: Synthetic oligonucleotide
gtgcgcacggtgaatatcggctccaca

SEQ ID NO: 200405 - DNA, 29 bp, Artificial Sequence
  Description of Artificial Sequence: Synthetic oligonucleotide
tgcgcacggtgaatatcggctccacaaag

SEQ ID NO: 200406 - DNA, 28 bp, Artificial Sequence
  Description of Artificial Sequence: Synthetic oligonucleotide
gcgcacggtgaatatcggctccacaaag

SEQ ID NO: 200407 - DNA, 28 bp, Artificial Sequence
  Description of Artificial Sequence: Synthetic oligonucleotide
cgcacggtgaatatcggctccacaaagg

SEQ ID NO: 200408 - DNA, 28 bp, Artificial Sequence
  Description of Artificial Sequence: Synthetic oligonucleotide
gcacggtgaatatcggctccacaaaggg

SEQ ID NO: 200409 - DNA, 28 bp, Artificial Sequence
  Description of Artificial Sequence: Synthetic oligonucleotide
cacggtgaatatcggctccacaaagggg

SEQ ID NO: 200410 - DNA, 29 bp, Artificial Sequence
  Description of Artificial Sequence: Synthetic oligonucleotide
acggtgaatatcggctccacaaaggggtc

SEQ ID NO: 200411 - DNA, 28 bp, Artificial Sequence
  Description of Artificial Sequence: Synthetic oligonucleotide
cggtgaatatcggctccacaaaggggtc

SEQ ID NO: 200412 - DNA, 28 bp, Artificial Sequence
  Description of Artificial Sequence: Synthetic oligonucleotide
ggtgaatatcggctccacaaaggggtcc

SEQ ID NO: 200413 - DNA, 29 bp, Artificial Sequence
  Description of Artificial Sequence: Synthetic oligonucleotide
gtgaatatcggctccacaaaggggtcctg

SEQ ID NO: 200414 - DNA, 30 bp, Artificial Sequence
  Description of Artificial Sequence: Synthetic oligonucleotide
tgaatatcggctccacaaaggggtcctgtc

SEQ ID NO: 200415 - DNA, 29 bp, Artificial Sequence
  Description of Artificial Sequence: Synthetic oligonucleotide
gaatatcggctccacaaaggggtcctgtc

SEQ ID NO: 200416 - DNA, 30 bp, Artificial Sequence
  Description of Artificial Sequence: Synthetic oligonucleotide
aatatcggctccacaaaggggtcctgtctg

SEQ ID NO: 200417 - DNA, 29 bp, Artificial Sequence
  Description of Artificial Sequence: Synthetic oligonucleotide
atatcggctccacaaaggggtcctgtctg

SEQ ID NO: 200418 - DNA, 28 bp, Artificial Sequence
  Description of Artificial Sequence: Synthetic oligonucleotide
tatcggctccacaaaggggtcctgtctg

SEQ ID NO: 200419 - DNA, 27 bp, Artificial Sequence
  Description of Artificial Sequence: Synthetic oligonucleotide
atcggctccacaaaggggtcctgtctg

SEQ ID NO: 200420 - DNA, 26 bp, Artificial Sequence
  Description of Artificial Sequence: Synthetic oligonucleotide
tcggctccacaaaggggtcctgtctg

SEQ ID NO: 200421 - DNA, 25 bp, Artificial Sequence
  Description of Artificial Sequence: Synthetic oligonucleotide
cggctccacaaaggggtcctgtctg

SEQ ID NO: 200422 - DNA, 27 bp, Artificial Sequence
  Description of Artificial Sequence: Synthetic oligonucleotide
ggctccacaaaggggtcctgtctggat

SEQ ID NO: 200423 - DNA, 29 bp, Artificial Sequence
  Description of Artificial Sequence: Synthetic oligonucleotide
gctccacaaaggggtcctgtctggataag

SEQ ID NO: 200424 - DNA, 29 bp, Artificial Sequence
  Description of Artificial Sequence: Synthetic oligonucleotide
ctccacaaaggggtcctgtctggataagc

SEQ ID NO: 200425 - DNA, 29 bp, Artificial Sequence
  Description of Artificial Sequence: Synthetic oligonucleotide
tccacaaaggggtcctgtctggataagcg

SEQ ID NO: 200426 - DNA, 28 bp, Artificial Sequence
  Description of Artificial Sequence: Synthetic oligonucleotide
ccacaaaggggtcctgtctggataagcg

SEQ ID NO: 200427 - DNA, 28 bp, Artificial Sequence
  Description of Artificial Sequence: Synthetic oligonucleotide
cacaaaggggtcctgtctggataagcgg

SEQ ID NO: 200428 - DNA, 28 bp, Artificial Sequence
  Description of Artificial Sequence: Synthetic oligonucleotide
acaaaggggtcctgtctggataagcggg

SEQ ID NO: 200429 - DNA, 27 bp, Artificial Sequence
  Description of Artificial Sequence: Synthetic oligonucleotide
caaaggggtcctgtctggataagcggg

SEQ ID NO: 200430 - DNA, 28 bp, Artificial Sequence
  Description of Artificial Sequence: Synthetic oligonucleotide
aaaggggtcctgtctggataagcgggac

SEQ ID NO: 200431 - DNA, 27 bp, Artificial Sequence
  Description of Artificial Sequence: Synthetic oligonucleotide
aaggggtcctgtctggataagcgggac

SEQ ID NO: 200432 - DNA, 27 bp, Artificial Sequence
  Description of Artificial Sequence: Synthetic oligonucleotide
aggggtcctgtctggataagcgggact

SEQ ID NO: 200433 - DNA, 26 bp, Artificial Sequence
  Description of Artificial Sequence: Synthetic oligonucleotide
ggggtcctgtctggataagcgggact

SEQ ID NO: 200434 - DNA, 26 bp, Artificial Sequence
  Description of Artificial Sequence: Synthetic oligonucleotide
gggtcctgtctggataagcgggactg

SEQ ID NO: 200435 - DNA, 26 bp, Artificial Sequence
  Description of Artificial Sequence: Synthetic oligonucleotide
ggtcctgtctggataagcgggactgc

SEQ ID NO: 200436 - DNA, 27 bp, Artificial Sequence
  Description of Artificial Sequence: Synthetic oligonucleotide
gtcctgtctggataagcgggactgcga

SEQ ID NO: 200437 - DNA, 27 bp, Artificial Sequence
  Description of Artificial Sequence: Synthetic oligonucleotide
tcctgtctggataagcgggactgcgag

SEQ ID NO: 200438 - DNA, 27 bp, Artificial Sequence
  Description of Artificial Sequence: Synthetic oligonucleotide
cctgtctggataagcgggactgcgaga

SEQ ID NO: 200439 - DNA, 28 bp, Artificial Sequence
  Description of Artificial Sequence: Synthetic oligonucleotide
ctgtctggataagcgggactgcgagaac

SEQ ID NO: 200440 - DNA, 30 bp, Artificial Sequence
  Description of Artificial Sequence: Synthetic oligonucleotide
tgtctggataagcgggactgcgagaactac

SEQ ID NO: 200441 - DNA, 29 bp, Artificial Sequence
  Description of Artificial Sequence: Synthetic oligonucleotide
gtctggataagcgggactgcgagaactac

SEQ ID NO: 200442 - DNA, 31 bp, Artificial Sequence
  Description of Artificial Sequence: Synthetic oligonucleotide
tctggataagcgggactgcgagaactacatc

SEQ ID NO: 200443 - DNA, 30 bp, Artificial Sequence
  Description of Artificial Sequence: Synthetic oligonucleotide
ctggataagcgggactgcgagaactacatc

SEQ ID NO: 200444 - DNA, 31 bp, Artificial Sequence
  Description of Artificial Sequence: Synthetic oligonucleotide
tggataagcgggactgcgagaactacatcac

SEQ ID NO: 200445 - DNA, 30 bp, Artificial Sequence
  Description of Artificial Sequence: Synthetic oligonucleotide
ggataagcgggactgcgagaactacatcac

SEQ ID NO: 200446 - DNA, 31 bp, Artificial Sequence
  Description of Artificial Sequence: Synthetic oligonucleotide
gataagcgggactgcgagaactacatcactc

SEQ ID NO: 200447 - DNA, 32 bp, Artificial Sequence
  Description of Artificial Sequence: Synthetic oligonucleotide
ataagcgggactgcgagaactacatcactctc

SEQ ID NO: 200448 - DNA, 31 bp, Artificial Sequence
  Description of Artificial Sequence: Synthetic oligonucleotide
taagcgggactgcgagaactacatcactctc

SEQ ID NO: 200449 - DNA, 30 bp, Artificial Sequence
  Description of Artificial Sequence: Synthetic oligonucleotide
aagcgggactgcgagaactacatcactctc

SEQ ID NO: 200450 - DNA, 29 bp, Artificial Sequence
  Description of Artificial Sequence: Synthetic oligonucleotide
agcgggactgcgagaactacatcactctc

SEQ ID NO: 200451 - DNA, 28 bp, Artificial Sequence
  Description of Artificial Sequence: Synthetic oligonucleotide
gcgggactgcgagaactacatcactctc

SEQ ID NO: 200452 - DNA, 28 bp, Artificial Sequence
  Description of Artificial Sequence: Synthetic oligonucleotide
cgggactgcgagaactacatcactctcc

SEQ ID NO: 200453 - DNA, 29 bp, Artificial Sequence
  Description of Artificial Sequence: Synthetic oligonucleotide
gggactgcgagaactacatcactctcctg

SEQ ID NO: 200454 - DNA, 29 bp, Artificial Sequence
  Description of Artificial Sequence: Synthetic oligonucleotide
ggactgcgagaactacatcactctcctgg

SEQ ID NO: 200455 - DNA, 30 bp, Artificial Sequence
  Description of Artificial Sequence: Synthetic oligonucleotide
gactgcgagaactacatcactctcctggag

SEQ ID NO: 200456 - DNA, 31 bp, Artificial Sequence
  Description of Artificial Sequence: Synthetic oligonucleotide
actgcgagaactacatcactctcctggagag

SEQ ID NO: 200457 - DNA, 30 bp, Artificial Sequence
  Description of Artificial Sequence: Synthetic oligonucleotide
ctgcgagaactacatcactctcctggagag

SEQ ID NO: 200458 - DNA, 30 bp, Artificial Sequence
  Description of Artificial Sequence: Synthetic oligonucleotide
tgcgagaactacatcactctcctggagagg

SEQ ID NO: 200459 - DNA, 29 bp, Artificial Sequence
  Description of Artificial Sequence: Synthetic oligonucleotide
gcgagaactacatcactctcctggagagg

SEQ ID NO: 200460 - DNA, 29 bp, Artificial Sequence
  Description of Artificial Sequence: Synthetic oligonucleotide
cgagaactacatcactctcctggagaggc

SEQ ID NO: 200461 - DNA, 29 bp, Artificial Sequence
  Description of Artificial Sequence: Synthetic oligonucleotide
gagaactacatcactctcctggagaggcg

SEQ ID NO: 200462 - DNA, 29 bp, Artificial Sequence
  Description of Artificial Sequence: Synthetic oligonucleotide
agaactacatcactctcctggagaggcgg

SEQ ID NO: 200463 - DNA, 28 bp, Artificial Sequence
  Description of Artificial Sequence: Synthetic oligonucleotide
gaactacatcactctcctggagaggcgg

SEQ ID NO: 200464 - DNA, 29 bp, Artificial Sequence
  Description of Artificial Sequence: Synthetic oligonucleotide
aactacatcactctcctggagaggcggag

SEQ ID NO: 200465 - DNA, 28 bp, Artificial Sequence
  Description of Artificial Sequence: Synthetic oligonucleotide
actacatcactctcctggagaggcggag

SEQ ID NO: 200466 - DNA, 27 bp, Artificial Sequence
  Description of Artificial Sequence: Synthetic oligonucleotide
ctacatcactctcctggagaggcggag

SEQ ID NO: 200467 - DNA, 28 bp, Artificial Sequence
  Description of Artificial Sequence: Synthetic oligonucleotide
tacatcactctcctggagaggcggagtg

SEQ ID NO: 200468 - DNA, 27 bp, Artificial Sequence
  Description of Artificial Sequence: Synthetic oligonucleotide
acatcactctcctggagaggcggagtg

SEQ ID NO: 200469 - DNA, 27 bp, Artificial Sequence
  Description of Artificial Sequence: Synthetic oligonucleotide
catcactctcctggagaggcggagtga

SEQ ID NO: 200470 - DNA, 27 bp, Artificial Sequence
  Description of Artificial Sequence: Synthetic oligonucleotide
atcactctcctggagaggcggagtgag

SEQ ID NO: 200471 - DNA, 26 bp, Artificial Sequence
  Description of Artificial Sequence: Synthetic oligonucleotide
tcactctcctggagaggcggagtgag

SEQ ID NO: 200472 - DNA, 25 bp, Artificial Sequence
  Description of Artificial Sequence: Synthetic oligonucleotide
cactctcctggagaggcggagtgag

SEQ ID NO: 200473 - DNA, 25 bp, Artificial Sequence
  Description of Artificial Sequence: Synthetic oligonucleotide
actctcctggagaggcggagtgagg

SEQ ID NO: 200474 - DNA, 24 bp, Artificial Sequence
  Description of Artificial Sequence: Synthetic oligonucleotide
ctctcctggagaggcggagtgagg

SEQ ID NO: 200475 - DNA, 24 bp, Artificial Sequence
  Description of Artificial Sequence: Synthetic oligonucleotide
tctcctggagaggcggagtgaggg

SEQ ID NO: 200476 - DNA, 23 bp, Artificial Sequence
  Description of Artificial Sequence: Synthetic oligonucleotide
ctcctggagaggcggagtgaggg

SEQ ID NO: 200477 - DNA, 23 bp, Artificial Sequence
  Description of Artificial Sequence: Synthetic oligonucleotide
tcctggagaggcggagtgagggg

SEQ ID NO: 200478 - DNA, 22 bp, Artificial Sequence
  Description of Artificial Sequence: Synthetic oligonucleotide
cctggagaggcggagtgagggg

SEQ ID NO: 200479 - DNA, 23 bp, Artificial Sequence
  Description of Artificial Sequence: Synthetic oligonucleotide
ctggagaggcggagtgaggggct

SEQ ID NO: 200480 - DNA, 23 bp, Artificial Sequence
  Description of Artificial Sequence: Synthetic oligonucleotide
tggagaggcggagtgaggggctg

SEQ ID NO: 200481 - DNA, 22 bp, Artificial Sequence
  Description of Artificial Sequence: Synthetic oligonucleotide
ggagaggcggagtgaggggctg

SEQ ID NO: 200482 - DNA, 23 bp, Artificial Sequence
  Description of Artificial Sequence: Synthetic oligonucleotide
gagaggcggagtgaggggctgct

SEQ ID NO: 200483 - DNA, 23 bp, Artificial Sequence
  Description of Artificial Sequence: Synthetic oligonucleotide
agaggcggagtgaggggctgctg

SEQ ID NO: 200484 - DNA, 22 bp, Artificial Sequence
  Description of Artificial Sequence: Synthetic oligonucleotide
gaggcggagtgaggggctgctg

SEQ ID NO: 200485 - DNA, 22 bp, Artificial Sequence
  Description of Artificial Sequence: Synthetic oligonucleotide
aggcggagtgaggggctgctgg

SEQ ID NO: 200486 - DNA, 21 bp, Artificial Sequence
  Description of Artificial Sequence: Synthetic oligonucleotide
ggcggagtgaggggctgctgg

SEQ ID NO: 200487 - DNA, 21 bp, Artificial Sequence
  Description of Artificial Sequence: Synthetic oligonucleotide
gcggagtgaggggctgctggc

SEQ ID NO: 200488 - DNA, 22 bp, Artificial Sequence
  Description of Artificial Sequence: Synthetic oligonucleotide
cggagtgaggggctgctggcct

SEQ ID NO: 200489 - DNA, 23 bp, Artificial Sequence
  Description of Artificial Sequence: Synthetic oligonucleotide
ggagtgaggggctgctggcctgt

SEQ ID NO: 200490 - DNA, 23 bp, Artificial Sequence
  Description of Artificial Sequence: Synthetic oligonucleotide
gagtgaggggctgctggcctgtg

SEQ ID NO: 200491 - DNA, 23 bp, Artificial Sequence
  Description of Artificial Sequence: Synthetic oligonucleotide
agtgaggggctgctggcctgtgg

SEQ ID NO: 200492 - DNA, 22 bp, Artificial Sequence
  Description of Artificial Sequence: Synthetic oligonucleotide
gtgaggggctgctggcctgtgg

SEQ ID NO: 200493 - DNA, 23 bp, Artificial Sequence
  Description of Artificial Sequence: Synthetic oligonucleotide
tgaggggctgctggcctgtggca

SEQ ID NO: 200494 - DNA, 22 bp, Artificial Sequence
  Description of Artificial Sequence: Synthetic oligonucleotide
gaggggctgctggcctgtggca

SEQ ID NO: 200495 - DNA, 22 bp, Artificial Sequence
  Description of Artificial Sequence: Synthetic oligonucleotide
aggggctgctggcctgtggcac

SEQ ID NO: 200496 - DNA, 21 bp, Artificial Sequence
  Description of Artificial Sequence: Synthetic oligonucleotide
ggggctgctggcctgtggcac

SEQ ID NO: 200497 - DNA, 23 bp, Artificial Sequence
  Description of Artificial Sequence: Synthetic oligonucleotide
gggctgctggcctgtggcaccaa

SEQ ID NO: 200498 - DNA, 23 bp, Artificial Sequence
  Description of Artificial Sequence: Synthetic oligonucleotide
ggctgctggcctgtggcaccaac

SEQ ID NO: 200499 - DNA, 23 bp, Artificial Sequence
  Description of Artificial Sequence: Synthetic oligonucleotide
gctgctggcctgtggcaccaacg

SEQ ID NO: 200500 - DNA, 23 bp, Artificial Sequence
  Description of Artificial Sequence: Synthetic oligonucleotide
ctgctggcctgtggcaccaacgc

SEQ ID NO: 200501 - DNA, 23 bp, Artificial Sequence
  Description of Artificial Sequence: Synthetic oligonucleotide
tgctggcctgtggcaccaacgcc

SEQ ID NO: 200502 - DNA, 22 bp, Artificial Sequence
  Description of Artificial Sequence: Synthetic oligonucleotide
gctggcctgtggcaccaacgcc

SEQ ID NO: 200503 - DNA, 22 bp, Artificial Sequence
  Description of Artificial Sequence: Synthetic oligonucleotide
ctggcctgtggcaccaacgccc

SEQ ID NO: 200504 - DNA, 22 bp, Artificial Sequence
  Description of Artificial Sequence: Synthetic oligonucleotide
tggcctgtggcaccaacgcccg

SEQ ID NO: 200505 - DNA, 21 bp, Artificial Sequence
  Description of Artificial Sequence: Synthetic oligonucleotide
ggcctgtggcaccaacgcccg

SEQ ID NO: 200506 - DNA, 21 bp, Artificial Sequence
  Description of Artificial Sequence: Synthetic oligonucleotide
gcctgtggcaccaacgcccgg

SEQ ID NO: 200507 - DNA, 22 bp, Artificial Sequence
  Description of Artificial Sequence: Synthetic oligonucleotide
cctgtggcaccaacgcccggca

SEQ ID NO: 200508 - DNA, 22 bp, Artificial Sequence
  Description of Artificial Sequence: Synthetic oligonucleotide
ctgtggcaccaacgcccggcac

SEQ ID NO: 200509 - DNA, 22 bp, Artificial Sequence
  Description of Artificial Sequence: Synthetic oligonucleotide
tgtggcaccaacgcccggcacc

SEQ ID NO: 200510 - DNA, 21 bp, Artificial Sequence
  Description of Artificial Sequence: Synthetic oligonucleotide
gtggcaccaacgcccggcacc

SEQ ID NO: 200511 - DNA, 21 bp, Artificial Sequence
  Description of Artificial Sequence: Synthetic oligonucleotide
tggcaccaacgcccggcaccc

SEQ ID NO: 200512 - DNA, 20 bp, Artificial Sequence
  Description of Artificial Sequence: Synthetic oligonucleotide
ggcaccaacgcccggcaccc

SEQ ID NO: 200513 - DNA, 21 bp, Artificial Sequence
  Description of Artificial Sequence: Synthetic oligonucleotide
gcaccaacgcccggcacccca

SEQ ID NO: 200514 - DNA, 21 bp, Artificial Sequence
  Description of Artificial Sequence: Synthetic oligonucleotide
caccaacgcccggcaccccag

SEQ ID NO: 200515 - DNA, 22 bp, Artificial Sequence
  Description of Artificial Sequence: Synthetic oligonucleotide
accaacgcccggcaccccagct

SEQ ID NO: 200516 - DNA, 21 bp, Artificial Sequence
  Description of Artificial Sequence: Synthetic oligonucleotide
ccaacgcccggcaccccagct

SEQ ID NO: 200517 - DNA, 21 bp, Artificial Sequence
  Description of Artificial Sequence: Synthetic oligonucleotide
caacgcccggcaccccagctg

SEQ ID NO: 200518 - DNA, 22 bp, Artificial Sequence
  Description of Artificial Sequence: Synthetic oligonucleotide
aacgcccggcaccccagctgct

SEQ ID NO: 200519 - DNA, 21 bp, Artificial Sequence
  Description of Artificial Sequence: Synthetic oligonucleotide
acgcccggcaccccagctgct

SEQ ID NO: 200520 - DNA, 20 bp, Artificial Sequence
  Description of Artificial Sequence: Synthetic oligonucleotide
cgcccggcaccccagctgct

SEQ ID NO: 200521 - DNA, 20 bp, Artificial Sequence
  Description of Artificial Sequence: Synthetic oligonucleotide
gcccggcaccccagctgctg

SEQ ID NO: 200522 - DNA, 22 bp, Artificial Sequence
  Description of Artificial Sequence: Synthetic oligonucleotide
cccggcaccccagctgctggaa

SEQ ID NO: 200523 - DNA, 22 bp, Artificial Sequence
  Description of Artificial Sequence: Synthetic oligonucleotide
ccggcaccccagctgctggaac

SEQ ID NO: 200524 - DNA, 23 bp, Artificial Sequence
  Description of Artificial Sequence: Synthetic oligonucleotide
cggcaccccagctgctggaacct

SEQ ID NO: 200525 - DNA, 23 bp, Artificial Sequence
  Description of Artificial Sequence: Synthetic oligonucleotide
ggcaccccagctgctggaacctg

SEQ ID NO: 200526 - DNA, 24 bp, Artificial Sequence
  Description of Artificial Sequence: Synthetic oligonucleotide
gcaccccagctgctggaacctggt

SEQ ID NO: 200527 - DNA, 27 bp, Artificial Sequence
  Description of Artificial Sequence: Synthetic oligonucleotide
caccccagctgctggaacctggtgaat

SEQ ID NO: 200528 - DNA, 27 bp, Artificial Sequence
  Description of Artificial Sequence: Synthetic oligonucleotide
accccagctgctggaacctggtgaatg

SEQ ID NO: 200529 - DNA, 26 bp, Artificial Sequence
  Description of Artificial Sequence: Synthetic oligonucleotide
ccccagctgctggaacctggtgaatg

SEQ ID NO: 200530 - DNA, 26 bp, Artificial Sequence
  Description of Artificial Sequence: Synthetic oligonucleotide
cccagctgctggaacctggtgaatgg

SEQ ID NO: 200531 - DNA, 27 bp, Artificial Sequence
  Description of Artificial Sequence: Synthetic oligonucleotide
ccagctgctggaacctggtgaatggca

SEQ ID NO: 200532 - DNA, 27 bp, Artificial Sequence
  Description of Artificial Sequence: Synthetic oligonucleotide
cagctgctggaacctggtgaatggcac

SEQ ID NO: 200533 - DNA, 28 bp, Artificial Sequence
  Description of Artificial Sequence: Synthetic oligonucleotide
agctgctggaacctggtgaatggcactg

SEQ ID NO: 200534 - DNA, 27 bp, Artificial Sequence
  Description of Artificial Sequence: Synthetic oligonucleotide
gctgctggaacctggtgaatggcactg

SEQ ID NO: 200535 - DNA, 28 bp, Artificial Sequence
  Description of Artificial Sequence: Synthetic oligonucleotide
ctgctggaacctggtgaatggcactgtg

SEQ ID NO: 200536 - DNA, 28 bp, Artificial Sequence
  Description of Artificial Sequence: Synthetic oligonucleotide
tgctggaacctggtgaatggcactgtgg

SEQ ID NO: 200537 - DNA, 27 bp, Artificial Sequence
  Description of Artificial Sequence: Synthetic oligonucleotide
gctggaacctggtgaatggcactgtgg

SEQ ID NO: 200538 - DNA, 28 bp, Artificial Sequence
  Description of Artificial Sequence: Synthetic oligonucleotide
ctggaacctggtgaatggcactgtggtg

SEQ ID NO: 200539 - DNA, 28 bp, Artificial Sequence
  Description of Artificial Sequence: Synthetic oligonucleotide
tggaacctggtgaatggcactgtggtgc

SEQ ID NO: 200540 - DNA, 27 bp, Artificial Sequence
  Description of Artificial Sequence: Synthetic oligonucleotide
ggaacctggtgaatggcactgtggtgc

SEQ ID NO: 200541 - DNA, 27 bp, Artificial Sequence
  Description of Artificial Sequence: Synthetic oligonucleotide
gaacctggtgaatggcactgtggtgcc

SEQ ID NO: 200542 - DNA, 28 bp, Artificial Sequence
  Description of Artificial Sequence: Synthetic oligonucleotide
aacctggtgaatggcactgtggtgccac

SEQ ID NO: 200543 - DNA, 27 bp, Artificial Sequence
  Description of Artificial Sequence: Synthetic oligonucleotide
acctggtgaatggcactgtggtgccac

SEQ ID NO: 200544 - DNA, 27 bp, Artificial Sequence
  Description of Artificial Sequence: Synthetic oligonucleotide
cctggtgaatggcactgtggtgccact

SEQ ID NO: 200545 - DNA, 28 bp, Artificial Sequence
  Description of Artificial Sequence: Synthetic oligonucleotide
ctggtgaatggcactgtggtgccacttg

SEQ ID NO: 200546 - DNA, 28 bp, Artificial Sequence
  Description of Artificial Sequence: Synthetic oligonucleotide
tggtgaatggcactgtggtgccacttgg

SEQ ID NO: 200547 - DNA, 27 bp, Artificial Sequence
  Description of Artificial Sequence: Synthetic oligonucleotide
ggtgaatggcactgtggtgccacttgg

SEQ ID NO: 200548 - DNA, 27 bp, Artificial Sequence
  Description of Artificial Sequence: Synthetic oligonucleotide
gtgaatggcactgtggtgccacttggc

SEQ ID NO: 200549 - DNA, 27 bp, Artificial Sequence
  Description of Artificial Sequence: Synthetic oligonucleotide
tgaatggcactgtggtgccacttggcg

SEQ ID NO: 200550 - DNA, 27 bp, Artificial Sequence
  Description of Artificial Sequence: Synthetic oligonucleotide
gaatggcactgtggtgccacttggcga

SEQ ID NO: 200551 - DNA, 27 bp, Artificial Sequence
  Description of Artificial Sequence: Synthetic oligonucleotide
aatggcactgtggtgccacttggcgag

SEQ ID NO: 200552 - DNA, 27 bp, Artificial Sequence
  Description of Artificial Sequence: Synthetic oligonucleotide
atggcactgtggtgccacttggcgaga

SEQ ID NO: 200553 - DNA, 27 bp, Artificial Sequence
  Description of Artificial Sequence: Synthetic oligonucleotide
tggcactgtggtgccacttggcgagat

SEQ ID NO: 200554 - DNA, 26 bp, Artificial Sequence
  Description of Artificial Sequence: Synthetic oligonucleotide
ggcactgtggtgccacttggcgagat

SEQ ID NO: 200555 - DNA, 27 bp, Artificial Sequence
  Description of Artificial Sequence: Synthetic oligonucleotide
gcactgtggtgccacttggcgagatga

SEQ ID NO: 200556 - DNA, 27 bp, Artificial Sequence
  Description of Artificial Sequence: Synthetic oligonucleotide
cactgtggtgccacttggcgagatgag

SEQ ID NO: 200557 - DNA, 28 bp, Artificial Sequence
  Description of Artificial Sequence: Synthetic oligonucleotide
actgtggtgccacttggcgagatgagag

SEQ ID NO: 200558 - DNA, 27 bp, Artificial Sequence
  Description of Artificial Sequence: Synthetic oligonucleotide
ctgtggtgccacttggcgagatgagag

SEQ ID NO: 200559 - DNA, 27 bp, Artificial Sequence
  Description of Artificial Sequence: Synthetic oligonucleotide
tgtggtgccacttggcgagatgagagg

SEQ ID NO: 200560 - DNA, 26 bp, Artificial Sequence
  Description of Artificial Sequence: Synthetic oligonucleotide
gtggtgccacttggcgagatgagagg

SEQ ID NO: 200561 - DNA, 27 bp, Artificial Sequence
  Description of Artificial Sequence: Synthetic oligonucleotide
tggtgccacttggcgagatgagaggct

SEQ ID NO: 200562 - DNA, 27 bp, Artificial Sequence
  Description of Artificial Sequence: Synthetic oligonucleotide
ggtgccacttggcgagatgagaggcta

SEQ ID NO: 200563 - DNA, 27 bp, Artificial Sequence
  Description of Artificial Sequence: Synthetic oligonucleotide
gtgccacttggcgagatgagaggctac

SEQ ID NO: 200564 - DNA, 27 bp, Artificial Sequence
  Description of Artificial Sequence: Synthetic oligonucleotide
tgccacttggcgagatgagaggctacg

SEQ ID NO: 200565 - DNA, 26 bp, Artificial Sequence
  Description of Artificial Sequence: Synthetic oligonucleotide
gccacttggcgagatgagaggctacg

SEQ ID NO: 200566 - DNA, 26 bp, Artificial Sequence
  Description of Artificial Sequence: Synthetic oligonucleotide
ccacttggcgagatgagaggctacgc

SEQ ID NO: 200567 - DNA, 26 bp, Artificial Sequence
  Description of Artificial Sequence: Synthetic oligonucleotide
cacttggcgagatgagaggctacgcc

SEQ ID NO: 200568 - DNA, 26 bp, Artificial Sequence
  Description of Artificial Sequence: Synthetic oligonucleotide
acttggcgagatgagaggctacgccc

SEQ ID NO: 200569 - DNA, 25 bp, Artificial Sequence
  Description of Artificial Sequence: Synthetic oligonucleotide
cttggcgagatgagaggctacgccc

SEQ ID NO: 200570 - DNA, 25 bp, Artificial Sequence
  Description of Artificial Sequence: Synthetic oligonucleotide
ttggcgagatgagaggctacgcccc

SEQ ID NO: 200571 - DNA, 24 bp, Artificial Sequence
  Description of Artificial Sequence: Synthetic oligonucleotide
tggcgagatgagaggctacgcccc

SEQ ID NO: 200572 - DNA, 23 bp, Artificial Sequence
  Description of Artificial Sequence: Synthetic oligonucleotide
ggcgagatgagaggctacgcccc

SEQ ID NO: 200573 - DNA, 25 bp, Artificial Sequence
  Description of Artificial Sequence: Synthetic oligonucleotide
gcgagatgagaggctacgccccctt

SEQ ID NO: 200574 - DNA, 26 bp, Artificial Sequence
  Description of Artificial Sequence: Synthetic oligonucleotide
cgagatgagaggctacgcccccttca

SEQ ID NO: 200575 - DNA, 26 bp, Artificial Sequence
  Description of Artificial Sequence: Synthetic oligonucleotide
gagatgagaggctacgcccccttcag

SEQ ID NO: 200576 - DNA, 26 bp, Artificial Sequence
  Description of Artificial Sequence: Synthetic oligonucleotide
agatgagaggctacgcccccttcagc

SEQ ID NO: 200577 - DNA, 25 bp, Artificial Sequence
  Description of Artificial Sequence: Synthetic oligonucleotide
gatgagaggctacgcccccttcagc

SEQ ID NO: 200578 - DNA, 25 bp, Artificial Sequence
  Description of Artificial Sequence: Synthetic oligonucleotide
atgagaggctacgcccccttcagcc

SEQ ID NO: 200579 - DNA, 24 bp, Artificial Sequence
  Description of Artificial Sequence: Synthetic oligonucleotide
tgagaggctacgcccccttcagcc

SEQ ID NO: 200580 - DNA, 23 bp, Artificial Sequence
  Description of Artificial Sequence: Synthetic oligonucleotide
gagaggctacgcccccttcagcc

SEQ ID NO: 200581 - DNA, 23 bp, Artificial Sequence
  Description of Artificial Sequence: Synthetic oligonucleotide
agaggctacgcccccttcagccc

SEQ ID NO: 200582 - DNA, 22 bp, Artificial Sequence
  Description of Artificial Sequence: Synthetic oligonucleotide
gaggctacgcccccttcagccc

SEQ ID NO: 200583 - DNA, 22 bp, Artificial Sequence
  Description of Artificial Sequence: Synthetic oligonucleotide
aggctacgcccccttcagcccg

SEQ ID NO: 200584 - DNA, 21 bp, Artificial Sequence
  Description of Artificial Sequence: Synthetic oligonucleotide
ggctacgcccccttcagcccg

SEQ ID NO: 200585 - DNA, 22 bp, Artificial Sequence
  Description of Artificial Sequence: Synthetic oligonucleotide
gctacgcccccttcagcccgga

SEQ ID NO: 200586 - DNA, 22 bp, Artificial Sequence
  Description of Artificial Sequence: Synthetic oligonucleotide
ctacgcccccttcagcccggac

SEQ ID NO: 200587 - DNA, 23 bp, Artificial Sequence
  Description of Artificial Sequence: Synthetic oligonucleotide
tacgcccccttcagcccggacga

SEQ ID NO: 200588 - DNA, 22 bp, Artificial Sequence
  Description of Artificial Sequence: Synthetic oligonucleotide
acgcccccttcagcccggacga

SEQ ID NO: 200589 - DNA, 21 bp, Artificial Sequence
  Description of Artificial Sequence: Synthetic oligonucleotide
cgcccccttcagcccggacga

SEQ ID NO: 200590 - DNA, 23 bp, Artificial Sequence
  Description of Artificial Sequence: Synthetic oligonucleotide
gcccccttcagcccggacgagaa

SEQ ID NO: 200591 - DNA, 24 bp, Artificial Sequence
  Description of Artificial Sequence: Synthetic oligonucleotide
cccccttcagcccggacgagaact

SEQ ID NO: 200592 - DNA, 24 bp, Artificial Sequence
  Description of Artificial Sequence: Synthetic oligonucleotide
ccccttcagcccggacgagaactc

SEQ ID NO: 200593 - DNA, 24 bp, Artificial Sequence
  Description of Artificial Sequence: Synthetic oligonucleotide
cccttcagcccggacgagaactcc

SEQ ID NO: 200594 - DNA, 25 bp, Artificial Sequence
  Description of Artificial Sequence: Synthetic oligonucleotide
ccttcagcccggacgagaactccct

SEQ ID NO: 200595 - DNA, 25 bp, Artificial Sequence
  Description of Artificial Sequence: Synthetic oligonucleotide
cttcagcccggacgagaactccctg

SEQ ID NO: 200596 - DNA, 27 bp, Artificial Sequence
  Description of Artificial Sequence: Synthetic oligonucleotide
ttcagcccggacgagaactccctggtt

SEQ ID NO: 200597 - DNA, 26 bp, Artificial Sequence
  Description of Artificial Sequence: Synthetic oligonucleotide
tcagcccggacgagaactccctggtt

SEQ ID NO: 200598 - DNA, 25 bp, Artificial Sequence
  Description of Artificial Sequence: Synthetic oligonucleotide
cagcccggacgagaactccctggtt

SEQ ID NO: 200599 - DNA, 26 bp, Artificial Sequence
  Description of Artificial Sequence: Synthetic oligonucleotide
agcccggacgagaactccctggttct

SEQ ID NO: 200600 - DNA, 25 bp, Artificial Sequence
  Description of Artificial Sequence: Synthetic oligonucleotide
gcccggacgagaactccctggttct

SEQ ID NO: 200601 - DNA, 27 bp, Artificial Sequence
  Description of Artificial Sequence: Synthetic oligonucleotide
cccggacgagaactccctggttctgtt

SEQ ID NO: 200602 - DNA, 28 bp, Artificial Sequence
  Description of Artificial Sequence: Synthetic oligonucleotide
ccggacgagaactccctggttctgtttg

SEQ ID NO: 200603 - DNA, 30 bp, Artificial Sequence
  Description of Artificial Sequence: Synthetic oligonucleotide
cggacgagaactccctggttctgtttgaag

SEQ ID NO: 200604 - DNA, 30 bp, Artificial Sequence
  Description of Artificial Sequence: Synthetic oligonucleotide
ggacgagaactccctggttctgtttgaagg

SEQ ID NO: 200605 - DNA, 30 bp, Artificial Sequence
  Description of Artificial Sequence: Synthetic oligonucleotide
gacgagaactccctggttctgtttgaaggg

SEQ ID NO: 200606 - DNA, 30 bp, Artificial Sequence
  Description of Artificial Sequence: Synthetic oligonucleotide
acgagaactccctggttctgtttgaagggg

SEQ ID NO: 200607 - DNA, 29 bp, Artificial Sequence
  Description of Artificial Sequence: Synthetic oligonucleotide
cgagaactccctggttctgtttgaagggg

SEQ ID NO: 200608 - DNA, 30 bp, Artificial Sequence
  Description of Artificial Sequence: Synthetic oligonucleotide
gagaactccctggttctgtttgaaggggac

SEQ ID NO: 200609 - DNA, 30 bp, Artificial Sequence
  Description of Artificial Sequence: Synthetic oligonucleotide
agaactccctggttctgtttgaaggggacg

SEQ ID NO: 200610 - DNA, 29 bp, Artificial Sequence
  Description of Artificial Sequence: Synthetic oligonucleotide
gaactccctggttctgtttgaaggggacg

SEQ ID NO: 200611 - DNA, 30 bp, Artificial Sequence
  Description of Artificial Sequence: Synthetic oligonucleotide
aactccctggttctgtttgaaggggacgag

SEQ ID NO: 200612 - DNA, 29 bp, Artificial Sequence
  Description of Artificial Sequence: Synthetic oligonucleotide
actccctggttctgtttgaaggggacgag

SEQ ID NO: 200613 - DNA, 28 bp, Artificial Sequence
  Description of Artificial Sequence: Synthetic oligonucleotide
ctccctggttctgtttgaaggggacgag

SEQ ID NO: 200614 - DNA, 28 bp, Artificial Sequence
  Description of Artificial Sequence: Synthetic oligonucleotide
tccctggttctgtttgaaggggacgagg

SEQ ID NO: 200615 - DNA, 27 bp, Artificial Sequence
  Description of Artificial Sequence: Synthetic oligonucleotide
ccctggttctgtttgaaggggacgagg

SEQ ID NO: 200616 - DNA, 28 bp, Artificial Sequence
  Description of Artificial Sequence: Synthetic oligonucleotide
cctggttctgtttgaaggggacgaggtg

SEQ ID NO: 200617 - DNA, 32 bp, Artificial Sequence
  Description of Artificial Sequence: Synthetic oligonucleotide
ctggttctgtttgaaggggacgaggtgtattc

SEQ ID NO: 200618 - DNA, 32 bp, Artificial Sequence
  Description of Artificial Sequence: Synthetic oligonucleotide
tggttctgtttgaaggggacgaggtgtattcc

SEQ ID NO: 200619 - DNA, 31 bp, Artificial Sequence
  Description of Artificial Sequence: Synthetic oligonucleotide
ggttctgtttgaaggggacgaggtgtattcc

SEQ ID NO: 200620 - DNA, 32 bp, Artificial Sequence
  Description of Artificial Sequence: Synthetic oligonucleotide
gttctgtttgaaggggacgaggtgtattccac

SEQ ID NO: 200621 - DNA, 32 bp, Artificial Sequence
  Description of Artificial Sequence: Synthetic oligonucleotide
ttctgtttgaaggggacgaggtgtattccacc

SEQ ID NO: 200622 - DNA, 31 bp, Artificial Sequence
  Description of Artificial Sequence: Synthetic oligonucleotide
tctgtttgaaggggacgaggtgtattccacc

SEQ ID NO: 200623 - DNA, 30 bp, Artificial Sequence
  Description of Artificial Sequence: Synthetic oligonucleotide
ctgtttgaaggggacgaggtgtattccacc

SEQ ID NO: 200624 - DNA, 32 bp, Artificial Sequence
  Description of Artificial Sequence: Synthetic oligonucleotide
tgtttgaaggggacgaggtgtattccaccatc

SEQ ID NO: 200625 - DNA, 31 bp, Artificial Sequence
  Description of Artificial Sequence: Synthetic oligonucleotide
gtttgaaggggacgaggtgtattccaccatc

SEQ ID NO: 200626 - DNA, 31 bp, Artificial Sequence
  Description of Artificial Sequence: Synthetic oligonucleotide
tttgaaggggacgaggtgtattccaccatcc

SEQ ID NO: 200627 - DNA, 30 bp, Artificial Sequence
  Description of Artificial Sequence: Synthetic oligonucleotide
ttgaaggggacgaggtgtattccaccatcc

SEQ ID NO: 200628 - DNA, 29 bp, Artificial Sequence
  Description of Artificial Sequence: Synthetic oligonucleotide
tgaaggggacgaggtgtattccaccatcc

SEQ ID NO: 200629 - DNA, 28 bp, Artificial Sequence
  Description of Artificial Sequence: Synthetic oligonucleotide
gaaggggacgaggtgtattccaccatcc

SEQ ID NO: 200630 - DNA, 28 bp, Artificial Sequence
  Description of Artificial Sequence: Synthetic oligonucleotide
aaggggacgaggtgtattccaccatccg

SEQ ID NO: 200631 - DNA, 27 bp, Artificial Sequence
  Description of Artificial Sequence: Synthetic oligonucleotide
aggggacgaggtgtattccaccatccg

SEQ ID NO: 200632 - DNA, 26 bp, Artificial Sequence
  Description of Artificial Sequence: Synthetic oligonucleotide
ggggacgaggtgtattccaccatccg

SEQ ID NO: 200633 - DNA, 27 bp, Artificial Sequence
  Description of Artificial Sequence: Synthetic oligonucleotide
gggacgaggtgtattccaccatccgga

SEQ ID NO: 200634 - DNA, 28 bp, Artificial Sequence
  Description of Artificial Sequence: Synthetic oligonucleotide
ggacgaggtgtattccaccatccggaag

SEQ ID NO: 200635 - DNA, 28 bp, Artificial Sequence
  Description of Artificial Sequence: Synthetic oligonucleotide
gacgaggtgtattccaccatccggaagc

SEQ ID NO: 200636 - DNA, 29 bp, Artificial Sequence
  Description of Artificial Sequence: Synthetic oligonucleotide
acgaggtgtattccaccatccggaagcag

SEQ ID NO: 200637 - DNA, 28 bp, Artificial Sequence
  Description of Artificial Sequence: Synthetic oligonucleotide
cgaggtgtattccaccatccggaagcag

SEQ ID NO: 200638 - DNA, 28 bp, Artificial Sequence
  Description of Artificial Sequence: Synthetic oligonucleotide
gaggtgtattccaccatccggaagcagg

SEQ ID NO: 200639 - DNA, 32 bp, Artificial Sequence
  Description of Artificial Sequence: Synthetic oligonucleotide
aggtgtattccaccatccggaagcaggaatac

SEQ ID NO: 200640 - DNA, 31 bp, Artificial Sequence
  Description of Artificial Sequence: Synthetic oligonucleotide
ggtgtattccaccatccggaagcaggaatac

SEQ ID NO: 200641 - DNA, 34 bp, Artificial Sequence
  Description of Artificial Sequence: Synthetic oligonucleotide
gtgtattccaccatccggaagcaggaatacaatg

SEQ ID NO: 200642 - DNA, 34 bp, Artificial Sequence
  Description of Artificial Sequence: Synthetic oligonucleotide
tgtattccaccatccggaagcaggaatacaatgg

SEQ ID NO: 200643 - DNA, 33 bp, Artificial Sequence
  Description of Artificial Sequence: Synthetic oligonucleotide
gtattccaccatccggaagcaggaatacaatgg

SEQ ID NO: 200644 - DNA, 33 bp, Artificial Sequence
  Description of Artificial Sequence: Synthetic oligonucleotide
tattccaccatccggaagcaggaatacaatggg

SEQ ID NO: 200645 - DNA, 32 bp, Artificial Sequence
  Description of Artificial Sequence: Synthetic oligonucleotide
attccaccatccggaagcaggaatacaatggg

SEQ ID NO: 200646 - DNA, 31 bp, Artificial Sequence
  Description of Artificial Sequence: Synthetic oligonucleotide
ttccaccatccggaagcaggaatacaatggg

SEQ ID NO: 200647 - DNA, 30 bp, Artificial Sequence
  Description of Artificial Sequence: Synthetic oligonucleotide
tccaccatccggaagcaggaatacaatggg

SEQ ID NO: 200648 - DNA, 29 bp, Artificial Sequence
  Description of Artificial Sequence: Synthetic oligonucleotide
ccaccatccggaagcaggaatacaatggg

SEQ ID NO: 200649 - DNA, 31 bp, Artificial Sequence
  Description of Artificial Sequence: Synthetic oligonucleotide
caccatccggaagcaggaatacaatgggaag

SEQ ID NO: 200650 - DNA, 33 bp, Artificial Sequence
  Description of Artificial Sequence: Synthetic oligonucleotide
accatccggaagcaggaatacaatgggaagatc

SEQ ID NO: 200651 - DNA, 32 bp, Artificial Sequence
  Description of Artificial Sequence: Synthetic oligonucleotide
ccatccggaagcaggaatacaatgggaagatc

SEQ ID NO: 200652 - DNA, 32 bp, Artificial Sequence
  Description of Artificial Sequence: Synthetic oligonucleotide
catccggaagcaggaatacaatgggaagatcc

SEQ ID NO: 200653 - DNA, 32 bp, Artificial Sequence
  Description of Artificial Sequence: Synthetic oligonucleotide
atccggaagcaggaatacaatgggaagatccc

SEQ ID NO: 200654 - DNA, 31 bp, Artificial Sequence
  Description of Artificial Sequence: Synthetic oligonucleotide
tccggaagcaggaatacaatgggaagatccc

SEQ ID NO: 200655 - DNA, 30 bp, Artificial Sequence
  Description of Artificial Sequence: Synthetic oligonucleotide
ccggaagcaggaatacaatgggaagatccc

SEQ ID NO: 200656 - DNA, 31 bp, Artificial Sequence
  Description of Artificial Sequence: Synthetic oligonucleotide
cggaagcaggaatacaatgggaagatccctc

SEQ ID NO: 200657 - DNA, 31 bp, Artificial Sequence
  Description of Artificial Sequence: Synthetic oligonucleotide
ggaagcaggaatacaatgggaagatccctcg

SEQ ID NO: 200658 - DNA, 31 bp, Artificial Sequence
  Description of Artificial Sequence: Synthetic oligonucleotide
gaagcaggaatacaatgggaagatccctcgg

SEQ ID NO: 200659 - DNA, 33 bp, Artificial Sequence
  Description of Artificial Sequence: Synthetic oligonucleotide
aagcaggaatacaatgggaagatccctcggttc

SEQ ID NO: 200660 - DNA, 32 bp, Artificial Sequence
  Description of Artificial Sequence: Synthetic oligonucleotide
agcaggaatacaatgggaagatccctcggttc

SEQ ID NO: 200661 - DNA, 31 bp, Artificial Sequence
  Description of Artificial Sequence: Synthetic oligonucleotide
gcaggaatacaatgggaagatccctcggttc

SEQ ID NO: 200662 - DNA, 31 bp, Artificial Sequence
  Description of Artificial Sequence: Synthetic oligonucleotide
caggaatacaatgggaagatccctcggttcc

SEQ ID NO: 200663 - DNA, 31 bp, Artificial Sequence
  Description of Artificial Sequence: Synthetic oligonucleotide
aggaatacaatgggaagatccctcggttccg

SEQ ID NO: 200664 - DNA, 30 bp, Artificial Sequence
  Description of Artificial Sequence: Synthetic oligonucleotide
ggaatacaatgggaagatccctcggttccg

SEQ ID NO: 200665 - DNA, 30 bp, Artificial Sequence
  Description of Artificial Sequence: Synthetic oligonucleotide
gaatacaatgggaagatccctcggttccgc

SEQ ID NO: 200666 - DNA, 30 bp, Artificial Sequence
  Description of Artificial Sequence: Synthetic oligonucleotide
aatacaatgggaagatccctcggttccgcc

SEQ ID NO: 200667 - DNA, 29 bp, Artificial Sequence
  Description of Artificial Sequence: Synthetic oligonucleotide
atacaatgggaagatccctcggttccgcc

SEQ ID NO: 200668 - DNA, 28 bp, Artificial Sequence
  Description of Artificial Sequence: Synthetic oligonucleotide
tacaatgggaagatccctcggttccgcc

SEQ ID NO: 200669 - DNA, 27 bp, Artificial Sequence
  Description of Artificial Sequence: Synthetic oligonucleotide
acaatgggaagatccctcggttccgcc

SEQ ID NO: 200670 - DNA, 26 bp, Artificial Sequence
  Description of Artificial Sequence: Synthetic oligonucleotide
caatgggaagatccctcggttccgcc

SEQ ID NO: 200671 - DNA, 26 bp, Artificial Sequence
  Description of Artificial Sequence: Synthetic oligonucleotide
aatgggaagatccctcggttccgccg

SEQ ID NO: 200672 - DNA, 25 bp, Artificial Sequence
  Description of Artificial Sequence: Synthetic oligonucleotide
atgggaagatccctcggttccgccg

SEQ ID NO: 200673 - DNA, 24 bp, Artificial Sequence
  Description of Artificial Sequence: Synthetic oligonucleotide
tgggaagatccctcggttccgccg

SEQ ID NO: 200674 - DNA, 23 bp, Artificial Sequence
  Description of Artificial Sequence: Synthetic oligonucleotide
gggaagatccctcggttccgccg

SEQ ID NO: 200675 - DNA, 25 bp, Artificial Sequence
  Description of Artificial Sequence: Synthetic oligonucleotide
ggaagatccctcggttccgccgcat

SEQ ID NO: 200676 - DNA, 25 bp, Artificial Sequence
  Description of Artificial Sequence: Synthetic oligonucleotide
gaagatccctcggttccgccgcatc

SEQ ID NO: 200677 - DNA, 25 bp, Artificial Sequence
  Description of Artificial Sequence: Synthetic oligonucleotide
aagatccctcggttccgccgcatcc

SEQ ID NO: 200678 - DNA, 24 bp, Artificial Sequence
  Description of Artificial Sequence: Synthetic oligonucleotide
agatccctcggttccgccgcatcc

SEQ ID NO: 200679 - DNA, 23 bp, Artificial Sequence
  Description of Artificial Sequence: Synthetic oligonucleotide
gatccctcggttccgccgcatcc

SEQ ID NO: 200680 - DNA, 23 bp, Artificial Sequence
  Description of Artificial Sequence: Synthetic oligonucleotide
atccctcggttccgccgcatccg

SEQ ID NO: 200681 - DNA, 22 bp, Artificial Sequence
  Description of Artificial Sequence: Synthetic oligonucleotide
tccctcggttccgccgcatccg

SEQ ID NO: 200682 - DNA, 21 bp, Artificial Sequence
  Description of Artificial Sequence: Synthetic oligonucleotide
ccctcggttccgccgcatccg

SEQ ID NO: 200683 - DNA, 21 bp, Artificial Sequence
  Description of Artificial Sequence: Synthetic oligonucleotide
cctcggttccgccgcatccgg

SEQ ID NO: 200684 - DNA, 21 bp, Artificial Sequence
  Description of Artificial Sequence: Synthetic oligonucleotide
ctcggttccgccgcatccggg

SEQ ID NO: 200685 - DNA, 21 bp, Artificial Sequence
  Description of Artificial Sequence: Synthetic oligonucleotide
tcggttccgccgcatccgggg

SEQ ID NO: 200686 - DNA, 20 bp, Artificial Sequence
  Description of Artificial Sequence: Synthetic oligonucleotide
cggttccgccgcatccgggg

SEQ ID NO: 200687 - DNA, 20 bp, Artificial Sequence
  Description of Artificial Sequence: Synthetic oligonucleotide
ggttccgccgcatccggggc

SEQ ID NO: 200688 - DNA, 21 bp, Artificial Sequence
  Description of Artificial Sequence: Synthetic oligonucleotide
gttccgccgcatccggggcga

SEQ ID NO: 200689 - DNA, 22 bp, Artificial Sequence
  Description of Artificial Sequence: Synthetic oligonucleotide
ttccgccgcatccggggcgaga

SEQ ID NO: 200690 - DNA, 21 bp, Artificial Sequence
  Description of Artificial Sequence: Synthetic oligonucleotide
tccgccgcatccggggcgaga

SEQ ID NO: 200691 - DNA, 20 bp, Artificial Sequence
  Description of Artificial Sequence: Synthetic oligonucleotide
ccgccgcatccggggcgaga

SEQ ID NO: 200692 - DNA, 21 bp, Artificial Sequence
  Description of Artificial Sequence: Synthetic oligonucleotide
cgccgcatccggggcgagagt

SEQ ID NO: 200693 - DNA, 22 bp, Artificial Sequence
  Description of Artificial Sequence: Synthetic oligonucleotide
gccgcatccggggcgagagtga

SEQ ID NO: 200694 - DNA, 22 bp, Artificial Sequence
  Description of Artificial Sequence: Synthetic oligonucleotide
ccgcatccggggcgagagtgag

SEQ ID NO: 200695 - DNA, 23 bp, Artificial Sequence
  Description of Artificial Sequence: Synthetic oligonucleotide
cgcatccggggcgagagtgagct

SEQ ID NO: 200696 - DNA, 25 bp, Artificial Sequence
  Description of Artificial Sequence: Synthetic oligonucleotide
gcatccggggcgagagtgagctgta

SEQ ID NO: 200697 - DNA, 26 bp, Artificial Sequence
  Description of Artificial Sequence: Synthetic oligonucleotide
catccggggcgagagtgagctgtaca

SEQ ID NO: 200698 - DNA, 26 bp, Artificial Sequence
  Description of Artificial Sequence: Synthetic oligonucleotide
atccggggcgagagtgagctgtacac

SEQ ID NO: 200699 - DNA, 25 bp, Artificial Sequence
  Description of Artificial Sequence: Synthetic oligonucleotide
tccggggcgagagtgagctgtacac

SEQ ID NO: 200700 - DNA, 24 bp, Artificial Sequence
  Description of Artificial Sequence: Synthetic oligonucleotide
ccggggcgagagtgagctgtacac

SEQ ID NO: 200701 - DNA, 25 bp, Artificial Sequence
  Description of Artificial Sequence: Synthetic oligonucleotide
cggggcgagagtgagctgtacacca

SEQ ID NO: 200702 - DNA, 26 bp, Artificial Sequence
  Description of Artificial Sequence: Synthetic oligonucleotide
ggggcgagagtgagctgtacaccagt

SEQ ID NO: 200703 - DNA, 27 bp, Artificial Sequence
  Description of Artificial Sequence: Synthetic oligonucleotide
gggcgagagtgagctgtacaccagtga

SEQ ID NO: 200704 - DNA, 29 bp, Artificial Sequence
  Description of Artificial Sequence: Synthetic oligonucleotide
ggcgagagtgagctgtacaccagtgatac

SEQ ID NO: 200705 - DNA, 30 bp, Artificial Sequence
  Description of Artificial Sequence: Synthetic oligonucleotide
gcgagagtgagctgtacaccagtgatactg

SEQ ID NO: 200706 - DNA, 31 bp, Artificial Sequence
  Description of Artificial Sequence: Synthetic oligonucleotide
cgagagtgagctgtacaccagtgatactgtc

SEQ ID NO: 200707 - DNA, 33 bp, Artificial Sequence
  Description of Artificial Sequence: Synthetic oligonucleotide
gagagtgagctgtacaccagtgatactgtcatg

SEQ ID NO: 200708 - DNA, 33 bp, Artificial Sequence
  Description of Artificial Sequence: Synthetic oligonucleotide
agagtgagctgtacaccagtgatactgtcatgc

SEQ ID NO: 200709 - DNA, 32 bp, Artificial Sequence
  Description of Artificial Sequence: Synthetic oligonucleotide
gagtgagctgtacaccagtgatactgtcatgc

SEQ ID NO: 200710 - DNA, 33 bp, Artificial Sequence
  Description of Artificial Sequence: Synthetic oligonucleotide
agtgagctgtacaccagtgatactgtcatgcag

SEQ ID NO: 200711 - DNA, 32 bp, Artificial Sequence
  Description of Artificial Sequence: Synthetic oligonucleotide
gtgagctgtacaccagtgatactgtcatgcag

SEQ ID NO: 200712 - DNA, 34 bp, Artificial Sequence
  Description of Artificial Sequence: Synthetic oligonucleotide
tgagctgtacaccagtgatactgtcatgcagaac

SEQ ID NO: 200713 - DNA, 33 bp, Artificial Sequence
  Description of Artificial Sequence: Synthetic oligonucleotide
gagctgtacaccagtgatactgtcatgcagaac

SEQ ID NO: 200714 - DNA, 33 bp, Artificial Sequence
  Description of Artificial Sequence: Synthetic oligonucleotide
agctgtacaccagtgatactgtcatgcagaacc

SEQ ID NO: 200715 - DNA, 32 bp, Artificial Sequence
  Description of Artificial Sequence: Synthetic oligonucleotide
gctgtacaccagtgatactgtcatgcagaacc

SEQ ID NO: 200716 - DNA, 32 bp, Artificial Sequence
  Description of Artificial Sequence: Synthetic oligonucleotide
ctgtacaccagtgatactgtcatgcagaaccc

SEQ ID NO: 200717 - DNA, 33 bp, Artificial Sequence
  Description of Artificial Sequence: Synthetic oligonucleotide
tgtacaccagtgatactgtcatgcagaacccac

SEQ ID NO: 200718 - DNA, 32 bp, Artificial Sequence
  Description of Artificial Sequence: Synthetic oligonucleotide
gtacaccagtgatactgtcatgcagaacccac

SEQ ID NO: 200719 - DNA, 33 bp, Artificial Sequence
  Description of Artificial Sequence: Synthetic oligonucleotide
tacaccagtgatactgtcatgcagaacccacag

SEQ ID NO: 200720 - DNA, 32 bp, Artificial Sequence
  Description of Artificial Sequence: Synthetic oligonucleotide
acaccagtgatactgtcatgcagaacccacag

SEQ ID NO: 200721 - DNA, 31 bp, Artificial Sequence
  Description of Artificial Sequence: Synthetic oligonucleotide
caccagtgatactgtcatgcagaacccacag

SEQ ID NO: 200722 - DNA, 33 bp, Artificial Sequence
  Description of Artificial Sequence: Synthetic oligonucleotide
accagtgatactgtcatgcagaacccacagttc

SEQ ID NO: 200723 - DNA, 32 bp, Artificial Sequence
  Description of Artificial Sequence: Synthetic oligonucleotide
ccagtgatactgtcatgcagaacccacagttc

SEQ ID NO: 200724 - DNA, 34 bp, Artificial Sequence
  Description of Artificial Sequence: Synthetic oligonucleotide
cagtgatactgtcatgcagaacccacagttcatc

SEQ ID NO: 200725 - DNA, 37 bp, Artificial Sequence
  Description of Artificial Sequence: Synthetic oligonucleotide
agtgatactgtcatgcagaacccacagttcatcaaag

SEQ ID NO: 200726 - DNA, 36 bp, Artificial Sequence
  Description of Artificial Sequence: Synthetic oligonucleotide
gtgatactgtcatgcagaacccacagttcatcaaag

SEQ ID NO: 200727 - DNA, 36 bp, Artificial Sequence
  Description of Artificial Sequence: Synthetic oligonucleotide
tgatactgtcatgcagaacccacagttcatcaaagc

SEQ ID NO: 200728 - DNA, 35 bp, Artificial Sequence
  Description of Artificial Sequence: Synthetic oligonucleotide
gatactgtcatgcagaacccacagttcatcaaagc

SEQ ID NO: 200729 - DNA, 35 bp, Artificial Sequence
  Description of Artificial Sequence: Synthetic oligonucleotide
atactgtcatgcagaacccacagttcatcaaagcc

SEQ ID NO: 200730 - DNA, 34 bp, Artificial Sequence
  Description of Artificial Sequence: Synthetic oligonucleotide
tactgtcatgcagaacccacagttcatcaaagcc

SEQ ID NO: 200731 - DNA, 33 bp, Artificial Sequence
  Description of Artificial Sequence: Synthetic oligonucleotide
actgtcatgcagaacccacagttcatcaaagcc

SEQ ID NO: 200732 - DNA, 32 bp, Artificial Sequence
  Description of Artificial Sequence: Synthetic oligonucleotide
ctgtcatgcagaacccacagttcatcaaagcc

SEQ ID NO: 200733 - DNA, 33 bp, Artificial Sequence
  Description of Artificial Sequence: Synthetic oligonucleotide
tgtcatgcagaacccacagttcatcaaagccac

SEQ ID NO: 200734 - DNA, 32 bp, Artificial Sequence
  Description of Artificial Sequence: Synthetic oligonucleotide
gtcatgcagaacccacagttcatcaaagccac

SEQ ID NO: 200735 - DNA, 32 bp, Artificial Sequence
  Description of Artificial Sequence: Synthetic oligonucleotide
tcatgcagaacccacagttcatcaaagccacc

SEQ ID NO: 200736 - DNA, 31 bp, Artificial Sequence
  Description of Artificial Sequence: Synthetic oligonucleotide
catgcagaacccacagttcatcaaagccacc

SEQ ID NO: 200737 - DNA, 33 bp, Artificial Sequence
  Description of Artificial Sequence: Synthetic oligonucleotide
atgcagaacccacagttcatcaaagccaccatc

SEQ ID NO: 200738 - DNA, 32 bp, Artificial Sequence
  Description of Artificial Sequence: Synthetic oligonucleotide
tgcagaacccacagttcatcaaagccaccatc

SEQ ID NO: 200739 - DNA, 31 bp, Artificial Sequence
  Description of Artificial Sequence: Synthetic oligonucleotide
gcagaacccacagttcatcaaagccaccatc

SEQ ID NO: 200740 - DNA, 31 bp, Artificial Sequence
  Description of Artificial Sequence: Synthetic oligonucleotide
cagaacccacagttcatcaaagccaccatcg

SEQ ID NO: 200741 - DNA, 32 bp, Artificial Sequence
  Description of Artificial Sequence: Synthetic oligonucleotide
agaacccacagttcatcaaagccaccatcgtg

SEQ ID NO: 200742 - DNA, 31 bp, Artificial Sequence
  Description of Artificial Sequence: Synthetic oligonucleotide
gaacccacagttcatcaaagccaccatcgtg

SEQ ID NO: 200743 - DNA, 31 bp, Artificial Sequence
  Description of Artificial Sequence: Synthetic oligonucleotide
aacccacagttcatcaaagccaccatcgtgc

SEQ ID NO: 200744 - DNA, 30 bp, Artificial Sequence
  Description of Artificial Sequence: Synthetic oligonucleotide
acccacagttcatcaaagccaccatcgtgc

SEQ ID NO: 200745 - DNA, 29 bp, Artificial Sequence
  Description of Artificial Sequence: Synthetic oligonucleotide
cccacagttcatcaaagccaccatcgtgc

SEQ ID NO: 200746 - DNA, 30 bp, Artificial Sequence
  Description of Artificial Sequence: Synthetic oligonucleotide
ccacagttcatcaaagccaccatcgtgcac

SEQ ID NO: 200747 - DNA, 30 bp, Artificial Sequence
  Description of Artificial Sequence: Synthetic oligonucleotide
cacagttcatcaaagccaccatcgtgcacc

SEQ ID NO: 200748 - DNA, 32 bp, Artificial Sequence
  Description of Artificial Sequence: Synthetic oligonucleotide
acagttcatcaaagccaccatcgtgcaccaag

SEQ ID NO: 200749 - DNA, 31 bp, Artificial Sequence
  Description of Artificial Sequence: Synthetic oligonucleotide
cagttcatcaaagccaccatcgtgcaccaag

SEQ ID NO: 200750 - DNA, 32 bp, Artificial Sequence
  Description of Artificial Sequence: Synthetic oligonucleotide
agttcatcaaagccaccatcgtgcaccaagac

SEQ ID NO: 200751 - DNA, 31 bp, Artificial Sequence
  Description of Artificial Sequence: Synthetic oligonucleotide
gttcatcaaagccaccatcgtgcaccaagac

SEQ ID NO: 200752 - DNA, 31 bp, Artificial Sequence
  Description of Artificial Sequence: Synthetic oligonucleotide
ttcatcaaagccaccatcgtgcaccaagacc

SEQ ID NO: 200753 - DNA, 30 bp, Artificial Sequence
  Description of Artificial Sequence: Synthetic oligonucleotide
tcatcaaagccaccatcgtgcaccaagacc

SEQ ID NO: 200754 - DNA, 29 bp, Artificial Sequence
  Description of Artificial Sequence: Synthetic oligonucleotide
catcaaagccaccatcgtgcaccaagacc

SEQ ID NO: 200755 - DNA, 30 bp, Artificial Sequence
  Description of Artificial Sequence: Synthetic oligonucleotide
atcaaagccaccatcgtgcaccaagaccag

SEQ ID NO: 200756 - DNA, 29 bp, Artificial Sequence
  Description of Artificial Sequence: Synthetic oligonucleotide
tcaaagccaccatcgtgcaccaagaccag

SEQ ID NO: 200757 - DNA, 28 bp, Artificial Sequence
  Description of Artificial Sequence: Synthetic oligonucleotide
caaagccaccatcgtgcaccaagaccag

SEQ ID NO: 200758 - DNA, 28 bp, Artificial Sequence
  Description of Artificial Sequence: Synthetic oligonucleotide
aaagccaccatcgtgcaccaagaccagg

SEQ ID NO: 200759 - DNA, 27 bp, Artificial Sequence
  Description of Artificial Sequence: Synthetic oligonucleotide
aagccaccatcgtgcaccaagaccagg

SEQ ID NO: 200760 - DNA, 26 bp, Artificial Sequence
  Description of Artificial Sequence: Synthetic oligonucleotide
agccaccatcgtgcaccaagaccagg

SEQ ID NO: 200761 - DNA, 25 bp, Artificial Sequence
  Description of Artificial Sequence: Synthetic oligonucleotide
gccaccatcgtgcaccaagaccagg

SEQ ID NO: 200762 - DNA, 27 bp, Artificial Sequence
  Description of Artificial Sequence: Synthetic oligonucleotide
ccaccatcgtgcaccaagaccaggctt

SEQ ID NO: 200763 - DNA, 28 bp, Artificial Sequence
  Description of Artificial Sequence: Synthetic oligonucleotide
caccatcgtgcaccaagaccaggcttac

SEQ ID NO: 200764 - DNA, 28 bp, Artificial Sequence
  Description of Artificial Sequence: Synthetic oligonucleotide
accatcgtgcaccaagaccaggcttacg

SEQ ID NO: 200765 - DNA, 27 bp, Artificial Sequence
  Description of Artificial Sequence: Synthetic oligonucleotide
ccatcgtgcaccaagaccaggcttacg

SEQ ID NO: 200766 - DNA, 29 bp, Artificial Sequence
  Description of Artificial Sequence: Synthetic oligonucleotide
catcgtgcaccaagaccaggcttacgatg

SEQ ID NO: 200767 - DNA, 30 bp, Artificial Sequence
  Description of Artificial Sequence: Synthetic oligonucleotide
atcgtgcaccaagaccaggcttacgatgac

SEQ ID NO: 200768 - DNA, 29 bp, Artificial Sequence
  Description of Artificial Sequence: Synthetic oligonucleotide
tcgtgcaccaagaccaggcttacgatgac

SEQ ID NO: 200769 - DNA, 28 bp, Artificial Sequence
  Description of Artificial Sequence: Synthetic oligonucleotide
cgtgcaccaagaccaggcttacgatgac

SEQ ID NO: 200770 - DNA, 30 bp, Artificial Sequence
  Description of Artificial Sequence: Synthetic oligonucleotide
gtgcaccaagaccaggcttacgatgacaag

SEQ ID NO: 200771 - DNA, 32 bp, Artificial Sequence
  Description of Artificial Sequence: Synthetic oligonucleotide
tgcaccaagaccaggcttacgatgacaagatc

SEQ ID NO: 200772 - DNA, 31 bp, Artificial Sequence
  Description of Artificial Sequence: Synthetic oligonucleotide
gcaccaagaccaggcttacgatgacaagatc

SEQ ID NO: 200773 - DNA, 33 bp, Artificial Sequence
  Description of Artificial Sequence: Synthetic oligonucleotide
caccaagaccaggcttacgatgacaagatctac

SEQ ID NO: 200774 - DNA, 35 bp, Artificial Sequence
  Description of Artificial Sequence: Synthetic oligonucleotide
accaagaccaggcttacgatgacaagatctactac

SEQ ID NO: 200775 - DNA, 34 bp, Artificial Sequence
  Description of Artificial Sequence: Synthetic oligonucleotide
ccaagaccaggcttacgatgacaagatctactac

SEQ ID NO: 200776 - DNA, 36 bp, Artificial Sequence
  Description of Artificial Sequence: Synthetic oligonucleotide
caagaccaggcttacgatgacaagatctactacttc

SEQ ID NO: 200777 - DNA, 38 bp, Artificial Sequence
  Description of Artificial Sequence: Synthetic oligonucleotide
aagaccaggcttacgatgacaagatctactacttcttc

SEQ ID NO: 200778 - DNA, 37 bp, Artificial Sequence
  Description of Artificial Sequence: Synthetic oligonucleotide
agaccaggcttacgatgacaagatctactacttcttc

SEQ ID NO: 200779 - DNA, 36 bp, Artificial Sequence
  Description of Artificial Sequence: Synthetic oligonucleotide
gaccaggcttacgatgacaagatctactacttcttc

SEQ ID NO: 200780 - DNA, 36 bp, Artificial Sequence
  Description of Artificial Sequence: Synthetic oligonucleotide
accaggcttacgatgacaagatctactacttcttcc

SEQ ID NO: 200781 - DNA, 35 bp, Artificial Sequence
  Description of Artificial Sequence: Synthetic oligonucleotide
ccaggcttacgatgacaagatctactacttcttcc

SEQ ID NO: 200782 - DNA, 35 bp, Artificial Sequence
  Description of Artificial Sequence: Synthetic oligonucleotide
caggcttacgatgacaagatctactacttcttccg

SEQ ID NO: 200783 - DNA, 36 bp, Artificial Sequence
  Description of Artificial Sequence: Synthetic oligonucleotide
aggcttacgatgacaagatctactacttcttccgag

SEQ ID NO: 200784 - DNA, 35 bp, Artificial Sequence
  Description of Artificial Sequence: Synthetic oligonucleotide
ggcttacgatgacaagatctactacttcttccgag

SEQ ID NO: 200785 - DNA, 36 bp, Artificial Sequence
  Description of Artificial Sequence: Synthetic oligonucleotide
gcttacgatgacaagatctactacttcttccgagag

SEQ ID NO: 200786 - DNA, 36 bp, Artificial Sequence
  Description of Artificial Sequence: Synthetic oligonucleotide
cttacgatgacaagatctactacttcttccgagagg

SEQ ID NO: 200787 - DNA, 37 bp, Artificial Sequence
  Description of Artificial Sequence: Synthetic oligonucleotide
ttacgatgacaagatctactacttcttccgagaggac

SEQ ID NO: 200788 - DNA, 36 bp, Artificial Sequence
  Description of Artificial Sequence: Synthetic oligonucleotide
tacgatgacaagatctactacttcttccgagaggac

SEQ ID NO: 200789 - DNA, 35 bp, Artificial Sequence
  Description of Artificial Sequence: Synthetic oligonucleotide
acgatgacaagatctactacttcttccgagaggac

SEQ ID NO: 200790 - DNA, 34 bp, Artificial Sequence
  Description of Artificial Sequence: Synthetic oligonucleotide
cgatgacaagatctactacttcttccgagaggac

SEQ ID NO: 200791 - DNA, 37 bp, Artificial Sequence
  Description of Artificial Sequence: Synthetic oligonucleotide
gatgacaagatctactacttcttccgagaggacaatc

SEQ ID NO: 200792 - DNA, 37 bp, Artificial Sequence
  Description of Artificial Sequence: Synthetic oligonucleotide
atgacaagatctactacttcttccgagaggacaatcc

SEQ ID NO: 200793 - DNA, 36 bp, Artificial Sequence
  Description of Artificial Sequence: Synthetic oligonucleotide
tgacaagatctactacttcttccgagaggacaatcc

SEQ ID NO: 200794 - DNA, 35 bp, Artificial Sequence
  Description of Artificial Sequence: Synthetic oligonucleotide
gacaagatctactacttcttccgagaggacaatcc

SEQ ID NO: 200795 - DNA, 36 bp, Artificial Sequence
  Description of Artificial Sequence: Synthetic oligonucleotide
acaagatctactacttcttccgagaggacaatcctg

SEQ ID NO: 200796 - DNA, 35 bp, Artificial Sequence
  Description of Artificial Sequence: Synthetic oligonucleotide
caagatctactacttcttccgagaggacaatcctg

SEQ ID NO: 200797 - DNA, 36 bp, Artificial Sequence
  Description of Artificial Sequence: Synthetic oligonucleotide
aagatctactacttcttccgagaggacaatcctgac

SEQ ID NO: 200798 - DNA, 35 bp, Artificial Sequence
  Description of Artificial Sequence: Synthetic oligonucleotide
agatctactacttcttccgagaggacaatcctgac

SEQ ID NO: 200799 - DNA, 34 bp, Artificial Sequence
  Description of Artificial Sequence: Synthetic oligonucleotide
gatctactacttcttccgagaggacaatcctgac

SEQ ID NO: 200800 - DNA, 36 bp, Artificial Sequence
  Description of Artificial Sequence: Synthetic oligonucleotide
atctactacttcttccgagaggacaatcctgacaag

SEQ ID NO: 200801 - DNA, 35 bp, Artificial Sequence
  Description of Artificial Sequence: Synthetic oligonucleotide
tctactacttcttccgagaggacaatcctgacaag

SEQ ID NO: 200802 - DNA, 34 bp, Artificial Sequence
  Description of Artificial Sequence: Synthetic oligonucleotide
ctactacttcttccgagaggacaatcctgacaag

SEQ ID NO: 200803 - DNA, 37 bp, Artificial Sequence
  Description of Artificial Sequence: Synthetic oligonucleotide
tactacttcttccgagaggacaatcctgacaagaatc

SEQ ID NO: 200804 - DNA, 36 bp, Artificial Sequence
  Description of Artificial Sequence: Synthetic oligonucleotide
actacttcttccgagaggacaatcctgacaagaatc

SEQ ID NO: 200805 - DNA, 35 bp, Artificial Sequence
  Description of Artificial Sequence: Synthetic oligonucleotide
ctacttcttccgagaggacaatcctgacaagaatc

SEQ ID NO: 200806 - DNA, 35 bp, Artificial Sequence
  Description of Artificial Sequence: Synthetic oligonucleotide
tacttcttccgagaggacaatcctgacaagaatcc

SEQ ID NO: 200807 - DNA, 34 bp, Artificial Sequence
  Description of Artificial Sequence: Synthetic oligonucleotide
acttcttccgagaggacaatcctgacaagaatcc

SEQ ID NO: 200808 - DNA, 33 bp, Artificial Sequence
  Description of Artificial Sequence: Synthetic oligonucleotide
cttcttccgagaggacaatcctgacaagaatcc

SEQ ID NO: 200809 - DNA, 34 bp, Artificial Sequence
  Description of Artificial Sequence: Synthetic oligonucleotide
ttcttccgagaggacaatcctgacaagaatcctg

SEQ ID NO: 200810 - DNA, 33 bp, Artificial Sequence
  Description of Artificial Sequence: Synthetic oligonucleotide
tcttccgagaggacaatcctgacaagaatcctg

SEQ ID NO: 200811 - DNA, 32 bp, Artificial Sequence
  Description of Artificial Sequence: Synthetic oligonucleotide
cttccgagaggacaatcctgacaagaatcctg

SEQ ID NO: 200812 - DNA, 33 bp, Artificial Sequence
  Description of Artificial Sequence: Synthetic oligonucleotide
ttccgagaggacaatcctgacaagaatcctgag

SEQ ID NO: 200813 - DNA, 32 bp, Artificial Sequence
  Description of Artificial Sequence: Synthetic oligonucleotide
tccgagaggacaatcctgacaagaatcctgag

SEQ ID NO: 200814 - DNA, 31 bp, Artificial Sequence
  Description of Artificial Sequence: Synthetic oligonucleotide
ccgagaggacaatcctgacaagaatcctgag

SEQ ID NO: 200815 - DNA, 31 bp, Artificial Sequence
  Description of Artificial Sequence: Synthetic oligonucleotide
cgagaggacaatcctgacaagaatcctgagg

SEQ ID NO: 200816 - DNA, 31 bp, Artificial Sequence
  Description of Artificial Sequence: Synthetic oligonucleotide
gagaggacaatcctgacaagaatcctgaggc

SEQ ID NO: 200817 - DNA, 32 bp, Artificial Sequence
  Description of Artificial Sequence: Synthetic oligonucleotide
agaggacaatcctgacaagaatcctgaggctc

SEQ ID NO: 200818 - DNA, 31 bp, Artificial Sequence
  Description of Artificial Sequence: Synthetic oligonucleotide
gaggacaatcctgacaagaatcctgaggctc

SEQ ID NO: 200819 - DNA, 31 bp, Artificial Sequence
  Description of Artificial Sequence: Synthetic oligonucleotide
aggacaatcctgacaagaatcctgaggctcc

SEQ ID NO: 200820 - DNA, 30 bp, Artificial Sequence
  Description of Artificial Sequence: Synthetic oligonucleotide
ggacaatcctgacaagaatcctgaggctcc

SEQ ID NO: 200821 - DNA, 31 bp, Artificial Sequence
  Description of Artificial Sequence: Synthetic oligonucleotide
gacaatcctgacaagaatcctgaggctcctc

SEQ ID NO: 200822 - DNA, 32 bp, Artificial Sequence
  Description of Artificial Sequence: Synthetic oligonucleotide
acaatcctgacaagaatcctgaggctcctctc

SEQ ID NO: 200823 - DNA, 31 bp, Artificial Sequence
  Description of Artificial Sequence: Synthetic oligonucleotide
caatcctgacaagaatcctgaggctcctctc

SEQ ID NO: 200824 - DNA, 34 bp, Artificial Sequence
  Description of Artificial Sequence: Synthetic oligonucleotide
aatcctgacaagaatcctgaggctcctctcaatg

SEQ ID NO: 200825 - DNA, 33 bp, Artificial Sequence
  Description of Artificial Sequence: Synthetic oligonucleotide
atcctgacaagaatcctgaggctcctctcaatg

SEQ ID NO: 200826 - DNA, 32 bp, Artificial Sequence
  Description of Artificial Sequence: Synthetic oligonucleotide
tcctgacaagaatcctgaggctcctctcaatg

SEQ ID NO: 200827 - DNA, 31 bp, Artificial Sequence
  Description of Artificial Sequence: Synthetic oligonucleotide
cctgacaagaatcctgaggctcctctcaatg

SEQ ID NO: 200828 - DNA, 32 bp, Artificial Sequence
  Description of Artificial Sequence: Synthetic oligonucleotide
ctgacaagaatcctgaggctcctctcaatgtg

SEQ ID NO: 200829 - DNA, 33 bp, Artificial Sequence
  Description of Artificial Sequence: Synthetic oligonucleotide
tgacaagaatcctgaggctcctctcaatgtgtc

SEQ ID NO: 200830 - DNA, 32 bp, Artificial Sequence
  Description of Artificial Sequence: Synthetic oligonucleotide
gacaagaatcctgaggctcctctcaatgtgtc

SEQ ID NO: 200831 - DNA, 32 bp, Artificial Sequence
  Description of Artificial Sequence: Synthetic oligonucleotide
acaagaatcctgaggctcctctcaatgtgtcc

SEQ ID NO: 200832 - DNA, 31 bp, Artificial Sequence
  Description of Artificial Sequence: Synthetic oligonucleotide
caagaatcctgaggctcctctcaatgtgtcc

SEQ ID NO: 200833 - DNA, 31 bp, Artificial Sequence
  Description of Artificial Sequence: Synthetic oligonucleotide
aagaatcctgaggctcctctcaatgtgtccc

SEQ ID NO: 200834 - DNA, 30 bp, Artificial Sequence
  Description of Artificial Sequence: Synthetic oligonucleotide
agaatcctgaggctcctctcaatgtgtccc

SEQ ID NO: 200835 - DNA, 29 bp, Artificial Sequence
  Description of Artificial Sequence: Synthetic oligonucleotide
gaatcctgaggctcctctcaatgtgtccc

SEQ ID NO: 200836 - DNA, 29 bp, Artificial Sequence
  Description of Artificial Sequence: Synthetic oligonucleotide
aatcctgaggctcctctcaatgtgtcccg

SEQ ID NO: 200837 - DNA, 28 bp, Artificial Sequence
  Description of Artificial Sequence: Synthetic oligonucleotide
atcctgaggctcctctcaatgtgtcccg

SEQ ID NO: 200838 - DNA, 27 bp, Artificial Sequence
  Description of Artificial Sequence: Synthetic oligonucleotide
tcctgaggctcctctcaatgtgtcccg

SEQ ID NO: 200839 - DNA, 27 bp, Artificial Sequence
  Description of Artificial Sequence: Synthetic oligonucleotide
cctgaggctcctctcaatgtgtcccgt

SEQ ID NO: 200840 - DNA, 27 bp, Artificial Sequence
  Description of Artificial Sequence: Synthetic oligonucleotide
ctgaggctcctctcaatgtgtcccgtg

SEQ ID NO: 200841 - DNA, 28 bp, Artificial Sequence
  Description of Artificial Sequence: Synthetic oligonucleotide
tgaggctcctctcaatgtgtcccgtgtg

SEQ ID NO: 200842 - DNA, 27 bp, Artificial Sequence
  Description of Artificial Sequence: Synthetic oligonucleotide
gaggctcctctcaatgtgtcccgtgtg

SEQ ID NO: 200843 - DNA, 27 bp, Artificial Sequence
  Description of Artificial Sequence: Synthetic oligonucleotide
aggctcctctcaatgtgtcccgtgtgg

SEQ ID NO: 200844 - DNA, 26 bp, Artificial Sequence
  Description of Artificial Sequence: Synthetic oligonucleotide
ggctcctctcaatgtgtcccgtgtgg

SEQ ID NO: 200845 - DNA, 26 bp, Artificial Sequence
  Description of Artificial Sequence: Synthetic oligonucleotide
gctcctctcaatgtgtcccgtgtggc

SEQ ID NO: 200846 - DNA, 26 bp, Artificial Sequence
  Description of Artificial Sequence: Synthetic oligonucleotide
ctcctctcaatgtgtcccgtgtggcc

SEQ ID NO: 200847 - DNA, 27 bp, Artificial Sequence
  Description of Artificial Sequence: Synthetic oligonucleotide
tcctctcaatgtgtcccgtgtggccca

SEQ ID NO: 200848 - DNA, 26 bp, Artificial Sequence
  Description of Artificial Sequence: Synthetic oligonucleotide
cctctcaatgtgtcccgtgtggccca

SEQ ID NO: 200849 - DNA, 27 bp, Artificial Sequence
  Description of Artificial Sequence: Synthetic oligonucleotide
ctctcaatgtgtcccgtgtggcccagt

SEQ ID NO: 200850 - DNA, 28 bp, Artificial Sequence
  Description of Artificial Sequence: Synthetic oligonucleotide
tctcaatgtgtcccgtgtggcccagttg

SEQ ID NO: 200851 - DNA, 27 bp, Artificial Sequence
  Description of Artificial Sequence: Synthetic oligonucleotide
ctcaatgtgtcccgtgtggcccagttg

SEQ ID NO: 200852 - DNA, 28 bp, Artificial Sequence
  Description of Artificial Sequence: Synthetic oligonucleotide
tcaatgtgtcccgtgtggcccagttgtg

SEQ ID NO: 200853 - DNA, 27 bp, Artificial Sequence
  Description of Artificial Sequence: Synthetic oligonucleotide
caatgtgtcccgtgtggcccagttgtg

SEQ ID NO: 200854 - DNA, 27 bp, Artificial Sequence
  Description of Artificial Sequence: Synthetic oligonucleotide
aatgtgtcccgtgtggcccagttgtgc

SEQ ID NO: 200855 - DNA, 27 bp, Artificial Sequence
  Description of Artificial Sequence: Synthetic oligonucleotide
atgtgtcccgtgtggcccagttgtgca

SEQ ID NO: 200856 - DNA, 26 bp, Artificial Sequence
  Description of Artificial Sequence: Synthetic oligonucleotide
tgtgtcccgtgtggcccagttgtgca

SEQ ID NO: 200857 - DNA, 25 bp, Artificial Sequence
  Description of Artificial Sequence: Synthetic oligonucleotide
gtgtcccgtgtggcccagttgtgca

SEQ ID NO: 200858 - DNA, 25 bp, Artificial Sequence
  Description of Artificial Sequence: Synthetic oligonucleotide
tgtcccgtgtggcccagttgtgcag

SEQ ID NO: 200859 - DNA, 24 bp, Artificial Sequence
  Description of Artificial Sequence: Synthetic oligonucleotide
gtcccgtgtggcccagttgtgcag

SEQ ID NO: 200860 - DNA, 24 bp, Artificial Sequence
  Description of Artificial Sequence: Synthetic oligonucleotide
tcccgtgtggcccagttgtgcagg

SEQ ID NO: 200861 - DNA, 23 bp, Artificial Sequence
  Description of Artificial Sequence: Synthetic oligonucleotide
cccgtgtggcccagttgtgcagg

SEQ ID NO: 200862 - DNA, 23 bp, Artificial Sequence
  Description of Artificial Sequence: Synthetic oligonucleotide
ccgtgtggcccagttgtgcaggg

SEQ ID NO: 200863 - DNA, 23 bp, Artificial Sequence
  Description of Artificial Sequence: Synthetic oligonucleotide
cgtgtggcccagttgtgcagggg

SEQ ID NO: 200864 - DNA, 23 bp, Artificial Sequence
  Description of Artificial Sequence: Synthetic oligonucleotide
gtgtggcccagttgtgcaggggg

SEQ ID NO: 200865 - DNA, 24 bp, Artificial Sequence
  Description of Artificial Sequence: Synthetic oligonucleotide
tgtggcccagttgtgcagggggga

SEQ ID NO: 200866 - DNA, 23 bp, Artificial Sequence
  Description of Artificial Sequence: Synthetic oligonucleotide
gtggcccagttgtgcagggggga

SEQ ID NO: 200867 - DNA, 23 bp, Artificial Sequence
  Description of Artificial Sequence: Synthetic oligonucleotide
tggcccagttgtgcaggggggac

SEQ ID NO: 200868 - DNA, 22 bp, Artificial Sequence
  Description of Artificial Sequence: Synthetic oligonucleotide
ggcccagttgtgcaggggggac

SEQ ID NO: 200869 - DNA, 23 bp, Artificial Sequence
  Description of Artificial Sequence: Synthetic oligonucleotide
gcccagttgtgcaggggggacca

SEQ ID NO: 200870 - DNA, 23 bp, Artificial Sequence
  Description of Artificial Sequence: Synthetic oligonucleotide
cccagttgtgcaggggggaccag

SEQ ID NO: 200871 - DNA, 23 bp, Artificial Sequence
  Description of Artificial Sequence: Synthetic oligonucleotide
ccagttgtgcaggggggaccagg

SEQ ID NO: 200872 - DNA, 24 bp, Artificial Sequence
  Description of Artificial Sequence: Synthetic oligonucleotide
cagttgtgcaggggggaccagggt

SEQ ID NO: 200873 - DNA, 24 bp, Artificial Sequence
  Description of Artificial Sequence: Synthetic oligonucleotide
agttgtgcaggggggaccagggtg

SEQ ID NO: 200874 - DNA, 23 bp, Artificial Sequence
  Description of Artificial Sequence: Synthetic oligonucleotide
gttgtgcaggggggaccagggtg

SEQ ID NO: 200875 - DNA, 23 bp, Artificial Sequence
  Description of Artificial Sequence: Synthetic oligonucleotide
ttgtgcaggggggaccagggtgg

SEQ ID NO: 200876 - DNA, 22 bp, Artificial Sequence
  Description of Artificial Sequence: Synthetic oligonucleotide
tgtgcaggggggaccagggtgg

SEQ ID NO: 200877 - DNA, 21 bp, Artificial Sequence
  Description of Artificial Sequence: Synthetic oligonucleotide
gtgcaggggggaccagggtgg

SEQ ID NO: 200878 - DNA, 21 bp, Artificial Sequence
  Description of Artificial Sequence: Synthetic oligonucleotide
tgcaggggggaccagggtggg

SEQ ID NO: 200879 - DNA, 20 bp, Artificial Sequence
  Description of Artificial Sequence: Synthetic oligonucleotide
gcaggggggaccagggtggg

SEQ ID NO: 200880 - DNA, 23 bp, Artificial Sequence
  Description of Artificial Sequence: Synthetic oligonucleotide
caggggggaccagggtggggaaa

SEQ ID NO: 200881 - DNA, 25 bp, Artificial Sequence
  Description of Artificial Sequence: Synthetic oligonucleotide
aggggggaccagggtggggaaagtt

SEQ ID NO: 200882 - DNA, 24 bp, Artificial Sequence
  Description of Artificial Sequence: Synthetic oligonucleotide
ggggggaccagggtggggaaagtt

SEQ ID NO: 200883 - DNA, 25 bp, Artificial Sequence
  Description of Artificial Sequence: Synthetic oligonucleotide
gggggaccagggtggggaaagttca

SEQ ID NO: 200884 - DNA, 26 bp, Artificial Sequence
  Description of Artificial Sequence: Synthetic oligonucleotide
ggggaccagggtggggaaagttcact

SEQ ID NO: 200885 - DNA, 27 bp, Artificial Sequence
  Description of Artificial Sequence: Synthetic oligonucleotide
gggaccagggtggggaaagttcactgt

SEQ ID NO: 200886 - DNA, 27 bp, Artificial Sequence
  Description of Artificial Sequence: Synthetic oligonucleotide
ggaccagggtggggaaagttcactgtc

SEQ ID NO: 200887 - DNA, 28 bp, Artificial Sequence
  Description of Artificial Sequence: Synthetic oligonucleotide
gaccagggtggggaaagttcactgtcag

SEQ ID NO: 200888 - DNA, 29 bp, Artificial Sequence
  Description of Artificial Sequence: Synthetic oligonucleotide
accagggtggggaaagttcactgtcagtc

SEQ ID NO: 200889 - DNA, 28 bp, Artificial Sequence
  Description of Artificial Sequence: Synthetic oligonucleotide
ccagggtggggaaagttcactgtcagtc

SEQ ID NO: 200890 - DNA, 29 bp, Artificial Sequence
  Description of Artificial Sequence: Synthetic oligonucleotide
cagggtggggaaagttcactgtcagtctc

SEQ ID NO: 200891 - DNA, 29 bp, Artificial Sequence
  Description of Artificial Sequence: Synthetic oligonucleotide
agggtggggaaagttcactgtcagtctcc

SEQ ID NO: 200892 - DNA, 28 bp, Artificial Sequence
  Description of Artificial Sequence: Synthetic oligonucleotide
gggtggggaaagttcactgtcagtctcc

SEQ ID NO: 200893 - DNA, 30 bp, Artificial Sequence
  Description of Artificial Sequence: Synthetic oligonucleotide
ggtggggaaagttcactgtcagtctccaag

SEQ ID NO: 200894 - DNA, 31 bp, Artificial Sequence
  Description of Artificial Sequence: Synthetic oligonucleotide
gtggggaaagttcactgtcagtctccaagtg

SEQ ID NO: 200895 - DNA, 31 bp, Artificial Sequence
  Description of Artificial Sequence: Synthetic oligonucleotide
tggggaaagttcactgtcagtctccaagtgg

SEQ ID NO: 200896 - DNA, 30 bp, Artificial Sequence
  Description of Artificial Sequence: Synthetic oligonucleotide
ggggaaagttcactgtcagtctccaagtgg

SEQ ID NO: 200897 - DNA, 32 bp, Artificial Sequence
  Description of Artificial Sequence: Synthetic oligonucleotide
gggaaagttcactgtcagtctccaagtggaac

SEQ ID NO: 200898 - DNA, 33 bp, Artificial Sequence
  Description of Artificial Sequence: Synthetic oligonucleotide
ggaaagttcactgtcagtctccaagtggaacac

SEQ ID NO: 200899 - DNA, 37 bp, Artificial Sequence
  Description of Artificial Sequence: Synthetic oligonucleotide
gaaagttcactgtcagtctccaagtggaacacttttc

SEQ ID NO: 200900 - DNA, 38 bp, Artificial Sequence
  Description of Artificial Sequence: Synthetic oligonucleotide
aaagttcactgtcagtctccaagtggaacacttttctg

SEQ ID NO: 200901 - DNA, 37 bp, Artificial Sequence
  Description of Artificial Sequence: Synthetic oligonucleotide
aagttcactgtcagtctccaagtggaacacttttctg

SEQ ID NO: 200902 - DNA, 36 bp, Artificial Sequence
  Description of Artificial Sequence: Synthetic oligonucleotide
agttcactgtcagtctccaagtggaacacttttctg

SEQ ID NO: 200903 - DNA, 35 bp, Artificial Sequence
  Description of Artificial Sequence: Synthetic oligonucleotide
gttcactgtcagtctccaagtggaacacttttctg

SEQ ID NO: 200904 - DNA, 38 bp, Artificial Sequence
  Description of Artificial Sequence: Synthetic oligonucleotide
ttcactgtcagtctccaagtggaacacttttctgaaag

SEQ ID NO: 200905 - DNA, 37 bp, Artificial Sequence
  Description of Artificial Sequence: Synthetic oligonucleotide
tcactgtcagtctccaagtggaacacttttctgaaag

SEQ ID NO: 200906 - DNA, 36 bp, Artificial Sequence
  Description of Artificial Sequence: Synthetic oligonucleotide
cactgtcagtctccaagtggaacacttttctgaaag

SEQ ID NO: 200907 - DNA, 36 bp, Artificial Sequence
  Description of Artificial Sequence: Synthetic oligonucleotide
actgtcagtctccaagtggaacacttttctgaaagc

SEQ ID NO: 200908 - DNA, 35 bp, Artificial Sequence
  Description of Artificial Sequence: Synthetic oligonucleotide
ctgtcagtctccaagtggaacacttttctgaaagc

SEQ ID NO: 200909 - DNA, 35 bp, Artificial Sequence
  Description of Artificial Sequence: Synthetic oligonucleotide
tgtcagtctccaagtggaacacttttctgaaagcc

SEQ ID NO: 200910 - DNA, 34 bp, Artificial Sequence
  Description of Artificial Sequence: Synthetic oligonucleotide
gtcagtctccaagtggaacacttttctgaaagcc

SEQ ID NO: 200911 - DNA, 36 bp, Artificial Sequence
  Description of Artificial Sequence: Synthetic oligonucleotide
tcagtctccaagtggaacacttttctgaaagccatg

SEQ ID NO: 200912 - DNA, 35 bp, Artificial Sequence
  Description of Artificial Sequence: Synthetic oligonucleotide
cagtctccaagtggaacacttttctgaaagccatg

SEQ ID NO: 200913 - DNA, 35 bp, Artificial Sequence
  Description of Artificial Sequence: Synthetic oligonucleotide
agtctccaagtggaacacttttctgaaagccatgc

SEQ ID NO: 200914 - DNA, 34 bp, Artificial Sequence
  Description of Artificial Sequence: Synthetic oligonucleotide
gtctccaagtggaacacttttctgaaagccatgc

SEQ ID NO: 200915 - DNA, 35 bp, Artificial Sequence
  Description of Artificial Sequence: Synthetic oligonucleotide
tctccaagtggaacacttttctgaaagccatgctg

SEQ ID NO: 200916 - DNA, 34 bp, Artificial Sequence
  Description of Artificial Sequence: Synthetic oligonucleotide
ctccaagtggaacacttttctgaaagccatgctg

SEQ ID NO: 200917 - DNA, 34 bp, Artificial Sequence
  Description of Artificial Sequence: Synthetic oligonucleotide
tccaagtggaacacttttctgaaagccatgctgg

SEQ ID NO: 200918 - DNA, 33 bp, Artificial Sequence
  Description of Artificial Sequence: Synthetic oligonucleotide
ccaagtggaacacttttctgaaagccatgctgg

SEQ ID NO: 200919 - DNA, 36 bp, Artificial Sequence
  Description of Artificial Sequence: Synthetic oligonucleotide
caagtggaacacttttctgaaagccatgctggtatg

SEQ ID NO: 200920 - DNA, 36 bp, Artificial Sequence
  Description of Artificial Sequence: Synthetic oligonucleotide
aagtggaacacttttctgaaagccatgctggtatgc

SEQ ID NO: 200921 - DNA, 35 bp, Artificial Sequence
  Description of Artificial Sequence: Synthetic oligonucleotide
agtggaacacttttctgaaagccatgctggtatgc

SEQ ID NO: 200922 - DNA, 34 bp, Artificial Sequence
  Description of Artificial Sequence: Synthetic oligonucleotide
gtggaacacttttctgaaagccatgctggtatgc

SEQ ID NO: 200923 - DNA, 35 bp, Artificial Sequence
  Description of Artificial Sequence: Synthetic oligonucleotide
tggaacacttttctgaaagccatgctggtatgcag

SEQ ID NO: 200924 - DNA, 34 bp, Artificial Sequence
  Description of Artificial Sequence: Synthetic oligonucleotide
ggaacacttttctgaaagccatgctggtatgcag

SEQ ID NO: 200925 - DNA, 35 bp, Artificial Sequence
  Description of Artificial Sequence: Synthetic oligonucleotide
gaacacttttctgaaagccatgctggtatgcagtg

SEQ ID NO: 200926 - DNA, 37 bp, Artificial Sequence
  Description of Artificial Sequence: Synthetic oligonucleotide
aacacttttctgaaagccatgctggtatgcagtgatg

SEQ ID NO: 200927 - DNA, 36 bp, Artificial Sequence
  Description of Artificial Sequence: Synthetic oligonucleotide
acacttttctgaaagccatgctggtatgcagtgatg

SEQ ID NO: 200928 - DNA, 35 bp, Artificial Sequence
  Description of Artificial Sequence: Synthetic oligonucleotide
cacttttctgaaagccatgctggtatgcagtgatg

SEQ ID NO: 200929 - DNA, 35 bp, Artificial Sequence
  Description of Artificial Sequence: Synthetic oligonucleotide
acttttctgaaagccatgctggtatgcagtgatgc

SEQ ID NO: 200930 - DNA, 34 bp, Artificial Sequence
  Description of Artificial Sequence: Synthetic oligonucleotide
cttttctgaaagccatgctggtatgcagtgatgc

SEQ ID NO: 200931 - DNA, 35 bp, Artificial Sequence
  Description of Artificial Sequence: Synthetic oligonucleotide
ttttctgaaagccatgctggtatgcagtgatgctg

SEQ ID NO: 200932 - DNA, 34 bp, Artificial Sequence
  Description of Artificial Sequence: Synthetic oligonucleotide
tttctgaaagccatgctggtatgcagtgatgctg

SEQ ID NO: 200933 - DNA, 33 bp, Artificial Sequence
  Description of Artificial Sequence: Synthetic oligonucleotide
ttctgaaagccatgctggtatgcagtgatgctg

SEQ ID NO: 200934 - DNA, 32 bp, Artificial Sequence
  Description of Artificial Sequence: Synthetic oligonucleotide
tctgaaagccatgctggtatgcagtgatgctg

SEQ ID NO: 200935 - DNA, 31 bp, Artificial Sequence
  Description of Artificial Sequence: Synthetic oligonucleotide
ctgaaagccatgctggtatgcagtgatgctg

SEQ ID NO: 200936 - DNA, 31 bp, Artificial Sequence
  Description of Artificial Sequence: Synthetic oligonucleotide
tgaaagccatgctggtatgcagtgatgctgc

SEQ ID NO: 200937 - DNA, 30 bp, Artificial Sequence
  Description of Artificial Sequence: Synthetic oligonucleotide
gaaagccatgctggtatgcagtgatgctgc

SEQ ID NO: 200938 - DNA, 30 bp, Artificial Sequence
  Description of Artificial Sequence: Synthetic oligonucleotide
aaagccatgctggtatgcagtgatgctgcc

SEQ ID NO: 200939 - DNA, 29 bp, Artificial Sequence
  Description of Artificial Sequence: Synthetic oligonucleotide
aagccatgctggtatgcagtgatgctgcc

SEQ ID NO: 200940 - DNA, 28 bp, Artificial Sequence
  Description of Artificial Sequence: Synthetic oligonucleotide
agccatgctggtatgcagtgatgctgcc

SEQ ID NO: 200941 - DNA, 27 bp, Artificial Sequence
  Description of Artificial Sequence: Synthetic oligonucleotide
gccatgctggtatgcagtgatgctgcc

SEQ ID NO: 200942 - DNA, 28 bp, Artificial Sequence
  Description of Artificial Sequence: Synthetic oligonucleotide
ccatgctggtatgcagtgatgctgccac

SEQ ID NO: 200943 - DNA, 28 bp, Artificial Sequence
  Description of Artificial Sequence: Synthetic oligonucleotide
catgctggtatgcagtgatgctgccacc

SEQ ID NO: 200944 - DNA, 30 bp, Artificial Sequence
  Description of Artificial Sequence: Synthetic oligonucleotide
atgctggtatgcagtgatgctgccaccaac

SEQ ID NO: 200945 - DNA, 29 bp, Artificial Sequence
  Description of Artificial Sequence: Synthetic oligonucleotide
tgctggtatgcagtgatgctgccaccaac

SEQ ID NO: 200946 - DNA, 28 bp, Artificial Sequence
  Description of Artificial Sequence: Synthetic oligonucleotide
gctggtatgcagtgatgctgccaccaac

SEQ ID NO: 200947 - DNA, 30 bp, Artificial Sequence
  Description of Artificial Sequence: Synthetic oligonucleotide
ctggtatgcagtgatgctgccaccaacaag

SEQ ID NO: 200948 - DNA, 32 bp, Artificial Sequence
  Description of Artificial Sequence: Synthetic oligonucleotide
tggtatgcagtgatgctgccaccaacaagaac

SEQ ID NO: 200949 - DNA, 31 bp, Artificial Sequence
  Description of Artificial Sequence: Synthetic oligonucleotide
ggtatgcagtgatgctgccaccaacaagaac

SEQ ID NO: 200950 - DNA, 33 bp, Artificial Sequence
  Description of Artificial Sequence: Synthetic oligonucleotide
gtatgcagtgatgctgccaccaacaagaacttc

SEQ ID NO: 200951 - DNA, 35 bp, Artificial Sequence
  Description of Artificial Sequence: Synthetic oligonucleotide
tatgcagtgatgctgccaccaacaagaacttcaac

SEQ ID NO: 200952 - DNA, 34 bp, Artificial Sequence
  Description of Artificial Sequence: Synthetic oligonucleotide
atgcagtgatgctgccaccaacaagaacttcaac

SEQ ID NO: 200953 - DNA, 33 bp, Artificial Sequence
  Description of Artificial Sequence: Synthetic oligonucleotide
tgcagtgatgctgccaccaacaagaacttcaac

SEQ ID NO: 200954 - DNA, 32 bp, Artificial Sequence
  Description of Artificial Sequence: Synthetic oligonucleotide
gcagtgatgctgccaccaacaagaacttcaac

SEQ ID NO: 200955 - DNA, 33 bp, Artificial Sequence
  Description of Artificial Sequence: Synthetic oligonucleotide
cagtgatgctgccaccaacaagaacttcaacag

SEQ ID NO: 200956 - DNA, 33 bp, Artificial Sequence
  Description of Artificial Sequence: Synthetic oligonucleotide
agtgatgctgccaccaacaagaacttcaacagg

SEQ ID NO: 200957 - DNA, 32 bp, Artificial Sequence
  Description of Artificial Sequence: Synthetic oligonucleotide
gtgatgctgccaccaacaagaacttcaacagg

SEQ ID NO: 200958 - DNA, 32 bp, Artificial Sequence
  Description of Artificial Sequence: Synthetic oligonucleotide
tgatgctgccaccaacaagaacttcaacaggc

SEQ ID NO: 200959 - DNA, 31 bp, Artificial Sequence
  Description of Artificial Sequence: Synthetic oligonucleotide
gatgctgccaccaacaagaacttcaacaggc

SEQ ID NO: 200960 - DNA, 32 bp, Artificial Sequence
  Description of Artificial Sequence: Synthetic oligonucleotide
atgctgccaccaacaagaacttcaacaggctg

SEQ ID NO: 200961 - DNA, 31 bp, Artificial Sequence
  Description of Artificial Sequence: Synthetic oligonucleotide
tgctgccaccaacaagaacttcaacaggctg

SEQ ID NO: 200962 - DNA, 30 bp, Artificial Sequence
  Description of Artificial Sequence: Synthetic oligonucleotide
gctgccaccaacaagaacttcaacaggctg

SEQ ID NO: 200963 - DNA, 30 bp, Artificial Sequence
  Description of Artificial Sequence: Synthetic oligonucleotide
ctgccaccaacaagaacttcaacaggctgc

SEQ ID NO: 200964 - DNA, 32 bp, Artificial Sequence
  Description of Artificial Sequence: Synthetic oligonucleotide
tgccaccaacaagaacttcaacaggctgcaag

SEQ ID NO: 200965 - DNA, 31 bp, Artificial Sequence
  Description of Artificial Sequence: Synthetic oligonucleotide
gccaccaacaagaacttcaacaggctgcaag

SEQ ID NO: 200966 - DNA, 32 bp, Artificial Sequence
  Description of Artificial Sequence: Synthetic oligonucleotide
ccaccaacaagaacttcaacaggctgcaagac

SEQ ID NO: 200967 - DNA, 32 bp, Artificial Sequence
  Description of Artificial Sequence: Synthetic oligonucleotide
caccaacaagaacttcaacaggctgcaagacg

SEQ ID NO: 200968 - DNA, 33 bp, Artificial Sequence
  Description of Artificial Sequence: Synthetic oligonucleotide
accaacaagaacttcaacaggctgcaagacgtc

SEQ ID NO: 200969 - DNA, 32 bp, Artificial Sequence
  Description of Artificial Sequence: Synthetic oligonucleotide
ccaacaagaacttcaacaggctgcaagacgtc

SEQ ID NO: 200970 - DNA, 34 bp, Artificial Sequence
  Description of Artificial Sequence: Synthetic oligonucleotide
caacaagaacttcaacaggctgcaagacgtcttc

SEQ ID NO: 200971 - DNA, 34 bp, Artificial Sequence
  Description of Artificial Sequence: Synthetic oligonucleotide
aacaagaacttcaacaggctgcaagacgtcttcc

SEQ ID NO: 200972 - DNA, 33 bp, Artificial Sequence
  Description of Artificial Sequence: Synthetic oligonucleotide
acaagaacttcaacaggctgcaagacgtcttcc

SEQ ID NO: 200973 - DNA, 32 bp, Artificial Sequence
  Description of Artificial Sequence: Synthetic oligonucleotide
caagaacttcaacaggctgcaagacgtcttcc

SEQ ID NO: 200974 - DNA, 33 bp, Artificial Sequence
  Description of Artificial Sequence: Synthetic oligonucleotide
aagaacttcaacaggctgcaagacgtcttcctg

SEQ ID NO: 200975 - DNA, 32 bp, Artificial Sequence
  Description of Artificial Sequence: Synthetic oligonucleotide
agaacttcaacaggctgcaagacgtcttcctg

SEQ ID NO: 200976 - DNA, 31 bp, Artificial Sequence
  Description of Artificial Sequence: Synthetic oligonucleotide
gaacttcaacaggctgcaagacgtcttcctg

SEQ ID NO: 200977 - DNA, 31 bp, Artificial Sequence
  Description of Artificial Sequence: Synthetic oligonucleotide
aacttcaacaggctgcaagacgtcttcctgc

SEQ ID NO: 200978 - DNA, 30 bp, Artificial Sequence
  Description of Artificial Sequence: Synthetic oligonucleotide
acttcaacaggctgcaagacgtcttcctgc

SEQ ID NO: 200979 - DNA, 29 bp, Artificial Sequence
  Description of Artificial Sequence: Synthetic oligonucleotide
cttcaacaggctgcaagacgtcttcctgc

SEQ ID NO: 200980 - DNA, 30 bp, Artificial Sequence
  Description of Artificial Sequence: Synthetic oligonucleotide
ttcaacaggctgcaagacgtcttcctgctc

SEQ ID NO: 200981 - DNA, 29 bp, Artificial Sequence
  Description of Artificial Sequence: Synthetic oligonucleotide
tcaacaggctgcaagacgtcttcctgctc

SEQ ID NO: 200982 - DNA, 28 bp, Artificial Sequence
  Description of Artificial Sequence: Synthetic oligonucleotide
caacaggctgcaagacgtcttcctgctc

SEQ ID NO: 200983 - DNA, 28 bp, Artificial Sequence
  Description of Artificial Sequence: Synthetic oligonucleotide
aacaggctgcaagacgtcttcctgctcc

SEQ ID NO: 200984 - DNA, 27 bp, Artificial Sequence
  Description of Artificial Sequence: Synthetic oligonucleotide
acaggctgcaagacgtcttcctgctcc

SEQ ID NO: 200985 - DNA, 26 bp, Artificial Sequence
  Description of Artificial Sequence: Synthetic oligonucleotide
caggctgcaagacgtcttcctgctcc

SEQ ID NO: 200986 - DNA, 27 bp, Artificial Sequence
  Description of Artificial Sequence: Synthetic oligonucleotide
aggctgcaagacgtcttcctgctccct

SEQ ID NO: 200987 - DNA, 26 bp, Artificial Sequence
  Description of Artificial Sequence: Synthetic oligonucleotide
ggctgcaagacgtcttcctgctccct

SEQ ID NO: 200988 - DNA, 27 bp, Artificial Sequence
  Description of Artificial Sequence: Synthetic oligonucleotide
gctgcaagacgtcttcctgctccctga

SEQ ID NO: 200989 - DNA, 27 bp, Artificial Sequence
  Description of Artificial Sequence: Synthetic oligonucleotide
ctgcaagacgtcttcctgctccctgac

SEQ ID NO: 200990 - DNA, 27 bp, Artificial Sequence
  Description of Artificial Sequence: Synthetic oligonucleotide
tgcaagacgtcttcctgctccctgacc

SEQ ID NO: 200991 - DNA, 26 bp, Artificial Sequence
  Description of Artificial Sequence: Synthetic oligonucleotide
gcaagacgtcttcctgctccctgacc

SEQ ID NO: 200992 - DNA, 26 bp, Artificial Sequence
  Description of Artificial Sequence: Synthetic oligonucleotide
caagacgtcttcctgctccctgaccc

SEQ ID NO: 200993 - DNA, 27 bp, Artificial Sequence
  Description of Artificial Sequence: Synthetic oligonucleotide
aagacgtcttcctgctccctgacccca

SEQ ID NO: 200994 - DNA, 26 bp, Artificial Sequence
  Description of Artificial Sequence: Synthetic oligonucleotide
agacgtcttcctgctccctgacccca

SEQ ID NO: 200995 - DNA, 25 bp, Artificial Sequence
  Description of Artificial Sequence: Synthetic oligonucleotide
gacgtcttcctgctccctgacccca

SEQ ID NO: 200996 - DNA, 25 bp, Artificial Sequence
  Description of Artificial Sequence: Synthetic oligonucleotide
acgtcttcctgctccctgaccccag

SEQ ID NO: 200997 - DNA, 24 bp, Artificial Sequence
  Description of Artificial Sequence: Synthetic oligonucleotide
cgtcttcctgctccctgaccccag

SEQ ID NO: 200998 - DNA, 24 bp, Artificial Sequence
  Description of Artificial Sequence: Synthetic oligonucleotide
gtcttcctgctccctgaccccagc

SEQ ID NO: 200999 - DNA, 24 bp, Artificial Sequence
  Description of Artificial Sequence: Synthetic oligonucleotide
tcttcctgctccctgaccccagcg

SEQ ID NO: 201000 - DNA, 23 bp, Artificial Sequence
  Description of Artificial Sequence: Synthetic oligonucleotide
cttcctgctccctgaccccagcg

SEQ ID NO: 201001 - DNA, 23 bp, Artificial Sequence
  Description of Artificial Sequence: Synthetic oligonucleotide
ttcctgctccctgaccccagcgg

SEQ ID NO: 201002 - DNA, 22 bp, Artificial Sequence
  Description of Artificial Sequence: Synthetic oligonucleotide
tcctgctccctgaccccagcgg

SEQ ID NO: 201003 - DNA, 21 bp, Artificial Sequence
  Description of Artificial Sequence: Synthetic oligonucleotide
cctgctccctgaccccagcgg

SEQ ID NO: 201004 - DNA, 21 bp, Artificial Sequence
  Description of Artificial Sequence: Synthetic oligonucleotide
ctgctccctgaccccagcggc

SEQ ID NO: 201005 - DNA, 22 bp, Artificial Sequence
  Description of Artificial Sequence: Synthetic oligonucleotide
tgctccctgaccccagcggcca

SEQ ID NO: 201006 - DNA, 21 bp, Artificial Sequence
  Description of Artificial Sequence: Synthetic oligonucleotide
gctccctgaccccagcggcca

SEQ ID NO: 201007 - DNA, 22 bp, Artificial Sequence
  Description of Artificial Sequence: Synthetic oligonucleotide
ctccctgaccccagcggccagt

SEQ ID NO: 201008 - DNA, 22 bp, Artificial Sequence
  Description of Artificial Sequence: Synthetic oligonucleotide
tccctgaccccagcggccagtg

SEQ ID NO: 201009 - DNA, 21 bp, Artificial Sequence
  Description of Artificial Sequence: Synthetic oligonucleotide
ccctgaccccagcggccagtg

SEQ ID NO: 201010 - DNA, 22 bp, Artificial Sequence
  Description of Artificial Sequence: Synthetic oligonucleotide
cctgaccccagcggccagtgga

SEQ ID NO: 201011 - DNA, 22 bp, Artificial Sequence
  Description of Artificial Sequence: Synthetic oligonucleotide
ctgaccccagcggccagtggag

SEQ ID NO: 201012 - DNA, 22 bp, Artificial Sequence
  Description of Artificial Sequence: Synthetic oligonucleotide
tgaccccagcggccagtggagg

SEQ ID NO: 201013 - DNA, 21 bp, Artificial Sequence
  Description of Artificial Sequence: Synthetic oligonucleotide
gaccccagcggccagtggagg

SEQ ID NO: 201014 - DNA, 22 bp, Artificial Sequence
  Description of Artificial Sequence: Synthetic oligonucleotide
accccagcggccagtggaggga

SEQ ID NO: 201015 - DNA, 21 bp, Artificial Sequence
  Description of Artificial Sequence: Synthetic oligonucleotide
ccccagcggccagtggaggga

SEQ ID NO: 201016 - DNA, 22 bp, Artificial Sequence
  Description of Artificial Sequence: Synthetic oligonucleotide
cccagcggccagtggagggaca

SEQ ID NO: 201017 - DNA, 22 bp, Artificial Sequence
  Description of Artificial Sequence: Synthetic oligonucleotide
ccagcggccagtggagggacac

SEQ ID NO: 201018 - DNA, 23 bp, Artificial Sequence
  Description of Artificial Sequence: Synthetic oligonucleotide
cagcggccagtggagggacacca

SEQ ID NO: 201019 - DNA, 23 bp, Artificial Sequence
  Description of Artificial Sequence: Synthetic oligonucleotide
agcggccagtggagggacaccag

SEQ ID NO: 201020 - DNA, 22 bp, Artificial Sequence
  Description of Artificial Sequence: Synthetic oligonucleotide
gcggccagtggagggacaccag

SEQ ID NO: 201021 - DNA, 22 bp, Artificial Sequence
  Description of Artificial Sequence: Synthetic oligonucleotide
cggccagtggagggacaccagg

SEQ ID NO: 201022 - DNA, 23 bp, Artificial Sequence
  Description of Artificial Sequence: Synthetic oligonucleotide
ggccagtggagggacaccagggt

SEQ ID NO: 201023 - DNA, 26 bp, Artificial Sequence
  Description of Artificial Sequence: Synthetic oligonucleotide
gccagtggagggacaccagggtctat

SEQ ID NO: 201024 - DNA, 26 bp, Artificial Sequence
  Description of Artificial Sequence: Synthetic oligonucleotide
ccagtggagggacaccagggtctatg

SEQ ID NO: 201025 - DNA, 27 bp, Artificial Sequence
  Description of Artificial Sequence: Synthetic oligonucleotide
cagtggagggacaccagggtctatggt

SEQ ID NO: 201026 - DNA, 27 bp, Artificial Sequence
  Description of Artificial Sequence: Synthetic oligonucleotide
agtggagggacaccagggtctatggtg

SEQ ID NO: 201027 - DNA, 27 bp, Artificial Sequence
  Description of Artificial Sequence: Synthetic oligonucleotide
gtggagggacaccagggtctatggtgt

SEQ ID NO: 201028 - DNA, 30 bp, Artificial Sequence
  Description of Artificial Sequence: Synthetic oligonucleotide
tggagggacaccagggtctatggtgttttc

SEQ ID NO: 201029 - DNA, 29 bp, Artificial Sequence
  Description of Artificial Sequence: Synthetic oligonucleotide
ggagggacaccagggtctatggtgttttc

SEQ ID NO: 201030 - DNA, 30 bp, Artificial Sequence
  Description of Artificial Sequence: Synthetic oligonucleotide
gagggacaccagggtctatggtgttttctc

SEQ ID NO: 201031 - DNA, 30 bp, Artificial Sequence
  Description of Artificial Sequence: Synthetic oligonucleotide
agggacaccagggtctatggtgttttctcc

SEQ ID NO: 201032 - DNA, 29 bp, Artificial Sequence
  Description of Artificial Sequence: Synthetic oligonucleotide
gggacaccagggtctatggtgttttctcc

SEQ ID NO: 201033 - DNA, 31 bp, Artificial Sequence
  Description of Artificial Sequence: Synthetic oligonucleotide
ggacaccagggtctatggtgttttctccaac

SEQ ID NO: 201034 - DNA, 31 bp, Artificial Sequence
  Description of Artificial Sequence: Synthetic oligonucleotide
gacaccagggtctatggtgttttctccaacc

SEQ ID NO: 201035 - DNA, 31 bp, Artificial Sequence
  Description of Artificial Sequence: Synthetic oligonucleotide
acaccagggtctatggtgttttctccaaccc

SEQ ID NO: 201036 - DNA, 30 bp, Artificial Sequence
  Description of Artificial Sequence: Synthetic oligonucleotide
caccagggtctatggtgttttctccaaccc

SEQ ID NO: 201037 - DNA, 30 bp, Artificial Sequence
  Description of Artificial Sequence: Synthetic oligonucleotide
accagggtctatggtgttttctccaacccc

SEQ ID NO: 201038 - DNA, 29 bp, Artificial Sequence
  Description of Artificial Sequence: Synthetic oligonucleotide
ccagggtctatggtgttttctccaacccc

SEQ ID NO: 201039 - DNA, 30 bp, Artificial Sequence
  Description of Artificial Sequence: Synthetic oligonucleotide
cagggtctatggtgttttctccaacccctg

SEQ ID NO: 201040 - DNA, 30 bp, Artificial Sequence
  Description of Artificial Sequence: Synthetic oligonucleotide
agggtctatggtgttttctccaacccctgg

SEQ ID NO: 201041 - DNA, 29 bp, Artificial Sequence
  Description of Artificial Sequence: Synthetic oligonucleotide
gggtctatggtgttttctccaacccctgg

SEQ ID NO: 201042 - DNA, 31 bp, Artificial Sequence
  Description of Artificial Sequence: Synthetic oligonucleotide
ggtctatggtgttttctccaacccctggaac

SEQ ID NO: 201043 - DNA, 33 bp, Artificial Sequence
  Description of Artificial Sequence: Synthetic oligonucleotide
gtctatggtgttttctccaacccctggaactac

SEQ ID NO: 201044 - DNA, 34 bp, Artificial Sequence
  Description of Artificial Sequence: Synthetic oligonucleotide
tctatggtgttttctccaacccctggaactactc

SEQ ID NO: 201045 - DNA, 33 bp, Artificial Sequence
  Description of Artificial Sequence: Synthetic oligonucleotide
ctatggtgttttctccaacccctggaactactc

SEQ ID NO: 201046 - DNA, 34 bp, Artificial Sequence
  Description of Artificial Sequence: Synthetic oligonucleotide
tatggtgttttctccaacccctggaactactcag

SEQ ID NO: 201047 - DNA, 33 bp, Artificial Sequence
  Description of Artificial Sequence: Synthetic oligonucleotide
atggtgttttctccaacccctggaactactcag

SEQ ID NO: 201048 - DNA, 32 bp, Artificial Sequence
  Description of Artificial Sequence: Synthetic oligonucleotide
tggtgttttctccaacccctggaactactcag

SEQ ID NO: 201049 - DNA, 31 bp, Artificial Sequence
  Description of Artificial Sequence: Synthetic oligonucleotide
ggtgttttctccaacccctggaactactcag

SEQ ID NO: 201050 - DNA, 31 bp, Artificial Sequence
  Description of Artificial Sequence: Synthetic oligonucleotide
gtgttttctccaacccctggaactactcagc

SEQ ID NO: 201051 - DNA, 31 bp, Artificial Sequence
  Description of Artificial Sequence: Synthetic oligonucleotide
tgttttctccaacccctggaactactcagcc

SEQ ID NO: 201052 - DNA, 30 bp, Artificial Sequence
  Description of Artificial Sequence: Synthetic oligonucleotide
gttttctccaacccctggaactactcagcc

SEQ ID NO: 201053 - DNA, 30 bp, Artificial Sequence
  Description of Artificial Sequence: Synthetic oligonucleotide
ttttctccaacccctggaactactcagccg

SEQ ID NO: 201054 - DNA, 29 bp, Artificial Sequence
  Description of Artificial Sequence: Synthetic oligonucleotide
tttctccaacccctggaactactcagccg

SEQ ID NO: 201055 - DNA, 28 bp, Artificial Sequence
  Description of Artificial Sequence: Synthetic oligonucleotide
ttctccaacccctggaactactcagccg

SEQ ID NO: 201056 - DNA, 27 bp, Artificial Sequence
  Description of Artificial Sequence: Synthetic oligonucleotide
tctccaacccctggaactactcagccg

SEQ ID NO: 201057 - DNA, 27 bp, Artificial Sequence
  Description of Artificial Sequence: Synthetic oligonucleotide
ctccaacccctggaactactcagccgt

SEQ ID NO: 201058 - DNA, 27 bp, Artificial Sequence
  Description of Artificial Sequence: Synthetic oligonucleotide
tccaacccctggaactactcagccgtc

SEQ ID NO: 201059 - DNA, 27 bp, Artificial Sequence
  Description of Artificial Sequence: Synthetic oligonucleotide
ccaacccctggaactactcagccgtct

SEQ ID NO: 201060 - DNA, 27 bp, Artificial Sequence
  Description of Artificial Sequence: Synthetic oligonucleotide
caacccctggaactactcagccgtctg

SEQ ID NO: 201061 - DNA, 28 bp, Artificial Sequence
  Description of Artificial Sequence: Synthetic oligonucleotide
aacccctggaactactcagccgtctgtg

SEQ ID NO: 201062 - DNA, 27 bp, Artificial Sequence
  Description of Artificial Sequence: Synthetic oligonucleotide
acccctggaactactcagccgtctgtg

SEQ ID NO: 201063 - DNA, 27 bp, Artificial Sequence
  Description of Artificial Sequence: Synthetic oligonucleotide
cccctggaactactcagccgtctgtgt

SEQ ID NO: 201064 - DNA, 27 bp, Artificial Sequence
  Description of Artificial Sequence: Synthetic oligonucleotide
ccctggaactactcagccgtctgtgtg

SEQ ID NO: 201065 - DNA, 31 bp, Artificial Sequence
  Description of Artificial Sequence: Synthetic oligonucleotide
cctggaactactcagccgtctgtgtgtattc

SEQ ID NO: 201066 - DNA, 31 bp, Artificial Sequence
  Description of Artificial Sequence: Synthetic oligonucleotide
ctggaactactcagccgtctgtgtgtattcc

SEQ ID NO: 201067 - DNA, 31 bp, Artificial Sequence
  Description of Artificial Sequence: Synthetic oligonucleotide
tggaactactcagccgtctgtgtgtattccc

SEQ ID NO: 201068 - DNA, 30 bp, Artificial Sequence
  Description of Artificial Sequence: Synthetic oligonucleotide
ggaactactcagccgtctgtgtgtattccc

SEQ ID NO: 201069 - DNA, 31 bp, Artificial Sequence
  Description of Artificial Sequence: Synthetic oligonucleotide
gaactactcagccgtctgtgtgtattccctc

SEQ ID NO: 201070 - DNA, 31 bp, Artificial Sequence
  Description of Artificial Sequence: Synthetic oligonucleotide
aactactcagccgtctgtgtgtattccctcg

SEQ ID NO: 201071 - DNA, 30 bp, Artificial Sequence
  Description of Artificial Sequence: Synthetic oligonucleotide
actactcagccgtctgtgtgtattccctcg

SEQ ID NO: 201072 - DNA, 29 bp, Artificial Sequence
  Description of Artificial Sequence: Synthetic oligonucleotide
ctactcagccgtctgtgtgtattccctcg

SEQ ID NO: 201073 - DNA, 29 bp, Artificial Sequence
  Description of Artificial Sequence: Synthetic oligonucleotide
tactcagccgtctgtgtgtattccctcgg

SEQ ID NO: 201074 - DNA, 28 bp, Artificial Sequence
  Description of Artificial Sequence: Synthetic oligonucleotide
actcagccgtctgtgtgtattccctcgg

SEQ ID NO: 201075 - DNA, 27 bp, Artificial Sequence
  Description of Artificial Sequence: Synthetic oligonucleotide
ctcagccgtctgtgtgtattccctcgg

SEQ ID NO: 201076 - DNA, 28 bp, Artificial Sequence
  Description of Artificial Sequence: Synthetic oligonucleotide
tcagccgtctgtgtgtattccctcggtg

SEQ ID NO: 201077 - DNA, 27 bp, Artificial Sequence
  Description of Artificial Sequence: Synthetic oligonucleotide
cagccgtctgtgtgtattccctcggtg

SEQ ID NO: 201078 - DNA, 28 bp, Artificial Sequence
  Description of Artificial Sequence: Synthetic oligonucleotide
agccgtctgtgtgtattccctcggtgac

SEQ ID NO: 201079 - DNA, 27 bp, Artificial Sequence
  Description of Artificial Sequence: Synthetic oligonucleotide
gccgtctgtgtgtattccctcggtgac

SEQ ID NO: 201080 - DNA, 30 bp, Artificial Sequence
  Description of Artificial Sequence: Synthetic oligonucleotide
ccgtctgtgtgtattccctcggtgacattg

SEQ ID NO: 201081 - DNA, 31 bp, Artificial Sequence
  Description of Artificial Sequence: Synthetic oligonucleotide
cgtctgtgtgtattccctcggtgacattgac

SEQ ID NO: 201082 - DNA, 33 bp, Artificial Sequence
  Description of Artificial Sequence: Synthetic oligonucleotide
gtctgtgtgtattccctcggtgacattgacaag

SEQ ID NO: 201083 - DNA, 33 bp, Artificial Sequence
  Description of Artificial Sequence: Synthetic oligonucleotide
tctgtgtgtattccctcggtgacattgacaagg

SEQ ID NO: 201084 - DNA, 32 bp, Artificial Sequence
  Description of Artificial Sequence: Synthetic oligonucleotide
ctgtgtgtattccctcggtgacattgacaagg

SEQ ID NO: 201085 - DNA, 33 bp, Artificial Sequence
  Description of Artificial Sequence: Synthetic oligonucleotide
tgtgtgtattccctcggtgacattgacaaggtc

SEQ ID NO: 201086 - DNA, 32 bp, Artificial Sequence
  Description of Artificial Sequence: Synthetic oligonucleotide
gtgtgtattccctcggtgacattgacaaggtc

SEQ ID NO: 201087 - DNA, 34 bp, Artificial Sequence
  Description of Artificial Sequence: Synthetic oligonucleotide
tgtgtattccctcggtgacattgacaaggtcttc

SEQ ID NO: 201088 - DNA, 33 bp, Artificial Sequence
  Description of Artificial Sequence: Synthetic oligonucleotide
gtgtattccctcggtgacattgacaaggtcttc

SEQ ID NO: 201089 - DNA, 33 bp, Artificial Sequence
  Description of Artificial Sequence: Synthetic oligonucleotide
tgtattccctcggtgacattgacaaggtcttcc

SEQ ID NO: 201090 - DNA, 32 bp, Artificial Sequence
  Description of Artificial Sequence: Synthetic oligonucleotide
gtattccctcggtgacattgacaaggtcttcc

SEQ ID NO: 201091 - DNA, 32 bp, Artificial Sequence
  Description of Artificial Sequence: Synthetic oligonucleotide
tattccctcggtgacattgacaaggtcttccg

SEQ ID NO: 201092 - DNA, 31 bp, Artificial Sequence
  Description of Artificial Sequence: Synthetic oligonucleotide
attccctcggtgacattgacaaggtcttccg

SEQ ID NO: 201093 - DNA, 30 bp, Artificial Sequence
  Description of Artificial Sequence: Synthetic oligonucleotide
ttccctcggtgacattgacaaggtcttccg

SEQ ID NO: 201094 - DNA, 29 bp, Artificial Sequence
  Description of Artificial Sequence: Synthetic oligonucleotide
tccctcggtgacattgacaaggtcttccg

SEQ ID NO: 201095 - DNA, 28 bp, Artificial Sequence
  Description of Artificial Sequence: Synthetic oligonucleotide
ccctcggtgacattgacaaggtcttccg

SEQ ID NO: 201096 - DNA, 30 bp, Artificial Sequence
  Description of Artificial Sequence: Synthetic oligonucleotide
cctcggtgacattgacaaggtcttccgtac

SEQ ID NO: 201097 - DNA, 30 bp, Artificial Sequence
  Description of Artificial Sequence: Synthetic oligonucleotide
ctcggtgacattgacaaggtcttccgtacc

SEQ ID NO: 201098 - DNA, 31 bp, Artificial Sequence
  Description of Artificial Sequence: Synthetic oligonucleotide
tcggtgacattgacaaggtcttccgtacctc

SEQ ID NO: 201099 - DNA, 30 bp, Artificial Sequence
  Description of Artificial Sequence: Synthetic oligonucleotide
cggtgacattgacaaggtcttccgtacctc

SEQ ID NO: 201100 - DNA, 30 bp, Artificial Sequence
  Description of Artificial Sequence: Synthetic oligonucleotide
ggtgacattgacaaggtcttccgtacctcc

SEQ ID NO: 201101 - DNA, 31 bp, Artificial Sequence
  Description of Artificial Sequence: Synthetic oligonucleotide
gtgacattgacaaggtcttccgtacctcctc

SEQ ID NO: 201102 - DNA, 32 bp, Artificial Sequence
  Description of Artificial Sequence: Synthetic oligonucleotide
tgacattgacaaggtcttccgtacctcctcac

SEQ ID NO: 201103 - DNA, 31 bp, Artificial Sequence
  Description of Artificial Sequence: Synthetic oligonucleotide
gacattgacaaggtcttccgtacctcctcac

SEQ ID NO: 201104 - DNA, 32 bp, Artificial Sequence
  Description of Artificial Sequence: Synthetic oligonucleotide
acattgacaaggtcttccgtacctcctcactc

SEQ ID NO: 201105 - DNA, 31 bp, Artificial Sequence
  Description of Artificial Sequence: Synthetic oligonucleotide
cattgacaaggtcttccgtacctcctcactc

SEQ ID NO: 201106 - DNA, 33 bp, Artificial Sequence
  Description of Artificial Sequence: Synthetic oligonucleotide
attgacaaggtcttccgtacctcctcactcaag

SEQ ID NO: 201107 - DNA, 32 bp, Artificial Sequence
  Description of Artificial Sequence: Synthetic oligonucleotide
ttgacaaggtcttccgtacctcctcactcaag

SEQ ID NO: 201108 - DNA, 31 bp, Artificial Sequence
  Description of Artificial Sequence: Synthetic oligonucleotide
tgacaaggtcttccgtacctcctcactcaag

SEQ ID NO: 201109 - DNA, 30 bp, Artificial Sequence
  Description of Artificial Sequence: Synthetic oligonucleotide
gacaaggtcttccgtacctcctcactcaag

SEQ ID NO: 201110 - DNA, 30 bp, Artificial Sequence
  Description of Artificial Sequence: Synthetic oligonucleotide
acaaggtcttccgtacctcctcactcaagg

SEQ ID NO: 201111 - DNA, 29 bp, Artificial Sequence
  Description of Artificial Sequence: Synthetic oligonucleotide
caaggtcttccgtacctcctcactcaagg

SEQ ID NO: 201112 - DNA, 29 bp, Artificial Sequence
  Description of Artificial Sequence: Synthetic oligonucleotide
aaggtcttccgtacctcctcactcaaggg

SEQ ID NO: 201113 - DNA, 28 bp, Artificial Sequence
  Description of Artificial Sequence: Synthetic oligonucleotide
aggtcttccgtacctcctcactcaaggg

SEQ ID NO: 201114 - DNA, 27 bp, Artificial Sequence
  Description of Artificial Sequence: Synthetic oligonucleotide
ggtcttccgtacctcctcactcaaggg

SEQ ID NO: 201115 - DNA, 27 bp, Artificial Sequence
  Description of Artificial Sequence: Synthetic oligonucleotide
gtcttccgtacctcctcactcaagggc

SEQ ID NO: 201116 - DNA, 29 bp, Artificial Sequence
  Description of Artificial Sequence: Synthetic oligonucleotide
tcttccgtacctcctcactcaagggctac

SEQ ID NO: 201117 - DNA, 28 bp, Artificial Sequence
  Description of Artificial Sequence: Synthetic oligonucleotide
cttccgtacctcctcactcaagggctac

SEQ ID NO: 201118 - DNA, 28 bp, Artificial Sequence
  Description of Artificial Sequence: Synthetic oligonucleotide
ttccgtacctcctcactcaagggctacc

SEQ ID NO: 201119 - DNA, 27 bp, Artificial Sequence
  Description of Artificial Sequence: Synthetic oligonucleotide
tccgtacctcctcactcaagggctacc

SEQ ID NO: 201120 - DNA, 27 bp, Artificial Sequence
  Description of Artificial Sequence: Synthetic oligonucleotide
ccgtacctcctcactcaagggctacca

SEQ ID NO: 201121 - DNA, 27 bp, Artificial Sequence
  Description of Artificial Sequence: Synthetic oligonucleotide
cgtacctcctcactcaagggctaccac

SEQ ID NO: 201122 - DNA, 28 bp, Artificial Sequence
  Description of Artificial Sequence: Synthetic oligonucleotide
gtacctcctcactcaagggctaccactc

SEQ ID NO: 201123 - DNA, 30 bp, Artificial Sequence
  Description of Artificial Sequence: Synthetic oligonucleotide
tacctcctcactcaagggctaccactcaag

SEQ ID NO: 201124 - DNA, 29 bp, Artificial Sequence
  Description of Artificial Sequence: Synthetic oligonucleotide
acctcctcactcaagggctaccactcaag

SEQ ID NO: 201125 - DNA, 28 bp, Artificial Sequence
  Description of Artificial Sequence: Synthetic oligonucleotide
cctcctcactcaagggctaccactcaag

SEQ ID NO: 201126 - DNA, 28 bp, Artificial Sequence
  Description of Artificial Sequence: Synthetic oligonucleotide
ctcctcactcaagggctaccactcaagc

SEQ ID NO: 201127 - DNA, 28 bp, Artificial Sequence
  Description of Artificial Sequence: Synthetic oligonucleotide
tcctcactcaagggctaccactcaagcc

SEQ ID NO: 201128 - DNA, 27 bp, Artificial Sequence
  Description of Artificial Sequence: Synthetic oligonucleotide
cctcactcaagggctaccactcaagcc

SEQ ID NO: 201129 - DNA, 29 bp, Artificial Sequence
  Description of Artificial Sequence: Synthetic oligonucleotide
ctcactcaagggctaccactcaagccttc

SEQ ID NO: 201130 - DNA, 29 bp, Artificial Sequence
  Description of Artificial Sequence: Synthetic oligonucleotide
tcactcaagggctaccactcaagccttcc

SEQ ID NO: 201131 - DNA, 28 bp, Artificial Sequence
  Description of Artificial Sequence: Synthetic oligonucleotide
cactcaagggctaccactcaagccttcc

SEQ ID NO: 201132 - DNA, 28 bp, Artificial Sequence
  Description of Artificial Sequence: Synthetic oligonucleotide
actcaagggctaccactcaagccttccc

SEQ ID NO: 201133 - DNA, 27 bp, Artificial Sequence
  Description of Artificial Sequence: Synthetic oligonucleotide
ctcaagggctaccactcaagccttccc

SEQ ID NO: 201134 - DNA, 29 bp, Artificial Sequence
  Description of Artificial Sequence: Synthetic oligonucleotide
tcaagggctaccactcaagccttcccaac

SEQ ID NO: 201135 - DNA, 28 bp, Artificial Sequence
  Description of Artificial Sequence: Synthetic oligonucleotide
caagggctaccactcaagccttcccaac

SEQ ID NO: 201136 - DNA, 28 bp, Artificial Sequence
  Description of Artificial Sequence: Synthetic oligonucleotide
aagggctaccactcaagccttcccaacc

SEQ ID NO: 201137 - DNA, 27 bp, Artificial Sequence
  Description of Artificial Sequence: Synthetic oligonucleotide
agggctaccactcaagccttcccaacc

SEQ ID NO: 201138 - DNA, 26 bp, Artificial Sequence
  Description of Artificial Sequence: Synthetic oligonucleotide
gggctaccactcaagccttcccaacc

SEQ ID NO: 201139 - DNA, 26 bp, Artificial Sequence
  Description of Artificial Sequence: Synthetic oligonucleotide
ggctaccactcaagccttcccaaccc

SEQ ID NO: 201140 - DNA, 26 bp, Artificial Sequence
  Description of Artificial Sequence: Synthetic oligonucleotide
gctaccactcaagccttcccaacccg

SEQ ID NO: 201141 - DNA, 26 bp, Artificial Sequence
  Description of Artificial Sequence: Synthetic oligonucleotide
ctaccactcaagccttcccaacccgc

SEQ ID NO: 201142 - DNA, 26 bp, Artificial Sequence
  Description of Artificial Sequence: Synthetic oligonucleotide
taccactcaagccttcccaacccgcg

SEQ ID NO: 201143 - DNA, 25 bp, Artificial Sequence
  Description of Artificial Sequence: Synthetic oligonucleotide
accactcaagccttcccaacccgcg

SEQ ID NO: 201144 - DNA, 24 bp, Artificial Sequence
  Description of Artificial Sequence: Synthetic oligonucleotide
ccactcaagccttcccaacccgcg

SEQ ID NO: 201145 - DNA, 24 bp, Artificial Sequence
  Description of Artificial Sequence: Synthetic oligonucleotide
cactcaagccttcccaacccgcgg

SEQ ID NO: 201146 - DNA, 24 bp, Artificial Sequence
  Description of Artificial Sequence: Synthetic oligonucleotide
actcaagccttcccaacccgcggc

SEQ ID NO: 201147 - DNA, 23 bp, Artificial Sequence
  Description of Artificial Sequence: Synthetic oligonucleotide
ctcaagccttcccaacccgcggc

SEQ ID NO: 201148 - DNA, 24 bp, Artificial Sequence
  Description of Artificial Sequence: Synthetic oligonucleotide
tcaagccttcccaacccgcggcct

SEQ ID NO: 201149 - DNA, 23 bp, Artificial Sequence
  Description of Artificial Sequence: Synthetic oligonucleotide
caagccttcccaacccgcggcct

SEQ ID NO: 201150 - DNA, 23 bp, Artificial Sequence
  Description of Artificial Sequence: Synthetic oligonucleotide
aagccttcccaacccgcggcctg

SEQ ID NO: 201151 - DNA, 22 bp, Artificial Sequence
  Description of Artificial Sequence: Synthetic oligonucleotide
agccttcccaacccgcggcctg

SEQ ID NO: 201152 - DNA, 21 bp, Artificial Sequence
  Description of Artificial Sequence: Synthetic oligonucleotide
gccttcccaacccgcggcctg

SEQ ID NO: 201153 - DNA, 21 bp, Artificial Sequence
  Description of Artificial Sequence: Synthetic oligonucleotide
ccttcccaacccgcggcctgg

SEQ ID NO: 201154 - DNA, 23 bp, Artificial Sequence
  Description of Artificial Sequence: Synthetic oligonucleotide
cttcccaacccgcggcctggcaa

SEQ ID NO: 201155 - DNA, 24 bp, Artificial Sequence
  Description of Artificial Sequence: Synthetic oligonucleotide
ttcccaacccgcggcctggcaagt

SEQ ID NO: 201156 - DNA, 23 bp, Artificial Sequence
  Description of Artificial Sequence: Synthetic oligonucleotide
tcccaacccgcggcctggcaagt

SEQ ID NO: 201157 - DNA, 22 bp, Artificial Sequence
  Description of Artificial Sequence: Synthetic oligonucleotide
cccaacccgcggcctggcaagt

SEQ ID NO: 201158 - DNA, 22 bp, Artificial Sequence
  Description of Artificial Sequence: Synthetic oligonucleotide
ccaacccgcggcctggcaagtg

SEQ ID NO: 201159 - DNA, 22 bp, Artificial Sequence
  Description of Artificial Sequence: Synthetic oligonucleotide
caacccgcggcctggcaagtgc

SEQ ID NO: 201160 - DNA, 23 bp, Artificial Sequence
  Description of Artificial Sequence: Synthetic oligonucleotide
aacccgcggcctggcaagtgcct

SEQ ID NO: 201161 - DNA, 22 bp, Artificial Sequence
  Description of Artificial Sequence: Synthetic oligonucleotide
acccgcggcctggcaagtgcct

SEQ ID NO: 201162 - DNA, 21 bp, Artificial Sequence
  Description of Artificial Sequence: Synthetic oligonucleotide
cccgcggcctggcaagtgcct

SEQ ID NO: 201163 - DNA, 21 bp, Artificial Sequence
  Description of Artificial Sequence: Synthetic oligonucleotide
ccgcggcctggcaagtgcctc

SEQ ID NO: 201164 - DNA, 21 bp, Artificial Sequence
  Description of Artificial Sequence: Synthetic oligonucleotide
cgcggcctggcaagtgcctcc

SEQ ID NO: 201165 - DNA, 22 bp, Artificial Sequence
  Description of Artificial Sequence: Synthetic oligonucleotide
gcggcctggcaagtgcctccca

SEQ ID NO: 201166 - DNA, 23 bp, Artificial Sequence
  Description of Artificial Sequence: Synthetic oligonucleotide
cggcctggcaagtgcctcccaga

SEQ ID NO: 201167 - DNA, 23 bp, Artificial Sequence
  Description of Artificial Sequence: Synthetic oligonucleotide
ggcctggcaagtgcctcccagac

SEQ ID NO: 201168 - DNA, 24 bp, Artificial Sequence
  Description of Artificial Sequence: Synthetic oligonucleotide
gcctggcaagtgcctcccagacca

SEQ ID NO: 201169 - DNA, 24 bp, Artificial Sequence
  Description of Artificial Sequence: Synthetic oligonucleotide
cctggcaagtgcctcccagaccag

SEQ ID NO: 201170 - DNA, 25 bp, Artificial Sequence
  Description of Artificial Sequence: Synthetic oligonucleotide
ctggcaagtgcctcccagaccagca

SEQ ID NO: 201171 - DNA, 25 bp, Artificial Sequence
  Description of Artificial Sequence: Synthetic oligonucleotide
tggcaagtgcctcccagaccagcag

SEQ ID NO: 201172 - DNA, 24 bp, Artificial Sequence
  Description of Artificial Sequence: Synthetic oligonucleotide
ggcaagtgcctcccagaccagcag

SEQ ID NO: 201173 - DNA, 24 bp, Artificial Sequence
  Description of Artificial Sequence: Synthetic oligonucleotide
gcaagtgcctcccagaccagcagc

SEQ ID NO: 201174 - DNA, 24 bp, Artificial Sequence
  Description of Artificial Sequence: Synthetic oligonucleotide
caagtgcctcccagaccagcagcc

SEQ ID NO: 201175 - DNA, 27 bp, Artificial Sequence
  Description of Artificial Sequence: Synthetic oligonucleotide
aagtgcctcccagaccagcagccgata

SEQ ID NO: 201176 - DNA, 26 bp, Artificial Sequence
  Description of Artificial Sequence: Synthetic oligonucleotide
agtgcctcccagaccagcagccgata

SEQ ID NO: 201177 - DNA, 25 bp, Artificial Sequence
  Description of Artificial Sequence: Synthetic oligonucleotide
gtgcctcccagaccagcagccgata

SEQ ID NO: 201178 - DNA, 25 bp, Artificial Sequence
  Description of Artificial Sequence: Synthetic oligonucleotide
tgcctcccagaccagcagccgatac

SEQ ID NO: 201179 - DNA, 24 bp, Artificial Sequence
  Description of Artificial Sequence: Synthetic oligonucleotide
gcctcccagaccagcagccgatac

SEQ ID NO: 201180 - DNA, 24 bp, Artificial Sequence
  Description of Artificial Sequence: Synthetic oligonucleotide
cctcccagaccagcagccgatacc

SEQ ID NO: 201181 - DNA, 25 bp, Artificial Sequence
  Description of Artificial Sequence: Synthetic oligonucleotide
ctcccagaccagcagccgataccca

SEQ ID NO: 201182 - DNA, 26 bp, Artificial Sequence
  Description of Artificial Sequence: Synthetic oligonucleotide
tcccagaccagcagccgatacccaca

SEQ ID NO: 201183 - DNA, 25 bp, Artificial Sequence
  Description of Artificial Sequence: Synthetic oligonucleotide
cccagaccagcagccgatacccaca

SEQ ID NO: 201184 - DNA, 26 bp, Artificial Sequence
  Description of Artificial Sequence: Synthetic oligonucleotide
ccagaccagcagccgatacccacaga

SEQ ID NO: 201185 - DNA, 27 bp, Artificial Sequence
  Description of Artificial Sequence: Synthetic oligonucleotide
cagaccagcagccgatacccacagaga

SEQ ID NO: 201186 - DNA, 27 bp, Artificial Sequence
  Description of Artificial Sequence: Synthetic oligonucleotide
agaccagcagccgatacccacagagac

SEQ ID NO: 201187 - DNA, 26 bp, Artificial Sequence
  Description of Artificial Sequence: Synthetic oligonucleotide
gaccagcagccgatacccacagagac

SEQ ID NO: 201188 - DNA, 27 bp, Artificial Sequence
  Description of Artificial Sequence: Synthetic oligonucleotide
accagcagccgatacccacagagacct

SEQ ID NO: 201189 - DNA, 27 bp, Artificial Sequence
  Description of Artificial Sequence: Synthetic oligonucleotide
ccagcagccgatacccacagagacctt

SEQ ID NO: 201190 - DNA, 27 bp, Artificial Sequence
  Description of Artificial Sequence: Synthetic oligonucleotide
cagcagccgatacccacagagaccttc

SEQ ID NO: 201191 - DNA, 27 bp, Artificial Sequence
  Description of Artificial Sequence: Synthetic oligonucleotide
agcagccgatacccacagagaccttcc

SEQ ID NO: 201192 - DNA, 27 bp, Artificial Sequence
  Description of Artificial Sequence: Synthetic oligonucleotide
gcagccgatacccacagagaccttcca

SEQ ID NO: 201193 - DNA, 27 bp, Artificial Sequence
  Description of Artificial Sequence: Synthetic oligonucleotide
cagccgatacccacagagaccttccag

SEQ ID NO: 201194 - DNA, 27 bp, Artificial Sequence
  Description of Artificial Sequence: Synthetic oligonucleotide
agccgatacccacagagaccttccagg

SEQ ID NO: 201195 - DNA, 27 bp, Artificial Sequence
  Description of Artificial Sequence: Synthetic oligonucleotide
gccgatacccacagagaccttccaggt

SEQ ID NO: 201196 - DNA, 27 bp, Artificial Sequence
  Description of Artificial Sequence: Synthetic oligonucleotide
ccgatacccacagagaccttccaggtg

SEQ ID NO: 201197 - DNA, 27 bp, Artificial Sequence
  Description of Artificial Sequence: Synthetic oligonucleotide
cgatacccacagagaccttccaggtgg

SEQ ID NO: 201198 - DNA, 27 bp, Artificial Sequence
  Description of Artificial Sequence: Synthetic oligonucleotide
gatacccacagagaccttccaggtggc

SEQ ID NO: 201199 - DNA, 28 bp, Artificial Sequence
  Description of Artificial Sequence: Synthetic oligonucleotide
atacccacagagaccttccaggtggctg

SEQ ID NO: 201200 - DNA, 27 bp, Artificial Sequence
  Description of Artificial Sequence: Synthetic oligonucleotide
tacccacagagaccttccaggtggctg

SEQ ID NO: 201201 - DNA, 27 bp, Artificial Sequence
  Description of Artificial Sequence: Synthetic oligonucleotide
acccacagagaccttccaggtggctga

SEQ ID NO: 201202 - DNA, 26 bp, Artificial Sequence
  Description of Artificial Sequence: Synthetic oligonucleotide
cccacagagaccttccaggtggctga

SEQ ID NO: 201203 - DNA, 26 bp, Artificial Sequence
  Description of Artificial Sequence: Synthetic oligonucleotide
ccacagagaccttccaggtggctgac

SEQ ID NO: 201204 - DNA, 26 bp, Artificial Sequence
  Description of Artificial Sequence: Synthetic oligonucleotide
cacagagaccttccaggtggctgacc

SEQ ID NO: 201205 - DNA, 27 bp, Artificial Sequence
  Description of Artificial Sequence: Synthetic oligonucleotide
acagagaccttccaggtggctgaccgt

SEQ ID NO: 201206 - DNA, 26 bp, Artificial Sequence
  Description of Artificial Sequence: Synthetic oligonucleotide
cagagaccttccaggtggctgaccgt

SEQ ID NO: 201207 - DNA, 27 bp, Artificial Sequence
  Description of Artificial Sequence: Synthetic oligonucleotide
agagaccttccaggtggctgaccgtca

SEQ ID NO: 201208 - DNA, 26 bp, Artificial Sequence
  Description of Artificial Sequence: Synthetic oligonucleotide
gagaccttccaggtggctgaccgtca

SEQ ID NO: 201209 - DNA, 26 bp, Artificial Sequence
  Description of Artificial Sequence: Synthetic oligonucleotide
agaccttccaggtggctgaccgtcac

SEQ ID NO: 201210 - DNA, 25 bp, Artificial Sequence
  Description of Artificial Sequence: Synthetic oligonucleotide
gaccttccaggtggctgaccgtcac

SEQ ID NO: 201211 - DNA, 25 bp, Artificial Sequence
  Description of Artificial Sequence: Synthetic oligonucleotide
accttccaggtggctgaccgtcacc

SEQ ID NO: 201212 - DNA, 24 bp, Artificial Sequence
  Description of Artificial Sequence: Synthetic oligonucleotide
ccttccaggtggctgaccgtcacc

SEQ ID NO: 201213 - DNA, 25 bp, Artificial Sequence
  Description of Artificial Sequence: Synthetic oligonucleotide
cttccaggtggctgaccgtcaccca

SEQ ID NO: 201214 - DNA, 26 bp, Artificial Sequence
  Description of Artificial Sequence: Synthetic oligonucleotide
ttccaggtggctgaccgtcacccaga

SEQ ID NO: 201215 - DNA, 25 bp, Artificial Sequence
  Description of Artificial Sequence: Synthetic oligonucleotide
tccaggtggctgaccgtcacccaga

SEQ ID NO: 201216 - DNA, 24 bp, Artificial Sequence
  Description of Artificial Sequence: Synthetic oligonucleotide
ccaggtggctgaccgtcacccaga

SEQ ID NO: 201217 - DNA, 24 bp, Artificial Sequence
  Description of Artificial Sequence: Synthetic oligonucleotide
caggtggctgaccgtcacccagag

SEQ ID NO: 201218 - DNA, 25 bp, Artificial Sequence
  Description of Artificial Sequence: Synthetic oligonucleotide
aggtggctgaccgtcacccagaggt

SEQ ID NO: 201219 - DNA, 24 bp, Artificial Sequence
  Description of Artificial Sequence: Synthetic oligonucleotide
ggtggctgaccgtcacccagaggt

SEQ ID NO: 201220 - DNA, 24 bp, Artificial Sequence
  Description of Artificial Sequence: Synthetic oligonucleotide
gtggctgaccgtcacccagaggtg

SEQ ID NO: 201221 - DNA, 24 bp, Artificial Sequence
  Description of Artificial Sequence: Synthetic oligonucleotide
tggctgaccgtcacccagaggtgg

SEQ ID NO: 201222 - DNA, 23 bp, Artificial Sequence
  Description of Artificial Sequence: Synthetic oligonucleotide
ggctgaccgtcacccagaggtgg

SEQ ID NO: 201223 - DNA, 23 bp, Artificial Sequence
  Description of Artificial Sequence: Synthetic oligonucleotide
gctgaccgtcacccagaggtggc

SEQ ID NO: 201224 - DNA, 23 bp, Artificial Sequence
  Description of Artificial Sequence: Synthetic oligonucleotide
ctgaccgtcacccagaggtggcg

SEQ ID NO: 201225 - DNA, 24 bp, Artificial Sequence
  Description of Artificial Sequence: Synthetic oligonucleotide
tgaccgtcacccagaggtggcgca

SEQ ID NO: 201226 - DNA, 23 bp, Artificial Sequence
  Description of Artificial Sequence: Synthetic oligonucleotide
gaccgtcacccagaggtggcgca

SEQ ID NO: 201227 - DNA, 24 bp, Artificial Sequence
  Description of Artificial Sequence: Synthetic oligonucleotide
accgtcacccagaggtggcgcaga

SEQ ID NO: 201228 - DNA, 23 bp, Artificial Sequence
  Description of Artificial Sequence: Synthetic oligonucleotide
ccgtcacccagaggtggcgcaga

SEQ ID NO: 201229 - DNA, 23 bp, Artificial Sequence
  Description of Artificial Sequence: Synthetic oligonucleotide
cgtcacccagaggtggcgcagag

SEQ ID NO: 201230 - DNA, 23 bp, Artificial Sequence
  Description of Artificial Sequence: Synthetic oligonucleotide
gtcacccagaggtggcgcagagg

SEQ ID NO: 201231 - DNA, 24 bp, Artificial Sequence
  Description of Artificial Sequence: Synthetic oligonucleotide
tcacccagaggtggcgcagagggt

SEQ ID NO: 201232 - DNA, 23 bp, Artificial Sequence
  Description of Artificial Sequence: Synthetic oligonucleotide
cacccagaggtggcgcagagggt

SEQ ID NO: 201233 - DNA, 23 bp, Artificial Sequence
  Description of Artificial Sequence: Synthetic oligonucleotide
acccagaggtggcgcagagggtg

SEQ ID NO: 201234 - DNA, 22 bp, Artificial Sequence
  Description of Artificial Sequence: Synthetic oligonucleotide
cccagaggtggcgcagagggtg

SEQ ID NO: 201235 - DNA, 23 bp, Artificial Sequence
  Description of Artificial Sequence: Synthetic oligonucleotide
ccagaggtggcgcagagggtgga

SEQ ID NO: 201236 - DNA, 23 bp, Artificial Sequence
  Description of Artificial Sequence: Synthetic oligonucleotide
cagaggtggcgcagagggtggag

SEQ ID NO: 201237 - DNA, 23 bp, Artificial Sequence
  Description of Artificial Sequence: Synthetic oligonucleotide
agaggtggcgcagagggtggagc

SEQ ID NO: 201238 - DNA, 22 bp, Artificial Sequence
  Description of Artificial Sequence: Synthetic oligonucleotide
gaggtggcgcagagggtggagc

SEQ ID NO: 201239 - DNA, 22 bp, Artificial Sequence
  Description of Artificial Sequence: Synthetic oligonucleotide
aggtggcgcagagggtggagcc

SEQ ID NO: 201240 - DNA, 21 bp, Artificial Sequence
  Description of Artificial Sequence: Synthetic oligonucleotide
ggtggcgcagagggtggagcc

SEQ ID NO: 201241 - DNA, 23 bp, Artificial Sequence
  Description of Artificial Sequence: Synthetic oligonucleotide
gtggcgcagagggtggagcccat

SEQ ID NO: 201242 - DNA, 23 bp, Artificial Sequence
  Description of Artificial Sequence: Synthetic oligonucleotide
tggcgcagagggtggagcccatg

SEQ ID NO: 201243 - DNA, 22 bp, Artificial Sequence
  Description of Artificial Sequence: Synthetic oligonucleotide
ggcgcagagggtggagcccatg

SEQ ID NO: 201244 - DNA, 22 bp, Artificial Sequence
  Description of Artificial Sequence: Synthetic oligonucleotide
gcgcagagggtggagcccatgg

SEQ ID NO: 201245 - DNA, 22 bp, Artificial Sequence
  Description of Artificial Sequence: Synthetic oligonucleotide
cgcagagggtggagcccatggg

SEQ ID NO: 201246 - DNA, 22 bp, Artificial Sequence
  Description of Artificial Sequence: Synthetic oligonucleotide
gcagagggtggagcccatgggg

SEQ ID NO: 201247 - DNA, 22 bp, Artificial Sequence
  Description of Artificial Sequence: Synthetic oligonucleotide
cagagggtggagcccatggggc

SEQ ID NO: 201248 - DNA, 23 bp, Artificial Sequence
  Description of Artificial Sequence: Synthetic oligonucleotide
agagggtggagcccatggggcct

SEQ ID NO: 201249 - DNA, 22 bp, Artificial Sequence
  Description of Artificial Sequence: Synthetic oligonucleotide
gagggtggagcccatggggcct

SEQ ID NO: 201250 - DNA, 23 bp, Artificial Sequence
  Description of Artificial Sequence: Synthetic oligonucleotide
agggtggagcccatggggcctct

SEQ ID NO: 201251 - DNA, 22 bp, Artificial Sequence
  Description of Artificial Sequence: Synthetic oligonucleotide
gggtggagcccatggggcctct

SEQ ID NO: 201252 - DNA, 24 bp, Artificial Sequence
  Description of Artificial Sequence: Synthetic oligonucleotide
ggtggagcccatggggcctctgaa

SEQ ID NO: 201253 - DNA, 25 bp, Artificial Sequence
  Description of Artificial Sequence: Synthetic oligonucleotide
gtggagcccatggggcctctgaaga

SEQ ID NO: 201254 - DNA, 25 bp, Artificial Sequence
  Description of Artificial Sequence: Synthetic oligonucleotide
tggagcccatggggcctctgaagac

SEQ ID NO: 201255 - DNA, 24 bp, Artificial Sequence
  Description of Artificial Sequence: Synthetic oligonucleotide
ggagcccatggggcctctgaagac

SEQ ID NO: 201256 - DNA, 24 bp, Artificial Sequence
  Description of Artificial Sequence: Synthetic oligonucleotide
gagcccatggggcctctgaagacg

SEQ ID NO: 201257 - DNA, 24 bp, Artificial Sequence
  Description of Artificial Sequence: Synthetic oligonucleotide
agcccatggggcctctgaagacgc

SEQ ID NO: 201258 - DNA, 23 bp, Artificial Sequence
  Description of Artificial Sequence: Synthetic oligonucleotide
gcccatggggcctctgaagacgc

SEQ ID NO: 201259 - DNA, 26 bp, Artificial Sequence
  Description of Artificial Sequence: Synthetic oligonucleotide
cccatggggcctctgaagacgccatt

SEQ ID NO: 201260 - DNA, 27 bp, Artificial Sequence
  Description of Artificial Sequence: Synthetic oligonucleotide
ccatggggcctctgaagacgccattgt

SEQ ID NO: 201261 - DNA, 28 bp, Artificial Sequence
  Description of Artificial Sequence: Synthetic oligonucleotide
catggggcctctgaagacgccattgttc

SEQ ID NO: 201262 - DNA, 28 bp, Artificial Sequence
  Description of Artificial Sequence: Synthetic oligonucleotide
atggggcctctgaagacgccattgttcc

SEQ ID NO: 201263 - DNA, 27 bp, Artificial Sequence
  Description of Artificial Sequence: Synthetic oligonucleotide
tggggcctctgaagacgccattgttcc

SEQ ID NO: 201264 - DNA, 27 bp, Artificial Sequence
  Description of Artificial Sequence: Synthetic oligonucleotide
ggggcctctgaagacgccattgttcca

SEQ ID NO: 201265 - DNA, 27 bp, Artificial Sequence
  Description of Artificial Sequence: Synthetic oligonucleotide
gggcctctgaagacgccattgttccac

SEQ ID NO: 201266 - DNA, 28 bp, Artificial Sequence
  Description of Artificial Sequence: Synthetic oligonucleotide
ggcctctgaagacgccattgttccactc

SEQ ID NO: 201267 - DNA, 34 bp, Artificial Sequence
  Description of Artificial Sequence: Synthetic oligonucleotide
gcctctgaagacgccattgttccactctaaatac

SEQ ID NO: 201268 - DNA, 34 bp, Artificial Sequence
  Description of Artificial Sequence: Synthetic oligonucleotide
cctctgaagacgccattgttccactctaaatacc

SEQ ID NO: 201269 - DNA, 35 bp, Artificial Sequence
  Description of Artificial Sequence: Synthetic oligonucleotide
ctctgaagacgccattgttccactctaaataccac

SEQ ID NO: 201270 - DNA, 37 bp, Artificial Sequence
  Description of Artificial Sequence: Synthetic oligonucleotide
tctgaagacgccattgttccactctaaataccactac

SEQ ID NO: 201271 - DNA, 36 bp, Artificial Sequence
  Description of Artificial Sequence: Synthetic oligonucleotide
ctgaagacgccattgttccactctaaataccactac

SEQ ID NO: 201272 - DNA, 36 bp, Artificial Sequence
  Description of Artificial Sequence: Synthetic oligonucleotide
tgaagacgccattgttccactctaaataccactacc

SEQ ID NO: 201273 - DNA, 35 bp, Artificial Sequence
  Description of Artificial Sequence: Synthetic oligonucleotide
gaagacgccattgttccactctaaataccactacc

SEQ ID NO: 201274 - DNA, 36 bp, Artificial Sequence
  Description of Artificial Sequence: Synthetic oligonucleotide
aagacgccattgttccactctaaataccactaccag

SEQ ID NO: 201275 - DNA, 35 bp, Artificial Sequence
  Description of Artificial Sequence: Synthetic oligonucleotide
agacgccattgttccactctaaataccactaccag

SEQ ID NO: 201276 - DNA, 34 bp, Artificial Sequence
  Description of Artificial Sequence: Synthetic oligonucleotide
gacgccattgttccactctaaataccactaccag

SEQ ID NO: 201277 - DNA, 37 bp, Artificial Sequence
  Description of Artificial Sequence: Synthetic oligonucleotide
acgccattgttccactctaaataccactaccagaaag

SEQ ID NO: 201278 - DNA, 36 bp, Artificial Sequence
  Description of Artificial Sequence: Synthetic oligonucleotide
cgccattgttccactctaaataccactaccagaaag

SEQ ID NO: 201279 - DNA, 37 bp, Artificial Sequence
  Description of Artificial Sequence: Synthetic oligonucleotide
gccattgttccactctaaataccactaccagaaagtg

SEQ ID NO: 201280 - DNA, 37 bp, Artificial Sequence
  Description of Artificial Sequence: Synthetic oligonucleotide
ccattgttccactctaaataccactaccagaaagtgg

SEQ ID NO: 201281 - DNA, 37 bp, Artificial Sequence
  Description of Artificial Sequence: Synthetic oligonucleotide
cattgttccactctaaataccactaccagaaagtggc

SEQ ID NO: 201282 - DNA, 37 bp, Artificial Sequence
  Description of Artificial Sequence: Synthetic oligonucleotide
attgttccactctaaataccactaccagaaagtggcc

SEQ ID NO: 201283 - DNA, 36 bp, Artificial Sequence
  Description of Artificial Sequence: Synthetic oligonucleotide
ttgttccactctaaataccactaccagaaagtggcc

SEQ ID NO: 201284 - DNA, 35 bp, Artificial Sequence
  Description of Artificial Sequence: Synthetic oligonucleotide
tgttccactctaaataccactaccagaaagtggcc

SEQ ID NO: 201285 - DNA, 34 bp, Artificial Sequence
  Description of Artificial Sequence: Synthetic oligonucleotide
gttccactctaaataccactaccagaaagtggcc

SEQ ID NO: 201286 - DNA, 34 bp, Artificial Sequence
  Description of Artificial Sequence: Synthetic oligonucleotide
ttccactctaaataccactaccagaaagtggccg

SEQ ID NO: 201287 - DNA, 33 bp, Artificial Sequence
  Description of Artificial Sequence: Synthetic oligonucleotide
tccactctaaataccactaccagaaagtggccg

SEQ ID NO: 201288 - DNA, 32 bp, Artificial Sequence
  Description of Artificial Sequence: Synthetic oligonucleotide
ccactctaaataccactaccagaaagtggccg

SEQ ID NO: 201289 - DNA, 33 bp, Artificial Sequence
  Description of Artificial Sequence: Synthetic oligonucleotide
cactctaaataccactaccagaaagtggccgtc

SEQ ID NO: 201290 - DNA, 33 bp, Artificial Sequence
  Description of Artificial Sequence: Synthetic oligonucleotide
actctaaataccactaccagaaagtggccgtcc

SEQ ID NO: 201291 - DNA, 32 bp, Artificial Sequence
  Description of Artificial Sequence: Synthetic oligonucleotide
ctctaaataccactaccagaaagtggccgtcc

SEQ ID NO: 201292 - DNA, 33 bp, Artificial Sequence
  Description of Artificial Sequence: Synthetic oligonucleotide
tctaaataccactaccagaaagtggccgtccac

SEQ ID NO: 201293 - DNA, 32 bp, Artificial Sequence
  Description of Artificial Sequence: Synthetic oligonucleotide
ctaaataccactaccagaaagtggccgtccac

SEQ ID NO: 201294 - DNA, 32 bp, Artificial Sequence
  Description of Artificial Sequence: Synthetic oligonucleotide
taaataccactaccagaaagtggccgtccacc

SEQ ID NO: 201295 - DNA, 31 bp, Artificial Sequence
  Description of Artificial Sequence: Synthetic oligonucleotide
aaataccactaccagaaagtggccgtccacc

SEQ ID NO: 201296 - DNA, 30 bp, Artificial Sequence
  Description of Artificial Sequence: Synthetic oligonucleotide
aataccactaccagaaagtggccgtccacc

SEQ ID NO: 201297 - DNA, 29 bp, Artificial Sequence
  Description of Artificial Sequence: Synthetic oligonucleotide
ataccactaccagaaagtggccgtccacc

SEQ ID NO: 201298 - DNA, 28 bp, Artificial Sequence
  Description of Artificial Sequence: Synthetic oligonucleotide
taccactaccagaaagtggccgtccacc

SEQ ID NO: 201299 - DNA, 27 bp, Artificial Sequence
  Description of Artificial Sequence: Synthetic oligonucleotide
accactaccagaaagtggccgtccacc

SEQ ID NO: 201300 - DNA, 26 bp, Artificial Sequence
  Description of Artificial Sequence: Synthetic oligonucleotide
ccactaccagaaagtggccgtccacc

SEQ ID NO: 201301 - DNA, 26 bp, Artificial Sequence
  Description of Artificial Sequence: Synthetic oligonucleotide
cactaccagaaagtggccgtccaccg

SEQ ID NO: 201302 - DNA, 27 bp, Artificial Sequence
  Description of Artificial Sequence: Synthetic oligonucleotide
actaccagaaagtggccgtccaccgca

SEQ ID NO: 201303 - DNA, 27 bp, Artificial Sequence
  Description of Artificial Sequence: Synthetic oligonucleotide
ctaccagaaagtggccgtccaccgcat

SEQ ID NO: 201304 - DNA, 27 bp, Artificial Sequence
  Description of Artificial Sequence: Synthetic oligonucleotide
taccagaaagtggccgtccaccgcatg

SEQ ID NO: 201305 - DNA, 26 bp, Artificial Sequence
  Description of Artificial Sequence: Synthetic oligonucleotide
accagaaagtggccgtccaccgcatg

SEQ ID NO: 201306 - DNA, 25 bp, Artificial Sequence
  Description of Artificial Sequence: Synthetic oligonucleotide
ccagaaagtggccgtccaccgcatg

SEQ ID NO: 201307 - DNA, 27 bp, Artificial Sequence
  Description of Artificial Sequence: Synthetic oligonucleotide
cagaaagtggccgtccaccgcatgcaa

SEQ ID NO: 201308 - DNA, 27 bp, Artificial Sequence
  Description of Artificial Sequence: Synthetic oligonucleotide
agaaagtggccgtccaccgcatgcaag

SEQ ID NO: 201309 - DNA, 26 bp, Artificial Sequence
  Description of Artificial Sequence: Synthetic oligonucleotide
gaaagtggccgtccaccgcatgcaag

SEQ ID NO: 201310 - DNA, 26 bp, Artificial Sequence
  Description of Artificial Sequence: Synthetic oligonucleotide
aaagtggccgtccaccgcatgcaagc

SEQ ID NO: 201311 - DNA, 25 bp, Artificial Sequence
  Description of Artificial Sequence: Synthetic oligonucleotide
aagtggccgtccaccgcatgcaagc

SEQ ID NO: 201312 - DNA, 24 bp, Artificial Sequence
  Description of Artificial Sequence: Synthetic oligonucleotide
agtggccgtccaccgcatgcaagc

SEQ ID NO: 201313 - DNA, 23 bp, Artificial Sequence
  Description of Artificial Sequence: Synthetic oligonucleotide
gtggccgtccaccgcatgcaagc

SEQ ID NO: 201314 - DNA, 24 bp, Artificial Sequence
  Description of Artificial Sequence: Synthetic oligonucleotide
tggccgtccaccgcatgcaagcca

SEQ ID NO: 201315 - DNA, 23 bp, Artificial Sequence
  Description of Artificial Sequence: Synthetic oligonucleotide
ggccgtccaccgcatgcaagcca

SEQ ID NO: 201316 - DNA, 23 bp, Artificial Sequence
  Description of Artificial Sequence: Synthetic oligonucleotide
gccgtccaccgcatgcaagccag

SEQ ID NO: 201317 - DNA, 23 bp, Artificial Sequence
  Description of Artificial Sequence: Synthetic oligonucleotide
ccgtccaccgcatgcaagccagc

SEQ ID NO: 201318 - DNA, 24 bp, Artificial Sequence
  Description of Artificial Sequence: Synthetic oligonucleotide
cgtccaccgcatgcaagccagcca

SEQ ID NO: 201319 - DNA, 24 bp, Artificial Sequence
  Description of Artificial Sequence: Synthetic oligonucleotide
gtccaccgcatgcaagccagccac

SEQ ID NO: 201320 - DNA, 24 bp, Artificial Sequence
  Description of Artificial Sequence: Synthetic oligonucleotide
tccaccgcatgcaagccagccacg

SEQ ID NO: 201321 - DNA, 23 bp, Artificial Sequence
  Description of Artificial Sequence: Synthetic oligonucleotide
ccaccgcatgcaagccagccacg

SEQ ID NO: 201322 - DNA, 23 bp, Artificial Sequence
  Description of Artificial Sequence: Synthetic oligonucleotide
caccgcatgcaagccagccacgg

SEQ ID NO: 201323 - DNA, 23 bp, Artificial Sequence
  Description of Artificial Sequence: Synthetic oligonucleotide
accgcatgcaagccagccacggg

SEQ ID NO: 201324 - DNA, 22 bp, Artificial Sequence
  Description of Artificial Sequence: Synthetic oligonucleotide
ccgcatgcaagccagccacggg

SEQ ID NO: 201325 - DNA, 23 bp, Artificial Sequence
  Description of Artificial Sequence: Synthetic oligonucleotide
cgcatgcaagccagccacgggga

SEQ ID NO: 201326 - DNA, 24 bp, Artificial Sequence
  Description of Artificial Sequence: Synthetic oligonucleotide
gcatgcaagccagccacggggaga

SEQ ID NO: 201327 - DNA, 24 bp, Artificial Sequence
  Description of Artificial Sequence: Synthetic oligonucleotide
catgcaagccagccacggggagac

SEQ ID NO: 201328 - DNA, 27 bp, Artificial Sequence
  Description of Artificial Sequence: Synthetic oligonucleotide
atgcaagccagccacggggagaccttt

SEQ ID NO: 201329 - DNA, 26 bp, Artificial Sequence
  Description of Artificial Sequence: Synthetic oligonucleotide
tgcaagccagccacggggagaccttt

SEQ ID NO: 201330 - DNA, 25 bp, Artificial Sequence
  Description of Artificial Sequence: Synthetic oligonucleotide
gcaagccagccacggggagaccttt

SEQ ID NO: 201331 - DNA, 27 bp, Artificial Sequence
  Description of Artificial Sequence: Synthetic oligonucleotide
caagccagccacggggagacctttcat

SEQ ID NO: 201332 - DNA, 27 bp, Artificial Sequence
  Description of Artificial Sequence: Synthetic oligonucleotide
aagccagccacggggagacctttcatg

SEQ ID NO: 201333 - DNA, 27 bp, Artificial Sequence
  Description of Artificial Sequence: Synthetic oligonucleotide
agccagccacggggagacctttcatgt

SEQ ID NO: 201334 - DNA, 26 bp, Artificial Sequence
  Description of Artificial Sequence: Synthetic oligonucleotide
gccagccacggggagacctttcatgt

SEQ ID NO: 201335 - DNA, 26 bp, Artificial Sequence
  Description of Artificial Sequence: Synthetic oligonucleotide
ccagccacggggagacctttcatgtg

SEQ ID NO: 201336 - DNA, 27 bp, Artificial Sequence
  Description of Artificial Sequence: Synthetic oligonucleotide
cagccacggggagacctttcatgtgct

SEQ ID NO: 201337 - DNA, 30 bp, Artificial Sequence
  Description of Artificial Sequence: Synthetic oligonucleotide
agccacggggagacctttcatgtgctttac

SEQ ID NO: 201338 - DNA, 29 bp, Artificial Sequence
  Description of Artificial Sequence: Synthetic oligonucleotide
gccacggggagacctttcatgtgctttac

SEQ ID NO: 201339 - DNA, 29 bp, Artificial Sequence
  Description of Artificial Sequence: Synthetic oligonucleotide
ccacggggagacctttcatgtgctttacc

SEQ ID NO: 201340 - DNA, 32 bp, Artificial Sequence
  Description of Artificial Sequence: Synthetic oligonucleotide
cacggggagacctttcatgtgctttacctaac

SEQ ID NO: 201341 - DNA, 34 bp, Artificial Sequence
  Description of Artificial Sequence: Synthetic oligonucleotide
acggggagacctttcatgtgctttacctaactac

SEQ ID NO: 201342 - DNA, 33 bp, Artificial Sequence
  Description of Artificial Sequence: Synthetic oligonucleotide
cggggagacctttcatgtgctttacctaactac

SEQ ID NO: 201343 - DNA, 34 bp, Artificial Sequence
  Description of Artificial Sequence: Synthetic oligonucleotide
ggggagacctttcatgtgctttacctaactacag

SEQ ID NO: 201344 - DNA, 35 bp, Artificial Sequence
  Description of Artificial Sequence: Synthetic oligonucleotide
gggagacctttcatgtgctttacctaactacagac

SEQ ID NO: 201345 - DNA, 36 bp, Artificial Sequence
  Description of Artificial Sequence: Synthetic oligonucleotide
ggagacctttcatgtgctttacctaactacagacag

SEQ ID NO: 201346 - DNA, 36 bp, Artificial Sequence
  Description of Artificial Sequence: Synthetic oligonucleotide
gagacctttcatgtgctttacctaactacagacagg

SEQ ID NO: 201347 - DNA, 36 bp, Artificial Sequence
  Description of Artificial Sequence: Synthetic oligonucleotide
agacctttcatgtgctttacctaactacagacaggg

SEQ ID NO: 201348 - DNA, 35 bp, Artificial Sequence
  Description of Artificial Sequence: Synthetic oligonucleotide
gacctttcatgtgctttacctaactacagacaggg

SEQ ID NO: 201349 - DNA, 35 bp, Artificial Sequence
  Description of Artificial Sequence: Synthetic oligonucleotide
acctttcatgtgctttacctaactacagacagggg

SEQ ID NO: 201350 - DNA, 34 bp, Artificial Sequence
  Description of Artificial Sequence: Synthetic oligonucleotide
cctttcatgtgctttacctaactacagacagggg

SEQ ID NO: 201351 - DNA, 34 bp, Artificial Sequence
  Description of Artificial Sequence: Synthetic oligonucleotide
ctttcatgtgctttacctaactacagacaggggc

SEQ ID NO: 201352 - DNA, 35 bp, Artificial Sequence
  Description of Artificial Sequence: Synthetic oligonucleotide
tttcatgtgctttacctaactacagacaggggcac

SEQ ID NO: 201353 - DNA, 34 bp, Artificial Sequence
  Description of Artificial Sequence: Synthetic oligonucleotide
ttcatgtgctttacctaactacagacaggggcac

SEQ ID NO: 201354 - DNA, 33 bp, Artificial Sequence
  Description of Artificial Sequence: Synthetic oligonucleotide
tcatgtgctttacctaactacagacaggggcac

SEQ ID NO: 201355 - DNA, 32 bp, Artificial Sequence
  Description of Artificial Sequence: Synthetic oligonucleotide
catgtgctttacctaactacagacaggggcac

SEQ ID NO: 201356 - DNA, 35 bp, Artificial Sequence
  Description of Artificial Sequence: Synthetic oligonucleotide
atgtgctttacctaactacagacaggggcactatc

SEQ ID NO: 201357 - DNA, 34 bp, Artificial Sequence
  Description of Artificial Sequence: Synthetic oligonucleotide
tgtgctttacctaactacagacaggggcactatc

SEQ ID NO: 201358 - DNA, 33 bp, Artificial Sequence
  Description of Artificial Sequence: Synthetic oligonucleotide
gtgctttacctaactacagacaggggcactatc

SEQ ID NO: 201359 - DNA, 33 bp, Artificial Sequence
  Description of Artificial Sequence: Synthetic oligonucleotide
tgctttacctaactacagacaggggcactatcc

SEQ ID NO: 201360 - DNA, 32 bp, Artificial Sequence
  Description of Artificial Sequence: Synthetic oligonucleotide
gctttacctaactacagacaggggcactatcc

SEQ ID NO: 201361 - DNA, 33 bp, Artificial Sequence
  Description of Artificial Sequence: Synthetic oligonucleotide
ctttacctaactacagacaggggcactatccac

SEQ ID NO: 201362 - DNA, 35 bp, Artificial Sequence
  Description of Artificial Sequence: Synthetic oligonucleotide
tttacctaactacagacaggggcactatccacaag

SEQ ID NO: 201363 - DNA, 34 bp, Artificial Sequence
  Description of Artificial Sequence: Synthetic oligonucleotide
ttacctaactacagacaggggcactatccacaag

SEQ ID NO: 201364 - DNA, 33 bp, Artificial Sequence
  Description of Artificial Sequence: Synthetic oligonucleotide
tacctaactacagacaggggcactatccacaag

SEQ ID NO: 201365 - DNA, 32 bp, Artificial Sequence
  Description of Artificial Sequence: Synthetic oligonucleotide
acctaactacagacaggggcactatccacaag

SEQ ID NO: 201366 - DNA, 31 bp, Artificial Sequence
  Description of Artificial Sequence: Synthetic oligonucleotide
cctaactacagacaggggcactatccacaag

SEQ ID NO: 201367 - DNA, 31 bp, Artificial Sequence
  Description of Artificial Sequence: Synthetic oligonucleotide
ctaactacagacaggggcactatccacaagg

SEQ ID NO: 201368 - DNA, 32 bp, Artificial Sequence
  Description of Artificial Sequence: Synthetic oligonucleotide
taactacagacaggggcactatccacaaggtg

SEQ ID NO: 201369 - DNA, 31 bp, Artificial Sequence
  Description of Artificial Sequence: Synthetic oligonucleotide
aactacagacaggggcactatccacaaggtg

SEQ ID NO: 201370 - DNA, 30 bp, Artificial Sequence
  Description of Artificial Sequence: Synthetic oligonucleotide
actacagacaggggcactatccacaaggtg

SEQ ID NO: 201371 - DNA, 29 bp, Artificial Sequence
  Description of Artificial Sequence: Synthetic oligonucleotide
ctacagacaggggcactatccacaaggtg

SEQ ID NO: 201372 - DNA, 29 bp, Artificial Sequence
  Description of Artificial Sequence: Synthetic oligonucleotide
tacagacaggggcactatccacaaggtgg

SEQ ID NO: 201373 - DNA, 28 bp, Artificial Sequence
  Description of Artificial Sequence: Synthetic oligonucleotide
acagacaggggcactatccacaaggtgg

SEQ ID NO: 201374 - DNA, 27 bp, Artificial Sequence
  Description of Artificial Sequence: Synthetic oligonucleotide
cagacaggggcactatccacaaggtgg

SEQ ID NO: 201375 - DNA, 28 bp, Artificial Sequence
  Description of Artificial Sequence: Synthetic oligonucleotide
agacaggggcactatccacaaggtggtg

SEQ ID NO: 201376 - DNA, 27 bp, Artificial Sequence
  Description of Artificial Sequence: Synthetic oligonucleotide
gacaggggcactatccacaaggtggtg

SEQ ID NO: 201377 - DNA, 27 bp, Artificial Sequence
  Description of Artificial Sequence: Synthetic oligonucleotide
acaggggcactatccacaaggtggtgg

SEQ ID NO: 201378 - DNA, 27 bp, Artificial Sequence
  Description of Artificial Sequence: Synthetic oligonucleotide
caggggcactatccacaaggtggtgga

SEQ ID NO: 201379 - DNA, 28 bp, Artificial Sequence
  Description of Artificial Sequence: Synthetic oligonucleotide
aggggcactatccacaaggtggtggaac

SEQ ID NO: 201380 - DNA, 27 bp, Artificial Sequence
  Description of Artificial Sequence: Synthetic oligonucleotide
ggggcactatccacaaggtggtggaac

SEQ ID NO: 201381 - DNA, 27 bp, Artificial Sequence
  Description of Artificial Sequence: Synthetic oligonucleotide
gggcactatccacaaggtggtggaacc

SEQ ID NO: 201382 - DNA, 27 bp, Artificial Sequence
  Description of Artificial Sequence: Synthetic oligonucleotide
ggcactatccacaaggtggtggaaccg

SEQ ID NO: 201383 - DNA, 27 bp, Artificial Sequence
  Description of Artificial Sequence: Synthetic oligonucleotide
gcactatccacaaggtggtggaaccgg

SEQ ID NO: 201384 - DNA, 27 bp, Artificial Sequence
  Description of Artificial Sequence: Synthetic oligonucleotide
cactatccacaaggtggtggaaccggg

SEQ ID NO: 201385 - DNA, 27 bp, Artificial Sequence
  Description of Artificial Sequence: Synthetic oligonucleotide
actatccacaaggtggtggaaccgggg

SEQ ID NO: 201386 - DNA, 26 bp, Artificial Sequence
  Description of Artificial Sequence: Synthetic oligonucleotide
ctatccacaaggtggtggaaccgggg

SEQ ID NO: 201387 - DNA, 27 bp, Artificial Sequence
  Description of Artificial Sequence: Synthetic oligonucleotide
tatccacaaggtggtggaaccggggga

SEQ ID NO: 201388 - DNA, 26 bp, Artificial Sequence
  Description of Artificial Sequence: Synthetic oligonucleotide
atccacaaggtggtggaaccggggga

SEQ ID NO: 201389 - DNA, 25 bp, Artificial Sequence
  Description of Artificial Sequence: Synthetic oligonucleotide
tccacaaggtggtggaaccggggga

SEQ ID NO: 201390 - DNA, 24 bp, Artificial Sequence
  Description of Artificial Sequence: Synthetic oligonucleotide
ccacaaggtggtggaaccggggga

SEQ ID NO: 201391 - DNA, 24 bp, Artificial Sequence
  Description of Artificial Sequence: Synthetic oligonucleotide
cacaaggtggtggaaccgggggag

SEQ ID NO: 201392 - DNA, 25 bp, Artificial Sequence
  Description of Artificial Sequence: Synthetic oligonucleotide
acaaggtggtggaaccgggggagca

SEQ ID NO: 201393 - DNA, 24 bp, Artificial Sequence
  Description of Artificial Sequence: Synthetic oligonucleotide
caaggtggtggaaccgggggagca

SEQ ID NO: 201394 - DNA, 24 bp, Artificial Sequence
  Description of Artificial Sequence: Synthetic oligonucleotide
aaggtggtggaaccgggggagcag

SEQ ID NO: 201395 - DNA, 23 bp, Artificial Sequence
  Description of Artificial Sequence: Synthetic oligonucleotide
aggtggtggaaccgggggagcag

SEQ ID NO: 201396 - DNA, 22 bp, Artificial Sequence
  Description of Artificial Sequence: Synthetic oligonucleotide
ggtggtggaaccgggggagcag

SEQ ID NO: 201397 - DNA, 23 bp, Artificial Sequence
  Description of Artificial Sequence: Synthetic oligonucleotide
gtggtggaaccgggggagcagga

SEQ ID NO: 201398 - DNA, 23 bp, Artificial Sequence
  Description of Artificial Sequence: Synthetic oligonucleotide
tggtggaaccgggggagcaggag

SEQ ID NO: 201399 - DNA, 22 bp, Artificial Sequence
  Description of Artificial Sequence: Synthetic oligonucleotide
ggtggaaccgggggagcaggag

SEQ ID NO: 201400 - DNA, 23 bp, Artificial Sequence
  Description of Artificial Sequence: Synthetic oligonucleotide
gtggaaccgggggagcaggagca

SEQ ID NO: 201401 - DNA, 24 bp, Artificial Sequence
  Description of Artificial Sequence: Synthetic oligonucleotide
tggaaccgggggagcaggagcaca

SEQ ID NO: 201402 - DNA, 23 bp, Artificial Sequence
  Description of Artificial Sequence: Synthetic oligonucleotide
ggaaccgggggagcaggagcaca

SEQ ID NO: 201403 - DNA, 23 bp, Artificial Sequence
  Description of Artificial Sequence: Synthetic oligonucleotide
gaaccgggggagcaggagcacag

SEQ ID NO: 201404 - DNA, 25 bp, Artificial Sequence
  Description of Artificial Sequence: Synthetic oligonucleotide
aaccgggggagcaggagcacagctt

SEQ ID NO: 201405 - DNA, 24 bp, Artificial Sequence
  Description of Artificial Sequence: Synthetic oligonucleotide
accgggggagcaggagcacagctt

SEQ ID NO: 201406 - DNA, 23 bp, Artificial Sequence
  Description of Artificial Sequence: Synthetic oligonucleotide
ccgggggagcaggagcacagctt

SEQ ID NO: 201407 - DNA, 23 bp, Artificial Sequence
  Description of Artificial Sequence: Synthetic oligonucleotide
cgggggagcaggagcacagcttc

SEQ ID NO: 201408 - DNA, 23 bp, Artificial Sequence
  Description of Artificial Sequence: Synthetic oligonucleotide
gggggagcaggagcacagcttcg

SEQ ID NO: 201409 - DNA, 23 bp, Artificial Sequence
  Description of Artificial Sequence: Synthetic oligonucleotide
ggggagcaggagcacagcttcgc

SEQ ID NO: 201410 - DNA, 25 bp, Artificial Sequence
  Description of Artificial Sequence: Synthetic oligonucleotide
gggagcaggagcacagcttcgcctt

SEQ ID NO: 201411 - DNA, 27 bp, Artificial Sequence
  Description of Artificial Sequence: Synthetic oligonucleotide
ggagcaggagcacagcttcgccttcaa

SEQ ID NO: 201412 - DNA, 27 bp, Artificial Sequence
  Description of Artificial Sequence: Synthetic oligonucleotide
gagcaggagcacagcttcgccttcaac

SEQ ID NO: 201413 - DNA, 29 bp, Artificial Sequence
  Description of Artificial Sequence: Synthetic oligonucleotide
agcaggagcacagcttcgccttcaacatc

SEQ ID NO: 201414 - DNA, 28 bp, Artificial Sequence
  Description of Artificial Sequence: Synthetic oligonucleotide
gcaggagcacagcttcgccttcaacatc

SEQ ID NO: 201415 - DNA, 30 bp, Artificial Sequence
  Description of Artificial Sequence: Synthetic oligonucleotide
caggagcacagcttcgccttcaacatcatg

SEQ ID NO: 201416 - DNA, 30 bp, Artificial Sequence
  Description of Artificial Sequence: Synthetic oligonucleotide
aggagcacagcttcgccttcaacatcatgg

SEQ ID NO: 201417 - DNA, 29 bp, Artificial Sequence
  Description of Artificial Sequence: Synthetic oligonucleotide
ggagcacagcttcgccttcaacatcatgg

SEQ ID NO: 201418 - DNA, 30 bp, Artificial Sequence
  Description of Artificial Sequence: Synthetic oligonucleotide
gagcacagcttcgccttcaacatcatggag

SEQ ID NO: 201419 - DNA, 32 bp, Artificial Sequence
  Description of Artificial Sequence: Synthetic oligonucleotide
agcacagcttcgccttcaacatcatggagatc

SEQ ID NO: 201420 - DNA, 31 bp, Artificial Sequence
  Description of Artificial Sequence: Synthetic oligonucleotide
gcacagcttcgccttcaacatcatggagatc

SEQ ID NO: 201421 - DNA, 31 bp, Artificial Sequence
  Description of Artificial Sequence: Synthetic oligonucleotide
cacagcttcgccttcaacatcatggagatcc

SEQ ID NO: 201422 - DNA, 32 bp, Artificial Sequence
  Description of Artificial Sequence: Synthetic oligonucleotide
acagcttcgccttcaacatcatggagatccag

SEQ ID NO: 201423 - DNA, 31 bp, Artificial Sequence
  Description of Artificial Sequence: Synthetic oligonucleotide
cagcttcgccttcaacatcatggagatccag

SEQ ID NO: 201424 - DNA, 31 bp, Artificial Sequence
  Description of Artificial Sequence: Synthetic oligonucleotide
agcttcgccttcaacatcatggagatccagc

SEQ ID NO: 201425 - DNA, 30 bp, Artificial Sequence
  Description of Artificial Sequence: Synthetic oligonucleotide
gcttcgccttcaacatcatggagatccagc

SEQ ID NO: 201426 - DNA, 30 bp, Artificial Sequence
  Description of Artificial Sequence: Synthetic oligonucleotide
cttcgccttcaacatcatggagatccagcc

SEQ ID NO: 201427 - DNA, 30 bp, Artificial Sequence
  Description of Artificial Sequence: Synthetic oligonucleotide
ttcgccttcaacatcatggagatccagccc

SEQ ID NO: 201428 - DNA, 29 bp, Artificial Sequence
  Description of Artificial Sequence: Synthetic oligonucleotide
tcgccttcaacatcatggagatccagccc

SEQ ID NO: 201429 - DNA, 28 bp, Artificial Sequence
  Description of Artificial Sequence: Synthetic oligonucleotide
cgccttcaacatcatggagatccagccc

SEQ ID NO: 201430 - DNA, 30 bp, Artificial Sequence
  Description of Artificial Sequence: Synthetic oligonucleotide
gccttcaacatcatggagatccagcccttc

SEQ ID NO: 201431 - DNA, 30 bp, Artificial Sequence
  Description of Artificial Sequence: Synthetic oligonucleotide
ccttcaacatcatggagatccagcccttcc

SEQ ID NO: 201432 - DNA, 30 bp, Artificial Sequence
  Description of Artificial Sequence: Synthetic oligonucleotide
cttcaacatcatggagatccagcccttccg

SEQ ID NO: 201433 - DNA, 30 bp, Artificial Sequence
  Description of Artificial Sequence: Synthetic oligonucleotide
ttcaacatcatggagatccagcccttccgc

SEQ ID NO: 201434 - DNA, 29 bp, Artificial Sequence
  Description of Artificial Sequence: Synthetic oligonucleotide
tcaacatcatggagatccagcccttccgc

SEQ ID NO: 201435 - DNA, 28 bp, Artificial Sequence
  Description of Artificial Sequence: Synthetic oligonucleotide
caacatcatggagatccagcccttccgc

SEQ ID NO: 201436 - DNA, 28 bp, Artificial Sequence
  Description of Artificial Sequence: Synthetic oligonucleotide
aacatcatggagatccagcccttccgcc

SEQ ID NO: 201437 - DNA, 27 bp, Artificial Sequence
  Description of Artificial Sequence: Synthetic oligonucleotide
acatcatggagatccagcccttccgcc

SEQ ID NO: 201438 - DNA, 26 bp, Artificial Sequence
  Description of Artificial Sequence: Synthetic oligonucleotide
catcatggagatccagcccttccgcc

SEQ ID NO: 201439 - DNA, 26 bp, Artificial Sequence
  Description of Artificial Sequence: Synthetic oligonucleotide
atcatggagatccagcccttccgccg

SEQ ID NO: 201440 - DNA, 25 bp, Artificial Sequence
  Description of Artificial Sequence: Synthetic oligonucleotide
tcatggagatccagcccttccgccg

SEQ ID NO: 201441 - DNA, 24 bp, Artificial Sequence
  Description of Artificial Sequence: Synthetic oligonucleotide
catggagatccagcccttccgccg

SEQ ID NO: 201442 - DNA, 24 bp, Artificial Sequence
  Description of Artificial Sequence: Synthetic oligonucleotide
atggagatccagcccttccgccgc

SEQ ID NO: 201443 - DNA, 23 bp, Artificial Sequence
  Description of Artificial Sequence: Synthetic oligonucleotide
tggagatccagcccttccgccgc

SEQ ID NO: 201444 - DNA, 22 bp, Artificial Sequence
  Description of Artificial Sequence: Synthetic oligonucleotide
ggagatccagcccttccgccgc

SEQ ID NO: 201445 - DNA, 22 bp, Artificial Sequence
  Description of Artificial Sequence: Synthetic oligonucleotide
gagatccagcccttccgccgcg

SEQ ID NO: 201446 - DNA, 22 bp, Artificial Sequence
  Description of Artificial Sequence: Synthetic oligonucleotide
agatccagcccttccgccgcgc

SEQ ID NO: 201447 - DNA, 21 bp, Artificial Sequence
  Description of Artificial Sequence: Synthetic oligonucleotide
gatccagcccttccgccgcgc

SEQ ID NO: 201448 - DNA, 21 bp, Artificial Sequence
  Description of Artificial Sequence: Synthetic oligonucleotide
atccagcccttccgccgcgcg

SEQ ID NO: 201449 - DNA, 20 bp, Artificial Sequence
  Description of Artificial Sequence: Synthetic oligonucleotide
tccagcccttccgccgcgcg

SEQ ID NO: 201450 - DNA, 20 bp, Artificial Sequence
  Description of Artificial Sequence: Synthetic oligonucleotide
ccagcccttccgccgcgcgt

SEQ ID NO: 201451 - DNA, 20 bp, Artificial Sequence
  Description of Artificial Sequence: Synthetic oligonucleotide
cagcccttccgccgcgcggt

SEQ ID NO: 201452 - DNA, 20 bp, Artificial Sequence
  Description of Artificial Sequence: Synthetic oligonucleotide
agcccttccgccgcgcggct

SEQ ID NO: 201453 - DNA, 20 bp, Artificial Sequence
  Description of Artificial Sequence: Synthetic oligonucleotide
gcccttccgccgcgcggctt

SEQ ID NO: 201454 - DNA, 20 bp, Artificial Sequence
  Description of Artificial Sequence: Synthetic oligonucleotide
cccttccgccgcgcggctgt

SEQ ID NO: 201455 - DNA, 20 bp, Artificial Sequence
  Description of Artificial Sequence: Synthetic oligonucleotide
ccttccgccgcgcggctgct

SEQ ID NO: 201456 - DNA, 21 bp, Artificial Sequence
  Description of Artificial Sequence: Synthetic oligonucleotide
cttccgccgcgcggctgccat

SEQ ID NO: 201457 - DNA, 21 bp, Artificial Sequence
  Description of Artificial Sequence: Synthetic oligonucleotide
ttccgccgcgcggctgccatc

SEQ ID NO: 201458 - DNA, 20 bp, Artificial Sequence
  Description of Artificial Sequence: Synthetic oligonucleotide
tccgccgcgcggctgccatc

SEQ ID NO: 201459 - DNA, 20 bp, Artificial Sequence
  Description of Artificial Sequence: Synthetic oligonucleotide
ccgccgcgcggctgccatct

SEQ ID NO: 201460 - DNA, 20 bp, Artificial Sequence
  Description of Artificial Sequence: Synthetic oligonucleotide
cgccgcgcggctgccatcca

SEQ ID NO: 201461 - DNA, 21 bp, Artificial Sequence
  Description of Artificial Sequence: Synthetic oligonucleotide
gccgcgcggctgccatccaga

SEQ ID NO: 201462 - DNA, 21 bp, Artificial Sequence
  Description of Artificial Sequence: Synthetic oligonucleotide
ccgcgcggctgccatccagac

SEQ ID NO: 201463 - DNA, 23 bp, Artificial Sequence
  Description of Artificial Sequence: Synthetic oligonucleotide
cgcgcggctgccatccagaccat

SEQ ID NO: 201464 - DNA, 24 bp, Artificial Sequence
  Description of Artificial Sequence: Synthetic oligonucleotide
gcgcggctgccatccagaccatgt

SEQ ID NO: 201465 - DNA, 24 bp, Artificial Sequence
  Description of Artificial Sequence: Synthetic oligonucleotide
cgcggctgccatccagaccatgtc

SEQ ID NO: 201466 - DNA, 24 bp, Artificial Sequence
  Description of Artificial Sequence: Synthetic oligonucleotide
gcggctgccatccagaccatgtcg

SEQ ID NO: 201467 - DNA, 25 bp, Artificial Sequence
  Description of Artificial Sequence: Synthetic oligonucleotide
cggctgccatccagaccatgtcgct

SEQ ID NO: 201468 - DNA, 25 bp, Artificial Sequence
  Description of Artificial Sequence: Synthetic oligonucleotide
ggctgccatccagaccatgtcgctg

SEQ ID NO: 201469 - DNA, 27 bp, Artificial Sequence
  Description of Artificial Sequence: Synthetic oligonucleotide
gctgccatccagaccatgtcgctggat

SEQ ID NO: 201470 - DNA, 27 bp, Artificial Sequence
  Description of Artificial Sequence: Synthetic oligonucleotide
ctgccatccagaccatgtcgctggatg

SEQ ID NO: 201471 - DNA, 27 bp, Artificial Sequence
  Description of Artificial Sequence: Synthetic oligonucleotide
tgccatccagaccatgtcgctggatgc

SEQ ID NO: 201472 - DNA, 27 bp, Artificial Sequence
  Description of Artificial Sequence: Synthetic oligonucleotide
gccatccagaccatgtcgctggatgct

SEQ ID NO: 201473 - DNA, 27 bp, Artificial Sequence
  Description of Artificial Sequence: Synthetic oligonucleotide
ccatccagaccatgtcgctggatgctg

SEQ ID NO: 201474 - DNA, 28 bp, Artificial Sequence
  Description of Artificial Sequence: Synthetic oligonucleotide
catccagaccatgtcgctggatgctgag

SEQ ID NO: 201475 - DNA, 28 bp, Artificial Sequence
  Description of Artificial Sequence: Synthetic oligonucleotide
atccagaccatgtcgctggatgctgagc

SEQ ID NO: 201476 - DNA, 27 bp, Artificial Sequence
  Description of Artificial Sequence: Synthetic oligonucleotide
tccagaccatgtcgctggatgctgagc

SEQ ID NO: 201477 - DNA, 26 bp, Artificial Sequence
  Description of Artificial Sequence: Synthetic oligonucleotide
ccagaccatgtcgctggatgctgagc

SEQ ID NO: 201478 - DNA, 26 bp, Artificial Sequence
  Description of Artificial Sequence: Synthetic oligonucleotide
cagaccatgtcgctggatgctgagcg

SEQ ID NO: 201479 - DNA, 27 bp, Artificial Sequence
  Description of Artificial Sequence: Synthetic oligonucleotide
agaccatgtcgctggatgctgagcgga

SEQ ID NO: 201480 - DNA, 26 bp, Artificial Sequence
  Description of Artificial Sequence: Synthetic oligonucleotide
gaccatgtcgctggatgctgagcgga

SEQ ID NO: 201481 - DNA, 26 bp, Artificial Sequence
  Description of Artificial Sequence: Synthetic oligonucleotide
accatgtcgctggatgctgagcggag

SEQ ID NO: 201482 - DNA, 25 bp, Artificial Sequence
  Description of Artificial Sequence: Synthetic oligonucleotide
ccatgtcgctggatgctgagcggag

SEQ ID NO: 201483 - DNA, 27 bp, Artificial Sequence
  Description of Artificial Sequence: Synthetic oligonucleotide
catgtcgctggatgctgagcggaggaa

SEQ ID NO: 201484 - DNA, 27 bp, Artificial Sequence
  Description of Artificial Sequence: Synthetic oligonucleotide
atgtcgctggatgctgagcggaggaag

SEQ ID NO: 201485 - DNA, 26 bp, Artificial Sequence
  Description of Artificial Sequence: Synthetic oligonucleotide
tgtcgctggatgctgagcggaggaag

SEQ ID NO: 201486 - DNA, 25 bp, Artificial Sequence
  Description of Artificial Sequence: Synthetic oligonucleotide
gtcgctggatgctgagcggaggaag

SEQ ID NO: 201487 - DNA, 26 bp, Artificial Sequence
  Description of Artificial Sequence: Synthetic oligonucleotide
tcgctggatgctgagcggaggaagct

SEQ ID NO: 201488 - DNA, 25 bp, Artificial Sequence
  Description of Artificial Sequence: Synthetic oligonucleotide
cgctggatgctgagcggaggaagct

SEQ ID NO: 201489 - DNA, 27 bp, Artificial Sequence
  Description of Artificial Sequence: Synthetic oligonucleotide
gctggatgctgagcggaggaagctgta

SEQ ID NO: 201490 - DNA, 28 bp, Artificial Sequence
  Description of Artificial Sequence: Synthetic oligonucleotide
ctggatgctgagcggaggaagctgtatg

SEQ ID NO: 201491 - DNA, 29 bp, Artificial Sequence
  Description of Artificial Sequence: Synthetic oligonucleotide
tggatgctgagcggaggaagctgtatgtg

SEQ ID NO: 201492 - DNA, 28 bp, Artificial Sequence
  Description of Artificial Sequence: Synthetic oligonucleotide
ggatgctgagcggaggaagctgtatgtg

SEQ ID NO: 201493 - DNA, 29 bp, Artificial Sequence
  Description of Artificial Sequence: Synthetic oligonucleotide
gatgctgagcggaggaagctgtatgtgag

SEQ ID NO: 201494 - DNA, 29 bp, Artificial Sequence
  Description of Artificial Sequence: Synthetic oligonucleotide
atgctgagcggaggaagctgtatgtgagc

SEQ ID NO: 201495 - DNA, 28 bp, Artificial Sequence
  Description of Artificial Sequence: Synthetic oligonucleotide
tgctgagcggaggaagctgtatgtgagc

SEQ ID NO: 201496 - DNA, 27 bp, Artificial Sequence
  Description of Artificial Sequence: Synthetic oligonucleotide
gctgagcggaggaagctgtatgtgagc

SEQ ID NO: 201497 - DNA, 28 bp, Artificial Sequence
  Description of Artificial Sequence: Synthetic oligonucleotide
ctgagcggaggaagctgtatgtgagctc

SEQ ID NO: 201498 - DNA, 28 bp, Artificial Sequence
  Description of Artificial Sequence: Synthetic oligonucleotide
tgagcggaggaagctgtatgtgagctcc

SEQ ID NO: 201499 - DNA, 27 bp, Artificial Sequence
  Description of Artificial Sequence: Synthetic oligonucleotide
gagcggaggaagctgtatgtgagctcc

SEQ ID NO: 201500 - DNA, 27 bp, Artificial Sequence
  Description of Artificial Sequence: Synthetic oligonucleotide
agcggaggaagctgtatgtgagctccc

SEQ ID NO: 201501 - DNA, 27 bp, Artificial Sequence
  Description of Artificial Sequence: Synthetic oligonucleotide
gcggaggaagctgtatgtgagctccca

SEQ ID NO: 201502 - DNA, 27 bp, Artificial Sequence
  Description of Artificial Sequence: Synthetic oligonucleotide
cggaggaagctgtatgtgagctcccag

SEQ ID NO: 201503 - DNA, 28 bp, Artificial Sequence
  Description of Artificial Sequence: Synthetic oligonucleotide
ggaggaagctgtatgtgagctcccagtg

SEQ ID NO: 201504 - DNA, 28 bp, Artificial Sequence
  Description of Artificial Sequence: Synthetic oligonucleotide
gaggaagctgtatgtgagctcccagtgg

SEQ ID NO: 201505 - DNA, 28 bp, Artificial Sequence
  Description of Artificial Sequence: Synthetic oligonucleotide
aggaagctgtatgtgagctcccagtggg

SEQ ID NO: 201506 - DNA, 27 bp, Artificial Sequence
  Description of Artificial Sequence: Synthetic oligonucleotide
ggaagctgtatgtgagctcccagtggg

SEQ ID NO: 201507 - DNA, 28 bp, Artificial Sequence
  Description of Artificial Sequence: Synthetic oligonucleotide
gaagctgtatgtgagctcccagtgggag

SEQ ID NO: 201508 - DNA, 28 bp, Artificial Sequence
  Description of Artificial Sequence: Synthetic oligonucleotide
aagctgtatgtgagctcccagtgggagg

SEQ ID NO: 201509 - DNA, 27 bp, Artificial Sequence
  Description of Artificial Sequence: Synthetic oligonucleotide
agctgtatgtgagctcccagtgggagg

SEQ ID NO: 201510 - DNA, 27 bp, Artificial Sequence
  Description of Artificial Sequence: Synthetic oligonucleotide
gctgtatgtgagctcccagtgggaggt

SEQ ID NO: 201511 - DNA, 27 bp, Artificial Sequence
  Description of Artificial Sequence: Synthetic oligonucleotide
ctgtatgtgagctcccagtgggaggtg

SEQ ID NO: 201512 - DNA, 28 bp, Artificial Sequence
  Description of Artificial Sequence: Synthetic oligonucleotide
tgtatgtgagctcccagtgggaggtgag

SEQ ID NO: 201513 - DNA, 27 bp, Artificial Sequence
  Description of Artificial Sequence: Synthetic oligonucleotide
gtatgtgagctcccagtgggaggtgag

SEQ ID NO: 201514 - DNA, 27 bp, Artificial Sequence
  Description of Artificial Sequence: Synthetic oligonucleotide
tatgtgagctcccagtgggaggtgagc

SEQ ID NO: 201515 - DNA, 26 bp, Artificial Sequence
  Description of Artificial Sequence: Synthetic oligonucleotide
atgtgagctcccagtgggaggtgagc

SEQ ID NO: 201516 - DNA, 25 bp, Artificial Sequence
  Description of Artificial Sequence: Synthetic oligonucleotide
tgtgagctcccagtgggaggtgagc

SEQ ID NO: 201517 - DNA, 24 bp, Artificial Sequence
  Description of Artificial Sequence: Synthetic oligonucleotide
gtgagctcccagtgggaggtgagc

SEQ ID NO: 201518 - DNA, 25 bp, Artificial Sequence
  Description of Artificial Sequence: Synthetic oligonucleotide
tgagctcccagtgggaggtgagcca

SEQ ID NO: 201519 - DNA, 24 bp, Artificial Sequence
  Description of Artificial Sequence: Synthetic oligonucleotide
gagctcccagtgggaggtgagcca

SEQ ID NO: 201520 - DNA, 24 bp, Artificial Sequence
  Description of Artificial Sequence: Synthetic oligonucleotide
agctcccagtgggaggtgagccag

SEQ ID NO: 201521 - DNA, 23 bp, Artificial Sequence
  Description of Artificial Sequence: Synthetic oligonucleotide
gctcccagtgggaggtgagccag

SEQ ID NO: 201522 - DNA, 24 bp, Artificial Sequence
  Description of Artificial Sequence: Synthetic oligonucleotide
ctcccagtgggaggtgagccaggt

SEQ ID NO: 201523 - DNA, 24 bp, Artificial Sequence
  Description of Artificial Sequence: Synthetic oligonucleotide
tcccagtgggaggtgagccaggtg

SEQ ID NO: 201524 - DNA, 23 bp, Artificial Sequence
  Description of Artificial Sequence: Synthetic oligonucleotide
cccagtgggaggtgagccaggtg

SEQ ID NO: 201525 - DNA, 23 bp, Artificial Sequence
  Description of Artificial Sequence: Synthetic oligonucleotide
ccagtgggaggtgagccaggtgc

SEQ ID NO: 201526 - DNA, 23 bp, Artificial Sequence
  Description of Artificial Sequence: Synthetic oligonucleotide
cagtgggaggtgagccaggtgcc

SEQ ID NO: 201527 - DNA, 23 bp, Artificial Sequence
  Description of Artificial Sequence: Synthetic oligonucleotide
agtgggaggtgagccaggtgccc

SEQ ID NO: 201528 - DNA, 22 bp, Artificial Sequence
  Description of Artificial Sequence: Synthetic oligonucleotide
gtgggaggtgagccaggtgccc

SEQ ID NO: 201529 - DNA, 23 bp, Artificial Sequence
  Description of Artificial Sequence: Synthetic oligonucleotide
tgggaggtgagccaggtgcccct

SEQ ID NO: 201530 - DNA, 22 bp, Artificial Sequence
  Description of Artificial Sequence: Synthetic oligonucleotide
gggaggtgagccaggtgcccct

SEQ ID NO: 201531 - DNA, 22 bp, Artificial Sequence
  Description of Artificial Sequence: Synthetic oligonucleotide
ggaggtgagccaggtgcccctg

SEQ ID NO: 201532 - DNA, 23 bp, Artificial Sequence
  Description of Artificial Sequence: Synthetic oligonucleotide
gaggtgagccaggtgcccctgga

SEQ ID NO: 201533 - DNA, 23 bp, Artificial Sequence
  Description of Artificial Sequence: Synthetic oligonucleotide
aggtgagccaggtgcccctggac

SEQ ID NO: 201534 - DNA, 22 bp, Artificial Sequence
  Description of Artificial Sequence: Synthetic oligonucleotide
ggtgagccaggtgcccctggac

SEQ ID NO: 201535 - DNA, 23 bp, Artificial Sequence
  Description of Artificial Sequence: Synthetic oligonucleotide
gtgagccaggtgcccctggacct

SEQ ID NO: 201536 - DNA, 24 bp, Artificial Sequence
  Description of Artificial Sequence: Synthetic oligonucleotide
tgagccaggtgcccctggacctgt

SEQ ID NO: 201537 - DNA, 23 bp, Artificial Sequence
  Description of Artificial Sequence: Synthetic oligonucleotide
gagccaggtgcccctggacctgt

SEQ ID NO: 201538 - DNA, 24 bp, Artificial Sequence
  Description of Artificial Sequence: Synthetic oligonucleotide
agccaggtgcccctggacctgtgt

SEQ ID NO: 201539 - DNA, 23 bp, Artificial Sequence
  Description of Artificial Sequence: Synthetic oligonucleotide
gccaggtgcccctggacctgtgt

SEQ ID NO: 201540 - DNA, 24 bp, Artificial Sequence
  Description of Artificial Sequence: Synthetic oligonucleotide
ccaggtgcccctggacctgtgtga

SEQ ID NO: 201541 - DNA, 24 bp, Artificial Sequence
  Description of Artificial Sequence: Synthetic oligonucleotide
caggtgcccctggacctgtgtgag

SEQ ID NO: 201542 - DNA, 25 bp, Artificial Sequence
  Description of Artificial Sequence: Synthetic oligonucleotide
aggtgcccctggacctgtgtgaggt

SEQ ID NO: 201543 - DNA, 24 bp, Artificial Sequence
  Description of Artificial Sequence: Synthetic oligonucleotide
ggtgcccctggacctgtgtgaggt

SEQ ID NO: 201544 - DNA, 27 bp, Artificial Sequence
  Description of Artificial Sequence: Synthetic oligonucleotide
gtgcccctggacctgtgtgaggtctat

SEQ ID NO: 201545 - DNA, 27 bp, Artificial Sequence
  Description of Artificial Sequence: Synthetic oligonucleotide
tgcccctggacctgtgtgaggtctatg

SEQ ID NO: 201546 - DNA, 26 bp, Artificial Sequence
  Description of Artificial Sequence: Synthetic oligonucleotide
gcccctggacctgtgtgaggtctatg

SEQ ID NO: 201547 - DNA, 26 bp, Artificial Sequence
  Description of Artificial Sequence: Synthetic oligonucleotide
cccctggacctgtgtgaggtctatgg

SEQ ID NO: 201548 - DNA, 26 bp, Artificial Sequence
  Description of Artificial Sequence: Synthetic oligonucleotide
ccctggacctgtgtgaggtctatggc

SEQ ID NO: 201549 - DNA, 26 bp, Artificial Sequence
  Description of Artificial Sequence: Synthetic oligonucleotide
cctggacctgtgtgaggtctatggcg

SEQ ID NO: 201550 - DNA, 26 bp, Artificial Sequence
  Description of Artificial Sequence: Synthetic oligonucleotide
ctggacctgtgtgaggtctatggcgg

SEQ ID NO: 201551 - DNA, 26 bp, Artificial Sequence
  Description of Artificial Sequence: Synthetic oligonucleotide
tggacctgtgtgaggtctatggcggg

SEQ ID NO: 201552 - DNA, 25 bp, Artificial Sequence
  Description of Artificial Sequence: Synthetic oligonucleotide
ggacctgtgtgaggtctatggcggg

SEQ ID NO: 201553 - DNA, 25 bp, Artificial Sequence
  Description of Artificial Sequence: Synthetic oligonucleotide
gacctgtgtgaggtctatggcgggg

SEQ ID NO: 201554 - DNA, 25 bp, Artificial Sequence
  Description of Artificial Sequence: Synthetic oligonucleotide
acctgtgtgaggtctatggcggggg

SEQ ID NO: 201555 - DNA, 24 bp, Artificial Sequence
  Description of Artificial Sequence: Synthetic oligonucleotide
cctgtgtgaggtctatggcggggg

SEQ ID NO: 201556 - DNA, 25 bp, Artificial Sequence
  Description of Artificial Sequence: Synthetic oligonucleotide
ctgtgtgaggtctatggcgggggct

SEQ ID NO: 201557 - DNA, 25 bp, Artificial Sequence
  Description of Artificial Sequence: Synthetic oligonucleotide
tgtgtgaggtctatggcgggggctg

SEQ ID NO: 201558 - DNA, 24 bp, Artificial Sequence
  Description of Artificial Sequence: Synthetic oligonucleotide
gtgtgaggtctatggcgggggctg

SEQ ID NO: 201559 - DNA, 24 bp, Artificial Sequence
  Description of Artificial Sequence: Synthetic oligonucleotide
tgtgaggtctatggcgggggctgc

SEQ ID NO: 201560 - DNA, 23 bp, Artificial Sequence
  Description of Artificial Sequence: Synthetic oligonucleotide
gtgaggtctatggcgggggctgc

SEQ ID NO: 201561 - DNA, 24 bp, Artificial Sequence
  Description of Artificial Sequence: Synthetic oligonucleotide
tgaggtctatggcgggggctgcca

SEQ ID NO: 201562 - DNA, 23 bp, Artificial Sequence
  Description of Artificial Sequence: Synthetic oligonucleotide
gaggtctatggcgggggctgcca

SEQ ID NO: 201563 - DNA, 23 bp, Artificial Sequence
  Description of Artificial Sequence: Synthetic oligonucleotide
aggtctatggcgggggctgccac

SEQ ID NO: 201564 - DNA, 22 bp, Artificial Sequence
  Description of Artificial Sequence: Synthetic oligonucleotide
ggtctatggcgggggctgccac

SEQ ID NO: 201565 - DNA, 22 bp, Artificial Sequence
  Description of Artificial Sequence: Synthetic oligonucleotide
gtctatggcgggggctgccacg

SEQ ID NO: 201566 - DNA, 24 bp, Artificial Sequence
  Description of Artificial Sequence: Synthetic oligonucleotide
tctatggcgggggctgccacggtt

SEQ ID NO: 201567 - DNA, 23 bp, Artificial Sequence
  Description of Artificial Sequence: Synthetic oligonucleotide
ctatggcgggggctgccacggtt

SEQ ID NO: 201568 - DNA, 23 bp, Artificial Sequence
  Description of Artificial Sequence: Synthetic oligonucleotide
tatggcgggggctgccacggttg

SEQ ID NO: 201569 - DNA, 22 bp, Artificial Sequence
  Description of Artificial Sequence: Synthetic oligonucleotide
atggcgggggctgccacggttg

SEQ ID NO: 201570 - DNA, 21 bp, Artificial Sequence
  Description of Artificial Sequence: Synthetic oligonucleotide
tggcgggggctgccacggttg

SEQ ID NO: 201571 - DNA, 20 bp, Artificial Sequence
  Description of Artificial Sequence: Synthetic oligonucleotide
ggcgggggctgccacggttg

SEQ ID NO: 201572 - DNA, 20 bp, Artificial Sequence
  Description of Artificial Sequence: Synthetic oligonucleotide
gcgggggctgccacggttgc

SEQ ID NO: 201573 - DNA, 21 bp, Artificial Sequence
  Description of Artificial Sequence: Synthetic oligonucleotide
cgggggctgccacggttgcct

SEQ ID NO: 201574 - DNA, 23 bp, Artificial Sequence
  Description of Artificial Sequence: Synthetic oligonucleotide
gggggctgccacggttgcctcat

SEQ ID NO: 201575 - DNA, 24 bp, Artificial Sequence
  Description of Artificial Sequence: Synthetic oligonucleotide
ggggctgccacggttgcctcatgt

SEQ ID NO: 201576 - DNA, 24 bp, Artificial Sequence
  Description of Artificial Sequence: Synthetic oligonucleotide
gggctgccacggttgcctcatgtc

SEQ ID NO: 201577 - DNA, 24 bp, Artificial Sequence
  Description of Artificial Sequence: Synthetic oligonucleotide
ggctgccacggttgcctcatgtcc

SEQ ID NO: 201578 - DNA, 24 bp, Artificial Sequence
  Description of Artificial Sequence: Synthetic oligonucleotide
gctgccacggttgcctcatgtccc

SEQ ID NO: 201579 - DNA, 25 bp, Artificial Sequence
  Description of Artificial Sequence: Synthetic oligonucleotide
ctgccacggttgcctcatgtcccga

SEQ ID NO: 201580 - DNA, 26 bp, Artificial Sequence
  Description of Artificial Sequence: Synthetic oligonucleotide
tgccacggttgcctcatgtcccgaga

SEQ ID NO: 201581 - DNA, 25 bp, Artificial Sequence
  Description of Artificial Sequence: Synthetic oligonucleotide
gccacggttgcctcatgtcccgaga

SEQ ID NO: 201582 - DNA, 25 bp, Artificial Sequence
  Description of Artificial Sequence: Synthetic oligonucleotide
ccacggttgcctcatgtcccgagac

SEQ ID NO: 201583 - DNA, 25 bp, Artificial Sequence
  Description of Artificial Sequence: Synthetic oligonucleotide
cacggttgcctcatgtcccgagacc

SEQ ID NO: 201584 - DNA, 25 bp, Artificial Sequence
  Description of Artificial Sequence: Synthetic oligonucleotide
acggttgcctcatgtcccgagaccc

SEQ ID NO: 201585 - DNA, 24 bp, Artificial Sequence
  Description of Artificial Sequence: Synthetic oligonucleotide
cggttgcctcatgtcccgagaccc

SEQ ID NO: 201586 - DNA, 26 bp, Artificial Sequence
  Description of Artificial Sequence: Synthetic oligonucleotide
ggttgcctcatgtcccgagaccccta

SEQ ID NO: 201587 - DNA, 27 bp, Artificial Sequence
  Description of Artificial Sequence: Synthetic oligonucleotide
gttgcctcatgtcccgagacccctact

SEQ ID NO: 201588 - DNA, 27 bp, Artificial Sequence
  Description of Artificial Sequence: Synthetic oligonucleotide
ttgcctcatgtcccgagacccctactg

SEQ ID NO: 201589 - DNA, 26 bp, Artificial Sequence
  Description of Artificial Sequence: Synthetic oligonucleotide
tgcctcatgtcccgagacccctactg

SEQ ID NO: 201590 - DNA, 25 bp, Artificial Sequence
  Description of Artificial Sequence: Synthetic oligonucleotide
gcctcatgtcccgagacccctactg

SEQ ID NO: 201591 - DNA, 25 bp, Artificial Sequence
  Description of Artificial Sequence: Synthetic oligonucleotide
cctcatgtcccgagacccctactgc

SEQ ID NO: 201592 - DNA, 25 bp, Artificial Sequence
  Description of Artificial Sequence: Synthetic oligonucleotide
ctcatgtcccgagacccctactgcg

SEQ ID NO: 201593 - DNA, 25 bp, Artificial Sequence
  Description of Artificial Sequence: Synthetic oligonucleotide
tcatgtcccgagacccctactgcgg

SEQ ID NO: 201594 - DNA, 24 bp, Artificial Sequence
  Description of Artificial Sequence: Synthetic oligonucleotide
catgtcccgagacccctactgcgg

SEQ ID NO: 201595 - DNA, 25 bp, Artificial Sequence
  Description of Artificial Sequence: Synthetic oligonucleotide
atgtcccgagacccctactgcggct

SEQ ID NO: 201596 - DNA, 24 bp, Artificial Sequence
  Description of Artificial Sequence: Synthetic oligonucleotide
tgtcccgagacccctactgcggct

SEQ ID NO: 201597 - DNA, 23 bp, Artificial Sequence
  Description of Artificial Sequence: Synthetic oligonucleotide
gtcccgagacccctactgcggct

SEQ ID NO: 201598 - DNA, 23 bp, Artificial Sequence
  Description of Artificial Sequence: Synthetic oligonucleotide
tcccgagacccctactgcggctg

SEQ ID NO: 201599 - DNA, 22 bp, Artificial Sequence
  Description of Artificial Sequence: Synthetic oligonucleotide
cccgagacccctactgcggctg

SEQ ID NO: 201600 - DNA, 22 bp, Artificial Sequence
  Description of Artificial Sequence: Synthetic oligonucleotide
ccgagacccctactgcggctgg

SEQ ID NO: 201601 - DNA, 23 bp, Artificial Sequence
  Description of Artificial Sequence: Synthetic oligonucleotide
cgagacccctactgcggctggga

SEQ ID NO: 201602 - DNA, 23 bp, Artificial Sequence
  Description of Artificial Sequence: Synthetic oligonucleotide
gagacccctactgcggctgggac

SEQ ID NO: 201603 - DNA, 25 bp, Artificial Sequence
  Description of Artificial Sequence: Synthetic oligonucleotide
agacccctactgcggctgggaccaa

SEQ ID NO: 201604 - DNA, 24 bp, Artificial Sequence
  Description of Artificial Sequence: Synthetic oligonucleotide
gacccctactgcggctgggaccaa

SEQ ID NO: 201605 - DNA, 24 bp, Artificial Sequence
  Description of Artificial Sequence: Synthetic oligonucleotide
acccctactgcggctgggaccaag

SEQ ID NO: 201606 - DNA, 23 bp, Artificial Sequence
  Description of Artificial Sequence: Synthetic oligonucleotide
cccctactgcggctgggaccaag

SEQ ID NO: 201607 - DNA, 23 bp, Artificial Sequence
  Description of Artificial Sequence: Synthetic oligonucleotide
ccctactgcggctgggaccaagg

SEQ ID NO: 201608 - DNA, 23 bp, Artificial Sequence
  Description of Artificial Sequence: Synthetic oligonucleotide
cctactgcggctgggaccaaggc

SEQ ID NO: 201609 - DNA, 23 bp, Artificial Sequence
  Description of Artificial Sequence: Synthetic oligonucleotide
ctactgcggctgggaccaaggcc

SEQ ID NO: 201610 - DNA, 23 bp, Artificial Sequence
  Description of Artificial Sequence: Synthetic oligonucleotide
tactgcggctgggaccaaggccg

SEQ ID NO: 201611 - DNA, 22 bp, Artificial Sequence
  Description of Artificial Sequence: Synthetic oligonucleotide
actgcggctgggaccaaggccg

SEQ ID NO: 201612 - DNA, 21 bp, Artificial Sequence
  Description of Artificial Sequence: Synthetic oligonucleotide
ctgcggctgggaccaaggccg

SEQ ID NO: 201613 - DNA, 22 bp, Artificial Sequence
  Description of Artificial Sequence: Synthetic oligonucleotide
tgcggctgggaccaaggccgct

SEQ ID NO: 201614 - DNA, 21 bp, Artificial Sequence
  Description of Artificial Sequence: Synthetic oligonucleotide
gcggctgggaccaaggccgct

SEQ ID NO: 201615 - DNA, 21 bp, Artificial Sequence
  Description of Artificial Sequence: Synthetic oligonucleotide
cggctgggaccaaggccgctg

SEQ ID NO: 201616 - DNA, 23 bp, Artificial Sequence
  Description of Artificial Sequence: Synthetic oligonucleotide
ggctgggaccaaggccgctgcat

SEQ ID NO: 201617 - DNA, 24 bp, Artificial Sequence
  Description of Artificial Sequence: Synthetic oligonucleotide
gctgggaccaaggccgctgcatct

SEQ ID NO: 201618 - DNA, 24 bp, Artificial Sequence
  Description of Artificial Sequence: Synthetic oligonucleotide
ctgggaccaaggccgctgcatctc

SEQ ID NO: 201619 - DNA, 26 bp, Artificial Sequence
  Description of Artificial Sequence: Synthetic oligonucleotide
tgggaccaaggccgctgcatctccat

SEQ ID NO: 201620 - DNA, 25 bp, Artificial Sequence
  Description of Artificial Sequence: Synthetic oligonucleotide
gggaccaaggccgctgcatctccat

SEQ ID NO: 201621 - DNA, 27 bp, Artificial Sequence
  Description of Artificial Sequence: Synthetic oligonucleotide
ggaccaaggccgctgcatctccatcta

SEQ ID NO: 201622 - DNA, 27 bp, Artificial Sequence
  Description of Artificial Sequence: Synthetic oligonucleotide
gaccaaggccgctgcatctccatctac

SEQ ID NO: 201623 - DNA, 28 bp, Artificial Sequence
  Description of Artificial Sequence: Synthetic oligonucleotide
accaaggccgctgcatctccatctacag

SEQ ID NO: 201624 - DNA, 27 bp, Artificial Sequence
  Description of Artificial Sequence: Synthetic oligonucleotide
ccaaggccgctgcatctccatctacag

SEQ ID NO: 201625 - DNA, 27 bp, Artificial Sequence
  Description of Artificial Sequence: Synthetic oligonucleotide
caaggccgctgcatctccatctacagc

SEQ ID NO: 201626 - DNA, 28 bp, Artificial Sequence
  Description of Artificial Sequence: Synthetic oligonucleotide
aaggccgctgcatctccatctacagctc

SEQ ID NO: 201627 - DNA, 27 bp, Artificial Sequence
  Description of Artificial Sequence: Synthetic oligonucleotide
aggccgctgcatctccatctacagctc

SEQ ID NO: 201628 - DNA, 26 bp, Artificial Sequence
  Description of Artificial Sequence: Synthetic oligonucleotide
ggccgctgcatctccatctacagctc

SEQ ID NO: 201629 - DNA, 26 bp, Artificial Sequence
  Description of Artificial Sequence: Synthetic oligonucleotide
gccgctgcatctccatctacagctcc

SEQ ID NO: 201630 - DNA, 27 bp, Artificial Sequence
  Description of Artificial Sequence: Synthetic oligonucleotide
ccgctgcatctccatctacagctccga

SEQ ID NO: 201631 - DNA, 28 bp, Artificial Sequence
  Description of Artificial Sequence: Synthetic oligonucleotide
cgctgcatctccatctacagctccgaac

SEQ ID NO: 201632 - DNA, 28 bp, Artificial Sequence
  Description of Artificial Sequence: Synthetic oligonucleotide
gctgcatctccatctacagctccgaacg

SEQ ID NO: 201633 - DNA, 28 bp, Artificial Sequence
  Description of Artificial Sequence: Synthetic oligonucleotide
ctgcatctccatctacagctccgaacgg

SEQ ID NO: 201634 - DNA, 29 bp, Artificial Sequence
  Description of Artificial Sequence: Synthetic oligonucleotide
tgcatctccatctacagctccgaacggtc

SEQ ID NO: 201635 - DNA, 28 bp, Artificial Sequence
  Description of Artificial Sequence: Synthetic oligonucleotide
gcatctccatctacagctccgaacggtc

SEQ ID NO: 201636 - DNA, 29 bp, Artificial Sequence
  Description of Artificial Sequence: Synthetic oligonucleotide
catctccatctacagctccgaacggtcag

SEQ ID NO: 201637 - DNA, 30 bp, Artificial Sequence
  Description of Artificial Sequence: Synthetic oligonucleotide
atctccatctacagctccgaacggtcagtg

SEQ ID NO: 201638 - DNA, 29 bp, Artificial Sequence
  Description of Artificial Sequence: Synthetic oligonucleotide
tctccatctacagctccgaacggtcagtg

SEQ ID NO: 201639 - DNA, 28 bp, Artificial Sequence
  Description of Artificial Sequence: Synthetic oligonucleotide
ctccatctacagctccgaacggtcagtg

SEQ ID NO: 201640 - DNA, 28 bp, Artificial Sequence
  Description of Artificial Sequence: Synthetic oligonucleotide
tccatctacagctccgaacggtcagtgc

SEQ ID NO: 201641 - DNA, 27 bp, Artificial Sequence
  Description of Artificial Sequence: Synthetic oligonucleotide
ccatctacagctccgaacggtcagtgc

SEQ ID NO: 201642 - DNA, 28 bp, Artificial Sequence
  Description of Artificial Sequence: Synthetic oligonucleotide
catctacagctccgaacggtcagtgctg

SEQ ID NO: 201643 - DNA, 28 bp, Artificial Sequence
  Description of Artificial Sequence: Synthetic oligonucleotide
atctacagctccgaacggtcagtgctgc

SEQ ID NO: 201644 - DNA, 27 bp, Artificial Sequence
  Description of Artificial Sequence: Synthetic oligonucleotide
tctacagctccgaacggtcagtgctgc

SEQ ID NO: 201645 - DNA, 27 bp, Artificial Sequence
  Description of Artificial Sequence: Synthetic oligonucleotide
ctacagctccgaacggtcagtgctgca

SEQ ID NO: 201646 - DNA, 29 bp, Artificial Sequence
  Description of Artificial Sequence: Synthetic oligonucleotide
tacagctccgaacggtcagtgctgcaatc

SEQ ID NO: 201647 - DNA, 28 bp, Artificial Sequence
  Description of Artificial Sequence: Synthetic oligonucleotide
acagctccgaacggtcagtgctgcaatc

SEQ ID NO: 201648 - DNA, 27 bp, Artificial Sequence
  Description of Artificial Sequence: Synthetic oligonucleotide
cagctccgaacggtcagtgctgcaatc

SEQ ID NO: 201649 - DNA, 27 bp, Artificial Sequence
  Description of Artificial Sequence: Synthetic oligonucleotide
agctccgaacggtcagtgctgcaatcc

SEQ ID NO: 201650 - DNA, 27 bp, Artificial Sequence
  Description of Artificial Sequence: Synthetic oligonucleotide
gctccgaacggtcagtgctgcaatcca

SEQ ID NO: 201651 - DNA, 32 bp, Artificial Sequence
  Description of Artificial Sequence: Synthetic oligonucleotide
ctccgaacggtcagtgctgcaatccattaatc

SEQ ID NO: 201652 - DNA, 32 bp, Artificial Sequence
  Description of Artificial Sequence: Synthetic oligonucleotide
tccgaacggtcagtgctgcaatccattaatcc

SEQ ID NO: 201653 - DNA, 31 bp, Artificial Sequence
  Description of Artificial Sequence: Synthetic oligonucleotide
ccgaacggtcagtgctgcaatccattaatcc

SEQ ID NO: 201654 - DNA, 32 bp, Artificial Sequence
  Description of Artificial Sequence: Synthetic oligonucleotide
cgaacggtcagtgctgcaatccattaatccag

SEQ ID NO: 201655 - DNA, 32 bp, Artificial Sequence
  Description of Artificial Sequence: Synthetic oligonucleotide
gaacggtcagtgctgcaatccattaatccagc

SEQ ID NO: 201656 - DNA, 32 bp, Artificial Sequence
  Description of Artificial Sequence: Synthetic oligonucleotide
aacggtcagtgctgcaatccattaatccagcc

SEQ ID NO: 201657 - DNA, 31 bp, Artificial Sequence
  Description of Artificial Sequence: Synthetic oligonucleotide
acggtcagtgctgcaatccattaatccagcc

SEQ ID NO: 201658 - DNA, 30 bp, Artificial Sequence
  Description of Artificial Sequence: Synthetic oligonucleotide
cggtcagtgctgcaatccattaatccagcc

SEQ ID NO: 201659 - DNA, 30 bp, Artificial Sequence
  Description of Artificial Sequence: Synthetic oligonucleotide
ggtcagtgctgcaatccattaatccagccg

SEQ ID NO: 201660 - DNA, 31 bp, Artificial Sequence
  Description of Artificial Sequence: Synthetic oligonucleotide
gtcagtgctgcaatccattaatccagccgag

SEQ ID NO: 201661 - DNA, 31 bp, Artificial Sequence
  Description of Artificial Sequence: Synthetic oligonucleotide
tcagtgctgcaatccattaatccagccgagc

SEQ ID NO: 201662 - DNA, 30 bp, Artificial Sequence
  Description of Artificial Sequence: Synthetic oligonucleotide
cagtgctgcaatccattaatccagccgagc

SEQ ID NO: 201663 - DNA, 30 bp, Artificial Sequence
  Description of Artificial Sequence: Synthetic oligonucleotide
agtgctgcaatccattaatccagccgagcc

SEQ ID NO: 201664 - DNA, 29 bp, Artificial Sequence
  Description of Artificial Sequence: Synthetic oligonucleotide
gtgctgcaatccattaatccagccgagcc

SEQ ID NO: 201665 - DNA, 30 bp, Artificial Sequence
  Description of Artificial Sequence: Synthetic oligonucleotide
tgctgcaatccattaatccagccgagccac

SEQ ID NO: 201666 - DNA, 29 bp, Artificial Sequence
  Description of Artificial Sequence: Synthetic oligonucleotide
gctgcaatccattaatccagccgagccac

SEQ ID NO: 201667 - DNA, 30 bp, Artificial Sequence
  Description of Artificial Sequence: Synthetic oligonucleotide
ctgcaatccattaatccagccgagccacac

SEQ ID NO: 201668 - DNA, 32 bp, Artificial Sequence
  Description of Artificial Sequence: Synthetic oligonucleotide
tgcaatccattaatccagccgagccacacaag

SEQ ID NO: 201669 - DNA, 31 bp, Artificial Sequence
  Description of Artificial Sequence: Synthetic oligonucleotide
gcaatccattaatccagccgagccacacaag

SEQ ID NO: 201670 - DNA, 31 bp, Artificial Sequence
  Description of Artificial Sequence: Synthetic oligonucleotide
caatccattaatccagccgagccacacaagg

SEQ ID NO: 201671 - DNA, 32 bp, Artificial Sequence
  Description of Artificial Sequence: Synthetic oligonucleotide
aatccattaatccagccgagccacacaaggag

SEQ ID NO: 201672 - DNA, 31 bp, Artificial Sequence
  Description of Artificial Sequence: Synthetic oligonucleotide
atccattaatccagccgagccacacaaggag

SEQ ID NO: 201673 - DNA, 30 bp, Artificial Sequence
  Description of Artificial Sequence: Synthetic oligonucleotide
tccattaatccagccgagccacacaaggag

SEQ ID NO: 201674 - DNA, 29 bp, Artificial Sequence
  Description of Artificial Sequence: Synthetic oligonucleotide
ccattaatccagccgagccacacaaggag

SEQ ID NO: 201675 - DNA, 30 bp, Artificial Sequence
  Description of Artificial Sequence: Synthetic oligonucleotide
cattaatccagccgagccacacaaggagtg

SEQ ID NO: 201676 - DNA, 31 bp, Artificial Sequence
  Description of Artificial Sequence: Synthetic oligonucleotide
attaatccagccgagccacacaaggagtgtc

SEQ ID NO: 201677 - DNA, 30 bp, Artificial Sequence
  Description of Artificial Sequence: Synthetic oligonucleotide
ttaatccagccgagccacacaaggagtgtc

SEQ ID NO: 201678 - DNA, 29 bp, Artificial Sequence
  Description of Artificial Sequence: Synthetic oligonucleotide
taatccagccgagccacacaaggagtgtc

SEQ ID NO: 201679 - DNA, 28 bp, Artificial Sequence
  Description of Artificial Sequence: Synthetic oligonucleotide
aatccagccgagccacacaaggagtgtc

SEQ ID NO: 201680 - DNA, 27 bp, Artificial Sequence
  Description of Artificial Sequence: Synthetic oligonucleotide
atccagccgagccacacaaggagtgtc

SEQ ID NO: 201681 - DNA, 26 bp, Artificial Sequence
  Description of Artificial Sequence: Synthetic oligonucleotide
tccagccgagccacacaaggagtgtc

SEQ ID NO: 201682 - DNA, 25 bp, Artificial Sequence
  Description of Artificial Sequence: Synthetic oligonucleotide
ccagccgagccacacaaggagtgtc

SEQ ID NO: 201683 - DNA, 25 bp, Artificial Sequence
  Description of Artificial Sequence: Synthetic oligonucleotide
cagccgagccacacaaggagtgtcc

SEQ ID NO: 201684 - DNA, 27 bp, Artificial Sequence
  Description of Artificial Sequence: Synthetic oligonucleotide
agccgagccacacaaggagtgtcccaa

SEQ ID NO: 201685 - DNA, 26 bp, Artificial Sequence
  Description of Artificial Sequence: Synthetic oligonucleotide
gccgagccacacaaggagtgtcccaa

SEQ ID NO: 201686 - DNA, 26 bp, Artificial Sequence
  Description of Artificial Sequence: Synthetic oligonucleotide
ccgagccacacaaggagtgtcccaac

SEQ ID NO: 201687 - DNA, 26 bp, Artificial Sequence
  Description of Artificial Sequence: Synthetic oligonucleotide
cgagccacacaaggagtgtcccaacc

SEQ ID NO: 201688 - DNA, 26 bp, Artificial Sequence
  Description of Artificial Sequence: Synthetic oligonucleotide
gagccacacaaggagtgtcccaaccc

SEQ ID NO: 201689 - DNA, 27 bp, Artificial Sequence
  Description of Artificial Sequence: Synthetic oligonucleotide
agccacacaaggagtgtcccaacccca

SEQ ID NO: 201690 - DNA, 27 bp, Artificial Sequence
  Description of Artificial Sequence: Synthetic oligonucleotide
gccacacaaggagtgtcccaaccccaa

SEQ ID NO: 201691 - DNA, 28 bp, Artificial Sequence
  Description of Artificial Sequence: Synthetic oligonucleotide
ccacacaaggagtgtcccaaccccaaac

SEQ ID NO: 201692 - DNA, 28 bp, Artificial Sequence
  Description of Artificial Sequence: Synthetic oligonucleotide
cacacaaggagtgtcccaaccccaaacc

SEQ ID NO: 201693 - DNA, 29 bp, Artificial Sequence
  Description of Artificial Sequence: Synthetic oligonucleotide
acacaaggagtgtcccaaccccaaaccag

SEQ ID NO: 201694 - DNA, 28 bp, Artificial Sequence
  Description of Artificial Sequence: Synthetic oligonucleotide
cacaaggagtgtcccaaccccaaaccag

SEQ ID NO: 201695 - DNA, 29 bp, Artificial Sequence
  Description of Artificial Sequence: Synthetic oligonucleotide
acaaggagtgtcccaaccccaaaccagac

SEQ ID NO: 201696 - DNA, 28 bp, Artificial Sequence
  Description of Artificial Sequence: Synthetic oligonucleotide
caaggagtgtcccaaccccaaaccagac

SEQ ID NO: 201697 - DNA, 30 bp, Artificial Sequence
  Description of Artificial Sequence: Synthetic oligonucleotide
aaggagtgtcccaaccccaaaccagacaag

SEQ ID NO: 201698 - DNA, 29 bp, Artificial Sequence
  Description of Artificial Sequence: Synthetic oligonucleotide
aggagtgtcccaaccccaaaccagacaag

SEQ ID NO: 201699 - DNA, 28 bp, Artificial Sequence
  Description of Artificial Sequence: Synthetic oligonucleotide
ggagtgtcccaaccccaaaccagacaag

SEQ ID NO: 201700 - DNA, 28 bp, Artificial Sequence
  Description of Artificial Sequence: Synthetic oligonucleotide
gagtgtcccaaccccaaaccagacaagg

SEQ ID NO: 201701 - DNA, 28 bp, Artificial Sequence
  Description of Artificial Sequence: Synthetic oligonucleotide
agtgtcccaaccccaaaccagacaaggc

SEQ ID NO: 201702 - DNA, 27 bp, Artificial Sequence
  Description of Artificial Sequence: Synthetic oligonucleotide
gtgtcccaaccccaaaccagacaaggc

SEQ ID NO: 201703 - DNA, 27 bp, Artificial Sequence
  Description of Artificial Sequence: Synthetic oligonucleotide
tgtcccaaccccaaaccagacaaggcc

SEQ ID NO: 201704 - DNA, 26 bp, Artificial Sequence
  Description of Artificial Sequence: Synthetic oligonucleotide
gtcccaaccccaaaccagacaaggcc

SEQ ID NO: 201705 - DNA, 26 bp, Artificial Sequence
  Description of Artificial Sequence: Synthetic oligonucleotide
tcccaaccccaaaccagacaaggccc

SEQ ID NO: 201706 - DNA, 25 bp, Artificial Sequence
  Description of Artificial Sequence: Synthetic oligonucleotide
cccaaccccaaaccagacaaggccc

SEQ ID NO: 201707 - DNA, 26 bp, Artificial Sequence
  Description of Artificial Sequence: Synthetic oligonucleotide
ccaaccccaaaccagacaaggcccca

SEQ ID NO: 201708 - DNA, 27 bp, Artificial Sequence
  Description of Artificial Sequence: Synthetic oligonucleotide
caaccccaaaccagacaaggccccact

SEQ ID NO: 201709 - DNA, 27 bp, Artificial Sequence
  Description of Artificial Sequence: Synthetic oligonucleotide
aaccccaaaccagacaaggccccactg

SEQ ID NO: 201710 - DNA, 26 bp, Artificial Sequence
  Description of Artificial Sequence: Synthetic oligonucleotide
accccaaaccagacaaggccccactg

SEQ ID NO: 201711 - DNA, 25 bp, Artificial Sequence
  Description of Artificial Sequence: Synthetic oligonucleotide
ccccaaaccagacaaggccccactg

SEQ ID NO: 201712 - DNA, 26 bp, Artificial Sequence
  Description of Artificial Sequence: Synthetic oligonucleotide
cccaaaccagacaaggccccactgca

SEQ ID NO: 201713 - DNA, 27 bp, Artificial Sequence
  Description of Artificial Sequence: Synthetic oligonucleotide
ccaaaccagacaaggccccactgcaga

SEQ ID NO: 201714 - DNA, 28 bp, Artificial Sequence
  Description of Artificial Sequence: Synthetic oligonucleotide
caaaccagacaaggccccactgcagaag

SEQ ID NO: 201715 - DNA, 28 bp, Artificial Sequence
  Description of Artificial Sequence: Synthetic oligonucleotide
aaaccagacaaggccccactgcagaagg

SEQ ID NO: 201716 - DNA, 27 bp, Artificial Sequence
  Description of Artificial Sequence: Synthetic oligonucleotide
aaccagacaaggccccactgcagaagg

SEQ ID NO: 201717 - DNA, 27 bp, Artificial Sequence
  Description of Artificial Sequence: Synthetic oligonucleotide
accagacaaggccccactgcagaaggt

SEQ ID NO: 201718 - DNA, 27 bp, Artificial Sequence
  Description of Artificial Sequence: Synthetic oligonucleotide
ccagacaaggccccactgcagaaggtt

SEQ ID NO: 201719 - DNA, 28 bp, Artificial Sequence
  Description of Artificial Sequence: Synthetic oligonucleotide
cagacaaggccccactgcagaaggtttc

SEQ ID NO: 201720 - DNA, 28 bp, Artificial Sequence
  Description of Artificial Sequence: Synthetic oligonucleotide
agacaaggccccactgcagaaggtttcc

SEQ ID NO: 201721 - DNA, 27 bp, Artificial Sequence
  Description of Artificial Sequence: Synthetic oligonucleotide
gacaaggccccactgcagaaggtttcc

SEQ ID NO: 201722 - DNA, 27 bp, Artificial Sequence
  Description of Artificial Sequence: Synthetic oligonucleotide
acaaggccccactgcagaaggtttccc

SEQ ID NO: 201723 - DNA, 27 bp, Artificial Sequence
  Description of Artificial Sequence: Synthetic oligonucleotide
caaggccccactgcagaaggtttccct

SEQ ID NO: 201724 - DNA, 27 bp, Artificial Sequence
  Description of Artificial Sequence: Synthetic oligonucleotide
aaggccccactgcagaaggtttccctg

SEQ ID NO: 201725 - DNA, 26 bp, Artificial Sequence
  Description of Artificial Sequence: Synthetic oligonucleotide
aggccccactgcagaaggtttccctg

SEQ ID NO: 201726 - DNA, 25 bp, Artificial Sequence
  Description of Artificial Sequence: Synthetic oligonucleotide
ggccccactgcagaaggtttccctg

SEQ ID NO: 201727 - DNA, 25 bp, Artificial Sequence
  Description of Artificial Sequence: Synthetic oligonucleotide
gccccactgcagaaggtttccctgg

SEQ ID NO: 201728 - DNA, 25 bp, Artificial Sequence
  Description of Artificial Sequence: Synthetic oligonucleotide
ccccactgcagaaggtttccctggc

SEQ ID NO: 201729 - DNA, 25 bp, Artificial Sequence
  Description of Artificial Sequence: Synthetic oligonucleotide
cccactgcagaaggtttccctggcc

SEQ ID NO: 201730 - DNA, 25 bp, Artificial Sequence
  Description of Artificial Sequence: Synthetic oligonucleotide
ccactgcagaaggtttccctggccc

SEQ ID NO: 201731 - DNA, 27 bp, Artificial Sequence
  Description of Artificial Sequence: Synthetic oligonucleotide
cactgcagaaggtttccctggccccaa

SEQ ID NO: 201732 - DNA, 28 bp, Artificial Sequence
  Description of Artificial Sequence: Synthetic oligonucleotide
actgcagaaggtttccctggccccaaac

SEQ ID NO: 201733 - DNA, 27 bp, Artificial Sequence
  Description of Artificial Sequence: Synthetic oligonucleotide
ctgcagaaggtttccctggccccaaac

SEQ ID NO: 201734 - DNA, 28 bp, Artificial Sequence
  Description of Artificial Sequence: Synthetic oligonucleotide
tgcagaaggtttccctggccccaaactc

SEQ ID NO: 201735 - DNA, 27 bp, Artificial Sequence
  Description of Artificial Sequence: Synthetic oligonucleotide
gcagaaggtttccctggccccaaactc

SEQ ID NO: 201736 - DNA, 28 bp, Artificial Sequence
  Description of Artificial Sequence: Synthetic oligonucleotide
cagaaggtttccctggccccaaactctc

SEQ ID NO: 201737 - DNA, 28 bp, Artificial Sequence
  Description of Artificial Sequence: Synthetic oligonucleotide
agaaggtttccctggccccaaactctcg

SEQ ID NO: 201738 - DNA, 27 bp, Artificial Sequence
  Description of Artificial Sequence: Synthetic oligonucleotide
gaaggtttccctggccccaaactctcg

SEQ ID NO: 201739 - DNA, 27 bp, Artificial Sequence
  Description of Artificial Sequence: Synthetic oligonucleotide
aaggtttccctggccccaaactctcgc

SEQ ID NO: 201740 - DNA, 27 bp, Artificial Sequence
  Description of Artificial Sequence: Synthetic oligonucleotide
aggtttccctggccccaaactctcgct

SEQ ID NO: 201741 - DNA, 27 bp, Artificial Sequence
  Description of Artificial Sequence: Synthetic oligonucleotide
ggtttccctggccccaaactctcgcta

SEQ ID NO: 201742 - DNA, 27 bp, Artificial Sequence
  Description of Artificial Sequence: Synthetic oligonucleotide
gtttccctggccccaaactctcgctac

SEQ ID NO: 201743 - DNA, 29 bp, Artificial Sequence
  Description of Artificial Sequence: Synthetic oligonucleotide
tttccctggccccaaactctcgctactac

SEQ ID NO: 201744 - DNA, 28 bp, Artificial Sequence
  Description of Artificial Sequence: Synthetic oligonucleotide
ttccctggccccaaactctcgctactac

SEQ ID NO: 201745 - DNA, 27 bp, Artificial Sequence
  Description of Artificial Sequence: Synthetic oligonucleotide
tccctggccccaaactctcgctactac

SEQ ID NO: 201746 - DNA, 26 bp, Artificial Sequence
  Description of Artificial Sequence: Synthetic oligonucleotide
ccctggccccaaactctcgctactac

SEQ ID NO: 201747 - DNA, 27 bp, Artificial Sequence
  Description of Artificial Sequence: Synthetic oligonucleotide
cctggccccaaactctcgctactacct

SEQ ID NO: 201748 - DNA, 27 bp, Artificial Sequence
  Description of Artificial Sequence: Synthetic oligonucleotide
ctggccccaaactctcgctactacctg

SEQ ID NO: 201749 - DNA, 28 bp, Artificial Sequence
  Description of Artificial Sequence: Synthetic oligonucleotide
tggccccaaactctcgctactacctgag

SEQ ID NO: 201750 - DNA, 27 bp, Artificial Sequence
  Description of Artificial Sequence: Synthetic oligonucleotide
ggccccaaactctcgctactacctgag

SEQ ID NO: 201751 - DNA, 27 bp, Artificial Sequence
  Description of Artificial Sequence: Synthetic oligonucleotide
gccccaaactctcgctactacctgagc

SEQ ID NO: 201752 - DNA, 28 bp, Artificial Sequence
  Description of Artificial Sequence: Synthetic oligonucleotide
ccccaaactctcgctactacctgagctg

SEQ ID NO: 201753 - DNA, 28 bp, Artificial Sequence
  Description of Artificial Sequence: Synthetic oligonucleotide
cccaaactctcgctactacctgagctgc

SEQ ID NO: 201754 - DNA, 28 bp, Artificial Sequence
  Description of Artificial Sequence: Synthetic oligonucleotide
ccaaactctcgctactacctgagctgcc

SEQ ID NO: 201755 - DNA, 28 bp, Artificial Sequence
  Description of Artificial Sequence: Synthetic oligonucleotide
caaactctcgctactacctgagctgccc

SEQ ID NO: 201756 - DNA, 28 bp, Artificial Sequence
  Description of Artificial Sequence: Synthetic oligonucleotide
aaactctcgctactacctgagctgcccc

SEQ ID NO: 201757 - DNA, 27 bp, Artificial Sequence
  Description of Artificial Sequence: Synthetic oligonucleotide
aactctcgctactacctgagctgcccc

SEQ ID NO: 201758 - DNA, 27 bp, Artificial Sequence
  Description of Artificial Sequence: Synthetic oligonucleotide
actctcgctactacctgagctgcccca

SEQ ID NO: 201759 - DNA, 27 bp, Artificial Sequence
  Description of Artificial Sequence: Synthetic oligonucleotide
ctctcgctactacctgagctgccccat

SEQ ID NO: 201760 - DNA, 27 bp, Artificial Sequence
  Description of Artificial Sequence: Synthetic oligonucleotide
tctcgctactacctgagctgccccatg

SEQ ID NO: 201761 - DNA, 26 bp, Artificial Sequence
  Description of Artificial Sequence: Synthetic oligonucleotide
ctcgctactacctgagctgccccatg

SEQ ID NO: 201762 - DNA, 27 bp, Artificial Sequence
  Description of Artificial Sequence: Synthetic oligonucleotide
tcgctactacctgagctgccccatgga

SEQ ID NO: 201763 - DNA, 27 bp, Artificial Sequence
  Description of Artificial Sequence: Synthetic oligonucleotide
cgctactacctgagctgccccatggaa

SEQ ID NO: 201764 - DNA, 28 bp, Artificial Sequence
  Description of Artificial Sequence: Synthetic oligonucleotide
gctactacctgagctgccccatggaatc

SEQ ID NO: 201765 - DNA, 28 bp, Artificial Sequence
  Description of Artificial Sequence: Synthetic oligonucleotide
ctactacctgagctgccccatggaatcc

SEQ ID NO: 201766 - DNA, 28 bp, Artificial Sequence
  Description of Artificial Sequence: Synthetic oligonucleotide
tactacctgagctgccccatggaatccc

SEQ ID NO: 201767 - DNA, 27 bp, Artificial Sequence
  Description of Artificial Sequence: Synthetic oligonucleotide
actacctgagctgccccatggaatccc

SEQ ID NO: 201768 - DNA, 26 bp, Artificial Sequence
  Description of Artificial Sequence: Synthetic oligonucleotide
ctacctgagctgccccatggaatccc

SEQ ID NO: 201769 - DNA, 26 bp, Artificial Sequence
  Description of Artificial Sequence: Synthetic oligonucleotide
tacctgagctgccccatggaatcccg

SEQ ID NO: 201770 - DNA, 25 bp, Artificial Sequence
  Description of Artificial Sequence: Synthetic oligonucleotide
acctgagctgccccatggaatcccg

SEQ ID NO: 201771 - DNA, 24 bp, Artificial Sequence
  Description of Artificial Sequence: Synthetic oligonucleotide
cctgagctgccccatggaatcccg

SEQ ID NO: 201772 - DNA, 24 bp, Artificial Sequence
  Description of Artificial Sequence: Synthetic oligonucleotide
ctgagctgccccatggaatcccgc

SEQ ID NO: 201773 - DNA, 25 bp, Artificial Sequence
  Description of Artificial Sequence: Synthetic oligonucleotide
tgagctgccccatggaatcccgcca

SEQ ID NO: 201774 - DNA, 24 bp, Artificial Sequence
  Description of Artificial Sequence: Synthetic oligonucleotide
gagctgccccatggaatcccgcca

SEQ ID NO: 201775 - DNA, 24 bp, Artificial Sequence
  Description of Artificial Sequence: Synthetic oligonucleotide
agctgccccatggaatcccgccac

SEQ ID NO: 201776 - DNA, 23 bp, Artificial Sequence
  Description of Artificial Sequence: Synthetic oligonucleotide
gctgccccatggaatcccgccac

SEQ ID NO: 201777 - DNA, 23 bp, Artificial Sequence
  Description of Artificial Sequence: Synthetic oligonucleotide
ctgccccatggaatcccgccacg

SEQ ID NO: 201778 - DNA, 23 bp, Artificial Sequence
  Description of Artificial Sequence: Synthetic oligonucleotide
tgccccatggaatcccgccacgc

SEQ ID NO: 201779 - DNA, 22 bp, Artificial Sequence
  Description of Artificial Sequence: Synthetic oligonucleotide
gccccatggaatcccgccacgc

SEQ ID NO: 201780 - DNA, 23 bp, Artificial Sequence
  Description of Artificial Sequence: Synthetic oligonucleotide
ccccatggaatcccgccacgcca

SEQ ID NO: 201781 - DNA, 23 bp, Artificial Sequence
  Description of Artificial Sequence: Synthetic oligonucleotide
cccatggaatcccgccacgccac

SEQ ID NO: 201782 - DNA, 25 bp, Artificial Sequence
  Description of Artificial Sequence: Synthetic oligonucleotide
ccatggaatcccgccacgccaccta

SEQ ID NO: 201783 - DNA, 26 bp, Artificial Sequence
  Description of Artificial Sequence: Synthetic oligonucleotide
catggaatcccgccacgccacctact

SEQ ID NO: 201784 - DNA, 27 bp, Artificial Sequence
  Description of Artificial Sequence: Synthetic oligonucleotide
atggaatcccgccacgccacctactca

SEQ ID NO: 201785 - DNA, 27 bp, Artificial Sequence
  Description of Artificial Sequence: Synthetic oligonucleotide
tggaatcccgccacgccacctactcat

SEQ ID NO: 201786 - DNA, 26 bp, Artificial Sequence
  Description of Artificial Sequence: Synthetic oligonucleotide
ggaatcccgccacgccacctactcat

SEQ ID NO: 201787 - DNA, 26 bp, Artificial Sequence
  Description of Artificial Sequence: Synthetic oligonucleotide
gaatcccgccacgccacctactcatg

SEQ ID NO: 201788 - DNA, 26 bp, Artificial Sequence
  Description of Artificial Sequence: Synthetic oligonucleotide
aatcccgccacgccacctactcatgg

SEQ ID NO: 201789 - DNA, 25 bp, Artificial Sequence
  Description of Artificial Sequence: Synthetic oligonucleotide
atcccgccacgccacctactcatgg

SEQ ID NO: 201790 - DNA, 24 bp, Artificial Sequence
  Description of Artificial Sequence: Synthetic oligonucleotide
tcccgccacgccacctactcatgg

SEQ ID NO: 201791 - DNA, 23 bp, Artificial Sequence
  Description of Artificial Sequence: Synthetic oligonucleotide
cccgccacgccacctactcatgg

SEQ ID NO: 201792 - DNA, 23 bp, Artificial Sequence
  Description of Artificial Sequence: Synthetic oligonucleotide
ccgccacgccacctactcatggc

SEQ ID NO: 201793 - DNA, 23 bp, Artificial Sequence
  Description of Artificial Sequence: Synthetic oligonucleotide
cgccacgccacctactcatggcg

SEQ ID NO: 201794 - DNA, 23 bp, Artificial Sequence
  Description of Artificial Sequence: Synthetic oligonucleotide
gccacgccacctactcatggcgc

SEQ ID NO: 201795 - DNA, 24 bp, Artificial Sequence
  Description of Artificial Sequence: Synthetic oligonucleotide
ccacgccacctactcatggcgcca

SEQ ID NO: 201796 - DNA, 26 bp, Artificial Sequence
  Description of Artificial Sequence: Synthetic oligonucleotide
cacgccacctactcatggcgccacaa

SEQ ID NO: 201797 - DNA, 26 bp, Artificial Sequence
  Description of Artificial Sequence: Synthetic oligonucleotide
acgccacctactcatggcgccacaag

SEQ ID NO: 201798 - DNA, 25 bp, Artificial Sequence
  Description of Artificial Sequence: Synthetic oligonucleotide
cgccacctactcatggcgccacaag

SEQ ID NO: 201799 - DNA, 26 bp, Artificial Sequence
  Description of Artificial Sequence: Synthetic oligonucleotide
gccacctactcatggcgccacaagga

SEQ ID NO: 201800 - DNA, 27 bp, Artificial Sequence
  Description of Artificial Sequence: Synthetic oligonucleotide
ccacctactcatggcgccacaaggaga

SEQ ID NO: 201801 - DNA, 28 bp, Artificial Sequence
  Description of Artificial Sequence: Synthetic oligonucleotide
cacctactcatggcgccacaaggagaac

SEQ ID NO: 201802 - DNA, 28 bp, Artificial Sequence
  Description of Artificial Sequence: Synthetic oligonucleotide
acctactcatggcgccacaaggagaacg

SEQ ID NO: 201803 - DNA, 27 bp, Artificial Sequence
  Description of Artificial Sequence: Synthetic oligonucleotide
cctactcatggcgccacaaggagaacg

SEQ ID NO: 201804 - DNA, 28 bp, Artificial Sequence
  Description of Artificial Sequence: Synthetic oligonucleotide
ctactcatggcgccacaaggagaacgtg

SEQ ID NO: 201805 - DNA, 28 bp, Artificial Sequence
  Description of Artificial Sequence: Synthetic oligonucleotide
tactcatggcgccacaaggagaacgtgg

SEQ ID NO: 201806 - DNA, 27 bp, Artificial Sequence
  Description of Artificial Sequence: Synthetic oligonucleotide
actcatggcgccacaaggagaacgtgg

SEQ ID NO: 201807 - DNA, 27 bp, Artificial Sequence
  Description of Artificial Sequence: Synthetic oligonucleotide
ctcatggcgccacaaggagaacgtgga

SEQ ID NO: 201808 - DNA, 27 bp, Artificial Sequence
  Description of Artificial Sequence: Synthetic oligonucleotide
tcatggcgccacaaggagaacgtggag

SEQ ID NO: 201809 - DNA, 26 bp, Artificial Sequence
  Description of Artificial Sequence: Synthetic oligonucleotide
catggcgccacaaggagaacgtggag

SEQ ID NO: 201810 - DNA, 27 bp, Artificial Sequence
  Description of Artificial Sequence: Synthetic oligonucleotide
atggcgccacaaggagaacgtggagca

SEQ ID NO: 201811 - DNA, 26 bp, Artificial Sequence
  Description of Artificial Sequence: Synthetic oligonucleotide
tggcgccacaaggagaacgtggagca

SEQ ID NO: 201812 - DNA, 25 bp, Artificial Sequence
  Description of Artificial Sequence: Synthetic oligonucleotide
ggcgccacaaggagaacgtggagca

SEQ ID NO: 201813 - DNA, 26 bp, Artificial Sequence
  Description of Artificial Sequence: Synthetic oligonucleotide
gcgccacaaggagaacgtggagcaga

SEQ ID NO: 201814 - DNA, 26 bp, Artificial Sequence
  Description of Artificial Sequence: Synthetic oligonucleotide
cgccacaaggagaacgtggagcagag

SEQ ID NO: 201815 - DNA, 27 bp, Artificial Sequence
  Description of Artificial Sequence: Synthetic oligonucleotide
gccacaaggagaacgtggagcagagct

SEQ ID NO: 201816 - DNA, 27 bp, Artificial Sequence
  Description of Artificial Sequence: Synthetic oligonucleotide
ccacaaggagaacgtggagcagagctg

SEQ ID NO: 201817 - DNA, 27 bp, Artificial Sequence
  Description of Artificial Sequence: Synthetic oligonucleotide
cacaaggagaacgtggagcagagctgc

SEQ ID NO: 201818 - DNA, 27 bp, Artificial Sequence
  Description of Artificial Sequence: Synthetic oligonucleotide
acaaggagaacgtggagcagagctgcg

SEQ ID NO: 201819 - DNA, 27 bp, Artificial Sequence
  Description of Artificial Sequence: Synthetic oligonucleotide
caaggagaacgtggagcagagctgcga

SEQ ID NO: 201820 - DNA, 28 bp, Artificial Sequence
  Description of Artificial Sequence: Synthetic oligonucleotide
aaggagaacgtggagcagagctgcgaac

SEQ ID NO: 201821 - DNA, 27 bp, Artificial Sequence
  Description of Artificial Sequence: Synthetic oligonucleotide
aggagaacgtggagcagagctgcgaac

SEQ ID NO: 201822 - DNA, 26 bp, Artificial Sequence
  Description of Artificial Sequence: Synthetic oligonucleotide
ggagaacgtggagcagagctgcgaac

SEQ ID NO: 201823 - DNA, 27 bp, Artificial Sequence
  Description of Artificial Sequence: Synthetic oligonucleotide
gagaacgtggagcagagctgcgaacct

SEQ ID NO: 201824 - DNA, 27 bp, Artificial Sequence
  Description of Artificial Sequence: Synthetic oligonucleotide
agaacgtggagcagagctgcgaacctg

SEQ ID NO: 201825 - DNA, 26 bp, Artificial Sequence
  Description of Artificial Sequence: Synthetic oligonucleotide
gaacgtggagcagagctgcgaacctg

SEQ ID NO: 201826 - DNA, 27 bp, Artificial Sequence
  Description of Artificial Sequence: Synthetic oligonucleotide
aacgtggagcagagctgcgaacctggt

SEQ ID NO: 201827 - DNA, 26 bp, Artificial Sequence
  Description of Artificial Sequence: Synthetic oligonucleotide
acgtggagcagagctgcgaacctggt

SEQ ID NO: 201828 - DNA, 25 bp, Artificial Sequence
  Description of Artificial Sequence: Synthetic oligonucleotide
cgtggagcagagctgcgaacctggt

SEQ ID NO: 201829 - DNA, 26 bp, Artificial Sequence
  Description of Artificial Sequence: Synthetic oligonucleotide
gtggagcagagctgcgaacctggtca

SEQ ID NO: 201830 - DNA, 26 bp, Artificial Sequence
  Description of Artificial Sequence: Synthetic oligonucleotide
tggagcagagctgcgaacctggtcac

SEQ ID NO: 201831 - DNA, 25 bp, Artificial Sequence
  Description of Artificial Sequence: Synthetic oligonucleotide
ggagcagagctgcgaacctggtcac

SEQ ID NO: 201832 - DNA, 26 bp, Artificial Sequence
  Description of Artificial Sequence: Synthetic oligonucleotide
gagcagagctgcgaacctggtcacca

SEQ ID NO: 201833 - DNA, 27 bp, Artificial Sequence
  Description of Artificial Sequence: Synthetic oligonucleotide
agcagagctgcgaacctggtcaccaga

SEQ ID NO: 201834 - DNA, 26 bp, Artificial Sequence
  Description of Artificial Sequence: Synthetic oligonucleotide
gcagagctgcgaacctggtcaccaga

SEQ ID NO: 201835 - DNA, 26 bp, Artificial Sequence
  Description of Artificial Sequence: Synthetic oligonucleotide
cagagctgcgaacctggtcaccagag

SEQ ID NO: 201836 - DNA, 26 bp, Artificial Sequence
  Description of Artificial Sequence: Synthetic oligonucleotide
agagctgcgaacctggtcaccagagc

SEQ ID NO: 201837 - DNA, 25 bp, Artificial Sequence
  Description of Artificial Sequence: Synthetic oligonucleotide
gagctgcgaacctggtcaccagagc

SEQ ID NO: 201838 - DNA, 25 bp, Artificial Sequence
  Description of Artificial Sequence: Synthetic oligonucleotide
agctgcgaacctggtcaccagagcc

SEQ ID NO: 201839 - DNA, 24 bp, Artificial Sequence
  Description of Artificial Sequence: Synthetic oligonucleotide
gctgcgaacctggtcaccagagcc

SEQ ID NO: 201840 - DNA, 24 bp, Artificial Sequence
  Description of Artificial Sequence: Synthetic oligonucleotide
ctgcgaacctggtcaccagagccc

SEQ ID NO: 201841 - DNA, 26 bp, Artificial Sequence
  Description of Artificial Sequence: Synthetic oligonucleotide
tgcgaacctggtcaccagagccccaa

SEQ ID NO: 201842 - DNA, 25 bp, Artificial Sequence
  Description of Artificial Sequence: Synthetic oligonucleotide
gcgaacctggtcaccagagccccaa

SEQ ID NO: 201843 - DNA, 26 bp, Artificial Sequence
  Description of Artificial Sequence: Synthetic oligonucleotide
cgaacctggtcaccagagccccaact

SEQ ID NO: 201844 - DNA, 26 bp, Artificial Sequence
  Description of Artificial Sequence: Synthetic oligonucleotide
gaacctggtcaccagagccccaactg

SEQ ID NO: 201845 - DNA, 27 bp, Artificial Sequence
  Description of Artificial Sequence: Synthetic oligonucleotide
aacctggtcaccagagccccaactgca

SEQ ID NO: 201846 - DNA, 27 bp, Artificial Sequence
  Description of Artificial Sequence: Synthetic oligonucleotide
acctggtcaccagagccccaactgcat

SEQ ID NO: 201847 - DNA, 26 bp, Artificial Sequence
  Description of Artificial Sequence: Synthetic oligonucleotide
cctggtcaccagagccccaactgcat

SEQ ID NO: 201848 - DNA, 26 bp, Artificial Sequence
  Description of Artificial Sequence: Synthetic oligonucleotide
ctggtcaccagagccccaactgcatc

SEQ ID NO: 201849 - DNA, 27 bp, Artificial Sequence
  Description of Artificial Sequence: Synthetic oligonucleotide
tggtcaccagagccccaactgcatcct

SEQ ID NO: 201850 - DNA, 26 bp, Artificial Sequence
  Description of Artificial Sequence: Synthetic oligonucleotide
ggtcaccagagccccaactgcatcct

SEQ ID NO: 201851 - DNA, 27 bp, Artificial Sequence
  Description of Artificial Sequence: Synthetic oligonucleotide
gtcaccagagccccaactgcatcctgt

SEQ ID NO: 201852 - DNA, 28 bp, Artificial Sequence
  Description of Artificial Sequence: Synthetic oligonucleotide
tcaccagagccccaactgcatcctgttc

SEQ ID NO: 201853 - DNA, 27 bp, Artificial Sequence
  Description of Artificial Sequence: Synthetic oligonucleotide
caccagagccccaactgcatcctgttc

SEQ ID NO: 201854 - DNA, 29 bp, Artificial Sequence
  Description of Artificial Sequence: Synthetic oligonucleotide
accagagccccaactgcatcctgttcatc

SEQ ID NO: 201855 - DNA, 28 bp, Artificial Sequence
  Description of Artificial Sequence: Synthetic oligonucleotide
ccagagccccaactgcatcctgttcatc

SEQ ID NO: 201856 - DNA, 28 bp, Artificial Sequence
  Description of Artificial Sequence: Synthetic oligonucleotide
cagagccccaactgcatcctgttcatcg

SEQ ID NO: 201857 - DNA, 29 bp, Artificial Sequence
  Description of Artificial Sequence: Synthetic oligonucleotide
agagccccaactgcatcctgttcatcgag

SEQ ID NO: 201858 - DNA, 28 bp, Artificial Sequence
  Description of Artificial Sequence: Synthetic oligonucleotide
gagccccaactgcatcctgttcatcgag

SEQ ID NO: 201859 - DNA, 30 bp, Artificial Sequence
  Description of Artificial Sequence: Synthetic oligonucleotide
agccccaactgcatcctgttcatcgagaac

SEQ ID NO: 201860 - DNA, 29 bp, Artificial Sequence
  Description of Artificial Sequence: Synthetic oligonucleotide
gccccaactgcatcctgttcatcgagaac

SEQ ID NO: 201861 - DNA, 29 bp, Artificial Sequence
  Description of Artificial Sequence: Synthetic oligonucleotide
ccccaactgcatcctgttcatcgagaacc

SEQ ID NO: 201862 - DNA, 30 bp, Artificial Sequence
  Description of Artificial Sequence: Synthetic oligonucleotide
cccaactgcatcctgttcatcgagaacctc

SEQ ID NO: 201863 - DNA, 31 bp, Artificial Sequence
  Description of Artificial Sequence: Synthetic oligonucleotide
ccaactgcatcctgttcatcgagaacctcac

SEQ ID NO: 201864 - DNA, 31 bp, Artificial Sequence
  Description of Artificial Sequence: Synthetic oligonucleotide
caactgcatcctgttcatcgagaacctcacg

SEQ ID NO: 201865 - DNA, 31 bp, Artificial Sequence
  Description of Artificial Sequence: Synthetic oligonucleotide
aactgcatcctgttcatcgagaacctcacgg

SEQ ID NO: 201866 - DNA, 30 bp, Artificial Sequence
  Description of Artificial Sequence: Synthetic oligonucleotide
actgcatcctgttcatcgagaacctcacgg

SEQ ID NO: 201867 - DNA, 29 bp, Artificial Sequence
  Description of Artificial Sequence: Synthetic oligonucleotide
ctgcatcctgttcatcgagaacctcacgg

SEQ ID NO: 201868 - DNA, 29 bp, Artificial Sequence
  Description of Artificial Sequence: Synthetic oligonucleotide
tgcatcctgttcatcgagaacctcacggc

SEQ ID NO: 201869 - DNA, 28 bp, Artificial Sequence
  Description of Artificial Sequence: Synthetic oligonucleotide
gcatcctgttcatcgagaacctcacggc

SEQ ID NO: 201870 - DNA, 28 bp, Artificial Sequence
  Description of Artificial Sequence: Synthetic oligonucleotide
catcctgttcatcgagaacctcacggcg

SEQ ID NO: 201871 - DNA, 28 bp, Artificial Sequence
  Description of Artificial Sequence: Synthetic oligonucleotide
atcctgttcatcgagaacctcacggcgc

SEQ ID NO: 201872 - DNA, 27 bp, Artificial Sequence
  Description of Artificial Sequence: Synthetic oligonucleotide
tcctgttcatcgagaacctcacggcgc

SEQ ID NO: 201873 - DNA, 27 bp, Artificial Sequence
  Description of Artificial Sequence: Synthetic oligonucleotide
cctgttcatcgagaacctcacggcgca

SEQ ID NO: 201874 - DNA, 27 bp, Artificial Sequence
  Description of Artificial Sequence: Synthetic oligonucleotide
ctgttcatcgagaacctcacggcgcag

SEQ ID NO: 201875 - DNA, 27 bp, Artificial Sequence
  Description of Artificial Sequence: Synthetic oligonucleotide
tgttcatcgagaacctcacggcgcagc

SEQ ID NO: 201876 - DNA, 27 bp, Artificial Sequence
  Description of Artificial Sequence: Synthetic oligonucleotide
gttcatcgagaacctcacggcgcagca

SEQ ID NO: 201877 - DNA, 27 bp, Artificial Sequence
  Description of Artificial Sequence: Synthetic oligonucleotide
ttcatcgagaacctcacggcgcagcag

SEQ ID NO: 201878 - DNA, 27 bp, Artificial Sequence
  Description of Artificial Sequence: Synthetic oligonucleotide
tcatcgagaacctcacggcgcagcagt

SEQ ID NO: 201879 - DNA, 27 bp, Artificial Sequence
  Description of Artificial Sequence: Synthetic oligonucleotide
catcgagaacctcacggcgcagcagta

SEQ ID NO: 201880 - DNA, 27 bp, Artificial Sequence
  Description of Artificial Sequence: Synthetic oligonucleotide
atcgagaacctcacggcgcagcagtac

SEQ ID NO: 201881 - DNA, 26 bp, Artificial Sequence
  Description of Artificial Sequence: Synthetic oligonucleotide
tcgagaacctcacggcgcagcagtac

SEQ ID NO: 201882 - DNA, 25 bp, Artificial Sequence
  Description of Artificial Sequence: Synthetic oligonucleotide
cgagaacctcacggcgcagcagtac

SEQ ID NO: 201883 - DNA, 25 bp, Artificial Sequence
  Description of Artificial Sequence: Synthetic oligonucleotide
gagaacctcacggcgcagcagtacg

SEQ ID NO: 201884 - DNA, 25 bp, Artificial Sequence
  Description of Artificial Sequence: Synthetic oligonucleotide
agaacctcacggcgcagcagtacgg

SEQ ID NO: 201885 - DNA, 24 bp, Artificial Sequence
  Description of Artificial Sequence: Synthetic oligonucleotide
gaacctcacggcgcagcagtacgg

SEQ ID NO: 201886 - DNA, 24 bp, Artificial Sequence
  Description of Artificial Sequence: Synthetic oligonucleotide
aacctcacggcgcagcagtacggc

SEQ ID NO: 201887 - DNA, 23 bp, Artificial Sequence
  Description of Artificial Sequence: Synthetic oligonucleotide
acctcacggcgcagcagtacggc

SEQ ID NO: 201888 - DNA, 22 bp, Artificial Sequence
  Description of Artificial Sequence: Synthetic oligonucleotide
cctcacggcgcagcagtacggc

SEQ ID NO: 201889 - DNA, 23 bp, Artificial Sequence
  Description of Artificial Sequence: Synthetic oligonucleotide
ctcacggcgcagcagtacggcca

SEQ ID NO: 201890 - DNA, 25 bp, Artificial Sequence
  Description of Artificial Sequence: Synthetic oligonucleotide
tcacggcgcagcagtacggccacta

SEQ ID NO: 201891 - DNA, 24 bp, Artificial Sequence
  Description of Artificial Sequence: Synthetic oligonucleotide
cacggcgcagcagtacggccacta

SEQ ID NO: 201892 - DNA, 26 bp, Artificial Sequence
  Description of Artificial Sequence: Synthetic oligonucleotide
acggcgcagcagtacggccactactt

SEQ ID NO: 201893 - DNA, 25 bp, Artificial Sequence
  Description of Artificial Sequence: Synthetic oligonucleotide
cggcgcagcagtacggccactactt

SEQ ID NO: 201894 - DNA, 26 bp, Artificial Sequence
  Description of Artificial Sequence: Synthetic oligonucleotide
ggcgcagcagtacggccactacttct

SEQ ID NO: 201895 - DNA, 26 bp, Artificial Sequence
  Description of Artificial Sequence: Synthetic oligonucleotide
gcgcagcagtacggccactacttctg

SEQ ID NO: 201896 - DNA, 26 bp, Artificial Sequence
  Description of Artificial Sequence: Synthetic oligonucleotide
cgcagcagtacggccactacttctgc

SEQ ID NO: 201897 - DNA, 27 bp, Artificial Sequence
  Description of Artificial Sequence: Synthetic oligonucleotide
gcagcagtacggccactacttctgcga

SEQ ID NO: 201898 - DNA, 27 bp, Artificial Sequence
  Description of Artificial Sequence: Synthetic oligonucleotide
cagcagtacggccactacttctgcgag

SEQ ID NO: 201899 - DNA, 27 bp, Artificial Sequence
  Description of Artificial Sequence: Synthetic oligonucleotide
agcagtacggccactacttctgcgagg

SEQ ID NO: 201900 - DNA, 26 bp, Artificial Sequence
  Description of Artificial Sequence: Synthetic oligonucleotide
gcagtacggccactacttctgcgagg

SEQ ID NO: 201901 - DNA, 26 bp, Artificial Sequence
  Description of Artificial Sequence: Synthetic oligonucleotide
cagtacggccactacttctgcgaggc

SEQ ID NO: 201902 - DNA, 26 bp, Artificial Sequence
  Description of Artificial Sequence: Synthetic oligonucleotide
agtacggccactacttctgcgaggcc

SEQ ID NO: 201903 - DNA, 25 bp, Artificial Sequence
  Description of Artificial Sequence: Synthetic oligonucleotide
gtacggccactacttctgcgaggcc

SEQ ID NO: 201904 - DNA, 26 bp, Artificial Sequence
  Description of Artificial Sequence: Synthetic oligonucleotide
tacggccactacttctgcgaggccca

SEQ ID NO: 201905 - DNA, 25 bp, Artificial Sequence
  Description of Artificial Sequence: Synthetic oligonucleotide
acggccactacttctgcgaggccca

SEQ ID NO: 201906 - DNA, 24 bp, Artificial Sequence
  Description of Artificial Sequence: Synthetic oligonucleotide
cggccactacttctgcgaggccca

SEQ ID NO: 201907 - DNA, 24 bp, Artificial Sequence
  Description of Artificial Sequence: Synthetic oligonucleotide
ggccactacttctgcgaggcccag

SEQ ID NO: 201908 - DNA, 25 bp, Artificial Sequence
  Description of Artificial Sequence: Synthetic oligonucleotide
gccactacttctgcgaggcccagga

SEQ ID NO: 201909 - DNA, 25 bp, Artificial Sequence
  Description of Artificial Sequence: Synthetic oligonucleotide
ccactacttctgcgaggcccaggag

SEQ ID NO: 201910 - DNA, 25 bp, Artificial Sequence
  Description of Artificial Sequence: Synthetic oligonucleotide
cactacttctgcgaggcccaggagg

SEQ ID NO: 201911 - DNA, 25 bp, Artificial Sequence
  Description of Artificial Sequence: Synthetic oligonucleotide
actacttctgcgaggcccaggaggg

SEQ ID NO: 201912 - DNA, 24 bp, Artificial Sequence
  Description of Artificial Sequence: Synthetic oligonucleotide
ctacttctgcgaggcccaggaggg

SEQ ID NO: 201913 - DNA, 25 bp, Artificial Sequence
  Description of Artificial Sequence: Synthetic oligonucleotide
tacttctgcgaggcccaggagggct

SEQ ID NO: 201914 - DNA, 24 bp, Artificial Sequence
  Description of Artificial Sequence: Synthetic oligonucleotide
acttctgcgaggcccaggagggct

SEQ ID NO: 201915 - DNA, 23 bp, Artificial Sequence
  Description of Artificial Sequence: Synthetic oligonucleotide
cttctgcgaggcccaggagggct

SEQ ID NO: 201916 - DNA, 23 bp, Artificial Sequence
  Description of Artificial Sequence: Synthetic oligonucleotide
ttctgcgaggcccaggagggctc

SEQ ID NO: 201917 - DNA, 22 bp, Artificial Sequence
  Description of Artificial Sequence: Synthetic oligonucleotide
tctgcgaggcccaggagggctc

SEQ ID NO: 201918 - DNA, 21 bp, Artificial Sequence
  Description of Artificial Sequence: Synthetic oligonucleotide
ctgcgaggcccaggagggctc

SEQ ID NO: 201919 - DNA, 23 bp, Artificial Sequence
  Description of Artificial Sequence: Synthetic oligonucleotide
tgcgaggcccaggagggctccta

SEQ ID NO: 201920 - DNA, 22 bp, Artificial Sequence
  Description of Artificial Sequence: Synthetic oligonucleotide
gcgaggcccaggagggctccta

SEQ ID NO: 201921 - DNA, 24 bp, Artificial Sequence
  Description of Artificial Sequence: Synthetic oligonucleotide
cgaggcccaggagggctcctactt

SEQ ID NO: 201922 - DNA, 24 bp, Artificial Sequence
  Description of Artificial Sequence: Synthetic oligonucleotide
gaggcccaggagggctcctacttc

SEQ ID NO: 201923 - DNA, 24 bp, Artificial Sequence
  Description of Artificial Sequence: Synthetic oligonucleotide
aggcccaggagggctcctacttcc

SEQ ID NO: 201924 - DNA, 23 bp, Artificial Sequence
  Description of Artificial Sequence: Synthetic oligonucleotide
ggcccaggagggctcctacttcc

SEQ ID NO: 201925 - DNA, 23 bp, Artificial Sequence
  Description of Artificial Sequence: Synthetic oligonucleotide
gcccaggagggctcctacttccg

SEQ ID NO: 201926 - DNA, 23 bp, Artificial Sequence
  Description of Artificial Sequence: Synthetic oligonucleotide
cccaggagggctcctacttccgc

SEQ ID NO: 201927 - DNA, 24 bp, Artificial Sequence
  Description of Artificial Sequence: Synthetic oligonucleotide
ccaggagggctcctacttccgcga

SEQ ID NO: 201928 - DNA, 24 bp, Artificial Sequence
  Description of Artificial Sequence: Synthetic oligonucleotide
caggagggctcctacttccgcgag

SEQ ID NO: 201929 - DNA, 24 bp, Artificial Sequence
  Description of Artificial Sequence: Synthetic oligonucleotide
aggagggctcctacttccgcgagg

SEQ ID NO: 201930 - DNA, 23 bp, Artificial Sequence
  Description of Artificial Sequence: Synthetic oligonucleotide
ggagggctcctacttccgcgagg

SEQ ID NO: 201931 - DNA, 24 bp, Artificial Sequence
  Description of Artificial Sequence: Synthetic oligonucleotide
gagggctcctacttccgcgaggct

SEQ ID NO: 201932 - DNA, 25 bp, Artificial Sequence
  Description of Artificial Sequence: Synthetic oligonucleotide
agggctcctacttccgcgaggctca

SEQ ID NO: 201933 - DNA, 24 bp, Artificial Sequence
  Description of Artificial Sequence: Synthetic oligonucleotide
gggctcctacttccgcgaggctca

SEQ ID NO: 201934 - DNA, 24 bp, Artificial Sequence
  Description of Artificial Sequence: Synthetic oligonucleotide
ggctcctacttccgcgaggctcag

SEQ ID NO: 201935 - DNA, 25 bp, Artificial Sequence
  Description of Artificial Sequence: Synthetic oligonucleotide
gctcctacttccgcgaggctcagca

SEQ ID NO: 201936 - DNA, 26 bp, Artificial Sequence
  Description of Artificial Sequence: Synthetic oligonucleotide
ctcctacttccgcgaggctcagcact

SEQ ID NO: 201937 - DNA, 26 bp, Artificial Sequence
  Description of Artificial Sequence: Synthetic oligonucleotide
tcctacttccgcgaggctcagcactg

SEQ ID NO: 201938 - DNA, 25 bp, Artificial Sequence
  Description of Artificial Sequence: Synthetic oligonucleotide
cctacttccgcgaggctcagcactg

SEQ ID NO: 201939 - DNA, 25 bp, Artificial Sequence
  Description of Artificial Sequence: Synthetic oligonucleotide
ctacttccgcgaggctcagcactgg

SEQ ID NO: 201940 - DNA, 26 bp, Artificial Sequence
  Description of Artificial Sequence: Synthetic oligonucleotide
tacttccgcgaggctcagcactggca

SEQ ID NO: 201941 - DNA, 25 bp, Artificial Sequence
  Description of Artificial Sequence: Synthetic oligonucleotide
acttccgcgaggctcagcactggca

SEQ ID NO: 201942 - DNA, 24 bp, Artificial Sequence
  Description of Artificial Sequence: Synthetic oligonucleotide
cttccgcgaggctcagcactggca

SEQ ID NO: 201943 - DNA, 24 bp, Artificial Sequence
  Description of Artificial Sequence: Synthetic oligonucleotide
ttccgcgaggctcagcactggcag

SEQ ID NO: 201944 - DNA, 23 bp, Artificial Sequence
  Description of Artificial Sequence: Synthetic oligonucleotide
tccgcgaggctcagcactggcag

SEQ ID NO: 201945 - DNA, 22 bp, Artificial Sequence
  Description of Artificial Sequence: Synthetic oligonucleotide
ccgcgaggctcagcactggcag

SEQ ID NO: 201946 - DNA, 23 bp, Artificial Sequence
  Description of Artificial Sequence: Synthetic oligonucleotide
cgcgaggctcagcactggcagct

SEQ ID NO: 201947 - DNA, 23 bp, Artificial Sequence
  Description of Artificial Sequence: Synthetic oligonucleotide
gcgaggctcagcactggcagctg

SEQ ID NO: 201948 - DNA, 24 bp, Artificial Sequence
  Description of Artificial Sequence: Synthetic oligonucleotide
cgaggctcagcactggcagctgct

SEQ ID NO: 201949 - DNA, 24 bp, Artificial Sequence
  Description of Artificial Sequence: Synthetic oligonucleotide
gaggctcagcactggcagctgctg

SEQ ID NO: 201950 - DNA, 24 bp, Artificial Sequence
  Description of Artificial Sequence: Synthetic oligonucleotide
aggctcagcactggcagctgctgc

SEQ ID NO: 201951 - DNA, 23 bp, Artificial Sequence
  Description of Artificial Sequence: Synthetic oligonucleotide
ggctcagcactggcagctgctgc

SEQ ID NO: 201952 - DNA, 23 bp, Artificial Sequence
  Description of Artificial Sequence: Synthetic oligonucleotide
gctcagcactggcagctgctgcc

SEQ ID NO: 201953 - DNA, 23 bp, Artificial Sequence
  Description of Artificial Sequence: Synthetic oligonucleotide
ctcagcactggcagctgctgccc

SEQ ID NO: 201954 - DNA, 24 bp, Artificial Sequence
  Description of Artificial Sequence: Synthetic oligonucleotide
tcagcactggcagctgctgcccga

SEQ ID NO: 201955 - DNA, 23 bp, Artificial Sequence
  Description of Artificial Sequence: Synthetic oligonucleotide
cagcactggcagctgctgcccga

SEQ ID NO: 201956 - DNA, 23 bp, Artificial Sequence
  Description of Artificial Sequence: Synthetic oligonucleotide
agcactggcagctgctgcccgag

SEQ ID NO: 201957 - DNA, 22 bp, Artificial Sequence
  Description of Artificial Sequence: Synthetic oligonucleotide
gcactggcagctgctgcccgag

SEQ ID NO: 201958 - DNA, 23 bp, Artificial Sequence
  Description of Artificial Sequence: Synthetic oligonucleotide
cactggcagctgctgcccgagga

SEQ ID NO: 201959 - DNA, 23 bp, Artificial Sequence
  Description of Artificial Sequence: Synthetic oligonucleotide
actggcagctgctgcccgaggac

SEQ ID NO: 201960 - DNA, 22 bp, Artificial Sequence
  Description of Artificial Sequence: Synthetic oligonucleotide
ctggcagctgctgcccgaggac

SEQ ID NO: 201961 - DNA, 22 bp, Artificial Sequence
  Description of Artificial Sequence: Synthetic oligonucleotide
tggcagctgctgcccgaggacg

SEQ ID NO: 201962 - DNA, 21 bp, Artificial Sequence
  Description of Artificial Sequence: Synthetic oligonucleotide
ggcagctgctgcccgaggacg

SEQ ID NO: 201963 - DNA, 21 bp, Artificial Sequence
  Description of Artificial Sequence: Synthetic oligonucleotide
gcagctgctgcccgaggacgg

SEQ ID NO: 201964 - DNA, 23 bp, Artificial Sequence
  Description of Artificial Sequence: Synthetic oligonucleotide
cagctgctgcccgaggacggcat

SEQ ID NO: 201965 - DNA, 25 bp, Artificial Sequence
  Description of Artificial Sequence: Synthetic oligonucleotide
agctgctgcccgaggacggcatcat

SEQ ID NO: 201966 - DNA, 24 bp, Artificial Sequence
  Description of Artificial Sequence: Synthetic oligonucleotide
gctgctgcccgaggacggcatcat

SEQ ID NO: 201967 - DNA, 24 bp, Artificial Sequence
  Description of Artificial Sequence: Synthetic oligonucleotide
ctgctgcccgaggacggcatcatg

SEQ ID NO: 201968 - DNA, 24 bp, Artificial Sequence
  Description of Artificial Sequence: Synthetic oligonucleotide
tgctgcccgaggacggcatcatgg

SEQ ID NO: 201969 - DNA, 23 bp, Artificial Sequence
  Description of Artificial Sequence: Synthetic oligonucleotide
gctgcccgaggacggcatcatgg

SEQ ID NO: 201970 - DNA, 23 bp, Artificial Sequence
  Description of Artificial Sequence: Synthetic oligonucleotide
ctgcccgaggacggcatcatggc

SEQ ID NO: 201971 - DNA, 23 bp, Artificial Sequence
  Description of Artificial Sequence: Synthetic oligonucleotide
tgcccgaggacggcatcatggcc

SEQ ID NO: 201972 - DNA, 22 bp, Artificial Sequence
  Description of Artificial Sequence: Synthetic oligonucleotide
gcccgaggacggcatcatggcc

SEQ ID NO: 201973 - DNA, 23 bp, Artificial Sequence
  Description of Artificial Sequence: Synthetic oligonucleotide
cccgaggacggcatcatggccga

SEQ ID NO: 201974 - DNA, 23 bp, Artificial Sequence
  Description of Artificial Sequence: Synthetic oligonucleotide
ccgaggacggcatcatggccgag

SEQ ID NO: 201975 - DNA, 24 bp, Artificial Sequence
  Description of Artificial Sequence: Synthetic oligonucleotide
cgaggacggcatcatggccgagca

SEQ ID NO: 201976 - DNA, 24 bp, Artificial Sequence
  Description of Artificial Sequence: Synthetic oligonucleotide
gaggacggcatcatggccgagcac

SEQ ID NO: 201977 - DNA, 25 bp, Artificial Sequence
  Description of Artificial Sequence: Synthetic oligonucleotide
aggacggcatcatggccgagcacct

SEQ ID NO: 201978 - DNA, 24 bp, Artificial Sequence
  Description of Artificial Sequence: Synthetic oligonucleotide
ggacggcatcatggccgagcacct

SEQ ID NO: 201979 - DNA, 24 bp, Artificial Sequence
  Description of Artificial Sequence: Synthetic oligonucleotide
gacggcatcatggccgagcacctg

SEQ ID NO: 201980 - DNA, 25 bp, Artificial Sequence
  Description of Artificial Sequence: Synthetic oligonucleotide
acggcatcatggccgagcacctgct

SEQ ID NO: 201981 - DNA, 24 bp, Artificial Sequence
  Description of Artificial Sequence: Synthetic oligonucleotide
cggcatcatggccgagcacctgct

SEQ ID NO: 201982 - DNA, 24 bp, Artificial Sequence
  Description of Artificial Sequence: Synthetic oligonucleotide
ggcatcatggccgagcacctgctg

SEQ ID NO: 201983 - DNA, 24 bp, Artificial Sequence
  Description of Artificial Sequence: Synthetic oligonucleotide
gcatcatggccgagcacctgctgg

SEQ ID NO: 201984 - DNA, 25 bp, Artificial Sequence
  Description of Artificial Sequence: Synthetic oligonucleotide
catcatggccgagcacctgctgggt

SEQ ID NO: 201985 - DNA, 27 bp, Artificial Sequence
  Description of Artificial Sequence: Synthetic oligonucleotide
atcatggccgagcacctgctgggtcat

SEQ ID NO: 201986 - DNA, 26 bp, Artificial Sequence
  Description of Artificial Sequence: Synthetic oligonucleotide
tcatggccgagcacctgctgggtcat

SEQ ID NO: 201987 - DNA, 25 bp, Artificial Sequence
  Description of Artificial Sequence: Synthetic oligonucleotide
catggccgagcacctgctgggtcat

SEQ ID NO: 201988 - DNA, 25 bp, Artificial Sequence
  Description of Artificial Sequence: Synthetic oligonucleotide
atggccgagcacctgctgggtcatg

SEQ ID NO: 201989 - DNA, 24 bp, Artificial Sequence
  Description of Artificial Sequence: Synthetic oligonucleotide
tggccgagcacctgctgggtcatg

SEQ ID NO: 201990 - DNA, 23 bp, Artificial Sequence
  Description of Artificial Sequence: Synthetic oligonucleotide
ggccgagcacctgctgggtcatg

SEQ ID NO: 201991 - DNA, 23 bp, Artificial Sequence
  Description of Artificial Sequence: Synthetic oligonucleotide
gccgagcacctgctgggtcatgc

SEQ ID NO: 201992 - DNA, 24 bp, Artificial Sequence
  Description of Artificial Sequence: Synthetic oligonucleotide
ccgagcacctgctgggtcatgcct

SEQ ID NO: 201993 - DNA, 25 bp, Artificial Sequence
  Description of Artificial Sequence: Synthetic oligonucleotide
cgagcacctgctgggtcatgcctgt

SEQ ID NO: 201994 - DNA, 25 bp, Artificial Sequence
  Description of Artificial Sequence: Synthetic oligonucleotide
gagcacctgctgggtcatgcctgtg

SEQ ID NO: 201995 - DNA, 25 bp, Artificial Sequence
  Description of Artificial Sequence: Synthetic oligonucleotide
agcacctgctgggtcatgcctgtgc

SEQ ID NO: 201996 - DNA, 24 bp, Artificial Sequence
  Description of Artificial Sequence: Synthetic oligonucleotide
gcacctgctgggtcatgcctgtgc

SEQ ID NO: 201997 - DNA, 24 bp, Artificial Sequence
  Description of Artificial Sequence: Synthetic oligonucleotide
cacctgctgggtcatgcctgtgcc

SEQ ID NO: 201998 - DNA, 25 bp, Artificial Sequence
  Description of Artificial Sequence: Synthetic oligonucleotide
acctgctgggtcatgcctgtgccct

SEQ ID NO: 201999 - DNA, 24 bp, Artificial Sequence
  Description of Artificial Sequence: Synthetic oligonucleotide
cctgctgggtcatgcctgtgccct

SEQ ID NO: 202000 - DNA, 24 bp, Artificial Sequence
  Description of Artificial Sequence: Synthetic oligonucleotide
ctgctgggtcatgcctgtgccctg

SEQ ID NO: 202001 - DNA, 24 bp, Artificial Sequence
  Description of Artificial Sequence: Synthetic oligonucleotide
tgctgggtcatgcctgtgccctgg

SEQ ID NO: 202002 - DNA, 23 bp, Artificial Sequence
  Description of Artificial Sequence: Synthetic oligonucleotide
gctgggtcatgcctgtgccctgg

SEQ ID NO: 202003 - DNA, 23 bp, Artificial Sequence
  Description of Artificial Sequence: Synthetic oligonucleotide
ctgggtcatgcctgtgccctggc

SEQ ID NO: 202004 - DNA, 23 bp, Artificial Sequence
  Description of Artificial Sequence: Synthetic oligonucleotide
tgggtcatgcctgtgccctggcc

SEQ ID NO: 202005 - DNA, 22 bp, Artificial Sequence
  Description of Artificial Sequence: Synthetic oligonucleotide
gggtcatgcctgtgccctggcc

SEQ ID NO: 202006 - DNA, 22 bp, Artificial Sequence
  Description of Artificial Sequence: Synthetic oligonucleotide
ggtcatgcctgtgccctggccg

SEQ ID NO: 202007 - DNA, 22 bp, Artificial Sequence
  Description of Artificial Sequence: Synthetic oligonucleotide
gtcatgcctgtgccctggccgc

SEQ ID NO: 202008 - DNA, 23 bp, Artificial Sequence
  Description of Artificial Sequence: Synthetic oligonucleotide
tcatgcctgtgccctggccgcct

SEQ ID NO: 202009 - DNA, 22 bp, Artificial Sequence
  Description of Artificial Sequence: Synthetic oligonucleotide
catgcctgtgccctggccgcct

SEQ ID NO: 202010 - DNA, 22 bp, Artificial Sequence
  Description of Artificial Sequence: Synthetic oligonucleotide
atgcctgtgccctggccgcctc

SEQ ID NO: 202011 - DNA, 21 bp, Artificial Sequence
  Description of Artificial Sequence: Synthetic oligonucleotide
tgcctgtgccctggccgcctc

SEQ ID NO: 202012 - DNA, 20 bp, Artificial Sequence
  Description of Artificial Sequence: Synthetic oligonucleotide
gcctgtgccctggccgcctc

SEQ ID NO: 202013 - DNA, 20 bp, Artificial Sequence
  Description of Artificial Sequence: Synthetic oligonucleotide
cctgtgccctggccgcctcc

SEQ ID NO: 202014 - DNA, 21 bp, Artificial Sequence
  Description of Artificial Sequence: Synthetic oligonucleotide
ctgtgccctggccgcctccct

SEQ ID NO: 202015 - DNA, 22 bp, Artificial Sequence
  Description of Artificial Sequence: Synthetic oligonucleotide
tgtgccctggccgcctccctct

SEQ ID NO: 202016 - DNA, 21 bp, Artificial Sequence
  Description of Artificial Sequence: Synthetic oligonucleotide
gtgccctggccgcctccctct

SEQ ID NO: 202017 - DNA, 21 bp, Artificial Sequence
  Description of Artificial Sequence: Synthetic oligonucleotide
tgccctggccgcctccctctg

SEQ ID NO: 202018 - DNA, 20 bp, Artificial Sequence
  Description of Artificial Sequence: Synthetic oligonucleotide
gccctggccgcctccctctg

SEQ ID NO: 202019 - DNA, 20 bp, Artificial Sequence
  Description of Artificial Sequence: Synthetic oligonucleotide
ccctggccgcctccctctgg

SEQ ID NO: 202020 - DNA, 21 bp, Artificial Sequence
  Description of Artificial Sequence: Synthetic oligonucleotide
cctggccgcctccctctggct

SEQ ID NO: 202021 - DNA, 21 bp, Artificial Sequence
  Description of Artificial Sequence: Synthetic oligonucleotide
ctggccgcctccctctggctg

SEQ ID NO: 202022 - DNA, 21 bp, Artificial Sequence
  Description of Artificial Sequence: Synthetic oligonucleotide
tggccgcctccctctggctgg

SEQ ID NO: 202023 - DNA, 20 bp, Artificial Sequence
  Description of Artificial Sequence: Synthetic oligonucleotide
ggccgcctccctctggctgg

SEQ ID NO: 202024 - DNA, 20 bp, Artificial Sequence
  Description of Artificial Sequence: Synthetic oligonucleotide
gccgcctccctctggctggg

SEQ ID NO: 202025 - DNA, 20 bp, Artificial Sequence
  Description of Artificial Sequence: Synthetic oligonucleotide
ccgcctccctctggctgggg

SEQ ID NO: 202026 - DNA, 21 bp, Artificial Sequence
  Description of Artificial Sequence: Synthetic oligonucleotide
cgcctccctctggctgggggt

SEQ ID NO: 202027 - DNA, 21 bp, Artificial Sequence
  Description of Artificial Sequence: Synthetic oligonucleotide
gcctccctctggctgggggtg

SEQ ID NO: 202028 - DNA, 22 bp, Artificial Sequence
  Description of Artificial Sequence: Synthetic oligonucleotide
cctccctctggctgggggtgct

SEQ ID NO: 202029 - DNA, 22 bp, Artificial Sequence
  Description of Artificial Sequence: Synthetic oligonucleotide
ctccctctggctgggggtgctg

SEQ ID NO: 202030 - DNA, 22 bp, Artificial Sequence
  Description of Artificial Sequence: Synthetic oligonucleotide
tccctctggctgggggtgctgc

SEQ ID NO: 202031 - DNA, 21 bp, Artificial Sequence
  Description of Artificial Sequence: Synthetic oligonucleotide
ccctctggctgggggtgctgc

SEQ ID NO: 202032 - DNA, 21 bp, Artificial Sequence
  Description of Artificial Sequence: Synthetic oligonucleotide
cctctggctgggggtgctgcc

SEQ ID NO: 202033 - DNA, 22 bp, Artificial Sequence
  Description of Artificial Sequence: Synthetic oligonucleotide
ctctggctgggggtgctgccca

SEQ ID NO: 202034 - DNA, 23 bp, Artificial Sequence
  Description of Artificial Sequence: Synthetic oligonucleotide
tctggctgggggtgctgcccaca

SEQ ID NO: 202035 - DNA, 22 bp, Artificial Sequence
  Description of Artificial Sequence: Synthetic oligonucleotide
ctggctgggggtgctgcccaca

SEQ ID NO: 202036 - DNA, 23 bp, Artificial Sequence
  Description of Artificial Sequence: Synthetic oligonucleotide
tggctgggggtgctgcccacact

SEQ ID NO: 202037 - DNA, 22 bp, Artificial Sequence
  Description of Artificial Sequence: Synthetic oligonucleotide
ggctgggggtgctgcccacact

SEQ ID NO: 202038 - DNA, 23 bp, Artificial Sequence
  Description of Artificial Sequence: Synthetic oligonucleotide
gctgggggtgctgcccacactca

SEQ ID NO: 202039 - DNA, 24 bp, Artificial Sequence
  Description of Artificial Sequence: Synthetic oligonucleotide
ctgggggtgctgcccacactcact

SEQ ID NO: 202040 - DNA, 26 bp, Artificial Sequence
  Description of Artificial Sequence: Synthetic oligonucleotide
tgggggtgctgcccacactcactctt

SEQ ID NO: 202041 - DNA, 25 bp, Artificial Sequence
  Description of Artificial Sequence: Synthetic oligonucleotide
gggggtgctgcccacactcactctt

SEQ ID NO: 202042 - DNA, 25 bp, Artificial Sequence
  Description of Artificial Sequence: Synthetic oligonucleotide
ggggtgctgcccacactcactcttg

SEQ ID NO: 202043 - DNA, 25 bp, Artificial Sequence
  Description of Artificial Sequence: Synthetic oligonucleotide
gggtgctgcccacactcactcttgg

SEQ ID NO: 202044 - DNA, 27 bp, Artificial Sequence
  Description of Artificial Sequence: Synthetic oligonucleotide
ggtgctgcccacactcactcttggctt

SEQ ID NO: 202045 - DNA, 27 bp, Artificial Sequence
  Description of Artificial Sequence: Synthetic oligonucleotide
gtgctgcccacactcactcttggcttg

SEQ ID NO: 202046 - DNA, 27 bp, Artificial Sequence
  Description of Artificial Sequence: Synthetic oligonucleotide
tgctgcccacactcactcttggcttgc

SEQ ID NO: 202047 - DNA, 27 bp, Artificial Sequence
  Description of Artificial Sequence: Synthetic oligonucleotide
gctgcccacactcactcttggcttgct

SEQ ID NO: 202048 - DNA, 27 bp, Artificial Sequence
  Description of Artificial Sequence: Synthetic oligonucleotide
ctgcccacactcactcttggcttgctg

SEQ ID NO: 202049 - DNA, 27 bp, Artificial Sequence
  Description of Artificial Sequence: Synthetic oligonucleotide
tgcccacactcactcttggcttgctgg

SEQ ID NO: 202050 - DNA, 27 bp, Artificial Sequence
  Description of Artificial Sequence: Synthetic oligonucleotide
gcccacactcactcttggcttgctggt

SEQ ID NO: 202051 - DNA, 27 bp, Artificial Sequence
  Description of Artificial Sequence: Synthetic oligonucleotide
cccacactcactcttggcttgctggtc

SEQ ID NO: 202052 - DNA, 27 bp, Artificial Sequence
  Description of Artificial Sequence: Synthetic oligonucleotide
ccacactcactcttggcttgctggtcc

SEQ ID NO: 202053 - DNA, 28 bp, Artificial Sequence
  Description of Artificial Sequence: Synthetic oligonucleotide
cacactcactcttggcttgctggtccac

SEQ ID NO: 202054 - DNA, 30 bp, Artificial Sequence
  Description of Artificial Sequence: Synthetic oligonucleotide
acactcactcttggcttgctggtccactag

SEQ ID NO: 202055 - DNA, 24 bp, Artificial Sequence
  Description of Artificial Sequence: Synthetic oligonucleotide
agacccctactgcggctgggacca

SEQ ID NO: 202056 - DNA, 23 bp, Artificial Sequence
  Description of Artificial Sequence: Synthetic oligonucleotide
gacccctactgcggctgggacca

SEQ ID NO: 202057 - DNA, 23 bp, Artificial Sequence
  Description of Artificial Sequence: Synthetic oligonucleotide
acccctactgcggctgggaccag

SEQ ID NO: 202058 - DNA, 22 bp, Artificial Sequence
  Description of Artificial Sequence: Synthetic oligonucleotide
cccctactgcggctgggaccag

SEQ ID NO: 202059 - DNA, 22 bp, Artificial Sequence
  Description of Artificial Sequence: Synthetic oligonucleotide
ccctactgcggctgggaccagg

SEQ ID NO: 202060 - DNA, 22 bp, Artificial Sequence
  Description of Artificial Sequence: Synthetic oligonucleotide
cctactgcggctgggaccaggg

SEQ ID NO: 202061 - DNA, 22 bp, Artificial Sequence
  Description of Artificial Sequence: Synthetic oligonucleotide
ctactgcggctgggaccagggc

SEQ ID NO: 202062 - DNA, 22 bp, Artificial Sequence
  Description of Artificial Sequence: Synthetic oligonucleotide
tactgcggctgggaccagggcc

SEQ ID NO: 202063 - DNA, 21 bp, Artificial Sequence
  Description of Artificial Sequence: Synthetic oligonucleotide
actgcggctgggaccagggcc

SEQ ID NO: 202064 - DNA, 20 bp, Artificial Sequence
  Description of Artificial Sequence: Synthetic oligonucleotide
ctgcggctgggaccagggcc

SEQ ID NO: 202065 - DNA, 20 bp, Artificial Sequence
  Description of Artificial Sequence: Synthetic oligonucleotide
tgcggctgggaccagggccg

SEQ ID NO: 202066 - DNA, 20 bp, Artificial Sequence
  Description of Artificial Sequence: Synthetic oligonucleotide
gcggctgggaccagggccgt

SEQ ID NO: 202067 - DNA, 20 bp, Artificial Sequence
  Description of Artificial Sequence: Synthetic oligonucleotide
cggctgggaccagggccgct

SEQ ID NO: 202068 - DNA, 20 bp, Artificial Sequence
  Description of Artificial Sequence: Synthetic oligonucleotide
ggctgggaccagggccgctg

SEQ ID NO: 202069 - DNA, 22 bp, Artificial Sequence
  Description of Artificial Sequence: Synthetic oligonucleotide
gctgggaccagggccgctgcat

SEQ ID NO: 202070 - DNA, 23 bp, Artificial Sequence
  Description of Artificial Sequence: Synthetic oligonucleotide
ctgggaccagggccgctgcatct

SEQ ID NO: 202071 - DNA, 23 bp, Artificial Sequence
  Description of Artificial Sequence: Synthetic oligonucleotide
tgggaccagggccgctgcatctc

SEQ ID NO: 202072 - DNA, 22 bp, Artificial Sequence
  Description of Artificial Sequence: Synthetic oligonucleotide
gggaccagggccgctgcatctc

SEQ ID NO: 202073 - DNA, 24 bp, Artificial Sequence
  Description of Artificial Sequence: Synthetic oligonucleotide
ggaccagggccgctgcatctccat

SEQ ID NO: 202074 - DNA, 26 bp, Artificial Sequence
  Description of Artificial Sequence: Synthetic oligonucleotide
gaccagggccgctgcatctccatcta

SEQ ID NO: 202075 - DNA, 27 bp, Artificial Sequence
  Description of Artificial Sequence: Synthetic oligonucleotide
accagggccgctgcatctccatctaca

SEQ ID NO: 202076 - DNA, 26 bp, Artificial Sequence
  Description of Artificial Sequence: Synthetic oligonucleotide
ccagggccgctgcatctccatctaca

SEQ ID NO: 202077 - DNA, 26 bp, Artificial Sequence
  Description of Artificial Sequence: Synthetic oligonucleotide
cagggccgctgcatctccatctacag

SEQ ID NO: 202078 - DNA, 27 bp, Artificial Sequence
  Description of Artificial Sequence: Synthetic oligonucleotide
agggccgctgcatctccatctacagct

SEQ ID NO: 202079 - DNA, 26 bp, Artificial Sequence
  Description of Artificial Sequence: Synthetic oligonucleotide
gggccgctgcatctccatctacagct

SEQ ID NO: 202080 - DNA, 34 bp, Artificial Sequence
  Description of Artificial Sequence: Synthetic oligonucleotide
cactctaaataccactaccagaaagtggccgttc

SEQ ID NO: 202081 - DNA, 35 bp, Artificial Sequence
  Description of Artificial Sequence: Synthetic oligonucleotide
actctaaataccactaccagaaagtggccgttcac

SEQ ID NO: 202082 - DNA, 34 bp, Artificial Sequence
  Description of Artificial Sequence: Synthetic oligonucleotide
ctctaaataccactaccagaaagtggccgttcac

SEQ ID NO: 202083 - DNA, 34 bp, Artificial Sequence
  Description of Artificial Sequence: Synthetic oligonucleotide
tctaaataccactaccagaaagtggccgttcacc

SEQ ID NO: 202084 - DNA, 33 bp, Artificial Sequence
  Description of Artificial Sequence: Synthetic oligonucleotide
ctaaataccactaccagaaagtggccgttcacc

SEQ ID NO: 202085 - DNA, 33 bp, Artificial Sequence
  Description of Artificial Sequence: Synthetic oligonucleotide
taaataccactaccagaaagtggccgttcaccg

SEQ ID NO: 202086 - DNA, 32 bp, Artificial Sequence
  Description of Artificial Sequence: Synthetic oligonucleotide
aaataccactaccagaaagtggccgttcaccg

SEQ ID NO: 202087 - DNA, 31 bp, Artificial Sequence
  Description of Artificial Sequence: Synthetic oligonucleotide
aataccactaccagaaagtggccgttcaccg

SEQ ID NO: 202088 - DNA, 30 bp, Artificial Sequence
  Description of Artificial Sequence: Synthetic oligonucleotide
ataccactaccagaaagtggccgttcaccg

SEQ ID NO: 202089 - DNA, 29 bp, Artificial Sequence
  Description of Artificial Sequence: Synthetic oligonucleotide
taccactaccagaaagtggccgttcaccg

SEQ ID NO: 202090 - DNA, 28 bp, Artificial Sequence
  Description of Artificial Sequence: Synthetic oligonucleotide
accactaccagaaagtggccgttcaccg

SEQ ID NO: 202091 - DNA, 27 bp, Artificial Sequence
  Description of Artificial Sequence: Synthetic oligonucleotide
ccactaccagaaagtggccgttcaccg

SEQ ID NO: 202092 - DNA, 27 bp, Artificial Sequence
  Description of Artificial Sequence: Synthetic oligonucleotide
cactaccagaaagtggccgttcaccgc

SEQ ID NO: 202093 - DNA, 29 bp, Artificial Sequence
  Description of Artificial Sequence: Synthetic oligonucleotide
actaccagaaagtggccgttcaccgcatg

SEQ ID NO: 202094 - DNA, 28 bp, Artificial Sequence
  Description of Artificial Sequence: Synthetic oligonucleotide
ctaccagaaagtggccgttcaccgcatg

SEQ ID NO: 202095 - DNA, 28 bp, Artificial Sequence
  Description of Artificial Sequence: Synthetic oligonucleotide
taccagaaagtggccgttcaccgcatgc

SEQ ID NO: 202096 - DNA, 27 bp, Artificial Sequence
  Description of Artificial Sequence: Synthetic oligonucleotide
accagaaagtggccgttcaccgcatgc

SEQ ID NO: 202097 - DNA, 27 bp, Artificial Sequence
  Description of Artificial Sequence: Synthetic oligonucleotide
ccagaaagtggccgttcaccgcatgca

SEQ ID NO: 202098 - DNA, 28 bp, Artificial Sequence
  Description of Artificial Sequence: Synthetic oligonucleotide
cagaaagtggccgttcaccgcatgcaag

SEQ ID NO: 202099 - DNA, 28 bp, Artificial Sequence
  Description of Artificial Sequence: Synthetic oligonucleotide
agaaagtggccgttcaccgcatgcaagc

SEQ ID NO: 202100 - DNA, 27 bp, Artificial Sequence
  Description of Artificial Sequence: Synthetic oligonucleotide
gaaagtggccgttcaccgcatgcaagc

SEQ ID NO: 202101 - DNA, 27 bp, Artificial Sequence
  Description of Artificial Sequence: Synthetic oligonucleotide
aaagtggccgttcaccgcatgcaagcc

SEQ ID NO: 202102 - DNA, 27 bp, Artificial Sequence
  Description of Artificial Sequence: Synthetic oligonucleotide
aagtggccgttcaccgcatgcaagcca

SEQ ID NO: 202103 - DNA, 26 bp, Artificial Sequence
  Description of Artificial Sequence: Synthetic oligonucleotide
agtggccgttcaccgcatgcaagcca

SEQ ID NO: 202104 - DNA, 25 bp, Artificial Sequence
  Description of Artificial Sequence: Synthetic oligonucleotide
gtggccgttcaccgcatgcaagcca

SEQ ID NO: 202105 - DNA, 25 bp, Artificial Sequence
  Description of Artificial Sequence: Synthetic oligonucleotide
tggccgttcaccgcatgcaagccag

SEQ ID NO: 202106 - DNA, 24 bp, Artificial Sequence
  Description of Artificial Sequence: Synthetic oligonucleotide
ggccgttcaccgcatgcaagccag

SEQ ID NO: 202107 - DNA, 24 bp, Artificial Sequence
  Description of Artificial Sequence: Synthetic oligonucleotide
gccgttcaccgcatgcaagccagc

SEQ ID NO: 202108 - DNA, 25 bp, Artificial Sequence
  Description of Artificial Sequence: Synthetic oligonucleotide
ccgttcaccgcatgcaagccagcca

SEQ ID NO: 202109 - DNA, 25 bp, Artificial Sequence
  Description of Artificial Sequence: Synthetic oligonucleotide
cgttcaccgcatgcaagccagccac

SEQ ID NO: 202110 - DNA, 25 bp, Artificial Sequence
  Description of Artificial Sequence: Synthetic oligonucleotide
gttcaccgcatgcaagccagccacg

SEQ ID NO: 202111 - DNA, 25 bp, Artificial Sequence
  Description of Artificial Sequence: Synthetic oligonucleotide
ttcaccgcatgcaagccagccacgg

SEQ ID NO: 202112 - DNA, 24 bp, Artificial Sequence
  Description of Artificial Sequence: Synthetic oligonucleotide
tcaccgcatgcaagccagccacgg

SEQ ID NO: 202113 - DNA, 24 bp, Artificial Sequence
  Description of Artificial Sequence: Synthetic oligonucleotide
ctgggtcatgcctgtgccctggct

SEQ ID NO: 202114 - DNA, 24 bp, Artificial Sequence
  Description of Artificial Sequence: Synthetic oligonucleotide
tgggtcatgcctgtgccctggctg

SEQ ID NO: 202115 - DNA, 23 bp, Artificial Sequence
  Description of Artificial Sequence: Synthetic oligonucleotide
gggtcatgcctgtgccctggctg

SEQ ID NO: 202116 - DNA, 23 bp, Artificial Sequence
  Description of Artificial Sequence: Synthetic oligonucleotide
ggtcatgcctgtgccctggctgc

SEQ ID NO: 202117 - DNA, 24 bp, Artificial Sequence
  Description of Artificial Sequence: Synthetic oligonucleotide
gtcatgcctgtgccctggctgcct

SEQ ID NO: 202118 - DNA, 24 bp, Artificial Sequence
  Description of Artificial Sequence: Synthetic oligonucleotide
tcatgcctgtgccctggctgcctc

SEQ ID NO: 202119 - DNA, 23 bp, Artificial Sequence
  Description of Artificial Sequence: Synthetic oligonucleotide
catgcctgtgccctggctgcctc

SEQ ID NO: 202120 - DNA, 23 bp, Artificial Sequence
  Description of Artificial Sequence: Synthetic oligonucleotide
atgcctgtgccctggctgcctcc

SEQ ID NO: 202121 - DNA, 22 bp, Artificial Sequence
  Description of Artificial Sequence: Synthetic oligonucleotide
tgcctgtgccctggctgcctcc

SEQ ID NO: 202122 - DNA, 21 bp, Artificial Sequence
  Description of Artificial Sequence: Synthetic oligonucleotide
gcctgtgccctggctgcctcc

SEQ ID NO: 202123 - DNA, 22 bp, Artificial Sequence
  Description of Artificial Sequence: Synthetic oligonucleotide
cctgtgccctggctgcctccct

SEQ ID NO: 202124 - DNA, 23 bp, Artificial Sequence
  Description of Artificial Sequence: Synthetic oligonucleotide
ctgtgccctggctgcctccctct

SEQ ID NO: 202125 - DNA, 23 bp, Artificial Sequence
  Description of Artificial Sequence: Synthetic oligonucleotide
tgtgccctggctgcctccctctg

SEQ ID NO: 202126 - DNA, 22 bp, Artificial Sequence
  Description of Artificial Sequence: Synthetic oligonucleotide
gtgccctggctgcctccctctg

SEQ ID NO: 202127 - DNA, 22 bp, Artificial Sequence
  Description of Artificial Sequence: Synthetic oligonucleotide
tgccctggctgcctccctctgg

SEQ ID NO: 202128 - DNA, 21 bp, Artificial Sequence
  Description of Artificial Sequence: Synthetic oligonucleotide
gccctggctgcctccctctgg

SEQ ID NO: 202129 - DNA, 22 bp, Artificial Sequence
  Description of Artificial Sequence: Synthetic oligonucleotide
ccctggctgcctccctctggct

SEQ ID NO: 202130 - DNA, 22 bp, Artificial Sequence
  Description of Artificial Sequence: Synthetic oligonucleotide
cctggctgcctccctctggctg

SEQ ID NO: 202131 - DNA, 22 bp, Artificial Sequence
  Description of Artificial Sequence: Synthetic oligonucleotide
ctggctgcctccctctggctgg

SEQ ID NO: 202132 - DNA, 22 bp, Artificial Sequence
  Description of Artificial Sequence: Synthetic oligonucleotide
tggctgcctccctctggctggg

SEQ ID NO: 202133 - DNA, 21 bp, Artificial Sequence
  Description of Artificial Sequence: Synthetic oligonucleotide
ggctgcctccctctggctggg

SEQ ID NO: 202134 - DNA, 21 bp, Artificial Sequence
  Description of Artificial Sequence: Synthetic oligonucleotide
gctgcctccctctggctgggg

SEQ ID NO: 202135 - DNA, 22 bp, Artificial Sequence
  Description of Artificial Sequence: Synthetic oligonucleotide
ctgcctccctctggctgggggt

SEQ ID NO: 202136 - DNA, 22 bp, Artificial Sequence
  Description of Artificial Sequence: Synthetic oligonucleotide
tgcctccctctggctgggggtg

SEQ ID NO: 202137 - DNA, 20 bp, Artificial Sequence
  Description of Artificial Sequence: Synthetic oligonucleotide
cccagcgcaccgcgcgccat

SEQ ID NO: 202138 - DNA, 20 bp, Artificial Sequence
  Description of Artificial Sequence: Synthetic oligonucleotide
ccagcgcaccgcgcgccagt

SEQ ID NO: 202139 - DNA, 20 bp, Artificial Sequence
  Description of Artificial Sequence: Synthetic oligonucleotide
cagcgcaccgcgcgccagct

SEQ ID NO: 202140 - DNA, 20 bp, Artificial Sequence
  Description of Artificial Sequence: Synthetic oligonucleotide
agcgcaccgcgcgccagcgt

SEQ ID NO: 202141 - DNA, 20 bp, Artificial Sequence
  Description of Artificial Sequence: Synthetic oligonucleotide
gcgcaccgcgcgccagcgtt

SEQ ID NO: 202142 - DNA, 20 bp, Artificial Sequence
  Description of Artificial Sequence: Synthetic oligonucleotide
cgcaccgcgcgccagcgtct

SEQ ID NO: 202143 - DNA, 20 bp, Artificial Sequence
  Description of Artificial Sequence: Synthetic oligonucleotide
gcaccgcgcgccagcgtcct

SEQ ID NO: 202144 - DNA, 20 bp, Artificial Sequence
  Description of Artificial Sequence: Synthetic oligonucleotide
caccgcgcgccagcgtccct

SEQ ID NO: 202145 - DNA, 20 bp, Artificial Sequence
  Description of Artificial Sequence: Synthetic oligonucleotide
accgcgcgccagcgtccctg

SEQ ID NO: 202146 - DNA, 20 bp, Artificial Sequence
  Description of Artificial Sequence: Synthetic oligonucleotide
ccgcgcgccagcgtccctgt

SEQ ID NO: 202147 - DNA, 20 bp, Artificial Sequence
  Description of Artificial Sequence: Synthetic oligonucleotide
cgcgcgccagcgtccctggt

SEQ ID NO: 202148 - DNA, 20 bp, Artificial Sequence
  Description of Artificial Sequence: Synthetic oligonucleotide
gcgcgccagcgtccctggct

SEQ ID NO: 202149 - DNA, 20 bp, Artificial Sequence
  Description of Artificial Sequence: Synthetic oligonucleotide
cgcgccagcgtccctggcct

SEQ ID NO: 202150 - DNA, 20 bp, Artificial Sequence
  Description of Artificial Sequence: Synthetic oligonucleotide
gcgccagcgtccctggccct

SEQ ID NO: 202151 - DNA, 20 bp, Artificial Sequence
  Description of Artificial Sequence: Synthetic oligonucleotide
cgccagcgtccctggcccgt

SEQ ID NO: 202152 - DNA, 20 bp, Artificial Sequence
  Description of Artificial Sequence: Synthetic oligonucleotide
gccagcgtccctggcccgct

SEQ ID NO: 202153 - DNA, 20 bp, Artificial Sequence
  Description of Artificial Sequence: Synthetic oligonucleotide
ccagcgtccctggcccgcct

SEQ ID NO: 202154 - DNA, 20 bp, Artificial Sequence
  Description of Artificial Sequence: Synthetic oligonucleotide
cagcgtccctggcccgccgt

SEQ ID NO: 202155 - DNA, 20 bp, Artificial Sequence
  Description of Artificial Sequence: Synthetic oligonucleotide
agcgtccctggcccgccggt

SEQ ID NO: 202156 - DNA, 27 bp, Artificial Sequence
  Description of Artificial Sequence: Synthetic oligonucleotide
atgaagcctcctccgcccggaagtact

SEQ ID NO: 202157 - DNA, 26 bp, Artificial Sequence
  Description of Artificial Sequence: Synthetic oligonucleotide
tgaagcctcctccgcccggaagtact

SEQ ID NO: 202158 - DNA, 25 bp, Artificial Sequence
  Description of Artificial Sequence: Synthetic oligonucleotide
gaagcctcctccgcccggaagtact

SEQ ID NO: 202159 - DNA, 25 bp, Artificial Sequence
  Description of Artificial Sequence: Synthetic oligonucleotide
aagcctcctccgcccggaagtactg

SEQ ID NO: 202160 - DNA, 24 bp, Artificial Sequence
  Description of Artificial Sequence: Synthetic oligonucleotide
agcctcctccgcccggaagtactg

SEQ ID NO: 202161 - DNA, 23 bp, Artificial Sequence
  Description of Artificial Sequence: Synthetic oligonucleotide
gcctcctccgcccggaagtactg

SEQ ID NO: 202162 - DNA, 23 bp, Artificial Sequence
  Description of Artificial Sequence: Synthetic oligonucleotide
cctcctccgcccggaagtactgc

SEQ ID NO: 202163 - DNA, 23 bp, Artificial Sequence
  Description of Artificial Sequence: Synthetic oligonucleotide
ctcctccgcccggaagtactgcc

SEQ ID NO: 202164 - DNA, 23 bp, Artificial Sequence
  Description of Artificial Sequence: Synthetic oligonucleotide
tcctccgcccggaagtactgccc

SEQ ID NO: 202165 - DNA, 22 bp, Artificial Sequence
  Description of Artificial Sequence: Synthetic oligonucleotide
cctccgcccggaagtactgccc

SEQ ID NO: 202166 - DNA, 22 bp, Artificial Sequence
  Description of Artificial Sequence: Synthetic oligonucleotide
ctccgcccggaagtactgcccc

SEQ ID NO: 202167 - DNA, 23 bp, Artificial Sequence
  Description of Artificial Sequence: Synthetic oligonucleotide
tccgcccggaagtactgccccca

SEQ ID NO: 202168 - DNA, 22 bp, Artificial Sequence
  Description of Artificial Sequence: Synthetic oligonucleotide
ccgcccggaagtactgccccca

SEQ ID NO: 202169 - DNA, 22 bp, Artificial Sequence
  Description of Artificial Sequence: Synthetic oligonucleotide
cgcccggaagtactgcccccag

SEQ ID NO: 202170 - DNA, 22 bp, Artificial Sequence
  Description of Artificial Sequence: Synthetic oligonucleotide
gcccggaagtactgcccccagc

SEQ ID NO: 202171 - DNA, 22 bp, Artificial Sequence
  Description of Artificial Sequence: Synthetic oligonucleotide
cccggaagtactgcccccagcg

SEQ ID NO: 202172 - DNA, 23 bp, Artificial Sequence
  Description of Artificial Sequence: Synthetic oligonucleotide
ccggaagtactgcccccagcgca

SEQ ID NO: 202173 - DNA, 23 bp, Artificial Sequence
  Description of Artificial Sequence: Synthetic oligonucleotide
cggaagtactgcccccagcgcac

SEQ ID NO: 202174 - DNA, 23 bp, Artificial Sequence
  Description of Artificial Sequence: Synthetic oligonucleotide
ggaagtactgcccccagcgcacc

SEQ ID NO: 202175 - DNA, 23 bp, Artificial Sequence
  Description of Artificial Sequence: Synthetic oligonucleotide
gaagtactgcccccagcgcaccg

SEQ ID NO: 202176 - DNA, 23 bp, Artificial Sequence
  Description of Artificial Sequence: Synthetic oligonucleotide
aagtactgcccccagcgcaccgc

SEQ ID NO: 202177 - DNA, 22 bp, Artificial Sequence
  Description of Artificial Sequence: Synthetic oligonucleotide
agtactgcccccagcgcaccgc

SEQ ID NO: 202178 - DNA, 21 bp, Artificial Sequence
  Description of Artificial Sequence: Synthetic oligonucleotide
gtactgcccccagcgcaccgc

SEQ ID NO: 202179 - DNA, 21 bp, Artificial Sequence
  Description of Artificial Sequence: Synthetic oligonucleotide
tactgcccccagcgcaccgcg

SEQ ID NO: 202180 - DNA, 20 bp, Artificial Sequence
  Description of Artificial Sequence: Synthetic oligonucleotide
actgcccccagcgcaccgcg

SEQ ID NO: 202181 - DNA, 20 bp, Artificial Sequence
  Description of Artificial Sequence: Synthetic oligonucleotide
ctgcccccagcgcaccgcgt

SEQ ID NO: 202182 - DNA, 20 bp, Artificial Sequence
  Description of Artificial Sequence: Synthetic oligonucleotide
tgcccccagcgcaccgcgct

SEQ ID NO: 202183 - DNA, 20 bp, Artificial Sequence
  Description of Artificial Sequence: Synthetic oligonucleotide
accgcgcgcccgcgtccgtt

SEQ ID NO: 202184 - DNA, 20 bp, Artificial Sequence
  Description of Artificial Sequence: Synthetic oligonucleotide
ccgcgcgcccgcgtccgttt

SEQ ID NO: 202185 - DNA, 20 bp, Artificial Sequence
  Description of Artificial Sequence: Synthetic oligonucleotide
cgcgcgcccgcgtccgtgtt

SEQ ID NO: 202186 - DNA, 20 bp, Artificial Sequence
  Description of Artificial Sequence: Synthetic oligonucleotide
gcgcgcccgcgtccgtggtt

SEQ ID NO: 202187 - DNA, 20 bp, Artificial Sequence
  Description of Artificial Sequence: Synthetic oligonucleotide
cgcgcccgcgtccgtggctt

SEQ ID NO: 202188 - DNA, 20 bp, Artificial Sequence
  Description of Artificial Sequence: Synthetic oligonucleotide
gcgcccgcgtccgtggcctt

SEQ ID NO: 202189 - DNA, 20 bp, Artificial Sequence
  Description of Artificial Sequence: Synthetic oligonucleotide
cgcccgcgtccgtggccctt

SEQ ID NO: 202190 - DNA, 20 bp, Artificial Sequence
  Description of Artificial Sequence: Synthetic oligonucleotide
gcccgcgtccgtggcccgtt

SEQ ID NO: 202191 - DNA, 20 bp, Artificial Sequence
  Description of Artificial Sequence: Synthetic oligonucleotide
cccgcgtccgtggcccgctt

SEQ ID NO: 202192 - DNA, 20 bp, Artificial Sequence
  Description of Artificial Sequence: Synthetic oligonucleotide
ccgcgtccgtggcccgcctt

SEQ ID NO: 202193 - DNA, 20 bp, Artificial Sequence
  Description of Artificial Sequence: Synthetic oligonucleotide
cgcgtccgtggcccgccgtt

SEQ ID NO: 202194 - DNA, 20 bp, Artificial Sequence
  Description of Artificial Sequence: Synthetic oligonucleotide
gcgtccgtggcccgccggtt

SEQ ID NO: 202195 - DNA, 20 bp, Artificial Sequence
  Description of Artificial Sequence: Synthetic oligonucleotide
cgtccgtggcccgccggctt

SEQ ID NO: 202196 - DNA, 20 bp, Artificial Sequence
  Description of Artificial Sequence: Synthetic oligonucleotide
gtccgtggcccgccggctct

SEQ ID NO: 202197 - DNA, 20 bp, Artificial Sequence
  Description of Artificial Sequence: Synthetic oligonucleotide
tccgtggcccgccggctcgt

SEQ ID NO: 202198 - DNA, 20 bp, Artificial Sequence
  Description of Artificial Sequence: Synthetic oligonucleotide
ccgtggcccgccggctcgtt

SEQ ID NO: 202199 - DNA, 20 bp, Artificial Sequence
  Description of Artificial Sequence: Synthetic oligonucleotide
cgtggcccgccggctcggtt

SEQ ID NO: 202200 - DNA, 20 bp, Artificial Sequence
  Description of Artificial Sequence: Synthetic oligonucleotide
gtggcccgccggctcggttg

SEQ ID NO: 202201 - DNA, 27 bp, Artificial Sequence
  Description of Artificial Sequence: Synthetic oligonucleotide
ctcctctcaatgtgtcccgtgtggcca

SEQ ID NO: 202202 - DNA, 27 bp, Artificial Sequence
  Description of Artificial Sequence: Synthetic oligonucleotide
tcctctcaatgtgtcccgtgtggccag

SEQ ID NO: 202203 - DNA, 27 bp, Artificial Sequence
  Description of Artificial Sequence: Synthetic oligonucleotide
cctctcaatgtgtcccgtgtggccagt

SEQ ID NO: 202204 - DNA, 28 bp, Artificial Sequence
  Description of Artificial Sequence: Synthetic oligonucleotide
ctctcaatgtgtcccgtgtggccagttg

SEQ ID NO: 202205 - DNA, 29 bp, Artificial Sequence
  Description of Artificial Sequence: Synthetic oligonucleotide
tctcaatgtgtcccgtgtggccagttgtg

SEQ ID NO: 202206 - DNA, 28 bp, Artificial Sequence
  Description of Artificial Sequence: Synthetic oligonucleotide
ctcaatgtgtcccgtgtggccagttgtg

SEQ ID NO: 202207 - DNA, 28 bp, Artificial Sequence
  Description of Artificial Sequence: Synthetic oligonucleotide
tcaatgtgtcccgtgtggccagttgtgc

SEQ ID NO: 202208 - DNA, 27 bp, Artificial Sequence
  Description of Artificial Sequence: Synthetic oligonucleotide
caatgtgtcccgtgtggccagttgtgc

SEQ ID NO: 202209 - DNA, 28 bp, Artificial Sequence
  Description of Artificial Sequence: Synthetic oligonucleotide
aatgtgtcccgtgtggccagttgtgcag

SEQ ID NO: 202210 - DNA, 27 bp, Artificial Sequence
  Description of Artificial Sequence: Synthetic oligonucleotide
atgtgtcccgtgtggccagttgtgcag

SEQ ID NO: 202211 - DNA, 26 bp, Artificial Sequence
  Description of Artificial Sequence: Synthetic oligonucleotide
tgtgtcccgtgtggccagttgtgcag

SEQ ID NO: 202212 - DNA, 25 bp, Artificial Sequence
  Description of Artificial Sequence: Synthetic oligonucleotide
gtgtcccgtgtggccagttgtgcag

SEQ ID NO: 202213 - DNA, 25 bp, Artificial Sequence
  Description of Artificial Sequence: Synthetic oligonucleotide
tgtcccgtgtggccagttgtgcagg

SEQ ID NO: 202214 - DNA, 24 bp, Artificial Sequence
  Description of Artificial Sequence: Synthetic oligonucleotide
gtcccgtgtggccagttgtgcagg

SEQ ID NO: 202215 - DNA, 24 bp, Artificial Sequence
  Description of Artificial Sequence: Synthetic oligonucleotide
tcccgtgtggccagttgtgcaggg

SEQ ID NO: 202216 - DNA, 23 bp, Artificial Sequence
  Description of Artificial Sequence: Synthetic oligonucleotide
cccgtgtggccagttgtgcaggg

SEQ ID NO: 202217 - DNA, 23 bp, Artificial Sequence
  Description of Artificial Sequence: Synthetic oligonucleotide
ccgtgtggccagttgtgcagggg

SEQ ID NO: 202218 - DNA, 23 bp, Artificial Sequence
  Description of Artificial Sequence: Synthetic oligonucleotide
cgtgtggccagttgtgcaggggg

SEQ ID NO: 202219 - DNA, 24 bp, Artificial Sequence
  Description of Artificial Sequence: Synthetic oligonucleotide
gtgtggccagttgtgcagggggga

SEQ ID NO: 202220 - DNA, 24 bp, Artificial Sequence
  Description of Artificial Sequence: Synthetic oligonucleotide
tgtggccagttgtgcaggggggac

SEQ ID NO: 202221 - DNA, 23 bp, Artificial Sequence
  Description of Artificial Sequence: Synthetic oligonucleotide
gtggccagttgtgcaggggggac

SEQ ID NO: 202222 - DNA, 24 bp, Artificial Sequence
  Description of Artificial Sequence: Synthetic oligonucleotide
tggccagttgtgcaggggggacca

SEQ ID NO: 202223 - DNA, 23 bp, Artificial Sequence
  Description of Artificial Sequence: Synthetic oligonucleotide
ggccagttgtgcaggggggacca

SEQ ID NO: 202224 - DNA, 23 bp, Artificial Sequence
  Description of Artificial Sequence: Synthetic oligonucleotide
gccagttgtgcaggggggaccag

SEQ ID NO: 202225 - DNA, 26 bp, Artificial Sequence
  Description of Artificial Sequence: Synthetic oligonucleotide
aagatccctcggttccgccgcatcca

SEQ ID NO: 202226 - DNA, 25 bp, Artificial Sequence
  Description of Artificial Sequence: Synthetic oligonucleotide
agatccctcggttccgccgcatcca

SEQ ID NO: 202227 - DNA, 24 bp, Artificial Sequence
  Description of Artificial Sequence: Synthetic oligonucleotide
gatccctcggttccgccgcatcca

SEQ ID NO: 202228 - DNA, 24 bp, Artificial Sequence
  Description of Artificial Sequence: Synthetic oligonucleotide
atccctcggttccgccgcatccag

SEQ ID NO: 202229 - DNA, 23 bp, Artificial Sequence
  Description of Artificial Sequence: Synthetic oligonucleotide
tccctcggttccgccgcatccag

SEQ ID NO: 202230 - DNA, 22 bp, Artificial Sequence
  Description of Artificial Sequence: Synthetic oligonucleotide
ccctcggttccgccgcatccag

SEQ ID NO: 202231 - DNA, 22 bp, Artificial Sequence
  Description of Artificial Sequence: Synthetic oligonucleotide
cctcggttccgccgcatccagg

SEQ ID NO: 202232 - DNA, 22 bp, Artificial Sequence
  Description of Artificial Sequence: Synthetic oligonucleotide
ctcggttccgccgcatccaggg

SEQ ID NO: 202233 - DNA, 22 bp, Artificial Sequence
  Description of Artificial Sequence: Synthetic oligonucleotide
tcggttccgccgcatccagggc

SEQ ID NO: 202234 - DNA, 21 bp, Artificial Sequence
  Description of Artificial Sequence: Synthetic oligonucleotide
cggttccgccgcatccagggc

SEQ ID NO: 202235 - DNA, 22 bp, Artificial Sequence
  Description of Artificial Sequence: Synthetic oligonucleotide
ggttccgccgcatccagggcga

SEQ ID NO: 202236 - DNA, 23 bp, Artificial Sequence
  Description of Artificial Sequence: Synthetic oligonucleotide
gttccgccgcatccagggcgaga

SEQ ID NO: 202237 - DNA, 24 bp, Artificial Sequence
  Description of Artificial Sequence: Synthetic oligonucleotide
ttccgccgcatccagggcgagagt

SEQ ID NO: 202238 - DNA, 23 bp, Artificial Sequence
  Description of Artificial Sequence: Synthetic oligonucleotide
tccgccgcatccagggcgagagt

SEQ ID NO: 202239 - DNA, 22 bp, Artificial Sequence
  Description of Artificial Sequence: Synthetic oligonucleotide
ccgccgcatccagggcgagagt

SEQ ID NO: 202240 - DNA, 23 bp, Artificial Sequence
  Description of Artificial Sequence: Synthetic oligonucleotide
cgccgcatccagggcgagagtga

SEQ ID NO: 202241 - DNA, 23 bp, Artificial Sequence
  Description of Artificial Sequence: Synthetic oligonucleotide
gccgcatccagggcgagagtgag

SEQ ID NO: 202242 - DNA, 24 bp, Artificial Sequence
  Description of Artificial Sequence: Synthetic oligonucleotide
ccgcatccagggcgagagtgagct

SEQ ID NO: 202243 - DNA, 26 bp, Artificial Sequence
  Description of Artificial Sequence: Synthetic oligonucleotide
cgcatccagggcgagagtgagctgta

SEQ ID NO: 202244 - DNA, 27 bp, Artificial Sequence
  Description of Artificial Sequence: Synthetic oligonucleotide
gcatccagggcgagagtgagctgtaca

SEQ ID NO: 202245 - DNA, 27 bp, Artificial Sequence
  Description of Artificial Sequence: Synthetic oligonucleotide
catccagggcgagagtgagctgtacac

SEQ ID NO: 202246 - DNA, 27 bp, Artificial Sequence
  Description of Artificial Sequence: Synthetic oligonucleotide
atccagggcgagagtgagctgtacacc

SEQ ID NO: 202247 - DNA, 27 bp, Artificial Sequence
  Description of Artificial Sequence: Synthetic oligonucleotide
tccagggcgagagtgagctgtacacca

SEQ ID NO: 202248 - DNA, 26 bp, Artificial Sequence
  Description of Artificial Sequence: Synthetic oligonucleotide
ccagggcgagagtgagctgtacacca

SEQ ID NO: 202249 - DNA, 27 bp, Artificial Sequence
  Description of Artificial Sequence: Synthetic oligonucleotide
cagggcgagagtgagctgtacaccagt

SEQ ID NO: 202250 - DNA, 27 bp, Artificial Sequence
  Description of Artificial Sequence: Synthetic oligonucleotide
agggcgagagtgagctgtacaccagtg

SEQ ID NO: 202251 - DNA, 29 bp, Artificial Sequence
  Description of Artificial Sequence: Synthetic oligonucleotide
aacatcatggagatccagcccttccgctg

SEQ ID NO: 202252 - DNA, 28 bp, Artificial Sequence
  Description of Artificial Sequence: Synthetic oligonucleotide
acatcatggagatccagcccttccgctg

SEQ ID NO: 202253 - DNA, 27 bp, Artificial Sequence
  Description of Artificial Sequence: Synthetic oligonucleotide
catcatggagatccagcccttccgctg

SEQ ID NO: 202254 - DNA, 27 bp, Artificial Sequence
  Description of Artificial Sequence: Synthetic oligonucleotide
atcatggagatccagcccttccgctgc

SEQ ID NO: 202255 - DNA, 26 bp, Artificial Sequence
  Description of Artificial Sequence: Synthetic oligonucleotide
tcatggagatccagcccttccgctgc

SEQ ID NO: 202256 - DNA, 25 bp, Artificial Sequence
  Description of Artificial Sequence: Synthetic oligonucleotide
catggagatccagcccttccgctgc

SEQ ID NO: 202257 - DNA, 25 bp, Artificial Sequence
  Description of Artificial Sequence: Synthetic oligonucleotide
atggagatccagcccttccgctgcg

SEQ ID NO: 202258 - DNA, 24 bp, Artificial Sequence
  Description of Artificial Sequence: Synthetic oligonucleotide
tggagatccagcccttccgctgcg

SEQ ID NO: 202259 - DNA, 23 bp, Artificial Sequence
  Description of Artificial Sequence: Synthetic oligonucleotide
ggagatccagcccttccgctgcg

SEQ ID NO: 202260 - DNA, 23 bp, Artificial Sequence
  Description of Artificial Sequence: Synthetic oligonucleotide
gagatccagcccttccgctgcgc

SEQ ID NO: 202261 - DNA, 23 bp, Artificial Sequence
  Description of Artificial Sequence: Synthetic oligonucleotide
agatccagcccttccgctgcgcg

SEQ ID NO: 202262 - DNA, 22 bp, Artificial Sequence
  Description of Artificial Sequence: Synthetic oligonucleotide
gatccagcccttccgctgcgcg

SEQ ID NO: 202263 - DNA, 22 bp, Artificial Sequence
  Description of Artificial Sequence: Synthetic oligonucleotide
atccagcccttccgctgcgcgg

SEQ ID NO: 202264 - DNA, 21 bp, Artificial Sequence
  Description of Artificial Sequence: Synthetic oligonucleotide
tccagcccttccgctgcgcgg

SEQ ID NO: 202265 - DNA, 20 bp, Artificial Sequence
  Description of Artificial Sequence: Synthetic oligonucleotide
ccagcccttccgctgcgcgg

SEQ ID NO: 202266 - DNA, 21 bp, Artificial Sequence
  Description of Artificial Sequence: Synthetic oligonucleotide
cagcccttccgctgcgcggct

SEQ ID NO: 202267 - DNA, 21 bp, Artificial Sequence
  Description of Artificial Sequence: Synthetic oligonucleotide
agcccttccgctgcgcggctg

SEQ ID NO: 202268 - DNA, 20 bp, Artificial Sequence
  Description of Artificial Sequence: Synthetic oligonucleotide
gcccttccgctgcgcggctg

SEQ ID NO: 202269 - DNA, 20 bp, Artificial Sequence
  Description of Artificial Sequence: Synthetic oligonucleotide
cccttccgctgcgcggctgc

SEQ ID NO: 202270 - DNA, 22 bp, Artificial Sequence
  Description of Artificial Sequence: Synthetic oligonucleotide
ccttccgctgcgcggctgccat

SEQ ID NO: 202271 - DNA, 22 bp, Artificial Sequence
  Description of Artificial Sequence: Synthetic oligonucleotide
cttccgctgcgcggctgccatc

SEQ ID NO: 202272 - DNA, 23 bp, Artificial Sequence
  Description of Artificial Sequence: Synthetic oligonucleotide
ttccgctgcgcggctgccatcca

SEQ ID NO: 202273 - DNA, 22 bp, Artificial Sequence
  Description of Artificial Sequence: Synthetic oligonucleotide
tccgctgcgcggctgccatcca

SEQ ID NO: 202274 - DNA, 21 bp, Artificial Sequence
  Description of Artificial Sequence: Synthetic oligonucleotide
ccgctgcgcggctgccatcca

SEQ ID NO: 202275 - DNA, 22 bp, Artificial Sequence
  Description of Artificial Sequence: Synthetic oligonucleotide
cgctgcgcggctgccatccaga

SEQ ID NO: 202276 - DNA, 22 bp, Artificial Sequence
  Description of Artificial Sequence: Synthetic oligonucleotide
gctgcgcggctgccatccagac

SEQ ID NO: 202277 - DNA, 24 bp, Artificial Sequence
  Description of Artificial Sequence: Synthetic oligonucleotide
ctgcgcggctgccatccagaccat

SEQ ID NO: 202278 - DNA, 25 bp, Artificial Sequence
  Description of Artificial Sequence: Synthetic oligonucleotide
tgcgcggctgccatccagaccatgt

SEQ ID NO: 202279 - DNA, 26 bp, Artificial Sequence
  Description of Artificial Sequence: Synthetic oligonucleotide
gaagatccctcggttccgccgcatct

SEQ ID NO: 202280 - DNA, 26 bp, Artificial Sequence
  Description of Artificial Sequence: Synthetic oligonucleotide
aagatccctcggttccgccgcatctg

SEQ ID NO: 202281 - DNA, 25 bp, Artificial Sequence
  Description of Artificial Sequence: Synthetic oligonucleotide
agatccctcggttccgccgcatctg

SEQ ID NO: 202282 - DNA, 24 bp, Artificial Sequence
  Description of Artificial Sequence: Synthetic oligonucleotide
gatccctcggttccgccgcatctg

SEQ ID NO: 202283 - DNA, 24 bp, Artificial Sequence
  Description of Artificial Sequence: Synthetic oligonucleotide
atccctcggttccgccgcatctgg

SEQ ID NO: 202284 - DNA, 23 bp, Artificial Sequence
  Description of Artificial Sequence: Synthetic oligonucleotide
tccctcggttccgccgcatctgg

SEQ ID NO: 202285 - DNA, 22 bp, Artificial Sequence
  Description of Artificial Sequence: Synthetic oligonucleotide
ccctcggttccgccgcatctgg

SEQ ID NO: 202286 - DNA, 22 bp, Artificial Sequence
  Description of Artificial Sequence: Synthetic oligonucleotide
cctcggttccgccgcatctggg

SEQ ID NO: 202287 - DNA, 22 bp, Artificial Sequence
  Description of Artificial Sequence: Synthetic oligonucleotide
ctcggttccgccgcatctgggg

SEQ ID NO: 202288 - DNA, 22 bp, Artificial Sequence
  Description of Artificial Sequence: Synthetic oligonucleotide
tcggttccgccgcatctggggc

SEQ ID NO: 202289 - DNA, 21 bp, Artificial Sequence
  Description of Artificial Sequence: Synthetic oligonucleotide
cggttccgccgcatctggggc

SEQ ID NO: 202290 - DNA, 22 bp, Artificial Sequence
  Description of Artificial Sequence: Synthetic oligonucleotide
ggttccgccgcatctggggcga

SEQ ID NO: 202291 - DNA, 23 bp, Artificial Sequence
  Description of Artificial Sequence: Synthetic oligonucleotide
gttccgccgcatctggggcgaga

SEQ ID NO: 202292 - DNA, 24 bp, Artificial Sequence
  Description of Artificial Sequence: Synthetic oligonucleotide
ttccgccgcatctggggcgagagt

SEQ ID NO: 202293 - DNA, 23 bp, Artificial Sequence
  Description of Artificial Sequence: Synthetic oligonucleotide
tccgccgcatctggggcgagagt

SEQ ID NO: 202294 - DNA, 22 bp, Artificial Sequence
  Description of Artificial Sequence: Synthetic oligonucleotide
ccgccgcatctggggcgagagt

SEQ ID NO: 202295 - DNA, 23 bp, Artificial Sequence
  Description of Artificial Sequence: Synthetic oligonucleotide
cgccgcatctggggcgagagtga

SEQ ID NO: 202296 - DNA, 23 bp, Artificial Sequence
  Description of Artificial Sequence: Synthetic oligonucleotide
gccgcatctggggcgagagtgag

SEQ ID NO: 202297 - DNA, 24 bp, Artificial Sequence
  Description of Artificial Sequence: Synthetic oligonucleotide
ccgcatctggggcgagagtgagct

SEQ ID NO: 202298 - DNA, 26 bp, Artificial Sequence
  Description of Artificial Sequence: Synthetic oligonucleotide
cgcatctggggcgagagtgagctgta

SEQ ID NO: 202299 - DNA, 27 bp, Artificial Sequence
  Description of Artificial Sequence: Synthetic oligonucleotide
gcatctggggcgagagtgagctgtaca

SEQ ID NO: 202300 - DNA, 27 bp, Artificial Sequence
  Description of Artificial Sequence: Synthetic oligonucleotide
catctggggcgagagtgagctgtacac

SEQ ID NO: 202301 - DNA, 27 bp, Artificial Sequence
  Description of Artificial Sequence: Synthetic oligonucleotide
atctggggcgagagtgagctgtacacc

SEQ ID NO: 202302 - DNA, 27 bp, Artificial Sequence
  Description of Artificial Sequence: Synthetic oligonucleotide
tctggggcgagagtgagctgtacacca

SEQ ID NO: 202303 - DNA, 26 bp, Artificial Sequence
  Description of Artificial Sequence: Synthetic oligonucleotide
ctggggcgagagtgagctgtacacca

SEQ ID NO: 202304 - DNA, 27 bp, Artificial Sequence
  Description of Artificial Sequence: Synthetic oligonucleotide
tggggcgagagtgagctgtacaccagt

SEQ ID NO: 202305 - DNA, 31 bp, Artificial Sequence
  Description of Artificial Sequence: Synthetic oligonucleotide
cttcaacatcatggagatccagcccttccac

SEQ ID NO: 202306 - DNA, 31 bp, Artificial Sequence
  Description of Artificial Sequence: Synthetic oligonucleotide
ttcaacatcatggagatccagcccttccacc

SEQ ID NO: 202307 - DNA, 30 bp, Artificial Sequence
  Description of Artificial Sequence: Synthetic oligonucleotide
tcaacatcatggagatccagcccttccacc

SEQ ID NO: 202308 - DNA, 29 bp, Artificial Sequence
  Description of Artificial Sequence: Synthetic oligonucleotide
caacatcatggagatccagcccttccacc

SEQ ID NO: 202309 - DNA, 29 bp, Artificial Sequence
  Description of Artificial Sequence: Synthetic oligonucleotide
aacatcatggagatccagcccttccaccg

SEQ ID NO: 202310 - DNA, 28 bp, Artificial Sequence
  Description of Artificial Sequence: Synthetic oligonucleotide
acatcatggagatccagcccttccaccg

SEQ ID NO: 202311 - DNA, 27 bp, Artificial Sequence
  Description of Artificial Sequence: Synthetic oligonucleotide
catcatggagatccagcccttccaccg

SEQ ID NO: 202312 - DNA, 27 bp, Artificial Sequence
  Description of Artificial Sequence: Synthetic oligonucleotide
atcatggagatccagcccttccaccgc

SEQ ID NO: 202313 - DNA, 26 bp, Artificial Sequence
  Description of Artificial Sequence: Synthetic oligonucleotide
tcatggagatccagcccttccaccgc

SEQ ID NO: 202314 - DNA, 25 bp, Artificial Sequence
  Description of Artificial Sequence: Synthetic oligonucleotide
catggagatccagcccttccaccgc

SEQ ID NO: 202315 - DNA, 25 bp, Artificial Sequence
  Description of Artificial Sequence: Synthetic oligonucleotide
atggagatccagcccttccaccgcg

SEQ ID NO: 202316 - DNA, 24 bp, Artificial Sequence
  Description of Artificial Sequence: Synthetic oligonucleotide
tggagatccagcccttccaccgcg

SEQ ID NO: 202317 - DNA, 23 bp, Artificial Sequence
  Description of Artificial Sequence: Synthetic oligonucleotide
ggagatccagcccttccaccgcg

SEQ ID NO: 202318 - DNA, 23 bp, Artificial Sequence
  Description of Artificial Sequence: Synthetic oligonucleotide
gagatccagcccttccaccgcgc

SEQ ID NO: 202319 - DNA, 23 bp, Artificial Sequence
  Description of Artificial Sequence: Synthetic oligonucleotide
agatccagcccttccaccgcgcg

SEQ ID NO: 202320 - DNA, 22 bp, Artificial Sequence
  Description of Artificial Sequence: Synthetic oligonucleotide
gatccagcccttccaccgcgcg

SEQ ID NO: 202321 - DNA, 22 bp, Artificial Sequence
  Description of Artificial Sequence: Synthetic oligonucleotide
atccagcccttccaccgcgcgg

SEQ ID NO: 202322 - DNA, 21 bp, Artificial Sequence
  Description of Artificial Sequence: Synthetic oligonucleotide
tccagcccttccaccgcgcgg

SEQ ID NO: 202323 - DNA, 20 bp, Artificial Sequence
  Description of Artificial Sequence: Synthetic oligonucleotide
ccagcccttccaccgcgcgg

SEQ ID NO: 202324 - DNA, 21 bp, Artificial Sequence
  Description of Artificial Sequence: Synthetic oligonucleotide
cagcccttccaccgcgcggct

SEQ ID NO: 202325 - DNA, 21 bp, Artificial Sequence
  Description of Artificial Sequence: Synthetic oligonucleotide
agcccttccaccgcgcggctg

SEQ ID NO: 202326 - DNA, 20 bp, Artificial Sequence
  Description of Artificial Sequence: Synthetic oligonucleotide
gcccttccaccgcgcggctg

SEQ ID NO: 202327 - DNA, 20 bp, Artificial Sequence
  Description of Artificial Sequence: Synthetic oligonucleotide
cccttccaccgcgcggctgc

SEQ ID NO: 202328 - DNA, 22 bp, Artificial Sequence
  Description of Artificial Sequence: Synthetic oligonucleotide
ccttccaccgcgcggctgccat

SEQ ID NO: 202329 - DNA, 22 bp, Artificial Sequence
  Description of Artificial Sequence: Synthetic oligonucleotide
cttccaccgcgcggctgccatc

SEQ ID NO: 202330 - DNA, 23 bp, Artificial Sequence
  Description of Artificial Sequence: Synthetic oligonucleotide
ttccaccgcgcggctgccatcca

SEQ ID NO: 202331 - DNA, 22 bp, Artificial Sequence
  Description of Artificial Sequence: Synthetic oligonucleotide
tccaccgcgcggctgccatcca

SEQ ID NO: 202332 - DNA, 21 bp, Artificial Sequence
  Description of Artificial Sequence: Synthetic oligonucleotide
ccaccgcgcggctgccatcca

SEQ ID NO: 202333 - DNA, 22 bp, Artificial Sequence
  Description of Artificial Sequence: Synthetic oligonucleotide
caccgcgcggctgccatccaga

SEQ ID NO: 202334 - DNA, 22 bp, Artificial Sequence
  Description of Artificial Sequence: Synthetic oligonucleotide
accgcgcggctgccatccagac

SEQ ID NO: 202335 - DNA, 28 bp, Artificial Sequence
  Description of Artificial Sequence: Synthetic oligonucleotide
gtgccacttggcgagatgagaggctatg

SEQ ID NO: 202336 - DNA, 28 bp, Artificial Sequence
  Description of Artificial Sequence: Synthetic oligonucleotide
tgccacttggcgagatgagaggctatgc

SEQ ID NO: 202337 - DNA, 27 bp, Artificial Sequence
  Description of Artificial Sequence: Synthetic oligonucleotide
gccacttggcgagatgagaggctatgc

SEQ ID NO: 202338 - DNA, 27 bp, Artificial Sequence
  Description of Artificial Sequence: Synthetic oligonucleotide
ccacttggcgagatgagaggctatgcc

SEQ ID NO: 202339 - DNA, 27 bp, Artificial Sequence
  Description of Artificial Sequence: Synthetic oligonucleotide
cacttggcgagatgagaggctatgccc

SEQ ID NO: 202340 - DNA, 27 bp, Artificial Sequence
  Description of Artificial Sequence: Synthetic oligonucleotide
acttggcgagatgagaggctatgcccc

SEQ ID NO: 202341 - DNA, 26 bp, Artificial Sequence
  Description of Artificial Sequence: Synthetic oligonucleotide
cttggcgagatgagaggctatgcccc

SEQ ID NO: 202342 - DNA, 27 bp, Artificial Sequence
  Description of Artificial Sequence: Synthetic oligonucleotide
ttggcgagatgagaggctatgccccct

SEQ ID NO: 202343 - DNA, 27 bp, Artificial Sequence
  Description of Artificial Sequence: Synthetic oligonucleotide
tggcgagatgagaggctatgccccctt

SEQ ID NO: 202344 - DNA, 26 bp, Artificial Sequence
  Description of Artificial Sequence: Synthetic oligonucleotide
ggcgagatgagaggctatgccccctt

SEQ ID NO: 202345 - DNA, 27 bp, Artificial Sequence
  Description of Artificial Sequence: Synthetic oligonucleotide
gcgagatgagaggctatgcccccttca

SEQ ID NO: 202346 - DNA, 27 bp, Artificial Sequence
  Description of Artificial Sequence: Synthetic oligonucleotide
cgagatgagaggctatgcccccttcag

SEQ ID NO: 202347 - DNA, 27 bp, Artificial Sequence
  Description of Artificial Sequence: Synthetic oligonucleotide
gagatgagaggctatgcccccttcagc

SEQ ID NO: 202348 - DNA, 27 bp, Artificial Sequence
  Description of Artificial Sequence: Synthetic oligonucleotide
agatgagaggctatgcccccttcagcc

SEQ ID NO: 202349 - DNA, 26 bp, Artificial Sequence
  Description of Artificial Sequence: Synthetic oligonucleotide
gatgagaggctatgcccccttcagcc

SEQ ID NO: 202350 - DNA, 26 bp, Artificial Sequence
  Description of Artificial Sequence: Synthetic oligonucleotide
atgagaggctatgcccccttcagccc

SEQ ID NO: 202351 - DNA, 25 bp, Artificial Sequence
  Description of Artificial Sequence: Synthetic oligonucleotide
tgagaggctatgcccccttcagccc

SEQ ID NO: 202352 - DNA, 24 bp, Artificial Sequence
  Description of Artificial Sequence: Synthetic oligonucleotide
gagaggctatgcccccttcagccc

SEQ ID NO: 202353 - DNA, 24 bp, Artificial Sequence
  Description of Artificial Sequence: Synthetic oligonucleotide
agaggctatgcccccttcagcccg

SEQ ID NO: 202354 - DNA, 23 bp, Artificial Sequence
  Description of Artificial Sequence: Synthetic oligonucleotide
gaggctatgcccccttcagcccg

SEQ ID NO: 202355 - DNA, 24 bp, Artificial Sequence
  Description of Artificial Sequence: Synthetic oligonucleotide
aggctatgcccccttcagcccgga

SEQ ID NO: 202356 - DNA, 23 bp, Artificial Sequence
  Description of Artificial Sequence: Synthetic oligonucleotide
ggctatgcccccttcagcccgga

SEQ ID NO: 202357 - DNA, 23 bp, Artificial Sequence
  Description of Artificial Sequence: Synthetic oligonucleotide
gctatgcccccttcagcccggac

SEQ ID NO: 202358 - DNA, 24 bp, Artificial Sequence
  Description of Artificial Sequence: Synthetic oligonucleotide
ctatgcccccttcagcccggacga

SEQ ID NO: 202359 - DNA, 26 bp, Artificial Sequence
  Description of Artificial Sequence: Synthetic oligonucleotide
tatgcccccttcagcccggacgagaa

SEQ ID NO: 202360 - DNA, 25 bp, Artificial Sequence
  Description of Artificial Sequence: Synthetic oligonucleotide
atgcccccttcagcccggacgagaa

SEQ ID NO: 202361 - DNA, 24 bp, Artificial Sequence
  Description of Artificial Sequence: Synthetic oligonucleotide
tgcccccttcagcccggacgagaa

SEQ ID NO: 202362 - DNA, 30 bp, Artificial Sequence
  Description of Artificial Sequence: Synthetic oligonucleotide
gtcttccgtacctcctcactcaagggttac

SEQ ID NO: 202363 - DNA, 30 bp, Artificial Sequence
  Description of Artificial Sequence: Synthetic oligonucleotide
tcttccgtacctcctcactcaagggttacc

SEQ ID NO: 202364 - DNA, 29 bp, Artificial Sequence
  Description of Artificial Sequence: Synthetic oligonucleotide
cttccgtacctcctcactcaagggttacc

SEQ ID NO: 202365 - DNA, 30 bp, Artificial Sequence
  Description of Artificial Sequence: Synthetic oligonucleotide
ttccgtacctcctcactcaagggttaccac

SEQ ID NO: 202366 - DNA, 29 bp, Artificial Sequence
  Description of Artificial Sequence: Synthetic oligonucleotide
tccgtacctcctcactcaagggttaccac

SEQ ID NO: 202367 - DNA, 28 bp, Artificial Sequence
  Description of Artificial Sequence: Synthetic oligonucleotide
ccgtacctcctcactcaagggttaccac

SEQ ID NO: 202368 - DNA, 29 bp, Artificial Sequence
  Description of Artificial Sequence: Synthetic oligonucleotide
cgtacctcctcactcaagggttaccactc

SEQ ID NO: 202369 - DNA, 31 bp, Artificial Sequence
  Description of Artificial Sequence: Synthetic oligonucleotide
gtacctcctcactcaagggttaccactcaag

SEQ ID NO: 202370 - DNA, 31 bp, Artificial Sequence
  Description of Artificial Sequence: Synthetic oligonucleotide
tacctcctcactcaagggttaccactcaagc

SEQ ID NO: 202371 - DNA, 30 bp, Artificial Sequence
  Description of Artificial Sequence: Synthetic oligonucleotide
acctcctcactcaagggttaccactcaagc

SEQ ID NO: 202372 - DNA, 29 bp, Artificial Sequence
  Description of Artificial Sequence: Synthetic oligonucleotide
cctcctcactcaagggttaccactcaagc

SEQ ID NO: 202373 - DNA, 29 bp, Artificial Sequence
  Description of Artificial Sequence: Synthetic oligonucleotide
ctcctcactcaagggttaccactcaagcc

SEQ ID NO: 202374 - DNA, 31 bp, Artificial Sequence
  Description of Artificial Sequence: Synthetic oligonucleotide
tcctcactcaagggttaccactcaagccttc

SEQ ID NO: 202375 - DNA, 30 bp, Artificial Sequence
  Description of Artificial Sequence: Synthetic oligonucleotide
cctcactcaagggttaccactcaagccttc

SEQ ID NO: 202376 - DNA, 30 bp, Artificial Sequence
  Description of Artificial Sequence: Synthetic oligonucleotide
ctcactcaagggttaccactcaagccttcc

SEQ ID NO: 202377 - DNA, 30 bp, Artificial Sequence
  Description of Artificial Sequence: Synthetic oligonucleotide
tcactcaagggttaccactcaagccttccc

SEQ ID NO: 202378 - DNA, 29 bp, Artificial Sequence
  Description of Artificial Sequence: Synthetic oligonucleotide
cactcaagggttaccactcaagccttccc

SEQ ID NO: 202379 - DNA, 31 bp, Artificial Sequence
  Description of Artificial Sequence: Synthetic oligonucleotide
actcaagggttaccactcaagccttcccaac

SEQ ID NO: 202380 - DNA, 30 bp, Artificial Sequence
  Description of Artificial Sequence: Synthetic oligonucleotide
ctcaagggttaccactcaagccttcccaac

SEQ ID NO: 202381 - DNA, 30 bp, Artificial Sequence
  Description of Artificial Sequence: Synthetic oligonucleotide
tcaagggttaccactcaagccttcccaacc

SEQ ID NO: 202382 - DNA, 29 bp, Artificial Sequence
  Description of Artificial Sequence: Synthetic oligonucleotide
caagggttaccactcaagccttcccaacc

SEQ ID NO: 202383 - DNA, 29 bp, Artificial Sequence
  Description of Artificial Sequence: Synthetic oligonucleotide
aagggttaccactcaagccttcccaaccc

SEQ ID NO: 202384 - DNA, 28 bp, Artificial Sequence
  Description of Artificial Sequence: Synthetic oligonucleotide
agggttaccactcaagccttcccaaccc

SEQ ID NO: 202385 - DNA, 27 bp, Artificial Sequence
  Description of Artificial Sequence: Synthetic oligonucleotide
gggttaccactcaagccttcccaaccc

SEQ ID NO: 202386 - DNA, 27 bp, Artificial Sequence
  Description of Artificial Sequence: Synthetic oligonucleotide
ggttaccactcaagccttcccaacccg

SEQ ID NO: 202387 - DNA, 27 bp, Artificial Sequence
  Description of Artificial Sequence: Synthetic oligonucleotide
gttaccactcaagccttcccaacccgc

SEQ ID NO: 202388 - DNA, 27 bp, Artificial Sequence
  Description of Artificial Sequence: Synthetic oligonucleotide
ttaccactcaagccttcccaacccgcg

SEQ ID NO: 202389 - DNA, 30 bp, Artificial Sequence
  Description of Artificial Sequence: Synthetic oligonucleotide
atggaaggtggggaccaaagtgaggaagag

SEQ ID NO: 202390 - DNA, 29 bp, Artificial Sequence
  Description of Artificial Sequence: Synthetic oligonucleotide
tggaaggtggggaccaaagtgaggaagag

SEQ ID NO: 202391 - DNA, 28 bp, Artificial Sequence
  Description of Artificial Sequence: Synthetic oligonucleotide
ggaaggtggggaccaaagtgaggaagag

SEQ ID NO: 202392 - DNA, 28 bp, Artificial Sequence
  Description of Artificial Sequence: Synthetic oligonucleotide
gaaggtggggaccaaagtgaggaagagc

SEQ ID NO: 202393 - DNA, 28 bp, Artificial Sequence
  Description of Artificial Sequence: Synthetic oligonucleotide
aaggtggggaccaaagtgaggaagagcc

SEQ ID NO: 202394 - DNA, 27 bp, Artificial Sequence
  Description of Artificial Sequence: Synthetic oligonucleotide
aggtggggaccaaagtgaggaagagcc

SEQ ID NO: 202395 - DNA, 26 bp, Artificial Sequence
  Description of Artificial Sequence: Synthetic oligonucleotide
ggtggggaccaaagtgaggaagagcc

SEQ ID NO: 202396 - DNA, 27 bp, Artificial Sequence
  Description of Artificial Sequence: Synthetic oligonucleotide
gtggggaccaaagtgaggaagagccga

SEQ ID NO: 202397 - DNA, 27 bp, Artificial Sequence
  Description of Artificial Sequence: Synthetic oligonucleotide
tggggaccaaagtgaggaagagccgag

SEQ ID NO: 202398 - DNA, 26 bp, Artificial Sequence
  Description of Artificial Sequence: Synthetic oligonucleotide
ggggaccaaagtgaggaagagccgag

SEQ ID NO: 202399 - DNA, 26 bp, Artificial Sequence
  Description of Artificial Sequence: Synthetic oligonucleotide
gggaccaaagtgaggaagagccgagg

SEQ ID NO: 202400 - DNA, 27 bp, Artificial Sequence
  Description of Artificial Sequence: Synthetic oligonucleotide
ggaccaaagtgaggaagagccgaggga

SEQ ID NO: 202401 - DNA, 28 bp, Artificial Sequence
  Description of Artificial Sequence: Synthetic oligonucleotide
gaccaaagtgaggaagagccgagggaac

SEQ ID NO: 202402 - DNA, 28 bp, Artificial Sequence
  Description of Artificial Sequence: Synthetic oligonucleotide
accaaagtgaggaagagccgagggaacg

SEQ ID NO: 202403 - DNA, 27 bp, Artificial Sequence
  Description of Artificial Sequence: Synthetic oligonucleotide
ccaaagtgaggaagagccgagggaacg

SEQ ID NO: 202404 - DNA, 27 bp, Artificial Sequence
  Description of Artificial Sequence: Synthetic oligonucleotide
caaagtgaggaagagccgagggaacgc

SEQ ID NO: 202405 - DNA, 28 bp, Artificial Sequence
  Description of Artificial Sequence: Synthetic oligonucleotide
aaagtgaggaagagccgagggaacgcag

SEQ ID NO: 202406 - DNA, 27 bp, Artificial Sequence
  Description of Artificial Sequence: Synthetic oligonucleotide
aagtgaggaagagccgagggaacgcag

SEQ ID NO: 202407 - DNA, 26 bp, Artificial Sequence
  Description of Artificial Sequence: Synthetic oligonucleotide
agtgaggaagagccgagggaacgcag

SEQ ID NO: 202408 - DNA, 25 bp, Artificial Sequence
  Description of Artificial Sequence: Synthetic oligonucleotide
gtgaggaagagccgagggaacgcag

SEQ ID NO: 202409 - DNA, 25 bp, Artificial Sequence
  Description of Artificial Sequence: Synthetic oligonucleotide
tgaggaagagccgagggaacgcagc

SEQ ID NO: 202410 - DNA, 24 bp, Artificial Sequence
  Description of Artificial Sequence: Synthetic oligonucleotide
gaggaagagccgagggaacgcagc

SEQ ID NO: 202411 - DNA, 25 bp, Artificial Sequence
  Description of Artificial Sequence: Synthetic oligonucleotide
aggaagagccgagggaacgcagcca

SEQ ID NO: 202412 - DNA, 24 bp, Artificial Sequence
  Description of Artificial Sequence: Synthetic oligonucleotide
ggaagagccgagggaacgcagcca

SEQ ID NO: 202413 - DNA, 24 bp, Artificial Sequence
  Description of Artificial Sequence: Synthetic oligonucleotide
gaagagccgagggaacgcagccag

SEQ ID NO: 202414 - DNA, 24 bp, Artificial Sequence
  Description of Artificial Sequence: Synthetic oligonucleotide
aagagccgagggaacgcagccagg

SEQ ID NO: 202415 - DNA, 23 bp, Artificial Sequence
  Description of Artificial Sequence: Synthetic oligonucleotide
agagccgagggaacgcagccagg

SEQ ID NO: 202416 - DNA, 22 bp, Artificial Sequence
  Description of Artificial Sequence: Synthetic oligonucleotide
gagccgagggaacgcagccagg

SEQ ID NO: 202417 - DNA, 23 bp, Artificial Sequence
  Description of Artificial Sequence: Synthetic oligonucleotide
agccgagggaacgcagccaggca

SEQ ID NO: 202418 - DNA, 22 bp, Artificial Sequence
  Description of Artificial Sequence: Synthetic oligonucleotide
gccgagggaacgcagccaggca

SEQ ID NO: 202419 - DNA, 22 bp, Artificial Sequence
  Description of Artificial Sequence: Synthetic oligonucleotide
ccgagggaacgcagccaggcag

SEQ ID NO: 202420 - DNA, 23 bp, Artificial Sequence
  Description of Artificial Sequence: Synthetic oligonucleotide
cgagggaacgcagccaggcaggt

SEQ ID NO: 202421 - DNA, 23 bp, Artificial Sequence
  Description of Artificial Sequence: Synthetic oligonucleotide
gagggaacgcagccaggcaggtg

SEQ ID NO: 202422 - DNA, 26 bp, Artificial Sequence
  Description of Artificial Sequence: Synthetic oligonucleotide
agggaacgcagccaggcaggtggaat

SEQ ID NO: 202423 - DNA, 25 bp, Artificial Sequence
  Description of Artificial Sequence: Synthetic oligonucleotide
gggaacgcagccaggcaggtggaat

SEQ ID NO: 202424 - DNA, 25 bp, Artificial Sequence
  Description of Artificial Sequence: Synthetic oligonucleotide
ggaacgcagccaggcaggtggaatg

SEQ ID NO: 202425 - DNA, 25 bp, Artificial Sequence
  Description of Artificial Sequence: Synthetic oligonucleotide
gaacgcagccaggcaggtggaatgg

SEQ ID NO: 202426 - DNA, 27 bp, Artificial Sequence
  Description of Artificial Sequence: Synthetic oligonucleotide
aacgcagccaggcaggtggaatgggaa

SEQ ID NO: 202427 - DNA, 26 bp, Artificial Sequence
  Description of Artificial Sequence: Synthetic oligonucleotide
acgcagccaggcaggtggaatgggaa

SEQ ID NO: 202428 - DNA, 25 bp, Artificial Sequence
  Description of Artificial Sequence: Synthetic oligonucleotide
cgcagccaggcaggtggaatgggaa

SEQ ID NO: 202429 - DNA, 26 bp, Artificial Sequence
  Description of Artificial Sequence: Synthetic oligonucleotide
gcagccaggcaggtggaatgggaact

SEQ ID NO: 202430 - DNA, 27 bp, Artificial Sequence
  Description of Artificial Sequence: Synthetic oligonucleotide
cagccaggcaggtggaatgggaactct

SEQ ID NO: 202431 - DNA, 27 bp, Artificial Sequence
  Description of Artificial Sequence: Synthetic oligonucleotide
agccaggcaggtggaatgggaactctc

SEQ ID NO: 202432 - DNA, 27 bp, Artificial Sequence
  Description of Artificial Sequence: Synthetic oligonucleotide
gccaggcaggtggaatgggaactctct

SEQ ID NO: 202433 - DNA, 27 bp, Artificial Sequence
  Description of Artificial Sequence: Synthetic oligonucleotide
ccaggcaggtggaatgggaactctctg

SEQ ID NO: 202434 - DNA, 27 bp, Artificial Sequence
  Description of Artificial Sequence: Synthetic oligonucleotide
caggcaggtggaatgggaactctctgg

SEQ ID NO: 202435 - DNA, 28 bp, Artificial Sequence
  Description of Artificial Sequence: Synthetic oligonucleotide
aggcaggtggaatgggaactctctggag

SEQ ID NO: 202436 - DNA, 27 bp, Artificial Sequence
  Description of Artificial Sequence: Synthetic oligonucleotide
ggcaggtggaatgggaactctctggag

SEQ ID NO: 202437 - DNA, 27 bp, Artificial Sequence
  Description of Artificial Sequence: Synthetic oligonucleotide
gcaggtggaatgggaactctctggagc

SEQ ID NO: 202438 - DNA, 27 bp, Artificial Sequence
  Description of Artificial Sequence: Synthetic oligonucleotide
caggtggaatgggaactctctggagcc

SEQ ID NO: 202439 - DNA, 29 bp, Artificial Sequence
  Description of Artificial Sequence: Synthetic oligonucleotide
aggtggaatgggaactctctggagccaag

SEQ ID NO: 202440 - DNA, 28 bp, Artificial Sequence
  Description of Artificial Sequence: Synthetic oligonucleotide
ggtggaatgggaactctctggagccaag

SEQ ID NO: 202441 - DNA, 29 bp, Artificial Sequence
  Description of Artificial Sequence: Synthetic oligonucleotide
gtggaatgggaactctctggagccaagag

SEQ ID NO: 202442 - DNA, 30 bp, Artificial Sequence
  Description of Artificial Sequence: Synthetic oligonucleotide
tggaatgggaactctctggagccaagagag

SEQ ID NO: 202443 - DNA, 29 bp, Artificial Sequence
  Description of Artificial Sequence: Synthetic oligonucleotide
ggaatgggaactctctggagccaagagag

SEQ ID NO: 202444 - DNA, 29 bp, Artificial Sequence
  Description of Artificial Sequence: Synthetic oligonucleotide
gaatgggaactctctggagccaagagagc

SEQ ID NO: 202445 - DNA, 30 bp, Artificial Sequence
  Description of Artificial Sequence: Synthetic oligonucleotide
aatgggaactctctggagccaagagagcac

SEQ ID NO: 202446 - DNA, 29 bp, Artificial Sequence
  Description of Artificial Sequence: Synthetic oligonucleotide
atgggaactctctggagccaagagagcac

SEQ ID NO: 202447 - DNA, 28 bp, Artificial Sequence
  Description of Artificial Sequence: Synthetic oligonucleotide
tgggaactctctggagccaagagagcac

SEQ ID NO: 202448 - DNA, 27 bp, Artificial Sequence
  Description of Artificial Sequence: Synthetic oligonucleotide
gggaactctctggagccaagagagcac

SEQ ID NO: 202449 - DNA, 28 bp, Artificial Sequence
  Description of Artificial Sequence: Synthetic oligonucleotide
ggaactctctggagccaagagagcactc

SEQ ID NO: 202450 - DNA, 28 bp, Artificial Sequence
  Description of Artificial Sequence: Synthetic oligonucleotide
gaactctctggagccaagagagcactcc

SEQ ID NO: 202451 - DNA, 29 bp, Artificial Sequence
  Description of Artificial Sequence: Synthetic oligonucleotide
aactctctggagccaagagagcactccag

SEQ ID NO: 202452 - DNA, 28 bp, Artificial Sequence
  Description of Artificial Sequence: Synthetic oligonucleotide
actctctggagccaagagagcactccag

SEQ ID NO: 202453 - DNA, 27 bp, Artificial Sequence
  Description of Artificial Sequence: Synthetic oligonucleotide
ctctctggagccaagagagcactccag

SEQ ID NO: 202454 - DNA, 29 bp, Artificial Sequence
  Description of Artificial Sequence: Synthetic oligonucleotide
tctctggagccaagagagcactccagaag

SEQ ID NO: 202455 - DNA, 28 bp, Artificial Sequence
  Description of Artificial Sequence: Synthetic oligonucleotide
ctctggagccaagagagcactccagaag

SEQ ID NO: 202456 - DNA, 29 bp, Artificial Sequence
  Description of Artificial Sequence: Synthetic oligonucleotide
tctggagccaagagagcactccagaagag

SEQ ID NO: 202457 - DNA, 28 bp, Artificial Sequence
  Description of Artificial Sequence: Synthetic oligonucleotide
ctggagccaagagagcactccagaagag

SEQ ID NO: 202458 - DNA, 29 bp, Artificial Sequence
  Description of Artificial Sequence: Synthetic oligonucleotide
tggagccaagagagcactccagaagagag

SEQ ID NO: 202459 - DNA, 28 bp, Artificial Sequence
  Description of Artificial Sequence: Synthetic oligonucleotide
ggagccaagagagcactccagaagagag

SEQ ID NO: 202460 - DNA, 28 bp, Artificial Sequence
  Description of Artificial Sequence: Synthetic oligonucleotide
gagccaagagagcactccagaagagagg

SEQ ID NO: 202461 - DNA, 28 bp, Artificial Sequence
  Description of Artificial Sequence: Synthetic oligonucleotide
agccaagagagcactccagaagagaggc

SEQ ID NO: 202462 - DNA, 27 bp, Artificial Sequence
  Description of Artificial Sequence: Synthetic oligonucleotide
gccaagagagcactccagaagagaggc

SEQ ID NO: 202463 - DNA, 28 bp, Artificial Sequence
  Description of Artificial Sequence: Synthetic oligonucleotide
ccaagagagcactccagaagagaggctg

SEQ ID NO: 202464 - DNA, 28 bp, Artificial Sequence
  Description of Artificial Sequence: Synthetic oligonucleotide
caagagagcactccagaagagaggctgc

SEQ ID NO: 202465 - DNA, 28 bp, Artificial Sequence
  Description of Artificial Sequence: Synthetic oligonucleotide
aagagagcactccagaagagaggctgcc

SEQ ID NO: 202466 - DNA, 27 bp, Artificial Sequence
  Description of Artificial Sequence: Synthetic oligonucleotide
agagagcactccagaagagaggctgcc

SEQ ID NO: 202467 - DNA, 26 bp, Artificial Sequence
  Description of Artificial Sequence: Synthetic oligonucleotide
gagagcactccagaagagaggctgcc

SEQ ID NO: 202468 - DNA, 26 bp, Artificial Sequence
  Description of Artificial Sequence: Synthetic oligonucleotide
agagcactccagaagagaggctgccc

SEQ ID NO: 202469 - DNA, 25 bp, Artificial Sequence
  Description of Artificial Sequence: Synthetic oligonucleotide
gagcactccagaagagaggctgccc

SEQ ID NO: 202470 - DNA, 26 bp, Artificial Sequence
  Description of Artificial Sequence: Synthetic oligonucleotide
agcactccagaagagaggctgcccgt

SEQ ID NO: 202471 - DNA, 25 bp, Artificial Sequence
  Description of Artificial Sequence: Synthetic oligonucleotide
gcactccagaagagaggctgcccgt

SEQ ID NO: 202472 - DNA, 25 bp, Artificial Sequence
  Description of Artificial Sequence: Synthetic oligonucleotide
cactccagaagagaggctgcccgtg

SEQ ID NO: 202473 - DNA, 27 bp, Artificial Sequence
  Description of Artificial Sequence: Synthetic oligonucleotide
actccagaagagaggctgcccgtggaa

SEQ ID NO: 202474 - DNA, 26 bp, Artificial Sequence
  Description of Artificial Sequence: Synthetic oligonucleotide
ctccagaagagaggctgcccgtggaa

SEQ ID NO: 202475 - DNA, 26 bp, Artificial Sequence
  Description of Artificial Sequence: Synthetic oligonucleotide
tccagaagagaggctgcccgtggaag

SEQ ID NO: 202476 - DNA, 25 bp, Artificial Sequence
  Description of Artificial Sequence: Synthetic oligonucleotide
ccagaagagaggctgcccgtggaag

SEQ ID NO: 202477 - DNA, 25 bp, Artificial Sequence
  Description of Artificial Sequence: Synthetic oligonucleotide
cagaagagaggctgcccgtggaagg

SEQ ID NO: 202478 - DNA, 26 bp, Artificial Sequence
  Description of Artificial Sequence: Synthetic oligonucleotide
agaagagaggctgcccgtggaaggga

SEQ ID NO: 202479 - DNA, 25 bp, Artificial Sequence
  Description of Artificial Sequence: Synthetic oligonucleotide
gaagagaggctgcccgtggaaggga

SEQ ID NO: 202480 - DNA, 25 bp, Artificial Sequence
  Description of Artificial Sequence: Synthetic oligonucleotide
aagagaggctgcccgtggaagggag

SEQ ID NO: 202481 - DNA, 24 bp, Artificial Sequence
  Description of Artificial Sequence: Synthetic oligonucleotide
agagaggctgcccgtggaagggag

SEQ ID NO: 202482 - DNA, 23 bp, Artificial Sequence
  Description of Artificial Sequence: Synthetic oligonucleotide
gagaggctgcccgtggaagggag

SEQ ID NO: 202483 - DNA, 24 bp, Artificial Sequence
  Description of Artificial Sequence: Synthetic oligonucleotide
agaggctgcccgtggaagggagca

SEQ ID NO: 202484 - DNA, 23 bp, Artificial Sequence
  Description of Artificial Sequence: Synthetic oligonucleotide
gaggctgcccgtggaagggagca

SEQ ID NO: 202485 - DNA, 23 bp, Artificial Sequence
  Description of Artificial Sequence: Synthetic oligonucleotide
aggctgcccgtggaagggagcag

SEQ ID NO: 202486 - DNA, 22 bp, Artificial Sequence
  Description of Artificial Sequence: Synthetic oligonucleotide
ggctgcccgtggaagggagcag

SEQ ID NO: 202487 - DNA, 22 bp, Artificial Sequence
  Description of Artificial Sequence: Synthetic oligonucleotide
gctgcccgtggaagggagcagg

SEQ ID NO: 202488 - DNA, 22 bp, Artificial Sequence
  Description of Artificial Sequence: Synthetic oligonucleotide
ctgcccgtggaagggagcaggc

SEQ ID NO: 202489 - DNA, 24 bp, Artificial Sequence
  Description of Artificial Sequence: Synthetic oligonucleotide
tgcccgtggaagggagcaggccat

SEQ ID NO: 202490 - DNA, 23 bp, Artificial Sequence
  Description of Artificial Sequence: Synthetic oligonucleotide
gcccgtggaagggagcaggccat

SEQ ID NO: 202491 - DNA, 23 bp, Artificial Sequence
  Description of Artificial Sequence: Synthetic oligonucleotide
cccgtggaagggagcaggccatg

SEQ ID NO: 202492 - DNA, 23 bp, Artificial Sequence
  Description of Artificial Sequence: Synthetic oligonucleotide
ccgtggaagggagcaggccatgg

SEQ ID NO: 202493 - DNA, 23 bp, Artificial Sequence
  Description of Artificial Sequence: Synthetic oligonucleotide
cgtggaagggagcaggccatggg

SEQ ID NO: 202494 - DNA, 24 bp, Artificial Sequence
  Description of Artificial Sequence: Synthetic oligonucleotide
gtggaagggagcaggccatgggca

SEQ ID NO: 202495 - DNA, 25 bp, Artificial Sequence
  Description of Artificial Sequence: Synthetic oligonucleotide
tggaagggagcaggccatgggcagt

SEQ ID NO: 202496 - DNA, 24 bp, Artificial Sequence
  Description of Artificial Sequence: Synthetic oligonucleotide
ggaagggagcaggccatgggcagt

SEQ ID NO: 202497 - DNA, 24 bp, Artificial Sequence
  Description of Artificial Sequence: Synthetic oligonucleotide
gaagggagcaggccatgggcagtg

SEQ ID NO: 202498 - DNA, 24 bp, Artificial Sequence
  Description of Artificial Sequence: Synthetic oligonucleotide
aagggagcaggccatgggcagtgg

SEQ ID NO: 202499 - DNA, 23 bp, Artificial Sequence
  Description of Artificial Sequence: Synthetic oligonucleotide
agggagcaggccatgggcagtgg

SEQ ID NO: 202500 - DNA, 22 bp, Artificial Sequence
  Description of Artificial Sequence: Synthetic oligonucleotide
gggagcaggccatgggcagtgg

SEQ ID NO: 202501 - DNA, 22 bp, Artificial Sequence
  Description of Artificial Sequence: Synthetic oligonucleotide
ggagcaggccatgggcagtggc

SEQ ID NO: 202502 - DNA, 23 bp, Artificial Sequence
  Description of Artificial Sequence: Synthetic oligonucleotide
gagcaggccatgggcagtggcca

SEQ ID NO: 202503 - DNA, 23 bp, Artificial Sequence
  Description of Artificial Sequence: Synthetic oligonucleotide
agcaggccatgggcagtggccag

SEQ ID NO: 202504 - DNA, 22 bp, Artificial Sequence
  Description of Artificial Sequence: Synthetic oligonucleotide
gcaggccatgggcagtggccag

SEQ ID NO: 202505 - DNA, 22 bp, Artificial Sequence
  Description of Artificial Sequence: Synthetic oligonucleotide
caggccatgggcagtggccagg

SEQ ID NO: 202506 - DNA, 22 bp, Artificial Sequence
  Description of Artificial Sequence: Synthetic oligonucleotide
aggccatgggcagtggccaggc

SEQ ID NO: 202507 - DNA, 21 bp, Artificial Sequence
  Description of Artificial Sequence: Synthetic oligonucleotide
ggccatgggcagtggccaggc

SEQ ID NO: 202508 - DNA, 21 bp, Artificial Sequence
  Description of Artificial Sequence: Synthetic oligonucleotide
gccatgggcagtggccaggcg

SEQ ID NO: 202509 - DNA, 21 bp, Artificial Sequence
  Description of Artificial Sequence: Synthetic oligonucleotide
ccatgggcagtggccaggcgg

SEQ ID NO: 202510 - DNA, 22 bp, Artificial Sequence
  Description of Artificial Sequence: Synthetic oligonucleotide
catgggcagtggccaggcgggt

SEQ ID NO: 202511 - DNA, 22 bp, Artificial Sequence
  Description of Artificial Sequence: Synthetic oligonucleotide
atgggcagtggccaggcgggtg

SEQ ID NO: 202512 - DNA, 21 bp, Artificial Sequence
  Description of Artificial Sequence: Synthetic oligonucleotide
tgggcagtggccaggcgggtg

SEQ ID NO: 202513 - DNA, 20 bp, Artificial Sequence
  Description of Artificial Sequence: Synthetic oligonucleotide
gggcagtggccaggcgggtg

SEQ ID NO: 202514 - DNA, 21 bp, Artificial Sequence
  Description of Artificial Sequence: Synthetic oligonucleotide
ggcagtggccaggcgggtgct

SEQ ID NO: 202515 - DNA, 22 bp, Artificial Sequence
  Description of Artificial Sequence: Synthetic oligonucleotide
gcagtggccaggcgggtgctga

SEQ ID NO: 202516 - DNA, 23 bp, Artificial Sequence
  Description of Artificial Sequence: Synthetic oligonucleotide
cagtggccaggcgggtgctgaca

SEQ ID NO: 202517 - DNA, 23 bp, Artificial Sequence
  Description of Artificial Sequence: Synthetic oligonucleotide
agtggccaggcgggtgctgacag

SEQ ID NO: 202518 - DNA, 22 bp, Artificial Sequence
  Description of Artificial Sequence: Synthetic oligonucleotide
gtggccaggcgggtgctgacag

SEQ ID NO: 202519 - DNA, 25 bp, Artificial Sequence
  Description of Artificial Sequence: Synthetic oligonucleotide
tggccaggcgggtgctgacagctat

SEQ ID NO: 202520 - DNA, 24 bp, Artificial Sequence
  Description of Artificial Sequence: Synthetic oligonucleotide
ggccaggcgggtgctgacagctat

SEQ ID NO: 202521 - DNA, 24 bp, Artificial Sequence
  Description of Artificial Sequence: Synthetic oligonucleotide
gccaggcgggtgctgacagctatc

SEQ ID NO: 202522 - DNA, 25 bp, Artificial Sequence
  Description of Artificial Sequence: Synthetic oligonucleotide
ccaggcgggtgctgacagctatcct

SEQ ID NO: 202523 - DNA, 27 bp, Artificial Sequence
  Description of Artificial Sequence: Synthetic oligonucleotide
caggcgggtgctgacagctatcctgat

SEQ ID NO: 202524 - DNA, 30 bp, Artificial Sequence
  Description of Artificial Sequence: Synthetic oligonucleotide
aggcgggtgctgacagctatcctgattttg

SEQ ID NO: 202525 - DNA, 29 bp, Artificial Sequence
  Description of Artificial Sequence: Synthetic oligonucleotide
ggcgggtgctgacagctatcctgattttg

SEQ ID NO: 202526 - DNA, 29 bp, Artificial Sequence
  Description of Artificial Sequence: Synthetic oligonucleotide
gcgggtgctgacagctatcctgattttgg

SEQ ID NO: 202527 - DNA, 29 bp, Artificial Sequence
  Description of Artificial Sequence: Synthetic oligonucleotide
cgggtgctgacagctatcctgattttggg

SEQ ID NO: 202528 - DNA, 29 bp, Artificial Sequence
  Description of Artificial Sequence: Synthetic oligonucleotide
gggtgctgacagctatcctgattttgggc

SEQ ID NO: 202529 - DNA, 29 bp, Artificial Sequence
  Description of Artificial Sequence: Synthetic oligonucleotide
ggtgctgacagctatcctgattttgggcc

SEQ ID NO: 202530 - DNA, 30 bp, Artificial Sequence
  Description of Artificial Sequence: Synthetic oligonucleotide
gtgctgacagctatcctgattttgggcctg

SEQ ID NO: 202531 - DNA, 30 bp, Artificial Sequence
  Description of Artificial Sequence: Synthetic oligonucleotide
tgctgacagctatcctgattttgggcctgc

SEQ ID NO: 202532 - DNA, 29 bp, Artificial Sequence
  Description of Artificial Sequence: Synthetic oligonucleotide
gctgacagctatcctgattttgggcctgc

SEQ ID NO: 202533 - DNA, 30 bp, Artificial Sequence
  Description of Artificial Sequence: Synthetic oligonucleotide
ctgacagctatcctgattttgggcctgctc

SEQ ID NO: 202534 - DNA, 30 bp, Artificial Sequence
  Description of Artificial Sequence: Synthetic oligonucleotide
tgacagctatcctgattttgggcctgctcc

SEQ ID NO: 202535 - DNA, 29 bp, Artificial Sequence
  Description of Artificial Sequence: Synthetic oligonucleotide
gacagctatcctgattttgggcctgctcc

SEQ ID NO: 202536 - DNA, 32 bp, Artificial Sequence
  Description of Artificial Sequence: Synthetic oligonucleotide
acagctatcctgattttgggcctgctcctttg

SEQ ID NO: 202537 - DNA, 31 bp, Artificial Sequence
  Description of Artificial Sequence: Synthetic oligonucleotide
cagctatcctgattttgggcctgctcctttg

SEQ ID NO: 202538 - DNA, 36 bp, Artificial Sequence
  Description of Artificial Sequence: Synthetic oligonucleotide
agctatcctgattttgggcctgctcctttgtttttc

SEQ ID NO: 202539 - DNA, 35 bp, Artificial Sequence
  Description of Artificial Sequence: Synthetic oligonucleotide
gctatcctgattttgggcctgctcctttgtttttc

SEQ ID NO: 202540 - DNA, 36 bp, Artificial Sequence
  Description of Artificial Sequence: Synthetic oligonucleotide
ctatcctgattttgggcctgctcctttgtttttctg

SEQ ID NO: 202541 - DNA, 37 bp, Artificial Sequence
  Description of Artificial Sequence: Synthetic oligonucleotide
tatcctgattttgggcctgctcctttgtttttctgtg

SEQ ID NO: 202542 - DNA, 36 bp, Artificial Sequence
  Description of Artificial Sequence: Synthetic oligonucleotide
atcctgattttgggcctgctcctttgtttttctgtg

SEQ ID NO: 202543 - DNA, 35 bp, Artificial Sequence
  Description of Artificial Sequence: Synthetic oligonucleotide
tcctgattttgggcctgctcctttgtttttctgtg

SEQ ID NO: 202544 - DNA, 34 bp, Artificial Sequence
  Description of Artificial Sequence: Synthetic oligonucleotide
cctgattttgggcctgctcctttgtttttctgtg

SEQ ID NO: 202545 - DNA, 34 bp, Artificial Sequence
  Description of Artificial Sequence: Synthetic oligonucleotide
ctgattttgggcctgctcctttgtttttctgtgc

SEQ ID NO: 202546 - DNA, 38 bp, Artificial Sequence
  Description of Artificial Sequence: Synthetic oligonucleotide
tgattttgggcctgctcctttgtttttctgtgcttttg

SEQ ID NO: 202547 - DNA, 37 bp, Artificial Sequence
  Description of Artificial Sequence: Synthetic oligonucleotide
gattttgggcctgctcctttgtttttctgtgcttttg

SEQ ID NO: 202548 - DNA, 39 bp, Artificial Sequence
  Description of Artificial Sequence: Synthetic oligonucleotide
attttgggcctgctcctttgtttttctgtgcttttgttc

SEQ ID NO: 202549 - DNA, 38 bp, Artificial Sequence
  Description of Artificial Sequence: Synthetic oligonucleotide
ttttgggcctgctcctttgtttttctgtgcttttgttc

SEQ ID NO: 202550 - DNA, 37 bp, Artificial Sequence
  Description of Artificial Sequence: Synthetic oligonucleotide
tttgggcctgctcctttgtttttctgtgcttttgttc

SEQ ID NO: 202551 - DNA, 36 bp, Artificial Sequence
  Description of Artificial Sequence: Synthetic oligonucleotide
ttgggcctgctcctttgtttttctgtgcttttgttc

SEQ ID NO: 202552 - DNA, 35 bp, Artificial Sequence
  Description of Artificial Sequence: Synthetic oligonucleotide
tgggcctgctcctttgtttttctgtgcttttgttc

SEQ ID NO: 202553 - DNA, 34 bp, Artificial Sequence
  Description of Artificial Sequence: Synthetic oligonucleotide
gggcctgctcctttgtttttctgtgcttttgttc

SEQ ID NO: 202554 - DNA, 36 bp, Artificial Sequence
  Description of Artificial Sequence: Synthetic oligonucleotide
ggcctgctcctttgtttttctgtgcttttgttctac

SEQ ID NO: 202555 - DNA, 38 bp, Artificial Sequence
  Description of Artificial Sequence: Synthetic oligonucleotide
gcctgctcctttgtttttctgtgcttttgttctacaac

SEQ ID NO: 202556 - DNA, 40 bp, Artificial Sequence
  Description of Artificial Sequence: Synthetic oligonucleotide
cctgctcctttgtttttctgtgcttttgttctacaacttc

SEQ ID NO: 202557 - DNA, 40 bp, Artificial Sequence
  Description of Artificial Sequence: Synthetic oligonucleotide
ctgctcctttgtttttctgtgcttttgttctacaacttcc

SEQ ID NO: 202558 - DNA, 41 bp, Artificial Sequence
  Description of Artificial Sequence: Synthetic oligonucleotide
tgctcctttgtttttctgtgcttttgttctacaacttccag

SEQ ID NO: 202559 - DNA, 40 bp, Artificial Sequence
  Description of Artificial Sequence: Synthetic oligonucleotide
gctcctttgtttttctgtgcttttgttctacaacttccag

SEQ ID NO: 202560 - DNA, 42 bp, Artificial Sequence
  Description of Artificial Sequence: Synthetic oligonucleotide
ctcctttgtttttctgtgcttttgttctacaacttccagaac

SEQ ID NO: 202561 - DNA, 43 bp, Artificial Sequence
  Description of Artificial Sequence: Synthetic oligonucleotide
tcctttgtttttctgtgcttttgttctacaacttccagaactg

SEQ ID NO: 202562 - DNA, 42 bp, Artificial Sequence
  Description of Artificial Sequence: Synthetic oligonucleotide
cctttgtttttctgtgcttttgttctacaacttccagaactg

SEQ ID NO: 202563 - DNA, 43 bp, Artificial Sequence
  Description of Artificial Sequence: Synthetic oligonucleotide
ctttgtttttctgtgcttttgttctacaacttccagaactgtg

SEQ ID NO: 202564 - DNA, 43 bp, Artificial Sequence
  Description of Artificial Sequence: Synthetic oligonucleotide
tttgtttttctgtgcttttgttctacaacttccagaactgtgg

SEQ ID NO: 202565 - DNA, 42 bp, Artificial Sequence
  Description of Artificial Sequence: Synthetic oligonucleotide
ttgtttttctgtgcttttgttctacaacttccagaactgtgg

SEQ ID NO: 202566 - DNA, 41 bp, Artificial Sequence
  Description of Artificial Sequence: Synthetic oligonucleotide
tgtttttctgtgcttttgttctacaacttccagaactgtgg

SEQ ID NO: 202567 - DNA, 40 bp, Artificial Sequence
  Description of Artificial Sequence: Synthetic oligonucleotide
gtttttctgtgcttttgttctacaacttccagaactgtgg

SEQ ID NO: 202568 - DNA, 40 bp, Artificial Sequence
  Description of Artificial Sequence: Synthetic oligonucleotide
tttttctgtgcttttgttctacaacttccagaactgtggc

SEQ ID NO: 202569 - DNA, 39 bp, Artificial Sequence
  Description of Artificial Sequence: Synthetic oligonucleotide
ttttctgtgcttttgttctacaacttccagaactgtggc

SEQ ID NO: 202570 - DNA, 38 bp, Artificial Sequence
  Description of Artificial Sequence: Synthetic oligonucleotide
tttctgtgcttttgttctacaacttccagaactgtggc

SEQ ID NO: 202571 - DNA, 37 bp, Artificial Sequence
  Description of Artificial Sequence: Synthetic oligonucleotide
ttctgtgcttttgttctacaacttccagaactgtggc

SEQ ID NO: 202572 - DNA, 36 bp, Artificial Sequence
  Description of Artificial Sequence: Synthetic oligonucleotide
tctgtgcttttgttctacaacttccagaactgtggc

SEQ ID NO: 202573 - DNA, 35 bp, Artificial Sequence
  Description of Artificial Sequence: Synthetic oligonucleotide
ctgtgcttttgttctacaacttccagaactgtggc

SEQ ID NO: 202574 - DNA, 35 bp, Artificial Sequence
  Description of Artificial Sequence: Synthetic oligonucleotide
tgtgcttttgttctacaacttccagaactgtggcc

SEQ ID NO: 202575 - DNA, 34 bp, Artificial Sequence
  Description of Artificial Sequence: Synthetic oligonucleotide
gtgcttttgttctacaacttccagaactgtggcc

SEQ ID NO: 202576 - DNA, 34 bp, Artificial Sequence
  Description of Artificial Sequence: Synthetic oligonucleotide
tgcttttgttctacaacttccagaactgtggccc

SEQ ID NO: 202577 - DNA, 33 bp, Artificial Sequence
  Description of Artificial Sequence: Synthetic oligonucleotide
gcttttgttctacaacttccagaactgtggccc

SEQ ID NO: 202578 - DNA, 34 bp, Artificial Sequence
  Description of Artificial Sequence: Synthetic oligonucleotide
cttttgttctacaacttccagaactgtggccctc

SEQ ID NO: 202579 - DNA, 34 bp, Artificial Sequence
  Description of Artificial Sequence: Synthetic oligonucleotide
ttttgttctacaacttccagaactgtggccctcg

SEQ ID NO: 202580 - DNA, 33 bp, Artificial Sequence
  Description of Artificial Sequence: Synthetic oligonucleotide
tttgttctacaacttccagaactgtggccctcg

SEQ ID NO: 202581 - DNA, 32 bp, Artificial Sequence
  Description of Artificial Sequence: Synthetic oligonucleotide
ttgttctacaacttccagaactgtggccctcg

SEQ ID NO: 202582 - DNA, 31 bp, Artificial Sequence
  Description of Artificial Sequence: Synthetic oligonucleotide
tgttctacaacttccagaactgtggccctcg

SEQ ID NO: 202583 - DNA, 30 bp, Artificial Sequence
  Description of Artificial Sequence: Synthetic oligonucleotide
gttctacaacttccagaactgtggccctcg

SEQ ID NO: 202584 - DNA, 30 bp, Artificial Sequence
  Description of Artificial Sequence: Synthetic oligonucleotide
ttctacaacttccagaactgtggccctcgc

SEQ ID NO: 202585 - DNA, 29 bp, Artificial Sequence
  Description of Artificial Sequence: Synthetic oligonucleotide
tctacaacttccagaactgtggccctcgc

SEQ ID NO: 202586 - DNA, 28 bp, Artificial Sequence
  Description of Artificial Sequence: Synthetic oligonucleotide
ctacaacttccagaactgtggccctcgc

SEQ ID NO: 202587 - DNA, 28 bp, Artificial Sequence
  Description of Artificial Sequence: Synthetic oligonucleotide
tacaacttccagaactgtggccctcgcc

SEQ ID NO: 202588 - DNA, 27 bp, Artificial Sequence
  Description of Artificial Sequence: Synthetic oligonucleotide
acaacttccagaactgtggccctcgcc

SEQ ID NO: 202589 - DNA, 26 bp, Artificial Sequence
  Description of Artificial Sequence: Synthetic oligonucleotide
caacttccagaactgtggccctcgcc

SEQ ID NO: 202590 - DNA, 26 bp, Artificial Sequence
  Description of Artificial Sequence: Synthetic oligonucleotide
aacttccagaactgtggccctcgccc

SEQ ID NO: 202591 - DNA, 25 bp, Artificial Sequence
  Description of Artificial Sequence: Synthetic oligonucleotide
acttccagaactgtggccctcgccc

SEQ ID NO: 202592 - DNA, 24 bp, Artificial Sequence
  Description of Artificial Sequence: Synthetic oligonucleotide
cttccagaactgtggccctcgccc

SEQ ID NO: 202593 - DNA, 25 bp, Artificial Sequence
  Description of Artificial Sequence: Synthetic oligonucleotide
ttccagaactgtggccctcgcccct

SEQ ID NO: 202594 - DNA, 24 bp, Artificial Sequence
  Description of Artificial Sequence: Synthetic oligonucleotide
tccagaactgtggccctcgcccct

SEQ ID NO: 202595 - DNA, 23 bp, Artificial Sequence
  Description of Artificial Sequence: Synthetic oligonucleotide
ccagaactgtggccctcgcccct

SEQ ID NO: 202596 - DNA, 24 bp, Artificial Sequence
  Description of Artificial Sequence: Synthetic oligonucleotide
cagaactgtggccctcgcccctgt

SEQ ID NO: 202597 - DNA, 25 bp, Artificial Sequence
  Description of Artificial Sequence: Synthetic oligonucleotide
agaactgtggccctcgcccctgtga

SEQ ID NO: 202598 - DNA, 24 bp, Artificial Sequence
  Description of Artificial Sequence: Synthetic oligonucleotide
gaactgtggccctcgcccctgtga

SEQ ID NO: 202599 - DNA, 25 bp, Artificial Sequence
  Description of Artificial Sequence: Synthetic oligonucleotide
aactgtggccctcgcccctgtgaga

SEQ ID NO: 202600 - DNA, 24 bp, Artificial Sequence
  Description of Artificial Sequence: Synthetic oligonucleotide
actgtggccctcgcccctgtgaga

SEQ ID NO: 202601 - DNA, 23 bp, Artificial Sequence
  Description of Artificial Sequence: Synthetic oligonucleotide
ctgtggccctcgcccctgtgaga

SEQ ID NO: 202602 - DNA, 25 bp, Artificial Sequence
  Description of Artificial Sequence: Synthetic oligonucleotide
tgtggccctcgcccctgtgagacat

SEQ ID NO: 202603 - DNA, 24 bp, Artificial Sequence
  Description of Artificial Sequence: Synthetic oligonucleotide
gtggccctcgcccctgtgagacat

SEQ ID NO: 202604 - DNA, 25 bp, Artificial Sequence
  Description of Artificial Sequence: Synthetic oligonucleotide
tggccctcgcccctgtgagacatct

SEQ ID NO: 202605 - DNA, 24 bp, Artificial Sequence
  Description of Artificial Sequence: Synthetic oligonucleotide
ggccctcgcccctgtgagacatct

SEQ ID NO: 202606 - DNA, 25 bp, Artificial Sequence
  Description of Artificial Sequence: Synthetic oligonucleotide
gccctcgcccctgtgagacatctgt

SEQ ID NO: 202607 - DNA, 26 bp, Artificial Sequence
  Description of Artificial Sequence: Synthetic oligonucleotide
ccctcgcccctgtgagacatctgtgt

SEQ ID NO: 202608 - DNA, 27 bp, Artificial Sequence
  Description of Artificial Sequence: Synthetic oligonucleotide
cctcgcccctgtgagacatctgtgtgt

SEQ ID NO: 202609 - DNA, 29 bp, Artificial Sequence
  Description of Artificial Sequence: Synthetic oligonucleotide
ctcgcccctgtgagacatctgtgtgtttg

SEQ ID NO: 202610 - DNA, 29 bp, Artificial Sequence
  Description of Artificial Sequence: Synthetic oligonucleotide
tcgcccctgtgagacatctgtgtgtttgg

SEQ ID NO: 202611 - DNA, 28 bp, Artificial Sequence
  Description of Artificial Sequence: Synthetic oligonucleotide
cgcccctgtgagacatctgtgtgtttgg

SEQ ID NO: 202612 - DNA, 30 bp, Artificial Sequence
  Description of Artificial Sequence: Synthetic oligonucleotide
gcccctgtgagacatctgtgtgtttggatc

SEQ ID NO: 202613 - DNA, 31 bp, Artificial Sequence
  Description of Artificial Sequence: Synthetic oligonucleotide
cccctgtgagacatctgtgtgtttggatctc

SEQ ID NO: 202614 - DNA, 31 bp, Artificial Sequence
  Description of Artificial Sequence: Synthetic oligonucleotide
ccctgtgagacatctgtgtgtttggatctcc

SEQ ID NO: 202615 - DNA, 31 bp, Artificial Sequence
  Description of Artificial Sequence: Synthetic oligonucleotide
cctgtgagacatctgtgtgtttggatctccg

SEQ ID NO: 202616 - DNA, 31 bp, Artificial Sequence
  Description of Artificial Sequence: Synthetic oligonucleotide
ctgtgagacatctgtgtgtttggatctccgg

SEQ ID NO: 202617 - DNA, 31 bp, Artificial Sequence
  Description of Artificial Sequence: Synthetic oligonucleotide
tgtgagacatctgtgtgtttggatctccggg

SEQ ID NO: 202618 - DNA, 30 bp, Artificial Sequence
  Description of Artificial Sequence: Synthetic oligonucleotide
gtgagacatctgtgtgtttggatctccggg

SEQ ID NO: 202619 - DNA, 32 bp, Artificial Sequence
  Description of Artificial Sequence: Synthetic oligonucleotide
tgagacatctgtgtgtttggatctccgggatc

SEQ ID NO: 202620 - DNA, 31 bp, Artificial Sequence
  Description of Artificial Sequence: Synthetic oligonucleotide
gagacatctgtgtgtttggatctccgggatc

SEQ ID NO: 202621 - DNA, 35 bp, Artificial Sequence
  Description of Artificial Sequence: Synthetic oligonucleotide
agacatctgtgtgtttggatctccgggatcattac

SEQ ID NO: 202622 - DNA, 34 bp, Artificial Sequence
  Description of Artificial Sequence: Synthetic oligonucleotide
gacatctgtgtgtttggatctccgggatcattac

SEQ ID NO: 202623 - DNA, 34 bp, Artificial Sequence
  Description of Artificial Sequence: Synthetic oligonucleotide
acatctgtgtgtttggatctccgggatcattacc

SEQ ID NO: 202624 - DNA, 33 bp, Artificial Sequence
  Description of Artificial Sequence: Synthetic oligonucleotide
catctgtgtgtttggatctccgggatcattacc

SEQ ID NO: 202625 - DNA, 34 bp, Artificial Sequence
  Description of Artificial Sequence: Synthetic oligonucleotide
atctgtgtgtttggatctccgggatcattacctg

SEQ ID NO: 202626 - DNA, 33 bp, Artificial Sequence
  Description of Artificial Sequence: Synthetic oligonucleotide
tctgtgtgtttggatctccgggatcattacctg

SEQ ID NO: 202627 - DNA, 32 bp, Artificial Sequence
  Description of Artificial Sequence: Synthetic oligonucleotide
ctgtgtgtttggatctccgggatcattacctg

SEQ ID NO: 202628 - DNA, 32 bp, Artificial Sequence
  Description of Artificial Sequence: Synthetic oligonucleotide
tgtgtgtttggatctccgggatcattacctgg

SEQ ID NO: 202629 - DNA, 31 bp, Artificial Sequence
  Description of Artificial Sequence: Synthetic oligonucleotide
gtgtgtttggatctccgggatcattacctgg

SEQ ID NO: 202630 - DNA, 31 bp, Artificial Sequence
  Description of Artificial Sequence: Synthetic oligonucleotide
tgtgtttggatctccgggatcattacctggc

SEQ ID NO: 202631 - DNA, 30 bp, Artificial Sequence
  Description of Artificial Sequence: Synthetic oligonucleotide
gtgtttggatctccgggatcattacctggc

SEQ ID NO: 202632 - DNA, 30 bp, Artificial Sequence
  Description of Artificial Sequence: Synthetic oligonucleotide
tgtttggatctccgggatcattacctggcc

SEQ ID NO: 202633 - DNA, 29 bp, Artificial Sequence
  Description of Artificial Sequence: Synthetic oligonucleotide
gtttggatctccgggatcattacctggcc

SEQ ID NO: 202634 - DNA, 30 bp, Artificial Sequence
  Description of Artificial Sequence: Synthetic oligonucleotide
tttggatctccgggatcattacctggcctc

SEQ ID NO: 202635 - DNA, 29 bp, Artificial Sequence
  Description of Artificial Sequence: Synthetic oligonucleotide
ttggatctccgggatcattacctggcctc

SEQ ID NO: 202636 - DNA, 28 bp, Artificial Sequence
  Description of Artificial Sequence: Synthetic oligonucleotide
tggatctccgggatcattacctggcctc

SEQ ID NO: 202637 - DNA, 27 bp, Artificial Sequence
  Description of Artificial Sequence: Synthetic oligonucleotide
ggatctccgggatcattacctggcctc

SEQ ID NO: 202638 - DNA, 28 bp, Artificial Sequence
  Description of Artificial Sequence: Synthetic oligonucleotide
gatctccgggatcattacctggcctctg

SEQ ID NO: 202639 - DNA, 28 bp, Artificial Sequence
  Description of Artificial Sequence: Synthetic oligonucleotide
atctccgggatcattacctggcctctgg

SEQ ID NO: 202640 - DNA, 27 bp, Artificial Sequence
  Description of Artificial Sequence: Synthetic oligonucleotide
tctccgggatcattacctggcctctgg

SEQ ID NO: 202641 - DNA, 26 bp, Artificial Sequence
  Description of Artificial Sequence: Synthetic oligonucleotide
ctccgggatcattacctggcctctgg

SEQ ID NO: 202642 - DNA, 27 bp, Artificial Sequence
  Description of Artificial Sequence: Synthetic oligonucleotide
tccgggatcattacctggcctctggga

SEQ ID NO: 202643 - DNA, 27 bp, Artificial Sequence
  Description of Artificial Sequence: Synthetic oligonucleotide
ccgggatcattacctggcctctgggaa

SEQ ID NO: 202644 - DNA, 27 bp, Artificial Sequence
  Description of Artificial Sequence: Synthetic oligonucleotide
cgggatcattacctggcctctgggaac

SEQ ID NO: 202645 - DNA, 28 bp, Artificial Sequence
  Description of Artificial Sequence: Synthetic oligonucleotide
gggatcattacctggcctctgggaacac

SEQ ID NO: 202646 - DNA, 30 bp, Artificial Sequence
  Description of Artificial Sequence: Synthetic oligonucleotide
ggatcattacctggcctctgggaacacaag

SEQ ID NO: 202647 - DNA, 31 bp, Artificial Sequence
  Description of Artificial Sequence: Synthetic oligonucleotide
gatcattacctggcctctgggaacacaagtg

SEQ ID NO: 202648 - DNA, 32 bp, Artificial Sequence
  Description of Artificial Sequence: Synthetic oligonucleotide
atcattacctggcctctgggaacacaagtgtg

SEQ ID NO: 202649 - DNA, 31 bp, Artificial Sequence
  Description of Artificial Sequence: Synthetic oligonucleotide
tcattacctggcctctgggaacacaagtgtg

SEQ ID NO: 202650 - DNA, 30 bp, Artificial Sequence
  Description of Artificial Sequence: Synthetic oligonucleotide
cattacctggcctctgggaacacaagtgtg

SEQ ID NO: 202651 - DNA, 30 bp, Artificial Sequence
  Description of Artificial Sequence: Synthetic oligonucleotide
attacctggcctctgggaacacaagtgtgg

SEQ ID NO: 202652 - DNA, 29 bp, Artificial Sequence
  Description of Artificial Sequence: Synthetic oligonucleotide
ttacctggcctctgggaacacaagtgtgg

SEQ ID NO: 202653 - DNA, 28 bp, Artificial Sequence
  Description of Artificial Sequence: Synthetic oligonucleotide
tacctggcctctgggaacacaagtgtgg

SEQ ID NO: 202654 - DNA, 27 bp, Artificial Sequence
  Description of Artificial Sequence: Synthetic oligonucleotide
acctggcctctgggaacacaagtgtgg

SEQ ID NO: 202655 - DNA, 26 bp, Artificial Sequence
  Description of Artificial Sequence: Synthetic oligonucleotide
cctggcctctgggaacacaagtgtgg

SEQ ID NO: 202656 - DNA, 26 bp, Artificial Sequence
  Description of Artificial Sequence: Synthetic oligonucleotide
ctggcctctgggaacacaagtgtggc

SEQ ID NO: 202657 - DNA, 26 bp, Artificial Sequence
  Description of Artificial Sequence: Synthetic oligonucleotide
tggcctctgggaacacaagtgtggcc

SEQ ID NO: 202658 - DNA, 25 bp, Artificial Sequence
  Description of Artificial Sequence: Synthetic oligonucleotide
ggcctctgggaacacaagtgtggcc

SEQ ID NO: 202659 - DNA, 25 bp, Artificial Sequence
  Description of Artificial Sequence: Synthetic oligonucleotide
gcctctgggaacacaagtgtggccc

SEQ ID NO: 202660 - DNA, 25 bp, Artificial Sequence
  Description of Artificial Sequence: Synthetic oligonucleotide
cctctgggaacacaagtgtggcccc

SEQ ID NO: 202661 - DNA, 26 bp, Artificial Sequence
  Description of Artificial Sequence: Synthetic oligonucleotide
ctctgggaacacaagtgtggccccct

SEQ ID NO: 202662 - DNA, 26 bp, Artificial Sequence
  Description of Artificial Sequence: Synthetic oligonucleotide
tctgggaacacaagtgtggccccctg

SEQ ID NO: 202663 - DNA, 25 bp, Artificial Sequence
  Description of Artificial Sequence: Synthetic oligonucleotide
ctgggaacacaagtgtggccccctg

SEQ ID NO: 202664 - DNA, 26 bp, Artificial Sequence
  Description of Artificial Sequence: Synthetic oligonucleotide
tgggaacacaagtgtggccccctgca

SEQ ID NO: 202665 - DNA, 25 bp, Artificial Sequence
  Description of Artificial Sequence: Synthetic oligonucleotide
gggaacacaagtgtggccccctgca

SEQ ID NO: 202666 - DNA, 25 bp, Artificial Sequence
  Description of Artificial Sequence: Synthetic oligonucleotide
ggaacacaagtgtggccccctgcac

SEQ ID NO: 202667 - DNA, 25 bp, Artificial Sequence
  Description of Artificial Sequence: Synthetic oligonucleotide
gaacacaagtgtggccccctgcacc

SEQ ID NO: 202668 - DNA, 26 bp, Artificial Sequence
  Description of Artificial Sequence: Synthetic oligonucleotide
aacacaagtgtggccccctgcaccga

SEQ ID NO: 202669 - DNA, 25 bp, Artificial Sequence
  Description of Artificial Sequence: Synthetic oligonucleotide
acacaagtgtggccccctgcaccga

SEQ ID NO: 202670 - DNA, 24 bp, Artificial Sequence
  Description of Artificial Sequence: Synthetic oligonucleotide
cacaagtgtggccccctgcaccga

SEQ ID NO: 202671 - DNA, 26 bp, Artificial Sequence
  Description of Artificial Sequence: Synthetic oligonucleotide
acaagtgtggccccctgcaccgactt

SEQ ID NO: 202672 - DNA, 25 bp, Artificial Sequence
  Description of Artificial Sequence: Synthetic oligonucleotide
caagtgtggccccctgcaccgactt

SEQ ID NO: 202673 - DNA, 27 bp, Artificial Sequence
  Description of Artificial Sequence: Synthetic oligonucleotide
aagtgtggccccctgcaccgacttctt

SEQ ID NO: 202674 - DNA, 26 bp, Artificial Sequence
  Description of Artificial Sequence: Synthetic oligonucleotide
agtgtggccccctgcaccgacttctt

SEQ ID NO: 202675 - DNA, 25 bp, Artificial Sequence
  Description of Artificial Sequence: Synthetic oligonucleotide
gtgtggccccctgcaccgacttctt

SEQ ID NO: 202676 - DNA, 26 bp, Artificial Sequence
  Description of Artificial Sequence: Synthetic oligonucleotide
tgtggccccctgcaccgacttcttca

SEQ ID NO: 202677 - DNA, 25 bp, Artificial Sequence
  Description of Artificial Sequence: Synthetic oligonucleotide
gtggccccctgcaccgacttcttca

SEQ ID NO: 202678 - DNA, 25 bp, Artificial Sequence
  Description of Artificial Sequence: Synthetic oligonucleotide
tggccccctgcaccgacttcttcag

SEQ ID NO: 202679 - DNA, 24 bp, Artificial Sequence
  Description of Artificial Sequence: Synthetic oligonucleotide
ggccccctgcaccgacttcttcag

SEQ ID NO: 202680 - DNA, 27 bp, Artificial Sequence
  Description of Artificial Sequence: Synthetic oligonucleotide
gccccctgcaccgacttcttcagcttt

SEQ ID NO: 202681 - DNA, 27 bp, Artificial Sequence
  Description of Artificial Sequence: Synthetic oligonucleotide
ccccctgcaccgacttcttcagctttg

SEQ ID NO: 202682 - DNA, 27 bp, Artificial Sequence
  Description of Artificial Sequence: Synthetic oligonucleotide
cccctgcaccgacttcttcagctttgc

SEQ ID NO: 202683 - DNA, 27 bp, Artificial Sequence
  Description of Artificial Sequence: Synthetic oligonucleotide
ccctgcaccgacttcttcagctttgcc

SEQ ID NO: 202684 - DNA, 28 bp, Artificial Sequence
  Description of Artificial Sequence: Synthetic oligonucleotide
cctgcaccgacttcttcagctttgcctg

SEQ ID NO: 202685 - DNA, 29 bp, Artificial Sequence
  Description of Artificial Sequence: Synthetic oligonucleotide
ctgcaccgacttcttcagctttgcctgtg

SEQ ID NO: 202686 - DNA, 29 bp, Artificial Sequence
  Description of Artificial Sequence: Synthetic oligonucleotide
tgcaccgacttcttcagctttgcctgtgg

SEQ ID NO: 202687 - DNA, 28 bp, Artificial Sequence
  Description of Artificial Sequence: Synthetic oligonucleotide
gcaccgacttcttcagctttgcctgtgg

SEQ ID NO: 202688 - DNA, 30 bp, Artificial Sequence
  Description of Artificial Sequence: Synthetic oligonucleotide
caccgacttcttcagctttgcctgtggaag

SEQ ID NO: 202689 - DNA, 30 bp, Artificial Sequence
  Description of Artificial Sequence: Synthetic oligonucleotide
accgacttcttcagctttgcctgtggaagg

SEQ ID NO: 202690 - DNA, 29 bp, Artificial Sequence
  Description of Artificial Sequence: Synthetic oligonucleotide
ccgacttcttcagctttgcctgtggaagg

SEQ ID NO: 202691 - DNA, 29 bp, Artificial Sequence
  Description of Artificial Sequence: Synthetic oligonucleotide
cgacttcttcagctttgcctgtggaaggg

SEQ ID NO: 202692 - DNA, 29 bp, Artificial Sequence
  Description of Artificial Sequence: Synthetic oligonucleotide
gacttcttcagctttgcctgtggaagggc

SEQ ID NO: 202693 - DNA, 29 bp, Artificial Sequence
  Description of Artificial Sequence: Synthetic oligonucleotide
acttcttcagctttgcctgtggaagggcc

SEQ ID NO: 202694 - DNA, 28 bp, Artificial Sequence
  Description of Artificial Sequence: Synthetic oligonucleotide
cttcttcagctttgcctgtggaagggcc

SEQ ID NO: 202695 - DNA, 31 bp, Artificial Sequence
  Description of Artificial Sequence: Synthetic oligonucleotide
ttcttcagctttgcctgtggaagggccaaag

SEQ ID NO: 202696 - DNA, 30 bp, Artificial Sequence
  Description of Artificial Sequence: Synthetic oligonucleotide
tcttcagctttgcctgtggaagggccaaag

SEQ ID NO: 202697 - DNA, 29 bp, Artificial Sequence
  Description of Artificial Sequence: Synthetic oligonucleotide
cttcagctttgcctgtggaagggccaaag

SEQ ID NO: 202698 - DNA, 30 bp, Artificial Sequence
  Description of Artificial Sequence: Synthetic oligonucleotide
ttcagctttgcctgtggaagggccaaagag

SEQ ID NO: 202699 - DNA, 29 bp, Artificial Sequence
  Description of Artificial Sequence: Synthetic oligonucleotide
tcagctttgcctgtggaagggccaaagag

SEQ ID NO: 202700 - DNA, 28 bp, Artificial Sequence
  Description of Artificial Sequence: Synthetic oligonucleotide
cagctttgcctgtggaagggccaaagag

SEQ ID NO: 202701 - DNA, 29 bp, Artificial Sequence
  Description of Artificial Sequence: Synthetic oligonucleotide
agctttgcctgtggaagggccaaagagac

SEQ ID NO: 202702 - DNA, 28 bp, Artificial Sequence
  Description of Artificial Sequence: Synthetic oligonucleotide
gctttgcctgtggaagggccaaagagac

SEQ ID NO: 202703 - DNA, 28 bp, Artificial Sequence
  Description of Artificial Sequence: Synthetic oligonucleotide
ctttgcctgtggaagggccaaagagacc

SEQ ID NO: 202704 - DNA, 35 bp, Artificial Sequence
  Description of Artificial Sequence: Synthetic oligonucleotide
tttgcctgtggaagggccaaagagaccaataattc

SEQ ID NO: 202705 - DNA, 34 bp, Artificial Sequence
  Description of Artificial Sequence: Synthetic oligonucleotide
ttgcctgtggaagggccaaagagaccaataattc

SEQ ID NO: 202706 - DNA, 33 bp, Artificial Sequence
  Description of Artificial Sequence: Synthetic oligonucleotide
tgcctgtggaagggccaaagagaccaataattc

SEQ ID NO: 202707 - DNA, 32 bp, Artificial Sequence
  Description of Artificial Sequence: Synthetic oligonucleotide
gcctgtggaagggccaaagagaccaataattc

SEQ ID NO: 202708 - DNA, 36 bp, Artificial Sequence
  Description of Artificial Sequence: Synthetic oligonucleotide
cctgtggaagggccaaagagaccaataattcttttc

SEQ ID NO: 202709 - DNA, 37 bp, Artificial Sequence
  Description of Artificial Sequence: Synthetic oligonucleotide
ctgtggaagggccaaagagaccaataattcttttcag

SEQ ID NO: 202710 - DNA, 37 bp, Artificial Sequence
  Description of Artificial Sequence: Synthetic oligonucleotide
tgtggaagggccaaagagaccaataattcttttcagg

SEQ ID NO: 202711 - DNA, 36 bp, Artificial Sequence
  Description of Artificial Sequence: Synthetic oligonucleotide
gtggaagggccaaagagaccaataattcttttcagg

SEQ ID NO: 202712 - DNA, 37 bp, Artificial Sequence
  Description of Artificial Sequence: Synthetic oligonucleotide
tggaagggccaaagagaccaataattcttttcaggag

SEQ ID NO: 202713 - DNA, 36 bp, Artificial Sequence
  Description of Artificial Sequence: Synthetic oligonucleotide
ggaagggccaaagagaccaataattcttttcaggag

SEQ ID NO: 202714 - DNA, 36 bp, Artificial Sequence
  Description of Artificial Sequence: Synthetic oligonucleotide
gaagggccaaagagaccaataattcttttcaggagc

SEQ ID NO: 202715 - DNA, 38 bp, Artificial Sequence
  Description of Artificial Sequence: Synthetic oligonucleotide
aagggccaaagagaccaataattcttttcaggagcttg

SEQ ID NO: 202716 - DNA, 37 bp, Artificial Sequence
  Description of Artificial Sequence: Synthetic oligonucleotide
agggccaaagagaccaataattcttttcaggagcttg

SEQ ID NO: 202717 - DNA, 36 bp, Artificial Sequence
  Description of Artificial Sequence: Synthetic oligonucleotide
gggccaaagagaccaataattcttttcaggagcttg

SEQ ID NO: 202718 - DNA, 36 bp, Artificial Sequence
  Description of Artificial Sequence: Synthetic oligonucleotide
ggccaaagagaccaataattcttttcaggagcttgc

SEQ ID NO: 202719 - DNA, 36 bp, Artificial Sequence
  Description of Artificial Sequence: Synthetic oligonucleotide
gccaaagagaccaataattcttttcaggagcttgcc

SEQ ID NO: 202720 - DNA, 37 bp, Artificial Sequence
  Description of Artificial Sequence: Synthetic oligonucleotide
ccaaagagaccaataattcttttcaggagcttgccac

SEQ ID NO: 202721 - DNA, 40 bp, Artificial Sequence
  Description of Artificial Sequence: Synthetic oligonucleotide
caaagagaccaataattcttttcaggagcttgccacaaag

SEQ ID NO: 202722 - DNA, 42 bp, Artificial Sequence
  Description of Artificial Sequence: Synthetic oligonucleotide
aaagagaccaataattcttttcaggagcttgccacaaagaac

SEQ ID NO: 202723 - DNA, 41 bp, Artificial Sequence
  Description of Artificial Sequence: Synthetic oligonucleotide
aagagaccaataattcttttcaggagcttgccacaaagaac

SEQ ID NO: 202724 - DNA, 40 bp, Artificial Sequence
  Description of Artificial Sequence: Synthetic oligonucleotide
agagaccaataattcttttcaggagcttgccacaaagaac

SEQ ID NO: 202725 - DNA, 39 bp, Artificial Sequence
  Description of Artificial Sequence: Synthetic oligonucleotide
gagaccaataattcttttcaggagcttgccacaaagaac

SEQ ID NO: 202726 - DNA, 44 bp, Artificial Sequence
  Description of Artificial Sequence: Synthetic oligonucleotide
agaccaataattcttttcaggagcttgccacaaagaacaaaaac

SEQ ID NO: 202727 - DNA, 43 bp, Artificial Sequence
  Description of Artificial Sequence: Synthetic oligonucleotide
gaccaataattcttttcaggagcttgccacaaagaacaaaaac

SEQ ID NO: 202728 - DNA, 43 bp, Artificial Sequence
  Description of Artificial Sequence: Synthetic oligonucleotide
accaataattcttttcaggagcttgccacaaagaacaaaaacc

SEQ ID NO: 202729 - DNA, 42 bp, Artificial Sequence
  Description of Artificial Sequence: Synthetic oligonucleotide
ccaataattcttttcaggagcttgccacaaagaacaaaaacc

SEQ ID NO: 202730 - DNA, 42 bp, Artificial Sequence
  Description of Artificial Sequence: Synthetic oligonucleotide
caataattcttttcaggagcttgccacaaagaacaaaaaccg

SEQ ID NO: 202731 - DNA, 43 bp, Artificial Sequence
  Description of Artificial Sequence: Synthetic oligonucleotide
aataattcttttcaggagcttgccacaaagaacaaaaaccgac

SEQ ID NO: 202732 - DNA, 42 bp, Artificial Sequence
  Description of Artificial Sequence: Synthetic oligonucleotide
ataattcttttcaggagcttgccacaaagaacaaaaaccgac

SEQ ID NO: 202733 - DNA, 41 bp, Artificial Sequence
  Description of Artificial Sequence: Synthetic oligonucleotide
taattcttttcaggagcttgccacaaagaacaaaaaccgac

SEQ ID NO: 202734 - DNA, 40 bp, Artificial Sequence
  Description of Artificial Sequence: Synthetic oligonucleotide
aattcttttcaggagcttgccacaaagaacaaaaaccgac

SEQ ID NO: 202735 - DNA, 39 bp, Artificial Sequence
  Description of Artificial Sequence: Synthetic oligonucleotide
attcttttcaggagcttgccacaaagaacaaaaaccgac

SEQ ID NO: 202736 - DNA, 38 bp, Artificial Sequence
  Description of Artificial Sequence: Synthetic oligonucleotide
ttcttttcaggagcttgccacaaagaacaaaaaccgac

SEQ ID NO: 202737 - DNA, 37 bp, Artificial Sequence
  Description of Artificial Sequence: Synthetic oligonucleotide
tcttttcaggagcttgccacaaagaacaaaaaccgac

SEQ ID NO: 202738 - DNA, 36 bp, Artificial Sequence
  Description of Artificial Sequence: Synthetic oligonucleotide
cttttcaggagcttgccacaaagaacaaaaaccgac

SEQ ID NO: 202739 - DNA, 38 bp, Artificial Sequence
  Description of Artificial Sequence: Synthetic oligonucleotide
ttttcaggagcttgccacaaagaacaaaaaccgacttc

SEQ ID NO: 202740 - DNA, 37 bp, Artificial Sequence
  Description of Artificial Sequence: Synthetic oligonucleotide
tttcaggagcttgccacaaagaacaaaaaccgacttc

SEQ ID NO: 202741 - DNA, 36 bp, Artificial Sequence
  Description of Artificial Sequence: Synthetic oligonucleotide
ttcaggagcttgccacaaagaacaaaaaccgacttc

SEQ ID NO: 202742 - DNA, 35 bp, Artificial Sequence
  Description of Artificial Sequence: Synthetic oligonucleotide
tcaggagcttgccacaaagaacaaaaaccgacttc

SEQ ID NO: 202743 - DNA, 34 bp, Artificial Sequence
  Description of Artificial Sequence: Synthetic oligonucleotide
caggagcttgccacaaagaacaaaaaccgacttc

SEQ ID NO: 202744 - DNA, 34 bp, Artificial Sequence
  Description of Artificial Sequence: Synthetic oligonucleotide
aggagcttgccacaaagaacaaaaaccgacttcg

SEQ ID NO: 202745 - DNA, 33 bp, Artificial Sequence
  Description of Artificial Sequence: Synthetic oligonucleotide
ggagcttgccacaaagaacaaaaaccgacttcg

SEQ ID NO: 202746 - DNA, 33 bp, Artificial Sequence
  Description of Artificial Sequence: Synthetic oligonucleotide
gagcttgccacaaagaacaaaaaccgacttcgg

SEQ ID NO: 202747 - DNA, 34 bp, Artificial Sequence
  Description of Artificial Sequence: Synthetic oligonucleotide
agcttgccacaaagaacaaaaaccgacttcggag

SEQ ID NO: 202748 - DNA, 33 bp, Artificial Sequence
  Description of Artificial Sequence: Synthetic oligonucleotide
gcttgccacaaagaacaaaaaccgacttcggag

SEQ ID NO: 202749 - DNA, 37 bp, Artificial Sequence
  Description of Artificial Sequence: Synthetic oligonucleotide
cttgccacaaagaacaaaaaccgacttcggagaatac

SEQ ID NO: 202750 - DNA, 38 bp, Artificial Sequence
  Description of Artificial Sequence: Synthetic oligonucleotide
ttgccacaaagaacaaaaaccgacttcggagaatactg

SEQ ID NO: 202751 - DNA, 37 bp, Artificial Sequence
  Description of Artificial Sequence: Synthetic oligonucleotide
tgccacaaagaacaaaaaccgacttcggagaatactg

SEQ ID NO: 202752 - DNA, 36 bp, Artificial Sequence
  Description of Artificial Sequence: Synthetic oligonucleotide
gccacaaagaacaaaaaccgacttcggagaatactg

SEQ ID NO: 202753 - DNA, 36 bp, Artificial Sequence
  Description of Artificial Sequence: Synthetic oligonucleotide
ccacaaagaacaaaaaccgacttcggagaatactgg

SEQ ID NO: 202754 - DNA, 37 bp, Artificial Sequence
  Description of Artificial Sequence: Synthetic oligonucleotide
cacaaagaacaaaaaccgacttcggagaatactggag

SEQ ID NO: 202755 - DNA, 37 bp, Artificial Sequence
  Description of Artificial Sequence: Synthetic oligonucleotide
acaaagaacaaaaaccgacttcggagaatactggagg

SEQ ID NO: 202756 - DNA, 36 bp, Artificial Sequence
  Description of Artificial Sequence: Synthetic oligonucleotide
caaagaacaaaaaccgacttcggagaatactggagg

SEQ ID NO: 202757 - DNA, 37 bp, Artificial Sequence
  Description of Artificial Sequence: Synthetic oligonucleotide
aaagaacaaaaaccgacttcggagaatactggaggtc

SEQ ID NO: 202758 - DNA, 36 bp, Artificial Sequence
  Description of Artificial Sequence: Synthetic oligonucleotide
aagaacaaaaaccgacttcggagaatactggaggtc

SEQ ID NO: 202759 - DNA, 35 bp, Artificial Sequence
  Description of Artificial Sequence: Synthetic oligonucleotide
agaacaaaaaccgacttcggagaatactggaggtc

SEQ ID NO: 202760 - DNA, 34 bp, Artificial Sequence
  Description of Artificial Sequence: Synthetic oligonucleotide
gaacaaaaaccgacttcggagaatactggaggtc

SEQ ID NO: 202761 - DNA, 34 bp, Artificial Sequence
  Description of Artificial Sequence: Synthetic oligonucleotide
aacaaaaaccgacttcggagaatactggaggtcc

SEQ ID NO: 202762 - DNA, 33 bp, Artificial Sequence
  Description of Artificial Sequence: Synthetic oligonucleotide
acaaaaaccgacttcggagaatactggaggtcc

SEQ ID NO: 202763 - DNA, 32 bp, Artificial Sequence
  Description of Artificial Sequence: Synthetic oligonucleotide
caaaaaccgacttcggagaatactggaggtcc

SEQ ID NO: 202764 - DNA, 33 bp, Artificial Sequence
  Description of Artificial Sequence: Synthetic oligonucleotide
aaaaaccgacttcggagaatactggaggtccag

SEQ ID NO: 202765 - DNA, 32 bp, Artificial Sequence
  Description of Artificial Sequence: Synthetic oligonucleotide
aaaaccgacttcggagaatactggaggtccag

SEQ ID NO: 202766 - DNA, 31 bp, Artificial Sequence
  Description of Artificial Sequence: Synthetic oligonucleotide
aaaccgacttcggagaatactggaggtccag

SEQ ID NO: 202767 - DNA, 30 bp, Artificial Sequence
  Description of Artificial Sequence: Synthetic oligonucleotide
aaccgacttcggagaatactggaggtccag

SEQ ID NO: 202768 - DNA, 29 bp, Artificial Sequence
  Description of Artificial Sequence: Synthetic oligonucleotide
accgacttcggagaatactggaggtccag

SEQ ID NO: 202769 - DNA, 28 bp, Artificial Sequence
  Description of Artificial Sequence: Synthetic oligonucleotide
ccgacttcggagaatactggaggtccag

SEQ ID NO: 202770 - DNA, 32 bp, Artificial Sequence
  Description of Artificial Sequence: Synthetic oligonucleotide
cgacttcggagaatactggaggtccagaattc

SEQ ID NO: 202771 - DNA, 32 bp, Artificial Sequence
  Description of Artificial Sequence: Synthetic oligonucleotide
gacttcggagaatactggaggtccagaattcc

SEQ ID NO: 202772 - DNA, 33 bp, Artificial Sequence
  Description of Artificial Sequence: Synthetic oligonucleotide
acttcggagaatactggaggtccagaattcctg

SEQ ID NO: 202773 - DNA, 32 bp, Artificial Sequence
  Description of Artificial Sequence: Synthetic oligonucleotide
cttcggagaatactggaggtccagaattcctg

SEQ ID NO: 202774 - DNA, 32 bp, Artificial Sequence
  Description of Artificial Sequence: Synthetic oligonucleotide
ttcggagaatactggaggtccagaattcctgg

SEQ ID NO: 202775 - DNA, 31 bp, Artificial Sequence
  Description of Artificial Sequence: Synthetic oligonucleotide
tcggagaatactggaggtccagaattcctgg

SEQ ID NO: 202776 - DNA, 30 bp, Artificial Sequence
  Description of Artificial Sequence: Synthetic oligonucleotide
cggagaatactggaggtccagaattcctgg

SEQ ID NO: 202777 - DNA, 30 bp, Artificial Sequence
  Description of Artificial Sequence: Synthetic oligonucleotide
ggagaatactggaggtccagaattcctggc

SEQ ID NO: 202778 - DNA, 31 bp, Artificial Sequence
  Description of Artificial Sequence: Synthetic oligonucleotide
gagaatactggaggtccagaattcctggcac

SEQ ID NO: 202779 - DNA, 31 bp, Artificial Sequence
  Description of Artificial Sequence: Synthetic oligonucleotide
agaatactggaggtccagaattcctggcacc

SEQ ID NO: 202780 - DNA, 30 bp, Artificial Sequence
  Description of Artificial Sequence: Synthetic oligonucleotide
gaatactggaggtccagaattcctggcacc

SEQ ID NO: 202781 - DNA, 30 bp, Artificial Sequence
  Description of Artificial Sequence: Synthetic oligonucleotide
aatactggaggtccagaattcctggcaccc

SEQ ID NO: 202782 - DNA, 29 bp, Artificial Sequence
  Description of Artificial Sequence: Synthetic oligonucleotide
atactggaggtccagaattcctggcaccc

SEQ ID NO: 202783 - DNA, 28 bp, Artificial Sequence
  Description of Artificial Sequence: Synthetic oligonucleotide
tactggaggtccagaattcctggcaccc

SEQ ID NO: 202784 - DNA, 27 bp, Artificial Sequence
  Description of Artificial Sequence: Synthetic oligonucleotide
actggaggtccagaattcctggcaccc

SEQ ID NO: 202785 - DNA, 27 bp, Artificial Sequence
  Description of Artificial Sequence: Synthetic oligonucleotide
ctggaggtccagaattcctggcaccca

SEQ ID NO: 202786 - DNA, 27 bp, Artificial Sequence
  Description of Artificial Sequence: Synthetic oligonucleotide
tggaggtccagaattcctggcacccag

SEQ ID NO: 202787 - DNA, 26 bp, Artificial Sequence
  Description of Artificial Sequence: Synthetic oligonucleotide
ggaggtccagaattcctggcacccag

SEQ ID NO: 202788 - DNA, 26 bp, Artificial Sequence
  Description of Artificial Sequence: Synthetic oligonucleotide
gaggtccagaattcctggcacccagg

SEQ ID NO: 202789 - DNA, 27 bp, Artificial Sequence
  Description of Artificial Sequence: Synthetic oligonucleotide
aggtccagaattcctggcacccaggct

SEQ ID NO: 202790 - DNA, 26 bp, Artificial Sequence
  Description of Artificial Sequence: Synthetic oligonucleotide
ggtccagaattcctggcacccaggct

SEQ ID NO: 202791 - DNA, 27 bp, Artificial Sequence
  Description of Artificial Sequence: Synthetic oligonucleotide
gtccagaattcctggcacccaggctct

SEQ ID NO: 202792 - DNA, 27 bp, Artificial Sequence
  Description of Artificial Sequence: Synthetic oligonucleotide
tccagaattcctggcacccaggctctg

SEQ ID NO: 202793 - DNA, 26 bp, Artificial Sequence
  Description of Artificial Sequence: Synthetic oligonucleotide
ccagaattcctggcacccaggctctg

SEQ ID NO: 202794 - DNA, 26 bp, Artificial Sequence
  Description of Artificial Sequence: Synthetic oligonucleotide
cagaattcctggcacccaggctctgg

SEQ ID NO: 202795 - DNA, 26 bp, Artificial Sequence
  Description of Artificial Sequence: Synthetic oligonucleotide
agaattcctggcacccaggctctggg

SEQ ID NO: 202796 - DNA, 25 bp, Artificial Sequence
  Description of Artificial Sequence: Synthetic oligonucleotide
gaattcctggcacccaggctctggg

SEQ ID NO: 202797 - DNA, 26 bp, Artificial Sequence
  Description of Artificial Sequence: Synthetic oligonucleotide
aattcctggcacccaggctctgggga

SEQ ID NO: 202798 - DNA, 25 bp, Artificial Sequence
  Description of Artificial Sequence: Synthetic oligonucleotide
attcctggcacccaggctctgggga

SEQ ID NO: 202799 - DNA, 24 bp, Artificial Sequence
  Description of Artificial Sequence: Synthetic oligonucleotide
ttcctggcacccaggctctgggga

SEQ ID NO: 202800 - DNA, 23 bp, Artificial Sequence
  Description of Artificial Sequence: Synthetic oligonucleotide
tcctggcacccaggctctgggga

SEQ ID NO: 202801 - DNA, 22 bp, Artificial Sequence
  Description of Artificial Sequence: Synthetic oligonucleotide
cctggcacccaggctctgggga

SEQ ID NO: 202802 - DNA, 22 bp, Artificial Sequence
  Description of Artificial Sequence: Synthetic oligonucleotide
ctggcacccaggctctggggag

SEQ ID NO: 202803 - DNA, 23 bp, Artificial Sequence
  Description of Artificial Sequence: Synthetic oligonucleotide
tggcacccaggctctggggagga

SEQ ID NO: 202804 - DNA, 22 bp, Artificial Sequence
  Description of Artificial Sequence: Synthetic oligonucleotide
ggcacccaggctctggggagga

SEQ ID NO: 202805 - DNA, 25 bp, Artificial Sequence
  Description of Artificial Sequence: Synthetic oligonucleotide
gcacccaggctctggggaggagaaa

SEQ ID NO: 202806 - DNA, 25 bp, Artificial Sequence
  Description of Artificial Sequence: Synthetic oligonucleotide
cacccaggctctggggaggagaaag

SEQ ID NO: 202807 - DNA, 25 bp, Artificial Sequence
  Description of Artificial Sequence: Synthetic oligonucleotide
acccaggctctggggaggagaaagc

SEQ ID NO: 202808 - DNA, 24 bp, Artificial Sequence
  Description of Artificial Sequence: Synthetic oligonucleotide
cccaggctctggggaggagaaagc

SEQ ID NO: 202809 - DNA, 26 bp, Artificial Sequence
  Description of Artificial Sequence: Synthetic oligonucleotide
ccaggctctggggaggagaaagcctt

SEQ ID NO: 202810 - DNA, 26 bp, Artificial Sequence
  Description of Artificial Sequence: Synthetic oligonucleotide
caggctctggggaggagaaagccttc

SEQ ID NO: 202811 - DNA, 27 bp, Artificial Sequence
  Description of Artificial Sequence: Synthetic oligonucleotide
aggctctggggaggagaaagccttcca

SEQ ID NO: 202812 - DNA, 26 bp, Artificial Sequence
  Description of Artificial Sequence: Synthetic oligonucleotide
ggctctggggaggagaaagccttcca

SEQ ID NO: 202813 - DNA, 27 bp, Artificial Sequence
  Description of Artificial Sequence: Synthetic oligonucleotide
gctctggggaggagaaagccttccagt

SEQ ID NO: 202814 - DNA, 28 bp, Artificial Sequence
  Description of Artificial Sequence: Synthetic oligonucleotide
ctctggggaggagaaagccttccagttc

SEQ ID NO: 202815 - DNA, 30 bp, Artificial Sequence
  Description of Artificial Sequence: Synthetic oligonucleotide
tctggggaggagaaagccttccagttctac

SEQ ID NO: 202816 - DNA, 29 bp, Artificial Sequence
  Description of Artificial Sequence: Synthetic oligonucleotide
ctggggaggagaaagccttccagttctac

SEQ ID NO: 202817 - DNA, 31 bp, Artificial Sequence
  Description of Artificial Sequence: Synthetic oligonucleotide
tggggaggagaaagccttccagttctacaac

SEQ ID NO: 202818 - DNA, 30 bp, Artificial Sequence
  Description of Artificial Sequence: Synthetic oligonucleotide
ggggaggagaaagccttccagttctacaac

SEQ ID NO: 202819 - DNA, 31 bp, Artificial Sequence
  Description of Artificial Sequence: Synthetic oligonucleotide
gggaggagaaagccttccagttctacaactc

SEQ ID NO: 202820 - DNA, 31 bp, Artificial Sequence
  Description of Artificial Sequence: Synthetic oligonucleotide
ggaggagaaagccttccagttctacaactcc

SEQ ID NO: 202821 - DNA, 32 bp, Artificial Sequence
  Description of Artificial Sequence: Synthetic oligonucleotide
gaggagaaagccttccagttctacaactcctg

SEQ ID NO: 202822 - DNA, 32 bp, Artificial Sequence
  Description of Artificial Sequence: Synthetic oligonucleotide
aggagaaagccttccagttctacaactcctgc

SEQ ID NO: 202823 - DNA, 31 bp, Artificial Sequence
  Description of Artificial Sequence: Synthetic oligonucleotide
ggagaaagccttccagttctacaactcctgc

SEQ ID NO: 202824 - DNA, 33 bp, Artificial Sequence
  Description of Artificial Sequence: Synthetic oligonucleotide
gagaaagccttccagttctacaactcctgcatg

SEQ ID NO: 202825 - DNA, 33 bp, Artificial Sequence
  Description of Artificial Sequence: Synthetic oligonucleotide
agaaagccttccagttctacaactcctgcatgg

SEQ ID NO: 202826 - DNA, 32 bp, Artificial Sequence
  Description of Artificial Sequence: Synthetic oligonucleotide
gaaagccttccagttctacaactcctgcatgg

SEQ ID NO: 202827 - DNA, 35 bp, Artificial Sequence
  Description of Artificial Sequence: Synthetic oligonucleotide
aaagccttccagttctacaactcctgcatggatac

SEQ ID NO: 202828 - DNA, 34 bp, Artificial Sequence
  Description of Artificial Sequence: Synthetic oligonucleotide
aagccttccagttctacaactcctgcatggatac

SEQ ID NO: 202829 - DNA, 33 bp, Artificial Sequence
  Description of Artificial Sequence: Synthetic oligonucleotide
agccttccagttctacaactcctgcatggatac

SEQ ID NO: 202830 - DNA, 32 bp, Artificial Sequence
  Description of Artificial Sequence: Synthetic oligonucleotide
gccttccagttctacaactcctgcatggatac

SEQ ID NO: 202831 - DNA, 33 bp, Artificial Sequence
  Description of Artificial Sequence: Synthetic oligonucleotide
ccttccagttctacaactcctgcatggatacac

SEQ ID NO: 202832 - DNA, 35 bp, Artificial Sequence
  Description of Artificial Sequence: Synthetic oligonucleotide
cttccagttctacaactcctgcatggatacacttg

SEQ ID NO: 202833 - DNA, 35 bp, Artificial Sequence
  Description of Artificial Sequence: Synthetic oligonucleotide
ttccagttctacaactcctgcatggatacacttgc

SEQ ID NO: 202834 - DNA, 34 bp, Artificial Sequence
  Description of Artificial Sequence: Synthetic oligonucleotide
tccagttctacaactcctgcatggatacacttgc

SEQ ID NO: 202835 - DNA, 33 bp, Artificial Sequence
  Description of Artificial Sequence: Synthetic oligonucleotide
ccagttctacaactcctgcatggatacacttgc

SEQ ID NO: 202836 - DNA, 33 bp, Artificial Sequence
  Description of Artificial Sequence: Synthetic oligonucleotide
cagttctacaactcctgcatggatacacttgcc

SEQ ID NO: 202837 - DNA, 36 bp, Artificial Sequence
  Description of Artificial Sequence: Synthetic oligonucleotide
agttctacaactcctgcatggatacacttgccattg

SEQ ID NO: 202838 - DNA, 35 bp, Artificial Sequence
  Description of Artificial Sequence: Synthetic oligonucleotide
gttctacaactcctgcatggatacacttgccattg

SEQ ID NO: 202839 - DNA, 37 bp, Artificial Sequence
  Description of Artificial Sequence: Synthetic oligonucleotide
ttctacaactcctgcatggatacacttgccattgaag

SEQ ID NO: 202840 - DNA, 36 bp, Artificial Sequence
  Description of Artificial Sequence: Synthetic oligonucleotide
tctacaactcctgcatggatacacttgccattgaag

SEQ ID NO: 202841 - DNA, 35 bp, Artificial Sequence
  Description of Artificial Sequence: Synthetic oligonucleotide
ctacaactcctgcatggatacacttgccattgaag

SEQ ID NO: 202842 - DNA, 35 bp, Artificial Sequence
  Description of Artificial Sequence: Synthetic oligonucleotide
tacaactcctgcatggatacacttgccattgaagc

SEQ ID NO: 202843 - DNA, 34 bp, Artificial Sequence
  Description of Artificial Sequence: Synthetic oligonucleotide
acaactcctgcatggatacacttgccattgaagc

SEQ ID NO: 202844 - DNA, 33 bp, Artificial Sequence
  Description of Artificial Sequence: Synthetic oligonucleotide
caactcctgcatggatacacttgccattgaagc

SEQ ID NO: 202845 - DNA, 34 bp, Artificial Sequence
  Description of Artificial Sequence: Synthetic oligonucleotide
aactcctgcatggatacacttgccattgaagctg

SEQ ID NO: 202846 - DNA, 33 bp, Artificial Sequence
  Description of Artificial Sequence: Synthetic oligonucleotide
actcctgcatggatacacttgccattgaagctg

SEQ ID NO: 202847 - DNA, 32 bp, Artificial Sequence
  Description of Artificial Sequence: Synthetic oligonucleotide
ctcctgcatggatacacttgccattgaagctg

SEQ ID NO: 202848 - DNA, 32 bp, Artificial Sequence
  Description of Artificial Sequence: Synthetic oligonucleotide
tcctgcatggatacacttgccattgaagctgc

SEQ ID NO: 202849 - DNA, 31 bp, Artificial Sequence
  Description of Artificial Sequence: Synthetic oligonucleotide
cctgcatggatacacttgccattgaagctgc

SEQ ID NO: 202850 - DNA, 32 bp, Artificial Sequence
  Description of Artificial Sequence: Synthetic oligonucleotide
ctgcatggatacacttgccattgaagctgcag

SEQ ID NO: 202851 - DNA, 32 bp, Artificial Sequence
  Description of Artificial Sequence: Synthetic oligonucleotide
tgcatggatacacttgccattgaagctgcagg

SEQ ID NO: 202852 - DNA, 31 bp, Artificial Sequence
  Description of Artificial Sequence: Synthetic oligonucleotide
gcatggatacacttgccattgaagctgcagg

SEQ ID NO: 202853 - DNA, 31 bp, Artificial Sequence
  Description of Artificial Sequence: Synthetic oligonucleotide
catggatacacttgccattgaagctgcaggg

SEQ ID NO: 202854 - DNA, 32 bp, Artificial Sequence
  Description of Artificial Sequence: Synthetic oligonucleotide
atggatacacttgccattgaagctgcagggac

SEQ ID NO: 202855 - DNA, 31 bp, Artificial Sequence
  Description of Artificial Sequence: Synthetic oligonucleotide
tggatacacttgccattgaagctgcagggac

SEQ ID NO: 202856 - DNA, 30 bp, Artificial Sequence
  Description of Artificial Sequence: Synthetic oligonucleotide
ggatacacttgccattgaagctgcagggac

SEQ ID NO: 202857 - DNA, 31 bp, Artificial Sequence
  Description of Artificial Sequence: Synthetic oligonucleotide
gatacacttgccattgaagctgcagggactg

SEQ ID NO: 202858 - DNA, 31 bp, Artificial Sequence
  Description of Artificial Sequence: Synthetic oligonucleotide
atacacttgccattgaagctgcagggactgg

SEQ ID NO: 202859 - DNA, 30 bp, Artificial Sequence
  Description of Artificial Sequence: Synthetic oligonucleotide
tacacttgccattgaagctgcagggactgg

SEQ ID NO: 202860 - DNA, 29 bp, Artificial Sequence
  Description of Artificial Sequence: Synthetic oligonucleotide
acacttgccattgaagctgcagggactgg

SEQ ID NO: 202861 - DNA, 28 bp, Artificial Sequence
  Description of Artificial Sequence: Synthetic oligonucleotide
cacttgccattgaagctgcagggactgg

SEQ ID NO: 202862 - DNA, 29 bp, Artificial Sequence
  Description of Artificial Sequence: Synthetic oligonucleotide
acttgccattgaagctgcagggactggtc

SEQ ID NO: 202863 - DNA, 28 bp, Artificial Sequence
  Description of Artificial Sequence: Synthetic oligonucleotide
cttgccattgaagctgcagggactggtc

SEQ ID NO: 202864 - DNA, 28 bp, Artificial Sequence
  Description of Artificial Sequence: Synthetic oligonucleotide
ttgccattgaagctgcagggactggtcc

SEQ ID NO: 202865 - DNA, 27 bp, Artificial Sequence
  Description of Artificial Sequence: Synthetic oligonucleotide
tgccattgaagctgcagggactggtcc

SEQ ID NO: 202866 - DNA, 26 bp, Artificial Sequence
  Description of Artificial Sequence: Synthetic oligonucleotide
gccattgaagctgcagggactggtcc

SEQ ID NO: 202867 - DNA, 26 bp, Artificial Sequence
  Description of Artificial Sequence: Synthetic oligonucleotide
ccattgaagctgcagggactggtccc

SEQ ID NO: 202868 - DNA, 27 bp, Artificial Sequence
  Description of Artificial Sequence: Synthetic oligonucleotide
cattgaagctgcagggactggtcccct

SEQ ID NO: 202869 - DNA, 27 bp, Artificial Sequence
  Description of Artificial Sequence: Synthetic oligonucleotide
attgaagctgcagggactggtcccctc

SEQ ID NO: 202870 - DNA, 27 bp, Artificial Sequence
  Description of Artificial Sequence: Synthetic oligonucleotide
ttgaagctgcagggactggtcccctca

SEQ ID NO: 202871 - DNA, 26 bp, Artificial Sequence
  Description of Artificial Sequence: Synthetic oligonucleotide
tgaagctgcagggactggtcccctca

SEQ ID NO: 202872 - DNA, 25 bp, Artificial Sequence
  Description of Artificial Sequence: Synthetic oligonucleotide
gaagctgcagggactggtcccctca

SEQ ID NO: 202873 - DNA, 26 bp, Artificial Sequence
  Description of Artificial Sequence: Synthetic oligonucleotide
aagctgcagggactggtcccctcaga

SEQ ID NO: 202874 - DNA, 25 bp, Artificial Sequence
  Description of Artificial Sequence: Synthetic oligonucleotide
agctgcagggactggtcccctcaga

SEQ ID NO: 202875 - DNA, 24 bp, Artificial Sequence
  Description of Artificial Sequence: Synthetic oligonucleotide
gctgcagggactggtcccctcaga

SEQ ID NO: 202876 - DNA, 26 bp, Artificial Sequence
  Description of Artificial Sequence: Synthetic oligonucleotide
ctgcagggactggtcccctcagacaa

SEQ ID NO: 202877 - DNA, 27 bp, Artificial Sequence
  Description of Artificial Sequence: Synthetic oligonucleotide
tgcagggactggtcccctcagacaagt

SEQ ID NO: 202878 - DNA, 27 bp, Artificial Sequence
  Description of Artificial Sequence: Synthetic oligonucleotide
gcagggactggtcccctcagacaagtt

SEQ ID NO: 202879 - DNA, 30 bp, Artificial Sequence
  Description of Artificial Sequence: Synthetic oligonucleotide
cagggactggtcccctcagacaagttattg

SEQ ID NO: 202880 - DNA, 31 bp, Artificial Sequence
  Description of Artificial Sequence: Synthetic oligonucleotide
agggactggtcccctcagacaagttattgag

SEQ ID NO: 202881 - DNA, 30 bp, Artificial Sequence
  Description of Artificial Sequence: Synthetic oligonucleotide
gggactggtcccctcagacaagttattgag

SEQ ID NO: 202882 - DNA, 30 bp, Artificial Sequence
  Description of Artificial Sequence: Synthetic oligonucleotide
ggactggtcccctcagacaagttattgagg

SEQ ID NO: 202883 - DNA, 31 bp, Artificial Sequence
  Description of Artificial Sequence: Synthetic oligonucleotide
gactggtcccctcagacaagttattgaggag

SEQ ID NO: 202884 - DNA, 31 bp, Artificial Sequence
  Description of Artificial Sequence: Synthetic oligonucleotide
actggtcccctcagacaagttattgaggagc

SEQ ID NO: 202885 - DNA, 30 bp, Artificial Sequence
  Description of Artificial Sequence: Synthetic oligonucleotide
ctggtcccctcagacaagttattgaggagc

SEQ ID NO: 202886 - DNA, 32 bp, Artificial Sequence
  Description of Artificial Sequence: Synthetic oligonucleotide
tggtcccctcagacaagttattgaggagcttg

SEQ ID NO: 202887 - DNA, 31 bp, Artificial Sequence
  Description of Artificial Sequence: Synthetic oligonucleotide
ggtcccctcagacaagttattgaggagcttg

SEQ ID NO: 202888 - DNA, 31 bp, Artificial Sequence
  Description of Artificial Sequence: Synthetic oligonucleotide
gtcccctcagacaagttattgaggagcttgg

SEQ ID NO: 202889 - DNA, 32 bp, Artificial Sequence
  Description of Artificial Sequence: Synthetic oligonucleotide
tcccctcagacaagttattgaggagcttggag

SEQ ID NO: 202890 - DNA, 31 bp, Artificial Sequence
  Description of Artificial Sequence: Synthetic oligonucleotide
cccctcagacaagttattgaggagcttggag

SEQ ID NO: 202891 - DNA, 31 bp, Artificial Sequence
  Description of Artificial Sequence: Synthetic oligonucleotide
ccctcagacaagttattgaggagcttggagg

SEQ ID NO: 202892 - DNA, 31 bp, Artificial Sequence
  Description of Artificial Sequence: Synthetic oligonucleotide
cctcagacaagttattgaggagcttggaggc

SEQ ID NO: 202893 - DNA, 32 bp, Artificial Sequence
  Description of Artificial Sequence: Synthetic oligonucleotide
ctcagacaagttattgaggagcttggaggctg

SEQ ID NO: 202894 - DNA, 32 bp, Artificial Sequence
  Description of Artificial Sequence: Synthetic oligonucleotide
tcagacaagttattgaggagcttggaggctgg

SEQ ID NO: 202895 - DNA, 31 bp, Artificial Sequence
  Description of Artificial Sequence: Synthetic oligonucleotide
cagacaagttattgaggagcttggaggctgg

SEQ ID NO: 202896 - DNA, 31 bp, Artificial Sequence
  Description of Artificial Sequence: Synthetic oligonucleotide
agacaagttattgaggagcttggaggctggc

SEQ ID NO: 202897 - DNA, 30 bp, Artificial Sequence
  Description of Artificial Sequence: Synthetic oligonucleotide
gacaagttattgaggagcttggaggctggc

SEQ ID NO: 202898 - DNA, 30 bp, Artificial Sequence
  Description of Artificial Sequence: Synthetic oligonucleotide
acaagttattgaggagcttggaggctggcg

SEQ ID NO: 202899 - DNA, 29 bp, Artificial Sequence
  Description of Artificial Sequence: Synthetic oligonucleotide
caagttattgaggagcttggaggctggcg

SEQ ID NO: 202900 - DNA, 29 bp, Artificial Sequence
  Description of Artificial Sequence: Synthetic oligonucleotide
aagttattgaggagcttggaggctggcgc

SEQ ID NO: 202901 - DNA, 28 bp, Artificial Sequence
  Description of Artificial Sequence: Synthetic oligonucleotide
agttattgaggagcttggaggctggcgc

SEQ ID NO: 202902 - DNA, 27 bp, Artificial Sequence
  Description of Artificial Sequence: Synthetic oligonucleotide
gttattgaggagcttggaggctggcgc

SEQ ID NO: 202903 - DNA, 29 bp, Artificial Sequence
  Description of Artificial Sequence: Synthetic oligonucleotide
ttattgaggagcttggaggctggcgcatc

SEQ ID NO: 202904 - DNA, 28 bp, Artificial Sequence
  Description of Artificial Sequence: Synthetic oligonucleotide
tattgaggagcttggaggctggcgcatc

SEQ ID NO: 202905 - DNA, 27 bp, Artificial Sequence
  Description of Artificial Sequence: Synthetic oligonucleotide
attgaggagcttggaggctggcgcatc

SEQ ID NO: 202906 - DNA, 27 bp, Artificial Sequence
  Description of Artificial Sequence: Synthetic oligonucleotide
ttgaggagcttggaggctggcgcatct

SEQ ID NO: 202907 - DNA, 26 bp, Artificial Sequence
  Description of Artificial Sequence: Synthetic oligonucleotide
tgaggagcttggaggctggcgcatct

SEQ ID NO: 202908 - DNA, 25 bp, Artificial Sequence
  Description of Artificial Sequence: Synthetic oligonucleotide
gaggagcttggaggctggcgcatct

SEQ ID NO: 202909 - DNA, 26 bp, Artificial Sequence
  Description of Artificial Sequence: Synthetic oligonucleotide
aggagcttggaggctggcgcatctct

SEQ ID NO: 202910 - DNA, 25 bp, Artificial Sequence
  Description of Artificial Sequence: Synthetic oligonucleotide
ggagcttggaggctggcgcatctct

SEQ ID NO: 202911 - DNA, 25 bp, Artificial Sequence
  Description of Artificial Sequence: Synthetic oligonucleotide
gagcttggaggctggcgcatctctg

SEQ ID NO: 202912 - DNA, 27 bp, Artificial Sequence
  Description of Artificial Sequence: Synthetic oligonucleotide
agcttggaggctggcgcatctctggta

SEQ ID NO: 202913 - DNA, 27 bp, Artificial Sequence
  Description of Artificial Sequence: Synthetic oligonucleotide
gcttggaggctggcgcatctctggtaa

SEQ ID NO: 202914 - DNA, 29 bp, Artificial Sequence
  Description of Artificial Sequence: Synthetic oligonucleotide
cttggaggctggcgcatctctggtaaatg

SEQ ID NO: 202915 - DNA, 29 bp, Artificial Sequence
  Description of Artificial Sequence: Synthetic oligonucleotide
ttggaggctggcgcatctctggtaaatgg

SEQ ID NO: 202916 - DNA, 28 bp, Artificial Sequence
  Description of Artificial Sequence: Synthetic oligonucleotide
tggaggctggcgcatctctggtaaatgg

SEQ ID NO: 202917 - DNA, 27 bp, Artificial Sequence
  Description of Artificial Sequence: Synthetic oligonucleotide
ggaggctggcgcatctctggtaaatgg

SEQ ID NO: 202918 - DNA, 28 bp, Artificial Sequence
  Description of Artificial Sequence: Synthetic oligonucleotide
gaggctggcgcatctctggtaaatggac

SEQ ID NO: 202919 - DNA, 30 bp, Artificial Sequence
  Description of Artificial Sequence: Synthetic oligonucleotide
aggctggcgcatctctggtaaatggacttc

SEQ ID NO: 202920 - DNA, 29 bp, Artificial Sequence
  Description of Artificial Sequence: Synthetic oligonucleotide
ggctggcgcatctctggtaaatggacttc

SEQ ID NO: 202921 - DNA, 29 bp, Artificial Sequence
  Description of Artificial Sequence: Synthetic oligonucleotide
gctggcgcatctctggtaaatggacttcc

SEQ ID NO: 202922 - DNA, 34 bp, Artificial Sequence
  Description of Artificial Sequence: Synthetic oligonucleotide
ctggcgcatctctggtaaatggacttccttaaac

SEQ ID NO: 202923 - DNA, 39 bp, Artificial Sequence
  Description of Artificial Sequence: Synthetic oligonucleotide
tggcgcatctctggtaaatggacttccttaaactttaac

SEQ ID NO: 202924 - DNA, 38 bp, Artificial Sequence
  Description of Artificial Sequence: Synthetic oligonucleotide
ggcgcatctctggtaaatggacttccttaaactttaac

SEQ ID NO: 202925 - DNA, 38 bp, Artificial Sequence
  Description of Artificial Sequence: Synthetic oligonucleotide
gcgcatctctggtaaatggacttccttaaactttaacc

SEQ ID NO: 202926 - DNA, 38 bp, Artificial Sequence
  Description of Artificial Sequence: Synthetic oligonucleotide
cgcatctctggtaaatggacttccttaaactttaaccg

SEQ ID NO: 202927 - DNA, 40 bp, Artificial Sequence
  Description of Artificial Sequence: Synthetic oligonucleotide
gcatctctggtaaatggacttccttaaactttaaccgaac

SEQ ID NO: 202928 - DNA, 40 bp, Artificial Sequence
  Description of Artificial Sequence: Synthetic oligonucleotide
catctctggtaaatggacttccttaaactttaaccgaacg

SEQ ID NO: 202929 - DNA, 40 bp, Artificial Sequence
  Description of Artificial Sequence: Synthetic oligonucleotide
atctctggtaaatggacttccttaaactttaaccgaacgc

SEQ ID NO: 202930 - DNA, 39 bp, Artificial Sequence
  Description of Artificial Sequence: Synthetic oligonucleotide
tctctggtaaatggacttccttaaactttaaccgaacgc

SEQ ID NO: 202931 - DNA, 38 bp, Artificial Sequence
  Description of Artificial Sequence: Synthetic oligonucleotide
ctctggtaaatggacttccttaaactttaaccgaacgc

SEQ ID NO: 202932 - DNA, 39 bp, Artificial Sequence
  Description of Artificial Sequence: Synthetic oligonucleotide
tctggtaaatggacttccttaaactttaaccgaacgctg

SEQ ID NO: 202933 - DNA, 38 bp, Artificial Sequence
  Description of Artificial Sequence: Synthetic oligonucleotide
ctggtaaatggacttccttaaactttaaccgaacgctg

SEQ ID NO: 202934 - DNA, 39 bp, Artificial Sequence
  Description of Artificial Sequence: Synthetic oligonucleotide
tggtaaatggacttccttaaactttaaccgaacgctgag

SEQ ID NO: 202935 - DNA, 38 bp, Artificial Sequence
  Description of Artificial Sequence: Synthetic oligonucleotide
ggtaaatggacttccttaaactttaaccgaacgctgag

SEQ ID NO: 202936 - DNA, 39 bp, Artificial Sequence
  Description of Artificial Sequence: Synthetic oligonucleotide
gtaaatggacttccttaaactttaaccgaacgctgagac

SEQ ID NO: 202937 - DNA, 41 bp, Artificial Sequence
  Description of Artificial Sequence: Synthetic oligonucleotide
taaatggacttccttaaactttaaccgaacgctgagacttc

SEQ ID NO: 202938 - DNA, 40 bp, Artificial Sequence
  Description of Artificial Sequence: Synthetic oligonucleotide
aaatggacttccttaaactttaaccgaacgctgagacttc

SEQ ID NO: 202939 - DNA, 39 bp, Artificial Sequence
  Description of Artificial Sequence: Synthetic oligonucleotide
aatggacttccttaaactttaaccgaacgctgagacttc

SEQ ID NO: 202940 - DNA, 38 bp, Artificial Sequence
  Description of Artificial Sequence: Synthetic oligonucleotide
atggacttccttaaactttaaccgaacgctgagacttc

SEQ ID NO: 202941 - DNA, 37 bp, Artificial Sequence
  Description of Artificial Sequence: Synthetic oligonucleotide
tggacttccttaaactttaaccgaacgctgagacttc

SEQ ID NO: 202942 - DNA, 36 bp, Artificial Sequence
  Description of Artificial Sequence: Synthetic oligonucleotide
ggacttccttaaactttaaccgaacgctgagacttc

SEQ ID NO: 202943 - DNA, 37 bp, Artificial Sequence
  Description of Artificial Sequence: Synthetic oligonucleotide
gacttccttaaactttaaccgaacgctgagacttctg

SEQ ID NO: 202944 - DNA, 39 bp, Artificial Sequence
  Description of Artificial Sequence: Synthetic oligonucleotide
acttccttaaactttaaccgaacgctgagacttctgatg

SEQ ID NO: 202945 - DNA, 38 bp, Artificial Sequence
  Description of Artificial Sequence: Synthetic oligonucleotide
cttccttaaactttaaccgaacgctgagacttctgatg

SEQ ID NO: 202946 - DNA, 39 bp, Artificial Sequence
  Description of Artificial Sequence: Synthetic oligonucleotide
ttccttaaactttaaccgaacgctgagacttctgatgag

SEQ ID NO: 202947 - DNA, 38 bp, Artificial Sequence
  Description of Artificial Sequence: Synthetic oligonucleotide
tccttaaactttaaccgaacgctgagacttctgatgag

SEQ ID NO: 202948 - DNA, 37 bp, Artificial Sequence
  Description of Artificial Sequence: Synthetic oligonucleotide
ccttaaactttaaccgaacgctgagacttctgatgag

SEQ ID NO: 202949 - DNA, 38 bp, Artificial Sequence
  Description of Artificial Sequence: Synthetic oligonucleotide
cttaaactttaaccgaacgctgagacttctgatgagtc

SEQ ID NO: 202950 - DNA, 39 bp, Artificial Sequence
  Description of Artificial Sequence: Synthetic oligonucleotide
ttaaactttaaccgaacgctgagacttctgatgagtcag

SEQ ID NO: 202951 - DNA, 38 bp, Artificial Sequence
  Description of Artificial Sequence: Synthetic oligonucleotide
taaactttaaccgaacgctgagacttctgatgagtcag

SEQ ID NO: 202952 - DNA, 37 bp, Artificial Sequence
  Description of Artificial Sequence: Synthetic oligonucleotide
aaactttaaccgaacgctgagacttctgatgagtcag

SEQ ID NO: 202953 - DNA, 36 bp, Artificial Sequence
  Description of Artificial Sequence: Synthetic oligonucleotide
aactttaaccgaacgctgagacttctgatgagtcag

SEQ ID NO: 202954 - DNA, 35 bp, Artificial Sequence
  Description of Artificial Sequence: Synthetic oligonucleotide
actttaaccgaacgctgagacttctgatgagtcag

SEQ ID NO: 202955 - DNA, 34 bp, Artificial Sequence
  Description of Artificial Sequence: Synthetic oligonucleotide
ctttaaccgaacgctgagacttctgatgagtcag

SEQ ID NO: 202956 - DNA, 37 bp, Artificial Sequence
  Description of Artificial Sequence: Synthetic oligonucleotide
tttaaccgaacgctgagacttctgatgagtcagtatg

SEQ ID NO: 202957 - DNA, 36 bp, Artificial Sequence
  Description of Artificial Sequence: Synthetic oligonucleotide
ttaaccgaacgctgagacttctgatgagtcagtatg

SEQ ID NO: 202958 - DNA, 35 bp, Artificial Sequence
  Description of Artificial Sequence: Synthetic oligonucleotide
taaccgaacgctgagacttctgatgagtcagtatg

SEQ ID NO: 202959 - DNA, 34 bp, Artificial Sequence
  Description of Artificial Sequence: Synthetic oligonucleotide
aaccgaacgctgagacttctgatgagtcagtatg

SEQ ID NO: 202960 - DNA, 33 bp, Artificial Sequence
  Description of Artificial Sequence: Synthetic oligonucleotide
accgaacgctgagacttctgatgagtcagtatg

SEQ ID NO: 202961 - DNA, 32 bp, Artificial Sequence
  Description of Artificial Sequence: Synthetic oligonucleotide
ccgaacgctgagacttctgatgagtcagtatg

SEQ ID NO: 202962 - DNA, 32 bp, Artificial Sequence
  Description of Artificial Sequence: Synthetic oligonucleotide
cgaacgctgagacttctgatgagtcagtatgg

SEQ ID NO: 202963 - DNA, 32 bp, Artificial Sequence
  Description of Artificial Sequence: Synthetic oligonucleotide
gaacgctgagacttctgatgagtcagtatggc

SEQ ID NO: 202964 - DNA, 32 bp, Artificial Sequence
  Description of Artificial Sequence: Synthetic oligonucleotide
aacgctgagacttctgatgagtcagtatggcc

SEQ ID NO: 202965 - DNA, 31 bp, Artificial Sequence
  Description of Artificial Sequence: Synthetic oligonucleotide
acgctgagacttctgatgagtcagtatggcc

SEQ ID NO: 202966 - DNA, 30 bp, Artificial Sequence
  Description of Artificial Sequence: Synthetic oligonucleotide
cgctgagacttctgatgagtcagtatggcc

SEQ ID NO: 202967 - DNA, 34 bp, Artificial Sequence
  Description of Artificial Sequence: Synthetic oligonucleotide
gctgagacttctgatgagtcagtatggccatttc

SEQ ID NO: 202968 - DNA, 34 bp, Artificial Sequence
  Description of Artificial Sequence: Synthetic oligonucleotide
ctgagacttctgatgagtcagtatggccatttcc

SEQ ID NO: 202969 - DNA, 34 bp, Artificial Sequence
  Description of Artificial Sequence: Synthetic oligonucleotide
tgagacttctgatgagtcagtatggccatttccc

SEQ ID NO: 202970 - DNA, 33 bp, Artificial Sequence
  Description of Artificial Sequence: Synthetic oligonucleotide
gagacttctgatgagtcagtatggccatttccc

SEQ ID NO: 202971 - DNA, 36 bp, Artificial Sequence
  Description of Artificial Sequence: Synthetic oligonucleotide
agacttctgatgagtcagtatggccatttccctttc

SEQ ID NO: 202972 - DNA, 35 bp, Artificial Sequence
  Description of Artificial Sequence: Synthetic oligonucleotide
gacttctgatgagtcagtatggccatttccctttc

SEQ ID NO: 202973 - DNA, 37 bp, Artificial Sequence
  Description of Artificial Sequence: Synthetic oligonucleotide
acttctgatgagtcagtatggccatttccctttcttc

SEQ ID NO: 202974 - DNA, 36 bp, Artificial Sequence
  Description of Artificial Sequence: Synthetic oligonucleotide
cttctgatgagtcagtatggccatttccctttcttc

SEQ ID NO: 202975 - DNA, 37 bp, Artificial Sequence
  Description of Artificial Sequence: Synthetic oligonucleotide
ttctgatgagtcagtatggccatttccctttcttcag

SEQ ID NO: 202976 - DNA, 36 bp, Artificial Sequence
  Description of Artificial Sequence: Synthetic oligonucleotide
tctgatgagtcagtatggccatttccctttcttcag

SEQ ID NO: 202977 - DNA, 35 bp, Artificial Sequence
  Description of Artificial Sequence: Synthetic oligonucleotide
ctgatgagtcagtatggccatttccctttcttcag

SEQ ID NO: 202978 - DNA, 36 bp, Artificial Sequence
  Description of Artificial Sequence: Synthetic oligonucleotide
tgatgagtcagtatggccatttccctttcttcagag

SEQ ID NO: 202979 - DNA, 35 bp, Artificial Sequence
  Description of Artificial Sequence: Synthetic oligonucleotide
gatgagtcagtatggccatttccctttcttcagag

SEQ ID NO: 202980 - DNA, 35 bp, Artificial Sequence
  Description of Artificial Sequence: Synthetic oligonucleotide
atgagtcagtatggccatttccctttcttcagagc

SEQ ID NO: 202981 - DNA, 34 bp, Artificial Sequence
  Description of Artificial Sequence: Synthetic oligonucleotide
tgagtcagtatggccatttccctttcttcagagc

SEQ ID NO: 202982 - DNA, 33 bp, Artificial Sequence
  Description of Artificial Sequence: Synthetic oligonucleotide
gagtcagtatggccatttccctttcttcagagc

SEQ ID NO: 202983 - DNA, 33 bp, Artificial Sequence
  Description of Artificial Sequence: Synthetic oligonucleotide
agtcagtatggccatttccctttcttcagagcc

SEQ ID NO: 202984 - DNA, 32 bp, Artificial Sequence
  Description of Artificial Sequence: Synthetic oligonucleotide
gtcagtatggccatttccctttcttcagagcc

SEQ ID NO: 202985 - DNA, 34 bp, Artificial Sequence
  Description of Artificial Sequence: Synthetic oligonucleotide
tcagtatggccatttccctttcttcagagcctac

SEQ ID NO: 202986 - DNA, 33 bp, Artificial Sequence
  Description of Artificial Sequence: Synthetic oligonucleotide
cagtatggccatttccctttcttcagagcctac

SEQ ID NO: 202987 - DNA, 33 bp, Artificial Sequence
  Description of Artificial Sequence: Synthetic oligonucleotide
agtatggccatttccctttcttcagagcctacc

SEQ ID NO: 202988 - DNA, 32 bp, Artificial Sequence
  Description of Artificial Sequence: Synthetic oligonucleotide
gtatggccatttccctttcttcagagcctacc

SEQ ID NO: 202989 - DNA, 34 bp, Artificial Sequence
  Description of Artificial Sequence: Synthetic oligonucleotide
tatggccatttccctttcttcagagcctacctag

SEQ ID NO: 202990 - DNA, 33 bp, Artificial Sequence
  Description of Artificial Sequence: Synthetic oligonucleotide
atggccatttccctttcttcagagcctacctag

SEQ ID NO: 202991 - DNA, 32 bp, Artificial Sequence
  Description of Artificial Sequence: Synthetic oligonucleotide
tggccatttccctttcttcagagcctacctag

SEQ ID NO: 202992 - DNA, 31 bp, Artificial Sequence
  Description of Artificial Sequence: Synthetic oligonucleotide
ggccatttccctttcttcagagcctacctag

SEQ ID NO: 202993 - DNA, 31 bp, Artificial Sequence
  Description of Artificial Sequence: Synthetic oligonucleotide
gccatttccctttcttcagagcctacctagg

SEQ ID NO: 202994 - DNA, 32 bp, Artificial Sequence
  Description of Artificial Sequence: Synthetic oligonucleotide
ccatttccctttcttcagagcctacctaggac

SEQ ID NO: 202995 - DNA, 32 bp, Artificial Sequence
  Description of Artificial Sequence: Synthetic oligonucleotide
catttccctttcttcagagcctacctaggacc

SEQ ID NO: 202996 - DNA, 33 bp, Artificial Sequence
  Description of Artificial Sequence: Synthetic oligonucleotide
atttccctttcttcagagcctacctaggacctc

SEQ ID NO: 202997 - DNA, 32 bp, Artificial Sequence
  Description of Artificial Sequence: Synthetic oligonucleotide
tttccctttcttcagagcctacctaggacctc

SEQ ID NO: 202998 - DNA, 31 bp, Artificial Sequence
  Description of Artificial Sequence: Synthetic oligonucleotide
ttccctttcttcagagcctacctaggacctc

SEQ ID NO: 202999 - DNA, 30 bp, Artificial Sequence
  Description of Artificial Sequence: Synthetic oligonucleotide
tccctttcttcagagcctacctaggacctc

SEQ ID NO: 203000 - DNA, 29 bp, Artificial Sequence
  Description of Artificial Sequence: Synthetic oligonucleotide
ccctttcttcagagcctacctaggacctc

SEQ ID NO: 203001 - DNA, 31 bp, Artificial Sequence
  Description of Artificial Sequence: Synthetic oligonucleotide
cctttcttcagagcctacctaggacctcatc

SEQ ID NO: 203002 - DNA, 31 bp, Artificial Sequence
  Description of Artificial Sequence: Synthetic oligonucleotide
ctttcttcagagcctacctaggacctcatcc

SEQ ID NO: 203003 - DNA, 32 bp, Artificial Sequence
  Description of Artificial Sequence: Synthetic oligonucleotide
tttcttcagagcctacctaggacctcatcctg

SEQ ID NO: 203004 - DNA, 31 bp, Artificial Sequence
  Description of Artificial Sequence: Synthetic oligonucleotide
ttcttcagagcctacctaggacctcatcctg

SEQ ID NO: 203005 - DNA, 30 bp, Artificial Sequence
  Description of Artificial Sequence: Synthetic oligonucleotide
tcttcagagcctacctaggacctcatcctg

SEQ ID NO: 203006 - DNA, 29 bp, Artificial Sequence
  Description of Artificial Sequence: Synthetic oligonucleotide
cttcagagcctacctaggacctcatcctg

SEQ ID NO: 203007 - DNA, 29 bp, Artificial Sequence
  Description of Artificial Sequence: Synthetic oligonucleotide
ttcagagcctacctaggacctcatcctgc

SEQ ID NO: 203008 - DNA, 28 bp, Artificial Sequence
  Description of Artificial Sequence: Synthetic oligonucleotide
tcagagcctacctaggacctcatcctgc

SEQ ID NO: 203009 - DNA, 27 bp, Artificial Sequence
  Description of Artificial Sequence: Synthetic oligonucleotide
cagagcctacctaggacctcatcctgc

SEQ ID NO: 203010 - DNA, 27 bp, Artificial Sequence
  Description of Artificial Sequence: Synthetic oligonucleotide
agagcctacctaggacctcatcctgcc

SEQ ID NO: 203011 - DNA, 27 bp, Artificial Sequence
  Description of Artificial Sequence: Synthetic oligonucleotide
gagcctacctaggacctcatcctgcct

SEQ ID NO: 203012 - DNA, 27 bp, Artificial Sequence
  Description of Artificial Sequence: Synthetic oligonucleotide
agcctacctaggacctcatcctgcctc

SEQ ID NO: 203013 - DNA, 27 bp, Artificial Sequence
  Description of Artificial Sequence: Synthetic oligonucleotide
gcctacctaggacctcatcctgcctct

SEQ ID NO: 203014 - DNA, 27 bp, Artificial Sequence
  Description of Artificial Sequence: Synthetic oligonucleotide
cctacctaggacctcatcctgcctctc

SEQ ID NO: 203015 - DNA, 27 bp, Artificial Sequence
  Description of Artificial Sequence: Synthetic oligonucleotide
ctacctaggacctcatcctgcctctcc

SEQ ID NO: 203016 - DNA, 28 bp, Artificial Sequence
  Description of Artificial Sequence: Synthetic oligonucleotide
tacctaggacctcatcctgcctctccac

SEQ ID NO: 203017 - DNA, 27 bp, Artificial Sequence
  Description of Artificial Sequence: Synthetic oligonucleotide
acctaggacctcatcctgcctctccac

SEQ ID NO: 203018 - DNA, 27 bp, Artificial Sequence
  Description of Artificial Sequence: Synthetic oligonucleotide
cctaggacctcatcctgcctctccaca

SEQ ID NO: 203019 - DNA, 27 bp, Artificial Sequence
  Description of Artificial Sequence: Synthetic oligonucleotide
ctaggacctcatcctgcctctccacac

SEQ ID NO: 203020 - DNA, 28 bp, Artificial Sequence
  Description of Artificial Sequence: Synthetic oligonucleotide
taggacctcatcctgcctctccacacac

SEQ ID NO: 203021 - DNA, 27 bp, Artificial Sequence
  Description of Artificial Sequence: Synthetic oligonucleotide
aggacctcatcctgcctctccacacac

SEQ ID NO: 203022 - DNA, 27 bp, Artificial Sequence
  Description of Artificial Sequence: Synthetic oligonucleotide
ggacctcatcctgcctctccacacaca

SEQ ID NO: 203023 - DNA, 27 bp, Artificial Sequence
  Description of Artificial Sequence: Synthetic oligonucleotide
gacctcatcctgcctctccacacacac

SEQ ID NO: 203024 - DNA, 27 bp, Artificial Sequence
  Description of Artificial Sequence: Synthetic oligonucleotide
acctcatcctgcctctccacacacacc

SEQ ID NO: 203025 - DNA, 27 bp, Artificial Sequence
  Description of Artificial Sequence: Synthetic oligonucleotide
cctcatcctgcctctccacacacacca

SEQ ID NO: 203026 - DNA, 27 bp, Artificial Sequence
  Description of Artificial Sequence: Synthetic oligonucleotide
ctcatcctgcctctccacacacaccag

SEQ ID NO: 203027 - DNA, 28 bp, Artificial Sequence
  Description of Artificial Sequence: Synthetic oligonucleotide
tcatcctgcctctccacacacaccagtc

SEQ ID NO: 203028 - DNA, 27 bp, Artificial Sequence
  Description of Artificial Sequence: Synthetic oligonucleotide
catcctgcctctccacacacaccagtc

SEQ ID NO: 203029 - DNA, 29 bp, Artificial Sequence
  Description of Artificial Sequence: Synthetic oligonucleotide
atcctgcctctccacacacaccagtcatc

SEQ ID NO: 203030 - DNA, 28 bp, Artificial Sequence
  Description of Artificial Sequence: Synthetic oligonucleotide
tcctgcctctccacacacaccagtcatc

SEQ ID NO: 203031 - DNA, 27 bp, Artificial Sequence
  Description of Artificial Sequence: Synthetic oligonucleotide
cctgcctctccacacacaccagtcatc

SEQ ID NO: 203032 - DNA, 27 bp, Artificial Sequence
  Description of Artificial Sequence: Synthetic oligonucleotide
ctgcctctccacacacaccagtcatcc

SEQ ID NO: 203033 - DNA, 28 bp, Artificial Sequence
  Description of Artificial Sequence: Synthetic oligonucleotide
tgcctctccacacacaccagtcatccag

SEQ ID NO: 203034 - DNA, 27 bp, Artificial Sequence
  Description of Artificial Sequence: Synthetic oligonucleotide
gcctctccacacacaccagtcatccag

SEQ ID NO: 203035 - DNA, 30 bp, Artificial Sequence
  Description of Artificial Sequence: Synthetic oligonucleotide
cctctccacacacaccagtcatccagatag

SEQ ID NO: 203036 - DNA, 31 bp, Artificial Sequence
  Description of Artificial Sequence: Synthetic oligonucleotide
ctctccacacacaccagtcatccagatagac

SEQ ID NO: 203037 - DNA, 31 bp, Artificial Sequence
  Description of Artificial Sequence: Synthetic oligonucleotide
tctccacacacaccagtcatccagatagacc

SEQ ID NO: 203038 - DNA, 30 bp, Artificial Sequence
  Description of Artificial Sequence: Synthetic oligonucleotide
ctccacacacaccagtcatccagatagacc

SEQ ID NO: 203039 - DNA, 31 bp, Artificial Sequence
  Description of Artificial Sequence: Synthetic oligonucleotide
tccacacacaccagtcatccagatagaccag

SEQ ID NO: 203040 - DNA, 30 bp, Artificial Sequence
  Description of Artificial Sequence: Synthetic oligonucleotide
ccacacacaccagtcatccagatagaccag

SEQ ID NO: 203041 - DNA, 30 bp, Artificial Sequence
  Description of Artificial Sequence: Synthetic oligonucleotide
cacacacaccagtcatccagatagaccagc

SEQ ID NO: 203042 - DNA, 30 bp, Artificial Sequence
  Description of Artificial Sequence: Synthetic oligonucleotide
acacacaccagtcatccagatagaccagcc

SEQ ID NO: 203043 - DNA, 29 bp, Artificial Sequence
  Description of Artificial Sequence: Synthetic oligonucleotide
cacacaccagtcatccagatagaccagcc

SEQ ID NO: 203044 - DNA, 30 bp, Artificial Sequence
  Description of Artificial Sequence: Synthetic oligonucleotide
acacaccagtcatccagatagaccagccag

SEQ ID NO: 203045 - DNA, 29 bp, Artificial Sequence
  Description of Artificial Sequence: Synthetic oligonucleotide
cacaccagtcatccagatagaccagccag

SEQ ID NO: 203046 - DNA, 30 bp, Artificial Sequence
  Description of Artificial Sequence: Synthetic oligonucleotide
acaccagtcatccagatagaccagccagag

SEQ ID NO: 203047 - DNA, 29 bp, Artificial Sequence
  Description of Artificial Sequence: Synthetic oligonucleotide
caccagtcatccagatagaccagccagag

SEQ ID NO: 203048 - DNA, 32 bp, Artificial Sequence
  Description of Artificial Sequence: Synthetic oligonucleotide
accagtcatccagatagaccagccagagtttg

SEQ ID NO: 203049 - DNA, 31 bp, Artificial Sequence
  Description of Artificial Sequence: Synthetic oligonucleotide
ccagtcatccagatagaccagccagagtttg

SEQ ID NO: 203050 - DNA, 33 bp, Artificial Sequence
  Description of Artificial Sequence: Synthetic oligonucleotide
cagtcatccagatagaccagccagagtttgatg

SEQ ID NO: 203051 - DNA, 35 bp, Artificial Sequence
  Description of Artificial Sequence: Synthetic oligonucleotide
agtcatccagatagaccagccagagtttgatgttc

SEQ ID NO: 203052 - DNA, 34 bp, Artificial Sequence
  Description of Artificial Sequence: Synthetic oligonucleotide
gtcatccagatagaccagccagagtttgatgttc

SEQ ID NO: 203053 - DNA, 34 bp, Artificial Sequence
  Description of Artificial Sequence: Synthetic oligonucleotide
tcatccagatagaccagccagagtttgatgttcc

SEQ ID NO: 203054 - DNA, 33 bp, Artificial Sequence
  Description of Artificial Sequence: Synthetic oligonucleotide
catccagatagaccagccagagtttgatgttcc

SEQ ID NO: 203055 - DNA, 33 bp, Artificial Sequence
  Description of Artificial Sequence: Synthetic oligonucleotide
atccagatagaccagccagagtttgatgttccc

SEQ ID NO: 203056 - DNA, 32 bp, Artificial Sequence
  Description of Artificial Sequence: Synthetic oligonucleotide
tccagatagaccagccagagtttgatgttccc

SEQ ID NO: 203057 - DNA, 31 bp, Artificial Sequence
  Description of Artificial Sequence: Synthetic oligonucleotide
ccagatagaccagccagagtttgatgttccc

SEQ ID NO: 203058 - DNA, 31 bp, Artificial Sequence
  Description of Artificial Sequence: Synthetic oligonucleotide
cagatagaccagccagagtttgatgttcccc

SEQ ID NO: 203059 - DNA, 32 bp, Artificial Sequence
  Description of Artificial Sequence: Synthetic oligonucleotide
agatagaccagccagagtttgatgttcccctc

SEQ ID NO: 203060 - DNA, 31 bp, Artificial Sequence
  Description of Artificial Sequence: Synthetic oligonucleotide
gatagaccagccagagtttgatgttcccctc

SEQ ID NO: 203061 - DNA, 33 bp, Artificial Sequence
  Description of Artificial Sequence: Synthetic oligonucleotide
atagaccagccagagtttgatgttcccctcaag

SEQ ID NO: 203062 - DNA, 32 bp, Artificial Sequence
  Description of Artificial Sequence: Synthetic oligonucleotide
tagaccagccagagtttgatgttcccctcaag

SEQ ID NO: 203063 - DNA, 31 bp, Artificial Sequence
  Description of Artificial Sequence: Synthetic oligonucleotide
agaccagccagagtttgatgttcccctcaag

SEQ ID NO: 203064 - DNA, 30 bp, Artificial Sequence
  Description of Artificial Sequence: Synthetic oligonucleotide
gaccagccagagtttgatgttcccctcaag

SEQ ID NO: 203065 - DNA, 30 bp, Artificial Sequence
  Description of Artificial Sequence: Synthetic oligonucleotide
accagccagagtttgatgttcccctcaagc

SEQ ID NO: 203066 - DNA, 29 bp, Artificial Sequence
  Description of Artificial Sequence: Synthetic oligonucleotide
ccagccagagtttgatgttcccctcaagc

SEQ ID NO: 203067 - DNA, 31 bp, Artificial Sequence
  Description of Artificial Sequence: Synthetic oligonucleotide
cagccagagtttgatgttcccctcaagcaag

SEQ ID NO: 203068 - DNA, 33 bp, Artificial Sequence
  Description of Artificial Sequence: Synthetic oligonucleotide
agccagagtttgatgttcccctcaagcaagatc

SEQ ID NO: 203069 - DNA, 32 bp, Artificial Sequence
  Description of Artificial Sequence: Synthetic oligonucleotide
gccagagtttgatgttcccctcaagcaagatc

SEQ ID NO: 203070 - DNA, 34 bp, Artificial Sequence
  Description of Artificial Sequence: Synthetic oligonucleotide
ccagagtttgatgttcccctcaagcaagatcaag

SEQ ID NO: 203071 - DNA, 36 bp, Artificial Sequence
  Description of Artificial Sequence: Synthetic oligonucleotide
cagagtttgatgttcccctcaagcaagatcaagaac

SEQ ID NO: 203072 - DNA, 37 bp, Artificial Sequence
  Description of Artificial Sequence: Synthetic oligonucleotide
agagtttgatgttcccctcaagcaagatcaagaacag

SEQ ID NO: 203073 - DNA, 36 bp, Artificial Sequence
  Description of Artificial Sequence: Synthetic oligonucleotide
gagtttgatgttcccctcaagcaagatcaagaacag

SEQ ID NO: 203074 - DNA, 38 bp, Artificial Sequence
  Description of Artificial Sequence: Synthetic oligonucleotide
agtttgatgttcccctcaagcaagatcaagaacagaag

SEQ ID NO: 203075 - DNA, 37 bp, Artificial Sequence
  Description of Artificial Sequence: Synthetic oligonucleotide
gtttgatgttcccctcaagcaagatcaagaacagaag

SEQ ID NO: 203076 - DNA, 39 bp, Artificial Sequence
  Description of Artificial Sequence: Synthetic oligonucleotide
tttgatgttcccctcaagcaagatcaagaacagaagatc

SEQ ID NO: 203077 - DNA, 38 bp, Artificial Sequence
  Description of Artificial Sequence: Synthetic oligonucleotide
ttgatgttcccctcaagcaagatcaagaacagaagatc

SEQ ID NO: 203078 - DNA, 37 bp, Artificial Sequence
  Description of Artificial Sequence: Synthetic oligonucleotide
tgatgttcccctcaagcaagatcaagaacagaagatc

SEQ ID NO: 203079 - DNA, 36 bp, Artificial Sequence
  Description of Artificial Sequence: Synthetic oligonucleotide
gatgttcccctcaagcaagatcaagaacagaagatc

SEQ ID NO: 203080 - DNA, 39 bp, Artificial Sequence
  Description of Artificial Sequence: Synthetic oligonucleotide
atgttcccctcaagcaagatcaagaacagaagatctatg

SEQ ID NO: 203081 - DNA, 38 bp, Artificial Sequence
  Description of Artificial Sequence: Synthetic oligonucleotide
tgttcccctcaagcaagatcaagaacagaagatctatg

SEQ ID NO: 203082 - DNA, 37 bp, Artificial Sequence
  Description of Artificial Sequence: Synthetic oligonucleotide
gttcccctcaagcaagatcaagaacagaagatctatg

SEQ ID NO: 203083 - DNA, 37 bp, Artificial Sequence
  Description of Artificial Sequence: Synthetic oligonucleotide
ttcccctcaagcaagatcaagaacagaagatctatgc

SEQ ID NO: 203084 - DNA, 36 bp, Artificial Sequence
  Description of Artificial Sequence: Synthetic oligonucleotide
tcccctcaagcaagatcaagaacagaagatctatgc

SEQ ID NO: 203085 - DNA, 35 bp, Artificial Sequence
  Description of Artificial Sequence: Synthetic oligonucleotide
cccctcaagcaagatcaagaacagaagatctatgc

SEQ ID NO: 203086 - DNA, 35 bp, Artificial Sequence
  Description of Artificial Sequence: Synthetic oligonucleotide
ccctcaagcaagatcaagaacagaagatctatgcc

SEQ ID NO: 203087 - DNA, 35 bp, Artificial Sequence
  Description of Artificial Sequence: Synthetic oligonucleotide
cctcaagcaagatcaagaacagaagatctatgccc

SEQ ID NO: 203088 - DNA, 36 bp, Artificial Sequence
  Description of Artificial Sequence: Synthetic oligonucleotide
ctcaagcaagatcaagaacagaagatctatgcccag

SEQ ID NO: 203089 - DNA, 38 bp, Artificial Sequence
  Description of Artificial Sequence: Synthetic oligonucleotide
tcaagcaagatcaagaacagaagatctatgcccagatc

SEQ ID NO: 203090 - DNA, 37 bp, Artificial Sequence
  Description of Artificial Sequence: Synthetic oligonucleotide
caagcaagatcaagaacagaagatctatgcccagatc

SEQ ID NO: 203091 - DNA, 40 bp, Artificial Sequence
  Description of Artificial Sequence: Synthetic oligonucleotide
aagcaagatcaagaacagaagatctatgcccagatctttc

SEQ ID NO: 203092 - DNA, 39 bp, Artificial Sequence
  Description of Artificial Sequence: Synthetic oligonucleotide
agcaagatcaagaacagaagatctatgcccagatctttc

SEQ ID NO: 203093 - DNA, 38 bp, Artificial Sequence
  Description of Artificial Sequence: Synthetic oligonucleotide
gcaagatcaagaacagaagatctatgcccagatctttc

SEQ ID NO: 203094 - DNA, 38 bp, Artificial Sequence
  Description of Artificial Sequence: Synthetic oligonucleotide
caagatcaagaacagaagatctatgcccagatctttcg

SEQ ID NO: 203095 - DNA, 38 bp, Artificial Sequence
  Description of Artificial Sequence: Synthetic oligonucleotide
aagatcaagaacagaagatctatgcccagatctttcgg

SEQ ID NO: 203096 - DNA, 37 bp, Artificial Sequence
  Description of Artificial Sequence: Synthetic oligonucleotide
agatcaagaacagaagatctatgcccagatctttcgg

SEQ ID NO: 203097 - DNA, 36 bp, Artificial Sequence
  Description of Artificial Sequence: Synthetic oligonucleotide
gatcaagaacagaagatctatgcccagatctttcgg

SEQ ID NO: 203098 - DNA, 36 bp, Artificial Sequence
  Description of Artificial Sequence: Synthetic oligonucleotide
atcaagaacagaagatctatgcccagatctttcggg

SEQ ID NO: 203099 - DNA, 35 bp, Artificial Sequence
  Description of Artificial Sequence: Synthetic oligonucleotide
tcaagaacagaagatctatgcccagatctttcggg

SEQ ID NO: 203100 - DNA, 34 bp, Artificial Sequence
  Description of Artificial Sequence: Synthetic oligonucleotide
caagaacagaagatctatgcccagatctttcggg

SEQ ID NO: 203101 - DNA, 38 bp, Artificial Sequence
  Description of Artificial Sequence: Synthetic oligonucleotide
aagaacagaagatctatgcccagatctttcgggaatac

SEQ ID NO: 203102 - DNA, 37 bp, Artificial Sequence
  Description of Artificial Sequence: Synthetic oligonucleotide
agaacagaagatctatgcccagatctttcgggaatac

SEQ ID NO: 203103 - DNA, 36 bp, Artificial Sequence
  Description of Artificial Sequence: Synthetic oligonucleotide
gaacagaagatctatgcccagatctttcgggaatac

SEQ ID NO: 203104 - DNA, 36 bp, Artificial Sequence
  Description of Artificial Sequence: Synthetic oligonucleotide
aacagaagatctatgcccagatctttcgggaatacc

SEQ ID NO: 203105 - DNA, 35 bp, Artificial Sequence
  Description of Artificial Sequence: Synthetic oligonucleotide
acagaagatctatgcccagatctttcgggaatacc

SEQ ID NO: 203106 - DNA, 34 bp, Artificial Sequence
  Description of Artificial Sequence: Synthetic oligonucleotide
cagaagatctatgcccagatctttcgggaatacc

SEQ ID NO: 203107 - DNA, 35 bp, Artificial Sequence
  Description of Artificial Sequence: Synthetic oligonucleotide
agaagatctatgcccagatctttcgggaatacctg

SEQ ID NO: 203108 - DNA, 34 bp, Artificial Sequence
  Description of Artificial Sequence: Synthetic oligonucleotide
gaagatctatgcccagatctttcgggaatacctg

SEQ ID NO: 203109 - DNA, 35 bp, Artificial Sequence
  Description of Artificial Sequence: Synthetic oligonucleotide
aagatctatgcccagatctttcgggaatacctgac

SEQ ID NO: 203110 - DNA, 34 bp, Artificial Sequence
  Description of Artificial Sequence: Synthetic oligonucleotide
agatctatgcccagatctttcgggaatacctgac

SEQ ID NO: 203111 - DNA, 33 bp, Artificial Sequence
  Description of Artificial Sequence: Synthetic oligonucleotide
gatctatgcccagatctttcgggaatacctgac

SEQ ID NO: 203112 - DNA, 36 bp, Artificial Sequence
  Description of Artificial Sequence: Synthetic oligonucleotide
atctatgcccagatctttcgggaatacctgacttac

SEQ ID NO: 203113 - DNA, 35 bp, Artificial Sequence
  Description of Artificial Sequence: Synthetic oligonucleotide
tctatgcccagatctttcgggaatacctgacttac

SEQ ID NO: 203114 - DNA, 34 bp, Artificial Sequence
  Description of Artificial Sequence: Synthetic oligonucleotide
ctatgcccagatctttcgggaatacctgacttac

SEQ ID NO: 203115 - DNA, 34 bp, Artificial Sequence
  Description of Artificial Sequence: Synthetic oligonucleotide
tatgcccagatctttcgggaatacctgacttacc

SEQ ID NO: 203116 - DNA, 33 bp, Artificial Sequence
  Description of Artificial Sequence: Synthetic oligonucleotide
atgcccagatctttcgggaatacctgacttacc

SEQ ID NO: 203117 - DNA, 32 bp, Artificial Sequence
  Description of Artificial Sequence: Synthetic oligonucleotide
tgcccagatctttcgggaatacctgacttacc

SEQ ID NO: 203118 - DNA, 31 bp, Artificial Sequence
  Description of Artificial Sequence: Synthetic oligonucleotide
gcccagatctttcgggaatacctgacttacc

SEQ ID NO: 203119 - DNA, 32 bp, Artificial Sequence
  Description of Artificial Sequence: Synthetic oligonucleotide
cccagatctttcgggaatacctgacttacctg

SEQ ID NO: 203120 - DNA, 35 bp, Artificial Sequence
  Description of Artificial Sequence: Synthetic oligonucleotide
ccagatctttcgggaatacctgacttacctgaatc

SEQ ID NO: 203121 - DNA, 36 bp, Artificial Sequence
  Description of Artificial Sequence: Synthetic oligonucleotide
cagatctttcgggaatacctgacttacctgaatcag

SEQ ID NO: 203122 - DNA, 36 bp, Artificial Sequence
  Description of Artificial Sequence: Synthetic oligonucleotide
agatctttcgggaatacctgacttacctgaatcagc

SEQ ID NO: 203123 - DNA, 35 bp, Artificial Sequence
  Description of Artificial Sequence: Synthetic oligonucleotide
gatctttcgggaatacctgacttacctgaatcagc

SEQ ID NO: 203124 - DNA, 36 bp, Artificial Sequence
  Description of Artificial Sequence: Synthetic oligonucleotide
atctttcgggaatacctgacttacctgaatcagctg

SEQ ID NO: 203125 - DNA, 35 bp, Artificial Sequence
  Description of Artificial Sequence: Synthetic oligonucleotide
tctttcgggaatacctgacttacctgaatcagctg

SEQ ID NO: 203126 - DNA, 34 bp, Artificial Sequence
  Description of Artificial Sequence: Synthetic oligonucleotide
ctttcgggaatacctgacttacctgaatcagctg

SEQ ID NO: 203127 - DNA, 34 bp, Artificial Sequence
  Description of Artificial Sequence: Synthetic oligonucleotide
tttcgggaatacctgacttacctgaatcagctgg

SEQ ID NO: 203128 - DNA, 33 bp, Artificial Sequence
  Description of Artificial Sequence: Synthetic oligonucleotide
ttcgggaatacctgacttacctgaatcagctgg

SEQ ID NO: 203129 - DNA, 32 bp, Artificial Sequence
  Description of Artificial Sequence: Synthetic oligonucleotide
tcgggaatacctgacttacctgaatcagctgg

SEQ ID NO: 203130 - DNA, 31 bp, Artificial Sequence
  Description of Artificial Sequence: Synthetic oligonucleotide
cgggaatacctgacttacctgaatcagctgg

SEQ ID NO: 203131 - DNA, 31 bp, Artificial Sequence
  Description of Artificial Sequence: Synthetic oligonucleotide
gggaatacctgacttacctgaatcagctggg

SEQ ID NO: 203132 - DNA, 33 bp, Artificial Sequence
  Description of Artificial Sequence: Synthetic oligonucleotide
ggaatacctgacttacctgaatcagctgggaac

SEQ ID NO: 203133 - DNA, 33 bp, Artificial Sequence
  Description of Artificial Sequence: Synthetic oligonucleotide
gaatacctgacttacctgaatcagctgggaacc

SEQ ID NO: 203134 - DNA, 35 bp, Artificial Sequence
  Description of Artificial Sequence: Synthetic oligonucleotide
aatacctgacttacctgaatcagctgggaaccttg

SEQ ID NO: 203135 - DNA, 34 bp, Artificial Sequence
  Description of Artificial Sequence: Synthetic oligonucleotide
atacctgacttacctgaatcagctgggaaccttg

SEQ ID NO: 203136 - DNA, 33 bp, Artificial Sequence
  Description of Artificial Sequence: Synthetic oligonucleotide
tacctgacttacctgaatcagctgggaaccttg

SEQ ID NO: 203137 - DNA, 32 bp, Artificial Sequence
  Description of Artificial Sequence: Synthetic oligonucleotide
acctgacttacctgaatcagctgggaaccttg

SEQ ID NO: 203138 - DNA, 31 bp, Artificial Sequence
  Description of Artificial Sequence: Synthetic oligonucleotide
cctgacttacctgaatcagctgggaaccttg

SEQ ID NO: 203139 - DNA, 31 bp, Artificial Sequence
  Description of Artificial Sequence: Synthetic oligonucleotide
ctgacttacctgaatcagctgggaaccttgc

SEQ ID NO: 203140 - DNA, 32 bp, Artificial Sequence
  Description of Artificial Sequence: Synthetic oligonucleotide
tgacttacctgaatcagctgggaaccttgctg

SEQ ID NO: 203141 - DNA, 31 bp, Artificial Sequence
  Description of Artificial Sequence: Synthetic oligonucleotide
gacttacctgaatcagctgggaaccttgctg

SEQ ID NO: 203142 - DNA, 31 bp, Artificial Sequence
  Description of Artificial Sequence: Synthetic oligonucleotide
acttacctgaatcagctgggaaccttgctgg

SEQ ID NO: 203143 - DNA, 30 bp, Artificial Sequence
  Description of Artificial Sequence: Synthetic oligonucleotide
cttacctgaatcagctgggaaccttgctgg

SEQ ID NO: 203144 - DNA, 30 bp, Artificial Sequence
  Description of Artificial Sequence: Synthetic oligonucleotide
ttacctgaatcagctgggaaccttgctggg

SEQ ID NO: 203145 - DNA, 29 bp, Artificial Sequence
  Description of Artificial Sequence: Synthetic oligonucleotide
tacctgaatcagctgggaaccttgctggg

SEQ ID NO: 203146 - DNA, 28 bp, Artificial Sequence
  Description of Artificial Sequence: Synthetic oligonucleotide
acctgaatcagctgggaaccttgctggg

SEQ ID NO: 203147 - DNA, 27 bp, Artificial Sequence
  Description of Artificial Sequence: Synthetic oligonucleotide
cctgaatcagctgggaaccttgctggg

SEQ ID NO: 203148 - DNA, 28 bp, Artificial Sequence
  Description of Artificial Sequence: Synthetic oligonucleotide
ctgaatcagctgggaaccttgctgggag

SEQ ID NO: 203149 - DNA, 28 bp, Artificial Sequence
  Description of Artificial Sequence: Synthetic oligonucleotide
tgaatcagctgggaaccttgctgggagg

SEQ ID NO: 203150 - DNA, 27 bp, Artificial Sequence
  Description of Artificial Sequence: Synthetic oligonucleotide
gaatcagctgggaaccttgctgggagg

SEQ ID NO: 203151 - DNA, 28 bp, Artificial Sequence
  Description of Artificial Sequence: Synthetic oligonucleotide
aatcagctgggaaccttgctgggaggag

SEQ ID NO: 203152 - DNA, 27 bp, Artificial Sequence
  Description of Artificial Sequence: Synthetic oligonucleotide
atcagctgggaaccttgctgggaggag

SEQ ID NO: 203153 - DNA, 27 bp, Artificial Sequence
  Description of Artificial Sequence: Synthetic oligonucleotide
tcagctgggaaccttgctgggaggaga

SEQ ID NO: 203154 - DNA, 26 bp, Artificial Sequence
  Description of Artificial Sequence: Synthetic oligonucleotide
cagctgggaaccttgctgggaggaga

SEQ ID NO: 203155 - DNA, 26 bp, Artificial Sequence
  Description of Artificial Sequence: Synthetic oligonucleotide
agctgggaaccttgctgggaggagac

SEQ ID NO: 203156 - DNA, 25 bp, Artificial Sequence
  Description of Artificial Sequence: Synthetic oligonucleotide
gctgggaaccttgctgggaggagac

SEQ ID NO: 203157 - DNA, 25 bp, Artificial Sequence
  Description of Artificial Sequence: Synthetic oligonucleotide
ctgggaaccttgctgggaggagacc

SEQ ID NO: 203158 - DNA, 27 bp, Artificial Sequence
  Description of Artificial Sequence: Synthetic oligonucleotide
tgggaaccttgctgggaggagacccaa

SEQ ID NO: 203159 - DNA, 26 bp, Artificial Sequence
  Description of Artificial Sequence: Synthetic oligonucleotide
gggaaccttgctgggaggagacccaa

SEQ ID NO: 203160 - DNA, 26 bp, Artificial Sequence
  Description of Artificial Sequence: Synthetic oligonucleotide
ggaaccttgctgggaggagacccaag

SEQ ID NO: 203161 - DNA, 27 bp, Artificial Sequence
  Description of Artificial Sequence: Synthetic oligonucleotide
gaaccttgctgggaggagacccaagca

SEQ ID NO: 203162 - DNA, 28 bp, Artificial Sequence
  Description of Artificial Sequence: Synthetic oligonucleotide
aaccttgctgggaggagacccaagcaag

SEQ ID NO: 203163 - DNA, 27 bp, Artificial Sequence
  Description of Artificial Sequence: Synthetic oligonucleotide
accttgctgggaggagacccaagcaag

SEQ ID NO: 203164 - DNA, 26 bp, Artificial Sequence
  Description of Artificial Sequence: Synthetic oligonucleotide
ccttgctgggaggagacccaagcaag

SEQ ID NO: 203165 - DNA, 27 bp, Artificial Sequence
  Description of Artificial Sequence: Synthetic oligonucleotide
cttgctgggaggagacccaagcaaggt

SEQ ID NO: 203166 - DNA, 27 bp, Artificial Sequence
  Description of Artificial Sequence: Synthetic oligonucleotide
ttgctgggaggagacccaagcaaggtg

SEQ ID NO: 203167 - DNA, 26 bp, Artificial Sequence
  Description of Artificial Sequence: Synthetic oligonucleotide
tgctgggaggagacccaagcaaggtg

SEQ ID NO: 203168 - DNA, 25 bp, Artificial Sequence
  Description of Artificial Sequence: Synthetic oligonucleotide
gctgggaggagacccaagcaaggtg

SEQ ID NO: 203169 - DNA, 27 bp, Artificial Sequence
  Description of Artificial Sequence: Synthetic oligonucleotide
ctgggaggagacccaagcaaggtgcaa

SEQ ID NO: 203170 - DNA, 27 bp, Artificial Sequence
  Description of Artificial Sequence: Synthetic oligonucleotide
tgggaggagacccaagcaaggtgcaag

SEQ ID NO: 203171 - DNA, 27 bp, Artificial Sequence
  Description of Artificial Sequence: Synthetic oligonucleotide
gggaggagacccaagcaaggtgcaaga

SEQ ID NO: 203172 - DNA, 28 bp, Artificial Sequence
  Description of Artificial Sequence: Synthetic oligonucleotide
ggaggagacccaagcaaggtgcaagaac

SEQ ID NO: 203173 - DNA, 29 bp, Artificial Sequence
  Description of Artificial Sequence: Synthetic oligonucleotide
gaggagacccaagcaaggtgcaagaacac

SEQ ID NO: 203174 - DNA, 30 bp, Artificial Sequence
  Description of Artificial Sequence: Synthetic oligonucleotide
aggagacccaagcaaggtgcaagaacactc

SEQ ID NO: 203175 - DNA, 29 bp, Artificial Sequence
  Description of Artificial Sequence: Synthetic oligonucleotide
ggagacccaagcaaggtgcaagaacactc

SEQ ID NO: 203176 - DNA, 31 bp, Artificial Sequence
  Description of Artificial Sequence: Synthetic oligonucleotide
gagacccaagcaaggtgcaagaacactcttc

SEQ ID NO: 203177 - DNA, 31 bp, Artificial Sequence
  Description of Artificial Sequence: Synthetic oligonucleotide
agacccaagcaaggtgcaagaacactcttcc

SEQ ID NO: 203178 - DNA, 30 bp, Artificial Sequence
  Description of Artificial Sequence: Synthetic oligonucleotide
gacccaagcaaggtgcaagaacactcttcc

SEQ ID NO: 203179 - DNA, 32 bp, Artificial Sequence
  Description of Artificial Sequence: Synthetic oligonucleotide
acccaagcaaggtgcaagaacactcttccttg

SEQ ID NO: 203180 - DNA, 31 bp, Artificial Sequence
  Description of Artificial Sequence: Synthetic oligonucleotide
cccaagcaaggtgcaagaacactcttccttg

SEQ ID NO: 203181 - DNA, 32 bp, Artificial Sequence
  Description of Artificial Sequence: Synthetic oligonucleotide
ccaagcaaggtgcaagaacactcttccttgtc

SEQ ID NO: 203182 - DNA, 35 bp, Artificial Sequence
  Description of Artificial Sequence: Synthetic oligonucleotide
caagcaaggtgcaagaacactcttccttgtcaatc

SEQ ID NO: 203183 - DNA, 36 bp, Artificial Sequence
  Description of Artificial Sequence: Synthetic oligonucleotide
aagcaaggtgcaagaacactcttccttgtcaatctc

SEQ ID NO: 203184 - DNA, 35 bp, Artificial Sequence
  Description of Artificial Sequence: Synthetic oligonucleotide
agcaaggtgcaagaacactcttccttgtcaatctc

SEQ ID NO: 203185 - DNA, 34 bp, Artificial Sequence
  Description of Artificial Sequence: Synthetic oligonucleotide
gcaaggtgcaagaacactcttccttgtcaatctc

SEQ ID NO: 203186 - DNA, 34 bp, Artificial Sequence
  Description of Artificial Sequence: Synthetic oligonucleotide
caaggtgcaagaacactcttccttgtcaatctcc

SEQ ID NO: 203187 - DNA, 36 bp, Artificial Sequence
  Description of Artificial Sequence: Synthetic oligonucleotide
aaggtgcaagaacactcttccttgtcaatctccatc

SEQ ID NO: 203188 - DNA, 35 bp, Artificial Sequence
  Description of Artificial Sequence: Synthetic oligonucleotide
aggtgcaagaacactcttccttgtcaatctccatc

SEQ ID NO: 203189 - DNA, 34 bp, Artificial Sequence
  Description of Artificial Sequence: Synthetic oligonucleotide
ggtgcaagaacactcttccttgtcaatctccatc

SEQ ID NO: 203190 - DNA, 35 bp, Artificial Sequence
  Description of Artificial Sequence: Synthetic oligonucleotide
gtgcaagaacactcttccttgtcaatctccatcac

SEQ ID NO: 203191 - DNA, 37 bp, Artificial Sequence
  Description of Artificial Sequence: Synthetic oligonucleotide
tgcaagaacactcttccttgtcaatctccatcacttc

SEQ ID NO: 203192 - DNA, 36 bp, Artificial Sequence
  Description of Artificial Sequence: Synthetic oligonucleotide
gcaagaacactcttccttgtcaatctccatcacttc

SEQ ID NO: 203193 - DNA, 37 bp, Artificial Sequence
  Description of Artificial Sequence: Synthetic oligonucleotide
caagaacactcttccttgtcaatctccatcacttcac

SEQ ID NO: 203194 - DNA, 37 bp, Artificial Sequence
  Description of Artificial Sequence: Synthetic oligonucleotide
aagaacactcttccttgtcaatctccatcacttcacg

SEQ ID NO: 203195 - DNA, 36 bp, Artificial Sequence
  Description of Artificial Sequence: Synthetic oligonucleotide
agaacactcttccttgtcaatctccatcacttcacg

SEQ ID NO: 203196 - DNA, 35 bp, Artificial Sequence
  Description of Artificial Sequence: Synthetic oligonucleotide
gaacactcttccttgtcaatctccatcacttcacg

SEQ ID NO: 203197 - DNA, 35 bp, Artificial Sequence
  Description of Artificial Sequence: Synthetic oligonucleotide
aacactcttccttgtcaatctccatcacttcacgg

SEQ ID NO: 203198 - DNA, 34 bp, Artificial Sequence
  Description of Artificial Sequence: Synthetic oligonucleotide
acactcttccttgtcaatctccatcacttcacgg

SEQ ID NO: 203199 - DNA, 33 bp, Artificial Sequence
  Description of Artificial Sequence: Synthetic oligonucleotide
cactcttccttgtcaatctccatcacttcacgg

SEQ ID NO: 203200 - DNA, 33 bp, Artificial Sequence
  Description of Artificial Sequence: Synthetic oligonucleotide
actcttccttgtcaatctccatcacttcacggc

SEQ ID NO: 203201 - DNA, 32 bp, Artificial Sequence
  Description of Artificial Sequence: Synthetic oligonucleotide
ctcttccttgtcaatctccatcacttcacggc

SEQ ID NO: 203202 - DNA, 33 bp, Artificial Sequence
  Description of Artificial Sequence: Synthetic oligonucleotide
tcttccttgtcaatctccatcacttcacggctg

SEQ ID NO: 203203 - DNA, 32 bp, Artificial Sequence
  Description of Artificial Sequence: Synthetic oligonucleotide
cttccttgtcaatctccatcacttcacggctg

SEQ ID NO: 203204 - DNA, 34 bp, Artificial Sequence
  Description of Artificial Sequence: Synthetic oligonucleotide
ttccttgtcaatctccatcacttcacggctgttc

SEQ ID NO: 203205 - DNA, 33 bp, Artificial Sequence
  Description of Artificial Sequence: Synthetic oligonucleotide
tccttgtcaatctccatcacttcacggctgttc

SEQ ID NO: 203206 - DNA, 32 bp, Artificial Sequence
  Description of Artificial Sequence: Synthetic oligonucleotide
ccttgtcaatctccatcacttcacggctgttc

SEQ ID NO: 203207 - DNA, 32 bp, Artificial Sequence
  Description of Artificial Sequence: Synthetic oligonucleotide
cttgtcaatctccatcacttcacggctgttcc

SEQ ID NO: 203208 - DNA, 33 bp, Artificial Sequence
  Description of Artificial Sequence: Synthetic oligonucleotide
ttgtcaatctccatcacttcacggctgttccag

SEQ ID NO: 203209 - DNA, 32 bp, Artificial Sequence
  Description of Artificial Sequence: Synthetic oligonucleotide
tgtcaatctccatcacttcacggctgttccag

SEQ ID NO: 203210 - DNA, 31 bp, Artificial Sequence
  Description of Artificial Sequence: Synthetic oligonucleotide
gtcaatctccatcacttcacggctgttccag

SEQ ID NO: 203211 - DNA, 34 bp, Artificial Sequence
  Description of Artificial Sequence: Synthetic oligonucleotide
tcaatctccatcacttcacggctgttccagtttc

SEQ ID NO: 203212 - DNA, 33 bp, Artificial Sequence
  Description of Artificial Sequence: Synthetic oligonucleotide
caatctccatcacttcacggctgttccagtttc

SEQ ID NO: 203213 - DNA, 34 bp, Artificial Sequence
  Description of Artificial Sequence: Synthetic oligonucleotide
aatctccatcacttcacggctgttccagtttctg

SEQ ID NO: 203214 - DNA, 33 bp, Artificial Sequence
  Description of Artificial Sequence: Synthetic oligonucleotide
atctccatcacttcacggctgttccagtttctg

SEQ ID NO: 203215 - DNA, 32 bp, Artificial Sequence
  Description of Artificial Sequence: Synthetic oligonucleotide
tctccatcacttcacggctgttccagtttctg

SEQ ID NO: 203216 - DNA, 31 bp, Artificial Sequence
  Description of Artificial Sequence: Synthetic oligonucleotide
ctccatcacttcacggctgttccagtttctg

SEQ ID NO: 203217 - DNA, 32 bp, Artificial Sequence
  Description of Artificial Sequence: Synthetic oligonucleotide
tccatcacttcacggctgttccagtttctgag

SEQ ID NO: 203218 - DNA, 31 bp, Artificial Sequence
  Description of Artificial Sequence: Synthetic oligonucleotide
ccatcacttcacggctgttccagtttctgag

SEQ ID NO: 203219 - DNA, 31 bp, Artificial Sequence
  Description of Artificial Sequence: Synthetic oligonucleotide
catcacttcacggctgttccagtttctgagg

SEQ ID NO: 203220 - DNA, 31 bp, Artificial Sequence
  Description of Artificial Sequence: Synthetic oligonucleotide
atcacttcacggctgttccagtttctgaggc

SEQ ID NO: 203221 - DNA, 30 bp, Artificial Sequence
  Description of Artificial Sequence: Synthetic oligonucleotide
tcacttcacggctgttccagtttctgaggc

SEQ ID NO: 203222 - DNA, 29 bp, Artificial Sequence
  Description of Artificial Sequence: Synthetic oligonucleotide
cacttcacggctgttccagtttctgaggc

SEQ ID NO: 203223 - DNA, 29 bp, Artificial Sequence
  Description of Artificial Sequence: Synthetic oligonucleotide
acttcacggctgttccagtttctgaggcc

SEQ ID NO: 203224 - DNA, 28 bp, Artificial Sequence
  Description of Artificial Sequence: Synthetic oligonucleotide
cttcacggctgttccagtttctgaggcc

SEQ ID NO: 203225 - DNA, 28 bp, Artificial Sequence
  Description of Artificial Sequence: Synthetic oligonucleotide
ttcacggctgttccagtttctgaggccc

SEQ ID NO: 203226 - DNA, 27 bp, Artificial Sequence
  Description of Artificial Sequence: Synthetic oligonucleotide
tcacggctgttccagtttctgaggccc

SEQ ID NO: 203227 - DNA, 26 bp, Artificial Sequence
  Description of Artificial Sequence: Synthetic oligonucleotide
cacggctgttccagtttctgaggccc

SEQ ID NO: 203228 - DNA, 27 bp, Artificial Sequence
  Description of Artificial Sequence: Synthetic oligonucleotide
acggctgttccagtttctgaggcccct

SEQ ID NO: 203229 - DNA, 26 bp, Artificial Sequence
  Description of Artificial Sequence: Synthetic oligonucleotide
cggctgttccagtttctgaggcccct

SEQ ID NO: 203230 - DNA, 26 bp, Artificial Sequence
  Description of Artificial Sequence: Synthetic oligonucleotide
ggctgttccagtttctgaggcccctg

SEQ ID NO: 203231 - DNA, 27 bp, Artificial Sequence
  Description of Artificial Sequence: Synthetic oligonucleotide
gctgttccagtttctgaggcccctgga

SEQ ID NO: 203232 - DNA, 27 bp, Artificial Sequence
  Description of Artificial Sequence: Synthetic oligonucleotide
ctgttccagtttctgaggcccctggag

SEQ ID NO: 203233 - DNA, 27 bp, Artificial Sequence
  Description of Artificial Sequence: Synthetic oligonucleotide
tgttccagtttctgaggcccctggagc

SEQ ID NO: 203234 - DNA, 27 bp, Artificial Sequence
  Description of Artificial Sequence: Synthetic oligonucleotide
gttccagtttctgaggcccctggagca

SEQ ID NO: 203235 - DNA, 27 bp, Artificial Sequence
  Description of Artificial Sequence: Synthetic oligonucleotide
ttccagtttctgaggcccctggagcag

SEQ ID NO: 203236 - DNA, 26 bp, Artificial Sequence
  Description of Artificial Sequence: Synthetic oligonucleotide
tccagtttctgaggcccctggagcag

SEQ ID NO: 203237 - DNA, 25 bp, Artificial Sequence
  Description of Artificial Sequence: Synthetic oligonucleotide
ccagtttctgaggcccctggagcag

SEQ ID NO: 203238 - DNA, 25 bp, Artificial Sequence
  Description of Artificial Sequence: Synthetic oligonucleotide
cagtttctgaggcccctggagcagc

SEQ ID NO: 203239 - DNA, 25 bp, Artificial Sequence
  Description of Artificial Sequence: Synthetic oligonucleotide
agtttctgaggcccctggagcagcg

SEQ ID NO: 203240 - DNA, 24 bp, Artificial Sequence
  Description of Artificial Sequence: Synthetic oligonucleotide
gtttctgaggcccctggagcagcg

SEQ ID NO: 203241 - DNA, 24 bp, Artificial Sequence
  Description of Artificial Sequence: Synthetic oligonucleotide
tttctgaggcccctggagcagcgg

SEQ ID NO: 203242 - DNA, 23 bp, Artificial Sequence
  Description of Artificial Sequence: Synthetic oligonucleotide
ttctgaggcccctggagcagcgg

SEQ ID NO: 203243 - DNA, 22 bp, Artificial Sequence
  Description of Artificial Sequence: Synthetic oligonucleotide
tctgaggcccctggagcagcgg

SEQ ID NO: 203244 - DNA, 21 bp, Artificial Sequence
  Description of Artificial Sequence: Synthetic oligonucleotide
ctgaggcccctggagcagcgg

SEQ ID NO: 203245 - DNA, 21 bp, Artificial Sequence
  Description of Artificial Sequence: Synthetic oligonucleotide
tgaggcccctggagcagcggc

SEQ ID NO: 203246 - DNA, 20 bp, Artificial Sequence
  Description of Artificial Sequence: Synthetic oligonucleotide
gaggcccctggagcagcggc

SEQ ID NO: 203247 - DNA, 20 bp, Artificial Sequence
  Description of Artificial Sequence: Synthetic oligonucleotide
aggcccctggagcagcggcg

SEQ ID NO: 203248 - DNA, 20 bp, Artificial Sequence
  Description of Artificial Sequence: Synthetic oligonucleotide
ggcccctggagcagcggcgt

SEQ ID NO: 203249 - DNA, 20 bp, Artificial Sequence
  Description of Artificial Sequence: Synthetic oligonucleotide
gcccctggagcagcggcggt

SEQ ID NO: 203250 - DNA, 20 bp, Artificial Sequence
  Description of Artificial Sequence: Synthetic oligonucleotide
cccctggagcagcggcgggt

SEQ ID NO: 203251 - DNA, 20 bp, Artificial Sequence
  Description of Artificial Sequence: Synthetic oligonucleotide
ccctggagcagcggcgggca

SEQ ID NO: 203252 - DNA, 21 bp, Artificial Sequence
  Description of Artificial Sequence: Synthetic oligonucleotide
cctggagcagcggcgggcaca

SEQ ID NO: 203253 - DNA, 21 bp, Artificial Sequence
  Description of Artificial Sequence: Synthetic oligonucleotide
ctggagcagcggcgggcacag

SEQ ID NO: 203254 - DNA, 21 bp, Artificial Sequence
  Description of Artificial Sequence: Synthetic oligonucleotide
tggagcagcggcgggcacagg

SEQ ID NO: 203255 - DNA, 20 bp, Artificial Sequence
  Description of Artificial Sequence: Synthetic oligonucleotide
ggagcagcggcgggcacagg

SEQ ID NO: 203256 - DNA, 20 bp, Artificial Sequence
  Description of Artificial Sequence: Synthetic oligonucleotide
gagcagcggcgggcacaggg

SEQ ID NO: 203257 - DNA, 22 bp, Artificial Sequence
  Description of Artificial Sequence: Synthetic oligonucleotide
agcagcggcgggcacagggcaa

SEQ ID NO: 203258 - DNA, 21 bp, Artificial Sequence
  Description of Artificial Sequence: Synthetic oligonucleotide
gcagcggcgggcacagggcaa

SEQ ID NO: 203259 - DNA, 21 bp, Artificial Sequence
  Description of Artificial Sequence: Synthetic oligonucleotide
cagcggcgggcacagggcaag

SEQ ID NO: 203260 - DNA, 22 bp, Artificial Sequence
  Description of Artificial Sequence: Synthetic oligonucleotide
agcggcgggcacagggcaagct

SEQ ID NO: 203261 - DNA, 21 bp, Artificial Sequence
  Description of Artificial Sequence: Synthetic oligonucleotide
gcggcgggcacagggcaagct

SEQ ID NO: 203262 - DNA, 23 bp, Artificial Sequence
  Description of Artificial Sequence: Synthetic oligonucleotide
cggcgggcacagggcaagctctt

SEQ ID NO: 203263 - DNA, 23 bp, Artificial Sequence
  Description of Artificial Sequence: Synthetic oligonucleotide
ggcgggcacagggcaagctcttc

SEQ ID NO: 203264 - DNA, 24 bp, Artificial Sequence
  Description of Artificial Sequence: Synthetic oligonucleotide
gcgggcacagggcaagctcttcca

SEQ ID NO: 203265 - DNA, 26 bp, Artificial Sequence
  Description of Artificial Sequence: Synthetic oligonucleotide
cgggcacagggcaagctcttccagat

SEQ ID NO: 203266 - DNA, 26 bp, Artificial Sequence
  Description of Artificial Sequence: Synthetic oligonucleotide
gggcacagggcaagctcttccagatg

SEQ ID NO: 203267 - DNA, 27 bp, Artificial Sequence
  Description of Artificial Sequence: Synthetic oligonucleotide
ggcacagggcaagctcttccagatggt

SEQ ID NO: 203268 - DNA, 27 bp, Artificial Sequence
  Description of Artificial Sequence: Synthetic oligonucleotide
gcacagggcaagctcttccagatggtc

SEQ ID NO: 203269 - DNA, 28 bp, Artificial Sequence
  Description of Artificial Sequence: Synthetic oligonucleotide
cacagggcaagctcttccagatggtcac

SEQ ID NO: 203270 - DNA, 31 bp, Artificial Sequence
  Description of Artificial Sequence: Synthetic oligonucleotide
acagggcaagctcttccagatggtcactatc

SEQ ID NO: 203271 - DNA, 30 bp, Artificial Sequence
  Description of Artificial Sequence: Synthetic oligonucleotide
cagggcaagctcttccagatggtcactatc

SEQ ID NO: 203272 - DNA, 30 bp, Artificial Sequence
  Description of Artificial Sequence: Synthetic oligonucleotide
agggcaagctcttccagatggtcactatcg

SEQ ID NO: 203273 - DNA, 29 bp, Artificial Sequence
  Description of Artificial Sequence: Synthetic oligonucleotide
gggcaagctcttccagatggtcactatcg

SEQ ID NO: 203274 - DNA, 30 bp, Artificial Sequence
  Description of Artificial Sequence: Synthetic oligonucleotide
ggcaagctcttccagatggtcactatcgac

SEQ ID NO: 203275 - DNA, 30 bp, Artificial Sequence
  Description of Artificial Sequence: Synthetic oligonucleotide
gcaagctcttccagatggtcactatcgacc

SEQ ID NO: 203276 - DNA, 31 bp, Artificial Sequence
  Description of Artificial Sequence: Synthetic oligonucleotide
caagctcttccagatggtcactatcgaccag

SEQ ID NO: 203277 - DNA, 31 bp, Artificial Sequence
  Description of Artificial Sequence: Synthetic oligonucleotide
aagctcttccagatggtcactatcgaccagc

SEQ ID NO: 203278 - DNA, 30 bp, Artificial Sequence
  Description of Artificial Sequence: Synthetic oligonucleotide
agctcttccagatggtcactatcgaccagc

SEQ ID NO: 203279 - DNA, 29 bp, Artificial Sequence
  Description of Artificial Sequence: Synthetic oligonucleotide
gctcttccagatggtcactatcgaccagc

SEQ ID NO: 203280 - DNA, 30 bp, Artificial Sequence
  Description of Artificial Sequence: Synthetic oligonucleotide
ctcttccagatggtcactatcgaccagctc

SEQ ID NO: 203281 - DNA, 32 bp, Artificial Sequence
  Description of Artificial Sequence: Synthetic oligonucleotide
tcttccagatggtcactatcgaccagctcaag

SEQ ID NO: 203282 - DNA, 31 bp, Artificial Sequence
  Description of Artificial Sequence: Synthetic oligonucleotide
cttccagatggtcactatcgaccagctcaag

SEQ ID NO: 203283 - DNA, 31 bp, Artificial Sequence
  Description of Artificial Sequence: Synthetic oligonucleotide
ttccagatggtcactatcgaccagctcaagg

SEQ ID NO: 203284 - DNA, 30 bp, Artificial Sequence
  Description of Artificial Sequence: Synthetic oligonucleotide
tccagatggtcactatcgaccagctcaagg

SEQ ID NO: 203285 - DNA, 29 bp, Artificial Sequence
  Description of Artificial Sequence: Synthetic oligonucleotide
ccagatggtcactatcgaccagctcaagg

SEQ ID NO: 203286 - DNA, 33 bp, Artificial Sequence
  Description of Artificial Sequence: Synthetic oligonucleotide
cagatggtcactatcgaccagctcaaggaaatg

SEQ ID NO: 203287 - DNA, 33 bp, Artificial Sequence
  Description of Artificial Sequence: Synthetic oligonucleotide
agatggtcactatcgaccagctcaaggaaatgg

SEQ ID NO: 203288 - DNA, 32 bp, Artificial Sequence
  Description of Artificial Sequence: Synthetic oligonucleotide
gatggtcactatcgaccagctcaaggaaatgg

SEQ ID NO: 203289 - DNA, 32 bp, Artificial Sequence
  Description of Artificial Sequence: Synthetic oligonucleotide
atggtcactatcgaccagctcaaggaaatggc

SEQ ID NO: 203290 - DNA, 31 bp, Artificial Sequence
  Description of Artificial Sequence: Synthetic oligonucleotide
tggtcactatcgaccagctcaaggaaatggc

SEQ ID NO: 203291 - DNA, 30 bp, Artificial Sequence
  Description of Artificial Sequence: Synthetic oligonucleotide
ggtcactatcgaccagctcaaggaaatggc

SEQ ID NO: 203292 - DNA, 30 bp, Artificial Sequence
  Description of Artificial Sequence: Synthetic oligonucleotide
gtcactatcgaccagctcaaggaaatggcc

SEQ ID NO: 203293 - DNA, 30 bp, Artificial Sequence
  Description of Artificial Sequence: Synthetic oligonucleotide
tcactatcgaccagctcaaggaaatggccc

SEQ ID NO: 203294 - DNA, 29 bp, Artificial Sequence
  Description of Artificial Sequence: Synthetic oligonucleotide
cactatcgaccagctcaaggaaatggccc

SEQ ID NO: 203295 - DNA, 29 bp, Artificial Sequence
  Description of Artificial Sequence: Synthetic oligonucleotide
actatcgaccagctcaaggaaatggcccc

SEQ ID NO: 203296 - DNA, 28 bp, Artificial Sequence
  Description of Artificial Sequence: Synthetic oligonucleotide
ctatcgaccagctcaaggaaatggcccc

SEQ ID NO: 203297 - DNA, 28 bp, Artificial Sequence
  Description of Artificial Sequence: Synthetic oligonucleotide
tatcgaccagctcaaggaaatggccccc

SEQ ID NO: 203298 - DNA, 27 bp, Artificial Sequence
  Description of Artificial Sequence: Synthetic oligonucleotide
atcgaccagctcaaggaaatggccccc

SEQ ID NO: 203299 - DNA, 26 bp, Artificial Sequence
  Description of Artificial Sequence: Synthetic oligonucleotide
tcgaccagctcaaggaaatggccccc

SEQ ID NO: 203300 - DNA, 25 bp, Artificial Sequence
  Description of Artificial Sequence: Synthetic oligonucleotide
cgaccagctcaaggaaatggccccc

SEQ ID NO: 203301 - DNA, 25 bp, Artificial Sequence
  Description of Artificial Sequence: Synthetic oligonucleotide
gaccagctcaaggaaatggcccccg

SEQ ID NO: 203302 - DNA, 25 bp, Artificial Sequence
  Description of Artificial Sequence: Synthetic oligonucleotide
accagctcaaggaaatggcccccgc

SEQ ID NO: 203303 - DNA, 24 bp, Artificial Sequence
  Description of Artificial Sequence: Synthetic oligonucleotide
ccagctcaaggaaatggcccccgc

SEQ ID NO: 203304 - DNA, 26 bp, Artificial Sequence
  Description of Artificial Sequence: Synthetic oligonucleotide
cagctcaaggaaatggcccccgccat

SEQ ID NO: 203305 - DNA, 26 bp, Artificial Sequence
  Description of Artificial Sequence: Synthetic oligonucleotide
agctcaaggaaatggcccccgccatc

SEQ ID NO: 203306 - DNA, 25 bp, Artificial Sequence
  Description of Artificial Sequence: Synthetic oligonucleotide
gctcaaggaaatggcccccgccatc

SEQ ID NO: 203307 - DNA, 26 bp, Artificial Sequence
  Description of Artificial Sequence: Synthetic oligonucleotide
ctcaaggaaatggcccccgccatcga

SEQ ID NO: 203308 - DNA, 27 bp, Artificial Sequence
  Description of Artificial Sequence: Synthetic oligonucleotide
tcaaggaaatggcccccgccatcgact

SEQ ID NO: 203309 - DNA, 26 bp, Artificial Sequence
  Description of Artificial Sequence: Synthetic oligonucleotide
caaggaaatggcccccgccatcgact

SEQ ID NO: 203310 - DNA, 26 bp, Artificial Sequence
  Description of Artificial Sequence: Synthetic oligonucleotide
aaggaaatggcccccgccatcgactg

SEQ ID NO: 203311 - DNA, 25 bp, Artificial Sequence
  Description of Artificial Sequence: Synthetic oligonucleotide
aggaaatggcccccgccatcgactg

SEQ ID NO: 203312 - DNA, 24 bp, Artificial Sequence
  Description of Artificial Sequence: Synthetic oligonucleotide
ggaaatggcccccgccatcgactg

SEQ ID NO: 203313 - DNA, 26 bp, Artificial Sequence
  Description of Artificial Sequence: Synthetic oligonucleotide
gaaatggcccccgccatcgactggtt

SEQ ID NO: 203314 - DNA, 27 bp, Artificial Sequence
  Description of Artificial Sequence: Synthetic oligonucleotide
aaatggcccccgccatcgactggttgt

SEQ ID NO: 203315 - DNA, 26 bp, Artificial Sequence
  Description of Artificial Sequence: Synthetic oligonucleotide
aatggcccccgccatcgactggttgt

SEQ ID NO: 203316 - DNA, 25 bp, Artificial Sequence
  Description of Artificial Sequence: Synthetic oligonucleotide
atggcccccgccatcgactggttgt

SEQ ID NO: 203317 - DNA, 24 bp, Artificial Sequence
  Description of Artificial Sequence: Synthetic oligonucleotide
tggcccccgccatcgactggttgt

SEQ ID NO: 203318 - DNA, 23 bp, Artificial Sequence
  Description of Artificial Sequence: Synthetic oligonucleotide
ggcccccgccatcgactggttgt

SEQ ID NO: 203319 - DNA, 23 bp, Artificial Sequence
  Description of Artificial Sequence: Synthetic oligonucleotide
gcccccgccatcgactggttgtc

SEQ ID NO: 203320 - DNA, 24 bp, Artificial Sequence
  Description of Artificial Sequence: Synthetic oligonucleotide
cccccgccatcgactggttgtcct

SEQ ID NO: 203321 - DNA, 24 bp, Artificial Sequence
  Description of Artificial Sequence: Synthetic oligonucleotide
ccccgccatcgactggttgtcctg

SEQ ID NO: 203322 - DNA, 26 bp, Artificial Sequence
  Description of Artificial Sequence: Synthetic oligonucleotide
cccgccatcgactggttgtcctgctt

SEQ ID NO: 203323 - DNA, 26 bp, Artificial Sequence
  Description of Artificial Sequence: Synthetic oligonucleotide
ccgccatcgactggttgtcctgcttg

SEQ ID NO: 203324 - DNA, 27 bp, Artificial Sequence
  Description of Artificial Sequence: Synthetic oligonucleotide
cgccatcgactggttgtcctgcttgca

SEQ ID NO: 203325 - DNA, 28 bp, Artificial Sequence
  Description of Artificial Sequence: Synthetic oligonucleotide
gccatcgactggttgtcctgcttgcaag

SEQ ID NO: 203326 - DNA, 28 bp, Artificial Sequence
  Description of Artificial Sequence: Synthetic oligonucleotide
ccatcgactggttgtcctgcttgcaagc

SEQ ID NO: 203327 - DNA, 28 bp, Artificial Sequence
  Description of Artificial Sequence: Synthetic oligonucleotide
catcgactggttgtcctgcttgcaagcg

SEQ ID NO: 203328 - DNA, 29 bp, Artificial Sequence
  Description of Artificial Sequence: Synthetic oligonucleotide
atcgactggttgtcctgcttgcaagcgac

SEQ ID NO: 203329 - DNA, 28 bp, Artificial Sequence
  Description of Artificial Sequence: Synthetic oligonucleotide
tcgactggttgtcctgcttgcaagcgac

SEQ ID NO: 203330 - DNA, 27 bp, Artificial Sequence
  Description of Artificial Sequence: Synthetic oligonucleotide
cgactggttgtcctgcttgcaagcgac

SEQ ID NO: 203331 - DNA, 30 bp, Artificial Sequence
  Description of Artificial Sequence: Synthetic oligonucleotide
gactggttgtcctgcttgcaagcgacattc

SEQ ID NO: 203332 - DNA, 31 bp, Artificial Sequence
  Description of Artificial Sequence: Synthetic oligonucleotide
actggttgtcctgcttgcaagcgacattcac

SEQ ID NO: 203333 - DNA, 30 bp, Artificial Sequence
  Description of Artificial Sequence: Synthetic oligonucleotide
ctggttgtcctgcttgcaagcgacattcac

SEQ ID NO: 203334 - DNA, 31 bp, Artificial Sequence
  Description of Artificial Sequence: Synthetic oligonucleotide
tggttgtcctgcttgcaagcgacattcacac

SEQ ID NO: 203335 - DNA, 30 bp, Artificial Sequence
  Description of Artificial Sequence: Synthetic oligonucleotide
ggttgtcctgcttgcaagcgacattcacac

SEQ ID NO: 203336 - DNA, 30 bp, Artificial Sequence
  Description of Artificial Sequence: Synthetic oligonucleotide
gttgtcctgcttgcaagcgacattcacacc

SEQ ID NO: 203337 - DNA, 30 bp, Artificial Sequence
  Description of Artificial Sequence: Synthetic oligonucleotide
ttgtcctgcttgcaagcgacattcacaccg

SEQ ID NO: 203338 - DNA, 29 bp, Artificial Sequence
  Description of Artificial Sequence: Synthetic oligonucleotide
tgtcctgcttgcaagcgacattcacaccg

SEQ ID NO: 203339 - DNA, 28 bp, Artificial Sequence
  Description of Artificial Sequence: Synthetic oligonucleotide
gtcctgcttgcaagcgacattcacaccg

SEQ ID NO: 203340 - DNA, 30 bp, Artificial Sequence
  Description of Artificial Sequence: Synthetic oligonucleotide
tcctgcttgcaagcgacattcacaccgatg

SEQ ID NO: 203341 - DNA, 29 bp, Artificial Sequence
  Description of Artificial Sequence: Synthetic oligonucleotide
cctgcttgcaagcgacattcacaccgatg

SEQ ID NO: 203342 - DNA, 30 bp, Artificial Sequence
  Description of Artificial Sequence: Synthetic oligonucleotide
ctgcttgcaagcgacattcacaccgatgtc

SEQ ID NO: 203343 - DNA, 30 bp, Artificial Sequence
  Description of Artificial Sequence: Synthetic oligonucleotide
tgcttgcaagcgacattcacaccgatgtcc

SEQ ID NO: 203344 - DNA, 29 bp, Artificial Sequence
  Description of Artificial Sequence: Synthetic oligonucleotide
gcttgcaagcgacattcacaccgatgtcc

SEQ ID NO: 203345 - DNA, 29 bp, Artificial Sequence
  Description of Artificial Sequence: Synthetic oligonucleotide
cttgcaagcgacattcacaccgatgtccc

SEQ ID NO: 203346 - DNA, 30 bp, Artificial Sequence
  Description of Artificial Sequence: Synthetic oligonucleotide
ttgcaagcgacattcacaccgatgtccctg

SEQ ID NO: 203347 - DNA, 29 bp, Artificial Sequence
  Description of Artificial Sequence: Synthetic oligonucleotide
tgcaagcgacattcacaccgatgtccctg

SEQ ID NO: 203348 - DNA, 28 bp, Artificial Sequence
  Description of Artificial Sequence: Synthetic oligonucleotide
gcaagcgacattcacaccgatgtccctg

SEQ ID NO: 203349 - DNA, 29 bp, Artificial Sequence
  Description of Artificial Sequence: Synthetic oligonucleotide
caagcgacattcacaccgatgtccctgag

SEQ ID NO: 203350 - DNA, 29 bp, Artificial Sequence
  Description of Artificial Sequence: Synthetic oligonucleotide
aagcgacattcacaccgatgtccctgagc

SEQ ID NO: 203351 - DNA, 28 bp, Artificial Sequence
  Description of Artificial Sequence: Synthetic oligonucleotide
agcgacattcacaccgatgtccctgagc

SEQ ID NO: 203352 - DNA, 27 bp, Artificial Sequence
  Description of Artificial Sequence: Synthetic oligonucleotide
gcgacattcacaccgatgtccctgagc

SEQ ID NO: 203353 - DNA, 27 bp, Artificial Sequence
  Description of Artificial Sequence: Synthetic oligonucleotide
cgacattcacaccgatgtccctgagcc

SEQ ID NO: 203354 - DNA, 27 bp, Artificial Sequence
  Description of Artificial Sequence: Synthetic oligonucleotide
gacattcacaccgatgtccctgagccc

SEQ ID NO: 203355 - DNA, 29 bp, Artificial Sequence
  Description of Artificial Sequence: Synthetic oligonucleotide
acattcacaccgatgtccctgagcccttc

SEQ ID NO: 203356 - DNA, 28 bp, Artificial Sequence
  Description of Artificial Sequence: Synthetic oligonucleotide
cattcacaccgatgtccctgagcccttc

SEQ ID NO: 203357 - DNA, 29 bp, Artificial Sequence
  Description of Artificial Sequence: Synthetic oligonucleotide
attcacaccgatgtccctgagcccttctc

SEQ ID NO: 203358 - DNA, 28 bp, Artificial Sequence
  Description of Artificial Sequence: Synthetic oligonucleotide
ttcacaccgatgtccctgagcccttctc

SEQ ID NO: 203359 - DNA, 27 bp, Artificial Sequence
  Description of Artificial Sequence: Synthetic oligonucleotide
tcacaccgatgtccctgagcccttctc

SEQ ID NO: 203360 - DNA, 27 bp, Artificial Sequence
  Description of Artificial Sequence: Synthetic oligonucleotide
cacaccgatgtccctgagcccttctca

SEQ ID NO: 203361 - DNA, 27 bp, Artificial Sequence
  Description of Artificial Sequence: Synthetic oligonucleotide
acaccgatgtccctgagcccttctcag

SEQ ID NO: 203362 - DNA, 27 bp, Artificial Sequence
  Description of Artificial Sequence: Synthetic oligonucleotide
caccgatgtccctgagcccttctcagt

SEQ ID NO: 203363 - DNA, 27 bp, Artificial Sequence
  Description of Artificial Sequence: Synthetic oligonucleotide
accgatgtccctgagcccttctcagtc

SEQ ID NO: 203364 - DNA, 26 bp, Artificial Sequence
  Description of Artificial Sequence: Synthetic oligonucleotide
ccgatgtccctgagcccttctcagtc

SEQ ID NO: 203365 - DNA, 26 bp, Artificial Sequence
  Description of Artificial Sequence: Synthetic oligonucleotide
cgatgtccctgagcccttctcagtcc

SEQ ID NO: 203366 - DNA, 27 bp, Artificial Sequence
  Description of Artificial Sequence: Synthetic oligonucleotide
gatgtccctgagcccttctcagtccct

SEQ ID NO: 203367 - DNA, 27 bp, Artificial Sequence
  Description of Artificial Sequence: Synthetic oligonucleotide
atgtccctgagcccttctcagtccctc

SEQ ID NO: 203368 - DNA, 26 bp, Artificial Sequence
  Description of Artificial Sequence: Synthetic oligonucleotide
tgtccctgagcccttctcagtccctc

SEQ ID NO: 203369 - DNA, 25 bp, Artificial Sequence
  Description of Artificial Sequence: Synthetic oligonucleotide
gtccctgagcccttctcagtccctc

SEQ ID NO: 203370 - DNA, 26 bp, Artificial Sequence
  Description of Artificial Sequence: Synthetic oligonucleotide
tccctgagcccttctcagtccctcgt

SEQ ID NO: 203371 - DNA, 25 bp, Artificial Sequence
  Description of Artificial Sequence: Synthetic oligonucleotide
ccctgagcccttctcagtccctcgt

SEQ ID NO: 203372 - DNA, 25 bp, Artificial Sequence
  Description of Artificial Sequence: Synthetic oligonucleotide
cctgagcccttctcagtccctcgtg

SEQ ID NO: 203373 - DNA, 26 bp, Artificial Sequence
  Description of Artificial Sequence: Synthetic oligonucleotide
ctgagcccttctcagtccctcgtggt

SEQ ID NO: 203374 - DNA, 26 bp, Artificial Sequence
  Description of Artificial Sequence: Synthetic oligonucleotide
tgagcccttctcagtccctcgtggtc

SEQ ID NO: 203375 - DNA, 25 bp, Artificial Sequence
  Description of Artificial Sequence: Synthetic oligonucleotide
gagcccttctcagtccctcgtggtc

SEQ ID NO: 203376 - DNA, 27 bp, Artificial Sequence
  Description of Artificial Sequence: Synthetic oligonucleotide
agcccttctcagtccctcgtggtccat

SEQ ID NO: 203377 - DNA, 26 bp, Artificial Sequence
  Description of Artificial Sequence: Synthetic oligonucleotide
gcccttctcagtccctcgtggtccat

SEQ ID NO: 203378 - DNA, 27 bp, Artificial Sequence
  Description of Artificial Sequence: Synthetic oligonucleotide
cccttctcagtccctcgtggtccatga

SEQ ID NO: 203379 - DNA, 27 bp, Artificial Sequence
  Description of Artificial Sequence: Synthetic oligonucleotide
ccttctcagtccctcgtggtccatgac

SEQ ID NO: 203380 - DNA, 27 bp, Artificial Sequence
  Description of Artificial Sequence: Synthetic oligonucleotide
cttctcagtccctcgtggtccatgacg

SEQ ID NO: 203381 - DNA, 28 bp, Artificial Sequence
  Description of Artificial Sequence: Synthetic oligonucleotide
ttctcagtccctcgtggtccatgacgtg

SEQ ID NO: 203382 - DNA, 27 bp, Artificial Sequence
  Description of Artificial Sequence: Synthetic oligonucleotide
tctcagtccctcgtggtccatgacgtg

SEQ ID NO: 203383 - DNA, 26 bp, Artificial Sequence
  Description of Artificial Sequence: Synthetic oligonucleotide
ctcagtccctcgtggtccatgacgtg

SEQ ID NO: 203384 - DNA, 27 bp, Artificial Sequence
  Description of Artificial Sequence: Synthetic oligonucleotide
tcagtccctcgtggtccatgacgtgga

SEQ ID NO: 203385 - DNA, 27 bp, Artificial Sequence
  Description of Artificial Sequence: Synthetic oligonucleotide
cagtccctcgtggtccatgacgtggaa

SEQ ID NO: 203386 - DNA, 32 bp, Artificial Sequence
  Description of Artificial Sequence: Synthetic oligonucleotide
agtccctcgtggtccatgacgtggaatatttg

SEQ ID NO: 203387 - DNA, 31 bp, Artificial Sequence
  Description of Artificial Sequence: Synthetic oligonucleotide
gtccctcgtggtccatgacgtggaatatttg

SEQ ID NO: 203388 - DNA, 36 bp, Artificial Sequence
  Description of Artificial Sequence: Synthetic oligonucleotide
tccctcgtggtccatgacgtggaatatttgaaaaac

SEQ ID NO: 203389 - DNA, 35 bp, Artificial Sequence
  Description of Artificial Sequence: Synthetic oligonucleotide
ccctcgtggtccatgacgtggaatatttgaaaaac

SEQ ID NO: 203390 - DNA, 37 bp, Artificial Sequence
  Description of Artificial Sequence: Synthetic oligonucleotide
cctcgtggtccatgacgtggaatatttgaaaaacatg

SEQ ID NO: 203391 - DNA, 38 bp, Artificial Sequence
  Description of Artificial Sequence: Synthetic oligonucleotide
ctcgtggtccatgacgtggaatatttgaaaaacatgtc

SEQ ID NO: 203392 - DNA, 39 bp, Artificial Sequence
  Description of Artificial Sequence: Synthetic oligonucleotide
tcgtggtccatgacgtggaatatttgaaaaacatgtcac

SEQ ID NO: 203393 - DNA, 38 bp, Artificial Sequence
  Description of Artificial Sequence: Synthetic oligonucleotide
cgtggtccatgacgtggaatatttgaaaaacatgtcac

SEQ ID NO: 203394 - DNA, 40 bp, Artificial Sequence
  Description of Artificial Sequence: Synthetic oligonucleotide
gtggtccatgacgtggaatatttgaaaaacatgtcacaac

SEQ ID NO: 203395 - DNA, 41 bp, Artificial Sequence
  Description of Artificial Sequence: Synthetic oligonucleotide
tggtccatgacgtggaatatttgaaaaacatgtcacaactg

SEQ ID NO: 203396 - DNA, 40 bp, Artificial Sequence
  Description of Artificial Sequence: Synthetic oligonucleotide
ggtccatgacgtggaatatttgaaaaacatgtcacaactg

SEQ ID NO: 203397 - DNA, 40 bp, Artificial Sequence
  Description of Artificial Sequence: Synthetic oligonucleotide
gtccatgacgtggaatatttgaaaaacatgtcacaactgg

SEQ ID NO: 203398 - DNA, 41 bp, Artificial Sequence
  Description of Artificial Sequence: Synthetic oligonucleotide
tccatgacgtggaatatttgaaaaacatgtcacaactggtg

SEQ ID NO: 203399 - DNA, 40 bp, Artificial Sequence
  Description of Artificial Sequence: Synthetic oligonucleotide
ccatgacgtggaatatttgaaaaacatgtcacaactggtg

SEQ ID NO: 203400 - DNA, 40 bp, Artificial Sequence
  Description of Artificial Sequence: Synthetic oligonucleotide
catgacgtggaatatttgaaaaacatgtcacaactggtgg

SEQ ID NO: 203401 - DNA, 41 bp, Artificial Sequence
  Description of Artificial Sequence: Synthetic oligonucleotide
atgacgtggaatatttgaaaaacatgtcacaactggtggag

SEQ ID NO: 203402 - DNA, 40 bp, Artificial Sequence
  Description of Artificial Sequence: Synthetic oligonucleotide
tgacgtggaatatttgaaaaacatgtcacaactggtggag

SEQ ID NO: 203403 - DNA, 39 bp, Artificial Sequence
  Description of Artificial Sequence: Synthetic oligonucleotide
gacgtggaatatttgaaaaacatgtcacaactggtggag

SEQ ID NO: 203404 - DNA, 39 bp, Artificial Sequence
  Description of Artificial Sequence: Synthetic oligonucleotide
acgtggaatatttgaaaaacatgtcacaactggtggagg

SEQ ID NO: 203405 - DNA, 38 bp, Artificial Sequence
  Description of Artificial Sequence: Synthetic oligonucleotide
cgtggaatatttgaaaaacatgtcacaactggtggagg

SEQ ID NO: 203406 - DNA, 39 bp, Artificial Sequence
  Description of Artificial Sequence: Synthetic oligonucleotide
gtggaatatttgaaaaacatgtcacaactggtggaggag

SEQ ID NO: 203407 - DNA, 41 bp, Artificial Sequence
  Description of Artificial Sequence: Synthetic oligonucleotide
tggaatatttgaaaaacatgtcacaactggtggaggagatg

SEQ ID NO: 203408 - DNA, 40 bp, Artificial Sequence
  Description of Artificial Sequence: Synthetic oligonucleotide
ggaatatttgaaaaacatgtcacaactggtggaggagatg

SEQ ID NO: 203409 - DNA, 40 bp, Artificial Sequence
  Description of Artificial Sequence: Synthetic oligonucleotide
gaatatttgaaaaacatgtcacaactggtggaggagatgc

SEQ ID NO: 203410 - DNA, 41 bp, Artificial Sequence
  Description of Artificial Sequence: Synthetic oligonucleotide
aatatttgaaaaacatgtcacaactggtggaggagatgctg

SEQ ID NO: 203411 - DNA, 40 bp, Artificial Sequence
  Description of Artificial Sequence: Synthetic oligonucleotide
atatttgaaaaacatgtcacaactggtggaggagatgctg

SEQ ID NO: 203412 - DNA, 39 bp, Artificial Sequence
  Description of Artificial Sequence: Synthetic oligonucleotide
tatttgaaaaacatgtcacaactggtggaggagatgctg

SEQ ID NO: 203413 - DNA, 38 bp, Artificial Sequence
  Description of Artificial Sequence: Synthetic oligonucleotide
atttgaaaaacatgtcacaactggtggaggagatgctg

SEQ ID NO: 203414 - DNA, 37 bp, Artificial Sequence
  Description of Artificial Sequence: Synthetic oligonucleotide
tttgaaaaacatgtcacaactggtggaggagatgctg

SEQ ID NO: 203415 - DNA, 36 bp, Artificial Sequence
  Description of Artificial Sequence: Synthetic oligonucleotide
ttgaaaaacatgtcacaactggtggaggagatgctg

SEQ ID NO: 203416 - DNA, 35 bp, Artificial Sequence
  Description of Artificial Sequence: Synthetic oligonucleotide
tgaaaaacatgtcacaactggtggaggagatgctg

SEQ ID NO: 203417 - DNA, 34 bp, Artificial Sequence
  Description of Artificial Sequence: Synthetic oligonucleotide
gaaaaacatgtcacaactggtggaggagatgctg

SEQ ID NO: 203418 - DNA, 34 bp, Artificial Sequence
  Description of Artificial Sequence: Synthetic oligonucleotide
aaaaacatgtcacaactggtggaggagatgctgc

SEQ ID NO: 203419 - DNA, 33 bp, Artificial Sequence
  Description of Artificial Sequence: Synthetic oligonucleotide
aaaacatgtcacaactggtggaggagatgctgc

SEQ ID NO: 203420 - DNA, 32 bp, Artificial Sequence
  Description of Artificial Sequence: Synthetic oligonucleotide
aaacatgtcacaactggtggaggagatgctgc

SEQ ID NO: 203421 - DNA, 31 bp, Artificial Sequence
  Description of Artificial Sequence: Synthetic oligonucleotide
aacatgtcacaactggtggaggagatgctgc

SEQ ID NO: 203422 - DNA, 30 bp, Artificial Sequence
  Description of Artificial Sequence: Synthetic oligonucleotide
acatgtcacaactggtggaggagatgctgc

SEQ ID NO: 203423 - DNA, 29 bp, Artificial Sequence
  Description of Artificial Sequence: Synthetic oligonucleotide
catgtcacaactggtggaggagatgctgc

SEQ ID NO: 203424 - DNA, 33 bp, Artificial Sequence
  Description of Artificial Sequence: Synthetic oligonucleotide
atgtcacaactggtggaggagatgctgctaaag

SEQ ID NO: 203425 - DNA, 32 bp, Artificial Sequence
  Description of Artificial Sequence: Synthetic oligonucleotide
tgtcacaactggtggaggagatgctgctaaag

SEQ ID NO: 203426 - DNA, 31 bp, Artificial Sequence
  Description of Artificial Sequence: Synthetic oligonucleotide
gtcacaactggtggaggagatgctgctaaag

SEQ ID NO: 203427 - DNA, 31 bp, Artificial Sequence
  Description of Artificial Sequence: Synthetic oligonucleotide
tcacaactggtggaggagatgctgctaaagc

SEQ ID NO: 203428 - DNA, 30 bp, Artificial Sequence
  Description of Artificial Sequence: Synthetic oligonucleotide
cacaactggtggaggagatgctgctaaagc

SEQ ID NO: 203429 - DNA, 31 bp, Artificial Sequence
  Description of Artificial Sequence: Synthetic oligonucleotide
acaactggtggaggagatgctgctaaagcag

SEQ ID NO: 203430 - DNA, 30 bp, Artificial Sequence
  Description of Artificial Sequence: Synthetic oligonucleotide
caactggtggaggagatgctgctaaagcag

SEQ ID NO: 203431 - DNA, 31 bp, Artificial Sequence
  Description of Artificial Sequence: Synthetic oligonucleotide
aactggtggaggagatgctgctaaagcagag

SEQ ID NO: 203432 - DNA, 30 bp, Artificial Sequence
  Description of Artificial Sequence: Synthetic oligonucleotide
actggtggaggagatgctgctaaagcagag

SEQ ID NO: 203433 - DNA, 29 bp, Artificial Sequence
  Description of Artificial Sequence: Synthetic oligonucleotide
ctggtggaggagatgctgctaaagcagag

SEQ ID NO: 203434 - DNA, 29 bp, Artificial Sequence
  Description of Artificial Sequence: Synthetic oligonucleotide
tggtggaggagatgctgctaaagcagagg

SEQ ID NO: 203435 - DNA, 28 bp, Artificial Sequence
  Description of Artificial Sequence: Synthetic oligonucleotide
ggtggaggagatgctgctaaagcagagg

SEQ ID NO: 203436 - DNA, 28 bp, Artificial Sequence
  Description of Artificial Sequence: Synthetic oligonucleotide
gtggaggagatgctgctaaagcagaggg

SEQ ID NO: 203437 - DNA, 29 bp, Artificial Sequence
  Description of Artificial Sequence: Synthetic oligonucleotide
tggaggagatgctgctaaagcagagggac

SEQ ID NO: 203438 - DNA, 28 bp, Artificial Sequence
  Description of Artificial Sequence: Synthetic oligonucleotide
ggaggagatgctgctaaagcagagggac

SEQ ID NO: 203439 - DNA, 31 bp, Artificial Sequence
  Description of Artificial Sequence: Synthetic oligonucleotide
gaggagatgctgctaaagcagagggactttc

SEQ ID NO: 203440 - DNA, 32 bp, Artificial Sequence
  Description of Artificial Sequence: Synthetic oligonucleotide
aggagatgctgctaaagcagagggactttctg

SEQ ID NO: 203441 - DNA, 31 bp, Artificial Sequence
  Description of Artificial Sequence: Synthetic oligonucleotide
ggagatgctgctaaagcagagggactttctg

SEQ ID NO: 203442 - DNA, 31 bp, Artificial Sequence
  Description of Artificial Sequence: Synthetic oligonucleotide
gagatgctgctaaagcagagggactttctgc

SEQ ID NO: 203443 - DNA, 32 bp, Artificial Sequence
  Description of Artificial Sequence: Synthetic oligonucleotide
agatgctgctaaagcagagggactttctgcag

SEQ ID NO: 203444 - DNA, 31 bp, Artificial Sequence
  Description of Artificial Sequence: Synthetic oligonucleotide
gatgctgctaaagcagagggactttctgcag

SEQ ID NO: 203445 - DNA, 32 bp, Artificial Sequence
  Description of Artificial Sequence: Synthetic oligonucleotide
atgctgctaaagcagagggactttctgcagag

SEQ ID NO: 203446 - DNA, 31 bp, Artificial Sequence
  Description of Artificial Sequence: Synthetic oligonucleotide
tgctgctaaagcagagggactttctgcagag

SEQ ID NO: 203447 - DNA, 30 bp, Artificial Sequence
  Description of Artificial Sequence: Synthetic oligonucleotide
gctgctaaagcagagggactttctgcagag

SEQ ID NO: 203448 - DNA, 30 bp, Artificial Sequence
  Description of Artificial Sequence: Synthetic oligonucleotide
ctgctaaagcagagggactttctgcagagc

SEQ ID NO: 203449 - DNA, 30 bp, Artificial Sequence
  Description of Artificial Sequence: Synthetic oligonucleotide
tgctaaagcagagggactttctgcagagcc

SEQ ID NO: 203450 - DNA, 29 bp, Artificial Sequence
  Description of Artificial Sequence: Synthetic oligonucleotide
gctaaagcagagggactttctgcagagcc

SEQ ID NO: 203451 - DNA, 30 bp, Artificial Sequence
  Description of Artificial Sequence: Synthetic oligonucleotide
ctaaagcagagggactttctgcagagccac

SEQ ID NO: 203452 - DNA, 32 bp, Artificial Sequence
  Description of Artificial Sequence: Synthetic oligonucleotide
taaagcagagggactttctgcagagccacatg

SEQ ID NO: 203453 - DNA, 31 bp, Artificial Sequence
  Description of Artificial Sequence: Synthetic oligonucleotide
aaagcagagggactttctgcagagccacatg

SEQ ID NO: 203454 - DNA, 30 bp, Artificial Sequence
  Description of Artificial Sequence: Synthetic oligonucleotide
aagcagagggactttctgcagagccacatg

SEQ ID NO: 203455 - DNA, 29 bp, Artificial Sequence
  Description of Artificial Sequence: Synthetic oligonucleotide
agcagagggactttctgcagagccacatg

SEQ ID NO: 203456 - DNA, 28 bp, Artificial Sequence
  Description of Artificial Sequence: Synthetic oligonucleotide
gcagagggactttctgcagagccacatg

SEQ ID NO: 203457 - DNA, 30 bp, Artificial Sequence
  Description of Artificial Sequence: Synthetic oligonucleotide
cagagggactttctgcagagccacatgatc

SEQ ID NO: 203458 - DNA, 33 bp, Artificial Sequence
  Description of Artificial Sequence: Synthetic oligonucleotide
agagggactttctgcagagccacatgatcttag

SEQ ID NO: 203459 - DNA, 32 bp, Artificial Sequence
  Description of Artificial Sequence: Synthetic oligonucleotide
gagggactttctgcagagccacatgatcttag

SEQ ID NO: 203460 - DNA, 32 bp, Artificial Sequence
  Description of Artificial Sequence: Synthetic oligonucleotide
agggactttctgcagagccacatgatcttagg

SEQ ID NO: 203461 - DNA, 31 bp, Artificial Sequence
  Description of Artificial Sequence: Synthetic oligonucleotide
gggactttctgcagagccacatgatcttagg

SEQ ID NO: 203462 - DNA, 31 bp, Artificial Sequence
  Description of Artificial Sequence: Synthetic oligonucleotide
ggactttctgcagagccacatgatcttaggg

SEQ ID NO: 203463 - DNA, 31 bp, Artificial Sequence
  Description of Artificial Sequence: Synthetic oligonucleotide
gactttctgcagagccacatgatcttagggc

SEQ ID NO: 203464 - DNA, 32 bp, Artificial Sequence
  Description of Artificial Sequence: Synthetic oligonucleotide
actttctgcagagccacatgatcttagggctg

SEQ ID NO: 203465 - DNA, 31 bp, Artificial Sequence
  Description of Artificial Sequence: Synthetic oligonucleotide
ctttctgcagagccacatgatcttagggctg

SEQ ID NO: 203466 - DNA, 31 bp, Artificial Sequence
  Description of Artificial Sequence: Synthetic oligonucleotide
tttctgcagagccacatgatcttagggctgg

SEQ ID NO: 203467 - DNA, 30 bp, Artificial Sequence
  Description of Artificial Sequence: Synthetic oligonucleotide
ttctgcagagccacatgatcttagggctgg

SEQ ID NO: 203468 - DNA, 29 bp, Artificial Sequence
  Description of Artificial Sequence: Synthetic oligonucleotide
tctgcagagccacatgatcttagggctgg

SEQ ID NO: 203469 - DNA, 28 bp, Artificial Sequence
  Description of Artificial Sequence: Synthetic oligonucleotide
ctgcagagccacatgatcttagggctgg

SEQ ID NO: 203470 - DNA, 29 bp, Artificial Sequence
  Description of Artificial Sequence: Synthetic oligonucleotide
tgcagagccacatgatcttagggctggtg

SEQ ID NO: 203471 - DNA, 28 bp, Artificial Sequence
  Description of Artificial Sequence: Synthetic oligonucleotide
gcagagccacatgatcttagggctggtg

SEQ ID NO: 203472 - DNA, 28 bp, Artificial Sequence
  Description of Artificial Sequence: Synthetic oligonucleotide
cagagccacatgatcttagggctggtgg

SEQ ID NO: 203473 - DNA, 29 bp, Artificial Sequence
  Description of Artificial Sequence: Synthetic oligonucleotide
agagccacatgatcttagggctggtggtg

SEQ ID NO: 203474 - DNA, 28 bp, Artificial Sequence
  Description of Artificial Sequence: Synthetic oligonucleotide
gagccacatgatcttagggctggtggtg

SEQ ID NO: 203475 - DNA, 29 bp, Artificial Sequence
  Description of Artificial Sequence: Synthetic oligonucleotide
agccacatgatcttagggctggtggtgac

SEQ ID NO: 203476 - DNA, 28 bp, Artificial Sequence
  Description of Artificial Sequence: Synthetic oligonucleotide
gccacatgatcttagggctggtggtgac

SEQ ID NO: 203477 - DNA, 28 bp, Artificial Sequence
  Description of Artificial Sequence: Synthetic oligonucleotide
ccacatgatcttagggctggtggtgacc

SEQ ID NO: 203478 - DNA, 28 bp, Artificial Sequence
  Description of Artificial Sequence: Synthetic oligonucleotide
cacatgatcttagggctggtggtgaccc

SEQ ID NO: 203479 - DNA, 31 bp, Artificial Sequence
  Description of Artificial Sequence: Synthetic oligonucleotide
acatgatcttagggctggtggtgaccctttc

SEQ ID NO: 203480 - DNA, 30 bp, Artificial Sequence
  Description of Artificial Sequence: Synthetic oligonucleotide
catgatcttagggctggtggtgaccctttc

SEQ ID NO: 203481 - DNA, 31 bp, Artificial Sequence
  Description of Artificial Sequence: Synthetic oligonucleotide
atgatcttagggctggtggtgaccctttctc

SEQ ID NO: 203482 - DNA, 30 bp, Artificial Sequence
  Description of Artificial Sequence: Synthetic oligonucleotide
tgatcttagggctggtggtgaccctttctc

SEQ ID NO: 203483 - DNA, 29 bp, Artificial Sequence
  Description of Artificial Sequence: Synthetic oligonucleotide
gatcttagggctggtggtgaccctttctc

SEQ ID NO: 203484 - DNA, 29 bp, Artificial Sequence
  Description of Artificial Sequence: Synthetic oligonucleotide
atcttagggctggtggtgaccctttctcc

SEQ ID NO: 203485 - DNA, 28 bp, Artificial Sequence
  Description of Artificial Sequence: Synthetic oligonucleotide
tcttagggctggtggtgaccctttctcc

SEQ ID NO: 203486 - DNA, 27 bp, Artificial Sequence
  Description of Artificial Sequence: Synthetic oligonucleotide
cttagggctggtggtgaccctttctcc

SEQ ID NO: 203487 - DNA, 28 bp, Artificial Sequence
  Description of Artificial Sequence: Synthetic oligonucleotide
ttagggctggtggtgaccctttctccag

SEQ ID NO: 203488 - DNA, 27 bp, Artificial Sequence
  Description of Artificial Sequence: Synthetic oligonucleotide
tagggctggtggtgaccctttctccag

SEQ ID NO: 203489 - DNA, 26 bp, Artificial Sequence
  Description of Artificial Sequence: Synthetic oligonucleotide
agggctggtggtgaccctttctccag

SEQ ID NO: 203490 - DNA, 25 bp, Artificial Sequence
  Description of Artificial Sequence: Synthetic oligonucleotide
gggctggtggtgaccctttctccag

SEQ ID NO: 203491 - DNA, 25 bp, Artificial Sequence
  Description of Artificial Sequence: Synthetic oligonucleotide
ggctggtggtgaccctttctccagc

SEQ ID NO: 203492 - DNA, 25 bp, Artificial Sequence
  Description of Artificial Sequence: Synthetic oligonucleotide
gctggtggtgaccctttctccagcc

SEQ ID NO: 203493 - DNA, 26 bp, Artificial Sequence
  Description of Artificial Sequence: Synthetic oligonucleotide
ctggtggtgaccctttctccagccct

SEQ ID NO: 203494 - DNA, 26 bp, Artificial Sequence
  Description of Artificial Sequence: Synthetic oligonucleotide
tggtggtgaccctttctccagccctg

SEQ ID NO: 203495 - DNA, 25 bp, Artificial Sequence
  Description of Artificial Sequence: Synthetic oligonucleotide
ggtggtgaccctttctccagccctg

SEQ ID NO: 203496 - DNA, 26 bp, Artificial Sequence
  Description of Artificial Sequence: Synthetic oligonucleotide
gtggtgaccctttctccagccctgga

SEQ ID NO: 203497 - DNA, 27 bp, Artificial Sequence
  Description of Artificial Sequence: Synthetic oligonucleotide
tggtgaccctttctccagccctggaca

SEQ ID NO: 203498 - DNA, 26 bp, Artificial Sequence
  Description of Artificial Sequence: Synthetic oligonucleotide
ggtgaccctttctccagccctggaca

SEQ ID NO: 203499 - DNA, 27 bp, Artificial Sequence
  Description of Artificial Sequence: Synthetic oligonucleotide
gtgaccctttctccagccctggacagt

SEQ ID NO: 203500 - DNA, 27 bp, Artificial Sequence
  Description of Artificial Sequence: Synthetic oligonucleotide
tgaccctttctccagccctggacagtc

SEQ ID NO: 203501 - DNA, 27 bp, Artificial Sequence
  Description of Artificial Sequence: Synthetic oligonucleotide
gaccctttctccagccctggacagtca

SEQ ID NO: 203502 - DNA, 30 bp, Artificial Sequence
  Description of Artificial Sequence: Synthetic oligonucleotide
accctttctccagccctggacagtcaattc

SEQ ID NO: 203503 - DNA, 29 bp, Artificial Sequence
  Description of Artificial Sequence: Synthetic oligonucleotide
ccctttctccagccctggacagtcaattc

SEQ ID NO: 203504 - DNA, 29 bp, Artificial Sequence
  Description of Artificial Sequence: Synthetic oligonucleotide
cctttctccagccctggacagtcaattcc

SEQ ID NO: 203505 - DNA, 30 bp, Artificial Sequence
  Description of Artificial Sequence: Synthetic oligonucleotide
ctttctccagccctggacagtcaattccag

SEQ ID NO: 203506 - DNA, 30 bp, Artificial Sequence
  Description of Artificial Sequence: Synthetic oligonucleotide
tttctccagccctggacagtcaattccagg

SEQ ID NO: 203507 - DNA, 29 bp, Artificial Sequence
  Description of Artificial Sequence: Synthetic oligonucleotide
ttctccagccctggacagtcaattccagg

SEQ ID NO: 203508 - DNA, 28 bp, Artificial Sequence
  Description of Artificial Sequence: Synthetic oligonucleotide
tctccagccctggacagtcaattccagg

SEQ ID NO: 203509 - DNA, 27 bp, Artificial Sequence
  Description of Artificial Sequence: Synthetic oligonucleotide
ctccagccctggacagtcaattccagg

SEQ ID NO: 203510 - DNA, 28 bp, Artificial Sequence
  Description of Artificial Sequence: Synthetic oligonucleotide
tccagccctggacagtcaattccaggag

SEQ ID NO: 203511 - DNA, 27 bp, Artificial Sequence
  Description of Artificial Sequence: Synthetic oligonucleotide
ccagccctggacagtcaattccaggag

SEQ ID NO: 203512 - DNA, 27 bp, Artificial Sequence
  Description of Artificial Sequence: Synthetic oligonucleotide
cagccctggacagtcaattccaggagg

SEQ ID NO: 203513 - DNA, 27 bp, Artificial Sequence
  Description of Artificial Sequence: Synthetic oligonucleotide
agccctggacagtcaattccaggaggc

SEQ ID NO: 203514 - DNA, 27 bp, Artificial Sequence
  Description of Artificial Sequence: Synthetic oligonucleotide
gccctggacagtcaattccaggaggca

SEQ ID NO: 203515 - DNA, 27 bp, Artificial Sequence
  Description of Artificial Sequence: Synthetic oligonucleotide
ccctggacagtcaattccaggaggcac

SEQ ID NO: 203516 - DNA, 27 bp, Artificial Sequence
  Description of Artificial Sequence: Synthetic oligonucleotide
cctggacagtcaattccaggaggcacg

SEQ ID NO: 203517 - DNA, 27 bp, Artificial Sequence
  Description of Artificial Sequence: Synthetic oligonucleotide
ctggacagtcaattccaggaggcacgc

SEQ ID NO: 203518 - DNA, 28 bp, Artificial Sequence
  Description of Artificial Sequence: Synthetic oligonucleotide
tggacagtcaattccaggaggcacgcag

SEQ ID NO: 203519 - DNA, 27 bp, Artificial Sequence
  Description of Artificial Sequence: Synthetic oligonucleotide
ggacagtcaattccaggaggcacgcag

SEQ ID NO: 203520 - DNA, 30 bp, Artificial Sequence
  Description of Artificial Sequence: Synthetic oligonucleotide
gacagtcaattccaggaggcacgcagaaag

SEQ ID NO: 203521 - DNA, 30 bp, Artificial Sequence
  Description of Artificial Sequence: Synthetic oligonucleotide
acagtcaattccaggaggcacgcagaaagc

SEQ ID NO: 203522 - DNA, 29 bp, Artificial Sequence
  Description of Artificial Sequence: Synthetic oligonucleotide
cagtcaattccaggaggcacgcagaaagc

SEQ ID NO: 203523 - DNA, 30 bp, Artificial Sequence
  Description of Artificial Sequence: Synthetic oligonucleotide
agtcaattccaggaggcacgcagaaagctc

SEQ ID NO: 203524 - DNA, 29 bp, Artificial Sequence
  Description of Artificial Sequence: Synthetic oligonucleotide
gtcaattccaggaggcacgcagaaagctc

SEQ ID NO: 203525 - DNA, 30 bp, Artificial Sequence
  Description of Artificial Sequence: Synthetic oligonucleotide
tcaattccaggaggcacgcagaaagctcag

SEQ ID NO: 203526 - DNA, 29 bp, Artificial Sequence
  Description of Artificial Sequence: Synthetic oligonucleotide
caattccaggaggcacgcagaaagctcag

SEQ ID NO: 203527 - DNA, 29 bp, Artificial Sequence
  Description of Artificial Sequence: Synthetic oligonucleotide
aattccaggaggcacgcagaaagctcagc

SEQ ID NO: 203528 - DNA, 28 bp, Artificial Sequence
  Description of Artificial Sequence: Synthetic oligonucleotide
attccaggaggcacgcagaaagctcagc

SEQ ID NO: 203529 - DNA, 27 bp, Artificial Sequence
  Description of Artificial Sequence: Synthetic oligonucleotide
ttccaggaggcacgcagaaagctcagc

SEQ ID NO: 203530 - DNA, 26 bp, Artificial Sequence
  Description of Artificial Sequence: Synthetic oligonucleotide
tccaggaggcacgcagaaagctcagc

SEQ ID NO: 203531 - DNA, 25 bp, Artificial Sequence
  Description of Artificial Sequence: Synthetic oligonucleotide
ccaggaggcacgcagaaagctcagc

SEQ ID NO: 203532 - DNA, 26 bp, Artificial Sequence
  Description of Artificial Sequence: Synthetic oligonucleotide
caggaggcacgcagaaagctcagcca

SEQ ID NO: 203533 - DNA, 27 bp, Artificial Sequence
  Description of Artificial Sequence: Synthetic oligonucleotide
aggaggcacgcagaaagctcagccaga

SEQ ID NO: 203534 - DNA, 27 bp, Artificial Sequence
  Description of Artificial Sequence: Synthetic oligonucleotide
ggaggcacgcagaaagctcagccagaa

SEQ ID NO: 203535 - DNA, 28 bp, Artificial Sequence
  Description of Artificial Sequence: Synthetic oligonucleotide
gaggcacgcagaaagctcagccagaaac

SEQ ID NO: 203536 - DNA, 29 bp, Artificial Sequence
  Description of Artificial Sequence: Synthetic oligonucleotide
aggcacgcagaaagctcagccagaaactg

SEQ ID NO: 203537 - DNA, 28 bp, Artificial Sequence
  Description of Artificial Sequence: Synthetic oligonucleotide
ggcacgcagaaagctcagccagaaactg

SEQ ID NO: 203538 - DNA, 28 bp, Artificial Sequence
  Description of Artificial Sequence: Synthetic oligonucleotide
gcacgcagaaagctcagccagaaactgc

SEQ ID NO: 203539 - DNA, 28 bp, Artificial Sequence
  Description of Artificial Sequence: Synthetic oligonucleotide
cacgcagaaagctcagccagaaactgcg

SEQ ID NO: 203540 - DNA, 28 bp, Artificial Sequence
  Description of Artificial Sequence: Synthetic oligonucleotide
acgcagaaagctcagccagaaactgcgg

SEQ ID NO: 203541 - DNA, 27 bp, Artificial Sequence
  Description of Artificial Sequence: Synthetic oligonucleotide
cgcagaaagctcagccagaaactgcgg

SEQ ID NO: 203542 - DNA, 27 bp, Artificial Sequence
  Description of Artificial Sequence: Synthetic oligonucleotide
gcagaaagctcagccagaaactgcggg

SEQ ID NO: 203543 - DNA, 29 bp, Artificial Sequence
  Description of Artificial Sequence: Synthetic oligonucleotide
cagaaagctcagccagaaactgcgggaac

SEQ ID NO: 203544 - DNA, 30 bp, Artificial Sequence
  Description of Artificial Sequence: Synthetic oligonucleotide
agaaagctcagccagaaactgcgggaactg

SEQ ID NO: 203545 - DNA, 29 bp, Artificial Sequence
  Description of Artificial Sequence: Synthetic oligonucleotide
gaaagctcagccagaaactgcgggaactg

SEQ ID NO: 203546 - DNA, 30 bp, Artificial Sequence
  Description of Artificial Sequence: Synthetic oligonucleotide
aaagctcagccagaaactgcgggaactgac

SEQ ID NO: 203547 - DNA, 29 bp, Artificial Sequence
  Description of Artificial Sequence: Synthetic oligonucleotide
aagctcagccagaaactgcgggaactgac

SEQ ID NO: 203548 - DNA, 28 bp, Artificial Sequence
  Description of Artificial Sequence: Synthetic oligonucleotide
agctcagccagaaactgcgggaactgac

SEQ ID NO: 203549 - DNA, 27 bp, Artificial Sequence
  Description of Artificial Sequence: Synthetic oligonucleotide
gctcagccagaaactgcgggaactgac

SEQ ID NO: 203550 - DNA, 28 bp, Artificial Sequence
  Description of Artificial Sequence: Synthetic oligonucleotide
ctcagccagaaactgcgggaactgacag

SEQ ID NO: 203551 - DNA, 29 bp, Artificial Sequence
  Description of Artificial Sequence: Synthetic oligonucleotide
tcagccagaaactgcgggaactgacagag

SEQ ID NO: 203552 - DNA, 28 bp, Artificial Sequence
  Description of Artificial Sequence: Synthetic oligonucleotide
cagccagaaactgcgggaactgacagag

SEQ ID NO: 203553 - DNA, 28 bp, Artificial Sequence
  Description of Artificial Sequence: Synthetic oligonucleotide
agccagaaactgcgggaactgacagagc

SEQ ID NO: 203554 - DNA, 27 bp, Artificial Sequence
  Description of Artificial Sequence: Synthetic oligonucleotide
gccagaaactgcgggaactgacagagc

SEQ ID NO: 203555 - DNA, 29 bp, Artificial Sequence
  Description of Artificial Sequence: Synthetic oligonucleotide
ccagaaactgcgggaactgacagagcaac

SEQ ID NO: 203556 - DNA, 29 bp, Artificial Sequence
  Description of Artificial Sequence: Synthetic oligonucleotide
cagaaactgcgggaactgacagagcaacc

SEQ ID NO: 203557 - DNA, 30 bp, Artificial Sequence
  Description of Artificial Sequence: Synthetic oligonucleotide
agaaactgcgggaactgacagagcaaccac

SEQ ID NO: 203558 - DNA, 29 bp, Artificial Sequence
  Description of Artificial Sequence: Synthetic oligonucleotide
gaaactgcgggaactgacagagcaaccac

SEQ ID NO: 203559 - DNA, 29 bp, Artificial Sequence
  Description of Artificial Sequence: Synthetic oligonucleotide
aaactgcgggaactgacagagcaaccacc

SEQ ID NO: 203560 - DNA, 28 bp, Artificial Sequence
  Description of Artificial Sequence: Synthetic oligonucleotide
aactgcgggaactgacagagcaaccacc

SEQ ID NO: 203561 - DNA, 27 bp, Artificial Sequence
  Description of Artificial Sequence: Synthetic oligonucleotide
actgcgggaactgacagagcaaccacc

SEQ ID NO: 203562 - DNA, 26 bp, Artificial Sequence
  Description of Artificial Sequence: Synthetic oligonucleotide
ctgcgggaactgacagagcaaccacc

SEQ ID NO: 203563 - DNA, 27 bp, Artificial Sequence
  Description of Artificial Sequence: Synthetic oligonucleotide
tgcgggaactgacagagcaaccaccca

SEQ ID NO: 203564 - DNA, 27 bp, Artificial Sequence
  Description of Artificial Sequence: Synthetic oligonucleotide
gcgggaactgacagagcaaccacccat

SEQ ID NO: 203565 - DNA, 27 bp, Artificial Sequence
  Description of Artificial Sequence: Synthetic oligonucleotide
cgggaactgacagagcaaccacccatg

SEQ ID NO: 203566 - DNA, 27 bp, Artificial Sequence
  Description of Artificial Sequence: Synthetic oligonucleotide
gggaactgacagagcaaccacccatgc

SEQ ID NO: 203567 - DNA, 27 bp, Artificial Sequence
  Description of Artificial Sequence: Synthetic oligonucleotide
ggaactgacagagcaaccacccatgcc

SEQ ID NO: 203568 - DNA, 28 bp, Artificial Sequence
  Description of Artificial Sequence: Synthetic oligonucleotide
gaactgacagagcaaccacccatgcctg

SEQ ID NO: 203569 - DNA, 28 bp, Artificial Sequence
  Description of Artificial Sequence: Synthetic oligonucleotide
aactgacagagcaaccacccatgcctgc

SEQ ID NO: 203570 - DNA, 27 bp, Artificial Sequence
  Description of Artificial Sequence: Synthetic oligonucleotide
actgacagagcaaccacccatgcctgc

SEQ ID NO: 203571 - DNA, 26 bp, Artificial Sequence
  Description of Artificial Sequence: Synthetic oligonucleotide
ctgacagagcaaccacccatgcctgc

SEQ ID NO: 203572 - DNA, 26 bp, Artificial Sequence
  Description of Artificial Sequence: Synthetic oligonucleotide
tgacagagcaaccacccatgcctgcc

SEQ ID NO: 203573 - DNA, 25 bp, Artificial Sequence
  Description of Artificial Sequence: Synthetic oligonucleotide
gacagagcaaccacccatgcctgcc

SEQ ID NO: 203574 - DNA, 25 bp, Artificial Sequence
  Description of Artificial Sequence: Synthetic oligonucleotide
acagagcaaccacccatgcctgccc

SEQ ID NO: 203575 - DNA, 24 bp, Artificial Sequence
  Description of Artificial Sequence: Synthetic oligonucleotide
cagagcaaccacccatgcctgccc

SEQ ID NO: 203576 - DNA, 24 bp, Artificial Sequence
  Description of Artificial Sequence: Synthetic oligonucleotide
agagcaaccacccatgcctgcccg

SEQ ID NO: 203577 - DNA, 23 bp, Artificial Sequence
  Description of Artificial Sequence: Synthetic oligonucleotide
gagcaaccacccatgcctgcccg

SEQ ID NO: 203578 - DNA, 23 bp, Artificial Sequence
  Description of Artificial Sequence: Synthetic oligonucleotide
agcaaccacccatgcctgcccgc

SEQ ID NO: 203579 - DNA, 22 bp, Artificial Sequence
  Description of Artificial Sequence: Synthetic oligonucleotide
gcaaccacccatgcctgcccgc

SEQ ID NO: 203580 - DNA, 22 bp, Artificial Sequence
  Description of Artificial Sequence: Synthetic oligonucleotide
caaccacccatgcctgcccgcc

SEQ ID NO: 203581 - DNA, 23 bp, Artificial Sequence
  Description of Artificial Sequence: Synthetic oligonucleotide
aaccacccatgcctgcccgccca

SEQ ID NO: 203582 - DNA, 22 bp, Artificial Sequence
  Description of Artificial Sequence: Synthetic oligonucleotide
accacccatgcctgcccgccca

SEQ ID NO: 203583 - DNA, 21 bp, Artificial Sequence
  Description of Artificial Sequence: Synthetic oligonucleotide
ccacccatgcctgcccgccca

SEQ ID NO: 203584 - DNA, 21 bp, Artificial Sequence
  Description of Artificial Sequence: Synthetic oligonucleotide
cacccatgcctgcccgcccac

SEQ ID NO: 203585 - DNA, 23 bp, Artificial Sequence
  Description of Artificial Sequence: Synthetic oligonucleotide
acccatgcctgcccgcccacgat

SEQ ID NO: 203586 - DNA, 22 bp, Artificial Sequence
  Description of Artificial Sequence: Synthetic oligonucleotide
cccatgcctgcccgcccacgat

SEQ ID NO: 203587 - DNA, 22 bp, Artificial Sequence
  Description of Artificial Sequence: Synthetic oligonucleotide
ccatgcctgcccgcccacgatg

SEQ ID NO: 203588 - DNA, 24 bp, Artificial Sequence
  Description of Artificial Sequence: Synthetic oligonucleotide
catgcctgcccgcccacgatggat

SEQ ID NO: 203589 - DNA, 26 bp, Artificial Sequence
  Description of Artificial Sequence: Synthetic oligonucleotide
atgcctgcccgcccacgatggatgaa

SEQ ID NO: 203590 - DNA, 25 bp, Artificial Sequence
  Description of Artificial Sequence: Synthetic oligonucleotide
tgcctgcccgcccacgatggatgaa

SEQ ID NO: 203591 - DNA, 24 bp, Artificial Sequence
  Description of Artificial Sequence: Synthetic oligonucleotide
gcctgcccgcccacgatggatgaa

SEQ ID NO: 203592 - DNA, 25 bp, Artificial Sequence
  Description of Artificial Sequence: Synthetic oligonucleotide
cctgcccgcccacgatggatgaagt

SEQ ID NO: 203593 - DNA, 25 bp, Artificial Sequence
  Description of Artificial Sequence: Synthetic oligonucleotide
ctgcccgcccacgatggatgaagtg

SEQ ID NO: 203594 - DNA, 25 bp, Artificial Sequence
  Description of Artificial Sequence: Synthetic oligonucleotide
tgcccgcccacgatggatgaagtgc

SEQ ID NO: 203595 - DNA, 24 bp, Artificial Sequence
  Description of Artificial Sequence: Synthetic oligonucleotide
gcccgcccacgatggatgaagtgc

SEQ ID NO: 203596 - DNA, 25 bp, Artificial Sequence
  Description of Artificial Sequence: Synthetic oligonucleotide
cccgcccacgatggatgaagtgcgt

SEQ ID NO: 203597 - DNA, 25 bp, Artificial Sequence
  Description of Artificial Sequence: Synthetic oligonucleotide
ccgcccacgatggatgaagtgcgtg

SEQ ID NO: 203598 - DNA, 26 bp, Artificial Sequence
  Description of Artificial Sequence: Synthetic oligonucleotide
cgcccacgatggatgaagtgcgtgga

SEQ ID NO: 203599 - DNA, 26 bp, Artificial Sequence
  Description of Artificial Sequence: Synthetic oligonucleotide
gcccacgatggatgaagtgcgtggag

SEQ ID NO: 203600 - DNA, 27 bp, Artificial Sequence
  Description of Artificial Sequence: Synthetic oligonucleotide
cccacgatggatgaagtgcgtggagga

SEQ ID NO: 203601 - DNA, 27 bp, Artificial Sequence
  Description of Artificial Sequence: Synthetic oligonucleotide
ccacgatggatgaagtgcgtggaggag

SEQ ID NO: 203602 - DNA, 28 bp, Artificial Sequence
  Description of Artificial Sequence: Synthetic oligonucleotide
cacgatggatgaagtgcgtggaggagac

SEQ ID NO: 203603 - DNA, 29 bp, Artificial Sequence
  Description of Artificial Sequence: Synthetic oligonucleotide
acgatggatgaagtgcgtggaggagacag

SEQ ID NO: 203604 - DNA, 28 bp, Artificial Sequence
  Description of Artificial Sequence: Synthetic oligonucleotide
cgatggatgaagtgcgtggaggagacag

SEQ ID NO: 203605 - DNA, 28 bp, Artificial Sequence
  Description of Artificial Sequence: Synthetic oligonucleotide
gatggatgaagtgcgtggaggagacagg

SEQ ID NO: 203606 - DNA, 28 bp, Artificial Sequence
  Description of Artificial Sequence: Synthetic oligonucleotide
atggatgaagtgcgtggaggagacaggc

SEQ ID NO: 203607 - DNA, 27 bp, Artificial Sequence
  Description of Artificial Sequence: Synthetic oligonucleotide
tggatgaagtgcgtggaggagacaggc

SEQ ID NO: 203608 - DNA, 27 bp, Artificial Sequence
  Description of Artificial Sequence: Synthetic oligonucleotide
ggatgaagtgcgtggaggagacaggca

SEQ ID NO: 203609 - DNA, 27 bp, Artificial Sequence
  Description of Artificial Sequence: Synthetic oligonucleotide
gatgaagtgcgtggaggagacaggcac

SEQ ID NO: 203610 - DNA, 27 bp, Artificial Sequence
  Description of Artificial Sequence: Synthetic oligonucleotide
atgaagtgcgtggaggagacaggcacg

SEQ ID NO: 203611 - DNA, 27 bp, Artificial Sequence
  Description of Artificial Sequence: Synthetic oligonucleotide
tgaagtgcgtggaggagacaggcacgt

SEQ ID NO: 203612 - DNA, 27 bp, Artificial Sequence
  Description of Artificial Sequence: Synthetic oligonucleotide
gaagtgcgtggaggagacaggcacgtt

SEQ ID NO: 203613 - DNA, 27 bp, Artificial Sequence
  Description of Artificial Sequence: Synthetic oligonucleotide
aagtgcgtggaggagacaggcacgttc

SEQ ID NO: 203614 - DNA, 27 bp, Artificial Sequence
  Description of Artificial Sequence: Synthetic oligonucleotide
agtgcgtggaggagacaggcacgttct

SEQ ID NO: 203615 - DNA, 27 bp, Artificial Sequence
  Description of Artificial Sequence: Synthetic oligonucleotide
gtgcgtggaggagacaggcacgttctt

SEQ ID NO: 203616 - DNA, 27 bp, Artificial Sequence
  Description of Artificial Sequence: Synthetic oligonucleotide
tgcgtggaggagacaggcacgttcttc

SEQ ID NO: 203617 - DNA, 26 bp, Artificial Sequence
  Description of Artificial Sequence: Synthetic oligonucleotide
gcgtggaggagacaggcacgttcttc

SEQ ID NO: 203618 - DNA, 27 bp, Artificial Sequence
  Description of Artificial Sequence: Synthetic oligonucleotide
cgtggaggagacaggcacgttcttcga

SEQ ID NO: 203619 - DNA, 27 bp, Artificial Sequence
  Description of Artificial Sequence: Synthetic oligonucleotide
gtggaggagacaggcacgttcttcgag

SEQ ID NO: 203620 - DNA, 27 bp, Artificial Sequence
  Description of Artificial Sequence: Synthetic oligonucleotide
tggaggagacaggcacgttcttcgagc

SEQ ID NO: 203621 - DNA, 26 bp, Artificial Sequence
  Description of Artificial Sequence: Synthetic oligonucleotide
ggaggagacaggcacgttcttcgagc

SEQ ID NO: 203622 - DNA, 26 bp, Artificial Sequence
  Description of Artificial Sequence: Synthetic oligonucleotide
gaggagacaggcacgttcttcgagcc

SEQ ID NO: 203623 - DNA, 27 bp, Artificial Sequence
  Description of Artificial Sequence: Synthetic oligonucleotide
aggagacaggcacgttcttcgagccca

SEQ ID NO: 203624 - DNA, 26 bp, Artificial Sequence
  Description of Artificial Sequence: Synthetic oligonucleotide
ggagacaggcacgttcttcgagccca

SEQ ID NO: 203625 - DNA, 26 bp, Artificial Sequence
  Description of Artificial Sequence: Synthetic oligonucleotide
gagacaggcacgttcttcgagcccac

SEQ ID NO: 203626 - DNA, 26 bp, Artificial Sequence
  Description of Artificial Sequence: Synthetic oligonucleotide
agacaggcacgttcttcgagcccacg

SEQ ID NO: 203627 - DNA, 25 bp, Artificial Sequence
  Description of Artificial Sequence: Synthetic oligonucleotide
gacaggcacgttcttcgagcccacg

SEQ ID NO: 203628 - DNA, 26 bp, Artificial Sequence
  Description of Artificial Sequence: Synthetic oligonucleotide
acaggcacgttcttcgagcccacgct

SEQ ID NO: 203629 - DNA, 25 bp, Artificial Sequence
  Description of Artificial Sequence: Synthetic oligonucleotide
caggcacgttcttcgagcccacgct

SEQ ID NO: 203630 - DNA, 25 bp, Artificial Sequence
  Description of Artificial Sequence: Synthetic oligonucleotide
aggcacgttcttcgagcccacgctg

SEQ ID NO: 203631 - DNA, 24 bp, Artificial Sequence
  Description of Artificial Sequence: Synthetic oligonucleotide
ggcacgttcttcgagcccacgctg

SEQ ID NO: 203632 - DNA, 24 bp, Artificial Sequence
  Description of Artificial Sequence: Synthetic oligonucleotide
gcacgttcttcgagcccacgctgg

SEQ ID NO: 203633 - DNA, 24 bp, Artificial Sequence
  Description of Artificial Sequence: Synthetic oligonucleotide
cacgttcttcgagcccacgctggc

SEQ ID NO: 203634 - DNA, 24 bp, Artificial Sequence
  Description of Artificial Sequence: Synthetic oligonucleotide
acgttcttcgagcccacgctggcg

SEQ ID NO: 203635 - DNA, 23 bp, Artificial Sequence
  Description of Artificial Sequence: Synthetic oligonucleotide
cgttcttcgagcccacgctggcg

SEQ ID NO: 203636 - DNA, 23 bp, Artificial Sequence
  Description of Artificial Sequence: Synthetic oligonucleotide
gttcttcgagcccacgctggcgg

SEQ ID NO: 203637 - DNA, 26 bp, Artificial Sequence
  Description of Artificial Sequence: Synthetic oligonucleotide
ttcttcgagcccacgctggcggcttt

SEQ ID NO: 203638 - DNA, 25 bp, Artificial Sequence
  Description of Artificial Sequence: Synthetic oligonucleotide
tcttcgagcccacgctggcggcttt

SEQ ID NO: 203639 - DNA, 24 bp, Artificial Sequence
  Description of Artificial Sequence: Synthetic oligonucleotide
cttcgagcccacgctggcggcttt

SEQ ID NO: 203640 - DNA, 27 bp, Artificial Sequence
  Description of Artificial Sequence: Synthetic oligonucleotide
ttcgagcccacgctggcggctttgttt

SEQ ID NO: 203641 - DNA, 26 bp, Artificial Sequence
  Description of Artificial Sequence: Synthetic oligonucleotide
tcgagcccacgctggcggctttgttt

SEQ ID NO: 203642 - DNA, 25 bp, Artificial Sequence
  Description of Artificial Sequence: Synthetic oligonucleotide
cgagcccacgctggcggctttgttt

SEQ ID NO: 203643 - DNA, 27 bp, Artificial Sequence
  Description of Artificial Sequence: Synthetic oligonucleotide
gagcccacgctggcggctttgtttgtt

SEQ ID NO: 203644 - DNA, 27 bp, Artificial Sequence
  Description of Artificial Sequence: Synthetic oligonucleotide
agcccacgctggcggctttgtttgttc

SEQ ID NO: 203645 - DNA, 26 bp, Artificial Sequence
  Description of Artificial Sequence: Synthetic oligonucleotide
gcccacgctggcggctttgtttgttc

SEQ ID NO: 203646 - DNA, 27 bp, Artificial Sequence
  Description of Artificial Sequence: Synthetic oligonucleotide
cccacgctggcggctttgtttgttcgt

SEQ ID NO: 203647 - DNA, 27 bp, Artificial Sequence
  Description of Artificial Sequence: Synthetic oligonucleotide
ccacgctggcggctttgtttgttcgtg

SEQ ID NO: 203648 - DNA, 28 bp, Artificial Sequence
  Description of Artificial Sequence: Synthetic oligonucleotide
cacgctggcggctttgtttgttcgtgag

SEQ ID NO: 203649 - DNA, 28 bp, Artificial Sequence
  Description of Artificial Sequence: Synthetic oligonucleotide
acgctggcggctttgtttgttcgtgagg

SEQ ID NO: 203650 - DNA, 27 bp, Artificial Sequence
  Description of Artificial Sequence: Synthetic oligonucleotide
cgctggcggctttgtttgttcgtgagg

SEQ ID NO: 203651 - DNA, 27 bp, Artificial Sequence
  Description of Artificial Sequence: Synthetic oligonucleotide
gctggcggctttgtttgttcgtgaggc

SEQ ID NO: 203652 - DNA, 27 bp, Artificial Sequence
  Description of Artificial Sequence: Synthetic oligonucleotide
ctggcggctttgtttgttcgtgaggcc

SEQ ID NO: 203653 - DNA, 30 bp, Artificial Sequence
  Description of Artificial Sequence: Synthetic oligonucleotide
tggcggctttgtttgttcgtgaggcctttg

SEQ ID NO: 203654 - DNA, 29 bp, Artificial Sequence
  Description of Artificial Sequence: Synthetic oligonucleotide
ggcggctttgtttgttcgtgaggcctttg

SEQ ID NO: 203655 - DNA, 29 bp, Artificial Sequence
  Description of Artificial Sequence: Synthetic oligonucleotide
gcggctttgtttgttcgtgaggcctttgg

SEQ ID NO: 203656 - DNA, 29 bp, Artificial Sequence
  Description of Artificial Sequence: Synthetic oligonucleotide
cggctttgtttgttcgtgaggcctttggc

SEQ ID NO: 203657 - DNA, 29 bp, Artificial Sequence
  Description of Artificial Sequence: Synthetic oligonucleotide
ggctttgtttgttcgtgaggcctttggcc

SEQ ID NO: 203658 - DNA, 29 bp, Artificial Sequence
  Description of Artificial Sequence: Synthetic oligonucleotide
gctttgtttgttcgtgaggcctttggccc

SEQ ID NO: 203659 - DNA, 29 bp, Artificial Sequence
  Description of Artificial Sequence: Synthetic oligonucleotide
ctttgtttgttcgtgaggcctttggcccg

SEQ ID NO: 203660 - DNA, 30 bp, Artificial Sequence
  Description of Artificial Sequence: Synthetic oligonucleotide
tttgtttgttcgtgaggcctttggcccgag

SEQ ID NO: 203661 - DNA, 29 bp, Artificial Sequence
  Description of Artificial Sequence: Synthetic oligonucleotide
ttgtttgttcgtgaggcctttggcccgag

SEQ ID NO: 203662 - DNA, 28 bp, Artificial Sequence
  Description of Artificial Sequence: Synthetic oligonucleotide
tgtttgttcgtgaggcctttggcccgag

SEQ ID NO: 203663 - DNA, 27 bp, Artificial Sequence
  Description of Artificial Sequence: Synthetic oligonucleotide
gtttgttcgtgaggcctttggcccgag

SEQ ID NO: 203664 - DNA, 27 bp, Artificial Sequence
  Description of Artificial Sequence: Synthetic oligonucleotide
tttgttcgtgaggcctttggcccgagc

SEQ ID NO: 203665 - DNA, 27 bp, Artificial Sequence
  Description of Artificial Sequence: Synthetic oligonucleotide
ttgttcgtgaggcctttggcccgagca

SEQ ID NO: 203666 - DNA, 26 bp, Artificial Sequence
  Description of Artificial Sequence: Synthetic oligonucleotide
tgttcgtgaggcctttggcccgagca

SEQ ID NO: 203667 - DNA, 25 bp, Artificial Sequence
  Description of Artificial Sequence: Synthetic oligonucleotide
gttcgtgaggcctttggcccgagca

SEQ ID NO: 203668 - DNA, 25 bp, Artificial Sequence
  Description of Artificial Sequence: Synthetic oligonucleotide
ttcgtgaggcctttggcccgagcac

SEQ ID NO: 203669 - DNA, 24 bp, Artificial Sequence
  Description of Artificial Sequence: Synthetic oligonucleotide
tcgtgaggcctttggcccgagcac

SEQ ID NO: 203670 - DNA, 23 bp, Artificial Sequence
  Description of Artificial Sequence: Synthetic oligonucleotide
cgtgaggcctttggcccgagcac

SEQ ID NO: 203671 - DNA, 23 bp, Artificial Sequence
  Description of Artificial Sequence: Synthetic oligonucleotide
gtgaggcctttggcccgagcacc

SEQ ID NO: 203672 - DNA, 23 bp, Artificial Sequence
  Description of Artificial Sequence: Synthetic oligonucleotide
tgaggcctttggcccgagcaccc

SEQ ID NO: 203673 - DNA, 22 bp, Artificial Sequence
  Description of Artificial Sequence: Synthetic oligonucleotide
gaggcctttggcccgagcaccc

SEQ ID NO: 203674 - DNA, 24 bp, Artificial Sequence
  Description of Artificial Sequence: Synthetic oligonucleotide
aggcctttggcccgagcacccgaa

SEQ ID NO: 203675 - DNA, 23 bp, Artificial Sequence
  Description of Artificial Sequence: Synthetic oligonucleotide
ggcctttggcccgagcacccgaa

SEQ ID NO: 203676 - DNA, 24 bp, Artificial Sequence
  Description of Artificial Sequence: Synthetic oligonucleotide
gcctttggcccgagcacccgaagt

SEQ ID NO: 203677 - DNA, 24 bp, Artificial Sequence
  Description of Artificial Sequence: Synthetic oligonucleotide
cctttggcccgagcacccgaagtg

SEQ ID NO: 203678 - DNA, 25 bp, Artificial Sequence
  Description of Artificial Sequence: Synthetic oligonucleotide
ctttggcccgagcacccgaagtgct

SEQ ID NO: 203679 - DNA, 25 bp, Artificial Sequence
  Description of Artificial Sequence: Synthetic oligonucleotide
tttggcccgagcacccgaagtgctg

SEQ ID NO: 203680 - DNA, 24 bp, Artificial Sequence
  Description of Artificial Sequence: Synthetic oligonucleotide
ttggcccgagcacccgaagtgctg

SEQ ID NO: 203681 - DNA, 23 bp, Artificial Sequence
  Description of Artificial Sequence: Synthetic oligonucleotide
tggcccgagcacccgaagtgctg

SEQ ID NO: 203682 - DNA, 22 bp, Artificial Sequence
  Description of Artificial Sequence: Synthetic oligonucleotide
ggcccgagcacccgaagtgctg

SEQ ID NO: 203683 - DNA, 22 bp, Artificial Sequence
  Description of Artificial Sequence: Synthetic oligonucleotide
gcccgagcacccgaagtgctgc

SEQ ID NO: 203684 - DNA, 24 bp, Artificial Sequence
  Description of Artificial Sequence: Synthetic oligonucleotide
cccgagcacccgaagtgctgccat

SEQ ID NO: 203685 - DNA, 27 bp, Artificial Sequence
  Description of Artificial Sequence: Synthetic oligonucleotide
ccgagcacccgaagtgctgccatgaaa

SEQ ID NO: 203686 - DNA, 32 bp, Artificial Sequence
  Description of Artificial Sequence: Synthetic oligonucleotide
cgagcacccgaagtgctgccatgaaattattc

SEQ ID NO: 203687 - DNA, 33 bp, Artificial Sequence
  Description of Artificial Sequence: Synthetic oligonucleotide
gagcacccgaagtgctgccatgaaattattcac

SEQ ID NO: 203688 - DNA, 34 bp, Artificial Sequence
  Description of Artificial Sequence: Synthetic oligonucleotide
agcacccgaagtgctgccatgaaattattcactg

SEQ ID NO: 203689 - DNA, 33 bp, Artificial Sequence
  Description of Artificial Sequence: Synthetic oligonucleotide
gcacccgaagtgctgccatgaaattattcactg

SEQ ID NO: 203690 - DNA, 33 bp, Artificial Sequence
  Description of Artificial Sequence: Synthetic oligonucleotide
cacccgaagtgctgccatgaaattattcactgc

SEQ ID NO: 203691 - DNA, 33 bp, Artificial Sequence
  Description of Artificial Sequence: Synthetic oligonucleotide
acccgaagtgctgccatgaaattattcactgcg

SEQ ID NO: 203692 - DNA, 32 bp, Artificial Sequence
  Description of Artificial Sequence: Synthetic oligonucleotide
cccgaagtgctgccatgaaattattcactgcg

SEQ ID NO: 203693 - DNA, 34 bp, Artificial Sequence
  Description of Artificial Sequence: Synthetic oligonucleotide
ccgaagtgctgccatgaaattattcactgcgatc

SEQ ID NO: 203694 - DNA, 34 bp, Artificial Sequence
  Description of Artificial Sequence: Synthetic oligonucleotide
cgaagtgctgccatgaaattattcactgcgatcc

SEQ ID NO: 203695 - DNA, 34 bp, Artificial Sequence
  Description of Artificial Sequence: Synthetic oligonucleotide
gaagtgctgccatgaaattattcactgcgatccg

SEQ ID NO: 203696 - DNA, 34 bp, Artificial Sequence
  Description of Artificial Sequence: Synthetic oligonucleotide
aagtgctgccatgaaattattcactgcgatccgg

SEQ ID NO: 203697 - DNA, 33 bp, Artificial Sequence
  Description of Artificial Sequence: Synthetic oligonucleotide
agtgctgccatgaaattattcactgcgatccgg

SEQ ID NO: 203698 - DNA, 32 bp, Artificial Sequence
  Description of Artificial Sequence: Synthetic oligonucleotide
gtgctgccatgaaattattcactgcgatccgg

SEQ ID NO: 203699 - DNA, 32 bp, Artificial Sequence
  Description of Artificial Sequence: Synthetic oligonucleotide
tgctgccatgaaattattcactgcgatccggg

SEQ ID NO: 203700 - DNA, 31 bp, Artificial Sequence
  Description of Artificial Sequence: Synthetic oligonucleotide
gctgccatgaaattattcactgcgatccggg

SEQ ID NO: 203701 - DNA, 33 bp, Artificial Sequence
  Description of Artificial Sequence: Synthetic oligonucleotide
ctgccatgaaattattcactgcgatccgggatg

SEQ ID NO: 203702 - DNA, 33 bp, Artificial Sequence
  Description of Artificial Sequence: Synthetic oligonucleotide
tgccatgaaattattcactgcgatccgggatgc

SEQ ID NO: 203703 - DNA, 32 bp, Artificial Sequence
  Description of Artificial Sequence: Synthetic oligonucleotide
gccatgaaattattcactgcgatccgggatgc

SEQ ID NO: 203704 - DNA, 32 bp, Artificial Sequence
  Description of Artificial Sequence: Synthetic oligonucleotide
ccatgaaattattcactgcgatccgggatgcc

SEQ ID NO: 203705 - DNA, 32 bp, Artificial Sequence
  Description of Artificial Sequence: Synthetic oligonucleotide
catgaaattattcactgcgatccgggatgccc

SEQ ID NO: 203706 - DNA, 33 bp, Artificial Sequence
  Description of Artificial Sequence: Synthetic oligonucleotide
atgaaattattcactgcgatccgggatgccctc

SEQ ID NO: 203707 - DNA, 32 bp, Artificial Sequence
  Description of Artificial Sequence: Synthetic oligonucleotide
tgaaattattcactgcgatccgggatgccctc

SEQ ID NO: 203708 - DNA, 31 bp, Artificial Sequence
  Description of Artificial Sequence: Synthetic oligonucleotide
gaaattattcactgcgatccgggatgccctc

SEQ ID NO: 203709 - DNA, 33 bp, Artificial Sequence
  Description of Artificial Sequence: Synthetic oligonucleotide
aaattattcactgcgatccgggatgccctcatc

SEQ ID NO: 203710 - DNA, 32 bp, Artificial Sequence
  Description of Artificial Sequence: Synthetic oligonucleotide
aattattcactgcgatccgggatgccctcatc

SEQ ID NO: 203711 - DNA, 31 bp, Artificial Sequence
  Description of Artificial Sequence: Synthetic oligonucleotide
attattcactgcgatccgggatgccctcatc

SEQ ID NO: 203712 - DNA, 30 bp, Artificial Sequence
  Description of Artificial Sequence: Synthetic oligonucleotide
ttattcactgcgatccgggatgccctcatc

SEQ ID NO: 203713 - DNA, 29 bp, Artificial Sequence
  Description of Artificial Sequence: Synthetic oligonucleotide
tattcactgcgatccgggatgccctcatc

SEQ ID NO: 203714 - DNA, 28 bp, Artificial Sequence
  Description of Artificial Sequence: Synthetic oligonucleotide
attcactgcgatccgggatgccctcatc

SEQ ID NO: 203715 - DNA, 27 bp, Artificial Sequence
  Description of Artificial Sequence: Synthetic oligonucleotide
ttcactgcgatccgggatgccctcatc

SEQ ID NO: 203716 - DNA, 27 bp, Artificial Sequence
  Description of Artificial Sequence: Synthetic oligonucleotide
tcactgcgatccgggatgccctcatca

SEQ ID NO: 203717 - DNA, 26 bp, Artificial Sequence
  Description of Artificial Sequence: Synthetic oligonucleotide
cactgcgatccgggatgccctcatca

SEQ ID NO: 203718 - DNA, 27 bp, Artificial Sequence
  Description of Artificial Sequence: Synthetic oligonucleotide
actgcgatccgggatgccctcatcact

SEQ ID NO: 203719 - DNA, 26 bp, Artificial Sequence
  Description of Artificial Sequence: Synthetic oligonucleotide
ctgcgatccgggatgccctcatcact

SEQ ID NO: 203720 - DNA, 26 bp, Artificial Sequence
  Description of Artificial Sequence: Synthetic oligonucleotide
tgcgatccgggatgccctcatcactc

SEQ ID NO: 203721 - DNA, 25 bp, Artificial Sequence
  Description of Artificial Sequence: Synthetic oligonucleotide
gcgatccgggatgccctcatcactc

SEQ ID NO: 203722 - DNA, 25 bp, Artificial Sequence
  Description of Artificial Sequence: Synthetic oligonucleotide
cgatccgggatgccctcatcactcg

SEQ ID NO: 203723 - DNA, 25 bp, Artificial Sequence
  Description of Artificial Sequence: Synthetic oligonucleotide
gatccgggatgccctcatcactcgc

SEQ ID NO: 203724 - DNA, 26 bp, Artificial Sequence
  Description of Artificial Sequence: Synthetic oligonucleotide
atccgggatgccctcatcactcgcct

SEQ ID NO: 203725 - DNA, 25 bp, Artificial Sequence
  Description of Artificial Sequence: Synthetic oligonucleotide
tccgggatgccctcatcactcgcct

SEQ ID NO: 203726 - DNA, 24 bp, Artificial Sequence
  Description of Artificial Sequence: Synthetic oligonucleotide
ccgggatgccctcatcactcgcct

SEQ ID NO: 203727 - DNA, 25 bp, Artificial Sequence
  Description of Artificial Sequence: Synthetic oligonucleotide
cgggatgccctcatcactcgcctca

SEQ ID NO: 203728 - DNA, 27 bp, Artificial Sequence
  Description of Artificial Sequence: Synthetic oligonucleotide
gggatgccctcatcactcgcctcagaa

SEQ ID NO: 203729 - DNA, 28 bp, Artificial Sequence
  Description of Artificial Sequence: Synthetic oligonucleotide
ggatgccctcatcactcgcctcagaaac

SEQ ID NO: 203730 - DNA, 28 bp, Artificial Sequence
  Description of Artificial Sequence: Synthetic oligonucleotide
gatgccctcatcactcgcctcagaaacc

SEQ ID NO: 203731 - DNA, 30 bp, Artificial Sequence
  Description of Artificial Sequence: Synthetic oligonucleotide
atgccctcatcactcgcctcagaaaccttc

SEQ ID NO: 203732 - DNA, 29 bp, Artificial Sequence
  Description of Artificial Sequence: Synthetic oligonucleotide
tgccctcatcactcgcctcagaaaccttc

SEQ ID NO: 203733 - DNA, 28 bp, Artificial Sequence
  Description of Artificial Sequence: Synthetic oligonucleotide
gccctcatcactcgcctcagaaaccttc

SEQ ID NO: 203734 - DNA, 28 bp, Artificial Sequence
  Description of Artificial Sequence: Synthetic oligonucleotide
ccctcatcactcgcctcagaaaccttcc

SEQ ID NO: 203735 - DNA, 28 bp, Artificial Sequence
  Description of Artificial Sequence: Synthetic oligonucleotide
cctcatcactcgcctcagaaaccttccc

SEQ ID NO: 203736 - DNA, 29 bp, Artificial Sequence
  Description of Artificial Sequence: Synthetic oligonucleotide
ctcatcactcgcctcagaaaccttccctg

SEQ ID NO: 203737 - DNA, 29 bp, Artificial Sequence
  Description of Artificial Sequence: Synthetic oligonucleotide
tcatcactcgcctcagaaaccttccctgg

SEQ ID NO: 203738 - DNA, 28 bp, Artificial Sequence
  Description of Artificial Sequence: Synthetic oligonucleotide
catcactcgcctcagaaaccttccctgg

SEQ ID NO: 203739 - DNA, 30 bp, Artificial Sequence
  Description of Artificial Sequence: Synthetic oligonucleotide
atcactcgcctcagaaaccttccctggatg

SEQ ID NO: 203740 - DNA, 29 bp, Artificial Sequence
  Description of Artificial Sequence: Synthetic oligonucleotide
tcactcgcctcagaaaccttccctggatg

SEQ ID NO: 203741 - DNA, 28 bp, Artificial Sequence
  Description of Artificial Sequence: Synthetic oligonucleotide
cactcgcctcagaaaccttccctggatg

SEQ ID NO: 203742 - DNA, 31 bp, Artificial Sequence
  Description of Artificial Sequence: Synthetic oligonucleotide
actcgcctcagaaaccttccctggatgaatg

SEQ ID NO: 203743 - DNA, 30 bp, Artificial Sequence
  Description of Artificial Sequence: Synthetic oligonucleotide
ctcgcctcagaaaccttccctggatgaatg

SEQ ID NO: 203744 - DNA, 31 bp, Artificial Sequence
  Description of Artificial Sequence: Synthetic oligonucleotide
tcgcctcagaaaccttccctggatgaatgag

SEQ ID NO: 203745 - DNA, 30 bp, Artificial Sequence
  Description of Artificial Sequence: Synthetic oligonucleotide
cgcctcagaaaccttccctggatgaatgag

SEQ ID NO: 203746 - DNA, 30 bp, Artificial Sequence
  Description of Artificial Sequence: Synthetic oligonucleotide
gcctcagaaaccttccctggatgaatgagg

SEQ ID NO: 203747 - DNA, 31 bp, Artificial Sequence
  Description of Artificial Sequence: Synthetic oligonucleotide
cctcagaaaccttccctggatgaatgaggag

SEQ ID NO: 203748 - DNA, 32 bp, Artificial Sequence
  Description of Artificial Sequence: Synthetic oligonucleotide
ctcagaaaccttccctggatgaatgaggagac

SEQ ID NO: 203749 - DNA, 32 bp, Artificial Sequence
  Description of Artificial Sequence: Synthetic oligonucleotide
tcagaaaccttccctggatgaatgaggagacc

SEQ ID NO: 203750 - DNA, 31 bp, Artificial Sequence
  Description of Artificial Sequence: Synthetic oligonucleotide
cagaaaccttccctggatgaatgaggagacc

SEQ ID NO: 203751 - DNA, 31 bp, Artificial Sequence
  Description of Artificial Sequence: Synthetic oligonucleotide
agaaaccttccctggatgaatgaggagaccc

SEQ ID NO: 203752 - DNA, 30 bp, Artificial Sequence
  Description of Artificial Sequence: Synthetic oligonucleotide
gaaaccttccctggatgaatgaggagaccc

SEQ ID NO: 203753 - DNA, 31 bp, Artificial Sequence
  Description of Artificial Sequence: Synthetic oligonucleotide
aaaccttccctggatgaatgaggagacccag

SEQ ID NO: 203754 - DNA, 30 bp, Artificial Sequence
  Description of Artificial Sequence: Synthetic oligonucleotide
aaccttccctggatgaatgaggagacccag

SEQ ID NO: 203755 - DNA, 29 bp, Artificial Sequence
  Description of Artificial Sequence: Synthetic oligonucleotide
accttccctggatgaatgaggagacccag

SEQ ID NO: 203756 - DNA, 28 bp, Artificial Sequence
  Description of Artificial Sequence: Synthetic oligonucleotide
ccttccctggatgaatgaggagacccag

SEQ ID NO: 203757 - DNA, 30 bp, Artificial Sequence
  Description of Artificial Sequence: Synthetic oligonucleotide
cttccctggatgaatgaggagacccagaac

SEQ ID NO: 203758 - DNA, 32 bp, Artificial Sequence
  Description of Artificial Sequence: Synthetic oligonucleotide
ttccctggatgaatgaggagacccagaacatg

SEQ ID NO: 203759 - DNA, 31 bp, Artificial Sequence
  Description of Artificial Sequence: Synthetic oligonucleotide
tccctggatgaatgaggagacccagaacatg

SEQ ID NO: 203760 - DNA, 30 bp, Artificial Sequence
  Description of Artificial Sequence: Synthetic oligonucleotide
ccctggatgaatgaggagacccagaacatg

SEQ ID NO: 203761 - DNA, 30 bp, Artificial Sequence
  Description of Artificial Sequence: Synthetic oligonucleotide
cctggatgaatgaggagacccagaacatgg

SEQ ID NO: 203762 - DNA, 30 bp, Artificial Sequence
  Description of Artificial Sequence: Synthetic oligonucleotide
ctggatgaatgaggagacccagaacatggc

SEQ ID NO: 203763 - DNA, 30 bp, Artificial Sequence
  Description of Artificial Sequence: Synthetic oligonucleotide
tggatgaatgaggagacccagaacatggcc

SEQ ID NO: 203764 - DNA, 29 bp, Artificial Sequence
  Description of Artificial Sequence: Synthetic oligonucleotide
ggatgaatgaggagacccagaacatggcc

SEQ ID NO: 203765 - DNA, 29 bp, Artificial Sequence
  Description of Artificial Sequence: Synthetic oligonucleotide
gatgaatgaggagacccagaacatggccc

SEQ ID NO: 203766 - DNA, 30 bp, Artificial Sequence
  Description of Artificial Sequence: Synthetic oligonucleotide
atgaatgaggagacccagaacatggcccag

SEQ ID NO: 203767 - DNA, 29 bp, Artificial Sequence
  Description of Artificial Sequence: Synthetic oligonucleotide
tgaatgaggagacccagaacatggcccag

SEQ ID NO: 203768 - DNA, 28 bp, Artificial Sequence
  Description of Artificial Sequence: Synthetic oligonucleotide
gaatgaggagacccagaacatggcccag

SEQ ID NO: 203769 - DNA, 28 bp, Artificial Sequence
  Description of Artificial Sequence: Synthetic oligonucleotide
aatgaggagacccagaacatggcccagg

SEQ ID NO: 203770 - DNA, 27 bp, Artificial Sequence
  Description of Artificial Sequence: Synthetic oligonucleotide
atgaggagacccagaacatggcccagg

SEQ ID NO: 203771 - DNA, 27 bp, Artificial Sequence
  Description of Artificial Sequence: Synthetic oligonucleotide
tgaggagacccagaacatggcccagga

SEQ ID NO: 203772 - DNA, 26 bp, Artificial Sequence
  Description of Artificial Sequence: Synthetic oligonucleotide
gaggagacccagaacatggcccagga

SEQ ID NO: 203773 - DNA, 27 bp, Artificial Sequence
  Description of Artificial Sequence: Synthetic oligonucleotide
aggagacccagaacatggcccaggaca

SEQ ID NO: 203774 - DNA, 27 bp, Artificial Sequence
  Description of Artificial Sequence: Synthetic oligonucleotide
ggagacccagaacatggcccaggacaa

SEQ ID NO: 203775 - DNA, 27 bp, Artificial Sequence
  Description of Artificial Sequence: Synthetic oligonucleotide
gagacccagaacatggcccaggacaag

SEQ ID NO: 203776 - DNA, 27 bp, Artificial Sequence
  Description of Artificial Sequence: Synthetic oligonucleotide
agacccagaacatggcccaggacaagg

SEQ ID NO: 203777 - DNA, 27 bp, Artificial Sequence
  Description of Artificial Sequence: Synthetic oligonucleotide
gacccagaacatggcccaggacaaggt

SEQ ID NO: 203778 - DNA, 28 bp, Artificial Sequence
  Description of Artificial Sequence: Synthetic oligonucleotide
acccagaacatggcccaggacaaggttg

SEQ ID NO: 203779 - DNA, 27 bp, Artificial Sequence
  Description of Artificial Sequence: Synthetic oligonucleotide
cccagaacatggcccaggacaaggttg

SEQ ID NO: 203780 - DNA, 27 bp, Artificial Sequence
  Description of Artificial Sequence: Synthetic oligonucleotide
ccagaacatggcccaggacaaggttgc

SEQ ID NO: 203781 - DNA, 28 bp, Artificial Sequence
  Description of Artificial Sequence: Synthetic oligonucleotide
cagaacatggcccaggacaaggttgctc

SEQ ID NO: 203782 - DNA, 30 bp, Artificial Sequence
  Description of Artificial Sequence: Synthetic oligonucleotide
agaacatggcccaggacaaggttgctcaac

SEQ ID NO: 203783 - DNA, 29 bp, Artificial Sequence
  Description of Artificial Sequence: Synthetic oligonucleotide
gaacatggcccaggacaaggttgctcaac

SEQ ID NO: 203784 - DNA, 30 bp, Artificial Sequence
  Description of Artificial Sequence: Synthetic oligonucleotide
aacatggcccaggacaaggttgctcaactg

SEQ ID NO: 203785 - DNA, 29 bp, Artificial Sequence
  Description of Artificial Sequence: Synthetic oligonucleotide
acatggcccaggacaaggttgctcaactg

SEQ ID NO: 203786 - DNA, 28 bp, Artificial Sequence
  Description of Artificial Sequence: Synthetic oligonucleotide
catggcccaggacaaggttgctcaactg

SEQ ID NO: 203787 - DNA, 28 bp, Artificial Sequence
  Description of Artificial Sequence: Synthetic oligonucleotide
atggcccaggacaaggttgctcaactgc

SEQ ID NO: 203788 - DNA, 27 bp, Artificial Sequence
  Description of Artificial Sequence: Synthetic oligonucleotide
tggcccaggacaaggttgctcaactgc

SEQ ID NO: 203789 - DNA, 27 bp, Artificial Sequence
  Description of Artificial Sequence: Synthetic oligonucleotide
ggcccaggacaaggttgctcaactgca

SEQ ID NO: 203790 - DNA, 27 bp, Artificial Sequence
  Description of Artificial Sequence: Synthetic oligonucleotide
gcccaggacaaggttgctcaactgcag

SEQ ID NO: 203791 - DNA, 27 bp, Artificial Sequence
  Description of Artificial Sequence: Synthetic oligonucleotide
cccaggacaaggttgctcaactgcagg

SEQ ID NO: 203792 - DNA, 28 bp, Artificial Sequence
  Description of Artificial Sequence: Synthetic oligonucleotide
ccaggacaaggttgctcaactgcaggtg

SEQ ID NO: 203793 - DNA, 28 bp, Artificial Sequence
  Description of Artificial Sequence: Synthetic oligonucleotide
caggacaaggttgctcaactgcaggtgg

SEQ ID NO: 203794 - DNA, 29 bp, Artificial Sequence
  Description of Artificial Sequence: Synthetic oligonucleotide
aggacaaggttgctcaactgcaggtggag

SEQ ID NO: 203795 - DNA, 28 bp, Artificial Sequence
  Description of Artificial Sequence: Synthetic oligonucleotide
ggacaaggttgctcaactgcaggtggag

SEQ ID NO: 203796 - DNA, 30 bp, Artificial Sequence
  Description of Artificial Sequence: Synthetic oligonucleotide
gacaaggttgctcaactgcaggtggagatg

SEQ ID NO: 203797 - DNA, 30 bp, Artificial Sequence
  Description of Artificial Sequence: Synthetic oligonucleotide
acaaggttgctcaactgcaggtggagatgg

SEQ ID NO: 203798 - DNA, 29 bp, Artificial Sequence
  Description of Artificial Sequence: Synthetic oligonucleotide
caaggttgctcaactgcaggtggagatgg

SEQ ID NO: 203799 - DNA, 29 bp, Artificial Sequence
  Description of Artificial Sequence: Synthetic oligonucleotide
aaggttgctcaactgcaggtggagatggg

SEQ ID NO: 203800 - DNA, 28 bp, Artificial Sequence
  Description of Artificial Sequence: Synthetic oligonucleotide
aggttgctcaactgcaggtggagatggg

SEQ ID NO: 203801 - DNA, 27 bp, Artificial Sequence
  Description of Artificial Sequence: Synthetic oligonucleotide
ggttgctcaactgcaggtggagatggg

SEQ ID NO: 203802 - DNA, 27 bp, Artificial Sequence
  Description of Artificial Sequence: Synthetic oligonucleotide
gttgctcaactgcaggtggagatgggg

SEQ ID NO: 203803 - DNA, 27 bp, Artificial Sequence
  Description of Artificial Sequence: Synthetic oligonucleotide
ttgctcaactgcaggtggagatggggg

SEQ ID NO: 203804 - DNA, 26 bp, Artificial Sequence
  Description of Artificial Sequence: Synthetic oligonucleotide
tgctcaactgcaggtggagatggggg

SEQ ID NO: 203805 - DNA, 25 bp, Artificial Sequence
  Description of Artificial Sequence: Synthetic oligonucleotide
gctcaactgcaggtggagatggggg

SEQ ID NO: 203806 - DNA, 27 bp, Artificial Sequence
  Description of Artificial Sequence: Synthetic oligonucleotide
ctcaactgcaggtggagatgggggctt

SEQ ID NO: 203807 - DNA, 27 bp, Artificial Sequence
  Description of Artificial Sequence: Synthetic oligonucleotide
tcaactgcaggtggagatgggggcttc

SEQ ID NO: 203808 - DNA, 27 bp, Artificial Sequence
  Description of Artificial Sequence: Synthetic oligonucleotide
caactgcaggtggagatgggggcttca

SEQ ID NO: 203809 - DNA, 27 bp, Artificial Sequence
  Description of Artificial Sequence: Synthetic oligonucleotide
aactgcaggtggagatgggggcttcag

SEQ ID NO: 203810 - DNA, 27 bp, Artificial Sequence
  Description of Artificial Sequence: Synthetic oligonucleotide
actgcaggtggagatgggggcttcaga

SEQ ID NO: 203811 - DNA, 27 bp, Artificial Sequence
  Description of Artificial Sequence: Synthetic oligonucleotide
ctgcaggtggagatgggggcttcagaa

SEQ ID NO: 203812 - DNA, 28 bp, Artificial Sequence
  Description of Artificial Sequence: Synthetic oligonucleotide
tgcaggtggagatgggggcttcagaatg

SEQ ID NO: 203813 - DNA, 27 bp, Artificial Sequence
  Description of Artificial Sequence: Synthetic oligonucleotide
gcaggtggagatgggggcttcagaatg

SEQ ID NO: 203814 - DNA, 27 bp, Artificial Sequence
  Description of Artificial Sequence: Synthetic oligonucleotide
caggtggagatgggggcttcagaatgg

SEQ ID NO: 203815 - DNA, 27 bp, Artificial Sequence
  Description of Artificial Sequence: Synthetic oligonucleotide
aggtggagatgggggcttcagaatggg

SEQ ID NO: 203816 - DNA, 26 bp, Artificial Sequence
  Description of Artificial Sequence: Synthetic oligonucleotide
ggtggagatgggggcttcagaatggg

SEQ ID NO: 203817 - DNA, 26 bp, Artificial Sequence
  Description of Artificial Sequence: Synthetic oligonucleotide
gtggagatgggggcttcagaatgggc

SEQ ID NO: 203818 - DNA, 26 bp, Artificial Sequence
  Description of Artificial Sequence: Synthetic oligonucleotide
tggagatgggggcttcagaatgggcc

SEQ ID NO: 203819 - DNA, 25 bp, Artificial Sequence
  Description of Artificial Sequence: Synthetic oligonucleotide
ggagatgggggcttcagaatgggcc

SEQ ID NO: 203820 - DNA, 26 bp, Artificial Sequence
  Description of Artificial Sequence: Synthetic oligonucleotide
gagatgggggcttcagaatgggccct

SEQ ID NO: 203821 - DNA, 27 bp, Artificial Sequence
  Description of Artificial Sequence: Synthetic oligonucleotide
agatgggggcttcagaatgggccctga

SEQ ID NO: 203822 - DNA, 27 bp, Artificial Sequence
  Description of Artificial Sequence: Synthetic oligonucleotide
gatgggggcttcagaatgggccctgaa

SEQ ID NO: 203823 - DNA, 27 bp, Artificial Sequence
  Description of Artificial Sequence: Synthetic oligonucleotide
atgggggcttcagaatgggccctgaag

SEQ ID NO: 203824 - DNA, 26 bp, Artificial Sequence
  Description of Artificial Sequence: Synthetic oligonucleotide
tgggggcttcagaatgggccctgaag

SEQ ID NO: 203825 - DNA, 25 bp, Artificial Sequence
  Description of Artificial Sequence: Synthetic oligonucleotide
gggggcttcagaatgggccctgaag

SEQ ID NO: 203826 - DNA, 25 bp, Artificial Sequence
  Description of Artificial Sequence: Synthetic oligonucleotide
ggggcttcagaatgggccctgaagc

SEQ ID NO: 203827 - DNA, 26 bp, Artificial Sequence
  Description of Artificial Sequence: Synthetic oligonucleotide
gggcttcagaatgggccctgaagcca

SEQ ID NO: 203828 - DNA, 27 bp, Artificial Sequence
  Description of Artificial Sequence: Synthetic oligonucleotide
ggcttcagaatgggccctgaagccaga

SEQ ID NO: 203829 - DNA, 27 bp, Artificial Sequence
  Description of Artificial Sequence: Synthetic oligonucleotide
gcttcagaatgggccctgaagccagag

SEQ ID NO: 203830 - DNA, 27 bp, Artificial Sequence
  Description of Artificial Sequence: Synthetic oligonucleotide
cttcagaatgggccctgaagccagagc

SEQ ID NO: 203831 - DNA, 28 bp, Artificial Sequence
  Description of Artificial Sequence: Synthetic oligonucleotide
ttcagaatgggccctgaagccagagctg

SEQ ID NO: 203832 - DNA, 27 bp, Artificial Sequence
  Description of Artificial Sequence: Synthetic oligonucleotide
tcagaatgggccctgaagccagagctg

SEQ ID NO: 203833 - DNA, 26 bp, Artificial Sequence
  Description of Artificial Sequence: Synthetic oligonucleotide
cagaatgggccctgaagccagagctg

SEQ ID NO: 203834 - DNA, 26 bp, Artificial Sequence
  Description of Artificial Sequence: Synthetic oligonucleotide
agaatgggccctgaagccagagctgg

SEQ ID NO: 203835 - DNA, 25 bp, Artificial Sequence
  Description of Artificial Sequence: Synthetic oligonucleotide
gaatgggccctgaagccagagctgg

SEQ ID NO: 203836 - DNA, 25 bp, Artificial Sequence
  Description of Artificial Sequence: Synthetic oligonucleotide
aatgggccctgaagccagagctggc

SEQ ID NO: 203837 - DNA, 24 bp, Artificial Sequence
  Description of Artificial Sequence: Synthetic oligonucleotide
atgggccctgaagccagagctggc

SEQ ID NO: 203838 - DNA, 23 bp, Artificial Sequence
  Description of Artificial Sequence: Synthetic oligonucleotide
tgggccctgaagccagagctggc

SEQ ID NO: 203839 - DNA, 22 bp, Artificial Sequence
  Description of Artificial Sequence: Synthetic oligonucleotide
gggccctgaagccagagctggc

SEQ ID NO: 203840 - DNA, 22 bp, Artificial Sequence
  Description of Artificial Sequence: Synthetic oligonucleotide
ggccctgaagccagagctggcc

SEQ ID NO: 203841 - DNA, 22 bp, Artificial Sequence
  Description of Artificial Sequence: Synthetic oligonucleotide
gccctgaagccagagctggccc

SEQ ID NO: 203842 - DNA, 23 bp, Artificial Sequence
  Description of Artificial Sequence: Synthetic oligonucleotide
ccctgaagccagagctggcccga

SEQ ID NO: 203843 - DNA, 25 bp, Artificial Sequence
  Description of Artificial Sequence: Synthetic oligonucleotide
cctgaagccagagctggcccgacaa

SEQ ID NO: 203844 - DNA, 27 bp, Artificial Sequence
  Description of Artificial Sequence: Synthetic oligonucleotide
ctgaagccagagctggcccgacaagaa

SEQ ID NO: 203845 - DNA, 29 bp, Artificial Sequence
  Description of Artificial Sequence: Synthetic oligonucleotide
tgaagccagagctggcccgacaagaatac

SEQ ID NO: 203846 - DNA, 28 bp, Artificial Sequence
  Description of Artificial Sequence: Synthetic oligonucleotide
gaagccagagctggcccgacaagaatac

SEQ ID NO: 203847 - DNA, 30 bp, Artificial Sequence
  Description of Artificial Sequence: Synthetic oligonucleotide
aagccagagctggcccgacaagaatacaac

SEQ ID NO: 203848 - DNA, 29 bp, Artificial Sequence
  Description of Artificial Sequence: Synthetic oligonucleotide
agccagagctggcccgacaagaatacaac

SEQ ID NO: 203849 - DNA, 28 bp, Artificial Sequence
  Description of Artificial Sequence: Synthetic oligonucleotide
gccagagctggcccgacaagaatacaac

SEQ ID NO: 203850 - DNA, 28 bp, Artificial Sequence
  Description of Artificial Sequence: Synthetic oligonucleotide
ccagagctggcccgacaagaatacaacg

SEQ ID NO: 203851 - DNA, 33 bp, Artificial Sequence
  Description of Artificial Sequence: Synthetic oligonucleotide
cagagctggcccgacaagaatacaacgatatac

SEQ ID NO: 203852 - DNA, 34 bp, Artificial Sequence
  Description of Artificial Sequence: Synthetic oligonucleotide
agagctggcccgacaagaatacaacgatatacag

SEQ ID NO: 203853 - DNA, 33 bp, Artificial Sequence
  Description of Artificial Sequence: Synthetic oligonucleotide
gagctggcccgacaagaatacaacgatatacag

SEQ ID NO: 203854 - DNA, 33 bp, Artificial Sequence
  Description of Artificial Sequence: Synthetic oligonucleotide
agctggcccgacaagaatacaacgatatacagc

SEQ ID NO: 203855 - DNA, 32 bp, Artificial Sequence
  Description of Artificial Sequence: Synthetic oligonucleotide
gctggcccgacaagaatacaacgatatacagc

SEQ ID NO: 203856 - DNA, 34 bp, Artificial Sequence
  Description of Artificial Sequence: Synthetic oligonucleotide
ctggcccgacaagaatacaacgatatacagcttg

SEQ ID NO: 203857 - DNA, 34 bp, Artificial Sequence
  Description of Artificial Sequence: Synthetic oligonucleotide
tggcccgacaagaatacaacgatatacagcttgg

SEQ ID NO: 203858 - DNA, 33 bp, Artificial Sequence
  Description of Artificial Sequence: Synthetic oligonucleotide
ggcccgacaagaatacaacgatatacagcttgg

SEQ ID NO: 203859 - DNA, 35 bp, Artificial Sequence
  Description of Artificial Sequence: Synthetic oligonucleotide
gcccgacaagaatacaacgatatacagcttggatc

SEQ ID NO: 203860 - DNA, 35 bp, Artificial Sequence
  Description of Artificial Sequence: Synthetic oligonucleotide
cccgacaagaatacaacgatatacagcttggatcg

SEQ ID NO: 203861 - DNA, 36 bp, Artificial Sequence
  Description of Artificial Sequence: Synthetic oligonucleotide
ccgacaagaatacaacgatatacagcttggatcgag

SEQ ID NO: 203862 - DNA, 36 bp, Artificial Sequence
  Description of Artificial Sequence: Synthetic oligonucleotide
cgacaagaatacaacgatatacagcttggatcgagc

SEQ ID NO: 203863 - DNA, 38 bp, Artificial Sequence
  Description of Artificial Sequence: Synthetic oligonucleotide
gacaagaatacaacgatatacagcttggatcgagcttc

SEQ ID NO: 203864 - DNA, 38 bp, Artificial Sequence
  Description of Artificial Sequence: Synthetic oligonucleotide
acaagaatacaacgatatacagcttggatcgagcttcc

SEQ ID NO: 203865 - DNA, 37 bp, Artificial Sequence
  Description of Artificial Sequence: Synthetic oligonucleotide
caagaatacaacgatatacagcttggatcgagcttcc

SEQ ID NO: 203866 - DNA, 38 bp, Artificial Sequence
  Description of Artificial Sequence: Synthetic oligonucleotide
aagaatacaacgatatacagcttggatcgagcttcctg

SEQ ID NO: 203867 - DNA, 37 bp, Artificial Sequence
  Description of Artificial Sequence: Synthetic oligonucleotide
agaatacaacgatatacagcttggatcgagcttcctg

SEQ ID NO: 203868 - DNA, 36 bp, Artificial Sequence
  Description of Artificial Sequence: Synthetic oligonucleotide
gaatacaacgatatacagcttggatcgagcttcctg

SEQ ID NO: 203869 - DNA, 36 bp, Artificial Sequence
  Description of Artificial Sequence: Synthetic oligonucleotide
aatacaacgatatacagcttggatcgagcttcctgc

SEQ ID NO: 203870 - DNA, 35 bp, Artificial Sequence
  Description of Artificial Sequence: Synthetic oligonucleotide
atacaacgatatacagcttggatcgagcttcctgc

SEQ ID NO: 203871 - DNA, 34 bp, Artificial Sequence
  Description of Artificial Sequence: Synthetic oligonucleotide
tacaacgatatacagcttggatcgagcttcctgc

SEQ ID NO: 203872 - DNA, 33 bp, Artificial Sequence
  Description of Artificial Sequence: Synthetic oligonucleotide
acaacgatatacagcttggatcgagcttcctgc

SEQ ID NO: 203873 - DNA, 32 bp, Artificial Sequence
  Description of Artificial Sequence: Synthetic oligonucleotide
caacgatatacagcttggatcgagcttcctgc

SEQ ID NO: 203874 - DNA, 33 bp, Artificial Sequence
  Description of Artificial Sequence: Synthetic oligonucleotide
aacgatatacagcttggatcgagcttcctgcag

SEQ ID NO: 203875 - DNA, 32 bp, Artificial Sequence
  Description of Artificial Sequence: Synthetic oligonucleotide
acgatatacagcttggatcgagcttcctgcag

SEQ ID NO: 203876 - DNA, 31 bp, Artificial Sequence
  Description of Artificial Sequence: Synthetic oligonucleotide
cgatatacagcttggatcgagcttcctgcag

SEQ ID NO: 203877 - DNA, 32 bp, Artificial Sequence
  Description of Artificial Sequence: Synthetic oligonucleotide
gatatacagcttggatcgagcttcctgcagtc

SEQ ID NO: 203878 - DNA, 33 bp, Artificial Sequence
  Description of Artificial Sequence: Synthetic oligonucleotide
atatacagcttggatcgagcttcctgcagtctg

SEQ ID NO: 203879 - DNA, 32 bp, Artificial Sequence
  Description of Artificial Sequence: Synthetic oligonucleotide
tatacagcttggatcgagcttcctgcagtctg

SEQ ID NO: 203880 - DNA, 31 bp, Artificial Sequence
  Description of Artificial Sequence: Synthetic oligonucleotide
atacagcttggatcgagcttcctgcagtctg

SEQ ID NO: 203881 - DNA, 30 bp, Artificial Sequence
  Description of Artificial Sequence: Synthetic oligonucleotide
tacagcttggatcgagcttcctgcagtctg

SEQ ID NO: 203882 - DNA, 29 bp, Artificial Sequence
  Description of Artificial Sequence: Synthetic oligonucleotide
acagcttggatcgagcttcctgcagtctg

SEQ ID NO: 203883 - DNA, 28 bp, Artificial Sequence
  Description of Artificial Sequence: Synthetic oligonucleotide
cagcttggatcgagcttcctgcagtctg

SEQ ID NO: 203884 - DNA, 29 bp, Artificial Sequence
  Description of Artificial Sequence: Synthetic oligonucleotide
agcttggatcgagcttcctgcagtctgtc

SEQ ID NO: 203885 - DNA, 28 bp, Artificial Sequence
  Description of Artificial Sequence: Synthetic oligonucleotide
gcttggatcgagcttcctgcagtctgtc

SEQ ID NO: 203886 - DNA, 28 bp, Artificial Sequence
  Description of Artificial Sequence: Synthetic oligonucleotide
cttggatcgagcttcctgcagtctgtcc

SEQ ID NO: 203887 - DNA, 29 bp, Artificial Sequence
  Description of Artificial Sequence: Synthetic oligonucleotide
ttggatcgagcttcctgcagtctgtcctg

SEQ ID NO: 203888 - DNA, 28 bp, Artificial Sequence
  Description of Artificial Sequence: Synthetic oligonucleotide
tggatcgagcttcctgcagtctgtcctg

SEQ ID NO: 203889 - DNA, 27 bp, Artificial Sequence
  Description of Artificial Sequence: Synthetic oligonucleotide
ggatcgagcttcctgcagtctgtcctg

SEQ ID NO: 203890 - DNA, 28 bp, Artificial Sequence
  Description of Artificial Sequence: Synthetic oligonucleotide
gatcgagcttcctgcagtctgtcctgag

SEQ ID NO: 203891 - DNA, 28 bp, Artificial Sequence
  Description of Artificial Sequence: Synthetic oligonucleotide
atcgagcttcctgcagtctgtcctgagc

SEQ ID NO: 203892 - DNA, 27 bp, Artificial Sequence
  Description of Artificial Sequence: Synthetic oligonucleotide
tcgagcttcctgcagtctgtcctgagc

SEQ ID NO: 203893 - DNA, 27 bp, Artificial Sequence
  Description of Artificial Sequence: Synthetic oligonucleotide
cgagcttcctgcagtctgtcctgagct

SEQ ID NO: 203894 - DNA, 27 bp, Artificial Sequence
  Description of Artificial Sequence: Synthetic oligonucleotide
gagcttcctgcagtctgtcctgagctg

SEQ ID NO: 203895 - DNA, 28 bp, Artificial Sequence
  Description of Artificial Sequence: Synthetic oligonucleotide
agcttcctgcagtctgtcctgagctgtg

SEQ ID NO: 203896 - DNA, 27 bp, Artificial Sequence
  Description of Artificial Sequence: Synthetic oligonucleotide
gcttcctgcagtctgtcctgagctgtg

SEQ ID NO: 203897 - DNA, 28 bp, Artificial Sequence
  Description of Artificial Sequence: Synthetic oligonucleotide
cttcctgcagtctgtcctgagctgtgtc

SEQ ID NO: 203898 - DNA, 28 bp, Artificial Sequence
  Description of Artificial Sequence: Synthetic oligonucleotide
ttcctgcagtctgtcctgagctgtgtcc

SEQ ID NO: 203899 - DNA, 27 bp, Artificial Sequence
  Description of Artificial Sequence: Synthetic oligonucleotide
tcctgcagtctgtcctgagctgtgtcc

SEQ ID NO: 203900 - DNA, 26 bp, Artificial Sequence
  Description of Artificial Sequence: Synthetic oligonucleotide
cctgcagtctgtcctgagctgtgtcc

SEQ ID NO: 203901 - DNA, 26 bp, Artificial Sequence
  Description of Artificial Sequence: Synthetic oligonucleotide
ctgcagtctgtcctgagctgtgtccg

SEQ ID NO: 203902 - DNA, 27 bp, Artificial Sequence
  Description of Artificial Sequence: Synthetic oligonucleotide
tgcagtctgtcctgagctgtgtccggt

SEQ ID NO: 203903 - DNA, 26 bp, Artificial Sequence
  Description of Artificial Sequence: Synthetic oligonucleotide
gcagtctgtcctgagctgtgtccggt

SEQ ID NO: 203904 - DNA, 26 bp, Artificial Sequence
  Description of Artificial Sequence: Synthetic oligonucleotide
cagtctgtcctgagctgtgtccggtc

SEQ ID NO: 203905 - DNA, 26 bp, Artificial Sequence
  Description of Artificial Sequence: Synthetic oligonucleotide
agtctgtcctgagctgtgtccggtcc

SEQ ID NO: 203906 - DNA, 25 bp, Artificial Sequence
  Description of Artificial Sequence: Synthetic oligonucleotide
gtctgtcctgagctgtgtccggtcc

SEQ ID NO: 203907 - DNA, 26 bp, Artificial Sequence
  Description of Artificial Sequence: Synthetic oligonucleotide
tctgtcctgagctgtgtccggtccct

SEQ ID NO: 203908 - DNA, 25 bp, Artificial Sequence
  Description of Artificial Sequence: Synthetic oligonucleotide
ctgtcctgagctgtgtccggtccct

SEQ ID NO: 203909 - DNA, 25 bp, Artificial Sequence
  Description of Artificial Sequence: Synthetic oligonucleotide
tgtcctgagctgtgtccggtccctc

SEQ ID NO: 203910 - DNA, 24 bp, Artificial Sequence
  Description of Artificial Sequence: Synthetic oligonucleotide
gtcctgagctgtgtccggtccctc

SEQ ID NO: 203911 - DNA, 24 bp, Artificial Sequence
  Description of Artificial Sequence: Synthetic oligonucleotide
tcctgagctgtgtccggtccctcc

SEQ ID NO: 203912 - DNA, 23 bp, Artificial Sequence
  Description of Artificial Sequence: Synthetic oligonucleotide
cctgagctgtgtccggtccctcc

SEQ ID NO: 203913 - DNA, 24 bp, Artificial Sequence
  Description of Artificial Sequence: Synthetic oligonucleotide
ctgagctgtgtccggtccctccga

SEQ ID NO: 203914 - DNA, 24 bp, Artificial Sequence
  Description of Artificial Sequence: Synthetic oligonucleotide
tgagctgtgtccggtccctccgag

SEQ ID NO: 203915 - DNA, 23 bp, Artificial Sequence
  Description of Artificial Sequence: Synthetic oligonucleotide
gagctgtgtccggtccctccgag

SEQ ID NO: 203916 - DNA, 25 bp, Artificial Sequence
  Description of Artificial Sequence: Synthetic oligonucleotide
agctgtgtccggtccctccgagcta

SEQ ID NO: 203917 - DNA, 24 bp, Artificial Sequence
  Description of Artificial Sequence: Synthetic oligonucleotide
gctgtgtccggtccctccgagcta

SEQ ID NO: 203918 - DNA, 27 bp, Artificial Sequence
  Description of Artificial Sequence: Synthetic oligonucleotide
ctgtgtccggtccctccgagctagaat

SEQ ID NO: 203919 - DNA, 28 bp, Artificial Sequence
  Description of Artificial Sequence: Synthetic oligonucleotide
tgtgtccggtccctccgagctagaattg

SEQ ID NO: 203920 - DNA, 27 bp, Artificial Sequence
  Description of Artificial Sequence: Synthetic oligonucleotide
gtgtccggtccctccgagctagaattg

SEQ ID NO: 203921 - DNA, 28 bp, Artificial Sequence
  Description of Artificial Sequence: Synthetic oligonucleotide
tgtccggtccctccgagctagaattgtc

SEQ ID NO: 203922 - DNA, 27 bp, Artificial Sequence
  Description of Artificial Sequence: Synthetic oligonucleotide
gtccggtccctccgagctagaattgtc

SEQ ID NO: 203923 - DNA, 27 bp, Artificial Sequence
  Description of Artificial Sequence: Synthetic oligonucleotide
tccggtccctccgagctagaattgtcc

SEQ ID NO: 203924 - DNA, 27 bp, Artificial Sequence
  Description of Artificial Sequence: Synthetic oligonucleotide
ccggtccctccgagctagaattgtcca

SEQ ID NO: 203925 - DNA, 27 bp, Artificial Sequence
  Description of Artificial Sequence: Synthetic oligonucleotide
cggtccctccgagctagaattgtccag

SEQ ID NO: 203926 - DNA, 28 bp, Artificial Sequence
  Description of Artificial Sequence: Synthetic oligonucleotide
ggtccctccgagctagaattgtccagag

SEQ ID NO: 203927 - DNA, 28 bp, Artificial Sequence
  Description of Artificial Sequence: Synthetic oligonucleotide
gtccctccgagctagaattgtccagagc

SEQ ID NO: 203928 - DNA, 30 bp, Artificial Sequence
  Description of Artificial Sequence: Synthetic oligonucleotide
tccctccgagctagaattgtccagagcttc

SEQ ID NO: 203929 - DNA, 29 bp, Artificial Sequence
  Description of Artificial Sequence: Synthetic oligonucleotide
ccctccgagctagaattgtccagagcttc

SEQ ID NO: 203930 - DNA, 31 bp, Artificial Sequence
  Description of Artificial Sequence: Synthetic oligonucleotide
cctccgagctagaattgtccagagcttcttg

SEQ ID NO: 203931 - DNA, 31 bp, Artificial Sequence
  Description of Artificial Sequence: Synthetic oligonucleotide
ctccgagctagaattgtccagagcttcttgc

SEQ ID NO: 203932 - DNA, 32 bp, Artificial Sequence
  Description of Artificial Sequence: Synthetic oligonucleotide
tccgagctagaattgtccagagcttcttgcag

SEQ ID NO: 203933 - DNA, 31 bp, Artificial Sequence
  Description of Artificial Sequence: Synthetic oligonucleotide
ccgagctagaattgtccagagcttcttgcag

SEQ ID NO: 203934 - DNA, 31 bp, Artificial Sequence
  Description of Artificial Sequence: Synthetic oligonucleotide
cgagctagaattgtccagagcttcttgcagc

SEQ ID NO: 203935 - DNA, 31 bp, Artificial Sequence
  Description of Artificial Sequence: Synthetic oligonucleotide
gagctagaattgtccagagcttcttgcagcc

SEQ ID NO: 203936 - DNA, 32 bp, Artificial Sequence
  Description of Artificial Sequence: Synthetic oligonucleotide
agctagaattgtccagagcttcttgcagcctc

SEQ ID NO: 203937 - DNA, 31 bp, Artificial Sequence
  Description of Artificial Sequence: Synthetic oligonucleotide
gctagaattgtccagagcttcttgcagcctc

SEQ ID NO: 203938 - DNA, 32 bp, Artificial Sequence
  Description of Artificial Sequence: Synthetic oligonucleotide
ctagaattgtccagagcttcttgcagcctcac

SEQ ID NO: 203939 - DNA, 32 bp, Artificial Sequence
  Description of Artificial Sequence: Synthetic oligonucleotide
tagaattgtccagagcttcttgcagcctcacc

SEQ ID NO: 203940 - DNA, 31 bp, Artificial Sequence
  Description of Artificial Sequence: Synthetic oligonucleotide
agaattgtccagagcttcttgcagcctcacc

SEQ ID NO: 203941 - DNA, 30 bp, Artificial Sequence
  Description of Artificial Sequence: Synthetic oligonucleotide
gaattgtccagagcttcttgcagcctcacc

SEQ ID NO: 203942 - DNA, 30 bp, Artificial Sequence
  Description of Artificial Sequence: Synthetic oligonucleotide
aattgtccagagcttcttgcagcctcaccc

SEQ ID NO: 203943 - DNA, 29 bp, Artificial Sequence
  Description of Artificial Sequence: Synthetic oligonucleotide
attgtccagagcttcttgcagcctcaccc

SEQ ID NO: 203944 - DNA, 28 bp, Artificial Sequence
  Description of Artificial Sequence: Synthetic oligonucleotide
ttgtccagagcttcttgcagcctcaccc

SEQ ID NO: 203945 - DNA, 27 bp, Artificial Sequence
  Description of Artificial Sequence: Synthetic oligonucleotide
tgtccagagcttcttgcagcctcaccc

SEQ ID NO: 203946 - DNA, 26 bp, Artificial Sequence
  Description of Artificial Sequence: Synthetic oligonucleotide
gtccagagcttcttgcagcctcaccc

SEQ ID NO: 203947 - DNA, 26 bp, Artificial Sequence
  Description of Artificial Sequence: Synthetic oligonucleotide
tccagagcttcttgcagcctcacccc

SEQ ID NO: 203948 - DNA, 25 bp, Artificial Sequence
  Description of Artificial Sequence: Synthetic oligonucleotide
ccagagcttcttgcagcctcacccc

SEQ ID NO: 203949 - DNA, 27 bp, Artificial Sequence
  Description of Artificial Sequence: Synthetic oligonucleotide
cagagcttcttgcagcctcacccccaa

SEQ ID NO: 203950 - DNA, 27 bp, Artificial Sequence
  Description of Artificial Sequence: Synthetic oligonucleotide
agagcttcttgcagcctcacccccaac

SEQ ID NO: 203951 - DNA, 27 bp, Artificial Sequence
  Description of Artificial Sequence: Synthetic oligonucleotide
gagcttcttgcagcctcacccccaaca

SEQ ID NO: 203952 - DNA, 27 bp, Artificial Sequence
  Description of Artificial Sequence: Synthetic oligonucleotide
agcttcttgcagcctcacccccaacac

SEQ ID NO: 203953 - DNA, 27 bp, Artificial Sequence
  Description of Artificial Sequence: Synthetic oligonucleotide
gcttcttgcagcctcacccccaacaca

SEQ ID NO: 203954 - DNA, 27 bp, Artificial Sequence
  Description of Artificial Sequence: Synthetic oligonucleotide
cttcttgcagcctcacccccaacacag

SEQ ID NO: 203955 - DNA, 27 bp, Artificial Sequence
  Description of Artificial Sequence: Synthetic oligonucleotide
ttcttgcagcctcacccccaacacagg

SEQ ID NO: 203956 - DNA, 27 bp, Artificial Sequence
  Description of Artificial Sequence: Synthetic oligonucleotide
tcttgcagcctcacccccaacacaggt

SEQ ID NO: 203957 - DNA, 26 bp, Artificial Sequence
  Description of Artificial Sequence: Synthetic oligonucleotide
cttgcagcctcacccccaacacaggt

SEQ ID NO: 203958 - DNA, 26 bp, Artificial Sequence
  Description of Artificial Sequence: Synthetic oligonucleotide
ttgcagcctcacccccaacacaggtg

SEQ ID NO: 203959 - DNA, 25 bp, Artificial Sequence
  Description of Artificial Sequence: Synthetic oligonucleotide
tgcagcctcacccccaacacaggtg

SEQ ID NO: 203960 - DNA, 24 bp, Artificial Sequence
  Description of Artificial Sequence: Synthetic oligonucleotide
gcagcctcacccccaacacaggtg

SEQ ID NO: 203961 - DNA, 26 bp, Artificial Sequence
  Description of Artificial Sequence: Synthetic oligonucleotide
cagcctcacccccaacacaggtggaa

SEQ ID NO: 203962 - DNA, 26 bp, Artificial Sequence
  Description of Artificial Sequence: Synthetic oligonucleotide
agcctcacccccaacacaggtggaag

SEQ ID NO: 203963 - DNA, 25 bp, Artificial Sequence
  Description of Artificial Sequence: Synthetic oligonucleotide
gcctcacccccaacacaggtggaag

SEQ ID NO: 203964 - DNA, 26 bp, Artificial Sequence
  Description of Artificial Sequence: Synthetic oligonucleotide
cctcacccccaacacaggtggaaggt

SEQ ID NO: 203965 - DNA, 27 bp, Artificial Sequence
  Description of Artificial Sequence: Synthetic oligonucleotide
ctcacccccaacacaggtggaaggtgt

SEQ ID NO: 203966 - DNA, 27 bp, Artificial Sequence
  Description of Artificial Sequence: Synthetic oligonucleotide
tcacccccaacacaggtggaaggtgtc

SEQ ID NO: 203967 - DNA, 26 bp, Artificial Sequence
  Description of Artificial Sequence: Synthetic oligonucleotide
cacccccaacacaggtggaaggtgtc

SEQ ID NO: 203968 - DNA, 26 bp, Artificial Sequence
  Description of Artificial Sequence: Synthetic oligonucleotide
acccccaacacaggtggaaggtgtcc

SEQ ID NO: 203969 - DNA, 25 bp, Artificial Sequence
  Description of Artificial Sequence: Synthetic oligonucleotide
cccccaacacaggtggaaggtgtcc

SEQ ID NO: 203970 - DNA, 25 bp, Artificial Sequence
  Description of Artificial Sequence: Synthetic oligonucleotide
ccccaacacaggtggaaggtgtccc

SEQ ID NO: 203971 - DNA, 27 bp, Artificial Sequence
  Description of Artificial Sequence: Synthetic oligonucleotide
cccaacacaggtggaaggtgtcccctt

SEQ ID NO: 203972 - DNA, 27 bp, Artificial Sequence
  Description of Artificial Sequence: Synthetic oligonucleotide
ccaacacaggtggaaggtgtccccttg

SEQ ID NO: 203973 - DNA, 27 bp, Artificial Sequence
  Description of Artificial Sequence: Synthetic oligonucleotide
caacacaggtggaaggtgtccccttgg

SEQ ID NO: 203974 - DNA, 27 bp, Artificial Sequence
  Description of Artificial Sequence: Synthetic oligonucleotide
aacacaggtggaaggtgtccccttggg

SEQ ID NO: 203975 - DNA, 27 bp, Artificial Sequence
  Description of Artificial Sequence: Synthetic oligonucleotide
acacaggtggaaggtgtccccttggga

SEQ ID NO: 203976 - DNA, 26 bp, Artificial Sequence
  Description of Artificial Sequence: Synthetic oligonucleotide
cacaggtggaaggtgtccccttggga

SEQ ID NO: 203977 - DNA, 26 bp, Artificial Sequence
  Description of Artificial Sequence: Synthetic oligonucleotide
acaggtggaaggtgtccccttgggac

SEQ ID NO: 203978 - DNA, 25 bp, Artificial Sequence
  Description of Artificial Sequence: Synthetic oligonucleotide
caggtggaaggtgtccccttgggac

SEQ ID NO: 203979 - DNA, 26 bp, Artificial Sequence
  Description of Artificial Sequence: Synthetic oligonucleotide
aggtggaaggtgtccccttgggacgt

SEQ ID NO: 203980 - DNA, 25 bp, Artificial Sequence
  Description of Artificial Sequence: Synthetic oligonucleotide
ggtggaaggtgtccccttgggacgt

SEQ ID NO: 203981 - DNA, 27 bp, Artificial Sequence
  Description of Artificial Sequence: Synthetic oligonucleotide
gtggaaggtgtccccttgggacgtcaa

SEQ ID NO: 203982 - DNA, 28 bp, Artificial Sequence
  Description of Artificial Sequence: Synthetic oligonucleotide
tggaaggtgtccccttgggacgtcaatg

SEQ ID NO: 203983 - DNA, 27 bp, Artificial Sequence
  Description of Artificial Sequence: Synthetic oligonucleotide
ggaaggtgtccccttgggacgtcaatg

SEQ ID NO: 203984 - DNA, 27 bp, Artificial Sequence
  Description of Artificial Sequence: Synthetic oligonucleotide
gaaggtgtccccttgggacgtcaatgc

SEQ ID NO: 203985 - DNA, 30 bp, Artificial Sequence
  Description of Artificial Sequence: Synthetic oligonucleotide
aaggtgtccccttgggacgtcaatgcttac

SEQ ID NO: 203986 - DNA, 29 bp, Artificial Sequence
  Description of Artificial Sequence: Synthetic oligonucleotide
aggtgtccccttgggacgtcaatgcttac

SEQ ID NO: 203987 - DNA, 28 bp, Artificial Sequence
  Description of Artificial Sequence: Synthetic oligonucleotide
ggtgtccccttgggacgtcaatgcttac

SEQ ID NO: 203988 - DNA, 32 bp, Artificial Sequence
  Description of Artificial Sequence: Synthetic oligonucleotide
gtgtccccttgggacgtcaatgcttactattc

SEQ ID NO: 203989 - DNA, 32 bp, Artificial Sequence
  Description of Artificial Sequence: Synthetic oligonucleotide
tgtccccttgggacgtcaatgcttactattcg

SEQ ID NO: 203990 - DNA, 31 bp, Artificial Sequence
  Description of Artificial Sequence: Synthetic oligonucleotide
gtccccttgggacgtcaatgcttactattcg

SEQ ID NO: 203991 - DNA, 31 bp, Artificial Sequence
  Description of Artificial Sequence: Synthetic oligonucleotide
tccccttgggacgtcaatgcttactattcgg

SEQ ID NO: 203992 - DNA, 30 bp, Artificial Sequence
  Description of Artificial Sequence: Synthetic oligonucleotide
ccccttgggacgtcaatgcttactattcgg

SEQ ID NO: 203993 - DNA, 33 bp, Artificial Sequence
  Description of Artificial Sequence: Synthetic oligonucleotide
cccttgggacgtcaatgcttactattcggtatc

SEQ ID NO: 203994 - DNA, 34 bp, Artificial Sequence
  Description of Artificial Sequence: Synthetic oligonucleotide
ccttgggacgtcaatgcttactattcggtatctg

SEQ ID NO: 203995 - DNA, 35 bp, Artificial Sequence
  Description of Artificial Sequence: Synthetic oligonucleotide
cttgggacgtcaatgcttactattcggtatctgac

SEQ ID NO: 203996 - DNA, 35 bp, Artificial Sequence
  Description of Artificial Sequence: Synthetic oligonucleotide
ttgggacgtcaatgcttactattcggtatctgacc

SEQ ID NO: 203997 - DNA, 34 bp, Artificial Sequence
  Description of Artificial Sequence: Synthetic oligonucleotide
tgggacgtcaatgcttactattcggtatctgacc

SEQ ID NO: 203998 - DNA, 33 bp, Artificial Sequence
  Description of Artificial Sequence: Synthetic oligonucleotide
gggacgtcaatgcttactattcggtatctgacc

SEQ ID NO: 203999 - DNA, 35 bp, Artificial Sequence
  Description of Artificial Sequence: Synthetic oligonucleotide
ggacgtcaatgcttactattcggtatctgaccatg

SEQ ID NO: 204000 - DNA, 36 bp, Artificial Sequence
  Description of Artificial Sequence: Synthetic oligonucleotide
gacgtcaatgcttactattcggtatctgaccatgtg

SEQ ID NO: 204001 - DNA, 36 bp, Artificial Sequence
  Description of Artificial Sequence: Synthetic oligonucleotide
acgtcaatgcttactattcggtatctgaccatgtgg

SEQ ID NO: 204002 - DNA, 35 bp, Artificial Sequence
  Description of Artificial Sequence: Synthetic oligonucleotide
cgtcaatgcttactattcggtatctgaccatgtgg

SEQ ID NO: 204003 - DNA, 37 bp, Artificial Sequence
  Description of Artificial Sequence: Synthetic oligonucleotide
gtcaatgcttactattcggtatctgaccatgtggtag

SEQ ID NO: 204004 - DNA, 38 bp, Artificial Sequence
  Description of Artificial Sequence: Synthetic oligonucleotide
tcaatgcttactattcggtatctgaccatgtggtagtc

SEQ ID NO: 204005 - DNA, 37 bp, Artificial Sequence
  Description of Artificial Sequence: Synthetic oligonucleotide
caatgcttactattcggtatctgaccatgtggtagtc

SEQ ID NO: 204006 - DNA, 40 bp, Artificial Sequence
  Description of Artificial Sequence: Synthetic oligonucleotide
aatgcttactattcggtatctgaccatgtggtagtctttc

SEQ ID NO: 204007 - DNA, 39 bp, Artificial Sequence
  Description of Artificial Sequence: Synthetic oligonucleotide
atgcttactattcggtatctgaccatgtggtagtctttc

SEQ ID NO: 204008 - DNA, 38 bp, Artificial Sequence
  Description of Artificial Sequence: Synthetic oligonucleotide
tgcttactattcggtatctgaccatgtggtagtctttc

SEQ ID NO: 204009 - DNA, 37 bp, Artificial Sequence
  Description of Artificial Sequence: Synthetic oligonucleotide
gcttactattcggtatctgaccatgtggtagtctttc

SEQ ID NO: 204010 - DNA, 37 bp, Artificial Sequence
  Description of Artificial Sequence: Synthetic oligonucleotide
cttactattcggtatctgaccatgtggtagtctttcc

SEQ ID NO: 204011 - DNA, 38 bp, Artificial Sequence
  Description of Artificial Sequence: Synthetic oligonucleotide
ttactattcggtatctgaccatgtggtagtctttccag

SEQ ID NO: 204012 - DNA, 37 bp, Artificial Sequence
  Description of Artificial Sequence: Synthetic oligonucleotide
tactattcggtatctgaccatgtggtagtctttccag

SEQ ID NO: 204013 - DNA, 36 bp, Artificial Sequence
  Description of Artificial Sequence: Synthetic oligonucleotide
actattcggtatctgaccatgtggtagtctttccag

SEQ ID NO: 204014 - DNA, 35 bp, Artificial Sequence
  Description of Artificial Sequence: Synthetic oligonucleotide
ctattcggtatctgaccatgtggtagtctttccag

SEQ ID NO: 204015 - DNA, 35 bp, Artificial Sequence
  Description of Artificial Sequence: Synthetic oligonucleotide
tattcggtatctgaccatgtggtagtctttccagc

SEQ ID NO: 204016 - DNA, 34 bp, Artificial Sequence
  Description of Artificial Sequence: Synthetic oligonucleotide
attcggtatctgaccatgtggtagtctttccagc

SEQ ID NO: 204017 - DNA, 33 bp, Artificial Sequence
  Description of Artificial Sequence: Synthetic oligonucleotide
ttcggtatctgaccatgtggtagtctttccagc

SEQ ID NO: 204018 - DNA, 32 bp, Artificial Sequence
  Description of Artificial Sequence: Synthetic oligonucleotide
tcggtatctgaccatgtggtagtctttccagc

SEQ ID NO: 204019 - DNA, 31 bp, Artificial Sequence
  Description of Artificial Sequence: Synthetic oligonucleotide
cggtatctgaccatgtggtagtctttccagc

SEQ ID NO: 204020 - DNA, 32 bp, Artificial Sequence
  Description of Artificial Sequence: Synthetic oligonucleotide
ggtatctgaccatgtggtagtctttccagctg

SEQ ID NO: 204021 - DNA, 32 bp, Artificial Sequence
  Description of Artificial Sequence: Synthetic oligonucleotide
gtatctgaccatgtggtagtctttccagctgg

SEQ ID NO: 204022 - DNA, 33 bp, Artificial Sequence
  Description of Artificial Sequence: Synthetic oligonucleotide
tatctgaccatgtggtagtctttccagctggac

SEQ ID NO: 204023 - DNA, 32 bp, Artificial Sequence
  Description of Artificial Sequence: Synthetic oligonucleotide
atctgaccatgtggtagtctttccagctggac

SEQ ID NO: 204024 - DNA, 31 bp, Artificial Sequence
  Description of Artificial Sequence: Synthetic oligonucleotide
tctgaccatgtggtagtctttccagctggac

SEQ ID NO: 204025 - DNA, 30 bp, Artificial Sequence
  Description of Artificial Sequence: Synthetic oligonucleotide
ctgaccatgtggtagtctttccagctggac

SEQ ID NO: 204026 - DNA, 31 bp, Artificial Sequence
  Description of Artificial Sequence: Synthetic oligonucleotide
tgaccatgtggtagtctttccagctggactc

SEQ ID NO: 204027 - DNA, 30 bp, Artificial Sequence
  Description of Artificial Sequence: Synthetic oligonucleotide
gaccatgtggtagtctttccagctggactc

SEQ ID NO: 204028 - DNA, 30 bp, Artificial Sequence
  Description of Artificial Sequence: Synthetic oligonucleotide
accatgtggtagtctttccagctggactcc

SEQ ID NO: 204029 - DNA, 29 bp, Artificial Sequence
  Description of Artificial Sequence: Synthetic oligonucleotide
ccatgtggtagtctttccagctggactcc

SEQ ID NO: 204030 - DNA, 30 bp, Artificial Sequence
  Description of Artificial Sequence: Synthetic oligonucleotide
catgtggtagtctttccagctggactcctc

SEQ ID NO: 204031 - DNA, 30 bp, Artificial Sequence
  Description of Artificial Sequence: Synthetic oligonucleotide
atgtggtagtctttccagctggactcctcc

SEQ ID NO: 204032 - DNA, 29 bp, Artificial Sequence
  Description of Artificial Sequence: Synthetic oligonucleotide
tgtggtagtctttccagctggactcctcc

SEQ ID NO: 204033 - DNA, 28 bp, Artificial Sequence
  Description of Artificial Sequence: Synthetic oligonucleotide
gtggtagtctttccagctggactcctcc

SEQ ID NO: 204034 - DNA, 30 bp, Artificial Sequence
  Description of Artificial Sequence: Synthetic oligonucleotide
tggtagtctttccagctggactcctccaac

SEQ ID NO: 204035 - DNA, 29 bp, Artificial Sequence
  Description of Artificial Sequence: Synthetic oligonucleotide
ggtagtctttccagctggactcctccaac

SEQ ID NO: 204036 - DNA, 29 bp, Artificial Sequence
  Description of Artificial Sequence: Synthetic oligonucleotide
gtagtctttccagctggactcctccaacc

SEQ ID NO: 204037 - DNA, 29 bp, Artificial Sequence
  Description of Artificial Sequence: Synthetic oligonucleotide
tagtctttccagctggactcctccaaccc

SEQ ID NO: 204038 - DNA, 28 bp, Artificial Sequence
  Description of Artificial Sequence: Synthetic oligonucleotide
agtctttccagctggactcctccaaccc

SEQ ID NO: 204039 - DNA, 27 bp, Artificial Sequence
  Description of Artificial Sequence: Synthetic oligonucleotide
gtctttccagctggactcctccaaccc

SEQ ID NO: 204040 - DNA, 27 bp, Artificial Sequence
  Description of Artificial Sequence: Synthetic oligonucleotide
tctttccagctggactcctccaacccc

SEQ ID NO: 204041 - DNA, 26 bp, Artificial Sequence
  Description of Artificial Sequence: Synthetic oligonucleotide
ctttccagctggactcctccaacccc

SEQ ID NO: 204042 - DNA, 27 bp, Artificial Sequence
  Description of Artificial Sequence: Synthetic oligonucleotide
tttccagctggactcctccaaccccca

SEQ ID NO: 204043 - DNA, 27 bp, Artificial Sequence
  Description of Artificial Sequence: Synthetic oligonucleotide
ttccagctggactcctccaacccccat

SEQ ID NO: 204044 - DNA, 27 bp, Artificial Sequence
  Description of Artificial Sequence: Synthetic oligonucleotide
tccagctggactcctccaacccccatt

SEQ ID NO: 204045 - DNA, 26 bp, Artificial Sequence
  Description of Artificial Sequence: Synthetic oligonucleotide
ccagctggactcctccaacccccatt

SEQ ID NO: 204046 - DNA, 27 bp, Artificial Sequence
  Description of Artificial Sequence: Synthetic oligonucleotide
cagctggactcctccaacccccattct

SEQ ID NO: 204047 - DNA, 28 bp, Artificial Sequence
  Description of Artificial Sequence: Synthetic oligonucleotide
agctggactcctccaacccccattcttc

SEQ ID NO: 204048 - DNA, 27 bp, Artificial Sequence
  Description of Artificial Sequence: Synthetic oligonucleotide
gctggactcctccaacccccattcttc

SEQ ID NO: 204049 - DNA, 27 bp, Artificial Sequence
  Description of Artificial Sequence: Synthetic oligonucleotide
ctggactcctccaacccccattcttcc

SEQ ID NO: 204050 - DNA, 28 bp, Artificial Sequence
  Description of Artificial Sequence: Synthetic oligonucleotide
tggactcctccaacccccattcttccac

SEQ ID NO: 204051 - DNA, 27 bp, Artificial Sequence
  Description of Artificial Sequence: Synthetic oligonucleotide
ggactcctccaacccccattcttccac

SEQ ID NO: 204052 - DNA, 27 bp, Artificial Sequence
  Description of Artificial Sequence: Synthetic oligonucleotide
gactcctccaacccccattcttccacc

SEQ ID NO: 204053 - DNA, 27 bp, Artificial Sequence
  Description of Artificial Sequence: Synthetic oligonucleotide
actcctccaacccccattcttccaccc

SEQ ID NO: 204054 - DNA, 27 bp, Artificial Sequence
  Description of Artificial Sequence: Synthetic oligonucleotide
ctcctccaacccccattcttccaccct

SEQ ID NO: 204055 - DNA, 27 bp, Artificial Sequence
  Description of Artificial Sequence: Synthetic oligonucleotide
tcctccaacccccattcttccaccctg

SEQ ID NO: 204056 - DNA, 26 bp, Artificial Sequence
  Description of Artificial Sequence: Synthetic oligonucleotide
cctccaacccccattcttccaccctg

SEQ ID NO: 204057 - DNA, 26 bp, Artificial Sequence
  Description of Artificial Sequence: Synthetic oligonucleotide
ctccaacccccattcttccaccctgg

SEQ ID NO: 204058 - DNA, 27 bp, Artificial Sequence
  Description of Artificial Sequence: Synthetic oligonucleotide
tccaacccccattcttccaccctggct

SEQ ID NO: 204059 - DNA, 27 bp, Artificial Sequence
  Description of Artificial Sequence: Synthetic oligonucleotide
ccaacccccattcttccaccctggcta

SEQ ID NO: 204060 - DNA, 28 bp, Artificial Sequence
  Description of Artificial Sequence: Synthetic oligonucleotide
caacccccattcttccaccctggctatc

SEQ ID NO: 204061 - DNA, 28 bp, Artificial Sequence
  Description of Artificial Sequence: Synthetic oligonucleotide
aacccccattcttccaccctggctatcc

SEQ ID NO: 204062 - DNA, 27 bp, Artificial Sequence
  Description of Artificial Sequence: Synthetic oligonucleotide
acccccattcttccaccctggctatcc

SEQ ID NO: 204063 - DNA, 26 bp, Artificial Sequence
  Description of Artificial Sequence: Synthetic oligonucleotide
cccccattcttccaccctggctatcc

SEQ ID NO: 204064 - DNA, 27 bp, Artificial Sequence
  Description of Artificial Sequence: Synthetic oligonucleotide
ccccattcttccaccctggctatccca

SEQ ID NO: 204065 - DNA, 27 bp, Artificial Sequence
  Description of Artificial Sequence: Synthetic oligonucleotide
cccattcttccaccctggctatcccag

SEQ ID NO: 204066 - DNA, 28 bp, Artificial Sequence
  Description of Artificial Sequence: Synthetic oligonucleotide
ccattcttccaccctggctatcccagag

SEQ ID NO: 204067 - DNA, 28 bp, Artificial Sequence
  Description of Artificial Sequence: Synthetic oligonucleotide
cattcttccaccctggctatcccagagc

SEQ ID NO: 204068 - DNA, 28 bp, Artificial Sequence
  Description of Artificial Sequence: Synthetic oligonucleotide
attcttccaccctggctatcccagagcc

SEQ ID NO: 204069 - DNA, 27 bp, Artificial Sequence
  Description of Artificial Sequence: Synthetic oligonucleotide
ttcttccaccctggctatcccagagcc

SEQ ID NO: 204070 - DNA, 26 bp, Artificial Sequence
  Description of Artificial Sequence: Synthetic oligonucleotide
tcttccaccctggctatcccagagcc

SEQ ID NO: 204071 - DNA, 25 bp, Artificial Sequence
  Description of Artificial Sequence: Synthetic oligonucleotide
cttccaccctggctatcccagagcc

SEQ ID NO: 204072 - DNA, 26 bp, Artificial Sequence
  Description of Artificial Sequence: Synthetic oligonucleotide
ttccaccctggctatcccagagccgt

SEQ ID NO: 204073 - DNA, 25 bp, Artificial Sequence
  Description of Artificial Sequence: Synthetic oligonucleotide
tccaccctggctatcccagagccgt

SEQ ID NO: 204074 - DNA, 24 bp, Artificial Sequence
  Description of Artificial Sequence: Synthetic oligonucleotide
ccaccctggctatcccagagccgt

SEQ ID NO: 204075 - DNA, 26 bp, Artificial Sequence
  Description of Artificial Sequence: Synthetic oligonucleotide
caccctggctatcccagagccgtgaa

SEQ ID NO: 204076 - DNA, 27 bp, Artificial Sequence
  Description of Artificial Sequence: Synthetic oligonucleotide
accctggctatcccagagccgtgaact

SEQ ID NO: 204077 - DNA, 27 bp, Artificial Sequence
  Description of Artificial Sequence: Synthetic oligonucleotide
ccctggctatcccagagccgtgaactt

SEQ ID NO: 204078 - DNA, 28 bp, Artificial Sequence
  Description of Artificial Sequence: Synthetic oligonucleotide
cctggctatcccagagccgtgaactttg

SEQ ID NO: 204079 - DNA, 28 bp, Artificial Sequence
  Description of Artificial Sequence: Synthetic oligonucleotide
ctggctatcccagagccgtgaactttgg

SEQ ID NO: 204080 - DNA, 28 bp, Artificial Sequence
  Description of Artificial Sequence: Synthetic oligonucleotide
tggctatcccagagccgtgaactttggc

SEQ ID NO: 204081 - DNA, 27 bp, Artificial Sequence
  Description of Artificial Sequence: Synthetic oligonucleotide
ggctatcccagagccgtgaactttggc

SEQ ID NO: 204082 - DNA, 27 bp, Artificial Sequence
  Description of Artificial Sequence: Synthetic oligonucleotide
gctatcccagagccgtgaactttggcg

SEQ ID NO: 204083 - DNA, 27 bp, Artificial Sequence
  Description of Artificial Sequence: Synthetic oligonucleotide
ctatcccagagccgtgaactttggcgc

SEQ ID NO: 204084 - DNA, 28 bp, Artificial Sequence
  Description of Artificial Sequence: Synthetic oligonucleotide
tatcccagagccgtgaactttggcgctg

SEQ ID NO: 204085 - DNA, 27 bp, Artificial Sequence
  Description of Artificial Sequence: Synthetic oligonucleotide
atcccagagccgtgaactttggcgctg

SEQ ID NO: 204086 - DNA, 26 bp, Artificial Sequence
  Description of Artificial Sequence: Synthetic oligonucleotide
tcccagagccgtgaactttggcgctg

SEQ ID NO: 204087 - DNA, 25 bp, Artificial Sequence
  Description of Artificial Sequence: Synthetic oligonucleotide
cccagagccgtgaactttggcgctg

SEQ ID NO: 204088 - DNA, 26 bp, Artificial Sequence
  Description of Artificial Sequence: Synthetic oligonucleotide
ccagagccgtgaactttggcgctgct

SEQ ID NO: 204089 - DNA, 26 bp, Artificial Sequence
  Description of Artificial Sequence: Synthetic oligonucleotide
cagagccgtgaactttggcgctgctg

SEQ ID NO: 204090 - DNA, 26 bp, Artificial Sequence
  Description of Artificial Sequence: Synthetic oligonucleotide
agagccgtgaactttggcgctgctgg

SEQ ID NO: 204091 - DNA, 25 bp, Artificial Sequence
  Description of Artificial Sequence: Synthetic oligonucleotide
gagccgtgaactttggcgctgctgg

SEQ ID NO: 204092 - DNA, 26 bp, Artificial Sequence
  Description of Artificial Sequence: Synthetic oligonucleotide
agccgtgaactttggcgctgctggca

SEQ ID NO: 204093 - DNA, 25 bp, Artificial Sequence
  Description of Artificial Sequence: Synthetic oligonucleotide
gccgtgaactttggcgctgctggca

SEQ ID NO: 204094 - DNA, 25 bp, Artificial Sequence
  Description of Artificial Sequence: Synthetic oligonucleotide
ccgtgaactttggcgctgctggcag

SEQ ID NO: 204095 - DNA, 27 bp, Artificial Sequence
  Description of Artificial Sequence: Synthetic oligonucleotide
cgtgaactttggcgctgctggcagcat

SEQ ID NO: 204096 - DNA, 27 bp, Artificial Sequence
  Description of Artificial Sequence: Synthetic oligonucleotide
gtgaactttggcgctgctggcagcatc

SEQ ID NO: 204097 - DNA, 29 bp, Artificial Sequence
  Description of Artificial Sequence: Synthetic oligonucleotide
tgaactttggcgctgctggcagcatcatg

SEQ ID NO: 204098 - DNA, 28 bp, Artificial Sequence
  Description of Artificial Sequence: Synthetic oligonucleotide
gaactttggcgctgctggcagcatcatg

SEQ ID NO: 204099 - DNA, 28 bp, Artificial Sequence
  Description of Artificial Sequence: Synthetic oligonucleotide
aactttggcgctgctggcagcatcatgg

SEQ ID NO: 204100 - DNA, 27 bp, Artificial Sequence
  Description of Artificial Sequence: Synthetic oligonucleotide
actttggcgctgctggcagcatcatgg

SEQ ID NO: 204101 - DNA, 26 bp, Artificial Sequence
  Description of Artificial Sequence: Synthetic oligonucleotide
ctttggcgctgctggcagcatcatgg

SEQ ID NO: 204102 - DNA, 26 bp, Artificial Sequence
  Description of Artificial Sequence: Synthetic oligonucleotide
tttggcgctgctggcagcatcatggc

SEQ ID NO: 204103 - DNA, 25 bp, Artificial Sequence
  Description of Artificial Sequence: Synthetic oligonucleotide
ttggcgctgctggcagcatcatggc

SEQ ID NO: 204104 - DNA, 24 bp, Artificial Sequence
  Description of Artificial Sequence: Synthetic oligonucleotide
tggcgctgctggcagcatcatggc

SEQ ID NO: 204105 - DNA, 23 bp, Artificial Sequence
  Description of Artificial Sequence: Synthetic oligonucleotide
ggcgctgctggcagcatcatggc

SEQ ID NO: 204106 - DNA, 23 bp, Artificial Sequence
  Description of Artificial Sequence: Synthetic oligonucleotide
gcgctgctggcagcatcatggcc

SEQ ID NO: 204107 - DNA, 24 bp, Artificial Sequence
  Description of Artificial Sequence: Synthetic oligonucleotide
cgctgctggcagcatcatggccca

SEQ ID NO: 204108 - DNA, 24 bp, Artificial Sequence
  Description of Artificial Sequence: Synthetic oligonucleotide
gctgctggcagcatcatggcccac

SEQ ID NO: 204109 - DNA, 25 bp, Artificial Sequence
  Description of Artificial Sequence: Synthetic oligonucleotide
ctgctggcagcatcatggcccacga

SEQ ID NO: 204110 - DNA, 25 bp, Artificial Sequence
  Description of Artificial Sequence: Synthetic oligonucleotide
tgctggcagcatcatggcccacgag

SEQ ID NO: 204111 - DNA, 24 bp, Artificial Sequence
  Description of Artificial Sequence: Synthetic oligonucleotide
gctggcagcatcatggcccacgag

SEQ ID NO: 204112 - DNA, 25 bp, Artificial Sequence
  Description of Artificial Sequence: Synthetic oligonucleotide
ctggcagcatcatggcccacgagct

SEQ ID NO: 204113 - DNA, 27 bp, Artificial Sequence
  Description of Artificial Sequence: Synthetic oligonucleotide
tggcagcatcatggcccacgagctgtt

SEQ ID NO: 204114 - DNA, 26 bp, Artificial Sequence
  Description of Artificial Sequence: Synthetic oligonucleotide
ggcagcatcatggcccacgagctgtt

SEQ ID NO: 204115 - DNA, 26 bp, Artificial Sequence
  Description of Artificial Sequence: Synthetic oligonucleotide
gcagcatcatggcccacgagctgttg

SEQ ID NO: 204116 - DNA, 27 bp, Artificial Sequence
  Description of Artificial Sequence: Synthetic oligonucleotide
cagcatcatggcccacgagctgttgca

SEQ ID NO: 204117 - DNA, 27 bp, Artificial Sequence
  Description of Artificial Sequence: Synthetic oligonucleotide
agcatcatggcccacgagctgttgcac

SEQ ID NO: 204118 - DNA, 27 bp, Artificial Sequence
  Description of Artificial Sequence: Synthetic oligonucleotide
gcatcatggcccacgagctgttgcaca

SEQ ID NO: 204119 - DNA, 28 bp, Artificial Sequence
  Description of Artificial Sequence: Synthetic oligonucleotide
catcatggcccacgagctgttgcacatc

SEQ ID NO: 204120 - DNA, 30 bp, Artificial Sequence
  Description of Artificial Sequence: Synthetic oligonucleotide
atcatggcccacgagctgttgcacatcttc

SEQ ID NO: 204121 - DNA, 29 bp, Artificial Sequence
  Description of Artificial Sequence: Synthetic oligonucleotide
tcatggcccacgagctgttgcacatcttc

SEQ ID NO: 204122 - DNA, 28 bp, Artificial Sequence
  Description of Artificial Sequence: Synthetic oligonucleotide
catggcccacgagctgttgcacatcttc

SEQ ID NO: 204123 - DNA, 30 bp, Artificial Sequence
  Description of Artificial Sequence: Synthetic oligonucleotide
atggcccacgagctgttgcacatcttctac

SEQ ID NO: 204124 - DNA, 29 bp, Artificial Sequence
  Description of Artificial Sequence: Synthetic oligonucleotide
tggcccacgagctgttgcacatcttctac

SEQ ID NO: 204125 - DNA, 28 bp, Artificial Sequence
  Description of Artificial Sequence: Synthetic oligonucleotide
ggcccacgagctgttgcacatcttctac

SEQ ID NO: 204126 - DNA, 28 bp, Artificial Sequence
  Description of Artificial Sequence: Synthetic oligonucleotide
gcccacgagctgttgcacatcttctacc

SEQ ID NO: 204127 - DNA, 29 bp, Artificial Sequence
  Description of Artificial Sequence: Synthetic oligonucleotide
cccacgagctgttgcacatcttctaccag

SEQ ID NO: 204128 - DNA, 29 bp, Artificial Sequence
  Description of Artificial Sequence: Synthetic oligonucleotide
ccacgagctgttgcacatcttctaccagc

SEQ ID NO: 204129 - DNA, 30 bp, Artificial Sequence
  Description of Artificial Sequence: Synthetic oligonucleotide
cacgagctgttgcacatcttctaccagctc

SEQ ID NO: 204130 - DNA, 33 bp, Artificial Sequence
  Description of Artificial Sequence: Synthetic oligonucleotide
acgagctgttgcacatcttctaccagctcttac

SEQ ID NO: 204131 - DNA, 32 bp, Artificial Sequence
  Description of Artificial Sequence: Synthetic oligonucleotide
cgagctgttgcacatcttctaccagctcttac

SEQ ID NO: 204132 - DNA, 33 bp, Artificial Sequence
  Description of Artificial Sequence: Synthetic oligonucleotide
gagctgttgcacatcttctaccagctcttactg

SEQ ID NO: 204133 - DNA, 33 bp, Artificial Sequence
  Description of Artificial Sequence: Synthetic oligonucleotide
agctgttgcacatcttctaccagctcttactgc

SEQ ID NO: 204134 - DNA, 32 bp, Artificial Sequence
  Description of Artificial Sequence: Synthetic oligonucleotide
gctgttgcacatcttctaccagctcttactgc

SEQ ID NO: 204135 - DNA, 32 bp, Artificial Sequence
  Description of Artificial Sequence: Synthetic oligonucleotide
ctgttgcacatcttctaccagctcttactgcc

SEQ ID NO: 204136 - DNA, 33 bp, Artificial Sequence
  Description of Artificial Sequence: Synthetic oligonucleotide
tgttgcacatcttctaccagctcttactgcctg

SEQ ID NO: 204137 - DNA, 32 bp, Artificial Sequence
  Description of Artificial Sequence: Synthetic oligonucleotide
gttgcacatcttctaccagctcttactgcctg

SEQ ID NO: 204138 - DNA, 32 bp, Artificial Sequence
  Description of Artificial Sequence: Synthetic oligonucleotide
ttgcacatcttctaccagctcttactgcctgg

SEQ ID NO: 204139 - DNA, 31 bp, Artificial Sequence
  Description of Artificial Sequence: Synthetic oligonucleotide
tgcacatcttctaccagctcttactgcctgg

SEQ ID NO: 204140 - DNA, 30 bp, Artificial Sequence
  Description of Artificial Sequence: Synthetic oligonucleotide
gcacatcttctaccagctcttactgcctgg

SEQ ID NO: 204141 - DNA, 30 bp, Artificial Sequence
  Description of Artificial Sequence: Synthetic oligonucleotide
cacatcttctaccagctcttactgcctggg

SEQ ID NO: 204142 - DNA, 30 bp, Artificial Sequence
  Description of Artificial Sequence: Synthetic oligonucleotide
acatcttctaccagctcttactgcctgggg

SEQ ID NO: 204143 - DNA, 29 bp, Artificial Sequence
  Description of Artificial Sequence: Synthetic oligonucleotide
catcttctaccagctcttactgcctgggg

SEQ ID NO: 204144 - DNA, 29 bp, Artificial Sequence
  Description of Artificial Sequence: Synthetic oligonucleotide
atcttctaccagctcttactgcctggggg

SEQ ID NO: 204145 - DNA, 28 bp, Artificial Sequence
  Description of Artificial Sequence: Synthetic oligonucleotide
tcttctaccagctcttactgcctggggg

SEQ ID NO: 204146 - DNA, 27 bp, Artificial Sequence
  Description of Artificial Sequence: Synthetic oligonucleotide
cttctaccagctcttactgcctggggg

SEQ ID NO: 204147 - DNA, 27 bp, Artificial Sequence
  Description of Artificial Sequence: Synthetic oligonucleotide
ttctaccagctcttactgcctgggggc

SEQ ID NO: 204148 - DNA, 27 bp, Artificial Sequence
  Description of Artificial Sequence: Synthetic oligonucleotide
tctaccagctcttactgcctgggggct

SEQ ID NO: 204149 - DNA, 26 bp, Artificial Sequence
  Description of Artificial Sequence: Synthetic oligonucleotide
ctaccagctcttactgcctgggggct

SEQ ID NO: 204150 - DNA, 26 bp, Artificial Sequence
  Description of Artificial Sequence: Synthetic oligonucleotide
taccagctcttactgcctgggggctg

SEQ ID NO: 204151 - DNA, 25 bp, Artificial Sequence
  Description of Artificial Sequence: Synthetic oligonucleotide
accagctcttactgcctgggggctg

SEQ ID NO: 204152 - DNA, 24 bp, Artificial Sequence
  Description of Artificial Sequence: Synthetic oligonucleotide
ccagctcttactgcctgggggctg

SEQ ID NO: 204153 - DNA, 24 bp, Artificial Sequence
  Description of Artificial Sequence: Synthetic oligonucleotide
cagctcttactgcctgggggctgc

SEQ ID NO: 204154 - DNA, 25 bp, Artificial Sequence
  Description of Artificial Sequence: Synthetic oligonucleotide
agctcttactgcctgggggctgcct

SEQ ID NO: 204155 - DNA, 24 bp, Artificial Sequence
  Description of Artificial Sequence: Synthetic oligonucleotide
gctcttactgcctgggggctgcct

SEQ ID NO: 204156 - DNA, 24 bp, Artificial Sequence
  Description of Artificial Sequence: Synthetic oligonucleotide
ctcttactgcctgggggctgcctc

SEQ ID NO: 204157 - DNA, 24 bp, Artificial Sequence
  Description of Artificial Sequence: Synthetic oligonucleotide
tcttactgcctgggggctgcctcg

SEQ ID NO: 204158 - DNA, 23 bp, Artificial Sequence
  Description of Artificial Sequence: Synthetic oligonucleotide
cttactgcctgggggctgcctcg

SEQ ID NO: 204159 - DNA, 23 bp, Artificial Sequence
  Description of Artificial Sequence: Synthetic oligonucleotide
ttactgcctgggggctgcctcgc

SEQ ID NO: 204160 - DNA, 22 bp, Artificial Sequence
  Description of Artificial Sequence: Synthetic oligonucleotide
tactgcctgggggctgcctcgc

SEQ ID NO: 204161 - DNA, 21 bp, Artificial Sequence
  Description of Artificial Sequence: Synthetic oligonucleotide
actgcctgggggctgcctcgc

SEQ ID NO: 204162 - DNA, 20 bp, Artificial Sequence
  Description of Artificial Sequence: Synthetic oligonucleotide
ctgcctgggggctgcctcgc

SEQ ID NO: 204163 - DNA, 21 bp, Artificial Sequence
  Description of Artificial Sequence: Synthetic oligonucleotide
tgcctgggggctgcctcgcct

SEQ ID NO: 204164 - DNA, 20 bp, Artificial Sequence
  Description of Artificial Sequence: Synthetic oligonucleotide
gcctgggggctgcctcgcct

SEQ ID NO: 204165 - DNA, 21 bp, Artificial Sequence
  Description of Artificial Sequence: Synthetic oligonucleotide
cctgggggctgcctcgcctgt

SEQ ID NO: 204166 - DNA, 22 bp, Artificial Sequence
  Description of Artificial Sequence: Synthetic oligonucleotide
ctgggggctgcctcgcctgtga

SEQ ID NO: 204167 - DNA, 24 bp, Artificial Sequence
  Description of Artificial Sequence: Synthetic oligonucleotide
tgggggctgcctcgcctgtgacaa

SEQ ID NO: 204168 - DNA, 23 bp, Artificial Sequence
  Description of Artificial Sequence: Synthetic oligonucleotide
gggggctgcctcgcctgtgacaa

SEQ ID NO: 204169 - DNA, 23 bp, Artificial Sequence
  Description of Artificial Sequence: Synthetic oligonucleotide
ggggctgcctcgcctgtgacaac

SEQ ID NO: 204170 - DNA, 25 bp, Artificial Sequence
  Description of Artificial Sequence: Synthetic oligonucleotide
gggctgcctcgcctgtgacaaccat

SEQ ID NO: 204171 - DNA, 25 bp, Artificial Sequence
  Description of Artificial Sequence: Synthetic oligonucleotide
ggctgcctcgcctgtgacaaccatg

SEQ ID NO: 204172 - DNA, 25 bp, Artificial Sequence
  Description of Artificial Sequence: Synthetic oligonucleotide
gctgcctcgcctgtgacaaccatgc

SEQ ID NO: 204173 - DNA, 25 bp, Artificial Sequence
  Description of Artificial Sequence: Synthetic oligonucleotide
ctgcctcgcctgtgacaaccatgcc

SEQ ID NO: 204174 - DNA, 26 bp, Artificial Sequence
  Description of Artificial Sequence: Synthetic oligonucleotide
tgcctcgcctgtgacaaccatgccct

SEQ ID NO: 204175 - DNA, 25 bp, Artificial Sequence
  Description of Artificial Sequence: Synthetic oligonucleotide
gcctcgcctgtgacaaccatgccct

SEQ ID NO: 204176 - DNA, 25 bp, Artificial Sequence
  Description of Artificial Sequence: Synthetic oligonucleotide
cctcgcctgtgacaaccatgccctc

SEQ ID NO: 204177 - DNA, 26 bp, Artificial Sequence
  Description of Artificial Sequence: Synthetic oligonucleotide
ctcgcctgtgacaaccatgccctcca

SEQ ID NO: 204178 - DNA, 26 bp, Artificial Sequence
  Description of Artificial Sequence: Synthetic oligonucleotide
tcgcctgtgacaaccatgccctccag

SEQ ID NO: 204179 - DNA, 25 bp, Artificial Sequence
  Description of Artificial Sequence: Synthetic oligonucleotide
cgcctgtgacaaccatgccctccag

SEQ ID NO: 204180 - DNA, 27 bp, Artificial Sequence
  Description of Artificial Sequence: Synthetic oligonucleotide
gcctgtgacaaccatgccctccaggaa

SEQ ID NO: 204181 - DNA, 27 bp, Artificial Sequence
  Description of Artificial Sequence: Synthetic oligonucleotide
cctgtgacaaccatgccctccaggaag

SEQ ID NO: 204182 - DNA, 27 bp, Artificial Sequence
  Description of Artificial Sequence: Synthetic oligonucleotide
ctgtgacaaccatgccctccaggaagc

SEQ ID NO: 204183 - DNA, 28 bp, Artificial Sequence
  Description of Artificial Sequence: Synthetic oligonucleotide
tgtgacaaccatgccctccaggaagctc

SEQ ID NO: 204184 - DNA, 27 bp, Artificial Sequence
  Description of Artificial Sequence: Synthetic oligonucleotide
gtgacaaccatgccctccaggaagctc

SEQ ID NO: 204185 - DNA, 28 bp, Artificial Sequence
  Description of Artificial Sequence: Synthetic oligonucleotide
tgacaaccatgccctccaggaagctcac

SEQ ID NO: 204186 - DNA, 27 bp, Artificial Sequence
  Description of Artificial Sequence: Synthetic oligonucleotide
gacaaccatgccctccaggaagctcac

SEQ ID NO: 204187 - DNA, 27 bp, Artificial Sequence
  Description of Artificial Sequence: Synthetic oligonucleotide
acaaccatgccctccaggaagctcacc

SEQ ID NO: 204188 - DNA, 27 bp, Artificial Sequence
  Description of Artificial Sequence: Synthetic oligonucleotide
caaccatgccctccaggaagctcacct

SEQ ID NO: 204189 - DNA, 27 bp, Artificial Sequence
  Description of Artificial Sequence: Synthetic oligonucleotide
aaccatgccctccaggaagctcacctg

SEQ ID NO: 204190 - DNA, 27 bp, Artificial Sequence
  Description of Artificial Sequence: Synthetic oligonucleotide
accatgccctccaggaagctcacctgt

SEQ ID NO: 204191 - DNA, 26 bp, Artificial Sequence
  Description of Artificial Sequence: Synthetic oligonucleotide
ccatgccctccaggaagctcacctgt

SEQ ID NO: 204192 - DNA, 26 bp, Artificial Sequence
  Description of Artificial Sequence: Synthetic oligonucleotide
catgccctccaggaagctcacctgtg

SEQ ID NO: 204193 - DNA, 26 bp, Artificial Sequence
  Description of Artificial Sequence: Synthetic oligonucleotide
atgccctccaggaagctcacctgtgc

SEQ ID NO: 204194 - DNA, 25 bp, Artificial Sequence
  Description of Artificial Sequence: Synthetic oligonucleotide
tgccctccaggaagctcacctgtgc

SEQ ID NO: 204195 - DNA, 24 bp, Artificial Sequence
  Description of Artificial Sequence: Synthetic oligonucleotide
gccctccaggaagctcacctgtgc

SEQ ID NO: 204196 - DNA, 25 bp, Artificial Sequence
  Description of Artificial Sequence: Synthetic oligonucleotide
ccctccaggaagctcacctgtgcct

SEQ ID NO: 204197 - DNA, 27 bp, Artificial Sequence
  Description of Artificial Sequence: Synthetic oligonucleotide
cctccaggaagctcacctgtgcctgaa

SEQ ID NO: 204198 - DNA, 27 bp, Artificial Sequence
  Description of Artificial Sequence: Synthetic oligonucleotide
ctccaggaagctcacctgtgcctgaag

SEQ ID NO: 204199 - DNA, 27 bp, Artificial Sequence
  Description of Artificial Sequence: Synthetic oligonucleotide
tccaggaagctcacctgtgcctgaagc

SEQ ID NO: 204200 - DNA, 26 bp, Artificial Sequence
  Description of Artificial Sequence: Synthetic oligonucleotide
ccaggaagctcacctgtgcctgaagc

SEQ ID NO: 204201 - DNA, 26 bp, Artificial Sequence
  Description of Artificial Sequence: Synthetic oligonucleotide
caggaagctcacctgtgcctgaagcg

SEQ ID NO: 204202 - DNA, 26 bp, Artificial Sequence
  Description of Artificial Sequence: Synthetic oligonucleotide
aggaagctcacctgtgcctgaagcgc

SEQ ID NO: 204203 - DNA, 25 bp, Artificial Sequence
  Description of Artificial Sequence: Synthetic oligonucleotide
ggaagctcacctgtgcctgaagcgc

SEQ ID NO: 204204 - DNA, 27 bp, Artificial Sequence
  Description of Artificial Sequence: Synthetic oligonucleotide
gaagctcacctgtgcctgaagcgccat

SEQ ID NO: 204205 - DNA, 30 bp, Artificial Sequence
  Description of Artificial Sequence: Synthetic oligonucleotide
aagctcacctgtgcctgaagcgccattatg

SEQ ID NO: 204206 - DNA, 29 bp, Artificial Sequence
  Description of Artificial Sequence: Synthetic oligonucleotide
agctcacctgtgcctgaagcgccattatg

SEQ ID NO: 204207 - DNA, 28 bp, Artificial Sequence
  Description of Artificial Sequence: Synthetic oligonucleotide
gctcacctgtgcctgaagcgccattatg

SEQ ID NO: 204208 - DNA, 28 bp, Artificial Sequence
  Description of Artificial Sequence: Synthetic oligonucleotide
ctcacctgtgcctgaagcgccattatgc

SEQ ID NO: 204209 - DNA, 29 bp, Artificial Sequence
  Description of Artificial Sequence: Synthetic oligonucleotide
tcacctgtgcctgaagcgccattatgctg

SEQ ID NO: 204210 - DNA, 28 bp, Artificial Sequence
  Description of Artificial Sequence: Synthetic oligonucleotide
cacctgtgcctgaagcgccattatgctg

SEQ ID NO: 204211 - DNA, 28 bp, Artificial Sequence
  Description of Artificial Sequence: Synthetic oligonucleotide
acctgtgcctgaagcgccattatgctgc

SEQ ID NO: 204212 - DNA, 27 bp, Artificial Sequence
  Description of Artificial Sequence: Synthetic oligonucleotide
cctgtgcctgaagcgccattatgctgc

SEQ ID NO: 204213 - DNA, 27 bp, Artificial Sequence
  Description of Artificial Sequence: Synthetic oligonucleotide
ctgtgcctgaagcgccattatgctgcc

SEQ ID NO: 204214 - DNA, 30 bp, Artificial Sequence
  Description of Artificial Sequence: Synthetic oligonucleotide
tgtgcctgaagcgccattatgctgcctttc

SEQ ID NO: 204215 - DNA, 29 bp, Artificial Sequence
  Description of Artificial Sequence: Synthetic oligonucleotide
gtgcctgaagcgccattatgctgcctttc

SEQ ID NO: 204216 - DNA, 29 bp, Artificial Sequence
  Description of Artificial Sequence: Synthetic oligonucleotide
tgcctgaagcgccattatgctgcctttcc

SEQ ID NO: 204217 - DNA, 28 bp, Artificial Sequence
  Description of Artificial Sequence: Synthetic oligonucleotide
gcctgaagcgccattatgctgcctttcc

SEQ ID NO: 204218 - DNA, 32 bp, Artificial Sequence
  Description of Artificial Sequence: Synthetic oligonucleotide
cctgaagcgccattatgctgcctttccattac

SEQ ID NO: 204219 - DNA, 32 bp, Artificial Sequence
  Description of Artificial Sequence: Synthetic oligonucleotide
ctgaagcgccattatgctgcctttccattacc

SEQ ID NO: 204220 - DNA, 34 bp, Artificial Sequence
  Description of Artificial Sequence: Synthetic oligonucleotide
tgaagcgccattatgctgcctttccattacctag

SEQ ID NO: 204221 - DNA, 33 bp, Artificial Sequence
  Description of Artificial Sequence: Synthetic oligonucleotide
gaagcgccattatgctgcctttccattacctag

SEQ ID NO: 204222 - DNA, 33 bp, Artificial Sequence
  Description of Artificial Sequence: Synthetic oligonucleotide
aagcgccattatgctgcctttccattacctagc

SEQ ID NO: 204223 - DNA, 32 bp, Artificial Sequence
  Description of Artificial Sequence: Synthetic oligonucleotide
agcgccattatgctgcctttccattacctagc

SEQ ID NO: 204224 - DNA, 31 bp, Artificial Sequence
  Description of Artificial Sequence: Synthetic oligonucleotide
gcgccattatgctgcctttccattacctagc

SEQ ID NO: 204225 - DNA, 32 bp, Artificial Sequence
  Description of Artificial Sequence: Synthetic oligonucleotide
cgccattatgctgcctttccattacctagcag

SEQ ID NO: 204226 - DNA, 34 bp, Artificial Sequence
  Description of Artificial Sequence: Synthetic oligonucleotide
gccattatgctgcctttccattacctagcagaac

SEQ ID NO: 204227 - DNA, 34 bp, Artificial Sequence
  Description of Artificial Sequence: Synthetic oligonucleotide
ccattatgctgcctttccattacctagcagaacc

SEQ ID NO: 204228 - DNA, 35 bp, Artificial Sequence
  Description of Artificial Sequence: Synthetic oligonucleotide
cattatgctgcctttccattacctagcagaacctc

SEQ ID NO: 204229 - DNA, 35 bp, Artificial Sequence
  Description of Artificial Sequence: Synthetic oligonucleotide
attatgctgcctttccattacctagcagaacctcc

SEQ ID NO: 204230 - DNA, 34 bp, Artificial Sequence
  Description of Artificial Sequence: Synthetic oligonucleotide
ttatgctgcctttccattacctagcagaacctcc

SEQ ID NO: 204231 - DNA, 33 bp, Artificial Sequence
  Description of Artificial Sequence: Synthetic oligonucleotide
tatgctgcctttccattacctagcagaacctcc

SEQ ID NO: 204232 - DNA, 32 bp, Artificial Sequence
  Description of Artificial Sequence: Synthetic oligonucleotide
atgctgcctttccattacctagcagaacctcc

SEQ ID NO: 204233 - DNA, 31 bp, Artificial Sequence
  Description of Artificial Sequence: Synthetic oligonucleotide
tgctgcctttccattacctagcagaacctcc

SEQ ID NO: 204234 - DNA, 30 bp, Artificial Sequence
  Description of Artificial Sequence: Synthetic oligonucleotide
gctgcctttccattacctagcagaacctcc

SEQ ID NO: 204235 - DNA, 32 bp, Artificial Sequence
  Description of Artificial Sequence: Synthetic oligonucleotide
ctgcctttccattacctagcagaacctccttc

SEQ ID NO: 204236 - DNA, 35 bp, Artificial Sequence
  Description of Artificial Sequence: Synthetic oligonucleotide
tgcctttccattacctagcagaacctccttcaatg

SEQ ID NO: 204237 - DNA, 34 bp, Artificial Sequence
  Description of Artificial Sequence: Synthetic oligonucleotide
gcctttccattacctagcagaacctccttcaatg

SEQ ID NO: 204238 - DNA, 35 bp, Artificial Sequence
  Description of Artificial Sequence: Synthetic oligonucleotide
cctttccattacctagcagaacctccttcaatgac

SEQ ID NO: 204239 - DNA, 36 bp, Artificial Sequence
  Description of Artificial Sequence: Synthetic oligonucleotide
ctttccattacctagcagaacctccttcaatgactc

SEQ ID NO: 204240 - DNA, 36 bp, Artificial Sequence
  Description of Artificial Sequence: Synthetic oligonucleotide
tttccattacctagcagaacctccttcaatgactcc

SEQ ID NO: 204241 - DNA, 35 bp, Artificial Sequence
  Description of Artificial Sequence: Synthetic oligonucleotide
ttccattacctagcagaacctccttcaatgactcc

SEQ ID NO: 204242 - DNA, 34 bp, Artificial Sequence
  Description of Artificial Sequence: Synthetic oligonucleotide
tccattacctagcagaacctccttcaatgactcc

SEQ ID NO: 204243 - DNA, 33 bp, Artificial Sequence
  Description of Artificial Sequence: Synthetic oligonucleotide
ccattacctagcagaacctccttcaatgactcc

SEQ ID NO: 204244 - DNA, 33 bp, Artificial Sequence
  Description of Artificial Sequence: Synthetic oligonucleotide
cattacctagcagaacctccttcaatgactccc

SEQ ID NO: 204245 - DNA, 34 bp, Artificial Sequence
  Description of Artificial Sequence: Synthetic oligonucleotide
attacctagcagaacctccttcaatgactccctc

SEQ ID NO: 204246 - DNA, 33 bp, Artificial Sequence
  Description of Artificial Sequence: Synthetic oligonucleotide
ttacctagcagaacctccttcaatgactccctc

SEQ ID NO: 204247 - DNA, 32 bp, Artificial Sequence
  Description of Artificial Sequence: Synthetic oligonucleotide
tacctagcagaacctccttcaatgactccctc

SEQ ID NO: 204248 - DNA, 31 bp, Artificial Sequence
  Description of Artificial Sequence: Synthetic oligonucleotide
acctagcagaacctccttcaatgactccctc

SEQ ID NO: 204249 - DNA, 30 bp, Artificial Sequence
  Description of Artificial Sequence: Synthetic oligonucleotide
cctagcagaacctccttcaatgactccctc

SEQ ID NO: 204250 - DNA, 31 bp, Artificial Sequence
  Description of Artificial Sequence: Synthetic oligonucleotide
ctagcagaacctccttcaatgactccctcac

SEQ ID NO: 204251 - DNA, 34 bp, Artificial Sequence
  Description of Artificial Sequence: Synthetic oligonucleotide
tagcagaacctccttcaatgactccctcacattc

SEQ ID NO: 204252 - DNA, 33 bp, Artificial Sequence
  Description of Artificial Sequence: Synthetic oligonucleotide
agcagaacctccttcaatgactccctcacattc

SEQ ID NO: 204253 - DNA, 32 bp, Artificial Sequence
  Description of Artificial Sequence: Synthetic oligonucleotide
gcagaacctccttcaatgactccctcacattc

SEQ ID NO: 204254 - DNA, 35 bp, Artificial Sequence
  Description of Artificial Sequence: Synthetic oligonucleotide
cagaacctccttcaatgactccctcacattcttag

SEQ ID NO: 204255 - DNA, 36 bp, Artificial Sequence
  Description of Artificial Sequence: Synthetic oligonucleotide
agaacctccttcaatgactccctcacattcttagag

SEQ ID NO: 204256 - DNA, 35 bp, Artificial Sequence
  Description of Artificial Sequence: Synthetic oligonucleotide
gaacctccttcaatgactccctcacattcttagag

SEQ ID NO: 204257 - DNA, 38 bp, Artificial Sequence
  Description of Artificial Sequence: Synthetic oligonucleotide
aacctccttcaatgactccctcacattcttagagaatg

SEQ ID NO: 204258 - DNA, 37 bp, Artificial Sequence
  Description of Artificial Sequence: Synthetic oligonucleotide
acctccttcaatgactccctcacattcttagagaatg

SEQ ID NO: 204259 - DNA, 36 bp, Artificial Sequence
  Description of Artificial Sequence: Synthetic oligonucleotide
cctccttcaatgactccctcacattcttagagaatg

SEQ ID NO: 204260 - DNA, 36 bp, Artificial Sequence
  Description of Artificial Sequence: Synthetic oligonucleotide
ctccttcaatgactccctcacattcttagagaatgc

SEQ ID NO: 204261 - DNA, 37 bp, Artificial Sequence
  Description of Artificial Sequence: Synthetic oligonucleotide
tccttcaatgactccctcacattcttagagaatgctg

SEQ ID NO: 204262 - DNA, 36 bp, Artificial Sequence
  Description of Artificial Sequence: Synthetic oligonucleotide
ccttcaatgactccctcacattcttagagaatgctg

SEQ ID NO: 204263 - DNA, 36 bp, Artificial Sequence
  Description of Artificial Sequence: Synthetic oligonucleotide
cttcaatgactccctcacattcttagagaatgctgc

SEQ ID NO: 204264 - DNA, 37 bp, Artificial Sequence
  Description of Artificial Sequence: Synthetic oligonucleotide
ttcaatgactccctcacattcttagagaatgctgcag

SEQ ID NO: 204265 - DNA, 36 bp, Artificial Sequence
  Description of Artificial Sequence: Synthetic oligonucleotide
tcaatgactccctcacattcttagagaatgctgcag

SEQ ID NO: 204266 - DNA, 35 bp, Artificial Sequence
  Description of Artificial Sequence: Synthetic oligonucleotide
caatgactccctcacattcttagagaatgctgcag

SEQ ID NO: 204267 - DNA, 36 bp, Artificial Sequence
  Description of Artificial Sequence: Synthetic oligonucleotide
aatgactccctcacattcttagagaatgctgcagac

SEQ ID NO: 204268 - DNA, 35 bp, Artificial Sequence
  Description of Artificial Sequence: Synthetic oligonucleotide
atgactccctcacattcttagagaatgctgcagac

SEQ ID NO: 204269 - DNA, 34 bp, Artificial Sequence
  Description of Artificial Sequence: Synthetic oligonucleotide
tgactccctcacattcttagagaatgctgcagac

SEQ ID NO: 204270 - DNA, 33 bp, Artificial Sequence
  Description of Artificial Sequence: Synthetic oligonucleotide
gactccctcacattcttagagaatgctgcagac

SEQ ID NO: 204271 - DNA, 33 bp, Artificial Sequence
  Description of Artificial Sequence: Synthetic oligonucleotide
actccctcacattcttagagaatgctgcagacg

SEQ ID NO: 204272 - DNA, 32 bp, Artificial Sequence
  Description of Artificial Sequence: Synthetic oligonucleotide
ctccctcacattcttagagaatgctgcagacg

SEQ ID NO: 204273 - DNA, 34 bp, Artificial Sequence
  Description of Artificial Sequence: Synthetic oligonucleotide
tccctcacattcttagagaatgctgcagacgttg

SEQ ID NO: 204274 - DNA, 33 bp, Artificial Sequence
  Description of Artificial Sequence: Synthetic oligonucleotide
ccctcacattcttagagaatgctgcagacgttg

SEQ ID NO: 204275 - DNA, 33 bp, Artificial Sequence
  Description of Artificial Sequence: Synthetic oligonucleotide
cctcacattcttagagaatgctgcagacgttgg

SEQ ID NO: 204276 - DNA, 33 bp, Artificial Sequence
  Description of Artificial Sequence: Synthetic oligonucleotide
ctcacattcttagagaatgctgcagacgttggg

SEQ ID NO: 204277 - DNA, 33 bp, Artificial Sequence
  Description of Artificial Sequence: Synthetic oligonucleotide
tcacattcttagagaatgctgcagacgttgggg

SEQ ID NO: 204278 - DNA, 32 bp, Artificial Sequence
  Description of Artificial Sequence: Synthetic oligonucleotide
cacattcttagagaatgctgcagacgttgggg

SEQ ID NO: 204279 - DNA, 32 bp, Artificial Sequence
  Description of Artificial Sequence: Synthetic oligonucleotide
acattcttagagaatgctgcagacgttggggg

SEQ ID NO: 204280 - DNA, 31 bp, Artificial Sequence
  Description of Artificial Sequence: Synthetic oligonucleotide
cattcttagagaatgctgcagacgttggggg

SEQ ID NO: 204281 - DNA, 31 bp, Artificial Sequence
  Description of Artificial Sequence: Synthetic oligonucleotide
attcttagagaatgctgcagacgttgggggg

SEQ ID NO: 204282 - DNA, 30 bp, Artificial Sequence
  Description of Artificial Sequence: Synthetic oligonucleotide
ttcttagagaatgctgcagacgttgggggg

SEQ ID NO: 204283 - DNA, 29 bp, Artificial Sequence
  Description of Artificial Sequence: Synthetic oligonucleotide
tcttagagaatgctgcagacgttgggggg

SEQ ID NO: 204284 - DNA, 28 bp, Artificial Sequence
  Description of Artificial Sequence: Synthetic oligonucleotide
cttagagaatgctgcagacgttgggggg

SEQ ID NO: 204285 - DNA, 28 bp, Artificial Sequence
  Description of Artificial Sequence: Synthetic oligonucleotide
ttagagaatgctgcagacgttggggggc

SEQ ID NO: 204286 - DNA, 27 bp, Artificial Sequence
  Description of Artificial Sequence: Synthetic oligonucleotide
tagagaatgctgcagacgttggggggc

SEQ ID NO: 204287 - DNA, 27 bp, Artificial Sequence
  Description of Artificial Sequence: Synthetic oligonucleotide
agagaatgctgcagacgttggggggct

SEQ ID NO: 204288 - DNA, 27 bp, Artificial Sequence
  Description of Artificial Sequence: Synthetic oligonucleotide
gagaatgctgcagacgttggggggcta

SEQ ID NO: 204289 - DNA, 27 bp, Artificial Sequence
  Description of Artificial Sequence: Synthetic oligonucleotide
agaatgctgcagacgttggggggctag

SEQ ID NO: 204290 - DNA, 26 bp, Artificial Sequence
  Description of Artificial Sequence: Synthetic oligonucleotide
gaatgctgcagacgttggggggctag

SEQ ID NO: 204291 - DNA, 26 bp, Artificial Sequence
  Description of Artificial Sequence: Synthetic oligonucleotide
aatgctgcagacgttggggggctagc

SEQ ID NO: 204292 - DNA, 25 bp, Artificial Sequence
  Description of Artificial Sequence: Synthetic oligonucleotide
atgctgcagacgttggggggctagc

SEQ ID NO: 204293 - DNA, 24 bp, Artificial Sequence
  Description of Artificial Sequence: Synthetic oligonucleotide
tgctgcagacgttggggggctagc

SEQ ID NO: 204294 - DNA, 23 bp, Artificial Sequence
  Description of Artificial Sequence: Synthetic oligonucleotide
gctgcagacgttggggggctagc

SEQ ID NO: 204295 - DNA, 25 bp, Artificial Sequence
  Description of Artificial Sequence: Synthetic oligonucleotide
ctgcagacgttggggggctagccat

SEQ ID NO: 204296 - DNA, 25 bp, Artificial Sequence
  Description of Artificial Sequence: Synthetic oligonucleotide
tgcagacgttggggggctagccatc

SEQ ID NO: 204297 - DNA, 24 bp, Artificial Sequence
  Description of Artificial Sequence: Synthetic oligonucleotide
gcagacgttggggggctagccatc

SEQ ID NO: 204298 - DNA, 24 bp, Artificial Sequence
  Description of Artificial Sequence: Synthetic oligonucleotide
cagacgttggggggctagccatcg

SEQ ID NO: 204299 - DNA, 24 bp, Artificial Sequence
  Description of Artificial Sequence: Synthetic oligonucleotide
agacgttggggggctagccatcgc

SEQ ID NO: 204300 - DNA, 23 bp, Artificial Sequence
  Description of Artificial Sequence: Synthetic oligonucleotide
gacgttggggggctagccatcgc

SEQ ID NO: 204301 - DNA, 23 bp, Artificial Sequence
  Description of Artificial Sequence: Synthetic oligonucleotide
acgttggggggctagccatcgcg

SEQ ID NO: 204302 - DNA, 22 bp, Artificial Sequence
  Description of Artificial Sequence: Synthetic oligonucleotide
cgttggggggctagccatcgcg

SEQ ID NO: 204303 - DNA, 23 bp, Artificial Sequence
  Description of Artificial Sequence: Synthetic oligonucleotide
gttggggggctagccatcgcgct

SEQ ID NO: 204304 - DNA, 23 bp, Artificial Sequence
  Description of Artificial Sequence: Synthetic oligonucleotide
ttggggggctagccatcgcgctg

SEQ ID NO: 204305 - DNA, 22 bp, Artificial Sequence
  Description of Artificial Sequence: Synthetic oligonucleotide
tggggggctagccatcgcgctg

SEQ ID NO: 204306 - DNA, 21 bp, Artificial Sequence
  Description of Artificial Sequence: Synthetic oligonucleotide
ggggggctagccatcgcgctg

SEQ ID NO: 204307 - DNA, 22 bp, Artificial Sequence
  Description of Artificial Sequence: Synthetic oligonucleotide
gggggctagccatcgcgctgca

SEQ ID NO: 204308 - DNA, 22 bp, Artificial Sequence
  Description of Artificial Sequence: Synthetic oligonucleotide
ggggctagccatcgcgctgcag

SEQ ID NO: 204309 - DNA, 22 bp, Artificial Sequence
  Description of Artificial Sequence: Synthetic oligonucleotide
gggctagccatcgcgctgcagg

SEQ ID NO: 204310 - DNA, 25 bp, Artificial Sequence
  Description of Artificial Sequence: Synthetic oligonucleotide
ggctagccatcgcgctgcaggcata

SEQ ID NO: 204311 - DNA, 26 bp, Artificial Sequence
  Description of Artificial Sequence: Synthetic oligonucleotide
gctagccatcgcgctgcaggcataca

SEQ ID NO: 204312 - DNA, 26 bp, Artificial Sequence
  Description of Artificial Sequence: Synthetic oligonucleotide
ctagccatcgcgctgcaggcatacag

SEQ ID NO: 204313 - DNA, 27 bp, Artificial Sequence
  Description of Artificial Sequence: Synthetic oligonucleotide
tagccatcgcgctgcaggcatacagca

SEQ ID NO: 204314 - DNA, 27 bp, Artificial Sequence
  Description of Artificial Sequence: Synthetic oligonucleotide
agccatcgcgctgcaggcatacagcaa

SEQ ID NO: 204315 - DNA, 26 bp, Artificial Sequence
  Description of Artificial Sequence: Synthetic oligonucleotide
gccatcgcgctgcaggcatacagcaa

SEQ ID NO: 204316 - DNA, 27 bp, Artificial Sequence
  Description of Artificial Sequence: Synthetic oligonucleotide
ccatcgcgctgcaggcatacagcaaga

SEQ ID NO: 204317 - DNA, 27 bp, Artificial Sequence
  Description of Artificial Sequence: Synthetic oligonucleotide
catcgcgctgcaggcatacagcaagag

SEQ ID NO: 204318 - DNA, 27 bp, Artificial Sequence
  Description of Artificial Sequence: Synthetic oligonucleotide
atcgcgctgcaggcatacagcaagagg

SEQ ID NO: 204319 - DNA, 26 bp, Artificial Sequence
  Description of Artificial Sequence: Synthetic oligonucleotide
tcgcgctgcaggcatacagcaagagg

SEQ ID NO: 204320 - DNA, 25 bp, Artificial Sequence
  Description of Artificial Sequence: Synthetic oligonucleotide
cgcgctgcaggcatacagcaagagg

SEQ ID NO: 204321 - DNA, 26 bp, Artificial Sequence
  Description of Artificial Sequence: Synthetic oligonucleotide
gcgctgcaggcatacagcaagaggct

SEQ ID NO: 204322 - DNA, 27 bp, Artificial Sequence
  Description of Artificial Sequence: Synthetic oligonucleotide
cgctgcaggcatacagcaagaggctgt

SEQ ID NO: 204323 - DNA, 29 bp, Artificial Sequence
  Description of Artificial Sequence: Synthetic oligonucleotide
gctgcaggcatacagcaagaggctgttac

SEQ ID NO: 204324 - DNA, 29 bp, Artificial Sequence
  Description of Artificial Sequence: Synthetic oligonucleotide
ctgcaggcatacagcaagaggctgttacg

SEQ ID NO: 204325 - DNA, 29 bp, Artificial Sequence
  Description of Artificial Sequence: Synthetic oligonucleotide
tgcaggcatacagcaagaggctgttacgg

SEQ ID NO: 204326 - DNA, 28 bp, Artificial Sequence
  Description of Artificial Sequence: Synthetic oligonucleotide
gcaggcatacagcaagaggctgttacgg

SEQ ID NO: 204327 - DNA, 28 bp, Artificial Sequence
  Description of Artificial Sequence: Synthetic oligonucleotide
caggcatacagcaagaggctgttacggc

SEQ ID NO: 204328 - DNA, 29 bp, Artificial Sequence
  Description of Artificial Sequence: Synthetic oligonucleotide
aggcatacagcaagaggctgttacggcac

SEQ ID NO: 204329 - DNA, 28 bp, Artificial Sequence
  Description of Artificial Sequence: Synthetic oligonucleotide
ggcatacagcaagaggctgttacggcac

SEQ ID NO: 204330 - DNA, 28 bp, Artificial Sequence
  Description of Artificial Sequence: Synthetic oligonucleotide
gcatacagcaagaggctgttacggcacc

SEQ ID NO: 204331 - DNA, 30 bp, Artificial Sequence
  Description of Artificial Sequence: Synthetic oligonucleotide
catacagcaagaggctgttacggcaccatg

SEQ ID NO: 204332 - DNA, 30 bp, Artificial Sequence
  Description of Artificial Sequence: Synthetic oligonucleotide
atacagcaagaggctgttacggcaccatgg

SEQ ID NO: 204333 - DNA, 29 bp, Artificial Sequence
  Description of Artificial Sequence: Synthetic oligonucleotide
tacagcaagaggctgttacggcaccatgg

SEQ ID NO: 204334 - DNA, 28 bp, Artificial Sequence
  Description of Artificial Sequence: Synthetic oligonucleotide
acagcaagaggctgttacggcaccatgg

SEQ ID NO: 204335 - DNA, 27 bp, Artificial Sequence
  Description of Artificial Sequence: Synthetic oligonucleotide
cagcaagaggctgttacggcaccatgg

SEQ ID NO: 204336 - DNA, 27 bp, Artificial Sequence
  Description of Artificial Sequence: Synthetic oligonucleotide
agcaagaggctgttacggcaccatggg

SEQ ID NO: 204337 - DNA, 26 bp, Artificial Sequence
  Description of Artificial Sequence: Synthetic oligonucleotide
gcaagaggctgttacggcaccatggg

SEQ ID NO: 204338 - DNA, 27 bp, Artificial Sequence
  Description of Artificial Sequence: Synthetic oligonucleotide
caagaggctgttacggcaccatgggga

SEQ ID NO: 204339 - DNA, 27 bp, Artificial Sequence
  Description of Artificial Sequence: Synthetic oligonucleotide
aagaggctgttacggcaccatggggag

SEQ ID NO: 204340 - DNA, 27 bp, Artificial Sequence
  Description of Artificial Sequence: Synthetic oligonucleotide
agaggctgttacggcaccatggggaga

SEQ ID NO: 204341 - DNA, 26 bp, Artificial Sequence
  Description of Artificial Sequence: Synthetic oligonucleotide
gaggctgttacggcaccatggggaga

SEQ ID NO: 204342 - DNA, 27 bp, Artificial Sequence
  Description of Artificial Sequence: Synthetic oligonucleotide
aggctgttacggcaccatggggagact

SEQ ID NO: 204343 - DNA, 26 bp, Artificial Sequence
  Description of Artificial Sequence: Synthetic oligonucleotide
ggctgttacggcaccatggggagact

SEQ ID NO: 204344 - DNA, 27 bp, Artificial Sequence
  Description of Artificial Sequence: Synthetic oligonucleotide
gctgttacggcaccatggggagactgt

SEQ ID NO: 204345 - DNA, 27 bp, Artificial Sequence
  Description of Artificial Sequence: Synthetic oligonucleotide
ctgttacggcaccatggggagactgtc

SEQ ID NO: 204346 - DNA, 27 bp, Artificial Sequence
  Description of Artificial Sequence: Synthetic oligonucleotide
tgttacggcaccatggggagactgtcc

SEQ ID NO: 204347 - DNA, 27 bp, Artificial Sequence
  Description of Artificial Sequence: Synthetic oligonucleotide
gttacggcaccatggggagactgtcct

SEQ ID NO: 204348 - DNA, 27 bp, Artificial Sequence
  Description of Artificial Sequence: Synthetic oligonucleotide
ttacggcaccatggggagactgtcctg

SEQ ID NO: 204349 - DNA, 26 bp, Artificial Sequence
  Description of Artificial Sequence: Synthetic oligonucleotide
tacggcaccatggggagactgtcctg

SEQ ID NO: 204350 - DNA, 25 bp, Artificial Sequence
  Description of Artificial Sequence: Synthetic oligonucleotide
acggcaccatggggagactgtcctg

SEQ ID NO: 204351 - DNA, 24 bp, Artificial Sequence
  Description of Artificial Sequence: Synthetic oligonucleotide
cggcaccatggggagactgtcctg

SEQ ID NO: 204352 - DNA, 24 bp, Artificial Sequence
  Description of Artificial Sequence: Synthetic oligonucleotide
ggcaccatggggagactgtcctgc

SEQ ID NO: 204353 - DNA, 24 bp, Artificial Sequence
  Description of Artificial Sequence: Synthetic oligonucleotide
gcaccatggggagactgtcctgcc

SEQ ID NO: 204354 - DNA, 25 bp, Artificial Sequence
  Description of Artificial Sequence: Synthetic oligonucleotide
caccatggggagactgtcctgccca

SEQ ID NO: 204355 - DNA, 25 bp, Artificial Sequence
  Description of Artificial Sequence: Synthetic oligonucleotide
accatggggagactgtcctgcccag

SEQ ID NO: 204356 - DNA, 24 bp, Artificial Sequence
  Description of Artificial Sequence: Synthetic oligonucleotide
ccatggggagactgtcctgcccag

SEQ ID NO: 204357 - DNA, 24 bp, Artificial Sequence
  Description of Artificial Sequence: Synthetic oligonucleotide
catggggagactgtcctgcccagc

SEQ ID NO: 204358 - DNA, 25 bp, Artificial Sequence
  Description of Artificial Sequence: Synthetic oligonucleotide
atggggagactgtcctgcccagcct

SEQ ID NO: 204359 - DNA, 24 bp, Artificial Sequence
  Description of Artificial Sequence: Synthetic oligonucleotide
tggggagactgtcctgcccagcct

SEQ ID NO: 204360 - DNA, 23 bp, Artificial Sequence
  Description of Artificial Sequence: Synthetic oligonucleotide
ggggagactgtcctgcccagcct

SEQ ID NO: 204361 - DNA, 23 bp, Artificial Sequence
  Description of Artificial Sequence: Synthetic oligonucleotide
gggagactgtcctgcccagcctg

SEQ ID NO: 204362 - DNA, 24 bp, Artificial Sequence
  Description of Artificial Sequence: Synthetic oligonucleotide
ggagactgtcctgcccagcctgga

SEQ ID NO: 204363 - DNA, 24 bp, Artificial Sequence
  Description of Artificial Sequence: Synthetic oligonucleotide
gagactgtcctgcccagcctggac

SEQ ID NO: 204364 - DNA, 25 bp, Artificial Sequence
  Description of Artificial Sequence: Synthetic oligonucleotide
agactgtcctgcccagcctggacct

SEQ ID NO: 204365 - DNA, 24 bp, Artificial Sequence
  Description of Artificial Sequence: Synthetic oligonucleotide
gactgtcctgcccagcctggacct

SEQ ID NO: 204366 - DNA, 25 bp, Artificial Sequence
  Description of Artificial Sequence: Synthetic oligonucleotide
actgtcctgcccagcctggacctca

SEQ ID NO: 204367 - DNA, 24 bp, Artificial Sequence
  Description of Artificial Sequence: Synthetic oligonucleotide
ctgtcctgcccagcctggacctca

SEQ ID NO: 204368 - DNA, 24 bp, Artificial Sequence
  Description of Artificial Sequence: Synthetic oligonucleotide
tgtcctgcccagcctggacctcag

SEQ ID NO: 204369 - DNA, 23 bp, Artificial Sequence
  Description of Artificial Sequence: Synthetic oligonucleotide
gtcctgcccagcctggacctcag

SEQ ID NO: 204370 - DNA, 23 bp, Artificial Sequence
  Description of Artificial Sequence: Synthetic oligonucleotide
tcctgcccagcctggacctcagc

SEQ ID NO: 204371 - DNA, 22 bp, Artificial Sequence
  Description of Artificial Sequence: Synthetic oligonucleotide
cctgcccagcctggacctcagc

SEQ ID NO: 204372 - DNA, 22 bp, Artificial Sequence
  Description of Artificial Sequence: Synthetic oligonucleotide
ctgcccagcctggacctcagcc

SEQ ID NO: 204373 - DNA, 22 bp, Artificial Sequence
  Description of Artificial Sequence: Synthetic oligonucleotide
tgcccagcctggacctcagccc

SEQ ID NO: 204374 - DNA, 21 bp, Artificial Sequence
  Description of Artificial Sequence: Synthetic oligonucleotide
gcccagcctggacctcagccc

SEQ ID NO: 204375 - DNA, 21 bp, Artificial Sequence
  Description of Artificial Sequence: Synthetic oligonucleotide
cccagcctggacctcagcccc

SEQ ID NO: 204376 - DNA, 22 bp, Artificial Sequence
  Description of Artificial Sequence: Synthetic oligonucleotide
ccagcctggacctcagccccca

SEQ ID NO: 204377 - DNA, 22 bp, Artificial Sequence
  Description of Artificial Sequence: Synthetic oligonucleotide
cagcctggacctcagcccccag

SEQ ID NO: 204378 - DNA, 23 bp, Artificial Sequence
  Description of Artificial Sequence: Synthetic oligonucleotide
agcctggacctcagcccccagca

SEQ ID NO: 204379 - DNA, 22 bp, Artificial Sequence
  Description of Artificial Sequence: Synthetic oligonucleotide
gcctggacctcagcccccagca

SEQ ID NO: 204380 - DNA, 24 bp, Artificial Sequence
  Description of Artificial Sequence: Synthetic oligonucleotide
cctggacctcagcccccagcagat

SEQ ID NO: 204381 - DNA, 26 bp, Artificial Sequence
  Description of Artificial Sequence: Synthetic oligonucleotide
ctggacctcagcccccagcagatctt

SEQ ID NO: 204382 - DNA, 27 bp, Artificial Sequence
  Description of Artificial Sequence: Synthetic oligonucleotide
tggacctcagcccccagcagatcttct

SEQ ID NO: 204383 - DNA, 27 bp, Artificial Sequence
  Description of Artificial Sequence: Synthetic oligonucleotide
ggacctcagcccccagcagatcttctt

SEQ ID NO: 204384 - DNA, 28 bp, Artificial Sequence
  Description of Artificial Sequence: Synthetic oligonucleotide
gacctcagcccccagcagatcttctttc

SEQ ID NO: 204385 - DNA, 28 bp, Artificial Sequence
  Description of Artificial Sequence: Synthetic oligonucleotide
acctcagcccccagcagatcttctttcg

SEQ ID NO: 204386 - DNA, 27 bp, Artificial Sequence
  Description of Artificial Sequence: Synthetic oligonucleotide
cctcagcccccagcagatcttctttcg

SEQ ID NO: 204387 - DNA, 29 bp, Artificial Sequence
  Description of Artificial Sequence: Synthetic oligonucleotide
ctcagcccccagcagatcttctttcgaag

SEQ ID NO: 204388 - DNA, 29 bp, Artificial Sequence
  Description of Artificial Sequence: Synthetic oligonucleotide
tcagcccccagcagatcttctttcgaagc

SEQ ID NO: 204389 - DNA, 28 bp, Artificial Sequence
  Description of Artificial Sequence: Synthetic oligonucleotide
cagcccccagcagatcttctttcgaagc

SEQ ID NO: 204390 - DNA, 31 bp, Artificial Sequence
  Description of Artificial Sequence: Synthetic oligonucleotide
agcccccagcagatcttctttcgaagctatg

SEQ ID NO: 204391 - DNA, 30 bp, Artificial Sequence
  Description of Artificial Sequence: Synthetic oligonucleotide
gcccccagcagatcttctttcgaagctatg

SEQ ID NO: 204392 - DNA, 30 bp, Artificial Sequence
  Description of Artificial Sequence: Synthetic oligonucleotide
cccccagcagatcttctttcgaagctatgc

SEQ ID NO: 204393 - DNA, 30 bp, Artificial Sequence
  Description of Artificial Sequence: Synthetic oligonucleotide
ccccagcagatcttctttcgaagctatgcc

SEQ ID NO: 204394 - DNA, 30 bp, Artificial Sequence
  Description of Artificial Sequence: Synthetic oligonucleotide
cccagcagatcttctttcgaagctatgccc

SEQ ID NO: 204395 - DNA, 31 bp, Artificial Sequence
  Description of Artificial Sequence: Synthetic oligonucleotide
ccagcagatcttctttcgaagctatgcccag

SEQ ID NO: 204396 - DNA, 31 bp, Artificial Sequence
  Description of Artificial Sequence: Synthetic oligonucleotide
cagcagatcttctttcgaagctatgcccagg

SEQ ID NO: 204397 - DNA, 32 bp, Artificial Sequence
  Description of Artificial Sequence: Synthetic oligonucleotide
agcagatcttctttcgaagctatgcccaggtg

SEQ ID NO: 204398 - DNA, 31 bp, Artificial Sequence
  Description of Artificial Sequence: Synthetic oligonucleotide
gcagatcttctttcgaagctatgcccaggtg

SEQ ID NO: 204399 - DNA, 33 bp, Artificial Sequence
  Description of Artificial Sequence: Synthetic oligonucleotide
cagatcttctttcgaagctatgcccaggtgatg

SEQ ID NO: 204400 - DNA, 34 bp, Artificial Sequence
  Description of Artificial Sequence: Synthetic oligonucleotide
agatcttctttcgaagctatgcccaggtgatgtg

SEQ ID NO: 204401 - DNA, 33 bp, Artificial Sequence
  Description of Artificial Sequence: Synthetic oligonucleotide
gatcttctttcgaagctatgcccaggtgatgtg

SEQ ID NO: 204402 - DNA, 35 bp, Artificial Sequence
  Description of Artificial Sequence: Synthetic oligonucleotide
atcttctttcgaagctatgcccaggtgatgtgtag

SEQ ID NO: 204403 - DNA, 34 bp, Artificial Sequence
  Description of Artificial Sequence: Synthetic oligonucleotide
tcttctttcgaagctatgcccaggtgatgtgtag

SEQ ID NO: 204404 - DNA, 33 bp, Artificial Sequence
  Description of Artificial Sequence: Synthetic oligonucleotide
cttctttcgaagctatgcccaggtgatgtgtag

SEQ ID NO: 204405 - DNA, 33 bp, Artificial Sequence
  Description of Artificial Sequence: Synthetic oligonucleotide
ttctttcgaagctatgcccaggtgatgtgtagg

SEQ ID NO: 204406 - DNA, 32 bp, Artificial Sequence
  Description of Artificial Sequence: Synthetic oligonucleotide
tctttcgaagctatgcccaggtgatgtgtagg

SEQ ID NO: 204407 - DNA, 31 bp, Artificial Sequence
  Description of Artificial Sequence: Synthetic oligonucleotide
ctttcgaagctatgcccaggtgatgtgtagg

SEQ ID NO: 204408 - DNA, 33 bp, Artificial Sequence
  Description of Artificial Sequence: Synthetic oligonucleotide
tttcgaagctatgcccaggtgatgtgtaggaag

SEQ ID NO: 204409 - DNA, 32 bp, Artificial Sequence
  Description of Artificial Sequence: Synthetic oligonucleotide
ttcgaagctatgcccaggtgatgtgtaggaag

SEQ ID NO: 204410 - DNA, 31 bp, Artificial Sequence
  Description of Artificial Sequence: Synthetic oligonucleotide
tcgaagctatgcccaggtgatgtgtaggaag

SEQ ID NO: 204411 - DNA, 30 bp, Artificial Sequence
  Description of Artificial Sequence: Synthetic oligonucleotide
cgaagctatgcccaggtgatgtgtaggaag

SEQ ID NO: 204412 - DNA, 30 bp, Artificial Sequence
  Description of Artificial Sequence: Synthetic oligonucleotide
gaagctatgcccaggtgatgtgtaggaagc

SEQ ID NO: 204413 - DNA, 30 bp, Artificial Sequence
  Description of Artificial Sequence: Synthetic oligonucleotide
aagctatgcccaggtgatgtgtaggaagcc

SEQ ID NO: 204414 - DNA, 29 bp, Artificial Sequence
  Description of Artificial Sequence: Synthetic oligonucleotide
agctatgcccaggtgatgtgtaggaagcc

SEQ ID NO: 204415 - DNA, 28 bp, Artificial Sequence
  Description of Artificial Sequence: Synthetic oligonucleotide
gctatgcccaggtgatgtgtaggaagcc

SEQ ID NO: 204416 - DNA, 28 bp, Artificial Sequence
  Description of Artificial Sequence: Synthetic oligonucleotide
ctatgcccaggtgatgtgtaggaagccc

SEQ ID NO: 204417 - DNA, 29 bp, Artificial Sequence
  Description of Artificial Sequence: Synthetic oligonucleotide
tatgcccaggtgatgtgtaggaagcccag

SEQ ID NO: 204418 - DNA, 28 bp, Artificial Sequence
  Description of Artificial Sequence: Synthetic oligonucleotide
atgcccaggtgatgtgtaggaagcccag

SEQ ID NO: 204419 - DNA, 27 bp, Artificial Sequence
  Description of Artificial Sequence: Synthetic oligonucleotide
tgcccaggtgatgtgtaggaagcccag

SEQ ID NO: 204420 - DNA, 26 bp, Artificial Sequence
  Description of Artificial Sequence: Synthetic oligonucleotide
gcccaggtgatgtgtaggaagcccag

SEQ ID NO: 204421 - DNA, 26 bp, Artificial Sequence
  Description of Artificial Sequence: Synthetic oligonucleotide
cccaggtgatgtgtaggaagcccagc

SEQ ID NO: 204422 - DNA, 26 bp, Artificial Sequence
  Description of Artificial Sequence: Synthetic oligonucleotide
ccaggtgatgtgtaggaagcccagcc

SEQ ID NO: 204423 - DNA, 26 bp, Artificial Sequence
  Description of Artificial Sequence: Synthetic oligonucleotide
caggtgatgtgtaggaagcccagccc

SEQ ID NO: 204424 - DNA, 26 bp, Artificial Sequence
  Description of Artificial Sequence: Synthetic oligonucleotide
aggtgatgtgtaggaagcccagcccc

SEQ ID NO: 204425 - DNA, 25 bp, Artificial Sequence
  Description of Artificial Sequence: Synthetic oligonucleotide
ggtgatgtgtaggaagcccagcccc

SEQ ID NO: 204426 - DNA, 26 bp, Artificial Sequence
  Description of Artificial Sequence: Synthetic oligonucleotide
gtgatgtgtaggaagcccagccccca

SEQ ID NO: 204427 - DNA, 26 bp, Artificial Sequence
  Description of Artificial Sequence: Synthetic oligonucleotide
tgatgtgtaggaagcccagcccccag

SEQ ID NO: 204428 - DNA, 25 bp, Artificial Sequence
  Description of Artificial Sequence: Synthetic oligonucleotide
gatgtgtaggaagcccagcccccag

SEQ ID NO: 204429 - DNA, 26 bp, Artificial Sequence
  Description of Artificial Sequence: Synthetic oligonucleotide
atgtgtaggaagcccagcccccagga

SEQ ID NO: 204430 - DNA, 25 bp, Artificial Sequence
  Description of Artificial Sequence: Synthetic oligonucleotide
tgtgtaggaagcccagcccccagga

SEQ ID NO: 204431 - DNA, 24 bp, Artificial Sequence
  Description of Artificial Sequence: Synthetic oligonucleotide
gtgtaggaagcccagcccccagga

SEQ ID NO: 204432 - DNA, 25 bp, Artificial Sequence
  Description of Artificial Sequence: Synthetic oligonucleotide
tgtaggaagcccagcccccaggact

SEQ ID NO: 204433 - DNA, 24 bp, Artificial Sequence
  Description of Artificial Sequence: Synthetic oligonucleotide
gtaggaagcccagcccccaggact

SEQ ID NO: 204434 - DNA, 25 bp, Artificial Sequence
  Description of Artificial Sequence: Synthetic oligonucleotide
taggaagcccagcccccaggactct

SEQ ID NO: 204435 - DNA, 24 bp, Artificial Sequence
  Description of Artificial Sequence: Synthetic oligonucleotide
aggaagcccagcccccaggactct

SEQ ID NO: 204436 - DNA, 23 bp, Artificial Sequence
  Description of Artificial Sequence: Synthetic oligonucleotide
ggaagcccagcccccaggactct

SEQ ID NO: 204437 - DNA, 24 bp, Artificial Sequence
  Description of Artificial Sequence: Synthetic oligonucleotide
gaagcccagcccccaggactctca

SEQ ID NO: 204438 - DNA, 24 bp, Artificial Sequence
  Description of Artificial Sequence: Synthetic oligonucleotide
aagcccagcccccaggactctcac

SEQ ID NO: 204439 - DNA, 23 bp, Artificial Sequence
  Description of Artificial Sequence: Synthetic oligonucleotide
agcccagcccccaggactctcac

SEQ ID NO: 204440 - DNA, 22 bp, Artificial Sequence
  Description of Artificial Sequence: Synthetic oligonucleotide
gcccagcccccaggactctcac

SEQ ID NO: 204441 - DNA, 23 bp, Artificial Sequence
  Description of Artificial Sequence: Synthetic oligonucleotide
cccagcccccaggactctcacga

SEQ ID NO: 204442 - DNA, 24 bp, Artificial Sequence
  Description of Artificial Sequence: Synthetic oligonucleotide
ccagcccccaggactctcacgaca

SEQ ID NO: 204443 - DNA, 25 bp, Artificial Sequence
  Description of Artificial Sequence: Synthetic oligonucleotide
cagcccccaggactctcacgacact

SEQ ID NO: 204444 - DNA, 26 bp, Artificial Sequence
  Description of Artificial Sequence: Synthetic oligonucleotide
agcccccaggactctcacgacactca

SEQ ID NO: 204445 - DNA, 25 bp, Artificial Sequence
  Description of Artificial Sequence: Synthetic oligonucleotide
gcccccaggactctcacgacactca

SEQ ID NO: 204446 - DNA, 26 bp, Artificial Sequence
  Description of Artificial Sequence: Synthetic oligonucleotide
cccccaggactctcacgacactcaca

SEQ ID NO: 204447 - DNA, 26 bp, Artificial Sequence
  Description of Artificial Sequence: Synthetic oligonucleotide
ccccaggactctcacgacactcacag

SEQ ID NO: 204448 - DNA, 26 bp, Artificial Sequence
  Description of Artificial Sequence: Synthetic oligonucleotide
cccaggactctcacgacactcacagc

SEQ ID NO: 204449 - DNA, 26 bp, Artificial Sequence
  Description of Artificial Sequence: Synthetic oligonucleotide
ccaggactctcacgacactcacagcc

SEQ ID NO: 204450 - DNA, 27 bp, Artificial Sequence
  Description of Artificial Sequence: Synthetic oligonucleotide
caggactctcacgacactcacagccct

SEQ ID NO: 204451 - DNA, 27 bp, Artificial Sequence
  Description of Artificial Sequence: Synthetic oligonucleotide
aggactctcacgacactcacagccctc

SEQ ID NO: 204452 - DNA, 26 bp, Artificial Sequence
  Description of Artificial Sequence: Synthetic oligonucleotide
ggactctcacgacactcacagccctc

SEQ ID NO: 204453 - DNA, 27 bp, Artificial Sequence
  Description of Artificial Sequence: Synthetic oligonucleotide
gactctcacgacactcacagccctcca

SEQ ID NO: 204454 - DNA, 27 bp, Artificial Sequence
  Description of Artificial Sequence: Synthetic oligonucleotide
actctcacgacactcacagccctccac

SEQ ID NO: 204455 - DNA, 27 bp, Artificial Sequence
  Description of Artificial Sequence: Synthetic oligonucleotide
ctctcacgacactcacagccctccaca

SEQ ID NO: 204456 - DNA, 27 bp, Artificial Sequence
  Description of Artificial Sequence: Synthetic oligonucleotide
tctcacgacactcacagccctccacac

SEQ ID NO: 204457 - DNA, 26 bp, Artificial Sequence
  Description of Artificial Sequence: Synthetic oligonucleotide
ctcacgacactcacagccctccacac

SEQ ID NO: 204458 - DNA, 27 bp, Artificial Sequence
  Description of Artificial Sequence: Synthetic oligonucleotide
tcacgacactcacagccctccacacct

SEQ ID NO: 204459 - DNA, 26 bp, Artificial Sequence
  Description of Artificial Sequence: Synthetic oligonucleotide
cacgacactcacagccctccacacct

SEQ ID NO: 204460 - DNA, 26 bp, Artificial Sequence
  Description of Artificial Sequence: Synthetic oligonucleotide
acgacactcacagccctccacacctc

SEQ ID NO: 204461 - DNA, 25 bp, Artificial Sequence
  Description of Artificial Sequence: Synthetic oligonucleotide
cgacactcacagccctccacacctc

SEQ ID NO: 204462 - DNA, 25 bp, Artificial Sequence
  Description of Artificial Sequence: Synthetic oligonucleotide
gacactcacagccctccacacctcc

SEQ ID NO: 204463 - DNA, 26 bp, Artificial Sequence
  Description of Artificial Sequence: Synthetic oligonucleotide
acactcacagccctccacacctccga

SEQ ID NO: 204464 - DNA, 25 bp, Artificial Sequence
  Description of Artificial Sequence: Synthetic oligonucleotide
cactcacagccctccacacctccga

SEQ ID NO: 204465 - DNA, 26 bp, Artificial Sequence
  Description of Artificial Sequence: Synthetic oligonucleotide
actcacagccctccacacctccgagt

SEQ ID NO: 204466 - DNA, 25 bp, Artificial Sequence
  Description of Artificial Sequence: Synthetic oligonucleotide
ctcacagccctccacacctccgagt

SEQ ID NO: 204467 - DNA, 25 bp, Artificial Sequence
  Description of Artificial Sequence: Synthetic oligonucleotide
tcacagccctccacacctccgagtc

SEQ ID NO: 204468 - DNA, 24 bp, Artificial Sequence
  Description of Artificial Sequence: Synthetic oligonucleotide
cacagccctccacacctccgagtc

SEQ ID NO: 204469 - DNA, 25 bp, Artificial Sequence
  Description of Artificial Sequence: Synthetic oligonucleotide
acagccctccacacctccgagtcca

SEQ ID NO: 204470 - DNA, 24 bp, Artificial Sequence
  Description of Artificial Sequence: Synthetic oligonucleotide
cagccctccacacctccgagtcca

SEQ ID NO: 204471 - DNA, 24 bp, Artificial Sequence
  Description of Artificial Sequence: Synthetic oligonucleotide
agccctccacacctccgagtccac

SEQ ID NO: 204472 - DNA, 23 bp, Artificial Sequence
  Description of Artificial Sequence: Synthetic oligonucleotide
gccctccacacctccgagtccac

SEQ ID NO: 204473 - DNA, 23 bp, Artificial Sequence
  Description of Artificial Sequence: Synthetic oligonucleotide
ccctccacacctccgagtccacg

SEQ ID NO: 204474 - DNA, 23 bp, Artificial Sequence
  Description of Artificial Sequence: Synthetic oligonucleotide
cctccacacctccgagtccacgg

SEQ ID NO: 204475 - DNA, 23 bp, Artificial Sequence
  Description of Artificial Sequence: Synthetic oligonucleotide
ctccacacctccgagtccacggg

SEQ ID NO: 204476 - DNA, 23 bp, Artificial Sequence
  Description of Artificial Sequence: Synthetic oligonucleotide
tccacacctccgagtccacgggc

SEQ ID NO: 204477 - DNA, 22 bp, Artificial Sequence
  Description of Artificial Sequence: Synthetic oligonucleotide
ccacacctccgagtccacgggc

SEQ ID NO: 204478 - DNA, 22 bp, Artificial Sequence
  Description of Artificial Sequence: Synthetic oligonucleotide
cacacctccgagtccacgggcc

SEQ ID NO: 204479 - DNA, 22 bp, Artificial Sequence
  Description of Artificial Sequence: Synthetic oligonucleotide
acacctccgagtccacgggccc

SEQ ID NO: 204480 - DNA, 21 bp, Artificial Sequence
  Description of Artificial Sequence: Synthetic oligonucleotide
cacctccgagtccacgggccc

SEQ ID NO: 204481 - DNA, 22 bp, Artificial Sequence
  Description of Artificial Sequence: Synthetic oligonucleotide
acctccgagtccacgggcccct

SEQ ID NO: 204482 - DNA, 21 bp, Artificial Sequence
  Description of Artificial Sequence: Synthetic oligonucleotide
cctccgagtccacgggcccct

SEQ ID NO: 204483 - DNA, 22 bp, Artificial Sequence
  Description of Artificial Sequence: Synthetic oligonucleotide
ctccgagtccacgggcccctca

SEQ ID NO: 204484 - DNA, 22 bp, Artificial Sequence
  Description of Artificial Sequence: Synthetic oligonucleotide
tccgagtccacgggcccctcag

SEQ ID NO: 204485 - DNA, 21 bp, Artificial Sequence
  Description of Artificial Sequence: Synthetic oligonucleotide
ccgagtccacgggcccctcag

SEQ ID NO: 204486 - DNA, 22 bp, Artificial Sequence
  Description of Artificial Sequence: Synthetic oligonucleotide
cgagtccacgggcccctcagca

SEQ ID NO: 204487 - DNA, 22 bp, Artificial Sequence
  Description of Artificial Sequence: Synthetic oligonucleotide
gagtccacgggcccctcagcag

SEQ ID NO: 204488 - DNA, 23 bp, Artificial Sequence
  Description of Artificial Sequence: Synthetic oligonucleotide
agtccacgggcccctcagcagca

SEQ ID NO: 204489 - DNA, 22 bp, Artificial Sequence
  Description of Artificial Sequence: Synthetic oligonucleotide
gtccacgggcccctcagcagca

SEQ ID NO: 204490 - DNA, 22 bp, Artificial Sequence
  Description of Artificial Sequence: Synthetic oligonucleotide
tccacgggcccctcagcagcac

SEQ ID NO: 204491 - DNA, 21 bp, Artificial Sequence
  Description of Artificial Sequence: Synthetic oligonucleotide
ccacgggcccctcagcagcac

SEQ ID NO: 204492 - DNA, 21 bp, Artificial Sequence
  Description of Artificial Sequence: Synthetic oligonucleotide
cacgggcccctcagcagcacc

SEQ ID NO: 204493 - DNA, 21 bp, Artificial Sequence
  Description of Artificial Sequence: Synthetic oligonucleotide
acgggcccctcagcagcaccc

SEQ ID NO: 204494 - DNA, 20 bp, Artificial Sequence
  Description of Artificial Sequence: Synthetic oligonucleotide
cgggcccctcagcagcaccc

SEQ ID NO: 204495 - DNA, 21 bp, Artificial Sequence
  Description of Artificial Sequence: Synthetic oligonucleotide
gggcccctcagcagcacccca

SEQ ID NO: 204496 - DNA, 21 bp, Artificial Sequence
  Description of Artificial Sequence: Synthetic oligonucleotide
ggcccctcagcagcaccccag

SEQ ID NO: 204497 - DNA, 21 bp, Artificial Sequence
  Description of Artificial Sequence: Synthetic oligonucleotide
gcccctcagcagcaccccagc

SEQ ID NO: 204498 - DNA, 24 bp, Artificial Sequence
  Description of Artificial Sequence: Synthetic oligonucleotide
cccctcagcagcaccccagccttt

SEQ ID NO: 204499 - DNA, 24 bp, Artificial Sequence
  Description of Artificial Sequence: Synthetic oligonucleotide
ccctcagcagcaccccagcctttg

SEQ ID NO: 204500 - DNA, 24 bp, Artificial Sequence
  Description of Artificial Sequence: Synthetic oligonucleotide
cctcagcagcaccccagcctttgc

SEQ ID NO: 204501 - DNA, 25 bp, Artificial Sequence
  Description of Artificial Sequence: Synthetic oligonucleotide
ctcagcagcaccccagcctttgcca

SEQ ID NO: 204502 - DNA, 25 bp, Artificial Sequence
  Description of Artificial Sequence: Synthetic oligonucleotide
tcagcagcaccccagcctttgccag

SEQ ID NO: 204503 - DNA, 24 bp, Artificial Sequence
  Description of Artificial Sequence: Synthetic oligonucleotide
cagcagcaccccagcctttgccag

SEQ ID NO: 204504 - DNA, 27 bp, Artificial Sequence
  Description of Artificial Sequence: Synthetic oligonucleotide
agcagcaccccagcctttgccaggtat

SEQ ID NO: 204505 - DNA, 27 bp, Artificial Sequence
  Description of Artificial Sequence: Synthetic oligonucleotide
gcagcaccccagcctttgccaggtatt

SEQ ID NO: 204506 - DNA, 28 bp, Artificial Sequence
  Description of Artificial Sequence: Synthetic oligonucleotide
cagcaccccagcctttgccaggtatttc

SEQ ID NO: 204507 - DNA, 28 bp, Artificial Sequence
  Description of Artificial Sequence: Synthetic oligonucleotide
agcaccccagcctttgccaggtatttcc

SEQ ID NO: 204508 - DNA, 27 bp, Artificial Sequence
  Description of Artificial Sequence: Synthetic oligonucleotide
gcaccccagcctttgccaggtatttcc

SEQ ID NO: 204509 - DNA, 27 bp, Artificial Sequence
  Description of Artificial Sequence: Synthetic oligonucleotide
caccccagcctttgccaggtatttccg

SEQ ID NO: 204510 - DNA, 27 bp, Artificial Sequence
  Description of Artificial Sequence: Synthetic oligonucleotide
accccagcctttgccaggtatttccgc

SEQ ID NO: 204511 - DNA, 27 bp, Artificial Sequence
  Description of Artificial Sequence: Synthetic oligonucleotide
ccccagcctttgccaggtatttccgct

SEQ ID NO: 204512 - DNA, 27 bp, Artificial Sequence
  Description of Artificial Sequence: Synthetic oligonucleotide
cccagcctttgccaggtatttccgctg

SEQ ID NO: 204513 - DNA, 28 bp, Artificial Sequence
  Description of Artificial Sequence: Synthetic oligonucleotide
ccagcctttgccaggtatttccgctgtg

SEQ ID NO: 204514 - DNA, 28 bp, Artificial Sequence
  Description of Artificial Sequence: Synthetic oligonucleotide
cagcctttgccaggtatttccgctgtgc

SEQ ID NO: 204515 - DNA, 29 bp, Artificial Sequence
  Description of Artificial Sequence: Synthetic oligonucleotide
agcctttgccaggtatttccgctgtgcac

SEQ ID NO: 204516 - DNA, 28 bp, Artificial Sequence
  Description of Artificial Sequence: Synthetic oligonucleotide
gcctttgccaggtatttccgctgtgcac

SEQ ID NO: 204517 - DNA, 28 bp, Artificial Sequence
  Description of Artificial Sequence: Synthetic oligonucleotide
cctttgccaggtatttccgctgtgcacg

SEQ ID NO: 204518 - DNA, 29 bp, Artificial Sequence
  Description of Artificial Sequence: Synthetic oligonucleotide
ctttgccaggtatttccgctgtgcacgtg

SEQ ID NO: 204519 - DNA, 29 bp, Artificial Sequence
  Description of Artificial Sequence: Synthetic oligonucleotide
tttgccaggtatttccgctgtgcacgtgg

SEQ ID NO: 204520 - DNA, 28 bp, Artificial Sequence
  Description of Artificial Sequence: Synthetic oligonucleotide
ttgccaggtatttccgctgtgcacgtgg

SEQ ID NO: 204521 - DNA, 27 bp, Artificial Sequence
  Description of Artificial Sequence: Synthetic oligonucleotide
tgccaggtatttccgctgtgcacgtgg

SEQ ID NO: 204522 - DNA, 27 bp, Artificial Sequence
  Description of Artificial Sequence: Synthetic oligonucleotide
gccaggtatttccgctgtgcacgtggt

SEQ ID NO: 204523 - DNA, 27 bp, Artificial Sequence
  Description of Artificial Sequence: Synthetic oligonucleotide
ccaggtatttccgctgtgcacgtggtg

SEQ ID NO: 204524 - DNA, 27 bp, Artificial Sequence
  Description of Artificial Sequence: Synthetic oligonucleotide
caggtatttccgctgtgcacgtggtgc

SEQ ID NO: 204525 - DNA, 28 bp, Artificial Sequence
  Description of Artificial Sequence: Synthetic oligonucleotide
aggtatttccgctgtgcacgtggtgctc

SEQ ID NO: 204526 - DNA, 27 bp, Artificial Sequence
  Description of Artificial Sequence: Synthetic oligonucleotide
ggtatttccgctgtgcacgtggtgctc

SEQ ID NO: 204527 - DNA, 28 bp, Artificial Sequence
  Description of Artificial Sequence: Synthetic oligonucleotide
gtatttccgctgtgcacgtggtgctctc

SEQ ID NO: 204528 - DNA, 30 bp, Artificial Sequence
  Description of Artificial Sequence: Synthetic oligonucleotide
tatttccgctgtgcacgtggtgctctcttg

SEQ ID NO: 204529 - DNA, 29 bp, Artificial Sequence
  Description of Artificial Sequence: Synthetic oligonucleotide
atttccgctgtgcacgtggtgctctcttg

SEQ ID NO: 204530 - DNA, 28 bp, Artificial Sequence
  Description of Artificial Sequence: Synthetic oligonucleotide
tttccgctgtgcacgtggtgctctcttg

SEQ ID NO: 204531 - DNA, 27 bp, Artificial Sequence
  Description of Artificial Sequence: Synthetic oligonucleotide
ttccgctgtgcacgtggtgctctcttg

SEQ ID NO: 204532 - DNA, 27 bp, Artificial Sequence
  Description of Artificial Sequence: Synthetic oligonucleotide
tccgctgtgcacgtggtgctctcttga

SEQ ID NO: 204533 - DNA, 27 bp, Artificial Sequence
  Description of Artificial Sequence: Synthetic oligonucleotide
ccgctgtgcacgtggtgctctcttgaa

SEQ ID NO: 204534 - DNA, 27 bp, Artificial Sequence
  Description of Artificial Sequence: Synthetic oligonucleotide
cgctgtgcacgtggtgctctcttgaac

SEQ ID NO: 204535 - DNA, 27 bp, Artificial Sequence
  Description of Artificial Sequence: Synthetic oligonucleotide
gctgtgcacgtggtgctctcttgaacc

SEQ ID NO: 204536 - DNA, 27 bp, Artificial Sequence
  Description of Artificial Sequence: Synthetic oligonucleotide
ctgtgcacgtggtgctctcttgaaccc

SEQ ID NO: 204537 - DNA, 27 bp, Artificial Sequence
  Description of Artificial Sequence: Synthetic oligonucleotide
tgtgcacgtggtgctctcttgaacccc

SEQ ID NO: 204538 - DNA, 27 bp, Artificial Sequence
  Description of Artificial Sequence: Synthetic oligonucleotide
gtgcacgtggtgctctcttgaacccct

SEQ ID NO: 204539 - DNA, 27 bp, Artificial Sequence
  Description of Artificial Sequence: Synthetic oligonucleotide
tgcacgtggtgctctcttgaacccctc

SEQ ID NO: 204540 - DNA, 26 bp, Artificial Sequence
  Description of Artificial Sequence: Synthetic oligonucleotide
gcacgtggtgctctcttgaacccctc

SEQ ID NO: 204541 - DNA, 27 bp, Artificial Sequence
  Description of Artificial Sequence: Synthetic oligonucleotide
cacgtggtgctctcttgaacccctcca

SEQ ID NO: 204542 - DNA, 27 bp, Artificial Sequence
  Description of Artificial Sequence: Synthetic oligonucleotide
acgtggtgctctcttgaacccctccag

SEQ ID NO: 204543 - DNA, 26 bp, Artificial Sequence
  Description of Artificial Sequence: Synthetic oligonucleotide
cgtggtgctctcttgaacccctccag

SEQ ID NO: 204544 - DNA, 26 bp, Artificial Sequence
  Description of Artificial Sequence: Synthetic oligonucleotide
gtggtgctctcttgaacccctccagc

SEQ ID NO: 204545 - DNA, 26 bp, Artificial Sequence
  Description of Artificial Sequence: Synthetic oligonucleotide
tggtgctctcttgaacccctccagcc

SEQ ID NO: 204546 - DNA, 25 bp, Artificial Sequence
  Description of Artificial Sequence: Synthetic oligonucleotide
ggtgctctcttgaacccctccagcc

SEQ ID NO: 204547 - DNA, 25 bp, Artificial Sequence
  Description of Artificial Sequence: Synthetic oligonucleotide
gtgctctcttgaacccctccagccg

SEQ ID NO: 204548 - DNA, 26 bp, Artificial Sequence
  Description of Artificial Sequence: Synthetic oligonucleotide
tgctctcttgaacccctccagccgct

SEQ ID NO: 204549 - DNA, 25 bp, Artificial Sequence
  Description of Artificial Sequence: Synthetic oligonucleotide
gctctcttgaacccctccagccgct

SEQ ID NO: 204550 - DNA, 25 bp, Artificial Sequence
  Description of Artificial Sequence: Synthetic oligonucleotide
ctctcttgaacccctccagccgctg

SEQ ID NO: 204551 - DNA, 25 bp, Artificial Sequence
  Description of Artificial Sequence: Synthetic oligonucleotide
tctcttgaacccctccagccgctgc

SEQ ID NO: 204552 - DNA, 24 bp, Artificial Sequence
  Description of Artificial Sequence: Synthetic oligonucleotide
ctcttgaacccctccagccgctgc

SEQ ID NO: 204553 - DNA, 25 bp, Artificial Sequence
  Description of Artificial Sequence: Synthetic oligonucleotide
tcttgaacccctccagccgctgcca

SEQ ID NO: 204554 - DNA, 24 bp, Artificial Sequence
  Description of Artificial Sequence: Synthetic oligonucleotide
cttgaacccctccagccgctgcca

SEQ ID NO: 204555 - DNA, 24 bp, Artificial Sequence
  Description of Artificial Sequence: Synthetic oligonucleotide
ttgaacccctccagccgctgccag

SEQ ID NO: 204556 - DNA, 23 bp, Artificial Sequence
  Description of Artificial Sequence: Synthetic oligonucleotide
tgaacccctccagccgctgccag

SEQ ID NO: 204557 - DNA, 22 bp, Artificial Sequence
  Description of Artificial Sequence: Synthetic oligonucleotide
gaacccctccagccgctgccag

SEQ ID NO: 204558 - DNA, 23 bp, Artificial Sequence
  Description of Artificial Sequence: Synthetic oligonucleotide
aacccctccagccgctgccagct

SEQ ID NO: 204559 - DNA, 22 bp, Artificial Sequence
  Description of Artificial Sequence: Synthetic oligonucleotide
acccctccagccgctgccagct

SEQ ID NO: 204560 - DNA, 21 bp, Artificial Sequence
  Description of Artificial Sequence: Synthetic oligonucleotide
cccctccagccgctgccagct

SEQ ID NO: 204561 - DNA, 22 bp, Artificial Sequence
  Description of Artificial Sequence: Synthetic oligonucleotide
ccctccagccgctgccagctct

SEQ ID NO: 204562 - DNA, 22 bp, Artificial Sequence
  Description of Artificial Sequence: Synthetic oligonucleotide
cctccagccgctgccagctctg

SEQ ID NO: 204563 - DNA, 25 bp, Artificial Sequence
  Description of Artificial Sequence: Synthetic oligonucleotide
ctccagccgctgccagctctggtaa

SEQ ID NO: 204564 - DNA, 24 bp, Artificial Sequence
  Description of Artificial Sequence: Synthetic oligonucleotide
aaccacccatgcctgcccgcccat

SEQ ID NO: 204565 - DNA, 23 bp, Artificial Sequence
  Description of Artificial Sequence: Synthetic oligonucleotide
accacccatgcctgcccgcccat

SEQ ID NO: 204566 - DNA, 22 bp, Artificial Sequence
  Description of Artificial Sequence: Synthetic oligonucleotide
ccacccatgcctgcccgcccat

SEQ ID NO: 204567 - DNA, 24 bp, Artificial Sequence
  Description of Artificial Sequence: Synthetic oligonucleotide
cacccatgcctgcccgcccatgat

SEQ ID NO: 204568 - DNA, 24 bp, Artificial Sequence
  Description of Artificial Sequence: Synthetic oligonucleotide
acccatgcctgcccgcccatgatg

SEQ ID NO: 204569 - DNA, 23 bp, Artificial Sequence
  Description of Artificial Sequence: Synthetic oligonucleotide
cccatgcctgcccgcccatgatg

SEQ ID NO: 204570 - DNA, 25 bp, Artificial Sequence
  Description of Artificial Sequence: Synthetic oligonucleotide
ccatgcctgcccgcccatgatggat

SEQ ID NO: 204571 - DNA, 27 bp, Artificial Sequence
  Description of Artificial Sequence: Synthetic oligonucleotide
catgcctgcccgcccatgatggatgaa

SEQ ID NO: 204572 - DNA, 27 bp, Artificial Sequence
  Description of Artificial Sequence: Synthetic oligonucleotide
atgcctgcccgcccatgatggatgaag

SEQ ID NO: 204573 - DNA, 27 bp, Artificial Sequence
  Description of Artificial Sequence: Synthetic oligonucleotide
tgcctgcccgcccatgatggatgaagt

SEQ ID NO: 204574 - DNA, 26 bp, Artificial Sequence
  Description of Artificial Sequence: Synthetic oligonucleotide
gcctgcccgcccatgatggatgaagt

SEQ ID NO: 204575 - DNA, 26 bp, Artificial Sequence
  Description of Artificial Sequence: Synthetic oligonucleotide
cctgcccgcccatgatggatgaagtg

SEQ ID NO: 204576 - DNA, 26 bp, Artificial Sequence
  Description of Artificial Sequence: Synthetic oligonucleotide
ctgcccgcccatgatggatgaagtgc

SEQ ID NO: 204577 - DNA, 27 bp, Artificial Sequence
  Description of Artificial Sequence: Synthetic oligonucleotide
tgcccgcccatgatggatgaagtgcgt

SEQ ID NO: 204578 - DNA, 26 bp, Artificial Sequence
  Description of Artificial Sequence: Synthetic oligonucleotide
gcccgcccatgatggatgaagtgcgt

SEQ ID NO: 204579 - DNA, 26 bp, Artificial Sequence
  Description of Artificial Sequence: Synthetic oligonucleotide
cccgcccatgatggatgaagtgcgtg

SEQ ID NO: 204580 - DNA, 27 bp, Artificial Sequence
  Description of Artificial Sequence: Synthetic oligonucleotide
ccgcccatgatggatgaagtgcgtgga

SEQ ID NO: 204581 - DNA, 27 bp, Artificial Sequence
  Description of Artificial Sequence: Synthetic oligonucleotide
cgcccatgatggatgaagtgcgtggag

SEQ ID NO: 204582 - DNA, 27 bp, Artificial Sequence
  Description of Artificial Sequence: Synthetic oligonucleotide
gcccatgatggatgaagtgcgtggagg

SEQ ID NO: 204583 - DNA, 28 bp, Artificial Sequence
  Description of Artificial Sequence: Synthetic oligonucleotide
cccatgatggatgaagtgcgtggaggag

SEQ ID NO: 204584 - DNA, 29 bp, Artificial Sequence
  Description of Artificial Sequence: Synthetic oligonucleotide
ccatgatggatgaagtgcgtggaggagac

SEQ ID NO: 204585 - DNA, 30 bp, Artificial Sequence
  Description of Artificial Sequence: Synthetic oligonucleotide
catgatggatgaagtgcgtggaggagacag

SEQ ID NO: 204586 - DNA, 30 bp, Artificial Sequence
  Description of Artificial Sequence: Synthetic oligonucleotide
atgatggatgaagtgcgtggaggagacagg

SEQ ID NO: 204587 - DNA, 29 bp, Artificial Sequence
  Description of Artificial Sequence: Synthetic oligonucleotide
tgatggatgaagtgcgtggaggagacagg

SEQ ID NO: 204588 - DNA, 29 bp, Artificial Sequence
  Description of Artificial Sequence: Synthetic oligonucleotide
tggctatcccagagccgtgaactttggtg

SEQ ID NO: 204589 - DNA, 28 bp, Artificial Sequence
  Description of Artificial Sequence: Synthetic oligonucleotide
ggctatcccagagccgtgaactttggtg

SEQ ID NO: 204590 - DNA, 28 bp, Artificial Sequence
  Description of Artificial Sequence: Synthetic oligonucleotide
gctatcccagagccgtgaactttggtgc

SEQ ID NO: 204591 - DNA, 29 bp, Artificial Sequence
  Description of Artificial Sequence: Synthetic oligonucleotide
ctatcccagagccgtgaactttggtgctg

SEQ ID NO: 204592 - DNA, 29 bp, Artificial Sequence
  Description of Artificial Sequence: Synthetic oligonucleotide
tatcccagagccgtgaactttggtgctgc

SEQ ID NO: 204593 - DNA, 28 bp, Artificial Sequence
  Description of Artificial Sequence: Synthetic oligonucleotide
atcccagagccgtgaactttggtgctgc

SEQ ID NO: 204594 - DNA, 27 bp, Artificial Sequence
  Description of Artificial Sequence: Synthetic oligonucleotide
tcccagagccgtgaactttggtgctgc

SEQ ID NO: 204595 - DNA, 27 bp, Artificial Sequence
  Description of Artificial Sequence: Synthetic oligonucleotide
cccagagccgtgaactttggtgctgct

SEQ ID NO: 204596 - DNA, 27 bp, Artificial Sequence
  Description of Artificial Sequence: Synthetic oligonucleotide
ccagagccgtgaactttggtgctgctg

SEQ ID NO: 204597 - DNA, 27 bp, Artificial Sequence
  Description of Artificial Sequence: Synthetic oligonucleotide
cagagccgtgaactttggtgctgctgg

SEQ ID NO: 204598 - DNA, 27 bp, Artificial Sequence
  Description of Artificial Sequence: Synthetic oligonucleotide
agagccgtgaactttggtgctgctggc

SEQ ID NO: 204599 - DNA, 27 bp, Artificial Sequence
  Description of Artificial Sequence: Synthetic oligonucleotide
gagccgtgaactttggtgctgctggca

SEQ ID NO: 204600 - DNA, 27 bp, Artificial Sequence
  Description of Artificial Sequence: Synthetic oligonucleotide
agccgtgaactttggtgctgctggcag

SEQ ID NO: 204601 - DNA, 26 bp, Artificial Sequence
  Description of Artificial Sequence: Synthetic oligonucleotide
gccgtgaactttggtgctgctggcag

SEQ ID NO: 204602 - DNA, 27 bp, Artificial Sequence
  Description of Artificial Sequence: Synthetic oligonucleotide
ccgtgaactttggtgctgctggcagca

SEQ ID NO: 204603 - DNA, 28 bp, Artificial Sequence
  Description of Artificial Sequence: Synthetic oligonucleotide
cgtgaactttggtgctgctggcagcatc

SEQ ID NO: 204604 - DNA, 30 bp, Artificial Sequence
  Description of Artificial Sequence: Synthetic oligonucleotide
gtgaactttggtgctgctggcagcatcatg

SEQ ID NO: 204605 - DNA, 30 bp, Artificial Sequence
  Description of Artificial Sequence: Synthetic oligonucleotide
tgaactttggtgctgctggcagcatcatgg

SEQ ID NO: 204606 - DNA, 29 bp, Artificial Sequence
  Description of Artificial Sequence: Synthetic oligonucleotide
gaactttggtgctgctggcagcatcatgg

SEQ ID NO: 204607 - DNA, 29 bp, Artificial Sequence
  Description of Artificial Sequence: Synthetic oligonucleotide
aactttggtgctgctggcagcatcatggc

SEQ ID NO: 204608 - DNA, 28 bp, Artificial Sequence
  Description of Artificial Sequence: Synthetic oligonucleotide
actttggtgctgctggcagcatcatggc

SEQ ID NO: 204609 - DNA, 27 bp, Artificial Sequence
  Description of Artificial Sequence: Synthetic oligonucleotide
ctttggtgctgctggcagcatcatggc

SEQ ID NO: 204610 - DNA, 27 bp, Artificial Sequence
  Description of Artificial Sequence: Synthetic oligonucleotide
tttggtgctgctggcagcatcatggcc

SEQ ID NO: 204611 - DNA, 26 bp, Artificial Sequence
  Description of Artificial Sequence: Synthetic oligonucleotide
ttggtgctgctggcagcatcatggcc

SEQ ID NO: 204612 - DNA, 25 bp, Artificial Sequence
  Description of Artificial Sequence: Synthetic oligonucleotide
tggtgctgctggcagcatcatggcc

SEQ ID NO: 204613 - DNA, 24 bp, Artificial Sequence
  Description of Artificial Sequence: Synthetic oligonucleotide
ggtgctgctggcagcatcatggcc

SEQ ID NO: 204614 - DNA, 25 bp, Artificial Sequence
  Description of Artificial Sequence: Synthetic oligonucleotide
gtgctgctggcagcatcatggccca

SEQ ID NO: 204615 - DNA, 25 bp, Artificial Sequence
  Description of Artificial Sequence: Synthetic oligonucleotide
tgctgctggcagcatcatggcccac

SEQ ID NO: 204616 - DNA, 29 bp, Artificial Sequence
  Description of Artificial Sequence: Synthetic oligonucleotide
agcccccagcagatcttctttcgaagctg

SEQ ID NO: 204617 - DNA, 28 bp, Artificial Sequence
  Description of Artificial Sequence: Synthetic oligonucleotide
gcccccagcagatcttctttcgaagctg

SEQ ID NO: 204618 - DNA, 29 bp, Artificial Sequence
  Description of Artificial Sequence: Synthetic oligonucleotide
cccccagcagatcttctttcgaagctgtg

SEQ ID NO: 204619 - DNA, 29 bp, Artificial Sequence
  Description of Artificial Sequence: Synthetic oligonucleotide
ccccagcagatcttctttcgaagctgtgc

SEQ ID NO: 204620 - DNA, 29 bp, Artificial Sequence
  Description of Artificial Sequence: Synthetic oligonucleotide
cccagcagatcttctttcgaagctgtgcc

SEQ ID NO: 204621 - DNA, 29 bp, Artificial Sequence
  Description of Artificial Sequence: Synthetic oligonucleotide
ccagcagatcttctttcgaagctgtgccc

SEQ ID NO: 204622 - DNA, 30 bp, Artificial Sequence
  Description of Artificial Sequence: Synthetic oligonucleotide
cagcagatcttctttcgaagctgtgcccag

SEQ ID NO: 204623 - DNA, 30 bp, Artificial Sequence
  Description of Artificial Sequence: Synthetic oligonucleotide
agcagatcttctttcgaagctgtgcccagg

SEQ ID NO: 204624 - DNA, 29 bp, Artificial Sequence
  Description of Artificial Sequence: Synthetic oligonucleotide
gcagatcttctttcgaagctgtgcccagg

SEQ ID NO: 204625 - DNA, 30 bp, Artificial Sequence
  Description of Artificial Sequence: Synthetic oligonucleotide
cagatcttctttcgaagctgtgcccaggtg

SEQ ID NO: 204626 - DNA, 32 bp, Artificial Sequence
  Description of Artificial Sequence: Synthetic oligonucleotide
agatcttctttcgaagctgtgcccaggtgatg

SEQ ID NO: 204627 - DNA, 31 bp, Artificial Sequence
  Description of Artificial Sequence: Synthetic oligonucleotide
gatcttctttcgaagctgtgcccaggtgatg

SEQ ID NO: 204628 - DNA, 32 bp, Artificial Sequence
  Description of Artificial Sequence: Synthetic oligonucleotide
atcttctttcgaagctgtgcccaggtgatgtg

SEQ ID NO: 204629 - DNA, 31 bp, Artificial Sequence
  Description of Artificial Sequence: Synthetic oligonucleotide
tcttctttcgaagctgtgcccaggtgatgtg

SEQ ID NO: 204630 - DNA, 30 bp, Artificial Sequence
  Description of Artificial Sequence: Synthetic oligonucleotide
cttctttcgaagctgtgcccaggtgatgtg

SEQ ID NO: 204631 - DNA, 32 bp, Artificial Sequence
  Description of Artificial Sequence: Synthetic oligonucleotide
ttctttcgaagctgtgcccaggtgatgtgtag

SEQ ID NO: 204632 - DNA, 31 bp, Artificial Sequence
  Description of Artificial Sequence: Synthetic oligonucleotide
tctttcgaagctgtgcccaggtgatgtgtag

SEQ ID NO: 204633 - DNA, 30 bp, Artificial Sequence
  Description of Artificial Sequence: Synthetic oligonucleotide
ctttcgaagctgtgcccaggtgatgtgtag

SEQ ID NO: 204634 - DNA, 30 bp, Artificial Sequence
  Description of Artificial Sequence: Synthetic oligonucleotide
tttcgaagctgtgcccaggtgatgtgtagg

SEQ ID NO: 204635 - DNA, 29 bp, Artificial Sequence
  Description of Artificial Sequence: Synthetic oligonucleotide
ttcgaagctgtgcccaggtgatgtgtagg

SEQ ID NO: 204636 - DNA, 28 bp, Artificial Sequence
  Description of Artificial Sequence: Synthetic oligonucleotide
tcgaagctgtgcccaggtgatgtgtagg

SEQ ID NO: 204637 - DNA, 27 bp, Artificial Sequence
  Description of Artificial Sequence: Synthetic oligonucleotide
cgaagctgtgcccaggtgatgtgtagg

SEQ ID NO: 204638 - DNA, 29 bp, Artificial Sequence
  Description of Artificial Sequence: Synthetic oligonucleotide
gaagctgtgcccaggtgatgtgtaggaag

SEQ ID NO: 204639 - DNA, 29 bp, Artificial Sequence
  Description of Artificial Sequence: Synthetic oligonucleotide
aagctgtgcccaggtgatgtgtaggaagc

SEQ ID NO: 204640 - DNA, 28 bp, Artificial Sequence
  Description of Artificial Sequence: Synthetic oligonucleotide
agctgtgcccaggtgatgtgtaggaagc

SEQ ID NO: 204641 - DNA, 27 bp, Artificial Sequence
  Description of Artificial Sequence: Synthetic oligonucleotide
gctgtgcccaggtgatgtgtaggaagc

SEQ ID NO: 204642 - DNA, 27 bp, Artificial Sequence
  Description of Artificial Sequence: Synthetic oligonucleotide
ctgtgcccaggtgatgtgtaggaagcc

SEQ ID NO: 204643 - DNA, 27 bp, Artificial Sequence
  Description of Artificial Sequence: Synthetic oligonucleotide
tgtgcccaggtgatgtgtaggaagccc

SEQ ID NO: 204644 - DNA, 27 bp, Artificial Sequence
  Description of Artificial Sequence: Synthetic oligonucleotide
gtgcccaggtgatgtgtaggaagccca

SEQ ID NO: 204645 - DNA, 29 bp, Artificial Sequence
  Description of Artificial Sequence: Synthetic oligonucleotide
gacctcagcccccagcagatcttcttttg

SEQ ID NO: 204646 - DNA, 31 bp, Artificial Sequence
  Description of Artificial Sequence: Synthetic oligonucleotide
acctcagcccccagcagatcttcttttgaag

SEQ ID NO: 204647 - DNA, 30 bp, Artificial Sequence
  Description of Artificial Sequence: Synthetic oligonucleotide
cctcagcccccagcagatcttcttttgaag

SEQ ID NO: 204648 - DNA, 30 bp, Artificial Sequence
  Description of Artificial Sequence: Synthetic oligonucleotide
ctcagcccccagcagatcttcttttgaagc

SEQ ID NO: 204649 - DNA, 33 bp, Artificial Sequence
  Description of Artificial Sequence: Synthetic oligonucleotide
tcagcccccagcagatcttcttttgaagctatg

SEQ ID NO: 204650 - DNA, 32 bp, Artificial Sequence
  Description of Artificial Sequence: Synthetic oligonucleotide
cagcccccagcagatcttcttttgaagctatg

SEQ ID NO: 204651 - DNA, 32 bp, Artificial Sequence
  Description of Artificial Sequence: Synthetic oligonucleotide
agcccccagcagatcttcttttgaagctatgc

SEQ ID NO: 204652 - DNA, 31 bp, Artificial Sequence
  Description of Artificial Sequence: Synthetic oligonucleotide
gcccccagcagatcttcttttgaagctatgc

SEQ ID NO: 204653 - DNA, 31 bp, Artificial Sequence
  Description of Artificial Sequence: Synthetic oligonucleotide
cccccagcagatcttcttttgaagctatgcc

SEQ ID NO: 204654 - DNA, 31 bp, Artificial Sequence
  Description of Artificial Sequence: Synthetic oligonucleotide
ccccagcagatcttcttttgaagctatgccc

SEQ ID NO: 204655 - DNA, 32 bp, Artificial Sequence
  Description of Artificial Sequence: Synthetic oligonucleotide
cccagcagatcttcttttgaagctatgcccag

SEQ ID NO: 204656 - DNA, 32 bp, Artificial Sequence
  Description of Artificial Sequence: Synthetic oligonucleotide
ccagcagatcttcttttgaagctatgcccagg

SEQ ID NO: 204657 - DNA, 33 bp, Artificial Sequence
  Description of Artificial Sequence: Synthetic oligonucleotide
cagcagatcttcttttgaagctatgcccaggtg

SEQ ID NO: 204658 - DNA, 35 bp, Artificial Sequence
  Description of Artificial Sequence: Synthetic oligonucleotide
agcagatcttcttttgaagctatgcccaggtgatg

SEQ ID NO: 204659 - DNA, 34 bp, Artificial Sequence
  Description of Artificial Sequence: Synthetic oligonucleotide
gcagatcttcttttgaagctatgcccaggtgatg

SEQ ID NO: 204660 - DNA, 35 bp, Artificial Sequence
  Description of Artificial Sequence: Synthetic oligonucleotide
cagatcttcttttgaagctatgcccaggtgatgtg

SEQ ID NO: 204661 - DNA, 37 bp, Artificial Sequence
  Description of Artificial Sequence: Synthetic oligonucleotide
agatcttcttttgaagctatgcccaggtgatgtgtag

SEQ ID NO: 204662 - DNA, 36 bp, Artificial Sequence
  Description of Artificial Sequence: Synthetic oligonucleotide
gatcttcttttgaagctatgcccaggtgatgtgtag

SEQ ID NO: 204663 - DNA, 36 bp, Artificial Sequence
  Description of Artificial Sequence: Synthetic oligonucleotide
atcttcttttgaagctatgcccaggtgatgtgtagg

SEQ ID NO: 204664 - DNA, 35 bp, Artificial Sequence
  Description of Artificial Sequence: Synthetic oligonucleotide
tcttcttttgaagctatgcccaggtgatgtgtagg

SEQ ID NO: 204665 - DNA, 34 bp, Artificial Sequence
  Description of Artificial Sequence: Synthetic oligonucleotide
cttcttttgaagctatgcccaggtgatgtgtagg

SEQ ID NO: 204666 - DNA, 36 bp, Artificial Sequence
  Description of Artificial Sequence: Synthetic oligonucleotide
ttcttttgaagctatgcccaggtgatgtgtaggaag

SEQ ID NO: 204667 - DNA, 35 bp, Artificial Sequence
  Description of Artificial Sequence: Synthetic oligonucleotide
tcttttgaagctatgcccaggtgatgtgtaggaag

SEQ ID NO: 204668 - DNA, 34 bp, Artificial Sequence
  Description of Artificial Sequence: Synthetic oligonucleotide
cttttgaagctatgcccaggtgatgtgtaggaag

SEQ ID NO: 204669 - DNA, 34 bp, Artificial Sequence
  Description of Artificial Sequence: Synthetic oligonucleotide
ttttgaagctatgcccaggtgatgtgtaggaagc

SEQ ID NO: 204670 - DNA, 33 bp, Artificial Sequence
  Description of Artificial Sequence: Synthetic oligonucleotide
tttgaagctatgcccaggtgatgtgtaggaagc

SEQ ID NO: 204671 - DNA, 32 bp, Artificial Sequence
  Description of Artificial Sequence: Synthetic oligonucleotide
ttgaagctatgcccaggtgatgtgtaggaagc

SEQ ID NO: 204672 - DNA, 31 bp, Artificial Sequence
  Description of Artificial Sequence: Synthetic oligonucleotide
tgaagctatgcccaggtgatgtgtaggaagc

SEQ ID NO: 204673 - DNA, 38 bp, Artificial Sequence
  Description of Artificial Sequence: Synthetic oligonucleotide
caagaacactcttccttgtcaatctccatcacttcatg

SEQ ID NO: 204674 - DNA, 38 bp, Artificial Sequence
  Description of Artificial Sequence: Synthetic oligonucleotide
aagaacactcttccttgtcaatctccatcacttcatgg

SEQ ID NO: 204675 - DNA, 37 bp, Artificial Sequence
  Description of Artificial Sequence: Synthetic oligonucleotide
agaacactcttccttgtcaatctccatcacttcatgg

SEQ ID NO: 204676 - DNA, 36 bp, Artificial Sequence
  Description of Artificial Sequence: Synthetic oligonucleotide
gaacactcttccttgtcaatctccatcacttcatgg

SEQ ID NO: 204677 - DNA, 36 bp, Artificial Sequence
  Description of Artificial Sequence: Synthetic oligonucleotide
aacactcttccttgtcaatctccatcacttcatggc

SEQ ID NO: 204678 - DNA, 35 bp, Artificial Sequence
  Description of Artificial Sequence: Synthetic oligonucleotide
acactcttccttgtcaatctccatcacttcatggc

SEQ ID NO: 204679 - DNA, 34 bp, Artificial Sequence
  Description of Artificial Sequence: Synthetic oligonucleotide
cactcttccttgtcaatctccatcacttcatggc

SEQ ID NO: 204680 - DNA, 35 bp, Artificial Sequence
  Description of Artificial Sequence: Synthetic oligonucleotide
actcttccttgtcaatctccatcacttcatggctg

SEQ ID NO: 204681 - DNA, 34 bp, Artificial Sequence
  Description of Artificial Sequence: Synthetic oligonucleotide
ctcttccttgtcaatctccatcacttcatggctg

SEQ ID NO: 204682 - DNA, 36 bp, Artificial Sequence
  Description of Artificial Sequence: Synthetic oligonucleotide
tcttccttgtcaatctccatcacttcatggctgttc

SEQ ID NO: 204683 - DNA, 35 bp, Artificial Sequence
  Description of Artificial Sequence: Synthetic oligonucleotide
cttccttgtcaatctccatcacttcatggctgttc

SEQ ID NO: 204684 - DNA, 35 bp, Artificial Sequence
  Description of Artificial Sequence: Synthetic oligonucleotide
ttccttgtcaatctccatcacttcatggctgttcc

SEQ ID NO: 204685 - DNA, 34 bp, Artificial Sequence
  Description of Artificial Sequence: Synthetic oligonucleotide
tccttgtcaatctccatcacttcatggctgttcc

SEQ ID NO: 204686 - DNA, 33 bp, Artificial Sequence
  Description of Artificial Sequence: Synthetic oligonucleotide
ccttgtcaatctccatcacttcatggctgttcc

SEQ ID NO: 204687 - DNA, 34 bp, Artificial Sequence
  Description of Artificial Sequence: Synthetic oligonucleotide
cttgtcaatctccatcacttcatggctgttccag

SEQ ID NO: 204688 - DNA, 37 bp, Artificial Sequence
  Description of Artificial Sequence: Synthetic oligonucleotide
ttgtcaatctccatcacttcatggctgttccagtttc

SEQ ID NO: 204689 - DNA, 36 bp, Artificial Sequence
  Description of Artificial Sequence: Synthetic oligonucleotide
tgtcaatctccatcacttcatggctgttccagtttc

SEQ ID NO: 204690 - DNA, 35 bp, Artificial Sequence
  Description of Artificial Sequence: Synthetic oligonucleotide
gtcaatctccatcacttcatggctgttccagtttc

SEQ ID NO: 204691 - DNA, 36 bp, Artificial Sequence
  Description of Artificial Sequence: Synthetic oligonucleotide
tcaatctccatcacttcatggctgttccagtttctg

SEQ ID NO: 204692 - DNA, 35 bp, Artificial Sequence
  Description of Artificial Sequence: Synthetic oligonucleotide
caatctccatcacttcatggctgttccagtttctg

SEQ ID NO: 204693 - DNA, 36 bp, Artificial Sequence
  Description of Artificial Sequence: Synthetic oligonucleotide
aatctccatcacttcatggctgttccagtttctgag

SEQ ID NO: 204694 - DNA, 35 bp, Artificial Sequence
  Description of Artificial Sequence: Synthetic oligonucleotide
atctccatcacttcatggctgttccagtttctgag

SEQ ID NO: 204695 - DNA, 34 bp, Artificial Sequence
  Description of Artificial Sequence: Synthetic oligonucleotide
tctccatcacttcatggctgttccagtttctgag

SEQ ID NO: 204696 - DNA, 33 bp, Artificial Sequence
  Description of Artificial Sequence: Synthetic oligonucleotide
ctccatcacttcatggctgttccagtttctgag

SEQ ID NO: 204697 - DNA, 33 bp, Artificial Sequence
  Description of Artificial Sequence: Synthetic oligonucleotide
tccatcacttcatggctgttccagtttctgagg

SEQ ID NO: 204698 - DNA, 32 bp, Artificial Sequence
  Description of Artificial Sequence: Synthetic oligonucleotide
ccatcacttcatggctgttccagtttctgagg

SEQ ID NO: 204699 - DNA, 32 bp, Artificial Sequence
  Description of Artificial Sequence: Synthetic oligonucleotide
catcacttcatggctgttccagtttctgaggc

SEQ ID NO: 204700 - DNA, 32 bp, Artificial Sequence
  Description of Artificial Sequence: Synthetic oligonucleotide
atcacttcatggctgttccagtttctgaggcc

SEQ ID NO: 204701 - DNA, 31 bp, Artificial Sequence
  Description of Artificial Sequence: Synthetic oligonucleotide
tcacttcatggctgttccagtttctgaggcc

SEQ ID NO: 204702 - DNA, 30 bp, Artificial Sequence
  Description of Artificial Sequence: Synthetic oligonucleotide
cacttcatggctgttccagtttctgaggcc

SEQ ID NO: 204703 - DNA, 30 bp, Artificial Sequence
  Description of Artificial Sequence: Synthetic oligonucleotide
acttcatggctgttccagtttctgaggccc

SEQ ID NO: 204704 - DNA, 29 bp, Artificial Sequence
  Description of Artificial Sequence: Synthetic oligonucleotide
cttcatggctgttccagtttctgaggccc

SEQ ID NO: 204705 - DNA, 29 bp, Artificial Sequence
  Description of Artificial Sequence: Synthetic oligonucleotide
ttcatggctgttccagtttctgaggcccc

SEQ ID NO: 204706 - DNA, 28 bp, Artificial Sequence
  Description of Artificial Sequence: Synthetic oligonucleotide
tcatggctgttccagtttctgaggcccc

SEQ ID NO: 204707 - DNA, 27 bp, Artificial Sequence
  Description of Artificial Sequence: Synthetic oligonucleotide
catggctgttccagtttctgaggcccc

SEQ ID NO: 204708 - DNA, 28 bp, Artificial Sequence
  Description of Artificial Sequence: Synthetic oligonucleotide
atggctgttccagtttctgaggcccctg

SEQ ID NO: 204709 - DNA, 27 bp, Artificial Sequence
  Description of Artificial Sequence: Synthetic oligonucleotide
tggctgttccagtttctgaggcccctg

SEQ ID NO: 204710 - DNA, 27 bp, Artificial Sequence
  Description of Artificial Sequence: Synthetic oligonucleotide
tctttccagctggactcctccaacccg

SEQ ID NO: 204711 - DNA, 26 bp, Artificial Sequence
  Description of Artificial Sequence: Synthetic oligonucleotide
ctttccagctggactcctccaacccg

SEQ ID NO: 204712 - DNA, 27 bp, Artificial Sequence
  Description of Artificial Sequence: Synthetic oligonucleotide
tttccagctggactcctccaacccgca

SEQ ID NO: 204713 - DNA, 27 bp, Artificial Sequence
  Description of Artificial Sequence: Synthetic oligonucleotide
ttccagctggactcctccaacccgcat

SEQ ID NO: 204714 - DNA, 27 bp, Artificial Sequence
  Description of Artificial Sequence: Synthetic oligonucleotide
tccagctggactcctccaacccgcatt

SEQ ID NO: 204715 - DNA, 26 bp, Artificial Sequence
  Description of Artificial Sequence: Synthetic oligonucleotide
ccagctggactcctccaacccgcatt

SEQ ID NO: 204716 - DNA, 27 bp, Artificial Sequence
  Description of Artificial Sequence: Synthetic oligonucleotide
cagctggactcctccaacccgcattct

SEQ ID NO: 204717 - DNA, 28 bp, Artificial Sequence
  Description of Artificial Sequence: Synthetic oligonucleotide
agctggactcctccaacccgcattcttc

SEQ ID NO: 204718 - DNA, 27 bp, Artificial Sequence
  Description of Artificial Sequence: Synthetic oligonucleotide
gctggactcctccaacccgcattcttc

SEQ ID NO: 204719 - DNA, 27 bp, Artificial Sequence
  Description of Artificial Sequence: Synthetic oligonucleotide
ctggactcctccaacccgcattcttcc

SEQ ID NO: 204720 - DNA, 28 bp, Artificial Sequence
  Description of Artificial Sequence: Synthetic oligonucleotide
tggactcctccaacccgcattcttccac

SEQ ID NO: 204721 - DNA, 27 bp, Artificial Sequence
  Description of Artificial Sequence: Synthetic oligonucleotide
ggactcctccaacccgcattcttccac

SEQ ID NO: 204722 - DNA, 27 bp, Artificial Sequence
  Description of Artificial Sequence: Synthetic oligonucleotide
gactcctccaacccgcattcttccacc

SEQ ID NO: 204723 - DNA, 27 bp, Artificial Sequence
  Description of Artificial Sequence: Synthetic oligonucleotide
actcctccaacccgcattcttccaccc

SEQ ID NO: 204724 - DNA, 27 bp, Artificial Sequence
  Description of Artificial Sequence: Synthetic oligonucleotide
ctcctccaacccgcattcttccaccct

SEQ ID NO: 204725 - DNA, 27 bp, Artificial Sequence
  Description of Artificial Sequence: Synthetic oligonucleotide
tcctccaacccgcattcttccaccctg

SEQ ID NO: 204726 - DNA, 26 bp, Artificial Sequence
  Description of Artificial Sequence: Synthetic oligonucleotide
cctccaacccgcattcttccaccctg

SEQ ID NO: 204727 - DNA, 26 bp, Artificial Sequence
  Description of Artificial Sequence: Synthetic oligonucleotide
ctccaacccgcattcttccaccctgg

SEQ ID NO: 204728 - DNA, 27 bp, Artificial Sequence
  Description of Artificial Sequence: Synthetic oligonucleotide
tccaacccgcattcttccaccctggct

SEQ ID NO: 204729 - DNA, 27 bp, Artificial Sequence
  Description of Artificial Sequence: Synthetic oligonucleotide
ccaacccgcattcttccaccctggcta

SEQ ID NO: 204730 - DNA, 28 bp, Artificial Sequence
  Description of Artificial Sequence: Synthetic oligonucleotide
caacccgcattcttccaccctggctatc

SEQ ID NO: 204731 - DNA, 28 bp, Artificial Sequence
  Description of Artificial Sequence: Synthetic oligonucleotide
aacccgcattcttccaccctggctatcc

SEQ ID NO: 204732 - DNA, 27 bp, Artificial Sequence
  Description of Artificial Sequence: Synthetic oligonucleotide
acccgcattcttccaccctggctatcc

SEQ ID NO: 204733 - DNA, 26 bp, Artificial Sequence
  Description of Artificial Sequence: Synthetic oligonucleotide
cccgcattcttccaccctggctatcc

SEQ ID NO: 204734 - DNA, 27 bp, Artificial Sequence
  Description of Artificial Sequence: Synthetic oligonucleotide
ccgcattcttccaccctggctatccca

SEQ ID NO: 204735 - DNA, 27 bp, Artificial Sequence
  Description of Artificial Sequence: Synthetic oligonucleotide
cgcattcttccaccctggctatcccag

SEQ ID NO: 204736 - DNA, 28 bp, Artificial Sequence
  Description of Artificial Sequence: Synthetic oligonucleotide
gcattcttccaccctggctatcccagag

SEQ ID NO: 204737 - DNA, 29 bp, Artificial Sequence
  Description of Artificial Sequence: Synthetic oligonucleotide
atggcccacgagctgttgcacatcttctg

SEQ ID NO: 204738 - DNA, 28 bp, Artificial Sequence
  Description of Artificial Sequence: Synthetic oligonucleotide
tggcccacgagctgttgcacatcttctg

SEQ ID NO: 204739 - DNA, 27 bp, Artificial Sequence
  Description of Artificial Sequence: Synthetic oligonucleotide
ggcccacgagctgttgcacatcttctg

SEQ ID NO: 204740 - DNA, 27 bp, Artificial Sequence
  Description of Artificial Sequence: Synthetic oligonucleotide
gcccacgagctgttgcacatcttctgc

SEQ ID NO: 204741 - DNA, 27 bp, Artificial Sequence
  Description of Artificial Sequence: Synthetic oligonucleotide
cccacgagctgttgcacatcttctgcc

SEQ ID NO: 204742 - DNA, 28 bp, Artificial Sequence
  Description of Artificial Sequence: Synthetic oligonucleotide
ccacgagctgttgcacatcttctgccag

SEQ ID NO: 204743 - DNA, 28 bp, Artificial Sequence
  Description of Artificial Sequence: Synthetic oligonucleotide
cacgagctgttgcacatcttctgccagc

SEQ ID NO: 204744 - DNA, 29 bp, Artificial Sequence
  Description of Artificial Sequence: Synthetic oligonucleotide
acgagctgttgcacatcttctgccagctc

SEQ ID NO: 204745 - DNA, 28 bp, Artificial Sequence
  Description of Artificial Sequence: Synthetic oligonucleotide
cgagctgttgcacatcttctgccagctc

SEQ ID NO: 204746 - DNA, 31 bp, Artificial Sequence
  Description of Artificial Sequence: Synthetic oligonucleotide
gagctgttgcacatcttctgccagctcttac

SEQ ID NO: 204747 - DNA, 32 bp, Artificial Sequence
  Description of Artificial Sequence: Synthetic oligonucleotide
agctgttgcacatcttctgccagctcttactg

SEQ ID NO: 204748 - DNA, 31 bp, Artificial Sequence
  Description of Artificial Sequence: Synthetic oligonucleotide
gctgttgcacatcttctgccagctcttactg

SEQ ID NO: 204749 - DNA, 31 bp, Artificial Sequence
  Description of Artificial Sequence: Synthetic oligonucleotide
ctgttgcacatcttctgccagctcttactgc

SEQ ID NO: 204750 - DNA, 31 bp, Artificial Sequence
  Description of Artificial Sequence: Synthetic oligonucleotide
tgttgcacatcttctgccagctcttactgcc

SEQ ID NO: 204751 - DNA, 30 bp, Artificial Sequence
  Description of Artificial Sequence: Synthetic oligonucleotide
gttgcacatcttctgccagctcttactgcc

SEQ ID NO: 204752 - DNA, 31 bp, Artificial Sequence
  Description of Artificial Sequence: Synthetic oligonucleotide
ttgcacatcttctgccagctcttactgcctg

SEQ ID NO: 204753 - DNA, 30 bp, Artificial Sequence
  Description of Artificial Sequence: Synthetic oligonucleotide
tgcacatcttctgccagctcttactgcctg

SEQ ID NO: 204754 - DNA, 29 bp, Artificial Sequence
  Description of Artificial Sequence: Synthetic oligonucleotide
gcacatcttctgccagctcttactgcctg

SEQ ID NO: 204755 - DNA, 29 bp, Artificial Sequence
  Description of Artificial Sequence: Synthetic oligonucleotide
cacatcttctgccagctcttactgcctgg

SEQ ID NO: 204756 - DNA, 29 bp, Artificial Sequence
  Description of Artificial Sequence: Synthetic oligonucleotide
acatcttctgccagctcttactgcctggg

SEQ ID NO: 204757 - DNA, 28 bp, Artificial Sequence
  Description of Artificial Sequence: Synthetic oligonucleotide
catcttctgccagctcttactgcctggg

SEQ ID NO: 204758 - DNA, 28 bp, Artificial Sequence
  Description of Artificial Sequence: Synthetic oligonucleotide
atcttctgccagctcttactgcctgggg

SEQ ID NO: 204759 - DNA, 27 bp, Artificial Sequence
  Description of Artificial Sequence: Synthetic oligonucleotide
tcttctgccagctcttactgcctgggg

SEQ ID NO: 204760 - DNA, 26 bp, Artificial Sequence
  Description of Artificial Sequence: Synthetic oligonucleotide
cttctgccagctcttactgcctgggg

SEQ ID NO: 204761 - DNA, 26 bp, Artificial Sequence
  Description of Artificial Sequence: Synthetic oligonucleotide
ttctgccagctcttactgcctggggg

SEQ ID NO: 204762 - DNA, 25 bp, Artificial Sequence
  Description of Artificial Sequence: Synthetic oligonucleotide
tctgccagctcttactgcctggggg

SEQ ID NO: 204763 - DNA, 24 bp, Artificial Sequence
  Description of Artificial Sequence: Synthetic oligonucleotide
ctgccagctcttactgcctggggg

SEQ ID NO: 204764 - DNA, 25 bp, Artificial Sequence
  Description of Artificial Sequence: Synthetic oligonucleotide
tgccagctcttactgcctgggggct

SEQ ID NO: 204765 - DNA, 24 bp, Artificial Sequence
  Description of Artificial Sequence: Synthetic oligonucleotide
gccagctcttactgcctgggggct

SEQ ID NO: 204766 - DNA, 42 bp, Artificial Sequence
  Description of Artificial Sequence: Synthetic oligonucleotide
tcgtggtccatgacgtggaatatttgaaaaacatgtcataac

SEQ ID NO: 204767 - DNA, 41 bp, Artificial Sequence
  Description of Artificial Sequence: Synthetic oligonucleotide
cgtggtccatgacgtggaatatttgaaaaacatgtcataac

SEQ ID NO: 204768 - DNA, 42 bp, Artificial Sequence
  Description of Artificial Sequence: Synthetic oligonucleotide
gtggtccatgacgtggaatatttgaaaaacatgtcataactg

SEQ ID NO: 204769 - DNA, 42 bp, Artificial Sequence
  Description of Artificial Sequence: Synthetic oligonucleotide
tggtccatgacgtggaatatttgaaaaacatgtcataactgg

SEQ ID NO: 204770 - DNA, 41 bp, Artificial Sequence
  Description of Artificial Sequence: Synthetic oligonucleotide
ggtccatgacgtggaatatttgaaaaacatgtcataactgg

SEQ ID NO: 204771 - DNA, 42 bp, Artificial Sequence
  Description of Artificial Sequence: Synthetic oligonucleotide
gtccatgacgtggaatatttgaaaaacatgtcataactggtg

SEQ ID NO: 204772 - DNA, 42 bp, Artificial Sequence
  Description of Artificial Sequence: Synthetic oligonucleotide
tccatgacgtggaatatttgaaaaacatgtcataactggtgg

SEQ ID NO: 204773 - DNA, 41 bp, Artificial Sequence
  Description of Artificial Sequence: Synthetic oligonucleotide
ccatgacgtggaatatttgaaaaacatgtcataactggtgg

SEQ ID NO: 204774 - DNA, 42 bp, Artificial Sequence
  Description of Artificial Sequence: Synthetic oligonucleotide
catgacgtggaatatttgaaaaacatgtcataactggtggag

SEQ ID NO: 204775 - DNA, 42 bp, Artificial Sequence
  Description of Artificial Sequence: Synthetic oligonucleotide
atgacgtggaatatttgaaaaacatgtcataactggtggagg

SEQ ID NO: 204776 - DNA, 41 bp, Artificial Sequence
  Description of Artificial Sequence: Synthetic oligonucleotide
tgacgtggaatatttgaaaaacatgtcataactggtggagg

SEQ ID NO: 204777 - DNA, 40 bp, Artificial Sequence
  Description of Artificial Sequence: Synthetic oligonucleotide
gacgtggaatatttgaaaaacatgtcataactggtggagg

SEQ ID NO: 204778 - DNA, 41 bp, Artificial Sequence
  Description of Artificial Sequence: Synthetic oligonucleotide
acgtggaatatttgaaaaacatgtcataactggtggaggag

SEQ ID NO: 204779 - DNA, 40 bp, Artificial Sequence
  Description of Artificial Sequence: Synthetic oligonucleotide
cgtggaatatttgaaaaacatgtcataactggtggaggag

SEQ ID NO: 204780 - DNA, 42 bp, Artificial Sequence
  Description of Artificial Sequence: Synthetic oligonucleotide
gtggaatatttgaaaaacatgtcataactggtggaggagatg

SEQ ID NO: 204781 - DNA, 42 bp, Artificial Sequence
  Description of Artificial Sequence: Synthetic oligonucleotide
tggaatatttgaaaaacatgtcataactggtggaggagatgc

SEQ ID NO: 204782 - DNA, 41 bp, Artificial Sequence
  Description of Artificial Sequence: Synthetic oligonucleotide
ggaatatttgaaaaacatgtcataactggtggaggagatgc

SEQ ID NO: 204783 - DNA, 42 bp, Artificial Sequence
  Description of Artificial Sequence: Synthetic oligonucleotide
gaatatttgaaaaacatgtcataactggtggaggagatgctg

SEQ ID NO: 204784 - DNA, 42 bp, Artificial Sequence
  Description of Artificial Sequence: Synthetic oligonucleotide
aatatttgaaaaacatgtcataactggtggaggagatgctgc

SEQ ID NO: 204785 - DNA, 41 bp, Artificial Sequence
  Description of Artificial Sequence: Synthetic oligonucleotide
atatttgaaaaacatgtcataactggtggaggagatgctgc

SEQ ID NO: 204786 - DNA, 40 bp, Artificial Sequence
  Description of Artificial Sequence: Synthetic oligonucleotide
tatttgaaaaacatgtcataactggtggaggagatgctgc

SEQ ID NO: 204787 - DNA, 39 bp, Artificial Sequence
  Description of Artificial Sequence: Synthetic oligonucleotide
atttgaaaaacatgtcataactggtggaggagatgctgc

SEQ ID NO: 204788 - DNA, 38 bp, Artificial Sequence
  Description of Artificial Sequence: Synthetic oligonucleotide
tttgaaaaacatgtcataactggtggaggagatgctgc

SEQ ID NO: 204789 - DNA, 37 bp, Artificial Sequence
  Description of Artificial Sequence: Synthetic oligonucleotide
ttgaaaaacatgtcataactggtggaggagatgctgc

SEQ ID NO: 204790 - DNA, 36 bp, Artificial Sequence
  Description of Artificial Sequence: Synthetic oligonucleotide
tgaaaaacatgtcataactggtggaggagatgctgc

SEQ ID NO: 204791 - DNA, 35 bp, Artificial Sequence
  Description of Artificial Sequence: Synthetic oligonucleotide
gaaaaacatgtcataactggtggaggagatgctgc

SEQ ID NO: 204792 - DNA, 39 bp, Artificial Sequence
  Description of Artificial Sequence: Synthetic oligonucleotide
aaaaacatgtcataactggtggaggagatgctgctaaag

SEQ ID NO: 204793 - DNA, 38 bp, Artificial Sequence
  Description of Artificial Sequence: Synthetic oligonucleotide
aaaacatgtcataactggtggaggagatgctgctaaag

SEQ ID NO: 204794 - DNA, 37 bp, Artificial Sequence
  Description of Artificial Sequence: Synthetic oligonucleotide
aaacatgtcataactggtggaggagatgctgctaaag

SEQ ID NO: 204795 - DNA, 36 bp, Artificial Sequence
  Description of Artificial Sequence: Synthetic oligonucleotide
aacatgtcataactggtggaggagatgctgctaaag

SEQ ID NO: 204796 - DNA, 35 bp, Artificial Sequence
  Description of Artificial Sequence: Synthetic oligonucleotide
acatgtcataactggtggaggagatgctgctaaag

SEQ ID NO: 204797 - DNA, 34 bp, Artificial Sequence
  Description of Artificial Sequence: Synthetic oligonucleotide
catgtcataactggtggaggagatgctgctaaag

SEQ ID NO: 204798 - DNA, 34 bp, Artificial Sequence
  Description of Artificial Sequence: Synthetic oligonucleotide
atgtcataactggtggaggagatgctgctaaagc

SEQ ID NO: 204799 - DNA, 33 bp, Artificial Sequence
  Description of Artificial Sequence: Synthetic oligonucleotide
tgtcataactggtggaggagatgctgctaaagc

SEQ ID NO: 204800 - DNA, 32 bp, Artificial Sequence
  Description of Artificial Sequence: Synthetic oligonucleotide
gtcataactggtggaggagatgctgctaaagc

SEQ ID NO: 204801 - DNA, 33 bp, Artificial Sequence
  Description of Artificial Sequence: Synthetic oligonucleotide
tcataactggtggaggagatgctgctaaagcag

SEQ ID NO: 204802 - DNA, 32 bp, Artificial Sequence
  Description of Artificial Sequence: Synthetic oligonucleotide
cataactggtggaggagatgctgctaaagcag

SEQ ID NO: 204803 - DNA, 33 bp, Artificial Sequence
  Description of Artificial Sequence: Synthetic oligonucleotide
ataactggtggaggagatgctgctaaagcagag

SEQ ID NO: 204804 - DNA, 32 bp, Artificial Sequence
  Description of Artificial Sequence: Synthetic oligonucleotide
taactggtggaggagatgctgctaaagcagag

SEQ ID NO: 204805 - DNA, 27 bp, Artificial Sequence
  Description of Artificial Sequence: Synthetic oligonucleotide
aacacaagtgtggccccctgcaccgaa

SEQ ID NO: 204806 - DNA, 27 bp, Artificial Sequence
  Description of Artificial Sequence: Synthetic oligonucleotide
acacaagtgtggccccctgcaccgaat

SEQ ID NO: 204807 - DNA, 27 bp, Artificial Sequence
  Description of Artificial Sequence: Synthetic oligonucleotide
cacaagtgtggccccctgcaccgaatt

SEQ ID NO: 204808 - DNA, 27 bp, Artificial Sequence
  Description of Artificial Sequence: Synthetic oligonucleotide
acaagtgtggccccctgcaccgaattc

SEQ ID NO: 204809 - DNA, 27 bp, Artificial Sequence
  Description of Artificial Sequence: Synthetic oligonucleotide
caagtgtggccccctgcaccgaattct

SEQ ID NO: 204810 - DNA, 28 bp, Artificial Sequence
  Description of Artificial Sequence: Synthetic oligonucleotide
aagtgtggccccctgcaccgaattcttc

SEQ ID NO: 204811 - DNA, 27 bp, Artificial Sequence
  Description of Artificial Sequence: Synthetic oligonucleotide
agtgtggccccctgcaccgaattcttc

SEQ ID NO: 204812 - DNA, 27 bp, Artificial Sequence
  Description of Artificial Sequence: Synthetic oligonucleotide
gtgtggccccctgcaccgaattcttca

SEQ ID NO: 204813 - DNA, 27 bp, Artificial Sequence
  Description of Artificial Sequence: Synthetic oligonucleotide
tgtggccccctgcaccgaattcttcag

SEQ ID NO: 204814 - DNA, 26 bp, Artificial Sequence
  Description of Artificial Sequence: Synthetic oligonucleotide
gtggccccctgcaccgaattcttcag

SEQ ID NO: 204815 - DNA, 27 bp, Artificial Sequence
  Description of Artificial Sequence: Synthetic oligonucleotide
tggccccctgcaccgaattcttcagct

SEQ ID NO: 204816 - DNA, 27 bp, Artificial Sequence
  Description of Artificial Sequence: Synthetic oligonucleotide
ggccccctgcaccgaattcttcagctt

SEQ ID NO: 204817 - DNA, 28 bp, Artificial Sequence
  Description of Artificial Sequence: Synthetic oligonucleotide
gccccctgcaccgaattcttcagctttg

SEQ ID NO: 204818 - DNA, 28 bp, Artificial Sequence
  Description of Artificial Sequence: Synthetic oligonucleotide
ccccctgcaccgaattcttcagctttgc

SEQ ID NO: 204819 - DNA, 28 bp, Artificial Sequence
  Description of Artificial Sequence: Synthetic oligonucleotide
cccctgcaccgaattcttcagctttgcc

SEQ ID NO: 204820 - DNA, 29 bp, Artificial Sequence
  Description of Artificial Sequence: Synthetic oligonucleotide
ccctgcaccgaattcttcagctttgcctg

SEQ ID NO: 204821 - DNA, 30 bp, Artificial Sequence
  Description of Artificial Sequence: Synthetic oligonucleotide
cctgcaccgaattcttcagctttgcctgtg

SEQ ID NO: 204822 - DNA, 30 bp, Artificial Sequence
  Description of Artificial Sequence: Synthetic oligonucleotide
ctgcaccgaattcttcagctttgcctgtgg

SEQ ID NO: 204823 - DNA, 32 bp, Artificial Sequence
  Description of Artificial Sequence: Synthetic oligonucleotide
tgcaccgaattcttcagctttgcctgtggaag

SEQ ID NO: 204824 - DNA, 31 bp, Artificial Sequence
  Description of Artificial Sequence: Synthetic oligonucleotide
gcaccgaattcttcagctttgcctgtggaag

SEQ ID NO: 204825 - DNA, 31 bp, Artificial Sequence
  Description of Artificial Sequence: Synthetic oligonucleotide
caccgaattcttcagctttgcctgtggaagg

SEQ ID NO: 204826 - DNA, 31 bp, Artificial Sequence
  Description of Artificial Sequence: Synthetic oligonucleotide
accgaattcttcagctttgcctgtggaaggg

SEQ ID NO: 204827 - DNA, 30 bp, Artificial Sequence
  Description of Artificial Sequence: Synthetic oligonucleotide
ccgaattcttcagctttgcctgtggaaggg

SEQ ID NO: 204828 - DNA, 30 bp, Artificial Sequence
  Description of Artificial Sequence: Synthetic oligonucleotide
cgaattcttcagctttgcctgtggaagggc

SEQ ID NO: 204829 - DNA, 30 bp, Artificial Sequence
  Description of Artificial Sequence: Synthetic oligonucleotide
gaattcttcagctttgcctgtggaagggcc

SEQ ID NO: 204830 - DNA, 33 bp, Artificial Sequence
  Description of Artificial Sequence: Synthetic oligonucleotide
aattcttcagctttgcctgtggaagggccaaag

SEQ ID NO: 204831 - DNA, 32 bp, Artificial Sequence
  Description of Artificial Sequence: Synthetic oligonucleotide
attcttcagctttgcctgtggaagggccaaag

SEQ ID NO: 204832 - DNA, 30 bp, Artificial Sequence
  Description of Artificial Sequence: Synthetic oligonucleotide
gctttgtttgttcgtgaggcctttggcctg

SEQ ID NO: 204833 - DNA, 31 bp, Artificial Sequence
  Description of Artificial Sequence: Synthetic oligonucleotide
ctttgtttgttcgtgaggcctttggcctgag

SEQ ID NO: 204834 - DNA, 31 bp, Artificial Sequence
  Description of Artificial Sequence: Synthetic oligonucleotide
tttgtttgttcgtgaggcctttggcctgagc

SEQ ID NO: 204835 - DNA, 30 bp, Artificial Sequence
  Description of Artificial Sequence: Synthetic oligonucleotide
ttgtttgttcgtgaggcctttggcctgagc

SEQ ID NO: 204836 - DNA, 29 bp, Artificial Sequence
  Description of Artificial Sequence: Synthetic oligonucleotide
tgtttgttcgtgaggcctttggcctgagc

SEQ ID NO: 204837 - DNA, 28 bp, Artificial Sequence
  Description of Artificial Sequence: Synthetic oligonucleotide
gtttgttcgtgaggcctttggcctgagc

SEQ ID NO: 204838 - DNA, 29 bp, Artificial Sequence
  Description of Artificial Sequence: Synthetic oligonucleotide
tttgttcgtgaggcctttggcctgagcac

SEQ ID NO: 204839 - DNA, 28 bp, Artificial Sequence
  Description of Artificial Sequence: Synthetic oligonucleotide
ttgttcgtgaggcctttggcctgagcac

SEQ ID NO: 204840 - DNA, 27 bp, Artificial Sequence
  Description of Artificial Sequence: Synthetic oligonucleotide
tgttcgtgaggcctttggcctgagcac

SEQ ID NO: 204841 - DNA, 26 bp, Artificial Sequence
  Description of Artificial Sequence: Synthetic oligonucleotide
gttcgtgaggcctttggcctgagcac

SEQ ID NO: 204842 - DNA, 26 bp, Artificial Sequence
  Description of Artificial Sequence: Synthetic oligonucleotide
ttcgtgaggcctttggcctgagcacc

SEQ ID NO: 204843 - DNA, 25 bp, Artificial Sequence
  Description of Artificial Sequence: Synthetic oligonucleotide
tcgtgaggcctttggcctgagcacc

SEQ ID NO: 204844 - DNA, 24 bp, Artificial Sequence
  Description of Artificial Sequence: Synthetic oligonucleotide
cgtgaggcctttggcctgagcacc

SEQ ID NO: 204845 - DNA, 24 bp, Artificial Sequence
  Description of Artificial Sequence: Synthetic oligonucleotide
gtgaggcctttggcctgagcaccc

SEQ ID NO: 204846 - DNA, 26 bp, Artificial Sequence
  Description of Artificial Sequence: Synthetic oligonucleotide
tgaggcctttggcctgagcacccgaa

SEQ ID NO: 204847 - DNA, 25 bp, Artificial Sequence
  Description of Artificial Sequence: Synthetic oligonucleotide
gaggcctttggcctgagcacccgaa

SEQ ID NO: 204848 - DNA, 26 bp, Artificial Sequence
  Description of Artificial Sequence: Synthetic oligonucleotide
aggcctttggcctgagcacccgaagt

SEQ ID NO: 204849 - DNA, 25 bp, Artificial Sequence
  Description of Artificial Sequence: Synthetic oligonucleotide
ggcctttggcctgagcacccgaagt

SEQ ID NO: 204850 - DNA, 25 bp, Artificial Sequence
  Description of Artificial Sequence: Synthetic oligonucleotide
gcctttggcctgagcacccgaagtg

SEQ ID NO: 204851 - DNA, 26 bp, Artificial Sequence
  Description of Artificial Sequence: Synthetic oligonucleotide
cctttggcctgagcacccgaagtgct

SEQ ID NO: 204852 - DNA, 26 bp, Artificial Sequence
  Description of Artificial Sequence: Synthetic oligonucleotide
ctttggcctgagcacccgaagtgctg

SEQ ID NO: 204853 - DNA, 26 bp, Artificial Sequence
  Description of Artificial Sequence: Synthetic oligonucleotide
tttggcctgagcacccgaagtgctgc

SEQ ID NO: 204854 - DNA, 25 bp, Artificial Sequence
  Description of Artificial Sequence: Synthetic oligonucleotide
ttggcctgagcacccgaagtgctgc

SEQ ID NO: 204855 - DNA, 24 bp, Artificial Sequence
  Description of Artificial Sequence: Synthetic oligonucleotide
tggcctgagcacccgaagtgctgc

SEQ ID NO: 204856 - DNA, 23 bp, Artificial Sequence
  Description of Artificial Sequence: Synthetic oligonucleotide
ggcctgagcacccgaagtgctgc

SEQ ID NO: 204857 - DNA, 25 bp, Artificial Sequence
  Description of Artificial Sequence: Synthetic oligonucleotide
gcctgagcacccgaagtgctgccat

SEQ ID NO: 204858 - DNA, 27 bp, Artificial Sequence
  Description of Artificial Sequence: Synthetic oligonucleotide
cctgagcacccgaagtgctgccatgaa

SEQ ID NO: 204859 - DNA, 33 bp, Artificial Sequence
  Description of Artificial Sequence: Synthetic oligonucleotide
ctgagcacccgaagtgctgccatgaaattattc

SEQ ID NO: 204860 - DNA, 34 bp, Artificial Sequence
  Description of Artificial Sequence: Synthetic oligonucleotide
tgagcacccgaagtgctgccatgaaattattcac

SEQ ID NO: 204861 - DNA, 26 bp, Artificial Sequence
  Description of Artificial Sequence: Synthetic oligonucleotide
ccctgaagccagagctggcccgataa

SEQ ID NO: 204862 - DNA, 27 bp, Artificial Sequence
  Description of Artificial Sequence: Synthetic oligonucleotide
cctgaagccagagctggcccgataaga

SEQ ID NO: 204863 - DNA, 30 bp, Artificial Sequence
  Description of Artificial Sequence: Synthetic oligonucleotide
ctgaagccagagctggcccgataagaatac

SEQ ID NO: 204864 - DNA, 32 bp, Artificial Sequence
  Description of Artificial Sequence: Synthetic oligonucleotide
tgaagccagagctggcccgataagaatacaac

SEQ ID NO: 204865 - DNA, 31 bp, Artificial Sequence
  Description of Artificial Sequence: Synthetic oligonucleotide
gaagccagagctggcccgataagaatacaac

SEQ ID NO: 204866 - DNA, 31 bp, Artificial Sequence
  Description of Artificial Sequence: Synthetic oligonucleotide
aagccagagctggcccgataagaatacaacg

SEQ ID NO: 204867 - DNA, 30 bp, Artificial Sequence
  Description of Artificial Sequence: Synthetic oligonucleotide
agccagagctggcccgataagaatacaacg

SEQ ID NO: 204868 - DNA, 29 bp, Artificial Sequence
  Description of Artificial Sequence: Synthetic oligonucleotide
gccagagctggcccgataagaatacaacg

SEQ ID NO: 204869 - DNA, 34 bp, Artificial Sequence
  Description of Artificial Sequence: Synthetic oligonucleotide
ccagagctggcccgataagaatacaacgatatac

SEQ ID NO: 204870 - DNA, 35 bp, Artificial Sequence
  Description of Artificial Sequence: Synthetic oligonucleotide
cagagctggcccgataagaatacaacgatatacag

SEQ ID NO: 204871 - DNA, 35 bp, Artificial Sequence
  Description of Artificial Sequence: Synthetic oligonucleotide
agagctggcccgataagaatacaacgatatacagc

SEQ ID NO: 204872 - DNA, 34 bp, Artificial Sequence
  Description of Artificial Sequence: Synthetic oligonucleotide
gagctggcccgataagaatacaacgatatacagc

SEQ ID NO: 204873 - DNA, 36 bp, Artificial Sequence
  Description of Artificial Sequence: Synthetic oligonucleotide
agctggcccgataagaatacaacgatatacagcttg

SEQ ID NO: 204874 - DNA, 35 bp, Artificial Sequence
  Description of Artificial Sequence: Synthetic oligonucleotide
gctggcccgataagaatacaacgatatacagcttg

SEQ ID NO: 204875 - DNA, 35 bp, Artificial Sequence
  Description of Artificial Sequence: Synthetic oligonucleotide
ctggcccgataagaatacaacgatatacagcttgg

SEQ ID NO: 204876 - DNA, 37 bp, Artificial Sequence
  Description of Artificial Sequence: Synthetic oligonucleotide
tggcccgataagaatacaacgatatacagcttggatc

SEQ ID NO: 204877 - DNA, 36 bp, Artificial Sequence
  Description of Artificial Sequence: Synthetic oligonucleotide
ggcccgataagaatacaacgatatacagcttggatc

SEQ ID NO: 204878 - DNA, 36 bp, Artificial Sequence
  Description of Artificial Sequence: Synthetic oligonucleotide
gcccgataagaatacaacgatatacagcttggatcg

SEQ ID NO: 204879 - DNA, 37 bp, Artificial Sequence
  Description of Artificial Sequence: Synthetic oligonucleotide
cccgataagaatacaacgatatacagcttggatcgag

SEQ ID NO: 204880 - DNA, 37 bp, Artificial Sequence
  Description of Artificial Sequence: Synthetic oligonucleotide
ccgataagaatacaacgatatacagcttggatcgagc

SEQ ID NO: 204881 - DNA, 39 bp, Artificial Sequence
  Description of Artificial Sequence: Synthetic oligonucleotide
cgataagaatacaacgatatacagcttggatcgagcttc

SEQ ID NO: 204882 - DNA, 39 bp, Artificial Sequence
  Description of Artificial Sequence: Synthetic oligonucleotide
gataagaatacaacgatatacagcttggatcgagcttcc

SEQ ID NO: 204883 - DNA, 40 bp, Artificial Sequence
  Description of Artificial Sequence: Synthetic oligonucleotide
ataagaatacaacgatatacagcttggatcgagcttcctg

SEQ ID NO: 204884 - DNA, 39 bp, Artificial Sequence
  Description of Artificial Sequence: Synthetic oligonucleotide
taagaatacaacgatatacagcttggatcgagcttcctg

SEQ ID NO: 204885 - DNA, 26 bp, Artificial Sequence
  Description of Artificial Sequence: Synthetic oligonucleotide
tgtcctgagctgtgtccggtccctct

SEQ ID NO: 204886 - DNA, 25 bp, Artificial Sequence
  Description of Artificial Sequence: Synthetic oligonucleotide
gtcctgagctgtgtccggtccctct

SEQ ID NO: 204887 - DNA, 26 bp, Artificial Sequence
  Description of Artificial Sequence: Synthetic oligonucleotide
tcctgagctgtgtccggtccctctga

SEQ ID NO: 204888 - DNA, 25 bp, Artificial Sequence
  Description of Artificial Sequence: Synthetic oligonucleotide
cctgagctgtgtccggtccctctga

SEQ ID NO: 204889 - DNA, 25 bp, Artificial Sequence
  Description of Artificial Sequence: Synthetic oligonucleotide
ctgagctgtgtccggtccctctgag

SEQ ID NO: 204890 - DNA, 27 bp, Artificial Sequence
  Description of Artificial Sequence: Synthetic oligonucleotide
tgagctgtgtccggtccctctgagcta

SEQ ID NO: 204891 - DNA, 26 bp, Artificial Sequence
  Description of Artificial Sequence: Synthetic oligonucleotide
gagctgtgtccggtccctctgagcta

SEQ ID NO: 204892 - DNA, 27 bp, Artificial Sequence
  Description of Artificial Sequence: Synthetic oligonucleotide
agctgtgtccggtccctctgagctaga

SEQ ID NO: 204893 - DNA, 27 bp, Artificial Sequence
  Description of Artificial Sequence: Synthetic oligonucleotide
gctgtgtccggtccctctgagctagaa

SEQ ID NO: 204894 - DNA, 29 bp, Artificial Sequence
  Description of Artificial Sequence: Synthetic oligonucleotide
ctgtgtccggtccctctgagctagaattg

SEQ ID NO: 204895 - DNA, 30 bp, Artificial Sequence
  Description of Artificial Sequence: Synthetic oligonucleotide
tgtgtccggtccctctgagctagaattgtc

SEQ ID NO: 204896 - DNA, 29 bp, Artificial Sequence
  Description of Artificial Sequence: Synthetic oligonucleotide
gtgtccggtccctctgagctagaattgtc

SEQ ID NO: 204897 - DNA, 29 bp, Artificial Sequence
  Description of Artificial Sequence: Synthetic oligonucleotide
tgtccggtccctctgagctagaattgtcc

SEQ ID NO: 204898 - DNA, 28 bp, Artificial Sequence
  Description of Artificial Sequence: Synthetic oligonucleotide
gtccggtccctctgagctagaattgtcc

SEQ ID NO: 204899 - DNA, 29 bp, Artificial Sequence
  Description of Artificial Sequence: Synthetic oligonucleotide
tccggtccctctgagctagaattgtccag

SEQ ID NO: 204900 - DNA, 28 bp, Artificial Sequence
  Description of Artificial Sequence: Synthetic oligonucleotide
ccggtccctctgagctagaattgtccag

SEQ ID NO: 204901 - DNA, 29 bp, Artificial Sequence
  Description of Artificial Sequence: Synthetic oligonucleotide
cggtccctctgagctagaattgtccagag

SEQ ID NO: 204902 - DNA, 29 bp, Artificial Sequence
  Description of Artificial Sequence: Synthetic oligonucleotide
ggtccctctgagctagaattgtccagagc

SEQ ID NO: 204903 - DNA, 31 bp, Artificial Sequence
  Description of Artificial Sequence: Synthetic oligonucleotide
gtccctctgagctagaattgtccagagcttc

SEQ ID NO: 204904 - DNA, 33 bp, Artificial Sequence
  Description of Artificial Sequence: Synthetic oligonucleotide
tccctctgagctagaattgtccagagcttcttg

SEQ ID NO: 204905 - DNA, 32 bp, Artificial Sequence
  Description of Artificial Sequence: Synthetic oligonucleotide
ccctctgagctagaattgtccagagcttcttg

SEQ ID NO: 204906 - DNA, 32 bp, Artificial Sequence
  Description of Artificial Sequence: Synthetic oligonucleotide
cctctgagctagaattgtccagagcttcttgc

SEQ ID NO: 204907 - DNA, 33 bp, Artificial Sequence
  Description of Artificial Sequence: Synthetic oligonucleotide
ctctgagctagaattgtccagagcttcttgcag

SEQ ID NO: 204908 - DNA, 33 bp, Artificial Sequence
  Description of Artificial Sequence: Synthetic oligonucleotide
tctgagctagaattgtccagagcttcttgcagc

SEQ ID NO: 204909 - DNA, 32 bp, Artificial Sequence
  Description of Artificial Sequence: Synthetic oligonucleotide
ctgagctagaattgtccagagcttcttgcagc

SEQ ID NO: 204910 - DNA, 32 bp, Artificial Sequence
  Description of Artificial Sequence: Synthetic oligonucleotide
tgagctagaattgtccagagcttcttgcagcc

SEQ ID NO: 204911 - DNA, 27 bp, Artificial Sequence
  Description of Artificial Sequence: Synthetic oligonucleotide
aaggaaatggcccccgccatcgactga

SEQ ID NO: 204912 - DNA, 27 bp, Artificial Sequence
  Description of Artificial Sequence: Synthetic oligonucleotide
aggaaatggcccccgccatcgactgat

SEQ ID NO: 204913 - DNA, 27 bp, Artificial Sequence
  Description of Artificial Sequence: Synthetic oligonucleotide
ggaaatggcccccgccatcgactgatt

SEQ ID NO: 204914 - DNA, 27 bp, Artificial Sequence
  Description of Artificial Sequence: Synthetic oligonucleotide
gaaatggcccccgccatcgactgattg

SEQ ID NO: 204915 - DNA, 28 bp, Artificial Sequence
  Description of Artificial Sequence: Synthetic oligonucleotide
aaatggcccccgccatcgactgattgtc

SEQ ID NO: 204916 - DNA, 27 bp, Artificial Sequence
  Description of Artificial Sequence: Synthetic oligonucleotide
aatggcccccgccatcgactgattgtc

SEQ ID NO: 204917 - DNA, 26 bp, Artificial Sequence
  Description of Artificial Sequence: Synthetic oligonucleotide
atggcccccgccatcgactgattgtc

SEQ ID NO: 204918 - DNA, 25 bp, Artificial Sequence
  Description of Artificial Sequence: Synthetic oligonucleotide
tggcccccgccatcgactgattgtc

SEQ ID NO: 204919 - DNA, 24 bp, Artificial Sequence
  Description of Artificial Sequence: Synthetic oligonucleotide
ggcccccgccatcgactgattgtc

SEQ ID NO: 204920 - DNA, 25 bp, Artificial Sequence
  Description of Artificial Sequence: Synthetic oligonucleotide
gcccccgccatcgactgattgtcct

SEQ ID NO: 204921 - DNA, 25 bp, Artificial Sequence
  Description of Artificial Sequence: Synthetic oligonucleotide
cccccgccatcgactgattgtcctg

SEQ ID NO: 204922 - DNA, 27 bp, Artificial Sequence
  Description of Artificial Sequence: Synthetic oligonucleotide
ccccgccatcgactgattgtcctgctt

SEQ ID NO: 204923 - DNA, 27 bp, Artificial Sequence
  Description of Artificial Sequence: Synthetic oligonucleotide
cccgccatcgactgattgtcctgcttg

SEQ ID NO: 204924 - DNA, 27 bp, Artificial Sequence
  Description of Artificial Sequence: Synthetic oligonucleotide
ccgccatcgactgattgtcctgcttgc

SEQ ID NO: 204925 - DNA, 29 bp, Artificial Sequence
  Description of Artificial Sequence: Synthetic oligonucleotide
cgccatcgactgattgtcctgcttgcaag

SEQ ID NO: 204926 - DNA, 29 bp, Artificial Sequence
  Description of Artificial Sequence: Synthetic oligonucleotide
gccatcgactgattgtcctgcttgcaagc

SEQ ID NO: 204927 - DNA, 29 bp, Artificial Sequence
  Description of Artificial Sequence: Synthetic oligonucleotide
ccatcgactgattgtcctgcttgcaagcg

SEQ ID NO: 204928 - DNA, 30 bp, Artificial Sequence
  Description of Artificial Sequence: Synthetic oligonucleotide
catcgactgattgtcctgcttgcaagcgac

SEQ ID NO: 204929 - DNA, 33 bp, Artificial Sequence
  Description of Artificial Sequence: Synthetic oligonucleotide
atcgactgattgtcctgcttgcaagcgacattc

SEQ ID NO: 204930 - DNA, 32 bp, Artificial Sequence
  Description of Artificial Sequence: Synthetic oligonucleotide
tcgactgattgtcctgcttgcaagcgacattc

SEQ ID NO: 204931 - DNA, 31 bp, Artificial Sequence
  Description of Artificial Sequence: Synthetic oligonucleotide
cgactgattgtcctgcttgcaagcgacattc

SEQ ID NO: 204932 - DNA, 32 bp, Artificial Sequence
  Description of Artificial Sequence: Synthetic oligonucleotide
gactgattgtcctgcttgcaagcgacattcac

SEQ ID NO: 204933 - DNA, 33 bp, Artificial Sequence
  Description of Artificial Sequence: Synthetic oligonucleotide
actgattgtcctgcttgcaagcgacattcacac

SEQ ID NO: 204934 - DNA, 32 bp, Artificial Sequence
  Description of Artificial Sequence: Synthetic oligonucleotide
ctgattgtcctgcttgcaagcgacattcacac

SEQ ID NO: 204935 - DNA, 32 bp, Artificial Sequence
  Description of Artificial Sequence: Synthetic oligonucleotide
tgattgtcctgcttgcaagcgacattcacacc

SEQ ID NO: 204936 - DNA, 31 bp, Artificial Sequence
  Description of Artificial Sequence: Synthetic oligonucleotide
gattgtcctgcttgcaagcgacattcacacc

SEQ ID NO: 204937 - DNA, 31 bp, Artificial Sequence
  Description of Artificial Sequence: Synthetic oligonucleotide
attgtcctgcttgcaagcgacattcacaccg

SEQ ID NO: 204938 - DNA, 28 bp, Artificial Sequence
  Description of Artificial Sequence: Synthetic oligonucleotide
gttgcttaactgcaggtggagatggggg

SEQ ID NO: 204939 - DNA, 28 bp, Artificial Sequence
  Description of Artificial Sequence: Synthetic oligonucleotide
ttgcttaactgcaggtggagatgggggc

SEQ ID NO: 204940 - DNA, 27 bp, Artificial Sequence
  Description of Artificial Sequence: Synthetic oligonucleotide
tgcttaactgcaggtggagatgggggc

SEQ ID NO: 204941 - DNA, 27 bp, Artificial Sequence
  Description of Artificial Sequence: Synthetic oligonucleotide
gcttaactgcaggtggagatgggggct

SEQ ID NO: 204942 - DNA, 28 bp, Artificial Sequence
  Description of Artificial Sequence: Synthetic oligonucleotide
cttaactgcaggtggagatgggggcttc

SEQ ID NO: 204943 - DNA, 29 bp, Artificial Sequence
  Description of Artificial Sequence: Synthetic oligonucleotide
ttaactgcaggtggagatgggggcttcag

SEQ ID NO: 204944 - DNA, 28 bp, Artificial Sequence
  Description of Artificial Sequence: Synthetic oligonucleotide
taactgcaggtggagatgggggcttcag

SEQ ID NO: 204945 - DNA, 24 bp, Artificial Sequence
  Description of Artificial Sequence: Synthetic oligonucleotide
ctccagccgctgccagctctggtt

SEQ ID NO: 204946 - DNA, 24 bp, Artificial Sequence
  Description of Artificial Sequence: Synthetic oligonucleotide
tccagccgctgccagctctggttg

SEQ ID NO: 204947 - DNA, 39 bp, Artificial Sequence
  Description of Artificial Sequence: Synthetic oligonucleotide
tggacttccttaaactttaaccgaatgctgagacttctg

SEQ ID NO: 204948 - DNA, 38 bp, Artificial Sequence
  Description of Artificial Sequence: Synthetic oligonucleotide
ggacttccttaaactttaaccgaatgctgagacttctg

SEQ ID NO: 204949 - DNA, 40 bp, Artificial Sequence
  Description of Artificial Sequence: Synthetic oligonucleotide
gacttccttaaactttaaccgaatgctgagacttctgatg

SEQ ID NO: 204950 - DNA, 41 bp, Artificial Sequence
  Description of Artificial Sequence: Synthetic oligonucleotide
acttccttaaactttaaccgaatgctgagacttctgatgag

SEQ ID NO: 204951 - DNA, 40 bp, Artificial Sequence
  Description of Artificial Sequence: Synthetic oligonucleotide
cttccttaaactttaaccgaatgctgagacttctgatgag

SEQ ID NO: 204952 - DNA, 24 bp, Artificial Sequence
  Description of Artificial Sequence: Synthetic oligonucleotide
agctcttactgcctgggggctgcc

SEQ ID NO: 204953 - DNA, 23 bp, Artificial Sequence
  Description of Artificial Sequence: Synthetic oligonucleotide
gctcttactgcctgggggctgcc

SEQ ID NO: 204954 - DNA, 23 bp, Artificial Sequence
  Description of Artificial Sequence: Synthetic oligonucleotide
ctcttactgcctgggggctgccc

SEQ ID NO: 204955 - DNA, 23 bp, Artificial Sequence
  Description of Artificial Sequence: Synthetic oligonucleotide
tcttactgcctgggggctgcccc

SEQ ID NO: 204956 - DNA, 22 bp, Artificial Sequence
  Description of Artificial Sequence: Synthetic oligonucleotide
cttactgcctgggggctgcccc

SEQ ID NO: 204957 - DNA, 22 bp, Artificial Sequence
  Description of Artificial Sequence: Synthetic oligonucleotide
ttactgcctgggggctgccccg

SEQ ID NO: 204958 - DNA, 21 bp, Artificial Sequence
  Description of Artificial Sequence: Synthetic oligonucleotide
tactgcctgggggctgccccg

SEQ ID NO: 204959 - DNA, 20 bp, Artificial Sequence
  Description of Artificial Sequence: Synthetic oligonucleotide
actgcctgggggctgccccg

SEQ ID NO: 204960 - DNA, 20 bp, Artificial Sequence
  Description of Artificial Sequence: Synthetic oligonucleotide
ctgcctgggggctgccccgt

SEQ ID NO: 204961 - DNA, 20 bp, Artificial Sequence
  Description of Artificial Sequence: Synthetic oligonucleotide
tgcctgggggctgccccgct

SEQ ID NO: 204962 - DNA, 20 bp, Artificial Sequence
  Description of Artificial Sequence: Synthetic oligonucleotide
gcctgggggctgccccgctt

SEQ ID NO: 204963 - DNA, 20 bp, Artificial Sequence
  Description of Artificial Sequence: Synthetic oligonucleotide
cctgggggctgccccgcctt

SEQ ID NO: 204964 - DNA, 20 bp, Artificial Sequence
  Description of Artificial Sequence: Synthetic oligonucleotide
ctgggggctgccccgcctgt

SEQ ID NO: 204965 - DNA, 21 bp, Artificial Sequence
  Description of Artificial Sequence: Synthetic oligonucleotide
tgggggctgccccgcctgtga

SEQ ID NO: 204966 - DNA, 20 bp, Artificial Sequence
  Description of Artificial Sequence: Synthetic oligonucleotide
gggggctgccccgcctgtga

SEQ ID NO: 204967 - DNA, 22 bp, Artificial Sequence
  Description of Artificial Sequence: Synthetic oligonucleotide
ggggctgccccgcctgtgacaa

SEQ ID NO: 204968 - DNA, 22 bp, Artificial Sequence
  Description of Artificial Sequence: Synthetic oligonucleotide
gggctgccccgcctgtgacaac

SEQ ID NO: 204969 - DNA, 24 bp, Artificial Sequence
  Description of Artificial Sequence: Synthetic oligonucleotide
ggctgccccgcctgtgacaaccat

SEQ ID NO: 204970 - DNA, 24 bp, Artificial Sequence
  Description of Artificial Sequence: Synthetic oligonucleotide
gctgccccgcctgtgacaaccatg

SEQ ID NO: 204971 - DNA, 24 bp, Artificial Sequence
  Description of Artificial Sequence: Synthetic oligonucleotide
ctgccccgcctgtgacaaccatgc

SEQ ID NO: 204972 - DNA, 24 bp, Artificial Sequence
  Description of Artificial Sequence: Synthetic oligonucleotide
tgccccgcctgtgacaaccatgcc

SEQ ID NO: 204973 - DNA, 23 bp, Artificial Sequence
  Description of Artificial Sequence: Synthetic oligonucleotide
gccccgcctgtgacaaccatgcc

SEQ ID NO: 204974 - DNA, 24 bp, Artificial Sequence
  Description of Artificial Sequence: Synthetic oligonucleotide
ccccgcctgtgacaaccatgccct

SEQ ID NO: 204975 - DNA, 24 bp, Artificial Sequence
  Description of Artificial Sequence: Synthetic oligonucleotide
cccgcctgtgacaaccatgccctc

SEQ ID NO: 204976 - DNA, 25 bp, Artificial Sequence
  Description of Artificial Sequence: Synthetic oligonucleotide
ccgcctgtgacaaccatgccctcca

SEQ ID NO: 204977 - DNA, 34 bp, Artificial Sequence
  Description of Artificial Sequence: Synthetic oligonucleotide
cagaacctccttcaatgactccctcacattcttg

SEQ ID NO: 204978 - DNA, 34 bp, Artificial Sequence
  Description of Artificial Sequence: Synthetic oligonucleotide
agaacctccttcaatgactccctcacattcttgg

SEQ ID NO: 204979 - DNA, 33 bp, Artificial Sequence
  Description of Artificial Sequence: Synthetic oligonucleotide
gaacctccttcaatgactccctcacattcttgg

SEQ ID NO: 204980 - DNA, 34 bp, Artificial Sequence
  Description of Artificial Sequence: Synthetic oligonucleotide
aacctccttcaatgactccctcacattcttggag

SEQ ID NO: 204981 - DNA, 33 bp, Artificial Sequence
  Description of Artificial Sequence: Synthetic oligonucleotide
acctccttcaatgactccctcacattcttggag

SEQ ID NO: 204982 - DNA, 32 bp, Artificial Sequence
  Description of Artificial Sequence: Synthetic oligonucleotide
cctccttcaatgactccctcacattcttggag

SEQ ID NO: 204983 - DNA, 35 bp, Artificial Sequence
  Description of Artificial Sequence: Synthetic oligonucleotide
ctccttcaatgactccctcacattcttggagaatg

SEQ ID NO: 204984 - DNA, 35 bp, Artificial Sequence
  Description of Artificial Sequence: Synthetic oligonucleotide
tccttcaatgactccctcacattcttggagaatgc

SEQ ID NO: 204985 - DNA, 34 bp, Artificial Sequence
  Description of Artificial Sequence: Synthetic oligonucleotide
ccttcaatgactccctcacattcttggagaatgc

SEQ ID NO: 204986 - DNA, 35 bp, Artificial Sequence
  Description of Artificial Sequence: Synthetic oligonucleotide
cttcaatgactccctcacattcttggagaatgctg

SEQ ID NO: 204987 - DNA, 35 bp, Artificial Sequence
  Description of Artificial Sequence: Synthetic oligonucleotide
ttcaatgactccctcacattcttggagaatgctgc

SEQ ID NO: 204988 - DNA, 34 bp, Artificial Sequence
  Description of Artificial Sequence: Synthetic oligonucleotide
tcaatgactccctcacattcttggagaatgctgc

SEQ ID NO: 204989 - DNA, 33 bp, Artificial Sequence
  Description of Artificial Sequence: Synthetic oligonucleotide
caatgactccctcacattcttggagaatgctgc

SEQ ID NO: 204990 - DNA, 34 bp, Artificial Sequence
  Description of Artificial Sequence: Synthetic oligonucleotide
aatgactccctcacattcttggagaatgctgcag

SEQ ID NO: 204991 - DNA, 33 bp, Artificial Sequence
  Description of Artificial Sequence: Synthetic oligonucleotide
atgactccctcacattcttggagaatgctgcag

SEQ ID NO: 204992 - DNA, 32 bp, Artificial Sequence
  Description of Artificial Sequence: Synthetic oligonucleotide
tgactccctcacattcttggagaatgctgcag

SEQ ID NO: 204993 - DNA, 31 bp, Artificial Sequence
  Description of Artificial Sequence: Synthetic oligonucleotide
gactccctcacattcttggagaatgctgcag

SEQ ID NO: 204994 - DNA, 32 bp, Artificial Sequence
  Description of Artificial Sequence: Synthetic oligonucleotide
actccctcacattcttggagaatgctgcagac

SEQ ID NO: 204995 - DNA, 31 bp, Artificial Sequence
  Description of Artificial Sequence: Synthetic oligonucleotide
ctccctcacattcttggagaatgctgcagac

SEQ ID NO: 204996 - DNA, 31 bp, Artificial Sequence
  Description of Artificial Sequence: Synthetic oligonucleotide
tccctcacattcttggagaatgctgcagacg

SEQ ID NO: 204997 - DNA, 30 bp, Artificial Sequence
  Description of Artificial Sequence: Synthetic oligonucleotide
ccctcacattcttggagaatgctgcagacg

SEQ ID NO: 204998 - DNA, 32 bp, Artificial Sequence
  Description of Artificial Sequence: Synthetic oligonucleotide
cctcacattcttggagaatgctgcagacgttg

SEQ ID NO: 204999 - DNA, 32 bp, Artificial Sequence
  Description of Artificial Sequence: Synthetic oligonucleotide
ctcacattcttggagaatgctgcagacgttgg

SEQ ID NO: 205000 - DNA, 32 bp, Artificial Sequence
  Description of Artificial Sequence: Synthetic oligonucleotide
tcacattcttggagaatgctgcagacgttggg

SEQ ID NO: 205001 - DNA, 31 bp, Artificial Sequence
  Description of Artificial Sequence: Synthetic oligonucleotide
cacattcttggagaatgctgcagacgttggg

SEQ ID NO: 205002 - DNA, 31 bp, Artificial Sequence
  Description of Artificial Sequence: Synthetic oligonucleotide
acattcttggagaatgctgcagacgttgggg

SEQ ID NO: 205003 - DNA, 30 bp, Artificial Sequence
  Description of Artificial Sequence: Synthetic oligonucleotide
cattcttggagaatgctgcagacgttgggg

SEQ ID NO: 205004 - DNA, 30 bp, Artificial Sequence
  Description of Artificial Sequence: Synthetic oligonucleotide
attcttggagaatgctgcagacgttggggg

SEQ ID NO: 205005 - DNA, 29 bp, Artificial Sequence
  Description of Artificial Sequence: Synthetic oligonucleotide
ttcttggagaatgctgcagacgttggggg

SEQ ID NO: 205006 - DNA, 28 bp, Artificial Sequence
  Description of Artificial Sequence: Synthetic oligonucleotide
tcttggagaatgctgcagacgttggggg

SEQ ID NO: 205007 - DNA, 27 bp, Artificial Sequence
  Description of Artificial Sequence: Synthetic oligonucleotide
cttggagaatgctgcagacgttggggg

SEQ ID NO: 205008 - DNA, 27 bp, Artificial Sequence
  Description of Artificial Sequence: Synthetic oligonucleotide
ttggagaatgctgcagacgttgggggg

SEQ ID NO: 205009 - DNA, 26 bp, Artificial Sequence
  Description of Artificial Sequence: Synthetic oligonucleotide
tggagaatgctgcagacgttgggggg

SEQ ID NO: 205010 - DNA, 25 bp, Artificial Sequence
  Description of Artificial Sequence: Synthetic oligonucleotide
ggagaatgctgcagacgttgggggg

SEQ ID NO: 205011 - DNA, 26 bp, Artificial Sequence
  Description of Artificial Sequence: Synthetic oligonucleotide
atgggggcctcttctccaagaagccc

SEQ ID NO: 205012 - DNA, 25 bp, Artificial Sequence
  Description of Artificial Sequence: Synthetic oligonucleotide
tgggggcctcttctccaagaagccc

SEQ ID NO: 205013 - DNA, 24 bp, Artificial Sequence
  Description of Artificial Sequence: Synthetic oligonucleotide
gggggcctcttctccaagaagccc

SEQ ID NO: 205014 - DNA, 24 bp, Artificial Sequence
  Description of Artificial Sequence: Synthetic oligonucleotide
ggggcctcttctccaagaagcccg

SEQ ID NO: 205015 - DNA, 25 bp, Artificial Sequence
  Description of Artificial Sequence: Synthetic oligonucleotide
gggcctcttctccaagaagcccgga

SEQ ID NO: 205016 - DNA, 25 bp, Artificial Sequence
  Description of Artificial Sequence: Synthetic oligonucleotide
ggcctcttctccaagaagcccggag

SEQ ID NO: 205017 - DNA, 25 bp, Artificial Sequence
  Description of Artificial Sequence: Synthetic oligonucleotide
gcctcttctccaagaagcccggagc

SEQ ID NO: 205018 - DNA, 26 bp, Artificial Sequence
  Description of Artificial Sequence: Synthetic oligonucleotide
cctcttctccaagaagcccggagcct

SEQ ID NO: 205019 - DNA, 27 bp, Artificial Sequence
  Description of Artificial Sequence: Synthetic oligonucleotide
ctcttctccaagaagcccggagcctgt

SEQ ID NO: 205020 - DNA, 27 bp, Artificial Sequence
  Description of Artificial Sequence: Synthetic oligonucleotide
tcttctccaagaagcccggagcctgtc

SEQ ID NO: 205021 - DNA, 26 bp, Artificial Sequence
  Description of Artificial Sequence: Synthetic oligonucleotide
cttctccaagaagcccggagcctgtc

SEQ ID NO: 205022 - DNA, 26 bp, Artificial Sequence
  Description of Artificial Sequence: Synthetic oligonucleotide
ttctccaagaagcccggagcctgtcg

SEQ ID NO: 205023 - DNA, 25 bp, Artificial Sequence
  Description of Artificial Sequence: Synthetic oligonucleotide
tctccaagaagcccggagcctgtcg

SEQ ID NO: 205024 - DNA, 24 bp, Artificial Sequence
  Description of Artificial Sequence: Synthetic oligonucleotide
ctccaagaagcccggagcctgtcg

SEQ ID NO: 205025 - DNA, 24 bp, Artificial Sequence
  Description of Artificial Sequence: Synthetic oligonucleotide
tccaagaagcccggagcctgtcgg

SEQ ID NO: 205026 - DNA, 23 bp, Artificial Sequence
  Description of Artificial Sequence: Synthetic oligonucleotide
ccaagaagcccggagcctgtcgg

SEQ ID NO: 205027 - DNA, 23 bp, Artificial Sequence
  Description of Artificial Sequence: Synthetic oligonucleotide
caagaagcccggagcctgtcggg

SEQ ID NO: 205028 - DNA, 23 bp, Artificial Sequence
  Description of Artificial Sequence: Synthetic oligonucleotide
aagaagcccggagcctgtcgggc

SEQ ID NO: 205029 - DNA, 22 bp, Artificial Sequence
  Description of Artificial Sequence: Synthetic oligonucleotide
agaagcccggagcctgtcgggc

SEQ ID NO: 205030 - DNA, 21 bp, Artificial Sequence
  Description of Artificial Sequence: Synthetic oligonucleotide
gaagcccggagcctgtcgggc

SEQ ID NO: 205031 - DNA, 21 bp, Artificial Sequence
  Description of Artificial Sequence: Synthetic oligonucleotide
aagcccggagcctgtcgggcc

SEQ ID NO: 205032 - DNA, 20 bp, Artificial Sequence
  Description of Artificial Sequence: Synthetic oligonucleotide
agcccggagcctgtcgggcc

SEQ ID NO: 205033 - DNA, 20 bp, Artificial Sequence
  Description of Artificial Sequence: Synthetic oligonucleotide
gcccggagcctgtcgggcct

SEQ ID NO: 205034 - DNA, 20 bp, Artificial Sequence
  Description of Artificial Sequence: Synthetic oligonucleotide
cccggagcctgtcgggccgt

SEQ ID NO: 205035 - DNA, 20 bp, Artificial Sequence
  Description of Artificial Sequence: Synthetic oligonucleotide
ccggagcctgtcgggccgct

SEQ ID NO: 205036 - DNA, 20 bp, Artificial Sequence
  Description of Artificial Sequence: Synthetic oligonucleotide
cggagcctgtcgggccgcct

SEQ ID NO: 205037 - DNA, 20 bp, Artificial Sequence
  Description of Artificial Sequence: Synthetic oligonucleotide
ggagcctgtcgggccgccgt

SEQ ID NO: 205038 - DNA, 20 bp, Artificial Sequence
  Description of Artificial Sequence: Synthetic oligonucleotide
gagcctgtcgggccgccggt

SEQ ID NO: 205039 - DNA, 20 bp, Artificial Sequence
  Description of Artificial Sequence: Synthetic oligonucleotide
agcctgtcgggccgccggct

SEQ ID NO: 205040 - DNA, 20 bp, Artificial Sequence
  Description of Artificial Sequence: Synthetic oligonucleotide
gcctgtcgggccgccggctt

SEQ ID NO: 205041 - DNA, 20 bp, Artificial Sequence
  Description of Artificial Sequence: Synthetic oligonucleotide
cctgtcgggccgccggcgtt

SEQ ID NO: 205042 - DNA, 20 bp, Artificial Sequence
  Description of Artificial Sequence: Synthetic oligonucleotide
ctgtcgggccgccggcgctt

SEQ ID NO: 205043 - DNA, 20 bp, Artificial Sequence
  Description of Artificial Sequence: Synthetic oligonucleotide
tgtcgggccgccggcgcctt

SEQ ID NO: 205044 - DNA, 20 bp, Artificial Sequence
  Description of Artificial Sequence: Synthetic oligonucleotide
gtcgggccgccggcgccttt

SEQ ID NO: 205045 - DNA, 20 bp, Artificial Sequence
  Description of Artificial Sequence: Synthetic oligonucleotide
tcgggccgccggcgcccttt

SEQ ID NO: 205046 - DNA, 20 bp, Artificial Sequence
  Description of Artificial Sequence: Synthetic oligonucleotide
cgggccgccggcgccctttt

SEQ ID NO: 205047 - DNA, 20 bp, Artificial Sequence
  Description of Artificial Sequence: Synthetic oligonucleotide
gggccgccggcgcccgtttt

SEQ ID NO: 205048 - DNA, 20 bp, Artificial Sequence
  Description of Artificial Sequence: Synthetic oligonucleotide
ggccgccggcgcccggtttt

SEQ ID NO: 205049 - DNA, 20 bp, Artificial Sequence
  Description of Artificial Sequence: Synthetic oligonucleotide
gccgccggcgcccggtcttt

SEQ ID NO: 205050 - DNA, 20 bp, Artificial Sequence
  Description of Artificial Sequence: Synthetic oligonucleotide
ccgccggcgcccggtctctt

SEQ ID NO: 205051 - DNA, 20 bp, Artificial Sequence
  Description of Artificial Sequence: Synthetic oligonucleotide
cgccggcgcccggtctcctt

SEQ ID NO: 205052 - DNA, 20 bp, Artificial Sequence
  Description of Artificial Sequence: Synthetic oligonucleotide
gccggcgcccggtctccctt

SEQ ID NO: 205053 - DNA, 20 bp, Artificial Sequence
  Description of Artificial Sequence: Synthetic oligonucleotide
ccggcgcccggtctcccctt

SEQ ID NO: 205054 - DNA, 21 bp, Artificial Sequence
  Description of Artificial Sequence: Synthetic oligonucleotide
cggcgcccggtctccccttct

SEQ ID NO: 205055 - DNA, 21 bp, Artificial Sequence
  Description of Artificial Sequence: Synthetic oligonucleotide
ggcgcccggtctccccttctg

SEQ ID NO: 205056 - DNA, 22 bp, Artificial Sequence
  Description of Artificial Sequence: Synthetic oligonucleotide
gcgcccggtctccccttctgct

SEQ ID NO: 205057 - DNA, 22 bp, Artificial Sequence
  Description of Artificial Sequence: Synthetic oligonucleotide
cgcccggtctccccttctgctg

SEQ ID NO: 205058 - DNA, 22 bp, Artificial Sequence
  Description of Artificial Sequence: Synthetic oligonucleotide
gcccggtctccccttctgctgc

SEQ ID NO: 205059 - DNA, 22 bp, Artificial Sequence
  Description of Artificial Sequence: Synthetic oligonucleotide
cccggtctccccttctgctgcg

SEQ ID NO: 205060 - DNA, 23 bp, Artificial Sequence
  Description of Artificial Sequence: Synthetic oligonucleotide
ccggtctccccttctgctgcgga

SEQ ID NO: 205061 - DNA, 23 bp, Artificial Sequence
  Description of Artificial Sequence: Synthetic oligonucleotide
cggtctccccttctgctgcggag

SEQ ID NO: 205062 - DNA, 25 bp, Artificial Sequence
  Description of Artificial Sequence: Synthetic oligonucleotide
ggtctccccttctgctgcggaggat

SEQ ID NO: 205063 - DNA, 25 bp, Artificial Sequence
  Description of Artificial Sequence: Synthetic oligonucleotide
gtctccccttctgctgcggaggatc

SEQ ID NO: 205064 - DNA, 25 bp, Artificial Sequence
  Description of Artificial Sequence: Synthetic oligonucleotide
tctccccttctgctgcggaggatcc

SEQ ID NO: 205065 - DNA, 24 bp, Artificial Sequence
  Description of Artificial Sequence: Synthetic oligonucleotide
ctccccttctgctgcggaggatcc

SEQ ID NO: 205066 - DNA, 25 bp, Artificial Sequence
  Description of Artificial Sequence: Synthetic oligonucleotide
tccccttctgctgcggaggatccct

SEQ ID NO: 205067 - DNA, 24 bp, Artificial Sequence
  Description of Artificial Sequence: Synthetic oligonucleotide
ccccttctgctgcggaggatccct

SEQ ID NO: 205068 - DNA, 24 bp, Artificial Sequence
  Description of Artificial Sequence: Synthetic oligonucleotide
cccttctgctgcggaggatccctg

SEQ ID NO: 205069 - DNA, 25 bp, Artificial Sequence
  Description of Artificial Sequence: Synthetic oligonucleotide
ccttctgctgcggaggatccctgct

SEQ ID NO: 205070 - DNA, 25 bp, Artificial Sequence
  Description of Artificial Sequence: Synthetic oligonucleotide
cttctgctgcggaggatccctgctg

SEQ ID NO: 205071 - DNA, 25 bp, Artificial Sequence
  Description of Artificial Sequence: Synthetic oligonucleotide
ttctgctgcggaggatccctgctgg

SEQ ID NO: 205072 - DNA, 24 bp, Artificial Sequence
  Description of Artificial Sequence: Synthetic oligonucleotide
tctgctgcggaggatccctgctgg

SEQ ID NO: 205073 - DNA, 23 bp, Artificial Sequence
  Description of Artificial Sequence: Synthetic oligonucleotide
ctgctgcggaggatccctgctgg

SEQ ID NO: 205074 - DNA, 23 bp, Artificial Sequence
  Description of Artificial Sequence: Synthetic oligonucleotide
tgctgcggaggatccctgctggc

SEQ ID NO: 205075 - DNA, 22 bp, Artificial Sequence
  Description of Artificial Sequence: Synthetic oligonucleotide
gctgcggaggatccctgctggc

SEQ ID NO: 205076 - DNA, 22 bp, Artificial Sequence
  Description of Artificial Sequence: Synthetic oligonucleotide
ctgcggaggatccctgctggcg

SEQ ID NO: 205077 - DNA, 24 bp, Artificial Sequence
  Description of Artificial Sequence: Synthetic oligonucleotide
tgcggaggatccctgctggcggtt

SEQ ID NO: 205078 - DNA, 23 bp, Artificial Sequence
  Description of Artificial Sequence: Synthetic oligonucleotide
gcggaggatccctgctggcggtt

SEQ ID NO: 205079 - DNA, 24 bp, Artificial Sequence
  Description of Artificial Sequence: Synthetic oligonucleotide
cggaggatccctgctggcggttgt

SEQ ID NO: 205080 - DNA, 24 bp, Artificial Sequence
  Description of Artificial Sequence: Synthetic oligonucleotide
ggaggatccctgctggcggttgtg

SEQ ID NO: 205081 - DNA, 25 bp, Artificial Sequence
  Description of Artificial Sequence: Synthetic oligonucleotide
gaggatccctgctggcggttgtggt

SEQ ID NO: 205082 - DNA, 25 bp, Artificial Sequence
  Description of Artificial Sequence: Synthetic oligonucleotide
aggatccctgctggcggttgtggtg

SEQ ID NO: 205083 - DNA, 24 bp, Artificial Sequence
  Description of Artificial Sequence: Synthetic oligonucleotide
ggatccctgctggcggttgtggtg

SEQ ID NO: 205084 - DNA, 25 bp, Artificial Sequence
  Description of Artificial Sequence: Synthetic oligonucleotide
gatccctgctggcggttgtggtgct

SEQ ID NO: 205085 - DNA, 25 bp, Artificial Sequence
  Description of Artificial Sequence: Synthetic oligonucleotide
atccctgctggcggttgtggtgctg

SEQ ID NO: 205086 - DNA, 24 bp, Artificial Sequence
  Description of Artificial Sequence: Synthetic oligonucleotide
tccctgctggcggttgtggtgctg

SEQ ID NO: 205087 - DNA, 23 bp, Artificial Sequence
  Description of Artificial Sequence: Synthetic oligonucleotide
ccctgctggcggttgtggtgctg

SEQ ID NO: 205088 - DNA, 25 bp, Artificial Sequence
  Description of Artificial Sequence: Synthetic oligonucleotide
cctgctggcggttgtggtgctgctt

SEQ ID NO: 205089 - DNA, 25 bp, Artificial Sequence
  Description of Artificial Sequence: Synthetic oligonucleotide
ctgctggcggttgtggtgctgcttg

SEQ ID NO: 205090 - DNA, 25 bp, Artificial Sequence
  Description of Artificial Sequence: Synthetic oligonucleotide
tgctggcggttgtggtgctgcttgc

SEQ ID NO: 205091 - DNA, 24 bp, Artificial Sequence
  Description of Artificial Sequence: Synthetic oligonucleotide
gctggcggttgtggtgctgcttgc

SEQ ID NO: 205092 - DNA, 24 bp, Artificial Sequence
  Description of Artificial Sequence: Synthetic oligonucleotide
ctggcggttgtggtgctgcttgcg

SEQ ID NO: 205093 - DNA, 25 bp, Artificial Sequence
  Description of Artificial Sequence: Synthetic oligonucleotide
tggcggttgtggtgctgcttgcgct

SEQ ID NO: 205094 - DNA, 24 bp, Artificial Sequence
  Description of Artificial Sequence: Synthetic oligonucleotide
ggcggttgtggtgctgcttgcgct

SEQ ID NO: 205095 - DNA, 24 bp, Artificial Sequence
  Description of Artificial Sequence: Synthetic oligonucleotide
gcggttgtggtgctgcttgcgctg

SEQ ID NO: 205096 - DNA, 24 bp, Artificial Sequence
  Description of Artificial Sequence: Synthetic oligonucleotide
cggttgtggtgctgcttgcgctgc

SEQ ID NO: 205097 - DNA, 24 bp, Artificial Sequence
  Description of Artificial Sequence: Synthetic oligonucleotide
ggttgtggtgctgcttgcgctgcc

SEQ ID NO: 205098 - DNA, 24 bp, Artificial Sequence
  Description of Artificial Sequence: Synthetic oligonucleotide
gttgtggtgctgcttgcgctgccg

SEQ ID NO: 205099 - DNA, 25 bp, Artificial Sequence
  Description of Artificial Sequence: Synthetic oligonucleotide
ttgtggtgctgcttgcgctgccggt

SEQ ID NO: 205100 - DNA, 24 bp, Artificial Sequence
  Description of Artificial Sequence: Synthetic oligonucleotide
tgtggtgctgcttgcgctgccggt

SEQ ID NO: 205101 - DNA, 23 bp, Artificial Sequence
  Description of Artificial Sequence: Synthetic oligonucleotide
gtggtgctgcttgcgctgccggt

SEQ ID NO: 205102 - DNA, 23 bp, Artificial Sequence
  Description of Artificial Sequence: Synthetic oligonucleotide
tggtgctgcttgcgctgccggtg

SEQ ID NO: 205103 - DNA, 22 bp, Artificial Sequence
  Description of Artificial Sequence: Synthetic oligonucleotide
ggtgctgcttgcgctgccggtg

SEQ ID NO: 205104 - DNA, 22 bp, Artificial Sequence
  Description of Artificial Sequence: Synthetic oligonucleotide
gtgctgcttgcgctgccggtgg

SEQ ID NO: 205105 - DNA, 22 bp, Artificial Sequence
  Description of Artificial Sequence: Synthetic oligonucleotide
tgctgcttgcgctgccggtggc

SEQ ID NO: 205106 - DNA, 21 bp, Artificial Sequence
  Description of Artificial Sequence: Synthetic oligonucleotide
gctgcttgcgctgccggtggc

SEQ ID NO: 205107 - DNA, 22 bp, Artificial Sequence
  Description of Artificial Sequence: Synthetic oligonucleotide
ctgcttgcgctgccggtggcct

SEQ ID NO: 205108 - DNA, 22 bp, Artificial Sequence
  Description of Artificial Sequence: Synthetic oligonucleotide
tgcttgcgctgccggtggcctg

SEQ ID NO: 205109 - DNA, 21 bp, Artificial Sequence
  Description of Artificial Sequence: Synthetic oligonucleotide
gcttgcgctgccggtggcctg

SEQ ID NO: 205110 - DNA, 21 bp, Artificial Sequence
  Description of Artificial Sequence: Synthetic oligonucleotide
cttgcgctgccggtggcctgg

SEQ ID NO: 205111 - DNA, 21 bp, Artificial Sequence
  Description of Artificial Sequence: Synthetic oligonucleotide
ttgcgctgccggtggcctggg

SEQ ID NO: 205112 - DNA, 20 bp, Artificial Sequence
  Description of Artificial Sequence: Synthetic oligonucleotide
tgcgctgccggtggcctggg

SEQ ID NO: 205113 - DNA, 20 bp, Artificial Sequence
  Description of Artificial Sequence: Synthetic oligonucleotide
gcgctgccggtggcctgggt

SEQ ID NO: 205114 - DNA, 20 bp, Artificial Sequence
  Description of Artificial Sequence: Synthetic oligonucleotide
cgctgccggtggcctggggt

SEQ ID NO: 205115 - DNA, 23 bp, Artificial Sequence
  Description of Artificial Sequence: Synthetic oligonucleotide
gctgccggtggcctggggtcaat

SEQ ID NO: 205116 - DNA, 23 bp, Artificial Sequence
  Description of Artificial Sequence: Synthetic oligonucleotide
ctgccggtggcctggggtcaatg

SEQ ID NO: 205117 - DNA, 26 bp, Artificial Sequence
  Description of Artificial Sequence: Synthetic oligonucleotide
tgccggtggcctggggtcaatgcaat

SEQ ID NO: 205118 - DNA, 25 bp, Artificial Sequence
  Description of Artificial Sequence: Synthetic oligonucleotide
gccggtggcctggggtcaatgcaat

SEQ ID NO: 205119 - DNA, 25 bp, Artificial Sequence
  Description of Artificial Sequence: Synthetic oligonucleotide
ccggtggcctggggtcaatgcaatg

SEQ ID NO: 205120 - DNA, 25 bp, Artificial Sequence
  Description of Artificial Sequence: Synthetic oligonucleotide
cggtggcctggggtcaatgcaatgc

SEQ ID NO: 205121 - DNA, 25 bp, Artificial Sequence
  Description of Artificial Sequence: Synthetic oligonucleotide
ggtggcctggggtcaatgcaatgcc

SEQ ID NO: 205122 - DNA, 25 bp, Artificial Sequence
  Description of Artificial Sequence: Synthetic oligonucleotide
gtggcctggggtcaatgcaatgccc

SEQ ID NO: 205123 - DNA, 26 bp, Artificial Sequence
  Description of Artificial Sequence: Synthetic oligonucleotide
tggcctggggtcaatgcaatgcccca

SEQ ID NO: 205124 - DNA, 25 bp, Artificial Sequence
  Description of Artificial Sequence: Synthetic oligonucleotide
ggcctggggtcaatgcaatgcccca

SEQ ID NO: 205125 - DNA, 27 bp, Artificial Sequence
  Description of Artificial Sequence: Synthetic oligonucleotide
gcctggggtcaatgcaatgccccagaa

SEQ ID NO: 205126 - DNA, 28 bp, Artificial Sequence
  Description of Artificial Sequence: Synthetic oligonucleotide
cctggggtcaatgcaatgccccagaatg

SEQ ID NO: 205127 - DNA, 28 bp, Artificial Sequence
  Description of Artificial Sequence: Synthetic oligonucleotide
ctggggtcaatgcaatgccccagaatgg

SEQ ID NO: 205128 - DNA, 28 bp, Artificial Sequence
  Description of Artificial Sequence: Synthetic oligonucleotide
tggggtcaatgcaatgccccagaatggc

SEQ ID NO: 205129 - DNA, 27 bp, Artificial Sequence
  Description of Artificial Sequence: Synthetic oligonucleotide
ggggtcaatgcaatgccccagaatggc

SEQ ID NO: 205130 - DNA, 29 bp, Artificial Sequence
  Description of Artificial Sequence: Synthetic oligonucleotide
gggtcaatgcaatgccccagaatggcttc

SEQ ID NO: 205131 - DNA, 29 bp, Artificial Sequence
  Description of Artificial Sequence: Synthetic oligonucleotide
ggtcaatgcaatgccccagaatggcttcc

SEQ ID NO: 205132 - DNA, 33 bp, Artificial Sequence
  Description of Artificial Sequence: Synthetic oligonucleotide
gtcaatgcaatgccccagaatggcttccatttg

SEQ ID NO: 205133 - DNA, 33 bp, Artificial Sequence
  Description of Artificial Sequence: Synthetic oligonucleotide
tcaatgcaatgccccagaatggcttccatttgc

SEQ ID NO: 205134 - DNA, 32 bp, Artificial Sequence
  Description of Artificial Sequence: Synthetic oligonucleotide
caatgcaatgccccagaatggcttccatttgc

SEQ ID NO: 205135 - DNA, 32 bp, Artificial Sequence
  Description of Artificial Sequence: Synthetic oligonucleotide
aatgcaatgccccagaatggcttccatttgcc

SEQ ID NO: 205136 - DNA, 31 bp, Artificial Sequence
  Description of Artificial Sequence: Synthetic oligonucleotide
atgcaatgccccagaatggcttccatttgcc

SEQ ID NO: 205137 - DNA, 30 bp, Artificial Sequence
  Description of Artificial Sequence: Synthetic oligonucleotide
tgcaatgccccagaatggcttccatttgcc

SEQ ID NO: 205138 - DNA, 29 bp, Artificial Sequence
  Description of Artificial Sequence: Synthetic oligonucleotide
gcaatgccccagaatggcttccatttgcc

SEQ ID NO: 205139 - DNA, 30 bp, Artificial Sequence
  Description of Artificial Sequence: Synthetic oligonucleotide
caatgccccagaatggcttccatttgccag

SEQ ID NO: 205140 - DNA, 30 bp, Artificial Sequence
  Description of Artificial Sequence: Synthetic oligonucleotide
aatgccccagaatggcttccatttgccagg

SEQ ID NO: 205141 - DNA, 29 bp, Artificial Sequence
  Description of Artificial Sequence: Synthetic oligonucleotide
atgccccagaatggcttccatttgccagg

SEQ ID NO: 205142 - DNA, 28 bp, Artificial Sequence
  Description of Artificial Sequence: Synthetic oligonucleotide
tgccccagaatggcttccatttgccagg

SEQ ID NO: 205143 - DNA, 27 bp, Artificial Sequence
  Description of Artificial Sequence: Synthetic oligonucleotide
gccccagaatggcttccatttgccagg

SEQ ID NO: 205144 - DNA, 27 bp, Artificial Sequence
  Description of Artificial Sequence: Synthetic oligonucleotide
ccccagaatggcttccatttgccaggc

SEQ ID NO: 205145 - DNA, 27 bp, Artificial Sequence
  Description of Artificial Sequence: Synthetic oligonucleotide
cccagaatggcttccatttgccaggcc

SEQ ID NO: 205146 - DNA, 29 bp, Artificial Sequence
  Description of Artificial Sequence: Synthetic oligonucleotide
ccagaatggcttccatttgccaggcctac

SEQ ID NO: 205147 - DNA, 29 bp, Artificial Sequence
  Description of Artificial Sequence: Synthetic oligonucleotide
cagaatggcttccatttgccaggcctacc

SEQ ID NO: 205148 - DNA, 31 bp, Artificial Sequence
  Description of Artificial Sequence: Synthetic oligonucleotide
agaatggcttccatttgccaggcctaccaac

SEQ ID NO: 205149 - DNA, 30 bp, Artificial Sequence
  Description of Artificial Sequence: Synthetic oligonucleotide
gaatggcttccatttgccaggcctaccaac

SEQ ID NO: 205150 - DNA, 30 bp, Artificial Sequence
  Description of Artificial Sequence: Synthetic oligonucleotide
aatggcttccatttgccaggcctaccaacc

SEQ ID NO: 205151 - DNA, 29 bp, Artificial Sequence
  Description of Artificial Sequence: Synthetic oligonucleotide
atggcttccatttgccaggcctaccaacc

SEQ ID NO: 205152 - DNA, 28 bp, Artificial Sequence
  Description of Artificial Sequence: Synthetic oligonucleotide
tggcttccatttgccaggcctaccaacc

SEQ ID NO: 205153 - DNA, 27 bp, Artificial Sequence
  Description of Artificial Sequence: Synthetic oligonucleotide
ggcttccatttgccaggcctaccaacc

SEQ ID NO: 205154 - DNA, 30 bp, Artificial Sequence
  Description of Artificial Sequence: Synthetic oligonucleotide
gcttccatttgccaggcctaccaacctaac

SEQ ID NO: 205155 - DNA, 31 bp, Artificial Sequence
  Description of Artificial Sequence: Synthetic oligonucleotide
cttccatttgccaggcctaccaacctaactg

SEQ ID NO: 205156 - DNA, 33 bp, Artificial Sequence
  Description of Artificial Sequence: Synthetic oligonucleotide
ttccatttgccaggcctaccaacctaactgatg

SEQ ID NO: 205157 - DNA, 32 bp, Artificial Sequence
  Description of Artificial Sequence: Synthetic oligonucleotide
tccatttgccaggcctaccaacctaactgatg

SEQ ID NO: 205158 - DNA, 31 bp, Artificial Sequence
  Description of Artificial Sequence: Synthetic oligonucleotide
ccatttgccaggcctaccaacctaactgatg

SEQ ID NO: 205159 - DNA, 36 bp, Artificial Sequence
  Description of Artificial Sequence: Synthetic oligonucleotide
catttgccaggcctaccaacctaactgatgaatttg

SEQ ID NO: 205160 - DNA, 37 bp, Artificial Sequence
  Description of Artificial Sequence: Synthetic oligonucleotide
atttgccaggcctaccaacctaactgatgaatttgag

SEQ ID NO: 205161 - DNA, 36 bp, Artificial Sequence
  Description of Artificial Sequence: Synthetic oligonucleotide
tttgccaggcctaccaacctaactgatgaatttgag

SEQ ID NO: 205162 - DNA, 35 bp, Artificial Sequence
  Description of Artificial Sequence: Synthetic oligonucleotide
ttgccaggcctaccaacctaactgatgaatttgag

SEQ ID NO: 205163 - DNA, 34 bp, Artificial Sequence
  Description of Artificial Sequence: Synthetic oligonucleotide
tgccaggcctaccaacctaactgatgaatttgag

SEQ ID NO: 205164 - DNA, 33 bp, Artificial Sequence
  Description of Artificial Sequence: Synthetic oligonucleotide
gccaggcctaccaacctaactgatgaatttgag

SEQ ID NO: 205165 - DNA, 36 bp, Artificial Sequence
  Description of Artificial Sequence: Synthetic oligonucleotide
ccaggcctaccaacctaactgatgaatttgagtttc

SEQ ID NO: 205166 - DNA, 36 bp, Artificial Sequence
  Description of Artificial Sequence: Synthetic oligonucleotide
caggcctaccaacctaactgatgaatttgagtttcc

SEQ ID NO: 205167 - DNA, 36 bp, Artificial Sequence
  Description of Artificial Sequence: Synthetic oligonucleotide
aggcctaccaacctaactgatgaatttgagtttccc

SEQ ID NO: 205168 - DNA, 35 bp, Artificial Sequence
  Description of Artificial Sequence: Synthetic oligonucleotide
ggcctaccaacctaactgatgaatttgagtttccc

SEQ ID NO: 205169 - DNA, 38 bp, Artificial Sequence
  Description of Artificial Sequence: Synthetic oligonucleotide
gcctaccaacctaactgatgaatttgagtttcccattg

SEQ ID NO: 205170 - DNA, 38 bp, Artificial Sequence
  Description of Artificial Sequence: Synthetic oligonucleotide
cctaccaacctaactgatgaatttgagtttcccattgg

SEQ ID NO: 205171 - DNA, 38 bp, Artificial Sequence
  Description of Artificial Sequence: Synthetic oligonucleotide
ctaccaacctaactgatgaatttgagtttcccattggg

SEQ ID NO: 205172 - DNA, 39 bp, Artificial Sequence
  Description of Artificial Sequence: Synthetic oligonucleotide
taccaacctaactgatgaatttgagtttcccattgggac

SEQ ID NO: 205173 - DNA, 38 bp, Artificial Sequence
  Description of Artificial Sequence: Synthetic oligonucleotide
accaacctaactgatgaatttgagtttcccattgggac

SEQ ID NO: 205174 - DNA, 37 bp, Artificial Sequence
  Description of Artificial Sequence: Synthetic oligonucleotide
ccaacctaactgatgaatttgagtttcccattgggac

SEQ ID NO: 205175 - DNA, 41 bp, Artificial Sequence
  Description of Artificial Sequence: Synthetic oligonucleotide
caacctaactgatgaatttgagtttcccattgggacatatc

SEQ ID NO: 205176 - DNA, 42 bp, Artificial Sequence
  Description of Artificial Sequence: Synthetic oligonucleotide
aacctaactgatgaatttgagtttcccattgggacatatctg

SEQ ID NO: 205177 - DNA, 41 bp, Artificial Sequence
  Description of Artificial Sequence: Synthetic oligonucleotide
acctaactgatgaatttgagtttcccattgggacatatctg

SEQ ID NO: 205178 - DNA, 40 bp, Artificial Sequence
  Description of Artificial Sequence: Synthetic oligonucleotide
cctaactgatgaatttgagtttcccattgggacatatctg

SEQ ID NO: 205179 - DNA, 42 bp, Artificial Sequence
  Description of Artificial Sequence: Synthetic oligonucleotide
ctaactgatgaatttgagtttcccattgggacatatctgaac

SEQ ID NO: 205180 - DNA, 45 bp, Artificial Sequence
  Description of Artificial Sequence: Synthetic oligonucleotide
taactgatgaatttgagtttcccattgggacatatctgaactatg

SEQ ID NO: 205181 - DNA, 44 bp, Artificial Sequence
  Description of Artificial Sequence: Synthetic oligonucleotide
aactgatgaatttgagtttcccattgggacatatctgaactatg

SEQ ID NO: 205182 - DNA, 43 bp, Artificial Sequence
  Description of Artificial Sequence: Synthetic oligonucleotide
actgatgaatttgagtttcccattgggacatatctgaactatg

SEQ ID NO: 205183 - DNA, 42 bp, Artificial Sequence
  Description of Artificial Sequence: Synthetic oligonucleotide
ctgatgaatttgagtttcccattgggacatatctgaactatg

SEQ ID NO: 205184 - DNA, 45 bp, Artificial Sequence
  Description of Artificial Sequence: Synthetic oligonucleotide
tgatgaatttgagtttcccattgggacatatctgaactatgaatg

SEQ ID NO: 205185 - DNA, 44 bp, Artificial Sequence
  Description of Artificial Sequence: Synthetic oligonucleotide
gatgaatttgagtttcccattgggacatatctgaactatgaatg

SEQ ID NO: 205186 - DNA, 44 bp, Artificial Sequence
  Description of Artificial Sequence: Synthetic oligonucleotide
atgaatttgagtttcccattgggacatatctgaactatgaatgc

SEQ ID NO: 205187 - DNA, 43 bp, Artificial Sequence
  Description of Artificial Sequence: Synthetic oligonucleotide
tgaatttgagtttcccattgggacatatctgaactatgaatgc

SEQ ID NO: 205188 - DNA, 42 bp, Artificial Sequence
  Description of Artificial Sequence: Synthetic oligonucleotide
gaatttgagtttcccattgggacatatctgaactatgaatgc

SEQ ID NO: 205189 - DNA, 42 bp, Artificial Sequence
  Description of Artificial Sequence: Synthetic oligonucleotide
aatttgagtttcccattgggacatatctgaactatgaatgcc

SEQ ID NO: 205190 - DNA, 41 bp, Artificial Sequence
  Description of Artificial Sequence: Synthetic oligonucleotide
atttgagtttcccattgggacatatctgaactatgaatgcc

SEQ ID NO: 205191 - DNA, 40 bp, Artificial Sequence
  Description of Artificial Sequence: Synthetic oligonucleotide
tttgagtttcccattgggacatatctgaactatgaatgcc

SEQ ID NO: 205192 - DNA, 39 bp, Artificial Sequence
  Description of Artificial Sequence: Synthetic oligonucleotide
ttgagtttcccattgggacatatctgaactatgaatgcc

SEQ ID NO: 205193 - DNA, 38 bp, Artificial Sequence
  Description of Artificial Sequence: Synthetic oligonucleotide
tgagtttcccattgggacatatctgaactatgaatgcc

SEQ ID NO: 205194 - DNA, 37 bp, Artificial Sequence
  Description of Artificial Sequence: Synthetic oligonucleotide
gagtttcccattgggacatatctgaactatgaatgcc

SEQ ID NO: 205195 - DNA, 37 bp, Artificial Sequence
  Description of Artificial Sequence: Synthetic oligonucleotide
agtttcccattgggacatatctgaactatgaatgccg

SEQ ID NO: 205196 - DNA, 36 bp, Artificial Sequence
  Description of Artificial Sequence: Synthetic oligonucleotide
gtttcccattgggacatatctgaactatgaatgccg

SEQ ID NO: 205197 - DNA, 36 bp, Artificial Sequence
  Description of Artificial Sequence: Synthetic oligonucleotide
tttcccattgggacatatctgaactatgaatgccgc

SEQ ID NO: 205198 - DNA, 35 bp, Artificial Sequence
  Description of Artificial Sequence: Synthetic oligonucleotide
ttcccattgggacatatctgaactatgaatgccgc

SEQ ID NO: 205199 - DNA, 34 bp, Artificial Sequence
  Description of Artificial Sequence: Synthetic oligonucleotide
tcccattgggacatatctgaactatgaatgccgc

SEQ ID NO: 205200 - DNA, 33 bp, Artificial Sequence
  Description of Artificial Sequence: Synthetic oligonucleotide
cccattgggacatatctgaactatgaatgccgc

SEQ ID NO: 205201 - DNA, 33 bp, Artificial Sequence
  Description of Artificial Sequence: Synthetic oligonucleotide
ccattgggacatatctgaactatgaatgccgcc

SEQ ID NO: 205202 - DNA, 33 bp, Artificial Sequence
  Description of Artificial Sequence: Synthetic oligonucleotide
cattgggacatatctgaactatgaatgccgccc

SEQ ID NO: 205203 - DNA, 34 bp, Artificial Sequence
  Description of Artificial Sequence: Synthetic oligonucleotide
attgggacatatctgaactatgaatgccgccctg

SEQ ID NO: 205204 - DNA, 33 bp, Artificial Sequence
  Description of Artificial Sequence: Synthetic oligonucleotide
ttgggacatatctgaactatgaatgccgccctg

SEQ ID NO: 205205 - DNA, 32 bp, Artificial Sequence
  Description of Artificial Sequence: Synthetic oligonucleotide
tgggacatatctgaactatgaatgccgccctg

SEQ ID NO: 205206 - DNA, 31 bp, Artificial Sequence
  Description of Artificial Sequence: Synthetic oligonucleotide
gggacatatctgaactatgaatgccgccctg

SEQ ID NO: 205207 - DNA, 31 bp, Artificial Sequence
  Description of Artificial Sequence: Synthetic oligonucleotide
ggacatatctgaactatgaatgccgccctgg

SEQ ID NO: 205208 - DNA, 36 bp, Artificial Sequence
  Description of Artificial Sequence: Synthetic oligonucleotide
gacatatctgaactatgaatgccgccctggttattc

SEQ ID NO: 205209 - DNA, 36 bp, Artificial Sequence
  Description of Artificial Sequence: Synthetic oligonucleotide
acatatctgaactatgaatgccgccctggttattcc

SEQ ID NO: 205210 - DNA, 35 bp, Artificial Sequence
  Description of Artificial Sequence: Synthetic oligonucleotide
catatctgaactatgaatgccgccctggttattcc

SEQ ID NO: 205211 - DNA, 35 bp, Artificial Sequence
  Description of Artificial Sequence: Synthetic oligonucleotide
atatctgaactatgaatgccgccctggttattccg

SEQ ID NO: 205212 - DNA, 34 bp, Artificial Sequence
  Description of Artificial Sequence: Synthetic oligonucleotide
tatctgaactatgaatgccgccctggttattccg

SEQ ID NO: 205213 - DNA, 33 bp, Artificial Sequence
  Description of Artificial Sequence: Synthetic oligonucleotide
atctgaactatgaatgccgccctggttattccg

SEQ ID NO: 205214 - DNA, 32 bp, Artificial Sequence
  Description of Artificial Sequence: Synthetic oligonucleotide
tctgaactatgaatgccgccctggttattccg

SEQ ID NO: 205215 - DNA, 31 bp, Artificial Sequence
  Description of Artificial Sequence: Synthetic oligonucleotide
ctgaactatgaatgccgccctggttattccg

SEQ ID NO: 205216 - DNA, 31 bp, Artificial Sequence
  Description of Artificial Sequence: Synthetic oligonucleotide
tgaactatgaatgccgccctggttattccgg

SEQ ID NO: 205217 - DNA, 30 bp, Artificial Sequence
  Description of Artificial Sequence: Synthetic oligonucleotide
gaactatgaatgccgccctggttattccgg

SEQ ID NO: 205218 - DNA, 32 bp, Artificial Sequence
  Description of Artificial Sequence: Synthetic oligonucleotide
aactatgaatgccgccctggttattccggaag

SEQ ID NO: 205219 - DNA, 31 bp, Artificial Sequence
  Description of Artificial Sequence: Synthetic oligonucleotide
actatgaatgccgccctggttattccggaag

SEQ ID NO: 205220 - DNA, 30 bp, Artificial Sequence
  Description of Artificial Sequence: Synthetic oligonucleotide
ctatgaatgccgccctggttattccggaag

SEQ ID NO: 205221 - DNA, 31 bp, Artificial Sequence
  Description of Artificial Sequence: Synthetic oligonucleotide
tatgaatgccgccctggttattccggaagac

SEQ ID NO: 205222 - DNA, 30 bp, Artificial Sequence
  Description of Artificial Sequence: Synthetic oligonucleotide
atgaatgccgccctggttattccggaagac

SEQ ID NO: 205223 - DNA, 29 bp, Artificial Sequence
  Description of Artificial Sequence: Synthetic oligonucleotide
tgaatgccgccctggttattccggaagac

SEQ ID NO: 205224 - DNA, 28 bp, Artificial Sequence
  Description of Artificial Sequence: Synthetic oligonucleotide
gaatgccgccctggttattccggaagac

SEQ ID NO: 205225 - DNA, 28 bp, Artificial Sequence
  Description of Artificial Sequence: Synthetic oligonucleotide
aatgccgccctggttattccggaagacc

SEQ ID NO: 205226 - DNA, 27 bp, Artificial Sequence
  Description of Artificial Sequence: Synthetic oligonucleotide
atgccgccctggttattccggaagacc

SEQ ID NO: 205227 - DNA, 26 bp, Artificial Sequence
  Description of Artificial Sequence: Synthetic oligonucleotide
tgccgccctggttattccggaagacc

SEQ ID NO: 205228 - DNA, 25 bp, Artificial Sequence
  Description of Artificial Sequence: Synthetic oligonucleotide
gccgccctggttattccggaagacc

SEQ ID NO: 205229 - DNA, 27 bp, Artificial Sequence
  Description of Artificial Sequence: Synthetic oligonucleotide
ccgccctggttattccggaagaccgtt

SEQ ID NO: 205230 - DNA, 29 bp, Artificial Sequence
  Description of Artificial Sequence: Synthetic oligonucleotide
cgccctggttattccggaagaccgttttc

SEQ ID NO: 205231 - DNA, 32 bp, Artificial Sequence
  Description of Artificial Sequence: Synthetic oligonucleotide
gccctggttattccggaagaccgttttctatc

SEQ ID NO: 205232 - DNA, 34 bp, Artificial Sequence
  Description of Artificial Sequence: Synthetic oligonucleotide
ccctggttattccggaagaccgttttctatcatc

SEQ ID NO: 205233 - DNA, 35 bp, Artificial Sequence
  Description of Artificial Sequence: Synthetic oligonucleotide
cctggttattccggaagaccgttttctatcatctg

SEQ ID NO: 205234 - DNA, 35 bp, Artificial Sequence
  Description of Artificial Sequence: Synthetic oligonucleotide
ctggttattccggaagaccgttttctatcatctgc

SEQ ID NO: 205235 - DNA, 35 bp, Artificial Sequence
  Description of Artificial Sequence: Synthetic oligonucleotide
tggttattccggaagaccgttttctatcatctgcc

SEQ ID NO: 205236 - DNA, 34 bp, Artificial Sequence
  Description of Artificial Sequence: Synthetic oligonucleotide
ggttattccggaagaccgttttctatcatctgcc

SEQ ID NO: 205237 - DNA, 41 bp, Artificial Sequence
  Description of Artificial Sequence: Synthetic oligonucleotide
gttattccggaagaccgttttctatcatctgcctaaaaaac

SEQ ID NO: 205238 - DNA, 42 bp, Artificial Sequence
  Description of Artificial Sequence: Synthetic oligonucleotide
ttattccggaagaccgttttctatcatctgcctaaaaaactc

SEQ ID NO: 205239 - DNA, 41 bp, Artificial Sequence
  Description of Artificial Sequence: Synthetic oligonucleotide
tattccggaagaccgttttctatcatctgcctaaaaaactc

SEQ ID NO: 205240 - DNA, 40 bp, Artificial Sequence
  Description of Artificial Sequence: Synthetic oligonucleotide
attccggaagaccgttttctatcatctgcctaaaaaactc

SEQ ID NO: 205241 - DNA, 39 bp, Artificial Sequence
  Description of Artificial Sequence: Synthetic oligonucleotide
ttccggaagaccgttttctatcatctgcctaaaaaactc

SEQ ID NO: 205242 - DNA, 38 bp, Artificial Sequence
  Description of Artificial Sequence: Synthetic oligonucleotide
tccggaagaccgttttctatcatctgcctaaaaaactc

SEQ ID NO: 205243 - DNA, 37 bp, Artificial Sequence
  Description of Artificial Sequence: Synthetic oligonucleotide
ccggaagaccgttttctatcatctgcctaaaaaactc

SEQ ID NO: 205244 - DNA, 38 bp, Artificial Sequence
  Description of Artificial Sequence: Synthetic oligonucleotide
cggaagaccgttttctatcatctgcctaaaaaactcag

SEQ ID NO: 205245 - DNA, 39 bp, Artificial Sequence
  Description of Artificial Sequence: Synthetic oligonucleotide
ggaagaccgttttctatcatctgcctaaaaaactcagtc

SEQ ID NO: 205246 - DNA, 40 bp, Artificial Sequence
  Description of Artificial Sequence: Synthetic oligonucleotide
gaagaccgttttctatcatctgcctaaaaaactcagtctg

SEQ ID NO: 205247 - DNA, 40 bp, Artificial Sequence
  Description of Artificial Sequence: Synthetic oligonucleotide
aagaccgttttctatcatctgcctaaaaaactcagtctgg

SEQ ID NO: 205248 - DNA, 39 bp, Artificial Sequence
  Description of Artificial Sequence: Synthetic oligonucleotide
agaccgttttctatcatctgcctaaaaaactcagtctgg

SEQ ID NO: 205249 - DNA, 38 bp, Artificial Sequence
  Description of Artificial Sequence: Synthetic oligonucleotide
gaccgttttctatcatctgcctaaaaaactcagtctgg

SEQ ID NO: 205250 - DNA, 39 bp, Artificial Sequence
  Description of Artificial Sequence: Synthetic oligonucleotide
accgttttctatcatctgcctaaaaaactcagtctggac

SEQ ID NO: 205251 - DNA, 38 bp, Artificial Sequence
  Description of Artificial Sequence: Synthetic oligonucleotide
ccgttttctatcatctgcctaaaaaactcagtctggac

SEQ ID NO: 205252 - DNA, 39 bp, Artificial Sequence
  Description of Artificial Sequence: Synthetic oligonucleotide
cgttttctatcatctgcctaaaaaactcagtctggactg

SEQ ID NO: 205253 - DNA, 39 bp, Artificial Sequence
  Description of Artificial Sequence: Synthetic oligonucleotide
gttttctatcatctgcctaaaaaactcagtctggactgg

SEQ ID NO: 205254 - DNA, 40 bp, Artificial Sequence
  Description of Artificial Sequence: Synthetic oligonucleotide
ttttctatcatctgcctaaaaaactcagtctggactggtg

SEQ ID NO: 205255 - DNA, 39 bp, Artificial Sequence
  Description of Artificial Sequence: Synthetic oligonucleotide
tttctatcatctgcctaaaaaactcagtctggactggtg

SEQ ID NO: 205256 - DNA, 38 bp, Artificial Sequence
  Description of Artificial Sequence: Synthetic oligonucleotide
ttctatcatctgcctaaaaaactcagtctggactggtg

SEQ ID NO: 205257 - DNA, 37 bp, Artificial Sequence
  Description of Artificial Sequence: Synthetic oligonucleotide
tctatcatctgcctaaaaaactcagtctggactggtg

SEQ ID NO: 205258 - DNA, 36 bp, Artificial Sequence
  Description of Artificial Sequence: Synthetic oligonucleotide
ctatcatctgcctaaaaaactcagtctggactggtg

SEQ ID NO: 205259 - DNA, 36 bp, Artificial Sequence
  Description of Artificial Sequence: Synthetic oligonucleotide
tatcatctgcctaaaaaactcagtctggactggtgc

SEQ ID NO: 205260 - DNA, 35 bp, Artificial Sequence
  Description of Artificial Sequence: Synthetic oligonucleotide
atcatctgcctaaaaaactcagtctggactggtgc

SEQ ID NO: 205261 - DNA, 34 bp, Artificial Sequence
  Description of Artificial Sequence: Synthetic oligonucleotide
tcatctgcctaaaaaactcagtctggactggtgc

SEQ ID NO: 205262 - DNA, 33 bp, Artificial Sequence
  Description of Artificial Sequence: Synthetic oligonucleotide
catctgcctaaaaaactcagtctggactggtgc

SEQ ID NO: 205263 - DNA, 36 bp, Artificial Sequence
  Description of Artificial Sequence: Synthetic oligonucleotide
atctgcctaaaaaactcagtctggactggtgctaag

SEQ ID NO: 205264 - DNA, 35 bp, Artificial Sequence
  Description of Artificial Sequence: Synthetic oligonucleotide
tctgcctaaaaaactcagtctggactggtgctaag

SEQ ID NO: 205265 - DNA, 34 bp, Artificial Sequence
  Description of Artificial Sequence: Synthetic oligonucleotide
ctgcctaaaaaactcagtctggactggtgctaag

SEQ ID NO: 205266 - DNA, 34 bp, Artificial Sequence
  Description of Artificial Sequence: Synthetic oligonucleotide
tgcctaaaaaactcagtctggactggtgctaagg

SEQ ID NO: 205267 - DNA, 33 bp, Artificial Sequence
  Description of Artificial Sequence: Synthetic oligonucleotide
gcctaaaaaactcagtctggactggtgctaagg

SEQ ID NO: 205268 - DNA, 34 bp, Artificial Sequence
  Description of Artificial Sequence: Synthetic oligonucleotide
cctaaaaaactcagtctggactggtgctaaggac

SEQ ID NO: 205269 - DNA, 35 bp, Artificial Sequence
  Description of Artificial Sequence: Synthetic oligonucleotide
ctaaaaaactcagtctggactggtgctaaggacag

SEQ ID NO: 205270 - DNA, 35 bp, Artificial Sequence
  Description of Artificial Sequence: Synthetic oligonucleotide
taaaaaactcagtctggactggtgctaaggacagg

SEQ ID NO: 205271 - DNA, 34 bp, Artificial Sequence
  Description of Artificial Sequence: Synthetic oligonucleotide
aaaaaactcagtctggactggtgctaaggacagg

SEQ ID NO: 205272 - DNA, 33 bp, Artificial Sequence
  Description of Artificial Sequence: Synthetic oligonucleotide
aaaaactcagtctggactggtgctaaggacagg

SEQ ID NO: 205273 - DNA, 32 bp, Artificial Sequence
  Description of Artificial Sequence: Synthetic oligonucleotide
aaaactcagtctggactggtgctaaggacagg

SEQ ID NO: 205274 - DNA, 31 bp, Artificial Sequence
  Description of Artificial Sequence: Synthetic oligonucleotide
aaactcagtctggactggtgctaaggacagg

SEQ ID NO: 205275 - DNA, 30 bp, Artificial Sequence
  Description of Artificial Sequence: Synthetic oligonucleotide
aactcagtctggactggtgctaaggacagg

SEQ ID NO: 205276 - DNA, 29 bp, Artificial Sequence
  Description of Artificial Sequence: Synthetic oligonucleotide
actcagtctggactggtgctaaggacagg

SEQ ID NO: 205277 - DNA, 28 bp, Artificial Sequence
  Description of Artificial Sequence: Synthetic oligonucleotide
ctcagtctggactggtgctaaggacagg

SEQ ID NO: 205278 - DNA, 29 bp, Artificial Sequence
  Description of Artificial Sequence: Synthetic oligonucleotide
tcagtctggactggtgctaaggacaggtg

SEQ ID NO: 205279 - DNA, 28 bp, Artificial Sequence
  Description of Artificial Sequence: Synthetic oligonucleotide
cagtctggactggtgctaaggacaggtg

SEQ ID NO: 205280 - DNA, 28 bp, Artificial Sequence
  Description of Artificial Sequence: Synthetic oligonucleotide
agtctggactggtgctaaggacaggtgc

SEQ ID NO: 205281 - DNA, 27 bp, Artificial Sequence
  Description of Artificial Sequence: Synthetic oligonucleotide
gtctggactggtgctaaggacaggtgc

SEQ ID NO: 205282 - DNA, 28 bp, Artificial Sequence
  Description of Artificial Sequence: Synthetic oligonucleotide
tctggactggtgctaaggacaggtgcag

SEQ ID NO: 205283 - DNA, 27 bp, Artificial Sequence
  Description of Artificial Sequence: Synthetic oligonucleotide
ctggactggtgctaaggacaggtgcag

SEQ ID NO: 205284 - DNA, 28 bp, Artificial Sequence
  Description of Artificial Sequence: Synthetic oligonucleotide
tggactggtgctaaggacaggtgcagac

SEQ ID NO: 205285 - DNA, 27 bp, Artificial Sequence
  Description of Artificial Sequence: Synthetic oligonucleotide
ggactggtgctaaggacaggtgcagac

SEQ ID NO: 205286 - DNA, 27 bp, Artificial Sequence
  Description of Artificial Sequence: Synthetic oligonucleotide
gactggtgctaaggacaggtgcagacg

SEQ ID NO: 205287 - DNA, 32 bp, Artificial Sequence
  Description of Artificial Sequence: Synthetic oligonucleotide
actggtgctaaggacaggtgcagacgtaaatc

SEQ ID NO: 205288 - DNA, 31 bp, Artificial Sequence
  Description of Artificial Sequence: Synthetic oligonucleotide
ctggtgctaaggacaggtgcagacgtaaatc

SEQ ID NO: 205289 - DNA, 33 bp, Artificial Sequence
  Description of Artificial Sequence: Synthetic oligonucleotide
tggtgctaaggacaggtgcagacgtaaatcatg

SEQ ID NO: 205290 - DNA, 32 bp, Artificial Sequence
  Description of Artificial Sequence: Synthetic oligonucleotide
ggtgctaaggacaggtgcagacgtaaatcatg

SEQ ID NO: 205291 - DNA, 33 bp, Artificial Sequence
  Description of Artificial Sequence: Synthetic oligonucleotide
gtgctaaggacaggtgcagacgtaaatcatgtc

SEQ ID NO: 205292 - DNA, 33 bp, Artificial Sequence
  Description of Artificial Sequence: Synthetic oligonucleotide
tgctaaggacaggtgcagacgtaaatcatgtcg

SEQ ID NO: 205293 - DNA, 32 bp, Artificial Sequence
  Description of Artificial Sequence: Synthetic oligonucleotide
gctaaggacaggtgcagacgtaaatcatgtcg

SEQ ID NO: 205294 - DNA, 36 bp, Artificial Sequence
  Description of Artificial Sequence: Synthetic oligonucleotide
ctaaggacaggtgcagacgtaaatcatgtcgtaatc

SEQ ID NO: 205295 - DNA, 36 bp, Artificial Sequence
  Description of Artificial Sequence: Synthetic oligonucleotide
taaggacaggtgcagacgtaaatcatgtcgtaatcc

SEQ ID NO: 205296 - DNA, 35 bp, Artificial Sequence
  Description of Artificial Sequence: Synthetic oligonucleotide
aaggacaggtgcagacgtaaatcatgtcgtaatcc

SEQ ID NO: 205297 - DNA, 34 bp, Artificial Sequence
  Description of Artificial Sequence: Synthetic oligonucleotide
aggacaggtgcagacgtaaatcatgtcgtaatcc

SEQ ID NO: 205298 - DNA, 33 bp, Artificial Sequence
  Description of Artificial Sequence: Synthetic oligonucleotide
ggacaggtgcagacgtaaatcatgtcgtaatcc

SEQ ID NO: 205299 - DNA, 34 bp, Artificial Sequence
  Description of Artificial Sequence: Synthetic oligonucleotide
gacaggtgcagacgtaaatcatgtcgtaatcctc

SEQ ID NO: 205300 - DNA, 34 bp, Artificial Sequence
  Description of Artificial Sequence: Synthetic oligonucleotide
acaggtgcagacgtaaatcatgtcgtaatcctcc

SEQ ID NO: 205301 - DNA, 33 bp, Artificial Sequence
  Description of Artificial Sequence: Synthetic oligonucleotide
caggtgcagacgtaaatcatgtcgtaatcctcc

SEQ ID NO: 205302 - DNA, 34 bp, Artificial Sequence
  Description of Artificial Sequence: Synthetic oligonucleotide
aggtgcagacgtaaatcatgtcgtaatcctccag

SEQ ID NO: 205303 - DNA, 33 bp, Artificial Sequence
  Description of Artificial Sequence: Synthetic oligonucleotide
ggtgcagacgtaaatcatgtcgtaatcctccag

SEQ ID NO: 205304 - DNA, 35 bp, Artificial Sequence
  Description of Artificial Sequence: Synthetic oligonucleotide
gtgcagacgtaaatcatgtcgtaatcctccagatc

SEQ ID NO: 205305 - DNA, 35 bp, Artificial Sequence
  Description of Artificial Sequence: Synthetic oligonucleotide
tgcagacgtaaatcatgtcgtaatcctccagatcc

SEQ ID NO: 205306 - DNA, 34 bp, Artificial Sequence
  Description of Artificial Sequence: Synthetic oligonucleotide
gcagacgtaaatcatgtcgtaatcctccagatcc

SEQ ID NO: 205307 - DNA, 35 bp, Artificial Sequence
  Description of Artificial Sequence: Synthetic oligonucleotide
cagacgtaaatcatgtcgtaatcctccagatcctg

SEQ ID NO: 205308 - DNA, 36 bp, Artificial Sequence
  Description of Artificial Sequence: Synthetic oligonucleotide
agacgtaaatcatgtcgtaatcctccagatcctgtg

SEQ ID NO: 205309 - DNA, 35 bp, Artificial Sequence
  Description of Artificial Sequence: Synthetic oligonucleotide
gacgtaaatcatgtcgtaatcctccagatcctgtg

SEQ ID NO: 205310 - DNA, 38 bp, Artificial Sequence
  Description of Artificial Sequence: Synthetic oligonucleotide
acgtaaatcatgtcgtaatcctccagatcctgtgaatg

SEQ ID NO: 205311 - DNA, 37 bp, Artificial Sequence
  Description of Artificial Sequence: Synthetic oligonucleotide
cgtaaatcatgtcgtaatcctccagatcctgtgaatg

SEQ ID NO: 205312 - DNA, 37 bp, Artificial Sequence
  Description of Artificial Sequence: Synthetic oligonucleotide
gtaaatcatgtcgtaatcctccagatcctgtgaatgg

SEQ ID NO: 205313 - DNA, 37 bp, Artificial Sequence
  Description of Artificial Sequence: Synthetic oligonucleotide
taaatcatgtcgtaatcctccagatcctgtgaatggc

SEQ ID NO: 205314 - DNA, 36 bp, Artificial Sequence
  Description of Artificial Sequence: Synthetic oligonucleotide
aaatcatgtcgtaatcctccagatcctgtgaatggc

SEQ ID NO: 205315 - DNA, 35 bp, Artificial Sequence
  Description of Artificial Sequence: Synthetic oligonucleotide
aatcatgtcgtaatcctccagatcctgtgaatggc

SEQ ID NO: 205316 - DNA, 34 bp, Artificial Sequence
  Description of Artificial Sequence: Synthetic oligonucleotide
atcatgtcgtaatcctccagatcctgtgaatggc

SEQ ID NO: 205317 - DNA, 33 bp, Artificial Sequence
  Description of Artificial Sequence: Synthetic oligonucleotide
tcatgtcgtaatcctccagatcctgtgaatggc

SEQ ID NO: 205318 - DNA, 32 bp, Artificial Sequence
  Description of Artificial Sequence: Synthetic oligonucleotide
catgtcgtaatcctccagatcctgtgaatggc

SEQ ID NO: 205319 - DNA, 34 bp, Artificial Sequence
  Description of Artificial Sequence: Synthetic oligonucleotide
atgtcgtaatcctccagatcctgtgaatggcatg

SEQ ID NO: 205320 - DNA, 33 bp, Artificial Sequence
  Description of Artificial Sequence: Synthetic oligonucleotide
tgtcgtaatcctccagatcctgtgaatggcatg

SEQ ID NO: 205321 - DNA, 32 bp, Artificial Sequence
  Description of Artificial Sequence: Synthetic oligonucleotide
gtcgtaatcctccagatcctgtgaatggcatg

SEQ ID NO: 205322 - DNA, 32 bp, Artificial Sequence
  Description of Artificial Sequence: Synthetic oligonucleotide
tcgtaatcctccagatcctgtgaatggcatgg

SEQ ID NO: 205323 - DNA, 31 bp, Artificial Sequence
  Description of Artificial Sequence: Synthetic oligonucleotide
cgtaatcctccagatcctgtgaatggcatgg

SEQ ID NO: 205324 - DNA, 32 bp, Artificial Sequence
  Description of Artificial Sequence: Synthetic oligonucleotide
gtaatcctccagatcctgtgaatggcatggtg

SEQ ID NO: 205325 - DNA, 32 bp, Artificial Sequence
  Description of Artificial Sequence: Synthetic oligonucleotide
taatcctccagatcctgtgaatggcatggtgc

SEQ ID NO: 205326 - DNA, 31 bp, Artificial Sequence
  Description of Artificial Sequence: Synthetic oligonucleotide
aatcctccagatcctgtgaatggcatggtgc

SEQ ID NO: 205327 - DNA, 30 bp, Artificial Sequence
  Description of Artificial Sequence: Synthetic oligonucleotide
atcctccagatcctgtgaatggcatggtgc

SEQ ID NO: 205328 - DNA, 29 bp, Artificial Sequence
  Description of Artificial Sequence: Synthetic oligonucleotide
tcctccagatcctgtgaatggcatggtgc

SEQ ID NO: 205329 - DNA, 28 bp, Artificial Sequence
  Description of Artificial Sequence: Synthetic oligonucleotide
cctccagatcctgtgaatggcatggtgc

SEQ ID NO: 205330 - DNA, 30 bp, Artificial Sequence
  Description of Artificial Sequence: Synthetic oligonucleotide
ctccagatcctgtgaatggcatggtgcatg

SEQ ID NO: 205331 - DNA, 31 bp, Artificial Sequence
  Description of Artificial Sequence: Synthetic oligonucleotide
tccagatcctgtgaatggcatggtgcatgtg

SEQ ID NO: 205332 - DNA, 30 bp, Artificial Sequence
  Description of Artificial Sequence: Synthetic oligonucleotide
ccagatcctgtgaatggcatggtgcatgtg

SEQ ID NO: 205333 - DNA, 32 bp, Artificial Sequence
  Description of Artificial Sequence: Synthetic oligonucleotide
cagatcctgtgaatggcatggtgcatgtgatc

SEQ ID NO: 205334 - DNA, 35 bp, Artificial Sequence
  Description of Artificial Sequence: Synthetic oligonucleotide
agatcctgtgaatggcatggtgcatgtgatcaaag

SEQ ID NO: 205335 - DNA, 34 bp, Artificial Sequence
  Description of Artificial Sequence: Synthetic oligonucleotide
gatcctgtgaatggcatggtgcatgtgatcaaag

SEQ ID NO: 205336 - DNA, 34 bp, Artificial Sequence
  Description of Artificial Sequence: Synthetic oligonucleotide
atcctgtgaatggcatggtgcatgtgatcaaagg

SEQ ID NO: 205337 - DNA, 33 bp, Artificial Sequence
  Description of Artificial Sequence: Synthetic oligonucleotide
tcctgtgaatggcatggtgcatgtgatcaaagg

SEQ ID NO: 205338 - DNA, 32 bp, Artificial Sequence
  Description of Artificial Sequence: Synthetic oligonucleotide
cctgtgaatggcatggtgcatgtgatcaaagg

SEQ ID NO: 205339 - DNA, 32 bp, Artificial Sequence
  Description of Artificial Sequence: Synthetic oligonucleotide
ctgtgaatggcatggtgcatgtgatcaaaggc

SEQ ID NO: 205340 - DNA, 34 bp, Artificial Sequence
  Description of Artificial Sequence: Synthetic oligonucleotide
tgtgaatggcatggtgcatgtgatcaaaggcatc

SEQ ID NO: 205341 - DNA, 33 bp, Artificial Sequence
  Description of Artificial Sequence: Synthetic oligonucleotide
gtgaatggcatggtgcatgtgatcaaaggcatc

SEQ ID NO: 205342 - DNA, 33 bp, Artificial Sequence
  Description of Artificial Sequence: Synthetic oligonucleotide
tgaatggcatggtgcatgtgatcaaaggcatcc

SEQ ID NO: 205343 - DNA, 32 bp, Artificial Sequence
  Description of Artificial Sequence: Synthetic oligonucleotide
gaatggcatggtgcatgtgatcaaaggcatcc

SEQ ID NO: 205344 - DNA, 33 bp, Artificial Sequence
  Description of Artificial Sequence: Synthetic oligonucleotide
aatggcatggtgcatgtgatcaaaggcatccag

SEQ ID NO: 205345 - DNA, 32 bp, Artificial Sequence
  Description of Artificial Sequence: Synthetic oligonucleotide
atggcatggtgcatgtgatcaaaggcatccag

SEQ ID NO: 205346 - DNA, 31 bp, Artificial Sequence
  Description of Artificial Sequence: Synthetic oligonucleotide
tggcatggtgcatgtgatcaaaggcatccag

SEQ ID NO: 205347 - DNA, 30 bp, Artificial Sequence
  Description of Artificial Sequence: Synthetic oligonucleotide
ggcatggtgcatgtgatcaaaggcatccag

SEQ ID NO: 205348 - DNA, 32 bp, Artificial Sequence
  Description of Artificial Sequence: Synthetic oligonucleotide
gcatggtgcatgtgatcaaaggcatccagttc

SEQ ID NO: 205349 - DNA, 32 bp, Artificial Sequence
  Description of Artificial Sequence: Synthetic oligonucleotide
catggtgcatgtgatcaaaggcatccagttcg

SEQ ID NO: 205350 - DNA, 32 bp, Artificial Sequence
  Description of Artificial Sequence: Synthetic oligonucleotide
atggtgcatgtgatcaaaggcatccagttcgg

SEQ ID NO: 205351 - DNA, 31 bp, Artificial Sequence
  Description of Artificial Sequence: Synthetic oligonucleotide
tggtgcatgtgatcaaaggcatccagttcgg

SEQ ID NO: 205352 - DNA, 30 bp, Artificial Sequence
  Description of Artificial Sequence: Synthetic oligonucleotide
ggtgcatgtgatcaaaggcatccagttcgg

SEQ ID NO: 205353 - DNA, 32 bp, Artificial Sequence
  Description of Artificial Sequence: Synthetic oligonucleotide
gtgcatgtgatcaaaggcatccagttcggatc

SEQ ID NO: 205354 - DNA, 32 bp, Artificial Sequence
  Description of Artificial Sequence: Synthetic oligonucleotide
tgcatgtgatcaaaggcatccagttcggatcc

SEQ ID NO: 205355 - DNA, 31 bp, Artificial Sequence
  Description of Artificial Sequence: Synthetic oligonucleotide
gcatgtgatcaaaggcatccagttcggatcc

SEQ ID NO: 205356 - DNA, 31 bp, Artificial Sequence
  Description of Artificial Sequence: Synthetic oligonucleotide
catgtgatcaaaggcatccagttcggatccc

SEQ ID NO: 205357 - DNA, 43 bp, Artificial Sequence
  Description of Artificial Sequence: Synthetic oligonucleotide
atgtgatcaaaggcatccagttcggatcccaaattaaatattc

SEQ ID NO: 205358 - DNA, 42 bp, Artificial Sequence
  Description of Artificial Sequence: Synthetic oligonucleotide
tgtgatcaaaggcatccagttcggatcccaaattaaatattc

SEQ ID NO: 205359 - DNA, 41 bp, Artificial Sequence
  Description of Artificial Sequence: Synthetic oligonucleotide
gtgatcaaaggcatccagttcggatcccaaattaaatattc

SEQ ID NO: 205360 - DNA, 43 bp, Artificial Sequence
  Description of Artificial Sequence: Synthetic oligonucleotide
tgatcaaaggcatccagttcggatcccaaattaaatattcttg

SEQ ID NO: 205361 - DNA, 42 bp, Artificial Sequence
  Description of Artificial Sequence: Synthetic oligonucleotide
gatcaaaggcatccagttcggatcccaaattaaatattcttg

SEQ ID NO: 205362 - DNA, 44 bp, Artificial Sequence
  Description of Artificial Sequence: Synthetic oligonucleotide
atcaaaggcatccagttcggatcccaaattaaatattcttgtac

SEQ ID NO: 205363 - DNA, 43 bp, Artificial Sequence
  Description of Artificial Sequence: Synthetic oligonucleotide
tcaaaggcatccagttcggatcccaaattaaatattcttgtac

SEQ ID NO: 205364 - DNA, 42 bp, Artificial Sequence
  Description of Artificial Sequence: Synthetic oligonucleotide
caaaggcatccagttcggatcccaaattaaatattcttgtac

SEQ ID NO: 205365 - DNA, 46 bp, Artificial Sequence
  Description of Artificial Sequence: Synthetic oligonucleotide
aaaggcatccagttcggatcccaaattaaatattcttgtactaaag

SEQ ID NO: 205366 - DNA, 45 bp, Artificial Sequence
  Description of Artificial Sequence: Synthetic oligonucleotide
aaggcatccagttcggatcccaaattaaatattcttgtactaaag

SEQ ID NO: 205367 - DNA, 44 bp, Artificial Sequence
  Description of Artificial Sequence: Synthetic oligonucleotide
aggcatccagttcggatcccaaattaaatattcttgtactaaag

SEQ ID NO: 205368 - DNA, 43 bp, Artificial Sequence
  Description of Artificial Sequence: Synthetic oligonucleotide
ggcatccagttcggatcccaaattaaatattcttgtactaaag

SEQ ID NO: 205369 - DNA, 43 bp, Artificial Sequence
  Description of Artificial Sequence: Synthetic oligonucleotide
gcatccagttcggatcccaaattaaatattcttgtactaaagg

SEQ ID NO: 205370 - DNA, 43 bp, Artificial Sequence
  Description of Artificial Sequence: Synthetic oligonucleotide
catccagttcggatcccaaattaaatattcttgtactaaaggg

SEQ ID NO: 205371 - DNA, 46 bp, Artificial Sequence
  Description of Artificial Sequence: Synthetic oligonucleotide
atccagttcggatcccaaattaaatattcttgtactaaagggatac

SEQ ID NO: 205372 - DNA, 45 bp, Artificial Sequence
  Description of Artificial Sequence: Synthetic oligonucleotide
tccagttcggatcccaaattaaatattcttgtactaaagggatac

SEQ ID NO: 205373 - DNA, 44 bp, Artificial Sequence
  Description of Artificial Sequence: Synthetic oligonucleotide
ccagttcggatcccaaattaaatattcttgtactaaagggatac

SEQ ID NO: 205374 - DNA, 44 bp, Artificial Sequence
  Description of Artificial Sequence: Synthetic oligonucleotide
cagttcggatcccaaattaaatattcttgtactaaagggatacc

SEQ ID NO: 205375 - DNA, 44 bp, Artificial Sequence
  Description of Artificial Sequence: Synthetic oligonucleotide
agttcggatcccaaattaaatattcttgtactaaagggataccg

SEQ ID NO: 205376 - DNA, 43 bp, Artificial Sequence
  Description of Artificial Sequence: Synthetic oligonucleotide
gttcggatcccaaattaaatattcttgtactaaagggataccg

SEQ ID NO: 205377 - DNA, 44 bp, Artificial Sequence
  Description of Artificial Sequence: Synthetic oligonucleotide
ttcggatcccaaattaaatattcttgtactaaagggataccgac

SEQ ID NO: 205378 - DNA, 43 bp, Artificial Sequence
  Description of Artificial Sequence: Synthetic oligonucleotide
tcggatcccaaattaaatattcttgtactaaagggataccgac

SEQ ID NO: 205379 - DNA, 42 bp, Artificial Sequence
  Description of Artificial Sequence: Synthetic oligonucleotide
cggatcccaaattaaatattcttgtactaaagggataccgac

SEQ ID NO: 205380 - DNA, 43 bp, Artificial Sequence
  Description of Artificial Sequence: Synthetic oligonucleotide
ggatcccaaattaaatattcttgtactaaagggataccgactc

SEQ ID NO: 205381 - DNA, 46 bp, Artificial Sequence
  Description of Artificial Sequence: Synthetic oligonucleotide
gatcccaaattaaatattcttgtactaaagggataccgactcattg

SEQ ID NO: 205382 - DNA, 46 bp, Artificial Sequence
  Description of Artificial Sequence: Synthetic oligonucleotide
atcccaaattaaatattcttgtactaaagggataccgactcattgg

SEQ ID NO: 205383 - DNA, 45 bp, Artificial Sequence
  Description of Artificial Sequence: Synthetic oligonucleotide
tcccaaattaaatattcttgtactaaagggataccgactcattgg

SEQ ID NO: 205384 - DNA, 44 bp, Artificial Sequence
  Description of Artificial Sequence: Synthetic oligonucleotide
cccaaattaaatattcttgtactaaagggataccgactcattgg

SEQ ID NO: 205385 - DNA, 46 bp, Artificial Sequence
  Description of Artificial Sequence: Synthetic oligonucleotide
ccaaattaaatattcttgtactaaagggataccgactcattggttc

SEQ ID NO: 205386 - DNA, 46 bp, Artificial Sequence
  Description of Artificial Sequence: Synthetic oligonucleotide
caaattaaatattcttgtactaaagggataccgactcattggttcc

SEQ ID NO: 205387 - DNA, 47 bp, Artificial Sequence
  Description of Artificial Sequence: Synthetic oligonucleotide
aaattaaatattcttgtactaaagggataccgactcattggttcctc

SEQ ID NO: 205388 - DNA, 46 bp, Artificial Sequence
  Description of Artificial Sequence: Synthetic oligonucleotide
aattaaatattcttgtactaaagggataccgactcattggttcctc

SEQ ID NO: 205389 - DNA, 45 bp, Artificial Sequence
  Description of Artificial Sequence: Synthetic oligonucleotide
attaaatattcttgtactaaagggataccgactcattggttcctc

SEQ ID NO: 205390 - DNA, 44 bp, Artificial Sequence
  Description of Artificial Sequence: Synthetic oligonucleotide
ttaaatattcttgtactaaagggataccgactcattggttcctc

SEQ ID NO: 205391 - DNA, 43 bp, Artificial Sequence
  Description of Artificial Sequence: Synthetic oligonucleotide
taaatattcttgtactaaagggataccgactcattggttcctc

SEQ ID NO: 205392 - DNA, 42 bp, Artificial Sequence
  Description of Artificial Sequence: Synthetic oligonucleotide
aaatattcttgtactaaagggataccgactcattggttcctc

SEQ ID NO: 205393 - DNA, 41 bp, Artificial Sequence
  Description of Artificial Sequence: Synthetic oligonucleotide
aatattcttgtactaaagggataccgactcattggttcctc

SEQ ID NO: 205394 - DNA, 40 bp, Artificial Sequence
  Description of Artificial Sequence: Synthetic oligonucleotide
atattcttgtactaaagggataccgactcattggttcctc

SEQ ID NO: 205395 - DNA, 39 bp, Artificial Sequence
  Description of Artificial Sequence: Synthetic oligonucleotide
tattcttgtactaaagggataccgactcattggttcctc

SEQ ID NO: 205396 - DNA, 38 bp, Artificial Sequence
  Description of Artificial Sequence: Synthetic oligonucleotide
attcttgtactaaagggataccgactcattggttcctc

SEQ ID NO: 205397 - DNA, 37 bp, Artificial Sequence
  Description of Artificial Sequence: Synthetic oligonucleotide
ttcttgtactaaagggataccgactcattggttcctc

SEQ ID NO: 205398 - DNA, 36 bp, Artificial Sequence
  Description of Artificial Sequence: Synthetic oligonucleotide
tcttgtactaaagggataccgactcattggttcctc

SEQ ID NO: 205399 - DNA, 35 bp, Artificial Sequence
  Description of Artificial Sequence: Synthetic oligonucleotide
cttgtactaaagggataccgactcattggttcctc

SEQ ID NO: 205400 - DNA, 35 bp, Artificial Sequence
  Description of Artificial Sequence: Synthetic oligonucleotide
ttgtactaaagggataccgactcattggttcctcg

SEQ ID NO: 205401 - DNA, 34 bp, Artificial Sequence
  Description of Artificial Sequence: Synthetic oligonucleotide
tgtactaaagggataccgactcattggttcctcg

SEQ ID NO: 205402 - DNA, 33 bp, Artificial Sequence
  Description of Artificial Sequence: Synthetic oligonucleotide
gtactaaagggataccgactcattggttcctcg

SEQ ID NO: 205403 - DNA, 34 bp, Artificial Sequence
  Description of Artificial Sequence: Synthetic oligonucleotide
tactaaagggataccgactcattggttcctcgtc

SEQ ID NO: 205404 - DNA, 33 bp, Artificial Sequence
  Description of Artificial Sequence: Synthetic oligonucleotide
actaaagggataccgactcattggttcctcgtc

SEQ ID NO: 205405 - DNA, 32 bp, Artificial Sequence
  Description of Artificial Sequence: Synthetic oligonucleotide
ctaaagggataccgactcattggttcctcgtc

SEQ ID NO: 205406 - DNA, 33 bp, Artificial Sequence
  Description of Artificial Sequence: Synthetic oligonucleotide
taaagggataccgactcattggttcctcgtctg

SEQ ID NO: 205407 - DNA, 32 bp, Artificial Sequence
  Description of Artificial Sequence: Synthetic oligonucleotide
aaagggataccgactcattggttcctcgtctg

SEQ ID NO: 205408 - DNA, 31 bp, Artificial Sequence
  Description of Artificial Sequence: Synthetic oligonucleotide
aagggataccgactcattggttcctcgtctg

SEQ ID NO: 205409 - DNA, 30 bp, Artificial Sequence
  Description of Artificial Sequence: Synthetic oligonucleotide
agggataccgactcattggttcctcgtctg

SEQ ID NO: 205410 - DNA, 29 bp, Artificial Sequence
  Description of Artificial Sequence: Synthetic oligonucleotide
gggataccgactcattggttcctcgtctg

SEQ ID NO: 205411 - DNA, 29 bp, Artificial Sequence
  Description of Artificial Sequence: Synthetic oligonucleotide
ggataccgactcattggttcctcgtctgc

SEQ ID NO: 205412 - DNA, 29 bp, Artificial Sequence
  Description of Artificial Sequence: Synthetic oligonucleotide
gataccgactcattggttcctcgtctgcc

SEQ ID NO: 205413 - DNA, 30 bp, Artificial Sequence
  Description of Artificial Sequence: Synthetic oligonucleotide
ataccgactcattggttcctcgtctgccac

SEQ ID NO: 205414 - DNA, 29 bp, Artificial Sequence
  Description of Artificial Sequence: Synthetic oligonucleotide
taccgactcattggttcctcgtctgccac

SEQ ID NO: 205415 - DNA, 28 bp, Artificial Sequence
  Description of Artificial Sequence: Synthetic oligonucleotide
accgactcattggttcctcgtctgccac

SEQ ID NO: 205416 - DNA, 27 bp, Artificial Sequence
  Description of Artificial Sequence: Synthetic oligonucleotide
ccgactcattggttcctcgtctgccac

SEQ ID NO: 205417 - DNA, 29 bp, Artificial Sequence
  Description of Artificial Sequence: Synthetic oligonucleotide
cgactcattggttcctcgtctgccacatg

SEQ ID NO: 205418 - DNA, 29 bp, Artificial Sequence
  Description of Artificial Sequence: Synthetic oligonucleotide
gactcattggttcctcgtctgccacatgc

SEQ ID NO: 205419 - DNA, 31 bp, Artificial Sequence
  Description of Artificial Sequence: Synthetic oligonucleotide
actcattggttcctcgtctgccacatgcatc

SEQ ID NO: 205420 - DNA, 30 bp, Artificial Sequence
  Description of Artificial Sequence: Synthetic oligonucleotide
ctcattggttcctcgtctgccacatgcatc

SEQ ID NO: 205421 - DNA, 32 bp, Artificial Sequence
  Description of Artificial Sequence: Synthetic oligonucleotide
tcattggttcctcgtctgccacatgcatcatc

SEQ ID NO: 205422 - DNA, 31 bp, Artificial Sequence
  Description of Artificial Sequence: Synthetic oligonucleotide
cattggttcctcgtctgccacatgcatcatc

SEQ ID NO: 205423 - DNA, 32 bp, Artificial Sequence
  Description of Artificial Sequence: Synthetic oligonucleotide
attggttcctcgtctgccacatgcatcatctc

SEQ ID NO: 205424 - DNA, 31 bp, Artificial Sequence
  Description of Artificial Sequence: Synthetic oligonucleotide
ttggttcctcgtctgccacatgcatcatctc

SEQ ID NO: 205425 - DNA, 30 bp, Artificial Sequence
  Description of Artificial Sequence: Synthetic oligonucleotide
tggttcctcgtctgccacatgcatcatctc

SEQ ID NO: 205426 - DNA, 29 bp, Artificial Sequence
  Description of Artificial Sequence: Synthetic oligonucleotide
ggttcctcgtctgccacatgcatcatctc

SEQ ID NO: 205427 - DNA, 30 bp, Artificial Sequence
  Description of Artificial Sequence: Synthetic oligonucleotide
gttcctcgtctgccacatgcatcatctcag

SEQ ID NO: 205428 - DNA, 30 bp, Artificial Sequence
  Description of Artificial Sequence: Synthetic oligonucleotide
ttcctcgtctgccacatgcatcatctcagg

SEQ ID NO: 205429 - DNA, 29 bp, Artificial Sequence
  Description of Artificial Sequence: Synthetic oligonucleotide
tcctcgtctgccacatgcatcatctcagg

SEQ ID NO: 205430 - DNA, 28 bp, Artificial Sequence
  Description of Artificial Sequence: Synthetic oligonucleotide
cctcgtctgccacatgcatcatctcagg

SEQ ID NO: 205431 - DNA, 29 bp, Artificial Sequence
  Description of Artificial Sequence: Synthetic oligonucleotide
ctcgtctgccacatgcatcatctcaggtg

SEQ ID NO: 205432 - DNA, 32 bp, Artificial Sequence
  Description of Artificial Sequence: Synthetic oligonucleotide
tcgtctgccacatgcatcatctcaggtgatac

SEQ ID NO: 205433 - DNA, 31 bp, Artificial Sequence
  Description of Artificial Sequence: Synthetic oligonucleotide
cgtctgccacatgcatcatctcaggtgatac

SEQ ID NO: 205434 - DNA, 32 bp, Artificial Sequence
  Description of Artificial Sequence: Synthetic oligonucleotide
gtctgccacatgcatcatctcaggtgatactg

SEQ ID NO: 205435 - DNA, 33 bp, Artificial Sequence
  Description of Artificial Sequence: Synthetic oligonucleotide
tctgccacatgcatcatctcaggtgatactgtc

SEQ ID NO: 205436 - DNA, 32 bp, Artificial Sequence
  Description of Artificial Sequence: Synthetic oligonucleotide
ctgccacatgcatcatctcaggtgatactgtc

SEQ ID NO: 205437 - DNA, 36 bp, Artificial Sequence
  Description of Artificial Sequence: Synthetic oligonucleotide
tgccacatgcatcatctcaggtgatactgtcatttg

SEQ ID NO: 205438 - DNA, 35 bp, Artificial Sequence
  Description of Artificial Sequence: Synthetic oligonucleotide
gccacatgcatcatctcaggtgatactgtcatttg

SEQ ID NO: 205439 - DNA, 35 bp, Artificial Sequence
  Description of Artificial Sequence: Synthetic oligonucleotide
ccacatgcatcatctcaggtgatactgtcatttgg

SEQ ID NO: 205440 - DNA, 35 bp, Artificial Sequence
  Description of Artificial Sequence: Synthetic oligonucleotide
cacatgcatcatctcaggtgatactgtcatttggg

SEQ ID NO: 205441 - DNA, 40 bp, Artificial Sequence
  Description of Artificial Sequence: Synthetic oligonucleotide
acatgcatcatctcaggtgatactgtcatttgggataatg

SEQ ID NO: 205442 - DNA, 39 bp, Artificial Sequence
  Description of Artificial Sequence: Synthetic oligonucleotide
catgcatcatctcaggtgatactgtcatttgggataatg

SEQ ID NO: 205443 - DNA, 42 bp, Artificial Sequence
  Description of Artificial Sequence: Synthetic oligonucleotide
atgcatcatctcaggtgatactgtcatttgggataatgaaac

SEQ ID NO: 205444 - DNA, 41 bp, Artificial Sequence
  Description of Artificial Sequence: Synthetic oligonucleotide
tgcatcatctcaggtgatactgtcatttgggataatgaaac

SEQ ID NO: 205445 - DNA, 40 bp, Artificial Sequence
  Description of Artificial Sequence: Synthetic oligonucleotide
gcatcatctcaggtgatactgtcatttgggataatgaaac

SEQ ID NO: 205446 - DNA, 41 bp, Artificial Sequence
  Description of Artificial Sequence: Synthetic oligonucleotide
catcatctcaggtgatactgtcatttgggataatgaaacac

SEQ ID NO: 205447 - DNA, 41 bp, Artificial Sequence
  Description of Artificial Sequence: Synthetic oligonucleotide
atcatctcaggtgatactgtcatttgggataatgaaacacc

SEQ ID NO: 205448 - DNA, 40 bp, Artificial Sequence
  Description of Artificial Sequence: Synthetic oligonucleotide
tcatctcaggtgatactgtcatttgggataatgaaacacc

SEQ ID NO: 205449 - DNA, 39 bp, Artificial Sequence
  Description of Artificial Sequence: Synthetic oligonucleotide
catctcaggtgatactgtcatttgggataatgaaacacc

SEQ ID NO: 205450 - DNA, 44 bp, Artificial Sequence
  Description of Artificial Sequence: Synthetic oligonucleotide
atctcaggtgatactgtcatttgggataatgaaacacctatttg

SEQ ID NO: 205451 - DNA, 43 bp, Artificial Sequence
  Description of Artificial Sequence: Synthetic oligonucleotide
tctcaggtgatactgtcatttgggataatgaaacacctatttg

SEQ ID NO: 205452 - DNA, 42 bp, Artificial Sequence
  Description of Artificial Sequence: Synthetic oligonucleotide
ctcaggtgatactgtcatttgggataatgaaacacctatttg

SEQ ID NO: 205453 - DNA, 43 bp, Artificial Sequence
  Description of Artificial Sequence: Synthetic oligonucleotide
tcaggtgatactgtcatttgggataatgaaacacctatttgtg

SEQ ID NO: 205454 - DNA, 42 bp, Artificial Sequence
  Description of Artificial Sequence: Synthetic oligonucleotide
caggtgatactgtcatttgggataatgaaacacctatttgtg

SEQ ID NO: 205455 - DNA, 43 bp, Artificial Sequence
  Description of Artificial Sequence: Synthetic oligonucleotide
aggtgatactgtcatttgggataatgaaacacctatttgtgac

SEQ ID NO: 205456 - DNA, 42 bp, Artificial Sequence
  Description of Artificial Sequence: Synthetic oligonucleotide
ggtgatactgtcatttgggataatgaaacacctatttgtgac

SEQ ID NO: 205457 - DNA, 43 bp, Artificial Sequence
  Description of Artificial Sequence: Synthetic oligonucleotide
gtgatactgtcatttgggataatgaaacacctatttgtgacag

SEQ ID NO: 205458 - DNA, 47 bp, Artificial Sequence
  Description of Artificial Sequence: Synthetic oligonucleotide
tgatactgtcatttgggataatgaaacacctatttgtgacagaattc

SEQ ID NO: 205459 - DNA, 46 bp, Artificial Sequence
  Description of Artificial Sequence: Synthetic oligonucleotide
gatactgtcatttgggataatgaaacacctatttgtgacagaattc

SEQ ID NO: 205460 - DNA, 46 bp, Artificial Sequence
  Description of Artificial Sequence: Synthetic oligonucleotide
atactgtcatttgggataatgaaacacctatttgtgacagaattcc

SEQ ID NO: 205461 - DNA, 45 bp, Artificial Sequence
  Description of Artificial Sequence: Synthetic oligonucleotide
tactgtcatttgggataatgaaacacctatttgtgacagaattcc

SEQ ID NO: 205462 - DNA, 44 bp, Artificial Sequence
  Description of Artificial Sequence: Synthetic oligonucleotide
actgtcatttgggataatgaaacacctatttgtgacagaattcc

SEQ ID NO: 205463 - DNA, 43 bp, Artificial Sequence
  Description of Artificial Sequence: Synthetic oligonucleotide
ctgtcatttgggataatgaaacacctatttgtgacagaattcc

SEQ ID NO: 205464 - DNA, 45 bp, Artificial Sequence
  Description of Artificial Sequence: Synthetic oligonucleotide
tgtcatttgggataatgaaacacctatttgtgacagaattccttg

SEQ ID NO: 205465 - DNA, 44 bp, Artificial Sequence
  Description of Artificial Sequence: Synthetic oligonucleotide
gtcatttgggataatgaaacacctatttgtgacagaattccttg

SEQ ID NO: 205466 - DNA, 45 bp, Artificial Sequence
  Description of Artificial Sequence: Synthetic oligonucleotide
tcatttgggataatgaaacacctatttgtgacagaattccttgtg

SEQ ID NO: 205467 - DNA, 44 bp, Artificial Sequence
  Description of Artificial Sequence: Synthetic oligonucleotide
catttgggataatgaaacacctatttgtgacagaattccttgtg

SEQ ID NO: 205468 - DNA, 44 bp, Artificial Sequence
  Description of Artificial Sequence: Synthetic oligonucleotide
atttgggataatgaaacacctatttgtgacagaattccttgtgg

SEQ ID NO: 205469 - DNA, 43 bp, Artificial Sequence
  Description of Artificial Sequence: Synthetic oligonucleotide
tttgggataatgaaacacctatttgtgacagaattccttgtgg

SEQ ID NO: 205470 - DNA, 42 bp, Artificial Sequence
  Description of Artificial Sequence: Synthetic oligonucleotide
ttgggataatgaaacacctatttgtgacagaattccttgtgg

SEQ ID NO: 205471 - DNA, 41 bp, Artificial Sequence
  Description of Artificial Sequence: Synthetic oligonucleotide
tgggataatgaaacacctatttgtgacagaattccttgtgg

SEQ ID NO: 205472 - DNA, 40 bp, Artificial Sequence
  Description of Artificial Sequence: Synthetic oligonucleotide
gggataatgaaacacctatttgtgacagaattccttgtgg

SEQ ID NO: 205473 - DNA, 40 bp, Artificial Sequence
  Description of Artificial Sequence: Synthetic oligonucleotide
ggataatgaaacacctatttgtgacagaattccttgtggg

SEQ ID NO: 205474 - DNA, 40 bp, Artificial Sequence
  Description of Artificial Sequence: Synthetic oligonucleotide
gataatgaaacacctatttgtgacagaattccttgtgggc

SEQ ID NO: 205475 - DNA, 42 bp, Artificial Sequence
  Description of Artificial Sequence: Synthetic oligonucleotide
ataatgaaacacctatttgtgacagaattccttgtgggctac

SEQ ID NO: 205476 - DNA, 41 bp, Artificial Sequence
  Description of Artificial Sequence: Synthetic oligonucleotide
taatgaaacacctatttgtgacagaattccttgtgggctac

SEQ ID NO: 205477 - DNA, 40 bp, Artificial Sequence
  Description of Artificial Sequence: Synthetic oligonucleotide
aatgaaacacctatttgtgacagaattccttgtgggctac

SEQ ID NO: 205478 - DNA, 39 bp, Artificial Sequence
  Description of Artificial Sequence: Synthetic oligonucleotide
atgaaacacctatttgtgacagaattccttgtgggctac

SEQ ID NO: 205479 - DNA, 38 bp, Artificial Sequence
  Description of Artificial Sequence: Synthetic oligonucleotide
tgaaacacctatttgtgacagaattccttgtgggctac

SEQ ID NO: 205480 - DNA, 37 bp, Artificial Sequence
  Description of Artificial Sequence: Synthetic oligonucleotide
gaaacacctatttgtgacagaattccttgtgggctac

SEQ ID NO: 205481 - DNA, 37 bp, Artificial Sequence
  Description of Artificial Sequence: Synthetic oligonucleotide
aaacacctatttgtgacagaattccttgtgggctacc

SEQ ID NO: 205482 - DNA, 36 bp, Artificial Sequence
  Description of Artificial Sequence: Synthetic oligonucleotide
aacacctatttgtgacagaattccttgtgggctacc

SEQ ID NO: 205483 - DNA, 35 bp, Artificial Sequence
  Description of Artificial Sequence: Synthetic oligonucleotide
acacctatttgtgacagaattccttgtgggctacc

SEQ ID NO: 205484 - DNA, 34 bp, Artificial Sequence
  Description of Artificial Sequence: Synthetic oligonucleotide
cacctatttgtgacagaattccttgtgggctacc

SEQ ID NO: 205485 - DNA, 34 bp, Artificial Sequence
  Description of Artificial Sequence: Synthetic oligonucleotide
acctatttgtgacagaattccttgtgggctaccc

SEQ ID NO: 205486 - DNA, 33 bp, Artificial Sequence
  Description of Artificial Sequence: Synthetic oligonucleotide
cctatttgtgacagaattccttgtgggctaccc

SEQ ID NO: 205487 - DNA, 33 bp, Artificial Sequence
  Description of Artificial Sequence: Synthetic oligonucleotide
ctatttgtgacagaattccttgtgggctacccc

SEQ ID NO: 205488 - DNA, 33 bp, Artificial Sequence
  Description of Artificial Sequence: Synthetic oligonucleotide
tatttgtgacagaattccttgtgggctaccccc

SEQ ID NO: 205489 - DNA, 32 bp, Artificial Sequence
  Description of Artificial Sequence: Synthetic oligonucleotide
atttgtgacagaattccttgtgggctaccccc

SEQ ID NO: 205490 - DNA, 31 bp, Artificial Sequence
  Description of Artificial Sequence: Synthetic oligonucleotide
tttgtgacagaattccttgtgggctaccccc

SEQ ID NO: 205491 - DNA, 30 bp, Artificial Sequence
  Description of Artificial Sequence: Synthetic oligonucleotide
ttgtgacagaattccttgtgggctaccccc

SEQ ID NO: 205492 - DNA, 29 bp, Artificial Sequence
  Description of Artificial Sequence: Synthetic oligonucleotide
tgtgacagaattccttgtgggctaccccc

SEQ ID NO: 205493 - DNA, 28 bp, Artificial Sequence
  Description of Artificial Sequence: Synthetic oligonucleotide
gtgacagaattccttgtgggctaccccc

SEQ ID NO: 205494 - DNA, 28 bp, Artificial Sequence
  Description of Artificial Sequence: Synthetic oligonucleotide
tgacagaattccttgtgggctacccccc

SEQ ID NO: 205495 - DNA, 27 bp, Artificial Sequence
  Description of Artificial Sequence: Synthetic oligonucleotide
gacagaattccttgtgggctacccccc

SEQ ID NO: 205496 - DNA, 28 bp, Artificial Sequence
  Description of Artificial Sequence: Synthetic oligonucleotide
acagaattccttgtgggctaccccccac

SEQ ID NO: 205497 - DNA, 27 bp, Artificial Sequence
  Description of Artificial Sequence: Synthetic oligonucleotide
cagaattccttgtgggctaccccccac

SEQ ID NO: 205498 - DNA, 27 bp, Artificial Sequence
  Description of Artificial Sequence: Synthetic oligonucleotide
agaattccttgtgggctaccccccacc

SEQ ID NO: 205499 - DNA, 27 bp, Artificial Sequence
  Description of Artificial Sequence: Synthetic oligonucleotide
gaattccttgtgggctaccccccacca

SEQ ID NO: 205500 - DNA, 28 bp, Artificial Sequence
  Description of Artificial Sequence: Synthetic oligonucleotide
aattccttgtgggctaccccccaccatc

SEQ ID NO: 205501 - DNA, 27 bp, Artificial Sequence
  Description of Artificial Sequence: Synthetic oligonucleotide
attccttgtgggctaccccccaccatc

SEQ ID NO: 205502 - DNA, 27 bp, Artificial Sequence
  Description of Artificial Sequence: Synthetic oligonucleotide
ttccttgtgggctaccccccaccatca

SEQ ID NO: 205503 - DNA, 26 bp, Artificial Sequence
  Description of Artificial Sequence: Synthetic oligonucleotide
tccttgtgggctaccccccaccatca

SEQ ID NO: 205504 - DNA, 25 bp, Artificial Sequence
  Description of Artificial Sequence: Synthetic oligonucleotide
ccttgtgggctaccccccaccatca

SEQ ID NO: 205505 - DNA, 25 bp, Artificial Sequence
  Description of Artificial Sequence: Synthetic oligonucleotide
cttgtgggctaccccccaccatcac

SEQ ID NO: 205506 - DNA, 27 bp, Artificial Sequence
  Description of Artificial Sequence: Synthetic oligonucleotide
ttgtgggctaccccccaccatcaccaa

SEQ ID NO: 205507 - DNA, 27 bp, Artificial Sequence
  Description of Artificial Sequence: Synthetic oligonucleotide
tgtgggctaccccccaccatcaccaat

SEQ ID NO: 205508 - DNA, 26 bp, Artificial Sequence
  Description of Artificial Sequence: Synthetic oligonucleotide
gtgggctaccccccaccatcaccaat

SEQ ID NO: 205509 - DNA, 26 bp, Artificial Sequence
  Description of Artificial Sequence: Synthetic oligonucleotide
tgggctaccccccaccatcaccaatg

SEQ ID NO: 205510 - DNA, 25 bp, Artificial Sequence
  Description of Artificial Sequence: Synthetic oligonucleotide
gggctaccccccaccatcaccaatg

SEQ ID NO: 205511 - DNA, 26 bp, Artificial Sequence
  Description of Artificial Sequence: Synthetic oligonucleotide
ggctaccccccaccatcaccaatgga

SEQ ID NO: 205512 - DNA, 27 bp, Artificial Sequence
  Description of Artificial Sequence: Synthetic oligonucleotide
gctaccccccaccatcaccaatggaga

SEQ ID NO: 205513 - DNA, 30 bp, Artificial Sequence
  Description of Artificial Sequence: Synthetic oligonucleotide
ctaccccccaccatcaccaatggagatttc

SEQ ID NO: 205514 - DNA, 34 bp, Artificial Sequence
  Description of Artificial Sequence: Synthetic oligonucleotide
taccccccaccatcaccaatggagatttcattag

SEQ ID NO: 205515 - DNA, 33 bp, Artificial Sequence
  Description of Artificial Sequence: Synthetic oligonucleotide
accccccaccatcaccaatggagatttcattag

SEQ ID NO: 205516 - DNA, 32 bp, Artificial Sequence
  Description of Artificial Sequence: Synthetic oligonucleotide
ccccccaccatcaccaatggagatttcattag

SEQ ID NO: 205517 - DNA, 32 bp, Artificial Sequence
  Description of Artificial Sequence: Synthetic oligonucleotide
cccccaccatcaccaatggagatttcattagc

SEQ ID NO: 205518 - DNA, 33 bp, Artificial Sequence
  Description of Artificial Sequence: Synthetic oligonucleotide
ccccaccatcaccaatggagatttcattagcac

SEQ ID NO: 205519 - DNA, 33 bp, Artificial Sequence
  Description of Artificial Sequence: Synthetic oligonucleotide
cccaccatcaccaatggagatttcattagcacc

SEQ ID NO: 205520 - DNA, 35 bp, Artificial Sequence
  Description of Artificial Sequence: Synthetic oligonucleotide
ccaccatcaccaatggagatttcattagcaccaac

SEQ ID NO: 205521 - DNA, 36 bp, Artificial Sequence
  Description of Artificial Sequence: Synthetic oligonucleotide
caccatcaccaatggagatttcattagcaccaacag

SEQ ID NO: 205522 - DNA, 37 bp, Artificial Sequence
  Description of Artificial Sequence: Synthetic oligonucleotide
accatcaccaatggagatttcattagcaccaacagag

SEQ ID NO: 205523 - DNA, 36 bp, Artificial Sequence
  Description of Artificial Sequence: Synthetic oligonucleotide
ccatcaccaatggagatttcattagcaccaacagag

SEQ ID NO: 205524 - DNA, 37 bp, Artificial Sequence
  Description of Artificial Sequence: Synthetic oligonucleotide
catcaccaatggagatttcattagcaccaacagagag

SEQ ID NO: 205525 - DNA, 43 bp, Artificial Sequence
  Description of Artificial Sequence: Synthetic oligonucleotide
atcaccaatggagatttcattagcaccaacagagagaattttc

SEQ ID NO: 205526 - DNA, 42 bp, Artificial Sequence
  Description of Artificial Sequence: Synthetic oligonucleotide
tcaccaatggagatttcattagcaccaacagagagaattttc

SEQ ID NO: 205527 - DNA, 41 bp, Artificial Sequence
  Description of Artificial Sequence: Synthetic oligonucleotide
caccaatggagatttcattagcaccaacagagagaattttc

SEQ ID NO: 205528 - DNA, 42 bp, Artificial Sequence
  Description of Artificial Sequence: Synthetic oligonucleotide
accaatggagatttcattagcaccaacagagagaattttcac

SEQ ID NO: 205529 - DNA, 41 bp, Artificial Sequence
  Description of Artificial Sequence: Synthetic oligonucleotide
ccaatggagatttcattagcaccaacagagagaattttcac

SEQ ID NO: 205530 - DNA, 44 bp, Artificial Sequence
  Description of Artificial Sequence: Synthetic oligonucleotide
caatggagatttcattagcaccaacagagagaattttcactatg

SEQ ID NO: 205531 - DNA, 44 bp, Artificial Sequence
  Description of Artificial Sequence: Synthetic oligonucleotide
aatggagatttcattagcaccaacagagagaattttcactatgg

SEQ ID NO: 205532 - DNA, 43 bp, Artificial Sequence
  Description of Artificial Sequence: Synthetic oligonucleotide
atggagatttcattagcaccaacagagagaattttcactatgg

SEQ ID NO: 205533 - DNA, 42 bp, Artificial Sequence
  Description of Artificial Sequence: Synthetic oligonucleotide
tggagatttcattagcaccaacagagagaattttcactatgg

SEQ ID NO: 205534 - DNA, 41 bp, Artificial Sequence
  Description of Artificial Sequence: Synthetic oligonucleotide
ggagatttcattagcaccaacagagagaattttcactatgg

SEQ ID NO: 205535 - DNA, 43 bp, Artificial Sequence
  Description of Artificial Sequence: Synthetic oligonucleotide
gagatttcattagcaccaacagagagaattttcactatggatc

SEQ ID NO: 205536 - DNA, 44 bp, Artificial Sequence
  Description of Artificial Sequence: Synthetic oligonucleotide
agatttcattagcaccaacagagagaattttcactatggatcag

SEQ ID NO: 205537 - DNA, 43 bp, Artificial Sequence
  Description of Artificial Sequence: Synthetic oligonucleotide
gatttcattagcaccaacagagagaattttcactatggatcag

SEQ ID NO: 205538 - DNA, 44 bp, Artificial Sequence
  Description of Artificial Sequence: Synthetic oligonucleotide
atttcattagcaccaacagagagaattttcactatggatcagtg

SEQ ID NO: 205539 - DNA, 43 bp, Artificial Sequence
  Description of Artificial Sequence: Synthetic oligonucleotide
tttcattagcaccaacagagagaattttcactatggatcagtg

SEQ ID NO: 205540 - DNA, 42 bp, Artificial Sequence
  Description of Artificial Sequence: Synthetic oligonucleotide
ttcattagcaccaacagagagaattttcactatggatcagtg

SEQ ID NO: 205541 - DNA, 41 bp, Artificial Sequence
  Description of Artificial Sequence: Synthetic oligonucleotide
tcattagcaccaacagagagaattttcactatggatcagtg

SEQ ID NO: 205542 - DNA, 40 bp, Artificial Sequence
  Description of Artificial Sequence: Synthetic oligonucleotide
cattagcaccaacagagagaattttcactatggatcagtg

SEQ ID NO: 205543 - DNA, 40 bp, Artificial Sequence
  Description of Artificial Sequence: Synthetic oligonucleotide
attagcaccaacagagagaattttcactatggatcagtgg

SEQ ID NO: 205544 - DNA, 39 bp, Artificial Sequence
  Description of Artificial Sequence: Synthetic oligonucleotide
ttagcaccaacagagagaattttcactatggatcagtgg

SEQ ID NO: 205545 - DNA, 38 bp, Artificial Sequence
  Description of Artificial Sequence: Synthetic oligonucleotide
tagcaccaacagagagaattttcactatggatcagtgg

SEQ ID NO: 205546 - DNA, 37 bp, Artificial Sequence
  Description of Artificial Sequence: Synthetic oligonucleotide
agcaccaacagagagaattttcactatggatcagtgg

SEQ ID NO: 205547 - DNA, 36 bp, Artificial Sequence
  Description of Artificial Sequence: Synthetic oligonucleotide
gcaccaacagagagaattttcactatggatcagtgg

SEQ ID NO: 205548 - DNA, 37 bp, Artificial Sequence
  Description of Artificial Sequence: Synthetic oligonucleotide
caccaacagagagaattttcactatggatcagtggtg

SEQ ID NO: 205549 - DNA, 38 bp, Artificial Sequence
  Description of Artificial Sequence: Synthetic oligonucleotide
accaacagagagaattttcactatggatcagtggtgac

SEQ ID NO: 205550 - DNA, 37 bp, Artificial Sequence
  Description of Artificial Sequence: Synthetic oligonucleotide
ccaacagagagaattttcactatggatcagtggtgac

SEQ ID NO: 205551 - DNA, 37 bp, Artificial Sequence
  Description of Artificial Sequence: Synthetic oligonucleotide
caacagagagaattttcactatggatcagtggtgacc

SEQ ID NO: 205552 - DNA, 39 bp, Artificial Sequence
  Description of Artificial Sequence: Synthetic oligonucleotide
aacagagagaattttcactatggatcagtggtgacctac

SEQ ID NO: 205553 - DNA, 38 bp, Artificial Sequence
  Description of Artificial Sequence: Synthetic oligonucleotide
acagagagaattttcactatggatcagtggtgacctac

SEQ ID NO: 205554 - DNA, 37 bp, Artificial Sequence
  Description of Artificial Sequence: Synthetic oligonucleotide
cagagagaattttcactatggatcagtggtgacctac

SEQ ID NO: 205555 - DNA, 37 bp, Artificial Sequence
  Description of Artificial Sequence: Synthetic oligonucleotide
agagagaattttcactatggatcagtggtgacctacc

SEQ ID NO: 205556 - DNA, 36 bp, Artificial Sequence
  Description of Artificial Sequence: Synthetic oligonucleotide
gagagaattttcactatggatcagtggtgacctacc

SEQ ID NO: 205557 - DNA, 36 bp, Artificial Sequence
  Description of Artificial Sequence: Synthetic oligonucleotide
agagaattttcactatggatcagtggtgacctaccg

SEQ ID NO: 205558 - DNA, 35 bp, Artificial Sequence
  Description of Artificial Sequence: Synthetic oligonucleotide
gagaattttcactatggatcagtggtgacctaccg

SEQ ID NO: 205559 - DNA, 35 bp, Artificial Sequence
  Description of Artificial Sequence: Synthetic oligonucleotide
agaattttcactatggatcagtggtgacctaccgc

SEQ ID NO: 205560 - DNA, 34 bp, Artificial Sequence
  Description of Artificial Sequence: Synthetic oligonucleotide
gaattttcactatggatcagtggtgacctaccgc

SEQ ID NO: 205561 - DNA, 35 bp, Artificial Sequence
  Description of Artificial Sequence: Synthetic oligonucleotide
aattttcactatggatcagtggtgacctaccgctg

SEQ ID NO: 205562 - DNA, 34 bp, Artificial Sequence
  Description of Artificial Sequence: Synthetic oligonucleotide
attttcactatggatcagtggtgacctaccgctg

SEQ ID NO: 205563 - DNA, 33 bp, Artificial Sequence
  Description of Artificial Sequence: Synthetic oligonucleotide
ttttcactatggatcagtggtgacctaccgctg

SEQ ID NO: 205564 - DNA, 32 bp, Artificial Sequence
  Description of Artificial Sequence: Synthetic oligonucleotide
tttcactatggatcagtggtgacctaccgctg

SEQ ID NO: 205565 - DNA, 31 bp, Artificial Sequence
  Description of Artificial Sequence: Synthetic oligonucleotide
ttcactatggatcagtggtgacctaccgctg

SEQ ID NO: 205566 - DNA, 30 bp, Artificial Sequence
  Description of Artificial Sequence: Synthetic oligonucleotide
tcactatggatcagtggtgacctaccgctg

SEQ ID NO: 205567 - DNA, 29 bp, Artificial Sequence
  Description of Artificial Sequence: Synthetic oligonucleotide
cactatggatcagtggtgacctaccgctg

SEQ ID NO: 205568 - DNA, 29 bp, Artificial Sequence
  Description of Artificial Sequence: Synthetic oligonucleotide
actatggatcagtggtgacctaccgctgc

SEQ ID NO: 205569 - DNA, 28 bp, Artificial Sequence
  Description of Artificial Sequence: Synthetic oligonucleotide
ctatggatcagtggtgacctaccgctgc

SEQ ID NO: 205570 - DNA, 31 bp, Artificial Sequence
  Description of Artificial Sequence: Synthetic oligonucleotide
tatggatcagtggtgacctaccgctgcaatc

SEQ ID NO: 205571 - DNA, 30 bp, Artificial Sequence
  Description of Artificial Sequence: Synthetic oligonucleotide
atggatcagtggtgacctaccgctgcaatc

SEQ ID NO: 205572 - DNA, 29 bp, Artificial Sequence
  Description of Artificial Sequence: Synthetic oligonucleotide
tggatcagtggtgacctaccgctgcaatc

SEQ ID NO: 205573 - DNA, 28 bp, Artificial Sequence
  Description of Artificial Sequence: Synthetic oligonucleotide
ggatcagtggtgacctaccgctgcaatc

SEQ ID NO: 205574 - DNA, 28 bp, Artificial Sequence
  Description of Artificial Sequence: Synthetic oligonucleotide
gatcagtggtgacctaccgctgcaatcc

SEQ ID NO: 205575 - DNA, 29 bp, Artificial Sequence
  Description of Artificial Sequence: Synthetic oligonucleotide
atcagtggtgacctaccgctgcaatcctg

SEQ ID NO: 205576 - DNA, 28 bp, Artificial Sequence
  Description of Artificial Sequence: Synthetic oligonucleotide
tcagtggtgacctaccgctgcaatcctg

SEQ ID NO: 205577 - DNA, 27 bp, Artificial Sequence
  Description of Artificial Sequence: Synthetic oligonucleotide
cagtggtgacctaccgctgcaatcctg

SEQ ID NO: 205578 - DNA, 27 bp, Artificial Sequence
  Description of Artificial Sequence: Synthetic oligonucleotide
agtggtgacctaccgctgcaatcctgg

SEQ ID NO: 205579 - DNA, 27 bp, Artificial Sequence
  Description of Artificial Sequence: Synthetic oligonucleotide
gtggtgacctaccgctgcaatcctgga

SEQ ID NO: 205580 - DNA, 28 bp, Artificial Sequence
  Description of Artificial Sequence: Synthetic oligonucleotide
tggtgacctaccgctgcaatcctggaag

SEQ ID NO: 205581 - DNA, 27 bp, Artificial Sequence
  Description of Artificial Sequence: Synthetic oligonucleotide
ggtgacctaccgctgcaatcctggaag

SEQ ID NO: 205582 - DNA, 27 bp, Artificial Sequence
  Description of Artificial Sequence: Synthetic oligonucleotide
gtgacctaccgctgcaatcctggaagc

SEQ ID NO: 205583 - DNA, 27 bp, Artificial Sequence
  Description of Artificial Sequence: Synthetic oligonucleotide
tgacctaccgctgcaatcctggaagcg

SEQ ID NO: 205584 - DNA, 26 bp, Artificial Sequence
  Description of Artificial Sequence: Synthetic oligonucleotide
gacctaccgctgcaatcctggaagcg

SEQ ID NO: 205585 - DNA, 27 bp, Artificial Sequence
  Description of Artificial Sequence: Synthetic oligonucleotide
acctaccgctgcaatcctggaagcgga

SEQ ID NO: 205586 - DNA, 26 bp, Artificial Sequence
  Description of Artificial Sequence: Synthetic oligonucleotide
cctaccgctgcaatcctggaagcgga

SEQ ID NO: 205587 - DNA, 26 bp, Artificial Sequence
  Description of Artificial Sequence: Synthetic oligonucleotide
ctaccgctgcaatcctggaagcggag

SEQ ID NO: 205588 - DNA, 26 bp, Artificial Sequence
  Description of Artificial Sequence: Synthetic oligonucleotide
taccgctgcaatcctggaagcggagg

SEQ ID NO: 205589 - DNA, 25 bp, Artificial Sequence
  Description of Artificial Sequence: Synthetic oligonucleotide
accgctgcaatcctggaagcggagg

SEQ ID NO: 205590 - DNA, 24 bp, Artificial Sequence
  Description of Artificial Sequence: Synthetic oligonucleotide
ccgctgcaatcctggaagcggagg

SEQ ID NO: 205591 - DNA, 25 bp, Artificial Sequence
  Description of Artificial Sequence: Synthetic oligonucleotide
cgctgcaatcctggaagcggaggga

SEQ ID NO: 205592 - DNA, 27 bp, Artificial Sequence
  Description of Artificial Sequence: Synthetic oligonucleotide
gctgcaatcctggaagcggagggagaa

SEQ ID NO: 205593 - DNA, 28 bp, Artificial Sequence
  Description of Artificial Sequence: Synthetic oligonucleotide
ctgcaatcctggaagcggagggagaaag

SEQ ID NO: 205594 - DNA, 28 bp, Artificial Sequence
  Description of Artificial Sequence: Synthetic oligonucleotide
tgcaatcctggaagcggagggagaaagg

SEQ ID NO: 205595 - DNA, 27 bp, Artificial Sequence
  Description of Artificial Sequence: Synthetic oligonucleotide
gcaatcctggaagcggagggagaaagg

SEQ ID NO: 205596 - DNA, 28 bp, Artificial Sequence
  Description of Artificial Sequence: Synthetic oligonucleotide
caatcctggaagcggagggagaaaggtg

SEQ ID NO: 205597 - DNA, 31 bp, Artificial Sequence
  Description of Artificial Sequence: Synthetic oligonucleotide
aatcctggaagcggagggagaaaggtgtttg

SEQ ID NO: 205598 - DNA, 30 bp, Artificial Sequence
  Description of Artificial Sequence: Synthetic oligonucleotide
atcctggaagcggagggagaaaggtgtttg

SEQ ID NO: 205599 - DNA, 29 bp, Artificial Sequence
  Description of Artificial Sequence: Synthetic oligonucleotide
tcctggaagcggagggagaaaggtgtttg

SEQ ID NO: 205600 - DNA, 28 bp, Artificial Sequence
  Description of Artificial Sequence: Synthetic oligonucleotide
cctggaagcggagggagaaaggtgtttg

SEQ ID NO: 205601 - DNA, 29 bp, Artificial Sequence
  Description of Artificial Sequence: Synthetic oligonucleotide
ctggaagcggagggagaaaggtgtttgag

SEQ ID NO: 205602 - DNA, 29 bp, Artificial Sequence
  Description of Artificial Sequence: Synthetic oligonucleotide
tggaagcggagggagaaaggtgtttgagc

SEQ ID NO: 205603 - DNA, 28 bp, Artificial Sequence
  Description of Artificial Sequence: Synthetic oligonucleotide
ggaagcggagggagaaaggtgtttgagc

SEQ ID NO: 205604 - DNA, 30 bp, Artificial Sequence
  Description of Artificial Sequence: Synthetic oligonucleotide
gaagcggagggagaaaggtgtttgagcttg

SEQ ID NO: 205605 - DNA, 31 bp, Artificial Sequence
  Description of Artificial Sequence: Synthetic oligonucleotide
aagcggagggagaaaggtgtttgagcttgtg

SEQ ID NO: 205606 - DNA, 30 bp, Artificial Sequence
  Description of Artificial Sequence: Synthetic oligonucleotide
agcggagggagaaaggtgtttgagcttgtg

SEQ ID NO: 205607 - DNA, 29 bp, Artificial Sequence
  Description of Artificial Sequence: Synthetic oligonucleotide
gcggagggagaaaggtgtttgagcttgtg

SEQ ID NO: 205608 - DNA, 29 bp, Artificial Sequence
  Description of Artificial Sequence: Synthetic oligonucleotide
cggagggagaaaggtgtttgagcttgtgg

SEQ ID NO: 205609 - DNA, 29 bp, Artificial Sequence
  Description of Artificial Sequence: Synthetic oligonucleotide
ggagggagaaaggtgtttgagcttgtggg

SEQ ID NO: 205610 - DNA, 30 bp, Artificial Sequence
  Description of Artificial Sequence: Synthetic oligonucleotide
gagggagaaaggtgtttgagcttgtgggtg

SEQ ID NO: 205611 - DNA, 31 bp, Artificial Sequence
  Description of Artificial Sequence: Synthetic oligonucleotide
agggagaaaggtgtttgagcttgtgggtgag

SEQ ID NO: 205612 - DNA, 30 bp, Artificial Sequence
  Description of Artificial Sequence: Synthetic oligonucleotide
gggagaaaggtgtttgagcttgtgggtgag

SEQ ID NO: 205613 - DNA, 30 bp, Artificial Sequence
  Description of Artificial Sequence: Synthetic oligonucleotide
ggagaaaggtgtttgagcttgtgggtgagc

SEQ ID NO: 205614 - DNA, 30 bp, Artificial Sequence
  Description of Artificial Sequence: Synthetic oligonucleotide
gagaaaggtgtttgagcttgtgggtgagcc

SEQ ID NO: 205615 - DNA, 30 bp, Artificial Sequence
  Description of Artificial Sequence: Synthetic oligonucleotide
agaaaggtgtttgagcttgtgggtgagccc

SEQ ID NO: 205616 - DNA, 29 bp, Artificial Sequence
  Description of Artificial Sequence: Synthetic oligonucleotide
gaaaggtgtttgagcttgtgggtgagccc

SEQ ID NO: 205617 - DNA, 30 bp, Artificial Sequence
  Description of Artificial Sequence: Synthetic oligonucleotide
aaaggtgtttgagcttgtgggtgagccctc

SEQ ID NO: 205618 - DNA, 29 bp, Artificial Sequence
  Description of Artificial Sequence: Synthetic oligonucleotide
aaggtgtttgagcttgtgggtgagccctc

SEQ ID NO: 205619 - DNA, 28 bp, Artificial Sequence
  Description of Artificial Sequence: Synthetic oligonucleotide
aggtgtttgagcttgtgggtgagccctc

SEQ ID NO: 205620 - DNA, 27 bp, Artificial Sequence
  Description of Artificial Sequence: Synthetic oligonucleotide
ggtgtttgagcttgtgggtgagccctc

SEQ ID NO: 205621 - DNA, 27 bp, Artificial Sequence
  Description of Artificial Sequence: Synthetic oligonucleotide
gtgtttgagcttgtgggtgagccctcc

SEQ ID NO: 205622 - DNA, 32 bp, Artificial Sequence
  Description of Artificial Sequence: Synthetic oligonucleotide
tgtttgagcttgtgggtgagccctccatatac

SEQ ID NO: 205623 - DNA, 31 bp, Artificial Sequence
  Description of Artificial Sequence: Synthetic oligonucleotide
gtttgagcttgtgggtgagccctccatatac

SEQ ID NO: 205624 - DNA, 32 bp, Artificial Sequence
  Description of Artificial Sequence: Synthetic oligonucleotide
tttgagcttgtgggtgagccctccatatactg

SEQ ID NO: 205625 - DNA, 31 bp, Artificial Sequence
  Description of Artificial Sequence: Synthetic oligonucleotide
ttgagcttgtgggtgagccctccatatactg

SEQ ID NO: 205626 - DNA, 30 bp, Artificial Sequence
  Description of Artificial Sequence: Synthetic oligonucleotide
tgagcttgtgggtgagccctccatatactg

SEQ ID NO: 205627 - DNA, 29 bp, Artificial Sequence
  Description of Artificial Sequence: Synthetic oligonucleotide
gagcttgtgggtgagccctccatatactg

SEQ ID NO: 205628 - DNA, 29 bp, Artificial Sequence
  Description of Artificial Sequence: Synthetic oligonucleotide
agcttgtgggtgagccctccatatactgc

SEQ ID NO: 205629 - DNA, 28 bp, Artificial Sequence
  Description of Artificial Sequence: Synthetic oligonucleotide
gcttgtgggtgagccctccatatactgc

SEQ ID NO: 205630 - DNA, 29 bp, Artificial Sequence
  Description of Artificial Sequence: Synthetic oligonucleotide
cttgtgggtgagccctccatatactgcac

SEQ ID NO: 205631 - DNA, 29 bp, Artificial Sequence
  Description of Artificial Sequence: Synthetic oligonucleotide
ttgtgggtgagccctccatatactgcacc

SEQ ID NO: 205632 - DNA, 28 bp, Artificial Sequence
  Description of Artificial Sequence: Synthetic oligonucleotide
tgtgggtgagccctccatatactgcacc

SEQ ID NO: 205633 - DNA, 27 bp, Artificial Sequence
  Description of Artificial Sequence: Synthetic oligonucleotide
gtgggtgagccctccatatactgcacc

SEQ ID NO: 205634 - DNA, 28 bp, Artificial Sequence
  Description of Artificial Sequence: Synthetic oligonucleotide
tgggtgagccctccatatactgcaccag

SEQ ID NO: 205635 - DNA, 27 bp, Artificial Sequence
  Description of Artificial Sequence: Synthetic oligonucleotide
gggtgagccctccatatactgcaccag

SEQ ID NO: 205636 - DNA, 27 bp, Artificial Sequence
  Description of Artificial Sequence: Synthetic oligonucleotide
ggtgagccctccatatactgcaccagc

SEQ ID NO: 205637 - DNA, 30 bp, Artificial Sequence
  Description of Artificial Sequence: Synthetic oligonucleotide
gtgagccctccatatactgcaccagcaatg

SEQ ID NO: 205638 - DNA, 31 bp, Artificial Sequence
  Description of Artificial Sequence: Synthetic oligonucleotide
tgagccctccatatactgcaccagcaatgac

SEQ ID NO: 205639 - DNA, 30 bp, Artificial Sequence
  Description of Artificial Sequence: Synthetic oligonucleotide
gagccctccatatactgcaccagcaatgac

SEQ ID NO: 205640 - DNA, 30 bp, Artificial Sequence
  Description of Artificial Sequence: Synthetic oligonucleotide
agccctccatatactgcaccagcaatgacg

SEQ ID NO: 205641 - DNA, 29 bp, Artificial Sequence
  Description of Artificial Sequence: Synthetic oligonucleotide
gccctccatatactgcaccagcaatgacg

SEQ ID NO: 205642 - DNA, 31 bp, Artificial Sequence
  Description of Artificial Sequence: Synthetic oligonucleotide
ccctccatatactgcaccagcaatgacgatc

SEQ ID NO: 205643 - DNA, 33 bp, Artificial Sequence
  Description of Artificial Sequence: Synthetic oligonucleotide
cctccatatactgcaccagcaatgacgatcaag

SEQ ID NO: 205644 - DNA, 34 bp, Artificial Sequence
  Description of Artificial Sequence: Synthetic oligonucleotide
ctccatatactgcaccagcaatgacgatcaagtg

SEQ ID NO: 205645 - DNA, 34 bp, Artificial Sequence
  Description of Artificial Sequence: Synthetic oligonucleotide
tccatatactgcaccagcaatgacgatcaagtgg

SEQ ID NO: 205646 - DNA, 33 bp, Artificial Sequence
  Description of Artificial Sequence: Synthetic oligonucleotide
ccatatactgcaccagcaatgacgatcaagtgg

SEQ ID NO: 205647 - DNA, 33 bp, Artificial Sequence
  Description of Artificial Sequence: Synthetic oligonucleotide
catatactgcaccagcaatgacgatcaagtggg

SEQ ID NO: 205648 - DNA, 33 bp, Artificial Sequence
  Description of Artificial Sequence: Synthetic oligonucleotide
atatactgcaccagcaatgacgatcaagtgggc

SEQ ID NO: 205649 - DNA, 32 bp, Artificial Sequence
  Description of Artificial Sequence: Synthetic oligonucleotide
tatactgcaccagcaatgacgatcaagtgggc

SEQ ID NO: 205650 - DNA, 31 bp, Artificial Sequence
  Description of Artificial Sequence: Synthetic oligonucleotide
atactgcaccagcaatgacgatcaagtgggc

SEQ ID NO: 205651 - DNA, 30 bp, Artificial Sequence
  Description of Artificial Sequence: Synthetic oligonucleotide
tactgcaccagcaatgacgatcaagtgggc

SEQ ID NO: 205652 - DNA, 29 bp, Artificial Sequence
  Description of Artificial Sequence: Synthetic oligonucleotide
actgcaccagcaatgacgatcaagtgggc

SEQ ID NO: 205653 - DNA, 28 bp, Artificial Sequence
  Description of Artificial Sequence: Synthetic oligonucleotide
ctgcaccagcaatgacgatcaagtgggc

SEQ ID NO: 205654 - DNA, 30 bp, Artificial Sequence
  Description of Artificial Sequence: Synthetic oligonucleotide
tgcaccagcaatgacgatcaagtgggcatc

SEQ ID NO: 205655 - DNA, 29 bp, Artificial Sequence
  Description of Artificial Sequence: Synthetic oligonucleotide
gcaccagcaatgacgatcaagtgggcatc

SEQ ID NO: 205656 - DNA, 30 bp, Artificial Sequence
  Description of Artificial Sequence: Synthetic oligonucleotide
caccagcaatgacgatcaagtgggcatctg

SEQ ID NO: 205657 - DNA, 30 bp, Artificial Sequence
  Description of Artificial Sequence: Synthetic oligonucleotide
accagcaatgacgatcaagtgggcatctgg

SEQ ID NO: 205658 - DNA, 29 bp, Artificial Sequence
  Description of Artificial Sequence: Synthetic oligonucleotide
ccagcaatgacgatcaagtgggcatctgg

SEQ ID NO: 205659 - DNA, 30 bp, Artificial Sequence
  Description of Artificial Sequence: Synthetic oligonucleotide
cagcaatgacgatcaagtgggcatctggag

SEQ ID NO: 205660 - DNA, 30 bp, Artificial Sequence
  Description of Artificial Sequence: Synthetic oligonucleotide
agcaatgacgatcaagtgggcatctggagc

SEQ ID NO: 205661 - DNA, 29 bp, Artificial Sequence
  Description of Artificial Sequence: Synthetic oligonucleotide
gcaatgacgatcaagtgggcatctggagc

SEQ ID NO: 205662 - DNA, 29 bp, Artificial Sequence
  Description of Artificial Sequence: Synthetic oligonucleotide
caatgacgatcaagtgggcatctggagcg

SEQ ID NO: 205663 - DNA, 29 bp, Artificial Sequence
  Description of Artificial Sequence: Synthetic oligonucleotide
aatgacgatcaagtgggcatctggagcgg

SEQ ID NO: 205664 - DNA, 28 bp, Artificial Sequence
  Description of Artificial Sequence: Synthetic oligonucleotide
atgacgatcaagtgggcatctggagcgg

SEQ ID NO: 205665 - DNA, 27 bp, Artificial Sequence
  Description of Artificial Sequence: Synthetic oligonucleotide
tgacgatcaagtgggcatctggagcgg

SEQ ID NO: 205666 - DNA, 26 bp, Artificial Sequence
  Description of Artificial Sequence: Synthetic oligonucleotide
gacgatcaagtgggcatctggagcgg

SEQ ID NO: 205667 - DNA, 26 bp, Artificial Sequence
  Description of Artificial Sequence: Synthetic oligonucleotide
acgatcaagtgggcatctggagcggc

SEQ ID NO: 205668 - DNA, 25 bp, Artificial Sequence
  Description of Artificial Sequence: Synthetic oligonucleotide
cgatcaagtgggcatctggagcggc

SEQ ID NO: 205669 - DNA, 25 bp, Artificial Sequence
  Description of Artificial Sequence: Synthetic oligonucleotide
gatcaagtgggcatctggagcggcc

SEQ ID NO: 205670 - DNA, 25 bp, Artificial Sequence
  Description of Artificial Sequence: Synthetic oligonucleotide
atcaagtgggcatctggagcggccc

SEQ ID NO: 205671 - DNA, 24 bp, Artificial Sequence
  Description of Artificial Sequence: Synthetic oligonucleotide
tcaagtgggcatctggagcggccc

SEQ ID NO: 205672 - DNA, 23 bp, Artificial Sequence
  Description of Artificial Sequence: Synthetic oligonucleotide
caagtgggcatctggagcggccc

SEQ ID NO: 205673 - DNA, 23 bp, Artificial Sequence
  Description of Artificial Sequence: Synthetic oligonucleotide
aagtgggcatctggagcggcccc

SEQ ID NO: 205674 - DNA, 22 bp, Artificial Sequence
  Description of Artificial Sequence: Synthetic oligonucleotide
agtgggcatctggagcggcccc

SEQ ID NO: 205675 - DNA, 21 bp, Artificial Sequence
  Description of Artificial Sequence: Synthetic oligonucleotide
gtgggcatctggagcggcccc

SEQ ID NO: 205676 - DNA, 21 bp, Artificial Sequence
  Description of Artificial Sequence: Synthetic oligonucleotide
tgggcatctggagcggccccg

SEQ ID NO: 205677 - DNA, 20 bp, Artificial Sequence
  Description of Artificial Sequence: Synthetic oligonucleotide
gggcatctggagcggccccg

SEQ ID NO: 205678 - DNA, 20 bp, Artificial Sequence
  Description of Artificial Sequence: Synthetic oligonucleotide
ggcatctggagcggccccgc

SEQ ID NO: 205679 - DNA, 20 bp, Artificial Sequence
  Description of Artificial Sequence: Synthetic oligonucleotide
gcatctggagcggccccgcc

SEQ ID NO: 205680 - DNA, 20 bp, Artificial Sequence
  Description of Artificial Sequence: Synthetic oligonucleotide
catctggagcggccccgccc

SEQ ID NO: 205681 - DNA, 21 bp, Artificial Sequence
  Description of Artificial Sequence: Synthetic oligonucleotide
atctggagcggccccgcccct

SEQ ID NO: 205682 - DNA, 20 bp, Artificial Sequence
  Description of Artificial Sequence: Synthetic oligonucleotide
tctggagcggccccgcccct

SEQ ID NO: 205683 - DNA, 20 bp, Artificial Sequence
  Description of Artificial Sequence: Synthetic oligonucleotide
ctggagcggccccgcccctt

SEQ ID NO: 205684 - DNA, 20 bp, Artificial Sequence
  Description of Artificial Sequence: Synthetic oligonucleotide
tggagcggccccgcccctca

SEQ ID NO: 205685 - DNA, 20 bp, Artificial Sequence
  Description of Artificial Sequence: Synthetic oligonucleotide
ggagcggccccgcccctcat

SEQ ID NO: 205686 - DNA, 20 bp, Artificial Sequence
  Description of Artificial Sequence: Synthetic oligonucleotide
gagcggccccgcccctcagt

SEQ ID NO: 205687 - DNA, 20 bp, Artificial Sequence
  Description of Artificial Sequence: Synthetic oligonucleotide
agcggccccgcccctcagtg

SEQ ID NO: 205688 - DNA, 20 bp, Artificial Sequence
  Description of Artificial Sequence: Synthetic oligonucleotide
gcggccccgcccctcagtgt

SEQ ID NO: 205689 - DNA, 25 bp, Artificial Sequence
  Description of Artificial Sequence: Synthetic oligonucleotide
cggccccgcccctcagtgcattata

SEQ ID NO: 205690 - DNA, 25 bp, Artificial Sequence
  Description of Artificial Sequence: Synthetic oligonucleotide
ggccccgcccctcagtgcattatac

SEQ ID NO: 205691 - DNA, 27 bp, Artificial Sequence
  Description of Artificial Sequence: Synthetic oligonucleotide
gccccgcccctcagtgcattataccta

SEQ ID NO: 205692 - DNA, 28 bp, Artificial Sequence
  Description of Artificial Sequence: Synthetic oligonucleotide
ccccgcccctcagtgcattatacctaac

SEQ ID NO: 205693 - DNA, 32 bp, Artificial Sequence
  Description of Artificial Sequence: Synthetic oligonucleotide
cccgcccctcagtgcattatacctaacaaatg

SEQ ID NO: 205694 - DNA, 32 bp, Artificial Sequence
  Description of Artificial Sequence: Synthetic oligonucleotide
ccgcccctcagtgcattatacctaacaaatgc

SEQ ID NO: 205695 - DNA, 33 bp, Artificial Sequence
  Description of Artificial Sequence: Synthetic oligonucleotide
cgcccctcagtgcattatacctaacaaatgcac

SEQ ID NO: 205696 - DNA, 33 bp, Artificial Sequence
  Description of Artificial Sequence: Synthetic oligonucleotide
gcccctcagtgcattatacctaacaaatgcacg

SEQ ID NO: 205697 - DNA, 33 bp, Artificial Sequence
  Description of Artificial Sequence: Synthetic oligonucleotide
cccctcagtgcattatacctaacaaatgcacgc

SEQ ID NO: 205698 - DNA, 33 bp, Artificial Sequence
  Description of Artificial Sequence: Synthetic oligonucleotide
ccctcagtgcattatacctaacaaatgcacgcc

SEQ ID NO: 205699 - DNA, 34 bp, Artificial Sequence
  Description of Artificial Sequence: Synthetic oligonucleotide
cctcagtgcattatacctaacaaatgcacgcctc

SEQ ID NO: 205700 - DNA, 34 bp, Artificial Sequence
  Description of Artificial Sequence: Synthetic oligonucleotide
ctcagtgcattatacctaacaaatgcacgcctcc

SEQ ID NO: 205701 - DNA, 38 bp, Artificial Sequence
  Description of Artificial Sequence: Synthetic oligonucleotide
tcagtgcattatacctaacaaatgcacgcctccaaatg

SEQ ID NO: 205702 - DNA, 37 bp, Artificial Sequence
  Description of Artificial Sequence: Synthetic oligonucleotide
cagtgcattatacctaacaaatgcacgcctccaaatg

SEQ ID NO: 205703 - DNA, 38 bp, Artificial Sequence
  Description of Artificial Sequence: Synthetic oligonucleotide
agtgcattatacctaacaaatgcacgcctccaaatgtg

SEQ ID NO: 205704 - DNA, 37 bp, Artificial Sequence
  Description of Artificial Sequence: Synthetic oligonucleotide
gtgcattatacctaacaaatgcacgcctccaaatgtg

SEQ ID NO: 205705 - DNA, 37 bp, Artificial Sequence
  Description of Artificial Sequence: Synthetic oligonucleotide
tgcattatacctaacaaatgcacgcctccaaatgtgg

SEQ ID NO: 205706 - DNA, 36 bp, Artificial Sequence
  Description of Artificial Sequence: Synthetic oligonucleotide
gcattatacctaacaaatgcacgcctccaaatgtgg

SEQ ID NO: 205707 - DNA, 41 bp, Artificial Sequence
  Description of Artificial Sequence: Synthetic oligonucleotide
cattatacctaacaaatgcacgcctccaaatgtggaaaatg

SEQ ID NO: 205708 - DNA, 41 bp, Artificial Sequence
  Description of Artificial Sequence: Synthetic oligonucleotide
attatacctaacaaatgcacgcctccaaatgtggaaaatgg

SEQ ID NO: 205709 - DNA, 40 bp, Artificial Sequence
  Description of Artificial Sequence: Synthetic oligonucleotide
ttatacctaacaaatgcacgcctccaaatgtggaaaatgg

SEQ ID NO: 205710 - DNA, 39 bp, Artificial Sequence
  Description of Artificial Sequence: Synthetic oligonucleotide
tatacctaacaaatgcacgcctccaaatgtggaaaatgg

SEQ ID NO: 205711 - DNA, 38 bp, Artificial Sequence
  Description of Artificial Sequence: Synthetic oligonucleotide
atacctaacaaatgcacgcctccaaatgtggaaaatgg

SEQ ID NO: 205712 - DNA, 37 bp, Artificial Sequence
  Description of Artificial Sequence: Synthetic oligonucleotide
tacctaacaaatgcacgcctccaaatgtggaaaatgg

SEQ ID NO: 205713 - DNA, 36 bp, Artificial Sequence
  Description of Artificial Sequence: Synthetic oligonucleotide
acctaacaaatgcacgcctccaaatgtggaaaatgg

SEQ ID NO: 205714 - DNA, 35 bp, Artificial Sequence
  Description of Artificial Sequence: Synthetic oligonucleotide
cctaacaaatgcacgcctccaaatgtggaaaatgg

SEQ ID NO: 205715 - DNA, 41 bp, Artificial Sequence
  Description of Artificial Sequence: Synthetic oligonucleotide
ctaacaaatgcacgcctccaaatgtggaaaatggaatattg

SEQ ID NO: 205716 - DNA, 41 bp, Artificial Sequence
  Description of Artificial Sequence: Synthetic oligonucleotide
taacaaatgcacgcctccaaatgtggaaaatggaatattgg

SEQ ID NO: 205717 - DNA, 40 bp, Artificial Sequence
  Description of Artificial Sequence: Synthetic oligonucleotide
aacaaatgcacgcctccaaatgtggaaaatggaatattgg

SEQ ID NO: 205718 - DNA, 39 bp, Artificial Sequence
  Description of Artificial Sequence: Synthetic oligonucleotide
acaaatgcacgcctccaaatgtggaaaatggaatattgg

SEQ ID NO: 205719 - DNA, 38 bp, Artificial Sequence
  Description of Artificial Sequence: Synthetic oligonucleotide
caaatgcacgcctccaaatgtggaaaatggaatattgg

SEQ ID NO: 205720 - DNA, 41 bp, Artificial Sequence
  Description of Artificial Sequence: Synthetic oligonucleotide
aaatgcacgcctccaaatgtggaaaatggaatattggtatc

SEQ ID NO: 205721 - DNA, 40 bp, Artificial Sequence
  Description of Artificial Sequence: Synthetic oligonucleotide
aatgcacgcctccaaatgtggaaaatggaatattggtatc

SEQ ID NO: 205722 - DNA, 39 bp, Artificial Sequence
  Description of Artificial Sequence: Synthetic oligonucleotide
atgcacgcctccaaatgtggaaaatggaatattggtatc

SEQ ID NO: 205723 - DNA, 38 bp, Artificial Sequence
  Description of Artificial Sequence: Synthetic oligonucleotide
tgcacgcctccaaatgtggaaaatggaatattggtatc

SEQ ID NO: 205724 - DNA, 37 bp, Artificial Sequence
  Description of Artificial Sequence: Synthetic oligonucleotide
gcacgcctccaaatgtggaaaatggaatattggtatc

SEQ ID NO: 205725 - DNA, 38 bp, Artificial Sequence
  Description of Artificial Sequence: Synthetic oligonucleotide
cacgcctccaaatgtggaaaatggaatattggtatctg

SEQ ID NO: 205726 - DNA, 39 bp, Artificial Sequence
  Description of Artificial Sequence: Synthetic oligonucleotide
acgcctccaaatgtggaaaatggaatattggtatctgac

SEQ ID NO: 205727 - DNA, 38 bp, Artificial Sequence
  Description of Artificial Sequence: Synthetic oligonucleotide
cgcctccaaatgtggaaaatggaatattggtatctgac

SEQ ID NO: 205728 - DNA, 40 bp, Artificial Sequence
  Description of Artificial Sequence: Synthetic oligonucleotide
gcctccaaatgtggaaaatggaatattggtatctgacaac

SEQ ID NO: 205729 - DNA, 41 bp, Artificial Sequence
  Description of Artificial Sequence: Synthetic oligonucleotide
cctccaaatgtggaaaatggaatattggtatctgacaacag

SEQ ID NO: 205730 - DNA, 43 bp, Artificial Sequence
  Description of Artificial Sequence: Synthetic oligonucleotide
ctccaaatgtggaaaatggaatattggtatctgacaacagaag

SEQ ID NO: 205731 - DNA, 43 bp, Artificial Sequence
  Description of Artificial Sequence: Synthetic oligonucleotide
tccaaatgtggaaaatggaatattggtatctgacaacagaagc

SEQ ID NO: 205732 - DNA, 42 bp, Artificial Sequence
  Description of Artificial Sequence: Synthetic oligonucleotide
ccaaatgtggaaaatggaatattggtatctgacaacagaagc

SEQ ID NO: 205733 - DNA, 49 bp, Artificial Sequence
  Description of Artificial Sequence: Synthetic oligonucleotide
caaatgtggaaaatggaatattggtatctgacaacagaagcttattttc

SEQ ID NO: 205734 - DNA, 49 bp, Artificial Sequence
  Description of Artificial Sequence: Synthetic oligonucleotide
aaatgtggaaaatggaatattggtatctgacaacagaagcttattttcc

SEQ ID NO: 205735 - DNA, 48 bp, Artificial Sequence
  Description of Artificial Sequence: Synthetic oligonucleotide
aatgtggaaaatggaatattggtatctgacaacagaagcttattttcc

SEQ ID NO: 205736 - DNA, 47 bp, Artificial Sequence
  Description of Artificial Sequence: Synthetic oligonucleotide
atgtggaaaatggaatattggtatctgacaacagaagcttattttcc

SEQ ID NO: 205737 - DNA, 46 bp, Artificial Sequence
  Description of Artificial Sequence: Synthetic oligonucleotide
tgtggaaaatggaatattggtatctgacaacagaagcttattttcc

SEQ ID NO: 205738 - DNA, 45 bp, Artificial Sequence
  Description of Artificial Sequence: Synthetic oligonucleotide
gtggaaaatggaatattggtatctgacaacagaagcttattttcc

SEQ ID NO: 205739 - DNA, 51 bp, Artificial Sequence
  Description of Artificial Sequence: Synthetic oligonucleotide
tggaaaatggaatattggtatctgacaacagaagcttattttccttaaatg

SEQ ID NO: 205740 - DNA, 50 bp, Artificial Sequence
  Description of Artificial Sequence: Synthetic oligonucleotide
ggaaaatggaatattggtatctgacaacagaagcttattttccttaaatg

SEQ ID NO: 205741 - DNA, 52 bp, Artificial Sequence
  Description of Artificial Sequence: Synthetic oligonucleotide
gaaaatggaatattggtatctgacaacagaagcttattttccttaaatgaag

SEQ ID NO: 205742 - DNA, 54 bp, Artificial Sequence
  Description of Artificial Sequence: Synthetic oligonucleotide
aaaatggaatattggtatctgacaacagaagcttattttccttaaatgaagttg

SEQ ID NO: 205743 - DNA, 53 bp, Artificial Sequence
  Description of Artificial Sequence: Synthetic oligonucleotide
aaatggaatattggtatctgacaacagaagcttattttccttaaatgaagttg

SEQ ID NO: 205744 - DNA, 52 bp, Artificial Sequence
  Description of Artificial Sequence: Synthetic oligonucleotide
aatggaatattggtatctgacaacagaagcttattttccttaaatgaagttg

SEQ ID NO: 205745 - DNA, 51 bp, Artificial Sequence
  Description of Artificial Sequence: Synthetic oligonucleotide
atggaatattggtatctgacaacagaagcttattttccttaaatgaagttg

SEQ ID NO: 205746 - DNA, 50 bp, Artificial Sequence
  Description of Artificial Sequence: Synthetic oligonucleotide
tggaatattggtatctgacaacagaagcttattttccttaaatgaagttg

SEQ ID NO: 205747 - DNA, 49 bp, Artificial Sequence
  Description of Artificial Sequence: Synthetic oligonucleotide
ggaatattggtatctgacaacagaagcttattttccttaaatgaagttg

SEQ ID NO: 205748 - DNA, 50 bp, Artificial Sequence
  Description of Artificial Sequence: Synthetic oligonucleotide
gaatattggtatctgacaacagaagcttattttccttaaatgaagttgtg

SEQ ID NO: 205749 - DNA, 50 bp, Artificial Sequence
  Description of Artificial Sequence: Synthetic oligonucleotide
aatattggtatctgacaacagaagcttattttccttaaatgaagttgtgg

SEQ ID NO: 205750 - DNA, 49 bp, Artificial Sequence
  Description of Artificial Sequence: Synthetic oligonucleotide
atattggtatctgacaacagaagcttattttccttaaatgaagttgtgg

SEQ ID NO: 205751 - DNA, 48 bp, Artificial Sequence
  Description of Artificial Sequence: Synthetic oligonucleotide
tattggtatctgacaacagaagcttattttccttaaatgaagttgtgg

SEQ ID NO: 205752 - DNA, 47 bp, Artificial Sequence
  Description of Artificial Sequence: Synthetic oligonucleotide
attggtatctgacaacagaagcttattttccttaaatgaagttgtgg

SEQ ID NO: 205753 - DNA, 46 bp, Artificial Sequence
  Description of Artificial Sequence: Synthetic oligonucleotide
ttggtatctgacaacagaagcttattttccttaaatgaagttgtgg

SEQ ID NO: 205754 - DNA, 45 bp, Artificial Sequence
  Description of Artificial Sequence: Synthetic oligonucleotide
tggtatctgacaacagaagcttattttccttaaatgaagttgtgg

SEQ ID NO: 205755 - DNA, 44 bp, Artificial Sequence
  Description of Artificial Sequence: Synthetic oligonucleotide
ggtatctgacaacagaagcttattttccttaaatgaagttgtgg

SEQ ID NO: 205756 - DNA, 45 bp, Artificial Sequence
  Description of Artificial Sequence: Synthetic oligonucleotide
gtatctgacaacagaagcttattttccttaaatgaagttgtggag

SEQ ID NO: 205757 - DNA, 49 bp, Artificial Sequence
  Description of Artificial Sequence: Synthetic oligonucleotide
tatctgacaacagaagcttattttccttaaatgaagttgtggagtttag

SEQ ID NO: 205758 - DNA, 48 bp, Artificial Sequence
  Description of Artificial Sequence: Synthetic oligonucleotide
atctgacaacagaagcttattttccttaaatgaagttgtggagtttag

SEQ ID NO: 205759 - DNA, 47 bp, Artificial Sequence
  Description of Artificial Sequence: Synthetic oligonucleotide
tctgacaacagaagcttattttccttaaatgaagttgtggagtttag

SEQ ID NO: 205760 - DNA, 46 bp, Artificial Sequence
  Description of Artificial Sequence: Synthetic oligonucleotide
ctgacaacagaagcttattttccttaaatgaagttgtggagtttag

SEQ ID NO: 205761 - DNA, 46 bp, Artificial Sequence
  Description of Artificial Sequence: Synthetic oligonucleotide
tgacaacagaagcttattttccttaaatgaagttgtggagtttagg

SEQ ID NO: 205762 - DNA, 45 bp, Artificial Sequence
  Description of Artificial Sequence: Synthetic oligonucleotide
gacaacagaagcttattttccttaaatgaagttgtggagtttagg

SEQ ID NO: 205763 - DNA, 46 bp, Artificial Sequence
  Description of Artificial Sequence: Synthetic oligonucleotide
acaacagaagcttattttccttaaatgaagttgtggagtttaggtg

SEQ ID NO: 205764 - DNA, 45 bp, Artificial Sequence
  Description of Artificial Sequence: Synthetic oligonucleotide
caacagaagcttattttccttaaatgaagttgtggagtttaggtg

SEQ ID NO: 205765 - DNA, 46 bp, Artificial Sequence
  Description of Artificial Sequence: Synthetic oligonucleotide
aacagaagcttattttccttaaatgaagttgtggagtttaggtgtc

SEQ ID NO: 205766 - DNA, 45 bp, Artificial Sequence
  Description of Artificial Sequence: Synthetic oligonucleotide
acagaagcttattttccttaaatgaagttgtggagtttaggtgtc

SEQ ID NO: 205767 - DNA, 44 bp, Artificial Sequence
  Description of Artificial Sequence: Synthetic oligonucleotide
cagaagcttattttccttaaatgaagttgtggagtttaggtgtc

SEQ ID NO: 205768 - DNA, 45 bp, Artificial Sequence
  Description of Artificial Sequence: Synthetic oligonucleotide
agaagcttattttccttaaatgaagttgtggagtttaggtgtcag

SEQ ID NO: 205769 - DNA, 44 bp, Artificial Sequence
  Description of Artificial Sequence: Synthetic oligonucleotide
gaagcttattttccttaaatgaagttgtggagtttaggtgtcag

SEQ ID NO: 205770 - DNA, 44 bp, Artificial Sequence
  Description of Artificial Sequence: Synthetic oligonucleotide
aagcttattttccttaaatgaagttgtggagtttaggtgtcagc

SEQ ID NO: 205771 - DNA, 43 bp, Artificial Sequence
  Description of Artificial Sequence: Synthetic oligonucleotide
agcttattttccttaaatgaagttgtggagtttaggtgtcagc

SEQ ID NO: 205772 - DNA, 42 bp, Artificial Sequence
  Description of Artificial Sequence: Synthetic oligonucleotide
gcttattttccttaaatgaagttgtggagtttaggtgtcagc

SEQ ID NO: 205773 - DNA, 42 bp, Artificial Sequence
  Description of Artificial Sequence: Synthetic oligonucleotide
cttattttccttaaatgaagttgtggagtttaggtgtcagcc

SEQ ID NO: 205774 - DNA, 43 bp, Artificial Sequence
  Description of Artificial Sequence: Synthetic oligonucleotide
ttattttccttaaatgaagttgtggagtttaggtgtcagcctg

SEQ ID NO: 205775 - DNA, 42 bp, Artificial Sequence
  Description of Artificial Sequence: Synthetic oligonucleotide
tattttccttaaatgaagttgtggagtttaggtgtcagcctg

SEQ ID NO: 205776 - DNA, 41 bp, Artificial Sequence
  Description of Artificial Sequence: Synthetic oligonucleotide
attttccttaaatgaagttgtggagtttaggtgtcagcctg

SEQ ID NO: 205777 - DNA, 40 bp, Artificial Sequence
  Description of Artificial Sequence: Synthetic oligonucleotide
ttttccttaaatgaagttgtggagtttaggtgtcagcctg

SEQ ID NO: 205778 - DNA, 39 bp, Artificial Sequence
  Description of Artificial Sequence: Synthetic oligonucleotide
tttccttaaatgaagttgtggagtttaggtgtcagcctg

SEQ ID NO: 205779 - DNA, 38 bp, Artificial Sequence
  Description of Artificial Sequence: Synthetic oligonucleotide
ttccttaaatgaagttgtggagtttaggtgtcagcctg

SEQ ID NO: 205780 - DNA, 37 bp, Artificial Sequence
  Description of Artificial Sequence: Synthetic oligonucleotide
tccttaaatgaagttgtggagtttaggtgtcagcctg

SEQ ID NO: 205781 - DNA, 36 bp, Artificial Sequence
  Description of Artificial Sequence: Synthetic oligonucleotide
ccttaaatgaagttgtggagtttaggtgtcagcctg

SEQ ID NO: 205782 - DNA, 36 bp, Artificial Sequence
  Description of Artificial Sequence: Synthetic oligonucleotide
cttaaatgaagttgtggagtttaggtgtcagcctgg

SEQ ID NO: 205783 - DNA, 36 bp, Artificial Sequence
  Description of Artificial Sequence: Synthetic oligonucleotide
ttaaatgaagttgtggagtttaggtgtcagcctggc

SEQ ID NO: 205784 - DNA, 35 bp, Artificial Sequence
  Description of Artificial Sequence: Synthetic oligonucleotide
taaatgaagttgtggagtttaggtgtcagcctggc

SEQ ID NO: 205785 - DNA, 34 bp, Artificial Sequence
  Description of Artificial Sequence: Synthetic oligonucleotide
aaatgaagttgtggagtttaggtgtcagcctggc

SEQ ID NO: 205786 - DNA, 33 bp, Artificial Sequence
  Description of Artificial Sequence: Synthetic oligonucleotide
aatgaagttgtggagtttaggtgtcagcctggc

SEQ ID NO: 205787 - DNA, 32 bp, Artificial Sequence
  Description of Artificial Sequence: Synthetic oligonucleotide
atgaagttgtggagtttaggtgtcagcctggc

SEQ ID NO: 205788 - DNA, 31 bp, Artificial Sequence
  Description of Artificial Sequence: Synthetic oligonucleotide
tgaagttgtggagtttaggtgtcagcctggc

SEQ ID NO: 205789 - DNA, 30 bp, Artificial Sequence
  Description of Artificial Sequence: Synthetic oligonucleotide
gaagttgtggagtttaggtgtcagcctggc

SEQ ID NO: 205790 - DNA, 33 bp, Artificial Sequence
  Description of Artificial Sequence: Synthetic oligonucleotide
aagttgtggagtttaggtgtcagcctggctttg

SEQ ID NO: 205791 - DNA, 32 bp, Artificial Sequence
  Description of Artificial Sequence: Synthetic oligonucleotide
agttgtggagtttaggtgtcagcctggctttg

SEQ ID NO: 205792 - DNA, 31 bp, Artificial Sequence
  Description of Artificial Sequence: Synthetic oligonucleotide
gttgtggagtttaggtgtcagcctggctttg

SEQ ID NO: 205793 - DNA, 32 bp, Artificial Sequence
  Description of Artificial Sequence: Synthetic oligonucleotide
ttgtggagtttaggtgtcagcctggctttgtc

SEQ ID NO: 205794 - DNA, 31 bp, Artificial Sequence
  Description of Artificial Sequence: Synthetic oligonucleotide
tgtggagtttaggtgtcagcctggctttgtc

SEQ ID NO: 205795 - DNA, 30 bp, Artificial Sequence
  Description of Artificial Sequence: Synthetic oligonucleotide
gtggagtttaggtgtcagcctggctttgtc

SEQ ID NO: 205796 - DNA, 32 bp, Artificial Sequence
  Description of Artificial Sequence: Synthetic oligonucleotide
tggagtttaggtgtcagcctggctttgtcatg

SEQ ID NO: 205797 - DNA, 31 bp, Artificial Sequence
  Description of Artificial Sequence: Synthetic oligonucleotide
ggagtttaggtgtcagcctggctttgtcatg

SEQ ID NO: 205798 - DNA, 34 bp, Artificial Sequence
  Description of Artificial Sequence: Synthetic oligonucleotide
gagtttaggtgtcagcctggctttgtcatgaaag

SEQ ID NO: 205799 - DNA, 34 bp, Artificial Sequence
  Description of Artificial Sequence: Synthetic oligonucleotide
agtttaggtgtcagcctggctttgtcatgaaagg

SEQ ID NO: 205800 - DNA, 33 bp, Artificial Sequence
  Description of Artificial Sequence: Synthetic oligonucleotide
gtttaggtgtcagcctggctttgtcatgaaagg

SEQ ID NO: 205801 - DNA, 34 bp, Artificial Sequence
  Description of Artificial Sequence: Synthetic oligonucleotide
tttaggtgtcagcctggctttgtcatgaaaggac

SEQ ID NO: 205802 - DNA, 33 bp, Artificial Sequence
  Description of Artificial Sequence: Synthetic oligonucleotide
ttaggtgtcagcctggctttgtcatgaaaggac

SEQ ID NO: 205803 - DNA, 32 bp, Artificial Sequence
  Description of Artificial Sequence: Synthetic oligonucleotide
taggtgtcagcctggctttgtcatgaaaggac

SEQ ID NO: 205804 - DNA, 31 bp, Artificial Sequence
  Description of Artificial Sequence: Synthetic oligonucleotide
aggtgtcagcctggctttgtcatgaaaggac

SEQ ID NO: 205805 - DNA, 30 bp, Artificial Sequence
  Description of Artificial Sequence: Synthetic oligonucleotide
ggtgtcagcctggctttgtcatgaaaggac

SEQ ID NO: 205806 - DNA, 30 bp, Artificial Sequence
  Description of Artificial Sequence: Synthetic oligonucleotide
gtgtcagcctggctttgtcatgaaaggacc

SEQ ID NO: 205807 - DNA, 30 bp, Artificial Sequence
  Description of Artificial Sequence: Synthetic oligonucleotide
tgtcagcctggctttgtcatgaaaggaccc

SEQ ID NO: 205808 - DNA, 29 bp, Artificial Sequence
  Description of Artificial Sequence: Synthetic oligonucleotide
gtcagcctggctttgtcatgaaaggaccc

SEQ ID NO: 205809 - DNA, 29 bp, Artificial Sequence
  Description of Artificial Sequence: Synthetic oligonucleotide
tcagcctggctttgtcatgaaaggacccc

SEQ ID NO: 205810 - DNA, 28 bp, Artificial Sequence
  Description of Artificial Sequence: Synthetic oligonucleotide
cagcctggctttgtcatgaaaggacccc

SEQ ID NO: 205811 - DNA, 28 bp, Artificial Sequence
  Description of Artificial Sequence: Synthetic oligonucleotide
agcctggctttgtcatgaaaggaccccg

SEQ ID NO: 205812 - DNA, 27 bp, Artificial Sequence
  Description of Artificial Sequence: Synthetic oligonucleotide
gcctggctttgtcatgaaaggaccccg

SEQ ID NO: 205813 - DNA, 27 bp, Artificial Sequence
  Description of Artificial Sequence: Synthetic oligonucleotide
cctggctttgtcatgaaaggaccccgc

SEQ ID NO: 205814 - DNA, 27 bp, Artificial Sequence
  Description of Artificial Sequence: Synthetic oligonucleotide
ctggctttgtcatgaaaggaccccgcc

SEQ ID NO: 205815 - DNA, 27 bp, Artificial Sequence
  Description of Artificial Sequence: Synthetic oligonucleotide
tggctttgtcatgaaaggaccccgccg

SEQ ID NO: 205816 - DNA, 27 bp, Artificial Sequence
  Description of Artificial Sequence: Synthetic oligonucleotide
ggctttgtcatgaaaggaccccgccgt

SEQ ID NO: 205817 - DNA, 27 bp, Artificial Sequence
  Description of Artificial Sequence: Synthetic oligonucleotide
gctttgtcatgaaaggaccccgccgtg

SEQ ID NO: 205818 - DNA, 28 bp, Artificial Sequence
  Description of Artificial Sequence: Synthetic oligonucleotide
ctttgtcatgaaaggaccccgccgtgtg

SEQ ID NO: 205819 - DNA, 30 bp, Artificial Sequence
  Description of Artificial Sequence: Synthetic oligonucleotide
tttgtcatgaaaggaccccgccgtgtgaag

SEQ ID NO: 205820 - DNA, 29 bp, Artificial Sequence
  Description of Artificial Sequence: Synthetic oligonucleotide
ttgtcatgaaaggaccccgccgtgtgaag

SEQ ID NO: 205821 - DNA, 28 bp, Artificial Sequence
  Description of Artificial Sequence: Synthetic oligonucleotide
tgtcatgaaaggaccccgccgtgtgaag

SEQ ID NO: 205822 - DNA, 27 bp, Artificial Sequence
  Description of Artificial Sequence: Synthetic oligonucleotide
gtcatgaaaggaccccgccgtgtgaag

SEQ ID NO: 205823 - DNA, 28 bp, Artificial Sequence
  Description of Artificial Sequence: Synthetic oligonucleotide
tcatgaaaggaccccgccgtgtgaagtg

SEQ ID NO: 205824 - DNA, 27 bp, Artificial Sequence
  Description of Artificial Sequence: Synthetic oligonucleotide
catgaaaggaccccgccgtgtgaagtg

SEQ ID NO: 205825 - DNA, 27 bp, Artificial Sequence
  Description of Artificial Sequence: Synthetic oligonucleotide
atgaaaggaccccgccgtgtgaagtgc

SEQ ID NO: 205826 - DNA, 26 bp, Artificial Sequence
  Description of Artificial Sequence: Synthetic oligonucleotide
tgaaaggaccccgccgtgtgaagtgc

SEQ ID NO: 205827 - DNA, 25 bp, Artificial Sequence
  Description of Artificial Sequence: Synthetic oligonucleotide
gaaaggaccccgccgtgtgaagtgc

SEQ ID NO: 205828 - DNA, 26 bp, Artificial Sequence
  Description of Artificial Sequence: Synthetic oligonucleotide
aaaggaccccgccgtgtgaagtgcca

SEQ ID NO: 205829 - DNA, 25 bp, Artificial Sequence
  Description of Artificial Sequence: Synthetic oligonucleotide
aaggaccccgccgtgtgaagtgcca

SEQ ID NO: 205830 - DNA, 24 bp, Artificial Sequence
  Description of Artificial Sequence: Synthetic oligonucleotide
aggaccccgccgtgtgaagtgcca

SEQ ID NO: 205831 - DNA, 23 bp, Artificial Sequence
  Description of Artificial Sequence: Synthetic oligonucleotide
ggaccccgccgtgtgaagtgcca

SEQ ID NO: 205832 - DNA, 23 bp, Artificial Sequence
  Description of Artificial Sequence: Synthetic oligonucleotide
gaccccgccgtgtgaagtgccag

SEQ ID NO: 205833 - DNA, 23 bp, Artificial Sequence
  Description of Artificial Sequence: Synthetic oligonucleotide
accccgccgtgtgaagtgccagg

SEQ ID NO: 205834 - DNA, 22 bp, Artificial Sequence
  Description of Artificial Sequence: Synthetic oligonucleotide
ccccgccgtgtgaagtgccagg

SEQ ID NO: 205835 - DNA, 22 bp, Artificial Sequence
  Description of Artificial Sequence: Synthetic oligonucleotide
cccgccgtgtgaagtgccaggc

SEQ ID NO: 205836 - DNA, 22 bp, Artificial Sequence
  Description of Artificial Sequence: Synthetic oligonucleotide
ccgccgtgtgaagtgccaggcc

SEQ ID NO: 205837 - DNA, 23 bp, Artificial Sequence
  Description of Artificial Sequence: Synthetic oligonucleotide
cgccgtgtgaagtgccaggccct

SEQ ID NO: 205838 - DNA, 25 bp, Artificial Sequence
  Description of Artificial Sequence: Synthetic oligonucleotide
gccgtgtgaagtgccaggccctgaa

SEQ ID NO: 205839 - DNA, 27 bp, Artificial Sequence
  Description of Artificial Sequence: Synthetic oligonucleotide
ccgtgtgaagtgccaggccctgaacaa

SEQ ID NO: 205840 - DNA, 29 bp, Artificial Sequence
  Description of Artificial Sequence: Synthetic oligonucleotide
cgtgtgaagtgccaggccctgaacaaatg

SEQ ID NO: 205841 - DNA, 29 bp, Artificial Sequence
  Description of Artificial Sequence: Synthetic oligonucleotide
gtgtgaagtgccaggccctgaacaaatgg

SEQ ID NO: 205842 - DNA, 29 bp, Artificial Sequence
  Description of Artificial Sequence: Synthetic oligonucleotide
tgtgaagtgccaggccctgaacaaatggg

SEQ ID NO: 205843 - DNA, 28 bp, Artificial Sequence
  Description of Artificial Sequence: Synthetic oligonucleotide
gtgaagtgccaggccctgaacaaatggg

SEQ ID NO: 205844 - DNA, 29 bp, Artificial Sequence
  Description of Artificial Sequence: Synthetic oligonucleotide
tgaagtgccaggccctgaacaaatgggag

SEQ ID NO: 205845 - DNA, 28 bp, Artificial Sequence
  Description of Artificial Sequence: Synthetic oligonucleotide
gaagtgccaggccctgaacaaatgggag

SEQ ID NO: 205846 - DNA, 28 bp, Artificial Sequence
  Description of Artificial Sequence: Synthetic oligonucleotide
aagtgccaggccctgaacaaatgggagc

SEQ ID NO: 205847 - DNA, 27 bp, Artificial Sequence
  Description of Artificial Sequence: Synthetic oligonucleotide
agtgccaggccctgaacaaatgggagc

SEQ ID NO: 205848 - DNA, 26 bp, Artificial Sequence
  Description of Artificial Sequence: Synthetic oligonucleotide
gtgccaggccctgaacaaatgggagc

SEQ ID NO: 205849 - DNA, 26 bp, Artificial Sequence
  Description of Artificial Sequence: Synthetic oligonucleotide
tgccaggccctgaacaaatgggagcc

SEQ ID NO: 205850 - DNA, 25 bp, Artificial Sequence
  Description of Artificial Sequence: Synthetic oligonucleotide
gccaggccctgaacaaatgggagcc

SEQ ID NO: 205851 - DNA, 25 bp, Artificial Sequence
  Description of Artificial Sequence: Synthetic oligonucleotide
ccaggccctgaacaaatgggagccg

SEQ ID NO: 205852 - DNA, 26 bp, Artificial Sequence
  Description of Artificial Sequence: Synthetic oligonucleotide
caggccctgaacaaatgggagccgga

SEQ ID NO: 205853 - DNA, 26 bp, Artificial Sequence
  Description of Artificial Sequence: Synthetic oligonucleotide
aggccctgaacaaatgggagccggag

SEQ ID NO: 205854 - DNA, 25 bp, Artificial Sequence
  Description of Artificial Sequence: Synthetic oligonucleotide
ggccctgaacaaatgggagccggag

SEQ ID NO: 205855 - DNA, 27 bp, Artificial Sequence
  Description of Artificial Sequence: Synthetic oligonucleotide
gccctgaacaaatgggagccggagcta

SEQ ID NO: 205856 - DNA, 27 bp, Artificial Sequence
  Description of Artificial Sequence: Synthetic oligonucleotide
ccctgaacaaatgggagccggagctac

SEQ ID NO: 205857 - DNA, 27 bp, Artificial Sequence
  Description of Artificial Sequence: Synthetic oligonucleotide
cctgaacaaatgggagccggagctacc

SEQ ID NO: 205858 - DNA, 29 bp, Artificial Sequence
  Description of Artificial Sequence: Synthetic oligonucleotide
ctgaacaaatgggagccggagctaccaag

SEQ ID NO: 205859 - DNA, 29 bp, Artificial Sequence
  Description of Artificial Sequence: Synthetic oligonucleotide
tgaacaaatgggagccggagctaccaagc

SEQ ID NO: 205860 - DNA, 28 bp, Artificial Sequence
  Description of Artificial Sequence: Synthetic oligonucleotide
gaacaaatgggagccggagctaccaagc

SEQ ID NO: 205861 - DNA, 29 bp, Artificial Sequence
  Description of Artificial Sequence: Synthetic oligonucleotide
aacaaatgggagccggagctaccaagctg

SEQ ID NO: 205862 - DNA, 28 bp, Artificial Sequence
  Description of Artificial Sequence: Synthetic oligonucleotide
acaaatgggagccggagctaccaagctg

SEQ ID NO: 205863 - DNA, 27 bp, Artificial Sequence
  Description of Artificial Sequence: Synthetic oligonucleotide
caaatgggagccggagctaccaagctg

SEQ ID NO: 205864 - DNA, 27 bp, Artificial Sequence
  Description of Artificial Sequence: Synthetic oligonucleotide
aaatgggagccggagctaccaagctgc

SEQ ID NO: 205865 - DNA, 27 bp, Artificial Sequence
  Description of Artificial Sequence: Synthetic oligonucleotide
aatgggagccggagctaccaagctgct

SEQ ID NO: 205866 - DNA, 26 bp, Artificial Sequence
  Description of Artificial Sequence: Synthetic oligonucleotide
atgggagccggagctaccaagctgct

SEQ ID NO: 205867 - DNA, 25 bp, Artificial Sequence
  Description of Artificial Sequence: Synthetic oligonucleotide
tgggagccggagctaccaagctgct

SEQ ID NO: 205868 - DNA, 24 bp, Artificial Sequence
  Description of Artificial Sequence: Synthetic oligonucleotide
gggagccggagctaccaagctgct

SEQ ID NO: 205869 - DNA, 24 bp, Artificial Sequence
  Description of Artificial Sequence: Synthetic oligonucleotide
ggagccggagctaccaagctgctc

SEQ ID NO: 205870 - DNA, 25 bp, Artificial Sequence
  Description of Artificial Sequence: Synthetic oligonucleotide
gagccggagctaccaagctgctcca

SEQ ID NO: 205871 - DNA, 25 bp, Artificial Sequence
  Description of Artificial Sequence: Synthetic oligonucleotide
agccggagctaccaagctgctccag

SEQ ID NO: 205872 - DNA, 24 bp, Artificial Sequence
  Description of Artificial Sequence: Synthetic oligonucleotide
gccggagctaccaagctgctccag

SEQ ID NO: 205873 - DNA, 24 bp, Artificial Sequence
  Description of Artificial Sequence: Synthetic oligonucleotide
ccggagctaccaagctgctccagg

SEQ ID NO: 205874 - DNA, 27 bp, Artificial Sequence
  Description of Artificial Sequence: Synthetic oligonucleotide
cggagctaccaagctgctccagggtat

SEQ ID NO: 205875 - DNA, 27 bp, Artificial Sequence
  Description of Artificial Sequence: Synthetic oligonucleotide
ggagctaccaagctgctccagggtatg

SEQ ID NO: 205876 - DNA, 28 bp, Artificial Sequence
  Description of Artificial Sequence: Synthetic oligonucleotide
gagctaccaagctgctccagggtatgtc

SEQ ID NO: 205877 - DNA, 29 bp, Artificial Sequence
  Description of Artificial Sequence: Synthetic oligonucleotide
agctaccaagctgctccagggtatgtcag

SEQ ID NO: 205878 - DNA, 28 bp, Artificial Sequence
  Description of Artificial Sequence: Synthetic oligonucleotide
gctaccaagctgctccagggtatgtcag

SEQ ID NO: 205879 - DNA, 28 bp, Artificial Sequence
  Description of Artificial Sequence: Synthetic oligonucleotide
ctaccaagctgctccagggtatgtcagc

SEQ ID NO: 205880 - DNA, 28 bp, Artificial Sequence
  Description of Artificial Sequence: Synthetic oligonucleotide
taccaagctgctccagggtatgtcagcc

SEQ ID NO: 205881 - DNA, 27 bp, Artificial Sequence
  Description of Artificial Sequence: Synthetic oligonucleotide
accaagctgctccagggtatgtcagcc

SEQ ID NO: 205882 - DNA, 27 bp, Artificial Sequence
  Description of Artificial Sequence: Synthetic oligonucleotide
ccaagctgctccagggtatgtcagcca

SEQ ID NO: 205883 - DNA, 27 bp, Artificial Sequence
  Description of Artificial Sequence: Synthetic oligonucleotide
caagctgctccagggtatgtcagccac

SEQ ID NO: 205884 - DNA, 27 bp, Artificial Sequence
  Description of Artificial Sequence: Synthetic oligonucleotide
aagctgctccagggtatgtcagccacc

SEQ ID NO: 205885 - DNA, 27 bp, Artificial Sequence
  Description of Artificial Sequence: Synthetic oligonucleotide
agctgctccagggtatgtcagccacct

SEQ ID NO: 205886 - DNA, 26 bp, Artificial Sequence
  Description of Artificial Sequence: Synthetic oligonucleotide
gctgctccagggtatgtcagccacct

SEQ ID NO: 205887 - DNA, 26 bp, Artificial Sequence
  Description of Artificial Sequence: Synthetic oligonucleotide
ctgctccagggtatgtcagccacctc

SEQ ID NO: 205888 - DNA, 27 bp, Artificial Sequence
  Description of Artificial Sequence: Synthetic oligonucleotide
tgctccagggtatgtcagccacctcca

SEQ ID NO: 205889 - DNA, 26 bp, Artificial Sequence
  Description of Artificial Sequence: Synthetic oligonucleotide
gctccagggtatgtcagccacctcca

SEQ ID NO: 205890 - DNA, 27 bp, Artificial Sequence
  Description of Artificial Sequence: Synthetic oligonucleotide
ctccagggtatgtcagccacctccaga

SEQ ID NO: 205891 - DNA, 28 bp, Artificial Sequence
  Description of Artificial Sequence: Synthetic oligonucleotide
tccagggtatgtcagccacctccagatg

SEQ ID NO: 205892 - DNA, 27 bp, Artificial Sequence
  Description of Artificial Sequence: Synthetic oligonucleotide
ccagggtatgtcagccacctccagatg

SEQ ID NO: 205893 - DNA, 28 bp, Artificial Sequence
  Description of Artificial Sequence: Synthetic oligonucleotide
cagggtatgtcagccacctccagatgtc

SEQ ID NO: 205894 - DNA, 28 bp, Artificial Sequence
  Description of Artificial Sequence: Synthetic oligonucleotide
agggtatgtcagccacctccagatgtcc

SEQ ID NO: 205895 - DNA, 27 bp, Artificial Sequence
  Description of Artificial Sequence: Synthetic oligonucleotide
gggtatgtcagccacctccagatgtcc

SEQ ID NO: 205896 - DNA, 28 bp, Artificial Sequence
  Description of Artificial Sequence: Synthetic oligonucleotide
ggtatgtcagccacctccagatgtcctg

SEQ ID NO: 205897 - DNA, 28 bp, Artificial Sequence
  Description of Artificial Sequence: Synthetic oligonucleotide
gtatgtcagccacctccagatgtcctgc

SEQ ID NO: 205898 - DNA, 30 bp, Artificial Sequence
  Description of Artificial Sequence: Synthetic oligonucleotide
tatgtcagccacctccagatgtcctgcatg

SEQ ID NO: 205899 - DNA, 29 bp, Artificial Sequence
  Description of Artificial Sequence: Synthetic oligonucleotide
atgtcagccacctccagatgtcctgcatg

SEQ ID NO: 205900 - DNA, 28 bp, Artificial Sequence
  Description of Artificial Sequence: Synthetic oligonucleotide
tgtcagccacctccagatgtcctgcatg

SEQ ID NO: 205901 - DNA, 27 bp, Artificial Sequence
  Description of Artificial Sequence: Synthetic oligonucleotide
gtcagccacctccagatgtcctgcatg

SEQ ID NO: 205902 - DNA, 27 bp, Artificial Sequence
  Description of Artificial Sequence: Synthetic oligonucleotide
tcagccacctccagatgtcctgcatgc

SEQ ID NO: 205903 - DNA, 27 bp, Artificial Sequence
  Description of Artificial Sequence: Synthetic oligonucleotide
cagccacctccagatgtcctgcatgct

SEQ ID NO: 205904 - DNA, 27 bp, Artificial Sequence
  Description of Artificial Sequence: Synthetic oligonucleotide
agccacctccagatgtcctgcatgctg

SEQ ID NO: 205905 - DNA, 27 bp, Artificial Sequence
  Description of Artificial Sequence: Synthetic oligonucleotide
gccacctccagatgtcctgcatgctga

SEQ ID NO: 205906 - DNA, 27 bp, Artificial Sequence
  Description of Artificial Sequence: Synthetic oligonucleotide
ccacctccagatgtcctgcatgctgag

SEQ ID NO: 205907 - DNA, 27 bp, Artificial Sequence
  Description of Artificial Sequence: Synthetic oligonucleotide
cacctccagatgtcctgcatgctgagc

SEQ ID NO: 205908 - DNA, 27 bp, Artificial Sequence
  Description of Artificial Sequence: Synthetic oligonucleotide
acctccagatgtcctgcatgctgagcg

SEQ ID NO: 205909 - DNA, 27 bp, Artificial Sequence
  Description of Artificial Sequence: Synthetic oligonucleotide
cctccagatgtcctgcatgctgagcgt

SEQ ID NO: 205910 - DNA, 28 bp, Artificial Sequence
  Description of Artificial Sequence: Synthetic oligonucleotide
ctccagatgtcctgcatgctgagcgtac

SEQ ID NO: 205911 - DNA, 28 bp, Artificial Sequence
  Description of Artificial Sequence: Synthetic oligonucleotide
tccagatgtcctgcatgctgagcgtacc

SEQ ID NO: 205912 - DNA, 27 bp, Artificial Sequence
  Description of Artificial Sequence: Synthetic oligonucleotide
ccagatgtcctgcatgctgagcgtacc

SEQ ID NO: 205913 - DNA, 27 bp, Artificial Sequence
  Description of Artificial Sequence: Synthetic oligonucleotide
cagatgtcctgcatgctgagcgtaccc

SEQ ID NO: 205914 - DNA, 30 bp, Artificial Sequence
  Description of Artificial Sequence: Synthetic oligonucleotide
agatgtcctgcatgctgagcgtacccaaag

SEQ ID NO: 205915 - DNA, 29 bp, Artificial Sequence
  Description of Artificial Sequence: Synthetic oligonucleotide
gatgtcctgcatgctgagcgtacccaaag

SEQ ID NO: 205916 - DNA, 29 bp, Artificial Sequence
  Description of Artificial Sequence: Synthetic oligonucleotide
atgtcctgcatgctgagcgtacccaaagg

SEQ ID NO: 205917 - DNA, 28 bp, Artificial Sequence
  Description of Artificial Sequence: Synthetic oligonucleotide
tgtcctgcatgctgagcgtacccaaagg

SEQ ID NO: 205918 - DNA, 27 bp, Artificial Sequence
  Description of Artificial Sequence: Synthetic oligonucleotide
gtcctgcatgctgagcgtacccaaagg

SEQ ID NO: 205919 - DNA, 27 bp, Artificial Sequence
  Description of Artificial Sequence: Synthetic oligonucleotide
tcctgcatgctgagcgtacccaaaggg

SEQ ID NO: 205920 - DNA, 27 bp, Artificial Sequence
  Description of Artificial Sequence: Synthetic oligonucleotide
cctgcatgctgagcgtacccaaaggga

SEQ ID NO: 205921 - DNA, 27 bp, Artificial Sequence
  Description of Artificial Sequence: Synthetic oligonucleotide
ctgcatgctgagcgtacccaaagggac

SEQ ID NO: 205922 - DNA, 29 bp, Artificial Sequence
  Description of Artificial Sequence: Synthetic oligonucleotide
tgcatgctgagcgtacccaaagggacaag

SEQ ID NO: 205923 - DNA, 28 bp, Artificial Sequence
  Description of Artificial Sequence: Synthetic oligonucleotide
gcatgctgagcgtacccaaagggacaag

SEQ ID NO: 205924 - DNA, 28 bp, Artificial Sequence
  Description of Artificial Sequence: Synthetic oligonucleotide
catgctgagcgtacccaaagggacaagg

SEQ ID NO: 205925 - DNA, 29 bp, Artificial Sequence
  Description of Artificial Sequence: Synthetic oligonucleotide
atgctgagcgtacccaaagggacaaggac

SEQ ID NO: 205926 - DNA, 28 bp, Artificial Sequence
  Description of Artificial Sequence: Synthetic oligonucleotide
tgctgagcgtacccaaagggacaaggac

SEQ ID NO: 205927 - DNA, 27 bp, Artificial Sequence
  Description of Artificial Sequence: Synthetic oligonucleotide
gctgagcgtacccaaagggacaaggac

SEQ ID NO: 205928 - DNA, 29 bp, Artificial Sequence
  Description of Artificial Sequence: Synthetic oligonucleotide
ctgagcgtacccaaagggacaaggacaac

SEQ ID NO: 205929 - DNA, 33 bp, Artificial Sequence
  Description of Artificial Sequence: Synthetic oligonucleotide
tgagcgtacccaaagggacaaggacaacttttc

SEQ ID NO: 205930 - DNA, 32 bp, Artificial Sequence
  Description of Artificial Sequence: Synthetic oligonucleotide
gagcgtacccaaagggacaaggacaacttttc

SEQ ID NO: 205931 - DNA, 33 bp, Artificial Sequence
  Description of Artificial Sequence: Synthetic oligonucleotide
agcgtacccaaagggacaaggacaacttttcac

SEQ ID NO: 205932 - DNA, 32 bp, Artificial Sequence
  Description of Artificial Sequence: Synthetic oligonucleotide
gcgtacccaaagggacaaggacaacttttcac

SEQ ID NO: 205933 - DNA, 32 bp, Artificial Sequence
  Description of Artificial Sequence: Synthetic oligonucleotide
cgtacccaaagggacaaggacaacttttcacc

SEQ ID NO: 205934 - DNA, 33 bp, Artificial Sequence
  Description of Artificial Sequence: Synthetic oligonucleotide
gtacccaaagggacaaggacaacttttcacctg

SEQ ID NO: 205935 - DNA, 33 bp, Artificial Sequence
  Description of Artificial Sequence: Synthetic oligonucleotide
tacccaaagggacaaggacaacttttcacctgg

SEQ ID NO: 205936 - DNA, 32 bp, Artificial Sequence
  Description of Artificial Sequence: Synthetic oligonucleotide
acccaaagggacaaggacaacttttcacctgg

SEQ ID NO: 205937 - DNA, 31 bp, Artificial Sequence
  Description of Artificial Sequence: Synthetic oligonucleotide
cccaaagggacaaggacaacttttcacctgg

SEQ ID NO: 205938 - DNA, 31 bp, Artificial Sequence
  Description of Artificial Sequence: Synthetic oligonucleotide
ccaaagggacaaggacaacttttcacctggg

SEQ ID NO: 205939 - DNA, 31 bp, Artificial Sequence
  Description of Artificial Sequence: Synthetic oligonucleotide
caaagggacaaggacaacttttcacctgggc

SEQ ID NO: 205940 - DNA, 32 bp, Artificial Sequence
  Description of Artificial Sequence: Synthetic oligonucleotide
aaagggacaaggacaacttttcacctgggcag

SEQ ID NO: 205941 - DNA, 31 bp, Artificial Sequence
  Description of Artificial Sequence: Synthetic oligonucleotide
aagggacaaggacaacttttcacctgggcag

SEQ ID NO: 205942 - DNA, 30 bp, Artificial Sequence
  Description of Artificial Sequence: Synthetic oligonucleotide
agggacaaggacaacttttcacctgggcag

SEQ ID NO: 205943 - DNA, 29 bp, Artificial Sequence
  Description of Artificial Sequence: Synthetic oligonucleotide
gggacaaggacaacttttcacctgggcag

SEQ ID NO: 205944 - DNA, 29 bp, Artificial Sequence
  Description of Artificial Sequence: Synthetic oligonucleotide
ggacaaggacaacttttcacctgggcagg

SEQ ID NO: 205945 - DNA, 31 bp, Artificial Sequence
  Description of Artificial Sequence: Synthetic oligonucleotide
gacaaggacaacttttcacctgggcaggaag

SEQ ID NO: 205946 - DNA, 32 bp, Artificial Sequence
  Description of Artificial Sequence: Synthetic oligonucleotide
acaaggacaacttttcacctgggcaggaagtg

SEQ ID NO: 205947 - DNA, 31 bp, Artificial Sequence
  Description of Artificial Sequence: Synthetic oligonucleotide
caaggacaacttttcacctgggcaggaagtg

SEQ ID NO: 205948 - DNA, 33 bp, Artificial Sequence
  Description of Artificial Sequence: Synthetic oligonucleotide
aaggacaacttttcacctgggcaggaagtgttc

SEQ ID NO: 205949 - DNA, 32 bp, Artificial Sequence
  Description of Artificial Sequence: Synthetic oligonucleotide
aggacaacttttcacctgggcaggaagtgttc

SEQ ID NO: 205950 - DNA, 31 bp, Artificial Sequence
  Description of Artificial Sequence: Synthetic oligonucleotide
ggacaacttttcacctgggcaggaagtgttc

SEQ ID NO: 205951 - DNA, 33 bp, Artificial Sequence
  Description of Artificial Sequence: Synthetic oligonucleotide
gacaacttttcacctgggcaggaagtgttctac

SEQ ID NO: 205952 - DNA, 34 bp, Artificial Sequence
  Description of Artificial Sequence: Synthetic oligonucleotide
acaacttttcacctgggcaggaagtgttctacag

SEQ ID NO: 205953 - DNA, 33 bp, Artificial Sequence
  Description of Artificial Sequence: Synthetic oligonucleotide
caacttttcacctgggcaggaagtgttctacag

SEQ ID NO: 205954 - DNA, 33 bp, Artificial Sequence
  Description of Artificial Sequence: Synthetic oligonucleotide
aacttttcacctgggcaggaagtgttctacagc

SEQ ID NO: 205955 - DNA, 32 bp, Artificial Sequence
  Description of Artificial Sequence: Synthetic oligonucleotide
acttttcacctgggcaggaagtgttctacagc

SEQ ID NO: 205956 - DNA, 31 bp, Artificial Sequence
  Description of Artificial Sequence: Synthetic oligonucleotide
cttttcacctgggcaggaagtgttctacagc

SEQ ID NO: 205957 - DNA, 32 bp, Artificial Sequence
  Description of Artificial Sequence: Synthetic oligonucleotide
ttttcacctgggcaggaagtgttctacagctg

SEQ ID NO: 205958 - DNA, 31 bp, Artificial Sequence
  Description of Artificial Sequence: Synthetic oligonucleotide
tttcacctgggcaggaagtgttctacagctg

SEQ ID NO: 205959 - DNA, 30 bp, Artificial Sequence
  Description of Artificial Sequence: Synthetic oligonucleotide
ttcacctgggcaggaagtgttctacagctg

SEQ ID NO: 205960 - DNA, 29 bp, Artificial Sequence
  Description of Artificial Sequence: Synthetic oligonucleotide
tcacctgggcaggaagtgttctacagctg

SEQ ID NO: 205961 - DNA, 28 bp, Artificial Sequence
  Description of Artificial Sequence: Synthetic oligonucleotide
cacctgggcaggaagtgttctacagctg

SEQ ID NO: 205962 - DNA, 29 bp, Artificial Sequence
  Description of Artificial Sequence: Synthetic oligonucleotide
acctgggcaggaagtgttctacagctgtg

SEQ ID NO: 205963 - DNA, 28 bp, Artificial Sequence
  Description of Artificial Sequence: Synthetic oligonucleotide
cctgggcaggaagtgttctacagctgtg

SEQ ID NO: 205964 - DNA, 29 bp, Artificial Sequence
  Description of Artificial Sequence: Synthetic oligonucleotide
ctgggcaggaagtgttctacagctgtgag

SEQ ID NO: 205965 - DNA, 29 bp, Artificial Sequence
  Description of Artificial Sequence: Synthetic oligonucleotide
tgggcaggaagtgttctacagctgtgagc

SEQ ID NO: 205966 - DNA, 28 bp, Artificial Sequence
  Description of Artificial Sequence: Synthetic oligonucleotide
gggcaggaagtgttctacagctgtgagc

SEQ ID NO: 205967 - DNA, 28 bp, Artificial Sequence
  Description of Artificial Sequence: Synthetic oligonucleotide
ggcaggaagtgttctacagctgtgagcc

SEQ ID NO: 205968 - DNA, 28 bp, Artificial Sequence
  Description of Artificial Sequence: Synthetic oligonucleotide
gcaggaagtgttctacagctgtgagccc

SEQ ID NO: 205969 - DNA, 28 bp, Artificial Sequence
  Description of Artificial Sequence: Synthetic oligonucleotide
caggaagtgttctacagctgtgagcccg

SEQ ID NO: 205970 - DNA, 28 bp, Artificial Sequence
  Description of Artificial Sequence: Synthetic oligonucleotide
aggaagtgttctacagctgtgagcccgg

SEQ ID NO: 205971 - DNA, 27 bp, Artificial Sequence
  Description of Artificial Sequence: Synthetic oligonucleotide
ggaagtgttctacagctgtgagcccgg

SEQ ID NO: 205972 - DNA, 27 bp, Artificial Sequence
  Description of Artificial Sequence: Synthetic oligonucleotide
gaagtgttctacagctgtgagcccggc

SEQ ID NO: 205973 - DNA, 29 bp, Artificial Sequence
  Description of Artificial Sequence: Synthetic oligonucleotide
aagtgttctacagctgtgagcccggctac

SEQ ID NO: 205974 - DNA, 28 bp, Artificial Sequence
  Description of Artificial Sequence: Synthetic oligonucleotide
agtgttctacagctgtgagcccggctac

SEQ ID NO: 205975 - DNA, 27 bp, Artificial Sequence
  Description of Artificial Sequence: Synthetic oligonucleotide
gtgttctacagctgtgagcccggctac

SEQ ID NO: 205976 - DNA, 27 bp, Artificial Sequence
  Description of Artificial Sequence: Synthetic oligonucleotide
tgttctacagctgtgagcccggctacg

SEQ ID NO: 205977 - DNA, 27 bp, Artificial Sequence
  Description of Artificial Sequence: Synthetic oligonucleotide
gttctacagctgtgagcccggctacga

SEQ ID NO: 205978 - DNA, 27 bp, Artificial Sequence
  Description of Artificial Sequence: Synthetic oligonucleotide
ttctacagctgtgagcccggctacgac

SEQ ID NO: 205979 - DNA, 26 bp, Artificial Sequence
  Description of Artificial Sequence: Synthetic oligonucleotide
tctacagctgtgagcccggctacgac

SEQ ID NO: 205980 - DNA, 25 bp, Artificial Sequence
  Description of Artificial Sequence: Synthetic oligonucleotide
ctacagctgtgagcccggctacgac

SEQ ID NO: 205981 - DNA, 26 bp, Artificial Sequence
  Description of Artificial Sequence: Synthetic oligonucleotide
tacagctgtgagcccggctacgacct

SEQ ID NO: 205982 - DNA, 25 bp, Artificial Sequence
  Description of Artificial Sequence: Synthetic oligonucleotide
acagctgtgagcccggctacgacct

SEQ ID NO: 205983 - DNA, 24 bp, Artificial Sequence
  Description of Artificial Sequence: Synthetic oligonucleotide
cagctgtgagcccggctacgacct

SEQ ID NO: 205984 - DNA, 25 bp, Artificial Sequence
  Description of Artificial Sequence: Synthetic oligonucleotide
agctgtgagcccggctacgacctca

SEQ ID NO: 205985 - DNA, 24 bp, Artificial Sequence
  Description of Artificial Sequence: Synthetic oligonucleotide
gctgtgagcccggctacgacctca

SEQ ID NO: 205986 - DNA, 25 bp, Artificial Sequence
  Description of Artificial Sequence: Synthetic oligonucleotide
ctgtgagcccggctacgacctcaga

SEQ ID NO: 205987 - DNA, 25 bp, Artificial Sequence
  Description of Artificial Sequence: Synthetic oligonucleotide
tgtgagcccggctacgacctcagag

SEQ ID NO: 205988 - DNA, 24 bp, Artificial Sequence
  Description of Artificial Sequence: Synthetic oligonucleotide
gtgagcccggctacgacctcagag

SEQ ID NO: 205989 - DNA, 24 bp, Artificial Sequence
  Description of Artificial Sequence: Synthetic oligonucleotide
tgagcccggctacgacctcagagg

SEQ ID NO: 205990 - DNA, 23 bp, Artificial Sequence
  Description of Artificial Sequence: Synthetic oligonucleotide
gagcccggctacgacctcagagg

SEQ ID NO: 205991 - DNA, 23 bp, Artificial Sequence
  Description of Artificial Sequence: Synthetic oligonucleotide
agcccggctacgacctcagaggg

SEQ ID NO: 205992 - DNA, 22 bp, Artificial Sequence
  Description of Artificial Sequence: Synthetic oligonucleotide
gcccggctacgacctcagaggg

SEQ ID NO: 205993 - DNA, 22 bp, Artificial Sequence
  Description of Artificial Sequence: Synthetic oligonucleotide
cccggctacgacctcagagggg

SEQ ID NO: 205994 - DNA, 23 bp, Artificial Sequence
  Description of Artificial Sequence: Synthetic oligonucleotide
ccggctacgacctcagaggggct

SEQ ID NO: 205995 - DNA, 23 bp, Artificial Sequence
  Description of Artificial Sequence: Synthetic oligonucleotide
cggctacgacctcagaggggctg

SEQ ID NO: 205996 - DNA, 23 bp, Artificial Sequence
  Description of Artificial Sequence: Synthetic oligonucleotide
ggctacgacctcagaggggctgc

SEQ ID NO: 205997 - DNA, 24 bp, Artificial Sequence
  Description of Artificial Sequence: Synthetic oligonucleotide
gctacgacctcagaggggctgcgt

SEQ ID NO: 205998 - DNA, 27 bp, Artificial Sequence
  Description of Artificial Sequence: Synthetic oligonucleotide
ctacgacctcagaggggctgcgtctat

SEQ ID NO: 205999 - DNA, 27 bp, Artificial Sequence
  Description of Artificial Sequence: Synthetic oligonucleotide
tacgacctcagaggggctgcgtctatg

SEQ ID NO: 206000 - DNA, 26 bp, Artificial Sequence
  Description of Artificial Sequence: Synthetic oligonucleotide
acgacctcagaggggctgcgtctatg

SEQ ID NO: 206001 - DNA, 25 bp, Artificial Sequence
  Description of Artificial Sequence: Synthetic oligonucleotide
cgacctcagaggggctgcgtctatg

SEQ ID NO: 206002 - DNA, 25 bp, Artificial Sequence
  Description of Artificial Sequence: Synthetic oligonucleotide
gacctcagaggggctgcgtctatgc

SEQ ID NO: 206003 - DNA, 25 bp, Artificial Sequence
  Description of Artificial Sequence: Synthetic oligonucleotide
acctcagaggggctgcgtctatgcg

SEQ ID NO: 206004 - DNA, 24 bp, Artificial Sequence
  Description of Artificial Sequence: Synthetic oligonucleotide
cctcagaggggctgcgtctatgcg

SEQ ID NO: 206005 - DNA, 25 bp, Artificial Sequence
  Description of Artificial Sequence: Synthetic oligonucleotide
ctcagaggggctgcgtctatgcgct

SEQ ID NO: 206006 - DNA, 25 bp, Artificial Sequence
  Description of Artificial Sequence: Synthetic oligonucleotide
tcagaggggctgcgtctatgcgctg

SEQ ID NO: 206007 - DNA, 24 bp, Artificial Sequence
  Description of Artificial Sequence: Synthetic oligonucleotide
cagaggggctgcgtctatgcgctg

SEQ ID NO: 206008 - DNA, 25 bp, Artificial Sequence
  Description of Artificial Sequence: Synthetic oligonucleotide
agaggggctgcgtctatgcgctgca

SEQ ID NO: 206009 - DNA, 24 bp, Artificial Sequence
  Description of Artificial Sequence: Synthetic oligonucleotide
gaggggctgcgtctatgcgctgca

SEQ ID NO: 206010 - DNA, 25 bp, Artificial Sequence
  Description of Artificial Sequence: Synthetic oligonucleotide
aggggctgcgtctatgcgctgcaca

SEQ ID NO: 206011 - DNA, 24 bp, Artificial Sequence
  Description of Artificial Sequence: Synthetic oligonucleotide
ggggctgcgtctatgcgctgcaca

SEQ ID NO: 206012 - DNA, 24 bp, Artificial Sequence
  Description of Artificial Sequence: Synthetic oligonucleotide
gggctgcgtctatgcgctgcacac

SEQ ID NO: 206013 - DNA, 24 bp, Artificial Sequence
  Description of Artificial Sequence: Synthetic oligonucleotide
ggctgcgtctatgcgctgcacacc

SEQ ID NO: 206014 - DNA, 24 bp, Artificial Sequence
  Description of Artificial Sequence: Synthetic oligonucleotide
gctgcgtctatgcgctgcacaccc

SEQ ID NO: 206015 - DNA, 25 bp, Artificial Sequence
  Description of Artificial Sequence: Synthetic oligonucleotide
ctgcgtctatgcgctgcacacccca

SEQ ID NO: 206016 - DNA, 25 bp, Artificial Sequence
  Description of Artificial Sequence: Synthetic oligonucleotide
tgcgtctatgcgctgcacaccccag

SEQ ID NO: 206017 - DNA, 24 bp, Artificial Sequence
  Description of Artificial Sequence: Synthetic oligonucleotide
gcgtctatgcgctgcacaccccag

SEQ ID NO: 206018 - DNA, 24 bp, Artificial Sequence
  Description of Artificial Sequence: Synthetic oligonucleotide
cgtctatgcgctgcacaccccagg

SEQ ID NO: 206019 - DNA, 25 bp, Artificial Sequence
  Description of Artificial Sequence: Synthetic oligonucleotide
gtctatgcgctgcacaccccaggga

SEQ ID NO: 206020 - DNA, 26 bp, Artificial Sequence
  Description of Artificial Sequence: Synthetic oligonucleotide
tctatgcgctgcacaccccagggaga

SEQ ID NO: 206021 - DNA, 25 bp, Artificial Sequence
  Description of Artificial Sequence: Synthetic oligonucleotide
ctatgcgctgcacaccccagggaga

SEQ ID NO: 206022 - DNA, 26 bp, Artificial Sequence
  Description of Artificial Sequence: Synthetic oligonucleotide
tatgcgctgcacaccccagggagact

SEQ ID NO: 206023 - DNA, 25 bp, Artificial Sequence
  Description of Artificial Sequence: Synthetic oligonucleotide
atgcgctgcacaccccagggagact

SEQ ID NO: 206024 - DNA, 24 bp, Artificial Sequence
  Description of Artificial Sequence: Synthetic oligonucleotide
tgcgctgcacaccccagggagact

SEQ ID NO: 206025 - DNA, 23 bp, Artificial Sequence
  Description of Artificial Sequence: Synthetic oligonucleotide
gcgctgcacaccccagggagact

SEQ ID NO: 206026 - DNA, 23 bp, Artificial Sequence
  Description of Artificial Sequence: Synthetic oligonucleotide
cgctgcacaccccagggagactg

SEQ ID NO: 206027 - DNA, 24 bp, Artificial Sequence
  Description of Artificial Sequence: Synthetic oligonucleotide
gctgcacaccccagggagactgga

SEQ ID NO: 206028 - DNA, 24 bp, Artificial Sequence
  Description of Artificial Sequence: Synthetic oligonucleotide
ctgcacaccccagggagactggag

SEQ ID NO: 206029 - DNA, 24 bp, Artificial Sequence
  Description of Artificial Sequence: Synthetic oligonucleotide
tgcacaccccagggagactggagc

SEQ ID NO: 206030 - DNA, 23 bp, Artificial Sequence
  Description of Artificial Sequence: Synthetic oligonucleotide
gcacaccccagggagactggagc

SEQ ID NO: 206031 - DNA, 23 bp, Artificial Sequence
  Description of Artificial Sequence: Synthetic oligonucleotide
cacaccccagggagactggagcc

SEQ ID NO: 206032 - DNA, 24 bp, Artificial Sequence
  Description of Artificial Sequence: Synthetic oligonucleotide
acaccccagggagactggagccct

SEQ ID NO: 206033 - DNA, 23 bp, Artificial Sequence
  Description of Artificial Sequence: Synthetic oligonucleotide
caccccagggagactggagccct

SEQ ID NO: 206034 - DNA, 23 bp, Artificial Sequence
  Description of Artificial Sequence: Synthetic oligonucleotide
accccagggagactggagccctg

SEQ ID NO: 206035 - DNA, 22 bp, Artificial Sequence
  Description of Artificial Sequence: Synthetic oligonucleotide
ccccagggagactggagccctg

SEQ ID NO: 206036 - DNA, 23 bp, Artificial Sequence
  Description of Artificial Sequence: Synthetic oligonucleotide
cccagggagactggagccctgca

SEQ ID NO: 206037 - DNA, 23 bp, Artificial Sequence
  Description of Artificial Sequence: Synthetic oligonucleotide
ccagggagactggagccctgcag

SEQ ID NO: 206038 - DNA, 23 bp, Artificial Sequence
  Description of Artificial Sequence: Synthetic oligonucleotide
cagggagactggagccctgcagc

SEQ ID NO: 206039 - DNA, 23 bp, Artificial Sequence
  Description of Artificial Sequence: Synthetic oligonucleotide
agggagactggagccctgcagcc

SEQ ID NO: 206040 - DNA, 22 bp, Artificial Sequence
  Description of Artificial Sequence: Synthetic oligonucleotide
gggagactggagccctgcagcc

SEQ ID NO: 206041 - DNA, 22 bp, Artificial Sequence
  Description of Artificial Sequence: Synthetic oligonucleotide
ggagactggagccctgcagccc

SEQ ID NO: 206042 - DNA, 22 bp, Artificial Sequence
  Description of Artificial Sequence: Synthetic oligonucleotide
gagactggagccctgcagcccc

SEQ ID NO: 206043 - DNA, 23 bp, Artificial Sequence
  Description of Artificial Sequence: Synthetic oligonucleotide
agactggagccctgcagccccca

SEQ ID NO: 206044 - DNA, 22 bp, Artificial Sequence
  Description of Artificial Sequence: Synthetic oligonucleotide
gactggagccctgcagccccca

SEQ ID NO: 206045 - DNA, 24 bp, Artificial Sequence
  Description of Artificial Sequence: Synthetic oligonucleotide
actggagccctgcagcccccacat

SEQ ID NO: 206046 - DNA, 23 bp, Artificial Sequence
  Description of Artificial Sequence: Synthetic oligonucleotide
ctggagccctgcagcccccacat

SEQ ID NO: 206047 - DNA, 24 bp, Artificial Sequence
  Description of Artificial Sequence: Synthetic oligonucleotide
tggagccctgcagcccccacatgt

SEQ ID NO: 206048 - DNA, 23 bp, Artificial Sequence
  Description of Artificial Sequence: Synthetic oligonucleotide
ggagccctgcagcccccacatgt

SEQ ID NO: 206049 - DNA, 25 bp, Artificial Sequence
  Description of Artificial Sequence: Synthetic oligonucleotide
gagccctgcagcccccacatgtgaa

SEQ ID NO: 206050 - DNA, 26 bp, Artificial Sequence
  Description of Artificial Sequence: Synthetic oligonucleotide
agccctgcagcccccacatgtgaagt

SEQ ID NO: 206051 - DNA, 25 bp, Artificial Sequence
  Description of Artificial Sequence: Synthetic oligonucleotide
gccctgcagcccccacatgtgaagt

SEQ ID NO: 206052 - DNA, 27 bp, Artificial Sequence
  Description of Artificial Sequence: Synthetic oligonucleotide
ccctgcagcccccacatgtgaagtgaa

SEQ ID NO: 206053 - DNA, 29 bp, Artificial Sequence
  Description of Artificial Sequence: Synthetic oligonucleotide
cctgcagcccccacatgtgaagtgaaatc

SEQ ID NO: 206054 - DNA, 29 bp, Artificial Sequence
  Description of Artificial Sequence: Synthetic oligonucleotide
ctgcagcccccacatgtgaagtgaaatcc

SEQ ID NO: 206055 - DNA, 30 bp, Artificial Sequence
  Description of Artificial Sequence: Synthetic oligonucleotide
tgcagcccccacatgtgaagtgaaatcctg

SEQ ID NO: 206056 - DNA, 29 bp, Artificial Sequence
  Description of Artificial Sequence: Synthetic oligonucleotide
gcagcccccacatgtgaagtgaaatcctg

SEQ ID NO: 206057 - DNA, 30 bp, Artificial Sequence
  Description of Artificial Sequence: Synthetic oligonucleotide
cagcccccacatgtgaagtgaaatcctgtg

SEQ ID NO: 206058 - DNA, 32 bp, Artificial Sequence
  Description of Artificial Sequence: Synthetic oligonucleotide
agcccccacatgtgaagtgaaatcctgtgatg

SEQ ID NO: 206059 - DNA, 31 bp, Artificial Sequence
  Description of Artificial Sequence: Synthetic oligonucleotide
gcccccacatgtgaagtgaaatcctgtgatg

SEQ ID NO: 206060 - DNA, 32 bp, Artificial Sequence
  Description of Artificial Sequence: Synthetic oligonucleotide
cccccacatgtgaagtgaaatcctgtgatgac

SEQ ID NO: 206061 - DNA, 34 bp, Artificial Sequence
  Description of Artificial Sequence: Synthetic oligonucleotide
ccccacatgtgaagtgaaatcctgtgatgacttc

SEQ ID NO: 206062 - DNA, 36 bp, Artificial Sequence
  Description of Artificial Sequence: Synthetic oligonucleotide
cccacatgtgaagtgaaatcctgtgatgacttcatg

SEQ ID NO: 206063 - DNA, 36 bp, Artificial Sequence
  Description of Artificial Sequence: Synthetic oligonucleotide
ccacatgtgaagtgaaatcctgtgatgacttcatgg

SEQ ID NO: 206064 - DNA, 36 bp, Artificial Sequence
  Description of Artificial Sequence: Synthetic oligonucleotide
cacatgtgaagtgaaatcctgtgatgacttcatggg

SEQ ID NO: 206065 - DNA, 36 bp, Artificial Sequence
  Description of Artificial Sequence: Synthetic oligonucleotide
acatgtgaagtgaaatcctgtgatgacttcatgggc

SEQ ID NO: 206066 - DNA, 35 bp, Artificial Sequence
  Description of Artificial Sequence: Synthetic oligonucleotide
catgtgaagtgaaatcctgtgatgacttcatgggc

SEQ ID NO: 206067 - DNA, 35 bp, Artificial Sequence
  Description of Artificial Sequence: Synthetic oligonucleotide
atgtgaagtgaaatcctgtgatgacttcatgggcc

SEQ ID NO: 206068 - DNA, 34 bp, Artificial Sequence
  Description of Artificial Sequence: Synthetic oligonucleotide
tgtgaagtgaaatcctgtgatgacttcatgggcc

SEQ ID NO: 206069 - DNA, 33 bp, Artificial Sequence
  Description of Artificial Sequence: Synthetic oligonucleotide
gtgaagtgaaatcctgtgatgacttcatgggcc

SEQ ID NO: 206070 - DNA, 35 bp, Artificial Sequence
  Description of Artificial Sequence: Synthetic oligonucleotide
tgaagtgaaatcctgtgatgacttcatgggccaac

SEQ ID NO: 206071 - DNA, 34 bp, Artificial Sequence
  Description of Artificial Sequence: Synthetic oligonucleotide
gaagtgaaatcctgtgatgacttcatgggccaac

SEQ ID NO: 206072 - DNA, 36 bp, Artificial Sequence
  Description of Artificial Sequence: Synthetic oligonucleotide
aagtgaaatcctgtgatgacttcatgggccaacttc

SEQ ID NO: 206073 - DNA, 35 bp, Artificial Sequence
  Description of Artificial Sequence: Synthetic oligonucleotide
agtgaaatcctgtgatgacttcatgggccaacttc

SEQ ID NO: 206074 - DNA, 34 bp, Artificial Sequence
  Description of Artificial Sequence: Synthetic oligonucleotide
gtgaaatcctgtgatgacttcatgggccaacttc

SEQ ID NO: 206075 - DNA, 39 bp, Artificial Sequence
  Description of Artificial Sequence: Synthetic oligonucleotide
tgaaatcctgtgatgacttcatgggccaacttcttaatg

SEQ ID NO: 206076 - DNA, 38 bp, Artificial Sequence
  Description of Artificial Sequence: Synthetic oligonucleotide
gaaatcctgtgatgacttcatgggccaacttcttaatg

SEQ ID NO: 206077 - DNA, 38 bp, Artificial Sequence
  Description of Artificial Sequence: Synthetic oligonucleotide
aaatcctgtgatgacttcatgggccaacttcttaatgg

SEQ ID NO: 206078 - DNA, 37 bp, Artificial Sequence
  Description of Artificial Sequence: Synthetic oligonucleotide
aatcctgtgatgacttcatgggccaacttcttaatgg

SEQ ID NO: 206079 - DNA, 36 bp, Artificial Sequence
  Description of Artificial Sequence: Synthetic oligonucleotide
atcctgtgatgacttcatgggccaacttcttaatgg

SEQ ID NO: 206080 - DNA, 35 bp, Artificial Sequence
  Description of Artificial Sequence: Synthetic oligonucleotide
tcctgtgatgacttcatgggccaacttcttaatgg

SEQ ID NO: 206081 - DNA, 34 bp, Artificial Sequence
  Description of Artificial Sequence: Synthetic oligonucleotide
cctgtgatgacttcatgggccaacttcttaatgg

SEQ ID NO: 206082 - DNA, 34 bp, Artificial Sequence
  Description of Artificial Sequence: Synthetic oligonucleotide
ctgtgatgacttcatgggccaacttcttaatggc

SEQ ID NO: 206083 - DNA, 34 bp, Artificial Sequence
  Description of Artificial Sequence: Synthetic oligonucleotide
tgtgatgacttcatgggccaacttcttaatggcc

SEQ ID NO: 206084 - DNA, 33 bp, Artificial Sequence
  Description of Artificial Sequence: Synthetic oligonucleotide
gtgatgacttcatgggccaacttcttaatggcc

SEQ ID NO: 206085 - DNA, 33 bp, Artificial Sequence
  Description of Artificial Sequence: Synthetic oligonucleotide
tgatgacttcatgggccaacttcttaatggccg

SEQ ID NO: 206086 - DNA, 32 bp, Artificial Sequence
  Description of Artificial Sequence: Synthetic oligonucleotide
gatgacttcatgggccaacttcttaatggccg

SEQ ID NO: 206087 - DNA, 33 bp, Artificial Sequence
  Description of Artificial Sequence: Synthetic oligonucleotide
atgacttcatgggccaacttcttaatggccgtg

SEQ ID NO: 206088 - DNA, 32 bp, Artificial Sequence
  Description of Artificial Sequence: Synthetic oligonucleotide
tgacttcatgggccaacttcttaatggccgtg

SEQ ID NO: 206089 - DNA, 31 bp, Artificial Sequence
  Description of Artificial Sequence: Synthetic oligonucleotide
gacttcatgggccaacttcttaatggccgtg

SEQ ID NO: 206090 - DNA, 32 bp, Artificial Sequence
  Description of Artificial Sequence: Synthetic oligonucleotide
acttcatgggccaacttcttaatggccgtgtg

SEQ ID NO: 206091 - DNA, 31 bp, Artificial Sequence
  Description of Artificial Sequence: Synthetic oligonucleotide
cttcatgggccaacttcttaatggccgtgtg

SEQ ID NO: 206092 - DNA, 31 bp, Artificial Sequence
  Description of Artificial Sequence: Synthetic oligonucleotide
ttcatgggccaacttcttaatggccgtgtgc

SEQ ID NO: 206093 - DNA, 30 bp, Artificial Sequence
  Description of Artificial Sequence: Synthetic oligonucleotide
tcatgggccaacttcttaatggccgtgtgc

SEQ ID NO: 206094 - DNA, 29 bp, Artificial Sequence
  Description of Artificial Sequence: Synthetic oligonucleotide
catgggccaacttcttaatggccgtgtgc

SEQ ID NO: 206095 - DNA, 34 bp, Artificial Sequence
  Description of Artificial Sequence: Synthetic oligonucleotide
atgggccaacttcttaatggccgtgtgctatttc

SEQ ID NO: 206096 - DNA, 33 bp, Artificial Sequence
  Description of Artificial Sequence: Synthetic oligonucleotide
tgggccaacttcttaatggccgtgtgctatttc

SEQ ID NO: 206097 - DNA, 32 bp, Artificial Sequence
  Description of Artificial Sequence: Synthetic oligonucleotide
gggccaacttcttaatggccgtgtgctatttc

SEQ ID NO: 206098 - DNA, 32 bp, Artificial Sequence
  Description of Artificial Sequence: Synthetic oligonucleotide
ggccaacttcttaatggccgtgtgctatttcc

SEQ ID NO: 206099 - DNA, 33 bp, Artificial Sequence
  Description of Artificial Sequence: Synthetic oligonucleotide
gccaacttcttaatggccgtgtgctatttccag

SEQ ID NO: 206100 - DNA, 38 bp, Artificial Sequence
  Description of Artificial Sequence: Synthetic oligonucleotide
ccaacttcttaatggccgtgtgctatttccagtaaatc

SEQ ID NO: 206101 - DNA, 39 bp, Artificial Sequence
  Description of Artificial Sequence: Synthetic oligonucleotide
caacttcttaatggccgtgtgctatttccagtaaatctc

SEQ ID NO: 206102 - DNA, 39 bp, Artificial Sequence
  Description of Artificial Sequence: Synthetic oligonucleotide
aacttcttaatggccgtgtgctatttccagtaaatctcc

SEQ ID NO: 206103 - DNA, 38 bp, Artificial Sequence
  Description of Artificial Sequence: Synthetic oligonucleotide
acttcttaatggccgtgtgctatttccagtaaatctcc

SEQ ID NO: 206104 - DNA, 37 bp, Artificial Sequence
  Description of Artificial Sequence: Synthetic oligonucleotide
cttcttaatggccgtgtgctatttccagtaaatctcc

SEQ ID NO: 206105 - DNA, 38 bp, Artificial Sequence
  Description of Artificial Sequence: Synthetic oligonucleotide
ttcttaatggccgtgtgctatttccagtaaatctccag

SEQ ID NO: 206106 - DNA, 37 bp, Artificial Sequence
  Description of Artificial Sequence: Synthetic oligonucleotide
tcttaatggccgtgtgctatttccagtaaatctccag

SEQ ID NO: 206107 - DNA, 36 bp, Artificial Sequence
  Description of Artificial Sequence: Synthetic oligonucleotide
cttaatggccgtgtgctatttccagtaaatctccag

SEQ ID NO: 206108 - DNA, 36 bp, Artificial Sequence
  Description of Artificial Sequence: Synthetic oligonucleotide
ttaatggccgtgtgctatttccagtaaatctccagc

SEQ ID NO: 206109 - DNA, 35 bp, Artificial Sequence
  Description of Artificial Sequence: Synthetic oligonucleotide
taatggccgtgtgctatttccagtaaatctccagc

SEQ ID NO: 206110 - DNA, 34 bp, Artificial Sequence
  Description of Artificial Sequence: Synthetic oligonucleotide
aatggccgtgtgctatttccagtaaatctccagc

SEQ ID NO: 206111 - DNA, 33 bp, Artificial Sequence
  Description of Artificial Sequence: Synthetic oligonucleotide
atggccgtgtgctatttccagtaaatctccagc

SEQ ID NO: 206112 - DNA, 32 bp, Artificial Sequence
  Description of Artificial Sequence: Synthetic oligonucleotide
tggccgtgtgctatttccagtaaatctccagc

SEQ ID NO: 206113 - DNA, 31 bp, Artificial Sequence
  Description of Artificial Sequence: Synthetic oligonucleotide
ggccgtgtgctatttccagtaaatctccagc

SEQ ID NO: 206114 - DNA, 33 bp, Artificial Sequence
  Description of Artificial Sequence: Synthetic oligonucleotide
gccgtgtgctatttccagtaaatctccagcttg

SEQ ID NO: 206115 - DNA, 33 bp, Artificial Sequence
  Description of Artificial Sequence: Synthetic oligonucleotide
ccgtgtgctatttccagtaaatctccagcttgg

SEQ ID NO: 206116 - DNA, 34 bp, Artificial Sequence
  Description of Artificial Sequence: Synthetic oligonucleotide
cgtgtgctatttccagtaaatctccagcttggag

SEQ ID NO: 206117 - DNA, 34 bp, Artificial Sequence
  Description of Artificial Sequence: Synthetic oligonucleotide
gtgtgctatttccagtaaatctccagcttggagc

SEQ ID NO: 206118 - DNA, 38 bp, Artificial Sequence
  Description of Artificial Sequence: Synthetic oligonucleotide
tgtgctatttccagtaaatctccagcttggagcaaaag

SEQ ID NO: 206119 - DNA, 37 bp, Artificial Sequence
  Description of Artificial Sequence: Synthetic oligonucleotide
gtgctatttccagtaaatctccagcttggagcaaaag

SEQ ID NO: 206120 - DNA, 38 bp, Artificial Sequence
  Description of Artificial Sequence: Synthetic oligonucleotide
tgctatttccagtaaatctccagcttggagcaaaagtg

SEQ ID NO: 206121 - DNA, 37 bp, Artificial Sequence
  Description of Artificial Sequence: Synthetic oligonucleotide
gctatttccagtaaatctccagcttggagcaaaagtg

SEQ ID NO: 206122 - DNA, 37 bp, Artificial Sequence
  Description of Artificial Sequence: Synthetic oligonucleotide
ctatttccagtaaatctccagcttggagcaaaagtgg

SEQ ID NO: 206123 - DNA, 42 bp, Artificial Sequence
  Description of Artificial Sequence: Synthetic oligonucleotide
tatttccagtaaatctccagcttggagcaaaagtggattttg

SEQ ID NO: 206124 - DNA, 41 bp, Artificial Sequence
  Description of Artificial Sequence: Synthetic oligonucleotide
atttccagtaaatctccagcttggagcaaaagtggattttg

SEQ ID NO: 206125 - DNA, 40 bp, Artificial Sequence
  Description of Artificial Sequence: Synthetic oligonucleotide
tttccagtaaatctccagcttggagcaaaagtggattttg

SEQ ID NO: 206126 - DNA, 39 bp, Artificial Sequence
  Description of Artificial Sequence: Synthetic oligonucleotide
ttccagtaaatctccagcttggagcaaaagtggattttg

SEQ ID NO: 206127 - DNA, 38 bp, Artificial Sequence
  Description of Artificial Sequence: Synthetic oligonucleotide
tccagtaaatctccagcttggagcaaaagtggattttg

SEQ ID NO: 206128 - DNA, 37 bp, Artificial Sequence
  Description of Artificial Sequence: Synthetic oligonucleotide
ccagtaaatctccagcttggagcaaaagtggattttg

SEQ ID NO: 206129 - DNA, 40 bp, Artificial Sequence
  Description of Artificial Sequence: Synthetic oligonucleotide
cagtaaatctccagcttggagcaaaagtggattttgtttg

SEQ ID NO: 206130 - DNA, 41 bp, Artificial Sequence
  Description of Artificial Sequence: Synthetic oligonucleotide
agtaaatctccagcttggagcaaaagtggattttgtttgtg

SEQ ID NO: 206131 - DNA, 40 bp, Artificial Sequence
  Description of Artificial Sequence: Synthetic oligonucleotide
gtaaatctccagcttggagcaaaagtggattttgtttgtg

SEQ ID NO: 206132 - DNA, 42 bp, Artificial Sequence
  Description of Artificial Sequence: Synthetic oligonucleotide
taaatctccagcttggagcaaaagtggattttgtttgtgatg

SEQ ID NO: 206133 - DNA, 41 bp, Artificial Sequence
  Description of Artificial Sequence: Synthetic oligonucleotide
aaatctccagcttggagcaaaagtggattttgtttgtgatg

SEQ ID NO: 206134 - DNA, 40 bp, Artificial Sequence
  Description of Artificial Sequence: Synthetic oligonucleotide
aatctccagcttggagcaaaagtggattttgtttgtgatg

SEQ ID NO: 206135 - DNA, 39 bp, Artificial Sequence
  Description of Artificial Sequence: Synthetic oligonucleotide
atctccagcttggagcaaaagtggattttgtttgtgatg

SEQ ID NO: 206136 - DNA, 38 bp, Artificial Sequence
  Description of Artificial Sequence: Synthetic oligonucleotide
tctccagcttggagcaaaagtggattttgtttgtgatg

SEQ ID NO: 206137 - DNA, 37 bp, Artificial Sequence
  Description of Artificial Sequence: Synthetic oligonucleotide
ctccagcttggagcaaaagtggattttgtttgtgatg

SEQ ID NO: 206138 - DNA, 39 bp, Artificial Sequence
  Description of Artificial Sequence: Synthetic oligonucleotide
tccagcttggagcaaaagtggattttgtttgtgatgaag

SEQ ID NO: 206139 - DNA, 38 bp, Artificial Sequence
  Description of Artificial Sequence: Synthetic oligonucleotide
ccagcttggagcaaaagtggattttgtttgtgatgaag

SEQ ID NO: 206140 - DNA, 38 bp, Artificial Sequence
  Description of Artificial Sequence: Synthetic oligonucleotide
cagcttggagcaaaagtggattttgtttgtgatgaagg

SEQ ID NO: 206141 - DNA, 42 bp, Artificial Sequence
  Description of Artificial Sequence: Synthetic oligonucleotide
agcttggagcaaaagtggattttgtttgtgatgaaggatttc

SEQ ID NO: 206142 - DNA, 41 bp, Artificial Sequence
  Description of Artificial Sequence: Synthetic oligonucleotide
gcttggagcaaaagtggattttgtttgtgatgaaggatttc

SEQ ID NO: 206143 - DNA, 49 bp, Artificial Sequence
  Description of Artificial Sequence: Synthetic oligonucleotide
cttggagcaaaagtggattttgtttgtgatgaaggatttcaattaaaag

SEQ ID NO: 206144 - DNA, 49 bp, Artificial Sequence
  Description of Artificial Sequence: Synthetic oligonucleotide
ttggagcaaaagtggattttgtttgtgatgaaggatttcaattaaaagg

SEQ ID NO: 206145 - DNA, 48 bp, Artificial Sequence
  Description of Artificial Sequence: Synthetic oligonucleotide
tggagcaaaagtggattttgtttgtgatgaaggatttcaattaaaagg

SEQ ID NO: 206146 - DNA, 47 bp, Artificial Sequence
  Description of Artificial Sequence: Synthetic oligonucleotide
ggagcaaaagtggattttgtttgtgatgaaggatttcaattaaaagg

SEQ ID NO: 206147 - DNA, 47 bp, Artificial Sequence
  Description of Artificial Sequence: Synthetic oligonucleotide
gagcaaaagtggattttgtttgtgatgaaggatttcaattaaaaggc

SEQ ID NO: 206148 - DNA, 48 bp, Artificial Sequence
  Description of Artificial Sequence: Synthetic oligonucleotide
agcaaaagtggattttgtttgtgatgaaggatttcaattaaaaggcag

SEQ ID NO: 206149 - DNA, 47 bp, Artificial Sequence
  Description of Artificial Sequence: Synthetic oligonucleotide
gcaaaagtggattttgtttgtgatgaaggatttcaattaaaaggcag

SEQ ID NO: 206150 - DNA, 47 bp, Artificial Sequence
  Description of Artificial Sequence: Synthetic oligonucleotide
caaaagtggattttgtttgtgatgaaggatttcaattaaaaggcagc

SEQ ID NO: 206151 - DNA, 48 bp, Artificial Sequence
  Description of Artificial Sequence: Synthetic oligonucleotide
aaaagtggattttgtttgtgatgaaggatttcaattaaaaggcagctc

SEQ ID NO: 206152 - DNA, 47 bp, Artificial Sequence
  Description of Artificial Sequence: Synthetic oligonucleotide
aaagtggattttgtttgtgatgaaggatttcaattaaaaggcagctc

SEQ ID NO: 206153 - DNA, 46 bp, Artificial Sequence
  Description of Artificial Sequence: Synthetic oligonucleotide
aagtggattttgtttgtgatgaaggatttcaattaaaaggcagctc

SEQ ID NO: 206154 - DNA, 45 bp, Artificial Sequence
  Description of Artificial Sequence: Synthetic oligonucleotide
agtggattttgtttgtgatgaaggatttcaattaaaaggcagctc

SEQ ID NO: 206155 - DNA, 44 bp, Artificial Sequence
  Description of Artificial Sequence: Synthetic oligonucleotide
gtggattttgtttgtgatgaaggatttcaattaaaaggcagctc

SEQ ID NO: 206156 - DNA, 45 bp, Artificial Sequence
  Description of Artificial Sequence: Synthetic oligonucleotide
tggattttgtttgtgatgaaggatttcaattaaaaggcagctctg

SEQ ID NO: 206157 - DNA, 44 bp, Artificial Sequence
  Description of Artificial Sequence: Synthetic oligonucleotide
ggattttgtttgtgatgaaggatttcaattaaaaggcagctctg

SEQ ID NO: 206158 - DNA, 44 bp, Artificial Sequence
  Description of Artificial Sequence: Synthetic oligonucleotide
gattttgtttgtgatgaaggatttcaattaaaaggcagctctgc

SEQ ID NO: 206159 - DNA, 46 bp, Artificial Sequence
  Description of Artificial Sequence: Synthetic oligonucleotide
attttgtttgtgatgaaggatttcaattaaaaggcagctctgctag

SEQ ID NO: 206160 - DNA, 45 bp, Artificial Sequence
  Description of Artificial Sequence: Synthetic oligonucleotide
ttttgtttgtgatgaaggatttcaattaaaaggcagctctgctag

SEQ ID NO: 206161 - DNA, 44 bp, Artificial Sequence
  Description of Artificial Sequence: Synthetic oligonucleotide
tttgtttgtgatgaaggatttcaattaaaaggcagctctgctag

SEQ ID NO: 206162 - DNA, 43 bp, Artificial Sequence
  Description of Artificial Sequence: Synthetic oligonucleotide
ttgtttgtgatgaaggatttcaattaaaaggcagctctgctag

SEQ ID NO: 206163 - DNA, 42 bp, Artificial Sequence
  Description of Artificial Sequence: Synthetic oligonucleotide
tgtttgtgatgaaggatttcaattaaaaggcagctctgctag

SEQ ID NO: 206164 - DNA, 41 bp, Artificial Sequence
  Description of Artificial Sequence: Synthetic oligonucleotide
gtttgtgatgaaggatttcaattaaaaggcagctctgctag

SEQ ID NO: 206165 - DNA, 44 bp, Artificial Sequence
  Description of Artificial Sequence: Synthetic oligonucleotide
tttgtgatgaaggatttcaattaaaaggcagctctgctagttac

SEQ ID NO: 206166 - DNA, 43 bp, Artificial Sequence
  Description of Artificial Sequence: Synthetic oligonucleotide
ttgtgatgaaggatttcaattaaaaggcagctctgctagttac

SEQ ID NO: 206167 - DNA, 42 bp, Artificial Sequence
  Description of Artificial Sequence: Synthetic oligonucleotide
tgtgatgaaggatttcaattaaaaggcagctctgctagttac

SEQ ID NO: 206168 - DNA, 41 bp, Artificial Sequence
  Description of Artificial Sequence: Synthetic oligonucleotide
gtgatgaaggatttcaattaaaaggcagctctgctagttac

SEQ ID NO: 206169 - DNA, 42 bp, Artificial Sequence
  Description of Artificial Sequence: Synthetic oligonucleotide
tgatgaaggatttcaattaaaaggcagctctgctagttactg

SEQ ID NO: 206170 - DNA, 41 bp, Artificial Sequence
  Description of Artificial Sequence: Synthetic oligonucleotide
gatgaaggatttcaattaaaaggcagctctgctagttactg

SEQ ID NO: 206171 - DNA, 42 bp, Artificial Sequence
  Description of Artificial Sequence: Synthetic oligonucleotide
atgaaggatttcaattaaaaggcagctctgctagttactgtg

SEQ ID NO: 206172 - DNA, 41 bp, Artificial Sequence
  Description of Artificial Sequence: Synthetic oligonucleotide
tgaaggatttcaattaaaaggcagctctgctagttactgtg

SEQ ID NO: 206173 - DNA, 40 bp, Artificial Sequence
  Description of Artificial Sequence: Synthetic oligonucleotide
gaaggatttcaattaaaaggcagctctgctagttactgtg

SEQ ID NO: 206174 - DNA, 41 bp, Artificial Sequence
  Description of Artificial Sequence: Synthetic oligonucleotide
aaggatttcaattaaaaggcagctctgctagttactgtgtc

SEQ ID NO: 206175 - DNA, 40 bp, Artificial Sequence
  Description of Artificial Sequence: Synthetic oligonucleotide
aggatttcaattaaaaggcagctctgctagttactgtgtc

SEQ ID NO: 206176 - DNA, 39 bp, Artificial Sequence
  Description of Artificial Sequence: Synthetic oligonucleotide
ggatttcaattaaaaggcagctctgctagttactgtgtc

SEQ ID NO: 206177 - DNA, 41 bp, Artificial Sequence
  Description of Artificial Sequence: Synthetic oligonucleotide
gatttcaattaaaaggcagctctgctagttactgtgtcttg

SEQ ID NO: 206178 - DNA, 41 bp, Artificial Sequence
  Description of Artificial Sequence: Synthetic oligonucleotide
atttcaattaaaaggcagctctgctagttactgtgtcttgg

SEQ ID NO: 206179 - DNA, 40 bp, Artificial Sequence
  Description of Artificial Sequence: Synthetic oligonucleotide
tttcaattaaaaggcagctctgctagttactgtgtcttgg

SEQ ID NO: 206180 - DNA, 39 bp, Artificial Sequence
  Description of Artificial Sequence: Synthetic oligonucleotide
ttcaattaaaaggcagctctgctagttactgtgtcttgg

SEQ ID NO: 206181 - DNA, 38 bp, Artificial Sequence
  Description of Artificial Sequence: Synthetic oligonucleotide
tcaattaaaaggcagctctgctagttactgtgtcttgg

SEQ ID NO: 206182 - DNA, 37 bp, Artificial Sequence
  Description of Artificial Sequence: Synthetic oligonucleotide
caattaaaaggcagctctgctagttactgtgtcttgg

SEQ ID NO: 206183 - DNA, 37 bp, Artificial Sequence
  Description of Artificial Sequence: Synthetic oligonucleotide
aattaaaaggcagctctgctagttactgtgtcttggc

SEQ ID NO: 206184 - DNA, 36 bp, Artificial Sequence
  Description of Artificial Sequence: Synthetic oligonucleotide
attaaaaggcagctctgctagttactgtgtcttggc

SEQ ID NO: 206185 - DNA, 35 bp, Artificial Sequence
  Description of Artificial Sequence: Synthetic oligonucleotide
ttaaaaggcagctctgctagttactgtgtcttggc

SEQ ID NO: 206186 - DNA, 34 bp, Artificial Sequence
  Description of Artificial Sequence: Synthetic oligonucleotide
taaaaggcagctctgctagttactgtgtcttggc

SEQ ID NO: 206187 - DNA, 33 bp, Artificial Sequence
  Description of Artificial Sequence: Synthetic oligonucleotide
aaaaggcagctctgctagttactgtgtcttggc

SEQ ID NO: 206188 - DNA, 32 bp, Artificial Sequence
  Description of Artificial Sequence: Synthetic oligonucleotide
aaaggcagctctgctagttactgtgtcttggc

SEQ ID NO: 206189 - DNA, 31 bp, Artificial Sequence
  Description of Artificial Sequence: Synthetic oligonucleotide
aaggcagctctgctagttactgtgtcttggc

SEQ ID NO: 206190 - DNA, 30 bp, Artificial Sequence
  Description of Artificial Sequence: Synthetic oligonucleotide
aggcagctctgctagttactgtgtcttggc

SEQ ID NO: 206191 - DNA, 29 bp, Artificial Sequence
  Description of Artificial Sequence: Synthetic oligonucleotide
ggcagctctgctagttactgtgtcttggc

SEQ ID NO: 206192 - DNA, 30 bp, Artificial Sequence
  Description of Artificial Sequence: Synthetic oligonucleotide
gcagctctgctagttactgtgtcttggctg

SEQ ID NO: 206193 - DNA, 30 bp, Artificial Sequence
  Description of Artificial Sequence: Synthetic oligonucleotide
cagctctgctagttactgtgtcttggctgg

SEQ ID NO: 206194 - DNA, 33 bp, Artificial Sequence
  Description of Artificial Sequence: Synthetic oligonucleotide
agctctgctagttactgtgtcttggctggaatg

SEQ ID NO: 206195 - DNA, 32 bp, Artificial Sequence
  Description of Artificial Sequence: Synthetic oligonucleotide
gctctgctagttactgtgtcttggctggaatg

SEQ ID NO: 206196 - DNA, 32 bp, Artificial Sequence
  Description of Artificial Sequence: Synthetic oligonucleotide
ctctgctagttactgtgtcttggctggaatgg

SEQ ID NO: 206197 - DNA, 35 bp, Artificial Sequence
  Description of Artificial Sequence: Synthetic oligonucleotide
tctgctagttactgtgtcttggctggaatggaaag

SEQ ID NO: 206198 - DNA, 34 bp, Artificial Sequence
  Description of Artificial Sequence: Synthetic oligonucleotide
ctgctagttactgtgtcttggctggaatggaaag

SEQ ID NO: 206199 - DNA, 34 bp, Artificial Sequence
  Description of Artificial Sequence: Synthetic oligonucleotide
tgctagttactgtgtcttggctggaatggaaagc

SEQ ID NO: 206200 - DNA, 33 bp, Artificial Sequence
  Description of Artificial Sequence: Synthetic oligonucleotide
gctagttactgtgtcttggctggaatggaaagc

SEQ ID NO: 206201 - DNA, 33 bp, Artificial Sequence
  Description of Artificial Sequence: Synthetic oligonucleotide
ctagttactgtgtcttggctggaatggaaagcc

SEQ ID NO: 206202 - DNA, 36 bp, Artificial Sequence
  Description of Artificial Sequence: Synthetic oligonucleotide
tagttactgtgtcttggctggaatggaaagcctttg

SEQ ID NO: 206203 - DNA, 35 bp, Artificial Sequence
  Description of Artificial Sequence: Synthetic oligonucleotide
agttactgtgtcttggctggaatggaaagcctttg

SEQ ID NO: 206204 - DNA, 34 bp, Artificial Sequence
  Description of Artificial Sequence: Synthetic oligonucleotide
gttactgtgtcttggctggaatggaaagcctttg

SEQ ID NO: 206205 - DNA, 34 bp, Artificial Sequence
  Description of Artificial Sequence: Synthetic oligonucleotide
ttactgtgtcttggctggaatggaaagcctttgg

SEQ ID NO: 206206 - DNA, 33 bp, Artificial Sequence
  Description of Artificial Sequence: Synthetic oligonucleotide
tactgtgtcttggctggaatggaaagcctttgg

SEQ ID NO: 206207 - DNA, 32 bp, Artificial Sequence
  Description of Artificial Sequence: Synthetic oligonucleotide
actgtgtcttggctggaatggaaagcctttgg

SEQ ID NO: 206208 - DNA, 31 bp, Artificial Sequence
  Description of Artificial Sequence: Synthetic oligonucleotide
ctgtgtcttggctggaatggaaagcctttgg

SEQ ID NO: 206209 - DNA, 35 bp, Artificial Sequence
  Description of Artificial Sequence: Synthetic oligonucleotide
tgtgtcttggctggaatggaaagcctttggaatag

SEQ ID NO: 206210 - DNA, 34 bp, Artificial Sequence
  Description of Artificial Sequence: Synthetic oligonucleotide
gtgtcttggctggaatggaaagcctttggaatag

SEQ ID NO: 206211 - DNA, 34 bp, Artificial Sequence
  Description of Artificial Sequence: Synthetic oligonucleotide
tgtcttggctggaatggaaagcctttggaatagc

SEQ ID NO: 206212 - DNA, 33 bp, Artificial Sequence
  Description of Artificial Sequence: Synthetic oligonucleotide
gtcttggctggaatggaaagcctttggaatagc

SEQ ID NO: 206213 - DNA, 34 bp, Artificial Sequence
  Description of Artificial Sequence: Synthetic oligonucleotide
tcttggctggaatggaaagcctttggaatagcag

SEQ ID NO: 206214 - DNA, 33 bp, Artificial Sequence
  Description of Artificial Sequence: Synthetic oligonucleotide
cttggctggaatggaaagcctttggaatagcag

SEQ ID NO: 206215 - DNA, 34 bp, Artificial Sequence
  Description of Artificial Sequence: Synthetic oligonucleotide
ttggctggaatggaaagcctttggaatagcagtg

SEQ ID NO: 206216 - DNA, 33 bp, Artificial Sequence
  Description of Artificial Sequence: Synthetic oligonucleotide
tggctggaatggaaagcctttggaatagcagtg

SEQ ID NO: 206217 - DNA, 32 bp, Artificial Sequence
  Description of Artificial Sequence: Synthetic oligonucleotide
ggctggaatggaaagcctttggaatagcagtg

SEQ ID NO: 206218 - DNA, 34 bp, Artificial Sequence
  Description of Artificial Sequence: Synthetic oligonucleotide
gctggaatggaaagcctttggaatagcagtgttc

SEQ ID NO: 206219 - DNA, 34 bp, Artificial Sequence
  Description of Artificial Sequence: Synthetic oligonucleotide
ctggaatggaaagcctttggaatagcagtgttcc

SEQ ID NO: 206220 - DNA, 35 bp, Artificial Sequence
  Description of Artificial Sequence: Synthetic oligonucleotide
tggaatggaaagcctttggaatagcagtgttccag

SEQ ID NO: 206221 - DNA, 34 bp, Artificial Sequence
  Description of Artificial Sequence: Synthetic oligonucleotide
ggaatggaaagcctttggaatagcagtgttccag

SEQ ID NO: 206222 - DNA, 35 bp, Artificial Sequence
  Description of Artificial Sequence: Synthetic oligonucleotide
gaatggaaagcctttggaatagcagtgttccagtg

SEQ ID NO: 206223 - DNA, 36 bp, Artificial Sequence
  Description of Artificial Sequence: Synthetic oligonucleotide
aatggaaagcctttggaatagcagtgttccagtgtg

SEQ ID NO: 206224 - DNA, 35 bp, Artificial Sequence
  Description of Artificial Sequence: Synthetic oligonucleotide
atggaaagcctttggaatagcagtgttccagtgtg

SEQ ID NO: 206225 - DNA, 34 bp, Artificial Sequence
  Description of Artificial Sequence: Synthetic oligonucleotide
tggaaagcctttggaatagcagtgttccagtgtg

SEQ ID NO: 206226 - DNA, 33 bp, Artificial Sequence
  Description of Artificial Sequence: Synthetic oligonucleotide
ggaaagcctttggaatagcagtgttccagtgtg

SEQ ID NO: 206227 - DNA, 34 bp, Artificial Sequence
  Description of Artificial Sequence: Synthetic oligonucleotide
gaaagcctttggaatagcagtgttccagtgtgtg

SEQ ID NO: 206228 - DNA, 36 bp, Artificial Sequence
  Description of Artificial Sequence: Synthetic oligonucleotide
aaagcctttggaatagcagtgttccagtgtgtgaac

SEQ ID NO: 206229 - DNA, 35 bp, Artificial Sequence
  Description of Artificial Sequence: Synthetic oligonucleotide
aagcctttggaatagcagtgttccagtgtgtgaac

SEQ ID NO: 206230 - DNA, 34 bp, Artificial Sequence
  Description of Artificial Sequence: Synthetic oligonucleotide
agcctttggaatagcagtgttccagtgtgtgaac

SEQ ID NO: 206231 - DNA, 33 bp, Artificial Sequence
  Description of Artificial Sequence: Synthetic oligonucleotide
gcctttggaatagcagtgttccagtgtgtgaac

SEQ ID NO: 206232 - DNA, 37 bp, Artificial Sequence
  Description of Artificial Sequence: Synthetic oligonucleotide
cctttggaatagcagtgttccagtgtgtgaacaaatc

SEQ ID NO: 206233 - DNA, 41 bp, Artificial Sequence
  Description of Artificial Sequence: Synthetic oligonucleotide
ctttggaatagcagtgttccagtgtgtgaacaaatcttttg

SEQ ID NO: 206234 - DNA, 42 bp, Artificial Sequence
  Description of Artificial Sequence: Synthetic oligonucleotide
tttggaatagcagtgttccagtgtgtgaacaaatcttttgtc

SEQ ID NO: 206235 - DNA, 41 bp, Artificial Sequence
  Description of Artificial Sequence: Synthetic oligonucleotide
ttggaatagcagtgttccagtgtgtgaacaaatcttttgtc

SEQ ID NO: 206236 - DNA, 40 bp, Artificial Sequence
  Description of Artificial Sequence: Synthetic oligonucleotide
tggaatagcagtgttccagtgtgtgaacaaatcttttgtc

SEQ ID NO: 206237 - DNA, 39 bp, Artificial Sequence
  Description of Artificial Sequence: Synthetic oligonucleotide
ggaatagcagtgttccagtgtgtgaacaaatcttttgtc

SEQ ID NO: 206238 - DNA, 39 bp, Artificial Sequence
  Description of Artificial Sequence: Synthetic oligonucleotide
gaatagcagtgttccagtgtgtgaacaaatcttttgtcc

SEQ ID NO: 206239 - DNA, 41 bp, Artificial Sequence
  Description of Artificial Sequence: Synthetic oligonucleotide
aatagcagtgttccagtgtgtgaacaaatcttttgtccaag

SEQ ID NO: 206240 - DNA, 40 bp, Artificial Sequence
  Description of Artificial Sequence: Synthetic oligonucleotide
atagcagtgttccagtgtgtgaacaaatcttttgtccaag

SEQ ID NO: 206241 - DNA, 39 bp, Artificial Sequence
  Description of Artificial Sequence: Synthetic oligonucleotide
tagcagtgttccagtgtgtgaacaaatcttttgtccaag

SEQ ID NO: 206242 - DNA, 38 bp, Artificial Sequence
  Description of Artificial Sequence: Synthetic oligonucleotide
agcagtgttccagtgtgtgaacaaatcttttgtccaag

SEQ ID NO: 206243 - DNA, 37 bp, Artificial Sequence
  Description of Artificial Sequence: Synthetic oligonucleotide
gcagtgttccagtgtgtgaacaaatcttttgtccaag

SEQ ID NO: 206244 - DNA, 38 bp, Artificial Sequence
  Description of Artificial Sequence: Synthetic oligonucleotide
cagtgttccagtgtgtgaacaaatcttttgtccaagtc

SEQ ID NO: 206245 - DNA, 38 bp, Artificial Sequence
  Description of Artificial Sequence: Synthetic oligonucleotide
agtgttccagtgtgtgaacaaatcttttgtccaagtcc

SEQ ID NO: 206246 - DNA, 37 bp, Artificial Sequence
  Description of Artificial Sequence: Synthetic oligonucleotide
gtgttccagtgtgtgaacaaatcttttgtccaagtcc

SEQ ID NO: 206247 - DNA, 38 bp, Artificial Sequence
  Description of Artificial Sequence: Synthetic oligonucleotide
tgttccagtgtgtgaacaaatcttttgtccaagtcctc

SEQ ID NO: 206248 - DNA, 37 bp, Artificial Sequence
  Description of Artificial Sequence: Synthetic oligonucleotide
gttccagtgtgtgaacaaatcttttgtccaagtcctc

SEQ ID NO: 206249 - DNA, 37 bp, Artificial Sequence
  Description of Artificial Sequence: Synthetic oligonucleotide
ttccagtgtgtgaacaaatcttttgtccaagtcctcc

SEQ ID NO: 206250 - DNA, 36 bp, Artificial Sequence
  Description of Artificial Sequence: Synthetic oligonucleotide
tccagtgtgtgaacaaatcttttgtccaagtcctcc

SEQ ID NO: 206251 - DNA, 35 bp, Artificial Sequence
  Description of Artificial Sequence: Synthetic oligonucleotide
ccagtgtgtgaacaaatcttttgtccaagtcctcc

SEQ ID NO: 206252 - DNA, 36 bp, Artificial Sequence
  Description of Artificial Sequence: Synthetic oligonucleotide
cagtgtgtgaacaaatcttttgtccaagtcctccag

SEQ ID NO: 206253 - DNA, 41 bp, Artificial Sequence
  Description of Artificial Sequence: Synthetic oligonucleotide
agtgtgtgaacaaatcttttgtccaagtcctccagttattc

SEQ ID NO: 206254 - DNA, 40 bp, Artificial Sequence
  Description of Artificial Sequence: Synthetic oligonucleotide
gtgtgtgaacaaatcttttgtccaagtcctccagttattc

SEQ ID NO: 206255 - DNA, 40 bp, Artificial Sequence
  Description of Artificial Sequence: Synthetic oligonucleotide
tgtgtgaacaaatcttttgtccaagtcctccagttattcc

SEQ ID NO: 206256 - DNA, 39 bp, Artificial Sequence
  Description of Artificial Sequence: Synthetic oligonucleotide
gtgtgaacaaatcttttgtccaagtcctccagttattcc

SEQ ID NO: 206257 - DNA, 43 bp, Artificial Sequence
  Description of Artificial Sequence: Synthetic oligonucleotide
tgtgaacaaatcttttgtccaagtcctccagttattcctaatg

SEQ ID NO: 206258 - DNA, 42 bp, Artificial Sequence
  Description of Artificial Sequence: Synthetic oligonucleotide
gtgaacaaatcttttgtccaagtcctccagttattcctaatg

SEQ ID NO: 206259 - DNA, 42 bp, Artificial Sequence
  Description of Artificial Sequence: Synthetic oligonucleotide
tgaacaaatcttttgtccaagtcctccagttattcctaatgg

SEQ ID NO: 206260 - DNA, 41 bp, Artificial Sequence
  Description of Artificial Sequence: Synthetic oligonucleotide
gaacaaatcttttgtccaagtcctccagttattcctaatgg

SEQ ID NO: 206261 - DNA, 41 bp, Artificial Sequence
  Description of Artificial Sequence: Synthetic oligonucleotide
aacaaatcttttgtccaagtcctccagttattcctaatggg

SEQ ID NO: 206262 - DNA, 40 bp, Artificial Sequence
  Description of Artificial Sequence: Synthetic oligonucleotide
acaaatcttttgtccaagtcctccagttattcctaatggg

SEQ ID NO: 206263 - DNA, 39 bp, Artificial Sequence
  Description of Artificial Sequence: Synthetic oligonucleotide
caaatcttttgtccaagtcctccagttattcctaatggg

SEQ ID NO: 206264 - DNA, 40 bp, Artificial Sequence
  Description of Artificial Sequence: Synthetic oligonucleotide
aaatcttttgtccaagtcctccagttattcctaatgggag

SEQ ID NO: 206265 - DNA, 39 bp, Artificial Sequence
  Description of Artificial Sequence: Synthetic oligonucleotide
aatcttttgtccaagtcctccagttattcctaatgggag

SEQ ID NO: 206266 - DNA, 38 bp, Artificial Sequence
  Description of Artificial Sequence: Synthetic oligonucleotide
atcttttgtccaagtcctccagttattcctaatgggag

SEQ ID NO: 206267 - DNA, 37 bp, Artificial Sequence
  Description of Artificial Sequence: Synthetic oligonucleotide
tcttttgtccaagtcctccagttattcctaatgggag

SEQ ID NO: 206268 - DNA, 36 bp, Artificial Sequence
  Description of Artificial Sequence: Synthetic oligonucleotide
cttttgtccaagtcctccagttattcctaatgggag

SEQ ID NO: 206269 - DNA, 37 bp, Artificial Sequence
  Description of Artificial Sequence: Synthetic oligonucleotide
ttttgtccaagtcctccagttattcctaatgggagac

SEQ ID NO: 206270 - DNA, 36 bp, Artificial Sequence
  Description of Artificial Sequence: Synthetic oligonucleotide
tttgtccaagtcctccagttattcctaatgggagac

SEQ ID NO: 206271 - DNA, 35 bp, Artificial Sequence
  Description of Artificial Sequence: Synthetic oligonucleotide
ttgtccaagtcctccagttattcctaatgggagac

SEQ ID NO: 206272 - DNA, 34 bp, Artificial Sequence
  Description of Artificial Sequence: Synthetic oligonucleotide
tgtccaagtcctccagttattcctaatgggagac

SEQ ID NO: 206273 - DNA, 33 bp, Artificial Sequence
  Description of Artificial Sequence: Synthetic oligonucleotide
gtccaagtcctccagttattcctaatgggagac

SEQ ID NO: 206274 - DNA, 34 bp, Artificial Sequence
  Description of Artificial Sequence: Synthetic oligonucleotide
tccaagtcctccagttattcctaatgggagacac

SEQ ID NO: 206275 - DNA, 33 bp, Artificial Sequence
  Description of Artificial Sequence: Synthetic oligonucleotide
ccaagtcctccagttattcctaatgggagacac

SEQ ID NO: 206276 - DNA, 34 bp, Artificial Sequence
  Description of Artificial Sequence: Synthetic oligonucleotide
caagtcctccagttattcctaatgggagacacac

SEQ ID NO: 206277 - DNA, 35 bp, Artificial Sequence
  Description of Artificial Sequence: Synthetic oligonucleotide
aagtcctccagttattcctaatgggagacacacag

SEQ ID NO: 206278 - DNA, 34 bp, Artificial Sequence
  Description of Artificial Sequence: Synthetic oligonucleotide
agtcctccagttattcctaatgggagacacacag

SEQ ID NO: 206279 - DNA, 33 bp, Artificial Sequence
  Description of Artificial Sequence: Synthetic oligonucleotide
gtcctccagttattcctaatgggagacacacag

SEQ ID NO: 206280 - DNA, 33 bp, Artificial Sequence
  Description of Artificial Sequence: Synthetic oligonucleotide
tcctccagttattcctaatgggagacacacagg

SEQ ID NO: 206281 - DNA, 32 bp, Artificial Sequence
  Description of Artificial Sequence: Synthetic oligonucleotide
cctccagttattcctaatgggagacacacagg

SEQ ID NO: 206282 - DNA, 36 bp, Artificial Sequence
  Description of Artificial Sequence: Synthetic oligonucleotide
ctccagttattcctaatgggagacacacaggaaaac

SEQ ID NO: 206283 - DNA, 36 bp, Artificial Sequence
  Description of Artificial Sequence: Synthetic oligonucleotide
tccagttattcctaatgggagacacacaggaaaacc

SEQ ID NO: 206284 - DNA, 35 bp, Artificial Sequence
  Description of Artificial Sequence: Synthetic oligonucleotide
ccagttattcctaatgggagacacacaggaaaacc

SEQ ID NO: 206285 - DNA, 36 bp, Artificial Sequence
  Description of Artificial Sequence: Synthetic oligonucleotide
cagttattcctaatgggagacacacaggaaaacctc

SEQ ID NO: 206286 - DNA, 37 bp, Artificial Sequence
  Description of Artificial Sequence: Synthetic oligonucleotide
agttattcctaatgggagacacacaggaaaacctctg

SEQ ID NO: 206287 - DNA, 36 bp, Artificial Sequence
  Description of Artificial Sequence: Synthetic oligonucleotide
gttattcctaatgggagacacacaggaaaacctctg

SEQ ID NO: 206288 - DNA, 36 bp, Artificial Sequence
  Description of Artificial Sequence: Synthetic oligonucleotide
ttattcctaatgggagacacacaggaaaacctctgg

SEQ ID NO: 206289 - DNA, 35 bp, Artificial Sequence
  Description of Artificial Sequence: Synthetic oligonucleotide
tattcctaatgggagacacacaggaaaacctctgg

SEQ ID NO: 206290 - DNA, 34 bp, Artificial Sequence
  Description of Artificial Sequence: Synthetic oligonucleotide
attcctaatgggagacacacaggaaaacctctgg

SEQ ID NO: 206291 - DNA, 33 bp, Artificial Sequence
  Description of Artificial Sequence: Synthetic oligonucleotide
ttcctaatgggagacacacaggaaaacctctgg

SEQ ID NO: 206292 - DNA, 32 bp, Artificial Sequence
  Description of Artificial Sequence: Synthetic oligonucleotide
tcctaatgggagacacacaggaaaacctctgg

SEQ ID NO: 206293 - DNA, 31 bp, Artificial Sequence
  Description of Artificial Sequence: Synthetic oligonucleotide
cctaatgggagacacacaggaaaacctctgg

SEQ ID NO: 206294 - DNA, 33 bp, Artificial Sequence
  Description of Artificial Sequence: Synthetic oligonucleotide
ctaatgggagacacacaggaaaacctctggaag

SEQ ID NO: 206295 - DNA, 34 bp, Artificial Sequence
  Description of Artificial Sequence: Synthetic oligonucleotide
taatgggagacacacaggaaaacctctggaagtc

SEQ ID NO: 206296 - DNA, 33 bp, Artificial Sequence
  Description of Artificial Sequence: Synthetic oligonucleotide
aatgggagacacacaggaaaacctctggaagtc

SEQ ID NO: 206297 - DNA, 32 bp, Artificial Sequence
  Description of Artificial Sequence: Synthetic oligonucleotide
atgggagacacacaggaaaacctctggaagtc

SEQ ID NO: 206298 - DNA, 31 bp, Artificial Sequence
  Description of Artificial Sequence: Synthetic oligonucleotide
tgggagacacacaggaaaacctctggaagtc

SEQ ID NO: 206299 - DNA, 30 bp, Artificial Sequence
  Description of Artificial Sequence: Synthetic oligonucleotide
gggagacacacaggaaaacctctggaagtc

SEQ ID NO: 206300 - DNA, 33 bp, Artificial Sequence
  Description of Artificial Sequence: Synthetic oligonucleotide
ggagacacacaggaaaacctctggaagtctttc

SEQ ID NO: 206301 - DNA, 33 bp, Artificial Sequence
  Description of Artificial Sequence: Synthetic oligonucleotide
gagacacacaggaaaacctctggaagtctttcc

SEQ ID NO: 206302 - DNA, 33 bp, Artificial Sequence
  Description of Artificial Sequence: Synthetic oligonucleotide
agacacacaggaaaacctctggaagtctttccc

SEQ ID NO: 206303 - DNA, 32 bp, Artificial Sequence
  Description of Artificial Sequence: Synthetic oligonucleotide
gacacacaggaaaacctctggaagtctttccc

SEQ ID NO: 206304 - DNA, 35 bp, Artificial Sequence
  Description of Artificial Sequence: Synthetic oligonucleotide
acacacaggaaaacctctggaagtctttccctttg

SEQ ID NO: 206305 - DNA, 34 bp, Artificial Sequence
  Description of Artificial Sequence: Synthetic oligonucleotide
cacacaggaaaacctctggaagtctttccctttg

SEQ ID NO: 206306 - DNA, 34 bp, Artificial Sequence
  Description of Artificial Sequence: Synthetic oligonucleotide
acacaggaaaacctctggaagtctttccctttgg

SEQ ID NO: 206307 - DNA, 33 bp, Artificial Sequence
  Description of Artificial Sequence: Synthetic oligonucleotide
cacaggaaaacctctggaagtctttccctttgg

SEQ ID NO: 206308 - DNA, 33 bp, Artificial Sequence
  Description of Artificial Sequence: Synthetic oligonucleotide
acaggaaaacctctggaagtctttccctttggg

SEQ ID NO: 206309 - DNA, 32 bp, Artificial Sequence
  Description of Artificial Sequence: Synthetic oligonucleotide
caggaaaacctctggaagtctttccctttggg

SEQ ID NO: 206310 - DNA, 36 bp, Artificial Sequence
  Description of Artificial Sequence: Synthetic oligonucleotide
aggaaaacctctggaagtctttccctttgggaaaac

SEQ ID NO: 206311 - DNA, 35 bp, Artificial Sequence
  Description of Artificial Sequence: Synthetic oligonucleotide
ggaaaacctctggaagtctttccctttgggaaaac

SEQ ID NO: 206312 - DNA, 36 bp, Artificial Sequence
  Description of Artificial Sequence: Synthetic oligonucleotide
gaaaacctctggaagtctttccctttgggaaaacag

SEQ ID NO: 206313 - DNA, 43 bp, Artificial Sequence
  Description of Artificial Sequence: Synthetic oligonucleotide
aaaacctctggaagtctttccctttgggaaaacagtaaattac

SEQ ID NO: 206314 - DNA, 42 bp, Artificial Sequence
  Description of Artificial Sequence: Synthetic oligonucleotide
aaacctctggaagtctttccctttgggaaaacagtaaattac

SEQ ID NO: 206315 - DNA, 41 bp, Artificial Sequence
  Description of Artificial Sequence: Synthetic oligonucleotide
aacctctggaagtctttccctttgggaaaacagtaaattac

SEQ ID NO: 206316 - DNA, 40 bp, Artificial Sequence
  Description of Artificial Sequence: Synthetic oligonucleotide
acctctggaagtctttccctttgggaaaacagtaaattac

SEQ ID NO: 206317 - DNA, 39 bp, Artificial Sequence
  Description of Artificial Sequence: Synthetic oligonucleotide
cctctggaagtctttccctttgggaaaacagtaaattac

SEQ ID NO: 206318 - DNA, 40 bp, Artificial Sequence
  Description of Artificial Sequence: Synthetic oligonucleotide
ctctggaagtctttccctttgggaaaacagtaaattacac

SEQ ID NO: 206319 - DNA, 42 bp, Artificial Sequence
  Description of Artificial Sequence: Synthetic oligonucleotide
tctggaagtctttccctttgggaaaacagtaaattacacatg

SEQ ID NO: 206320 - DNA, 41 bp, Artificial Sequence
  Description of Artificial Sequence: Synthetic oligonucleotide
ctggaagtctttccctttgggaaaacagtaaattacacatg

SEQ ID NO: 206321 - DNA, 41 bp, Artificial Sequence
  Description of Artificial Sequence: Synthetic oligonucleotide
tggaagtctttccctttgggaaaacagtaaattacacatgc

SEQ ID NO: 206322 - DNA, 40 bp, Artificial Sequence
  Description of Artificial Sequence: Synthetic oligonucleotide
ggaagtctttccctttgggaaaacagtaaattacacatgc

SEQ ID NO: 206323 - DNA, 40 bp, Artificial Sequence
  Description of Artificial Sequence: Synthetic oligonucleotide
gaagtctttccctttgggaaaacagtaaattacacatgcg

SEQ ID NO: 206324 - DNA, 41 bp, Artificial Sequence
  Description of Artificial Sequence: Synthetic oligonucleotide
aagtctttccctttgggaaaacagtaaattacacatgcgac

SEQ ID NO: 206325 - DNA, 40 bp, Artificial Sequence
  Description of Artificial Sequence: Synthetic oligonucleotide
agtctttccctttgggaaaacagtaaattacacatgcgac

SEQ ID NO: 206326 - DNA, 39 bp, Artificial Sequence
  Description of Artificial Sequence: Synthetic oligonucleotide
gtctttccctttgggaaaacagtaaattacacatgcgac

SEQ ID NO: 206327 - DNA, 39 bp, Artificial Sequence
  Description of Artificial Sequence: Synthetic oligonucleotide
tctttccctttgggaaaacagtaaattacacatgcgacc

SEQ ID NO: 206328 - DNA, 38 bp, Artificial Sequence
  Description of Artificial Sequence: Synthetic oligonucleotide
ctttccctttgggaaaacagtaaattacacatgcgacc

SEQ ID NO: 206329 - DNA, 38 bp, Artificial Sequence
  Description of Artificial Sequence: Synthetic oligonucleotide
tttccctttgggaaaacagtaaattacacatgcgaccc

SEQ ID NO: 206330 - DNA, 37 bp, Artificial Sequence
  Description of Artificial Sequence: Synthetic oligonucleotide
ttccctttgggaaaacagtaaattacacatgcgaccc

SEQ ID NO: 206331 - DNA, 36 bp, Artificial Sequence
  Description of Artificial Sequence: Synthetic oligonucleotide
tccctttgggaaaacagtaaattacacatgcgaccc

SEQ ID NO: 206332 - DNA, 35 bp, Artificial Sequence
  Description of Artificial Sequence: Synthetic oligonucleotide
ccctttgggaaaacagtaaattacacatgcgaccc

SEQ ID NO: 206333 - DNA, 35 bp, Artificial Sequence
  Description of Artificial Sequence: Synthetic oligonucleotide
cctttgggaaaacagtaaattacacatgcgacccc

SEQ ID NO: 206334 - DNA, 35 bp, Artificial Sequence
  Description of Artificial Sequence: Synthetic oligonucleotide
ctttgggaaaacagtaaattacacatgcgaccccc

SEQ ID NO: 206335 - DNA, 36 bp, Artificial Sequence
  Description of Artificial Sequence: Synthetic oligonucleotide
tttgggaaaacagtaaattacacatgcgacccccac

SEQ ID NO: 206336 - DNA, 35 bp, Artificial Sequence
  Description of Artificial Sequence: Synthetic oligonucleotide
ttgggaaaacagtaaattacacatgcgacccccac

SEQ ID NO: 206337 - DNA, 34 bp, Artificial Sequence
  Description of Artificial Sequence: Synthetic oligonucleotide
tgggaaaacagtaaattacacatgcgacccccac

SEQ ID NO: 206338 - DNA, 33 bp, Artificial Sequence
  Description of Artificial Sequence: Synthetic oligonucleotide
gggaaaacagtaaattacacatgcgacccccac

SEQ ID NO: 206339 - DNA, 33 bp, Artificial Sequence
  Description of Artificial Sequence: Synthetic oligonucleotide
ggaaaacagtaaattacacatgcgacccccacc

SEQ ID NO: 206340 - DNA, 33 bp, Artificial Sequence
  Description of Artificial Sequence: Synthetic oligonucleotide
gaaaacagtaaattacacatgcgacccccaccc

SEQ ID NO: 206341 - DNA, 34 bp, Artificial Sequence
  Description of Artificial Sequence: Synthetic oligonucleotide
aaaacagtaaattacacatgcgacccccacccag

SEQ ID NO: 206342 - DNA, 33 bp, Artificial Sequence
  Description of Artificial Sequence: Synthetic oligonucleotide
aaacagtaaattacacatgcgacccccacccag

SEQ ID NO: 206343 - DNA, 32 bp, Artificial Sequence
  Description of Artificial Sequence: Synthetic oligonucleotide
aacagtaaattacacatgcgacccccacccag

SEQ ID NO: 206344 - DNA, 31 bp, Artificial Sequence
  Description of Artificial Sequence: Synthetic oligonucleotide
acagtaaattacacatgcgacccccacccag

SEQ ID NO: 206345 - DNA, 30 bp, Artificial Sequence
  Description of Artificial Sequence: Synthetic oligonucleotide
cagtaaattacacatgcgacccccacccag

SEQ ID NO: 206346 - DNA, 31 bp, Artificial Sequence
  Description of Artificial Sequence: Synthetic oligonucleotide
agtaaattacacatgcgacccccacccagac

SEQ ID NO: 206347 - DNA, 30 bp, Artificial Sequence
  Description of Artificial Sequence: Synthetic oligonucleotide
gtaaattacacatgcgacccccacccagac

SEQ ID NO: 206348 - DNA, 31 bp, Artificial Sequence
  Description of Artificial Sequence: Synthetic oligonucleotide
taaattacacatgcgacccccacccagacag

SEQ ID NO: 206349 - DNA, 30 bp, Artificial Sequence
  Description of Artificial Sequence: Synthetic oligonucleotide
aaattacacatgcgacccccacccagacag

SEQ ID NO: 206350 - DNA, 29 bp, Artificial Sequence
  Description of Artificial Sequence: Synthetic oligonucleotide
aattacacatgcgacccccacccagacag

SEQ ID NO: 206351 - DNA, 28 bp, Artificial Sequence
  Description of Artificial Sequence: Synthetic oligonucleotide
attacacatgcgacccccacccagacag

SEQ ID NO: 206352 - DNA, 27 bp, Artificial Sequence
  Description of Artificial Sequence: Synthetic oligonucleotide
ttacacatgcgacccccacccagacag

SEQ ID NO: 206353 - DNA, 27 bp, Artificial Sequence
  Description of Artificial Sequence: Synthetic oligonucleotide
tacacatgcgacccccacccagacaga

SEQ ID NO: 206354 - DNA, 26 bp, Artificial Sequence
  Description of Artificial Sequence: Synthetic oligonucleotide
acacatgcgacccccacccagacaga

SEQ ID NO: 206355 - DNA, 25 bp, Artificial Sequence
  Description of Artificial Sequence: Synthetic oligonucleotide
cacatgcgacccccacccagacaga

SEQ ID NO: 206356 - DNA, 25 bp, Artificial Sequence
  Description of Artificial Sequence: Synthetic oligonucleotide
acatgcgacccccacccagacagag

SEQ ID NO: 206357 - DNA, 24 bp, Artificial Sequence
  Description of Artificial Sequence: Synthetic oligonucleotide
catgcgacccccacccagacagag

SEQ ID NO: 206358 - DNA, 24 bp, Artificial Sequence
  Description of Artificial Sequence: Synthetic oligonucleotide
atgcgacccccacccagacagagg

SEQ ID NO: 206359 - DNA, 23 bp, Artificial Sequence
  Description of Artificial Sequence: Synthetic oligonucleotide
tgcgacccccacccagacagagg

SEQ ID NO: 206360 - DNA, 22 bp, Artificial Sequence
  Description of Artificial Sequence: Synthetic oligonucleotide
gcgacccccacccagacagagg

SEQ ID NO: 206361 - DNA, 23 bp, Artificial Sequence
  Description of Artificial Sequence: Synthetic oligonucleotide
cgacccccacccagacagaggga

SEQ ID NO: 206362 - DNA, 23 bp, Artificial Sequence
  Description of Artificial Sequence: Synthetic oligonucleotide
gacccccacccagacagagggac

SEQ ID NO: 206363 - DNA, 24 bp, Artificial Sequence
  Description of Artificial Sequence: Synthetic oligonucleotide
acccccacccagacagagggacga

SEQ ID NO: 206364 - DNA, 23 bp, Artificial Sequence
  Description of Artificial Sequence: Synthetic oligonucleotide
cccccacccagacagagggacga

SEQ ID NO: 206365 - DNA, 23 bp, Artificial Sequence
  Description of Artificial Sequence: Synthetic oligonucleotide
ccccacccagacagagggacgag

SEQ ID NO: 206366 - DNA, 25 bp, Artificial Sequence
  Description of Artificial Sequence: Synthetic oligonucleotide
cccacccagacagagggacgagctt

SEQ ID NO: 206367 - DNA, 25 bp, Artificial Sequence
  Description of Artificial Sequence: Synthetic oligonucleotide
ccacccagacagagggacgagcttc

SEQ ID NO: 206368 - DNA, 26 bp, Artificial Sequence
  Description of Artificial Sequence: Synthetic oligonucleotide
cacccagacagagggacgagcttcga

SEQ ID NO: 206369 - DNA, 26 bp, Artificial Sequence
  Description of Artificial Sequence: Synthetic oligonucleotide
acccagacagagggacgagcttcgac

SEQ ID NO: 206370 - DNA, 25 bp, Artificial Sequence
  Description of Artificial Sequence: Synthetic oligonucleotide
cccagacagagggacgagcttcgac

SEQ ID NO: 206371 - DNA, 26 bp, Artificial Sequence
  Description of Artificial Sequence: Synthetic oligonucleotide
ccagacagagggacgagcttcgacct

SEQ ID NO: 206372 - DNA, 27 bp, Artificial Sequence
  Description of Artificial Sequence: Synthetic oligonucleotide
cagacagagggacgagcttcgacctca

SEQ ID NO: 206373 - DNA, 29 bp, Artificial Sequence
  Description of Artificial Sequence: Synthetic oligonucleotide
agacagagggacgagcttcgacctcattg

SEQ ID NO: 206374 - DNA, 28 bp, Artificial Sequence
  Description of Artificial Sequence: Synthetic oligonucleotide
gacagagggacgagcttcgacctcattg

SEQ ID NO: 206375 - DNA, 28 bp, Artificial Sequence
  Description of Artificial Sequence: Synthetic oligonucleotide
acagagggacgagcttcgacctcattgg

SEQ ID NO: 206376 - DNA, 27 bp, Artificial Sequence
  Description of Artificial Sequence: Synthetic oligonucleotide
cagagggacgagcttcgacctcattgg

SEQ ID NO: 206377 - DNA, 28 bp, Artificial Sequence
  Description of Artificial Sequence: Synthetic oligonucleotide
agagggacgagcttcgacctcattggag

SEQ ID NO: 206378 - DNA, 27 bp, Artificial Sequence
  Description of Artificial Sequence: Synthetic oligonucleotide
gagggacgagcttcgacctcattggag

SEQ ID NO: 206379 - DNA, 28 bp, Artificial Sequence
  Description of Artificial Sequence: Synthetic oligonucleotide
agggacgagcttcgacctcattggagag

SEQ ID NO: 206380 - DNA, 27 bp, Artificial Sequence
  Description of Artificial Sequence: Synthetic oligonucleotide
gggacgagcttcgacctcattggagag

SEQ ID NO: 206381 - DNA, 28 bp, Artificial Sequence
  Description of Artificial Sequence: Synthetic oligonucleotide
ggacgagcttcgacctcattggagagag

SEQ ID NO: 206382 - DNA, 28 bp, Artificial Sequence
  Description of Artificial Sequence: Synthetic oligonucleotide
gacgagcttcgacctcattggagagagc

SEQ ID NO: 206383 - DNA, 29 bp, Artificial Sequence
  Description of Artificial Sequence: Synthetic oligonucleotide
acgagcttcgacctcattggagagagcac

SEQ ID NO: 206384 - DNA, 28 bp, Artificial Sequence
  Description of Artificial Sequence: Synthetic oligonucleotide
cgagcttcgacctcattggagagagcac

SEQ ID NO: 206385 - DNA, 28 bp, Artificial Sequence
  Description of Artificial Sequence: Synthetic oligonucleotide
gagcttcgacctcattggagagagcacc

SEQ ID NO: 206386 - DNA, 30 bp, Artificial Sequence
  Description of Artificial Sequence: Synthetic oligonucleotide
agcttcgacctcattggagagagcaccatc

SEQ ID NO: 206387 - DNA, 29 bp, Artificial Sequence
  Description of Artificial Sequence: Synthetic oligonucleotide
gcttcgacctcattggagagagcaccatc

SEQ ID NO: 206388 - DNA, 29 bp, Artificial Sequence
  Description of Artificial Sequence: Synthetic oligonucleotide
cttcgacctcattggagagagcaccatcc

SEQ ID NO: 206389 - DNA, 29 bp, Artificial Sequence
  Description of Artificial Sequence: Synthetic oligonucleotide
ttcgacctcattggagagagcaccatccg

SEQ ID NO: 206390 - DNA, 28 bp, Artificial Sequence
  Description of Artificial Sequence: Synthetic oligonucleotide
tcgacctcattggagagagcaccatccg

SEQ ID NO: 206391 - DNA, 27 bp, Artificial Sequence
  Description of Artificial Sequence: Synthetic oligonucleotide
cgacctcattggagagagcaccatccg

SEQ ID NO: 206392 - DNA, 27 bp, Artificial Sequence
  Description of Artificial Sequence: Synthetic oligonucleotide
gacctcattggagagagcaccatccgc

SEQ ID NO: 206393 - DNA, 28 bp, Artificial Sequence
  Description of Artificial Sequence: Synthetic oligonucleotide
acctcattggagagagcaccatccgctg

SEQ ID NO: 206394 - DNA, 27 bp, Artificial Sequence
  Description of Artificial Sequence: Synthetic oligonucleotide
cctcattggagagagcaccatccgctg

SEQ ID NO: 206395 - DNA, 27 bp, Artificial Sequence
  Description of Artificial Sequence: Synthetic oligonucleotide
ctcattggagagagcaccatccgctgc

SEQ ID NO: 206396 - DNA, 28 bp, Artificial Sequence
  Description of Artificial Sequence: Synthetic oligonucleotide
tcattggagagagcaccatccgctgcac

SEQ ID NO: 206397 - DNA, 27 bp, Artificial Sequence
  Description of Artificial Sequence: Synthetic oligonucleotide
cattggagagagcaccatccgctgcac

SEQ ID NO: 206398 - DNA, 29 bp, Artificial Sequence
  Description of Artificial Sequence: Synthetic oligonucleotide
attggagagagcaccatccgctgcacaag

SEQ ID NO: 206399 - DNA, 28 bp, Artificial Sequence
  Description of Artificial Sequence: Synthetic oligonucleotide
ttggagagagcaccatccgctgcacaag

SEQ ID NO: 206400 - DNA, 27 bp, Artificial Sequence
  Description of Artificial Sequence: Synthetic oligonucleotide
tggagagagcaccatccgctgcacaag

SEQ ID NO: 206401 - DNA, 27 bp, Artificial Sequence
  Description of Artificial Sequence: Synthetic oligonucleotide
ggagagagcaccatccgctgcacaagt

SEQ ID NO: 206402 - DNA, 27 bp, Artificial Sequence
  Description of Artificial Sequence: Synthetic oligonucleotide
gagagagcaccatccgctgcacaagtg

SEQ ID NO: 206403 - DNA, 28 bp, Artificial Sequence
  Description of Artificial Sequence: Synthetic oligonucleotide
agagagcaccatccgctgcacaagtgac

SEQ ID NO: 206404 - DNA, 27 bp, Artificial Sequence
  Description of Artificial Sequence: Synthetic oligonucleotide
gagagcaccatccgctgcacaagtgac

SEQ ID NO: 206405 - DNA, 27 bp, Artificial Sequence
  Description of Artificial Sequence: Synthetic oligonucleotide
agagcaccatccgctgcacaagtgacc

SEQ ID NO: 206406 - DNA, 26 bp, Artificial Sequence
  Description of Artificial Sequence: Synthetic oligonucleotide
gagcaccatccgctgcacaagtgacc

SEQ ID NO: 206407 - DNA, 27 bp, Artificial Sequence
  Description of Artificial Sequence: Synthetic oligonucleotide
agcaccatccgctgcacaagtgaccct

SEQ ID NO: 206408 - DNA, 26 bp, Artificial Sequence
  Description of Artificial Sequence: Synthetic oligonucleotide
gcaccatccgctgcacaagtgaccct

SEQ ID NO: 206409 - DNA, 27 bp, Artificial Sequence
  Description of Artificial Sequence: Synthetic oligonucleotide
caccatccgctgcacaagtgaccctca

SEQ ID NO: 206410 - DNA, 28 bp, Artificial Sequence
  Description of Artificial Sequence: Synthetic oligonucleotide
accatccgctgcacaagtgaccctcaag

SEQ ID NO: 206411 - DNA, 27 bp, Artificial Sequence
  Description of Artificial Sequence: Synthetic oligonucleotide
ccatccgctgcacaagtgaccctcaag

SEQ ID NO: 206412 - DNA, 27 bp, Artificial Sequence
  Description of Artificial Sequence: Synthetic oligonucleotide
catccgctgcacaagtgaccctcaagg

SEQ ID NO: 206413 - DNA, 27 bp, Artificial Sequence
  Description of Artificial Sequence: Synthetic oligonucleotide
atccgctgcacaagtgaccctcaaggg

SEQ ID NO: 206414 - DNA, 27 bp, Artificial Sequence
  Description of Artificial Sequence: Synthetic oligonucleotide
tccgctgcacaagtgaccctcaaggga

SEQ ID NO: 206415 - DNA, 27 bp, Artificial Sequence
  Description of Artificial Sequence: Synthetic oligonucleotide
ccgctgcacaagtgaccctcaagggaa

SEQ ID NO: 206416 - DNA, 28 bp, Artificial Sequence
  Description of Artificial Sequence: Synthetic oligonucleotide
cgctgcacaagtgaccctcaagggaatg

SEQ ID NO: 206417 - DNA, 28 bp, Artificial Sequence
  Description of Artificial Sequence: Synthetic oligonucleotide
gctgcacaagtgaccctcaagggaatgg

SEQ ID NO: 206418 - DNA, 28 bp, Artificial Sequence
  Description of Artificial Sequence: Synthetic oligonucleotide
ctgcacaagtgaccctcaagggaatggg

SEQ ID NO: 206419 - DNA, 28 bp, Artificial Sequence
  Description of Artificial Sequence: Synthetic oligonucleotide
tgcacaagtgaccctcaagggaatgggg

SEQ ID NO: 206420 - DNA, 27 bp, Artificial Sequence
  Description of Artificial Sequence: Synthetic oligonucleotide
gcacaagtgaccctcaagggaatgggg

SEQ ID NO: 206421 - DNA, 30 bp, Artificial Sequence
  Description of Artificial Sequence: Synthetic oligonucleotide
cacaagtgaccctcaagggaatggggtttg

SEQ ID NO: 206422 - DNA, 30 bp, Artificial Sequence
  Description of Artificial Sequence: Synthetic oligonucleotide
acaagtgaccctcaagggaatggggtttgg

SEQ ID NO: 206423 - DNA, 29 bp, Artificial Sequence
  Description of Artificial Sequence: Synthetic oligonucleotide
caagtgaccctcaagggaatggggtttgg

SEQ ID NO: 206424 - DNA, 30 bp, Artificial Sequence
  Description of Artificial Sequence: Synthetic oligonucleotide
aagtgaccctcaagggaatggggtttggag

SEQ ID NO: 206425 - DNA, 29 bp, Artificial Sequence
  Description of Artificial Sequence: Synthetic oligonucleotide
agtgaccctcaagggaatggggtttggag

SEQ ID NO: 206426 - DNA, 28 bp, Artificial Sequence
  Description of Artificial Sequence: Synthetic oligonucleotide
gtgaccctcaagggaatggggtttggag

SEQ ID NO: 206427 - DNA, 28 bp, Artificial Sequence
  Description of Artificial Sequence: Synthetic oligonucleotide
tgaccctcaagggaatggggtttggagc

SEQ ID NO: 206428 - DNA, 27 bp, Artificial Sequence
  Description of Artificial Sequence: Synthetic oligonucleotide
gaccctcaagggaatggggtttggagc

SEQ ID NO: 206429 - DNA, 28 bp, Artificial Sequence
  Description of Artificial Sequence: Synthetic oligonucleotide
accctcaagggaatggggtttggagcag

SEQ ID NO: 206430 - DNA, 27 bp, Artificial Sequence
  Description of Artificial Sequence: Synthetic oligonucleotide
ccctcaagggaatggggtttggagcag

SEQ ID NO: 206431 - DNA, 27 bp, Artificial Sequence
  Description of Artificial Sequence: Synthetic oligonucleotide
cctcaagggaatggggtttggagcagc

SEQ ID NO: 206432 - DNA, 27 bp, Artificial Sequence
  Description of Artificial Sequence: Synthetic oligonucleotide
ctcaagggaatggggtttggagcagcc

SEQ ID NO: 206433 - DNA, 27 bp, Artificial Sequence
  Description of Artificial Sequence: Synthetic oligonucleotide
tcaagggaatggggtttggagcagccc

SEQ ID NO: 206434 - DNA, 27 bp, Artificial Sequence
  Description of Artificial Sequence: Synthetic oligonucleotide
caagggaatggggtttggagcagccct

SEQ ID NO: 206435 - DNA, 27 bp, Artificial Sequence
  Description of Artificial Sequence: Synthetic oligonucleotide
aagggaatggggtttggagcagccctg

SEQ ID NO: 206436 - DNA, 26 bp, Artificial Sequence
  Description of Artificial Sequence: Synthetic oligonucleotide
agggaatggggtttggagcagccctg

SEQ ID NO: 206437 - DNA, 25 bp, Artificial Sequence
  Description of Artificial Sequence: Synthetic oligonucleotide
gggaatggggtttggagcagccctg

SEQ ID NO: 206438 - DNA, 25 bp, Artificial Sequence
  Description of Artificial Sequence: Synthetic oligonucleotide
ggaatggggtttggagcagccctgc

SEQ ID NO: 206439 - DNA, 25 bp, Artificial Sequence
  Description of Artificial Sequence: Synthetic oligonucleotide
gaatggggtttggagcagccctgcc

SEQ ID NO: 206440 - DNA, 25 bp, Artificial Sequence
  Description of Artificial Sequence: Synthetic oligonucleotide
aatggggtttggagcagccctgccc

SEQ ID NO: 206441 - DNA, 24 bp, Artificial Sequence
  Description of Artificial Sequence: Synthetic oligonucleotide
atggggtttggagcagccctgccc

SEQ ID NO: 206442 - DNA, 23 bp, Artificial Sequence
  Description of Artificial Sequence: Synthetic oligonucleotide
tggggtttggagcagccctgccc

SEQ ID NO: 206443 - DNA, 22 bp, Artificial Sequence
  Description of Artificial Sequence: Synthetic oligonucleotide
ggggtttggagcagccctgccc

SEQ ID NO: 206444 - DNA, 23 bp, Artificial Sequence
  Description of Artificial Sequence: Synthetic oligonucleotide
gggtttggagcagccctgcccct

SEQ ID NO: 206445 - DNA, 23 bp, Artificial Sequence
  Description of Artificial Sequence: Synthetic oligonucleotide
ggtttggagcagccctgcccctc

SEQ ID NO: 206446 - DNA, 23 bp, Artificial Sequence
  Description of Artificial Sequence: Synthetic oligonucleotide
gtttggagcagccctgcccctcg

SEQ ID NO: 206447 - DNA, 24 bp, Artificial Sequence
  Description of Artificial Sequence: Synthetic oligonucleotide
tttggagcagccctgcccctcgct

SEQ ID NO: 206448 - DNA, 23 bp, Artificial Sequence
  Description of Artificial Sequence: Synthetic oligonucleotide
ttggagcagccctgcccctcgct

SEQ ID NO: 206449 - DNA, 22 bp, Artificial Sequence
  Description of Artificial Sequence: Synthetic oligonucleotide
tggagcagccctgcccctcgct

SEQ ID NO: 206450 - DNA, 21 bp, Artificial Sequence
  Description of Artificial Sequence: Synthetic oligonucleotide
ggagcagccctgcccctcgct

SEQ ID NO: 206451 - DNA, 22 bp, Artificial Sequence
  Description of Artificial Sequence: Synthetic oligonucleotide
gagcagccctgcccctcgctgt

SEQ ID NO: 206452 - DNA, 22 bp, Artificial Sequence
  Description of Artificial Sequence: Synthetic oligonucleotide
agcagccctgcccctcgctgtg

SEQ ID NO: 206453 - DNA, 21 bp, Artificial Sequence
  Description of Artificial Sequence: Synthetic oligonucleotide
gcagccctgcccctcgctgtg

SEQ ID NO: 206454 - DNA, 25 bp, Artificial Sequence
  Description of Artificial Sequence: Synthetic oligonucleotide
cagccctgcccctcgctgtggaatt

SEQ ID NO: 206455 - DNA, 26 bp, Artificial Sequence
  Description of Artificial Sequence: Synthetic oligonucleotide
agccctgcccctcgctgtggaattct

SEQ ID NO: 206456 - DNA, 25 bp, Artificial Sequence
  Description of Artificial Sequence: Synthetic oligonucleotide
gccctgcccctcgctgtggaattct

SEQ ID NO: 206457 - DNA, 25 bp, Artificial Sequence
  Description of Artificial Sequence: Synthetic oligonucleotide
ccctgcccctcgctgtggaattctg

SEQ ID NO: 206458 - DNA, 25 bp, Artificial Sequence
  Description of Artificial Sequence: Synthetic oligonucleotide
cctgcccctcgctgtggaattctgg

SEQ ID NO: 206459 - DNA, 26 bp, Artificial Sequence
  Description of Artificial Sequence: Synthetic oligonucleotide
ctgcccctcgctgtggaattctgggt

SEQ ID NO: 206460 - DNA, 27 bp, Artificial Sequence
  Description of Artificial Sequence: Synthetic oligonucleotide
tgcccctcgctgtggaattctgggtca

SEQ ID NO: 206461 - DNA, 26 bp, Artificial Sequence
  Description of Artificial Sequence: Synthetic oligonucleotide
gcccctcgctgtggaattctgggtca

SEQ ID NO: 206462 - DNA, 27 bp, Artificial Sequence
  Description of Artificial Sequence: Synthetic oligonucleotide
cccctcgctgtggaattctgggtcact

SEQ ID NO: 206463 - DNA, 27 bp, Artificial Sequence
  Description of Artificial Sequence: Synthetic oligonucleotide
ccctcgctgtggaattctgggtcactg

SEQ ID NO: 206464 - DNA, 28 bp, Artificial Sequence
  Description of Artificial Sequence: Synthetic oligonucleotide
cctcgctgtggaattctgggtcactgtc

SEQ ID NO: 206465 - DNA, 30 bp, Artificial Sequence
  Description of Artificial Sequence: Synthetic oligonucleotide
ctcgctgtggaattctgggtcactgtcaag

SEQ ID NO: 206466 - DNA, 30 bp, Artificial Sequence
  Description of Artificial Sequence: Synthetic oligonucleotide
tcgctgtggaattctgggtcactgtcaagc

SEQ ID NO: 206467 - DNA, 29 bp, Artificial Sequence
  Description of Artificial Sequence: Synthetic oligonucleotide
cgctgtggaattctgggtcactgtcaagc

SEQ ID NO: 206468 - DNA, 29 bp, Artificial Sequence
  Description of Artificial Sequence: Synthetic oligonucleotide
gctgtggaattctgggtcactgtcaagcc

SEQ ID NO: 206469 - DNA, 29 bp, Artificial Sequence
  Description of Artificial Sequence: Synthetic oligonucleotide
ctgtggaattctgggtcactgtcaagccc

SEQ ID NO: 206470 - DNA, 29 bp, Artificial Sequence
  Description of Artificial Sequence: Synthetic oligonucleotide
tgtggaattctgggtcactgtcaagcccc

SEQ ID NO: 206471 - DNA, 28 bp, Artificial Sequence
  Description of Artificial Sequence: Synthetic oligonucleotide
gtggaattctgggtcactgtcaagcccc

SEQ ID NO: 206472 - DNA, 29 bp, Artificial Sequence
  Description of Artificial Sequence: Synthetic oligonucleotide
tggaattctgggtcactgtcaagccccag

SEQ ID NO: 206473 - DNA, 28 bp, Artificial Sequence
  Description of Artificial Sequence: Synthetic oligonucleotide
ggaattctgggtcactgtcaagccccag

SEQ ID NO: 206474 - DNA, 30 bp, Artificial Sequence
  Description of Artificial Sequence: Synthetic oligonucleotide
gaattctgggtcactgtcaagccccagatc

SEQ ID NO: 206475 - DNA, 35 bp, Artificial Sequence
  Description of Artificial Sequence: Synthetic oligonucleotide
aattctgggtcactgtcaagccccagatcattttc

SEQ ID NO: 206476 - DNA, 34 bp, Artificial Sequence
  Description of Artificial Sequence: Synthetic oligonucleotide
attctgggtcactgtcaagccccagatcattttc

SEQ ID NO: 206477 - DNA, 33 bp, Artificial Sequence
  Description of Artificial Sequence: Synthetic oligonucleotide
ttctgggtcactgtcaagccccagatcattttc

SEQ ID NO: 206478 - DNA, 32 bp, Artificial Sequence
  Description of Artificial Sequence: Synthetic oligonucleotide
tctgggtcactgtcaagccccagatcattttc

SEQ ID NO: 206479 - DNA, 31 bp, Artificial Sequence
  Description of Artificial Sequence: Synthetic oligonucleotide
ctgggtcactgtcaagccccagatcattttc

SEQ ID NO: 206480 - DNA, 32 bp, Artificial Sequence
  Description of Artificial Sequence: Synthetic oligonucleotide
tgggtcactgtcaagccccagatcattttctg

SEQ ID NO: 206481 - DNA, 31 bp, Artificial Sequence
  Description of Artificial Sequence: Synthetic oligonucleotide
gggtcactgtcaagccccagatcattttctg

SEQ ID NO: 206482 - DNA, 34 bp, Artificial Sequence
  Description of Artificial Sequence: Synthetic oligonucleotide
ggtcactgtcaagccccagatcattttctgtttg

SEQ ID NO: 206483 - DNA, 34 bp, Artificial Sequence
  Description of Artificial Sequence: Synthetic oligonucleotide
gtcactgtcaagccccagatcattttctgtttgc

SEQ ID NO: 206484 - DNA, 34 bp, Artificial Sequence
  Description of Artificial Sequence: Synthetic oligonucleotide
tcactgtcaagccccagatcattttctgtttgcc

SEQ ID NO: 206485 - DNA, 33 bp, Artificial Sequence
  Description of Artificial Sequence: Synthetic oligonucleotide
cactgtcaagccccagatcattttctgtttgcc

SEQ ID NO: 206486 - DNA, 35 bp, Artificial Sequence
  Description of Artificial Sequence: Synthetic oligonucleotide
actgtcaagccccagatcattttctgtttgccaag

SEQ ID NO: 206487 - DNA, 34 bp, Artificial Sequence
  Description of Artificial Sequence: Synthetic oligonucleotide
ctgtcaagccccagatcattttctgtttgccaag

SEQ ID NO: 206488 - DNA, 36 bp, Artificial Sequence
  Description of Artificial Sequence: Synthetic oligonucleotide
tgtcaagccccagatcattttctgtttgccaagttg

SEQ ID NO: 206489 - DNA, 35 bp, Artificial Sequence
  Description of Artificial Sequence: Synthetic oligonucleotide
gtcaagccccagatcattttctgtttgccaagttg

SEQ ID NO: 206490 - DNA, 39 bp, Artificial Sequence
  Description of Artificial Sequence: Synthetic oligonucleotide
tcaagccccagatcattttctgtttgccaagttgaaaac

SEQ ID NO: 206491 - DNA, 38 bp, Artificial Sequence
  Description of Artificial Sequence: Synthetic oligonucleotide
caagccccagatcattttctgtttgccaagttgaaaac

SEQ ID NO: 206492 - DNA, 38 bp, Artificial Sequence
  Description of Artificial Sequence: Synthetic oligonucleotide
aagccccagatcattttctgtttgccaagttgaaaacc

SEQ ID NO: 206493 - DNA, 37 bp, Artificial Sequence
  Description of Artificial Sequence: Synthetic oligonucleotide
agccccagatcattttctgtttgccaagttgaaaacc

SEQ ID NO: 206494 - DNA, 36 bp, Artificial Sequence
  Description of Artificial Sequence: Synthetic oligonucleotide
gccccagatcattttctgtttgccaagttgaaaacc

SEQ ID NO: 206495 - DNA, 36 bp, Artificial Sequence
  Description of Artificial Sequence: Synthetic oligonucleotide
ccccagatcattttctgtttgccaagttgaaaaccc

SEQ ID NO: 206496 - DNA, 39 bp, Artificial Sequence
  Description of Artificial Sequence: Synthetic oligonucleotide
cccagatcattttctgtttgccaagttgaaaacccaaac

SEQ ID NO: 206497 - DNA, 39 bp, Artificial Sequence
  Description of Artificial Sequence: Synthetic oligonucleotide
ccagatcattttctgtttgccaagttgaaaacccaaacc

SEQ ID NO: 206498 - DNA, 42 bp, Artificial Sequence
  Description of Artificial Sequence: Synthetic oligonucleotide
cagatcattttctgtttgccaagttgaaaacccaaaccaatg

SEQ ID NO: 206499 - DNA, 42 bp, Artificial Sequence
  Description of Artificial Sequence: Synthetic oligonucleotide
agatcattttctgtttgccaagttgaaaacccaaaccaatgc

SEQ ID NO: 206500 - DNA, 41 bp, Artificial Sequence
  Description of Artificial Sequence: Synthetic oligonucleotide
gatcattttctgtttgccaagttgaaaacccaaaccaatgc

SEQ ID NO: 206501 - DNA, 43 bp, Artificial Sequence
  Description of Artificial Sequence: Synthetic oligonucleotide
atcattttctgtttgccaagttgaaaacccaaaccaatgcatc

SEQ ID NO: 206502 - DNA, 42 bp, Artificial Sequence
  Description of Artificial Sequence: Synthetic oligonucleotide
tcattttctgtttgccaagttgaaaacccaaaccaatgcatc

SEQ ID NO: 206503 - DNA, 41 bp, Artificial Sequence
  Description of Artificial Sequence: Synthetic oligonucleotide
cattttctgtttgccaagttgaaaacccaaaccaatgcatc

SEQ ID NO: 206504 - DNA, 42 bp, Artificial Sequence
  Description of Artificial Sequence: Synthetic oligonucleotide
attttctgtttgccaagttgaaaacccaaaccaatgcatctg

SEQ ID NO: 206505 - DNA, 41 bp, Artificial Sequence
  Description of Artificial Sequence: Synthetic oligonucleotide
ttttctgtttgccaagttgaaaacccaaaccaatgcatctg

SEQ ID NO: 206506 - DNA, 40 bp, Artificial Sequence
  Description of Artificial Sequence: Synthetic oligonucleotide
tttctgtttgccaagttgaaaacccaaaccaatgcatctg

SEQ ID NO: 206507 - DNA, 39 bp, Artificial Sequence
  Description of Artificial Sequence: Synthetic oligonucleotide
ttctgtttgccaagttgaaaacccaaaccaatgcatctg

SEQ ID NO: 206508 - DNA, 38 bp, Artificial Sequence
  Description of Artificial Sequence: Synthetic oligonucleotide
tctgtttgccaagttgaaaacccaaaccaatgcatctg

SEQ ID NO: 206509 - DNA, 37 bp, Artificial Sequence
  Description of Artificial Sequence: Synthetic oligonucleotide
ctgtttgccaagttgaaaacccaaaccaatgcatctg

SEQ ID NO: 206510 - DNA, 38 bp, Artificial Sequence
  Description of Artificial Sequence: Synthetic oligonucleotide
tgtttgccaagttgaaaacccaaaccaatgcatctgac

SEQ ID NO: 206511 - DNA, 37 bp, Artificial Sequence
  Description of Artificial Sequence: Synthetic oligonucleotide
gtttgccaagttgaaaacccaaaccaatgcatctgac

SEQ ID NO: 206512 - DNA, 40 bp, Artificial Sequence
  Description of Artificial Sequence: Synthetic oligonucleotide
tttgccaagttgaaaacccaaaccaatgcatctgactttc

SEQ ID NO: 206513 - DNA, 39 bp, Artificial Sequence
  Description of Artificial Sequence: Synthetic oligonucleotide
ttgccaagttgaaaacccaaaccaatgcatctgactttc

SEQ ID NO: 206514 - DNA, 38 bp, Artificial Sequence
  Description of Artificial Sequence: Synthetic oligonucleotide
tgccaagttgaaaacccaaaccaatgcatctgactttc

SEQ ID NO: 206515 - DNA, 37 bp, Artificial Sequence
  Description of Artificial Sequence: Synthetic oligonucleotide
gccaagttgaaaacccaaaccaatgcatctgactttc

SEQ ID NO: 206516 - DNA, 37 bp, Artificial Sequence
  Description of Artificial Sequence: Synthetic oligonucleotide
ccaagttgaaaacccaaaccaatgcatctgactttcc

SEQ ID NO: 206517 - DNA, 37 bp, Artificial Sequence
  Description of Artificial Sequence: Synthetic oligonucleotide
caagttgaaaacccaaaccaatgcatctgactttccc

SEQ ID NO: 206518 - DNA, 40 bp, Artificial Sequence
  Description of Artificial Sequence: Synthetic oligonucleotide
aagttgaaaacccaaaccaatgcatctgactttcccattg

SEQ ID NO: 206519 - DNA, 39 bp, Artificial Sequence
  Description of Artificial Sequence: Synthetic oligonucleotide
agttgaaaacccaaaccaatgcatctgactttcccattg

SEQ ID NO: 206520 - DNA, 38 bp, Artificial Sequence
  Description of Artificial Sequence: Synthetic oligonucleotide
gttgaaaacccaaaccaatgcatctgactttcccattg

SEQ ID NO: 206521 - DNA, 38 bp, Artificial Sequence
  Description of Artificial Sequence: Synthetic oligonucleotide
ttgaaaacccaaaccaatgcatctgactttcccattgg

SEQ ID NO: 206522 - DNA, 37 bp, Artificial Sequence
  Description of Artificial Sequence: Synthetic oligonucleotide
tgaaaacccaaaccaatgcatctgactttcccattgg

SEQ ID NO: 206523 - DNA, 36 bp, Artificial Sequence
  Description of Artificial Sequence: Synthetic oligonucleotide
gaaaacccaaaccaatgcatctgactttcccattgg

SEQ ID NO: 206524 - DNA, 36 bp, Artificial Sequence
  Description of Artificial Sequence: Synthetic oligonucleotide
aaaacccaaaccaatgcatctgactttcccattggg

SEQ ID NO: 206525 - DNA, 35 bp, Artificial Sequence
  Description of Artificial Sequence: Synthetic oligonucleotide
aaacccaaaccaatgcatctgactttcccattggg

SEQ ID NO: 206526 - DNA, 34 bp, Artificial Sequence
  Description of Artificial Sequence: Synthetic oligonucleotide
aacccaaaccaatgcatctgactttcccattggg

SEQ ID NO: 206527 - DNA, 33 bp, Artificial Sequence
  Description of Artificial Sequence: Synthetic oligonucleotide
acccaaaccaatgcatctgactttcccattggg

SEQ ID NO: 206528 - DNA, 32 bp, Artificial Sequence
  Description of Artificial Sequence: Synthetic oligonucleotide
cccaaaccaatgcatctgactttcccattggg

SEQ ID NO: 206529 - DNA, 33 bp, Artificial Sequence
  Description of Artificial Sequence: Synthetic oligonucleotide
ccaaaccaatgcatctgactttcccattgggac

SEQ ID NO: 206530 - DNA, 35 bp, Artificial Sequence
  Description of Artificial Sequence: Synthetic oligonucleotide
caaaccaatgcatctgactttcccattgggacatc

SEQ ID NO: 206531 - DNA, 41 bp, Artificial Sequence
  Description of Artificial Sequence: Synthetic oligonucleotide
aaaccaatgcatctgactttcccattgggacatctttaaag

SEQ ID NO: 206532 - DNA, 40 bp, Artificial Sequence
  Description of Artificial Sequence: Synthetic oligonucleotide
aaccaatgcatctgactttcccattgggacatctttaaag

SEQ ID NO: 206533 - DNA, 39 bp, Artificial Sequence
  Description of Artificial Sequence: Synthetic oligonucleotide
accaatgcatctgactttcccattgggacatctttaaag

SEQ ID NO: 206534 - DNA, 38 bp, Artificial Sequence
  Description of Artificial Sequence: Synthetic oligonucleotide
ccaatgcatctgactttcccattgggacatctttaaag

SEQ ID NO: 206535 - DNA, 40 bp, Artificial Sequence
  Description of Artificial Sequence: Synthetic oligonucleotide
caatgcatctgactttcccattgggacatctttaaagtac

SEQ ID NO: 206536 - DNA, 40 bp, Artificial Sequence
  Description of Artificial Sequence: Synthetic oligonucleotide
aatgcatctgactttcccattgggacatctttaaagtacg

SEQ ID NO: 206537 - DNA, 39 bp, Artificial Sequence
  Description of Artificial Sequence: Synthetic oligonucleotide
atgcatctgactttcccattgggacatctttaaagtacg

SEQ ID NO: 206538 - DNA, 38 bp, Artificial Sequence
  Description of Artificial Sequence: Synthetic oligonucleotide
tgcatctgactttcccattgggacatctttaaagtacg

SEQ ID NO: 206539 - DNA, 37 bp, Artificial Sequence
  Description of Artificial Sequence: Synthetic oligonucleotide
gcatctgactttcccattgggacatctttaaagtacg

SEQ ID NO: 206540 - DNA, 40 bp, Artificial Sequence
  Description of Artificial Sequence: Synthetic oligonucleotide
catctgactttcccattgggacatctttaaagtacgaatg

SEQ ID NO: 206541 - DNA, 40 bp, Artificial Sequence
  Description of Artificial Sequence: Synthetic oligonucleotide
atctgactttcccattgggacatctttaaagtacgaatgc

SEQ ID NO: 206542 - DNA, 39 bp, Artificial Sequence
  Description of Artificial Sequence: Synthetic oligonucleotide
tctgactttcccattgggacatctttaaagtacgaatgc

SEQ ID NO: 206543 - DNA, 38 bp, Artificial Sequence
  Description of Artificial Sequence: Synthetic oligonucleotide
ctgactttcccattgggacatctttaaagtacgaatgc

SEQ ID NO: 206544 - DNA, 38 bp, Artificial Sequence
  Description of Artificial Sequence: Synthetic oligonucleotide
tgactttcccattgggacatctttaaagtacgaatgcc

SEQ ID NO: 206545 - DNA, 37 bp, Artificial Sequence
  Description of Artificial Sequence: Synthetic oligonucleotide
gactttcccattgggacatctttaaagtacgaatgcc

SEQ ID NO: 206546 - DNA, 37 bp, Artificial Sequence
  Description of Artificial Sequence: Synthetic oligonucleotide
actttcccattgggacatctttaaagtacgaatgccg

SEQ ID NO: 206547 - DNA, 36 bp, Artificial Sequence
  Description of Artificial Sequence: Synthetic oligonucleotide
ctttcccattgggacatctttaaagtacgaatgccg

SEQ ID NO: 206548 - DNA, 37 bp, Artificial Sequence
  Description of Artificial Sequence: Synthetic oligonucleotide
tttcccattgggacatctttaaagtacgaatgccgtc

SEQ ID NO: 206549 - DNA, 36 bp, Artificial Sequence
  Description of Artificial Sequence: Synthetic oligonucleotide
ttcccattgggacatctttaaagtacgaatgccgtc

SEQ ID NO: 206550 - DNA, 35 bp, Artificial Sequence
  Description of Artificial Sequence: Synthetic oligonucleotide
tcccattgggacatctttaaagtacgaatgccgtc

SEQ ID NO: 206551 - DNA, 34 bp, Artificial Sequence
  Description of Artificial Sequence: Synthetic oligonucleotide
cccattgggacatctttaaagtacgaatgccgtc

SEQ ID NO: 206552 - DNA, 34 bp, Artificial Sequence
  Description of Artificial Sequence: Synthetic oligonucleotide
ccattgggacatctttaaagtacgaatgccgtcc

SEQ ID NO: 206553 - DNA, 35 bp, Artificial Sequence
  Description of Artificial Sequence: Synthetic oligonucleotide
cattgggacatctttaaagtacgaatgccgtcctg

SEQ ID NO: 206554 - DNA, 36 bp, Artificial Sequence
  Description of Artificial Sequence: Synthetic oligonucleotide
attgggacatctttaaagtacgaatgccgtcctgag

SEQ ID NO: 206555 - DNA, 35 bp, Artificial Sequence
  Description of Artificial Sequence: Synthetic oligonucleotide
ttgggacatctttaaagtacgaatgccgtcctgag

SEQ ID NO: 206556 - DNA, 34 bp, Artificial Sequence
  Description of Artificial Sequence: Synthetic oligonucleotide
tgggacatctttaaagtacgaatgccgtcctgag

SEQ ID NO: 206557 - DNA, 33 bp, Artificial Sequence
  Description of Artificial Sequence: Synthetic oligonucleotide
gggacatctttaaagtacgaatgccgtcctgag

SEQ ID NO: 206558 - DNA, 35 bp, Artificial Sequence
  Description of Artificial Sequence: Synthetic oligonucleotide
ggacatctttaaagtacgaatgccgtcctgagtac

SEQ ID NO: 206559 - DNA, 37 bp, Artificial Sequence
  Description of Artificial Sequence: Synthetic oligonucleotide
gacatctttaaagtacgaatgccgtcctgagtactac

SEQ ID NO: 206560 - DNA, 37 bp, Artificial Sequence
  Description of Artificial Sequence: Synthetic oligonucleotide
acatctttaaagtacgaatgccgtcctgagtactacg

SEQ ID NO: 206561 - DNA, 36 bp, Artificial Sequence
  Description of Artificial Sequence: Synthetic oligonucleotide
catctttaaagtacgaatgccgtcctgagtactacg

SEQ ID NO: 206562 - DNA, 36 bp, Artificial Sequence
  Description of Artificial Sequence: Synthetic oligonucleotide
atctttaaagtacgaatgccgtcctgagtactacgg

SEQ ID NO: 206563 - DNA, 35 bp, Artificial Sequence
  Description of Artificial Sequence: Synthetic oligonucleotide
tctttaaagtacgaatgccgtcctgagtactacgg

SEQ ID NO: 206564 - DNA, 34 bp, Artificial Sequence
  Description of Artificial Sequence: Synthetic oligonucleotide
ctttaaagtacgaatgccgtcctgagtactacgg

SEQ ID NO: 206565 - DNA, 34 bp, Artificial Sequence
  Description of Artificial Sequence: Synthetic oligonucleotide
tttaaagtacgaatgccgtcctgagtactacggg

SEQ ID NO: 206566 - DNA, 33 bp, Artificial Sequence
  Description of Artificial Sequence: Synthetic oligonucleotide
ttaaagtacgaatgccgtcctgagtactacggg

SEQ ID NO: 206567 - DNA, 32 bp, Artificial Sequence
  Description of Artificial Sequence: Synthetic oligonucleotide
taaagtacgaatgccgtcctgagtactacggg

SEQ ID NO: 206568 - DNA, 31 bp, Artificial Sequence
  Description of Artificial Sequence: Synthetic oligonucleotide
aaagtacgaatgccgtcctgagtactacggg

SEQ ID NO: 206569 - DNA, 30 bp, Artificial Sequence
  Description of Artificial Sequence: Synthetic oligonucleotide
aagtacgaatgccgtcctgagtactacggg

SEQ ID NO: 206570 - DNA, 29 bp, Artificial Sequence
  Description of Artificial Sequence: Synthetic oligonucleotide
agtacgaatgccgtcctgagtactacggg

SEQ ID NO: 206571 - DNA, 28 bp, Artificial Sequence
  Description of Artificial Sequence: Synthetic oligonucleotide
gtacgaatgccgtcctgagtactacggg

SEQ ID NO: 206572 - DNA, 29 bp, Artificial Sequence
  Description of Artificial Sequence: Synthetic oligonucleotide
tacgaatgccgtcctgagtactacgggag

SEQ ID NO: 206573 - DNA, 28 bp, Artificial Sequence
  Description of Artificial Sequence: Synthetic oligonucleotide
acgaatgccgtcctgagtactacgggag

SEQ ID NO: 206574 - DNA, 27 bp, Artificial Sequence
  Description of Artificial Sequence: Synthetic oligonucleotide
cgaatgccgtcctgagtactacgggag

SEQ ID NO: 206575 - DNA, 27 bp, Artificial Sequence
  Description of Artificial Sequence: Synthetic oligonucleotide
gaatgccgtcctgagtactacgggagg

SEQ ID NO: 206576 - DNA, 27 bp, Artificial Sequence
  Description of Artificial Sequence: Synthetic oligonucleotide
aatgccgtcctgagtactacgggaggc

SEQ ID NO: 206577 - DNA, 26 bp, Artificial Sequence
  Description of Artificial Sequence: Synthetic oligonucleotide
atgccgtcctgagtactacgggaggc

SEQ ID NO: 206578 - DNA, 25 bp, Artificial Sequence
  Description of Artificial Sequence: Synthetic oligonucleotide
tgccgtcctgagtactacgggaggc

SEQ ID NO: 206579 - DNA, 24 bp, Artificial Sequence
  Description of Artificial Sequence: Synthetic oligonucleotide
gccgtcctgagtactacgggaggc

SEQ ID NO: 206580 - DNA, 27 bp, Artificial Sequence
  Description of Artificial Sequence: Synthetic oligonucleotide
ccgtcctgagtactacgggaggccatt

SEQ ID NO: 206581 - DNA, 27 bp, Artificial Sequence
  Description of Artificial Sequence: Synthetic oligonucleotide
cgtcctgagtactacgggaggccattc

SEQ ID NO: 206582 - DNA, 28 bp, Artificial Sequence
  Description of Artificial Sequence: Synthetic oligonucleotide
gtcctgagtactacgggaggccattctc

SEQ ID NO: 206583 - DNA, 31 bp, Artificial Sequence
  Description of Artificial Sequence: Synthetic oligonucleotide
tcctgagtactacgggaggccattctctatc

SEQ ID NO: 206584 - DNA, 30 bp, Artificial Sequence
  Description of Artificial Sequence: Synthetic oligonucleotide
cctgagtactacgggaggccattctctatc

SEQ ID NO: 206585 - DNA, 31 bp, Artificial Sequence
  Description of Artificial Sequence: Synthetic oligonucleotide
ctgagtactacgggaggccattctctatcac

SEQ ID NO: 206586 - DNA, 33 bp, Artificial Sequence
  Description of Artificial Sequence: Synthetic oligonucleotide
tgagtactacgggaggccattctctatcacatg

SEQ ID NO: 206587 - DNA, 32 bp, Artificial Sequence
  Description of Artificial Sequence: Synthetic oligonucleotide
gagtactacgggaggccattctctatcacatg

SEQ ID NO: 206588 - DNA, 33 bp, Artificial Sequence
  Description of Artificial Sequence: Synthetic oligonucleotide
agtactacgggaggccattctctatcacatgtc

SEQ ID NO: 206589 - DNA, 32 bp, Artificial Sequence
  Description of Artificial Sequence: Synthetic oligonucleotide
gtactacgggaggccattctctatcacatgtc

SEQ ID NO: 206590 - DNA, 34 bp, Artificial Sequence
  Description of Artificial Sequence: Synthetic oligonucleotide
tactacgggaggccattctctatcacatgtctag

SEQ ID NO: 206591 - DNA, 33 bp, Artificial Sequence
  Description of Artificial Sequence: Synthetic oligonucleotide
actacgggaggccattctctatcacatgtctag

SEQ ID NO: 206592 - DNA, 32 bp, Artificial Sequence
  Description of Artificial Sequence: Synthetic oligonucleotide
ctacgggaggccattctctatcacatgtctag

SEQ ID NO: 206593 - DNA, 36 bp, Artificial Sequence
  Description of Artificial Sequence: Synthetic oligonucleotide
tacgggaggccattctctatcacatgtctagataac

SEQ ID NO: 206594 - DNA, 35 bp, Artificial Sequence
  Description of Artificial Sequence: Synthetic oligonucleotide
acgggaggccattctctatcacatgtctagataac

SEQ ID NO: 206595 - DNA, 34 bp, Artificial Sequence
  Description of Artificial Sequence: Synthetic oligonucleotide
cgggaggccattctctatcacatgtctagataac

SEQ ID NO: 206596 - DNA, 34 bp, Artificial Sequence
  Description of Artificial Sequence: Synthetic oligonucleotide
gggaggccattctctatcacatgtctagataacc

SEQ ID NO: 206597 - DNA, 35 bp, Artificial Sequence
  Description of Artificial Sequence: Synthetic oligonucleotide
ggaggccattctctatcacatgtctagataacctg

SEQ ID NO: 206598 - DNA, 35 bp, Artificial Sequence
  Description of Artificial Sequence: Synthetic oligonucleotide
gaggccattctctatcacatgtctagataacctgg

SEQ ID NO: 206599 - DNA, 36 bp, Artificial Sequence
  Description of Artificial Sequence: Synthetic oligonucleotide
aggccattctctatcacatgtctagataacctggtc

SEQ ID NO: 206600 - DNA, 35 bp, Artificial Sequence
  Description of Artificial Sequence: Synthetic oligonucleotide
ggccattctctatcacatgtctagataacctggtc

SEQ ID NO: 206601 - DNA, 36 bp, Artificial Sequence
  Description of Artificial Sequence: Synthetic oligonucleotide
gccattctctatcacatgtctagataacctggtctg

SEQ ID NO: 206602 - DNA, 36 bp, Artificial Sequence
  Description of Artificial Sequence: Synthetic oligonucleotide
ccattctctatcacatgtctagataacctggtctgg

SEQ ID NO: 206603 - DNA, 37 bp, Artificial Sequence
  Description of Artificial Sequence: Synthetic oligonucleotide
cattctctatcacatgtctagataacctggtctggtc

SEQ ID NO: 206604 - DNA, 39 bp, Artificial Sequence
  Description of Artificial Sequence: Synthetic oligonucleotide
attctctatcacatgtctagataacctggtctggtcaag

SEQ ID NO: 206605 - DNA, 38 bp, Artificial Sequence
  Description of Artificial Sequence: Synthetic oligonucleotide
ttctctatcacatgtctagataacctggtctggtcaag

SEQ ID NO: 206606 - DNA, 37 bp, Artificial Sequence
  Description of Artificial Sequence: Synthetic oligonucleotide
tctctatcacatgtctagataacctggtctggtcaag

SEQ ID NO: 206607 - DNA, 36 bp, Artificial Sequence
  Description of Artificial Sequence: Synthetic oligonucleotide
ctctatcacatgtctagataacctggtctggtcaag

SEQ ID NO: 206608 - DNA, 37 bp, Artificial Sequence
  Description of Artificial Sequence: Synthetic oligonucleotide
tctatcacatgtctagataacctggtctggtcaagtc

SEQ ID NO: 206609 - DNA, 36 bp, Artificial Sequence
  Description of Artificial Sequence: Synthetic oligonucleotide
ctatcacatgtctagataacctggtctggtcaagtc

SEQ ID NO: 206610 - DNA, 36 bp, Artificial Sequence
  Description of Artificial Sequence: Synthetic oligonucleotide
tatcacatgtctagataacctggtctggtcaagtcc

SEQ ID NO: 206611 - DNA, 35 bp, Artificial Sequence
  Description of Artificial Sequence: Synthetic oligonucleotide
atcacatgtctagataacctggtctggtcaagtcc

SEQ ID NO: 206612 - DNA, 34 bp, Artificial Sequence
  Description of Artificial Sequence: Synthetic oligonucleotide
tcacatgtctagataacctggtctggtcaagtcc

SEQ ID NO: 206613 - DNA, 33 bp, Artificial Sequence
  Description of Artificial Sequence: Synthetic oligonucleotide
cacatgtctagataacctggtctggtcaagtcc

SEQ ID NO: 206614 - DNA, 33 bp, Artificial Sequence
  Description of Artificial Sequence: Synthetic oligonucleotide
acatgtctagataacctggtctggtcaagtccc

SEQ ID NO: 206615 - DNA, 32 bp, Artificial Sequence
  Description of Artificial Sequence: Synthetic oligonucleotide
catgtctagataacctggtctggtcaagtccc

SEQ ID NO: 206616 - DNA, 35 bp, Artificial Sequence
  Description of Artificial Sequence: Synthetic oligonucleotide
atgtctagataacctggtctggtcaagtcccaaag

SEQ ID NO: 206617 - DNA, 34 bp, Artificial Sequence
  Description of Artificial Sequence: Synthetic oligonucleotide
tgtctagataacctggtctggtcaagtcccaaag

SEQ ID NO: 206618 - DNA, 33 bp, Artificial Sequence
  Description of Artificial Sequence: Synthetic oligonucleotide
gtctagataacctggtctggtcaagtcccaaag

SEQ ID NO: 206619 - DNA, 35 bp, Artificial Sequence
  Description of Artificial Sequence: Synthetic oligonucleotide
tctagataacctggtctggtcaagtcccaaagatg

SEQ ID NO: 206620 - DNA, 34 bp, Artificial Sequence
  Description of Artificial Sequence: Synthetic oligonucleotide
ctagataacctggtctggtcaagtcccaaagatg

SEQ ID NO: 206621 - DNA, 35 bp, Artificial Sequence
  Description of Artificial Sequence: Synthetic oligonucleotide
tagataacctggtctggtcaagtcccaaagatgtc

SEQ ID NO: 206622 - DNA, 34 bp, Artificial Sequence
  Description of Artificial Sequence: Synthetic oligonucleotide
agataacctggtctggtcaagtcccaaagatgtc

SEQ ID NO: 206623 - DNA, 33 bp, Artificial Sequence
  Description of Artificial Sequence: Synthetic oligonucleotide
gataacctggtctggtcaagtcccaaagatgtc

SEQ ID NO: 206624 - DNA, 34 bp, Artificial Sequence
  Description of Artificial Sequence: Synthetic oligonucleotide
ataacctggtctggtcaagtcccaaagatgtctg

SEQ ID NO: 206625 - DNA, 33 bp, Artificial Sequence
  Description of Artificial Sequence: Synthetic oligonucleotide
taacctggtctggtcaagtcccaaagatgtctg

SEQ ID NO: 206626 - DNA, 32 bp, Artificial Sequence
  Description of Artificial Sequence: Synthetic oligonucleotide
aacctggtctggtcaagtcccaaagatgtctg

SEQ ID NO: 206627 - DNA, 31 bp, Artificial Sequence
  Description of Artificial Sequence: Synthetic oligonucleotide
acctggtctggtcaagtcccaaagatgtctg

SEQ ID NO: 206628 - DNA, 30 bp, Artificial Sequence
  Description of Artificial Sequence: Synthetic oligonucleotide
cctggtctggtcaagtcccaaagatgtctg

SEQ ID NO: 206629 - DNA, 34 bp, Artificial Sequence
  Description of Artificial Sequence: Synthetic oligonucleotide
ctggtctggtcaagtcccaaagatgtctgtaaac

SEQ ID NO: 206630 - DNA, 34 bp, Artificial Sequence
  Description of Artificial Sequence: Synthetic oligonucleotide
tggtctggtcaagtcccaaagatgtctgtaaacg

SEQ ID NO: 206631 - DNA, 33 bp, Artificial Sequence
  Description of Artificial Sequence: Synthetic oligonucleotide
ggtctggtcaagtcccaaagatgtctgtaaacg

SEQ ID NO: 206632 - DNA, 38 bp, Artificial Sequence
  Description of Artificial Sequence: Synthetic oligonucleotide
gtctggtcaagtcccaaagatgtctgtaaacgtaaatc

SEQ ID NO: 206633 - DNA, 40 bp, Artificial Sequence
  Description of Artificial Sequence: Synthetic oligonucleotide
tctggtcaagtcccaaagatgtctgtaaacgtaaatcatg

SEQ ID NO: 206634 - DNA, 39 bp, Artificial Sequence
  Description of Artificial Sequence: Synthetic oligonucleotide
ctggtcaagtcccaaagatgtctgtaaacgtaaatcatg

SEQ ID NO: 206635 - DNA, 44 bp, Artificial Sequence
  Description of Artificial Sequence: Synthetic oligonucleotide
tggtcaagtcccaaagatgtctgtaaacgtaaatcatgtaaaac

SEQ ID NO: 206636 - DNA, 43 bp, Artificial Sequence
  Description of Artificial Sequence: Synthetic oligonucleotide
ggtcaagtcccaaagatgtctgtaaacgtaaatcatgtaaaac

SEQ ID NO: 206637 - DNA, 44 bp, Artificial Sequence
  Description of Artificial Sequence: Synthetic oligonucleotide
gtcaagtcccaaagatgtctgtaaacgtaaatcatgtaaaactc

SEQ ID NO: 206638 - DNA, 44 bp, Artificial Sequence
  Description of Artificial Sequence: Synthetic oligonucleotide
tcaagtcccaaagatgtctgtaaacgtaaatcatgtaaaactcc

SEQ ID NO: 206639 - DNA, 43 bp, Artificial Sequence
  Description of Artificial Sequence: Synthetic oligonucleotide
caagtcccaaagatgtctgtaaacgtaaatcatgtaaaactcc

SEQ ID NO: 206640 - DNA, 44 bp, Artificial Sequence
  Description of Artificial Sequence: Synthetic oligonucleotide
aagtcccaaagatgtctgtaaacgtaaatcatgtaaaactcctc

SEQ ID NO: 206641 - DNA, 43 bp, Artificial Sequence
  Description of Artificial Sequence: Synthetic oligonucleotide
agtcccaaagatgtctgtaaacgtaaatcatgtaaaactcctc

SEQ ID NO: 206642 - DNA, 42 bp, Artificial Sequence
  Description of Artificial Sequence: Synthetic oligonucleotide
gtcccaaagatgtctgtaaacgtaaatcatgtaaaactcctc

SEQ ID NO: 206643 - DNA, 42 bp, Artificial Sequence
  Description of Artificial Sequence: Synthetic oligonucleotide
tcccaaagatgtctgtaaacgtaaatcatgtaaaactcctcc

SEQ ID NO: 206644 - DNA, 41 bp, Artificial Sequence
  Description of Artificial Sequence: Synthetic oligonucleotide
cccaaagatgtctgtaaacgtaaatcatgtaaaactcctcc

SEQ ID NO: 206645 - DNA, 42 bp, Artificial Sequence
  Description of Artificial Sequence: Synthetic oligonucleotide
ccaaagatgtctgtaaacgtaaatcatgtaaaactcctccag

SEQ ID NO: 206646 - DNA, 44 bp, Artificial Sequence
  Description of Artificial Sequence: Synthetic oligonucleotide
caaagatgtctgtaaacgtaaatcatgtaaaactcctccagatc

SEQ ID NO: 206647 - DNA, 44 bp, Artificial Sequence
  Description of Artificial Sequence: Synthetic oligonucleotide
aaagatgtctgtaaacgtaaatcatgtaaaactcctccagatcc

SEQ ID NO: 206648 - DNA, 43 bp, Artificial Sequence
  Description of Artificial Sequence: Synthetic oligonucleotide
aagatgtctgtaaacgtaaatcatgtaaaactcctccagatcc

SEQ ID NO: 206649 - DNA, 42 bp, Artificial Sequence
  Description of Artificial Sequence: Synthetic oligonucleotide
agatgtctgtaaacgtaaatcatgtaaaactcctccagatcc

SEQ ID NO: 206650 - DNA, 41 bp, Artificial Sequence
  Description of Artificial Sequence: Synthetic oligonucleotide
gatgtctgtaaacgtaaatcatgtaaaactcctccagatcc

SEQ ID NO: 206651 - DNA, 42 bp, Artificial Sequence
  Description of Artificial Sequence: Synthetic oligonucleotide
atgtctgtaaacgtaaatcatgtaaaactcctccagatccag

SEQ ID NO: 206652 - DNA, 41 bp, Artificial Sequence
  Description of Artificial Sequence: Synthetic oligonucleotide
tgtctgtaaacgtaaatcatgtaaaactcctccagatccag

SEQ ID NO: 206653 - DNA, 40 bp, Artificial Sequence
  Description of Artificial Sequence: Synthetic oligonucleotide
gtctgtaaacgtaaatcatgtaaaactcctccagatccag

SEQ ID NO: 206654 - DNA, 41 bp, Artificial Sequence
  Description of Artificial Sequence: Synthetic oligonucleotide
tctgtaaacgtaaatcatgtaaaactcctccagatccagtg

SEQ ID NO: 206655 - DNA, 40 bp, Artificial Sequence
  Description of Artificial Sequence: Synthetic oligonucleotide
ctgtaaacgtaaatcatgtaaaactcctccagatccagtg

SEQ ID NO: 206656 - DNA, 43 bp, Artificial Sequence
  Description of Artificial Sequence: Synthetic oligonucleotide
tgtaaacgtaaatcatgtaaaactcctccagatccagtgaatg

SEQ ID NO: 206657 - DNA, 42 bp, Artificial Sequence
  Description of Artificial Sequence: Synthetic oligonucleotide
gtaaacgtaaatcatgtaaaactcctccagatccagtgaatg

SEQ ID NO: 206658 - DNA, 42 bp, Artificial Sequence
  Description of Artificial Sequence: Synthetic oligonucleotide
taaacgtaaatcatgtaaaactcctccagatccagtgaatgg

SEQ ID NO: 206659 - DNA, 41 bp, Artificial Sequence
  Description of Artificial Sequence: Synthetic oligonucleotide
aaacgtaaatcatgtaaaactcctccagatccagtgaatgg

SEQ ID NO: 206660 - DNA, 40 bp, Artificial Sequence
  Description of Artificial Sequence: Synthetic oligonucleotide
aacgtaaatcatgtaaaactcctccagatccagtgaatgg

SEQ ID NO: 206661 - DNA, 39 bp, Artificial Sequence
  Description of Artificial Sequence: Synthetic oligonucleotide
acgtaaatcatgtaaaactcctccagatccagtgaatgg

SEQ ID NO: 206662 - DNA, 38 bp, Artificial Sequence
  Description of Artificial Sequence: Synthetic oligonucleotide
cgtaaatcatgtaaaactcctccagatccagtgaatgg

SEQ ID NO: 206663 - DNA, 38 bp, Artificial Sequence
  Description of Artificial Sequence: Synthetic oligonucleotide
gtaaatcatgtaaaactcctccagatccagtgaatggc

SEQ ID NO: 206664 - DNA, 40 bp, Artificial Sequence
  Description of Artificial Sequence: Synthetic oligonucleotide
taaatcatgtaaaactcctccagatccagtgaatggcatg

SEQ ID NO: 206665 - DNA, 39 bp, Artificial Sequence
  Description of Artificial Sequence: Synthetic oligonucleotide
aaatcatgtaaaactcctccagatccagtgaatggcatg

SEQ ID NO: 206666 - DNA, 38 bp, Artificial Sequence
  Description of Artificial Sequence: Synthetic oligonucleotide
aatcatgtaaaactcctccagatccagtgaatggcatg

SEQ ID NO: 206667 - DNA, 37 bp, Artificial Sequence
  Description of Artificial Sequence: Synthetic oligonucleotide
atcatgtaaaactcctccagatccagtgaatggcatg

SEQ ID NO: 206668 - DNA, 36 bp, Artificial Sequence
  Description of Artificial Sequence: Synthetic oligonucleotide
tcatgtaaaactcctccagatccagtgaatggcatg

SEQ ID NO: 206669 - DNA, 35 bp, Artificial Sequence
  Description of Artificial Sequence: Synthetic oligonucleotide
catgtaaaactcctccagatccagtgaatggcatg

SEQ ID NO: 206670 - DNA, 35 bp, Artificial Sequence
  Description of Artificial Sequence: Synthetic oligonucleotide
atgtaaaactcctccagatccagtgaatggcatgg

SEQ ID NO: 206671 - DNA, 34 bp, Artificial Sequence
  Description of Artificial Sequence: Synthetic oligonucleotide
tgtaaaactcctccagatccagtgaatggcatgg

SEQ ID NO: 206672 - DNA, 33 bp, Artificial Sequence
  Description of Artificial Sequence: Synthetic oligonucleotide
gtaaaactcctccagatccagtgaatggcatgg

SEQ ID NO: 206673 - DNA, 34 bp, Artificial Sequence
  Description of Artificial Sequence: Synthetic oligonucleotide
taaaactcctccagatccagtgaatggcatggtg

SEQ ID NO: 206674 - DNA, 33 bp, Artificial Sequence
  Description of Artificial Sequence: Synthetic oligonucleotide
aaaactcctccagatccagtgaatggcatggtg

SEQ ID NO: 206675 - DNA, 32 bp, Artificial Sequence
  Description of Artificial Sequence: Synthetic oligonucleotide
aaactcctccagatccagtgaatggcatggtg

SEQ ID NO: 206676 - DNA, 31 bp, Artificial Sequence
  Description of Artificial Sequence: Synthetic oligonucleotide
aactcctccagatccagtgaatggcatggtg

SEQ ID NO: 206677 - DNA, 30 bp, Artificial Sequence
  Description of Artificial Sequence: Synthetic oligonucleotide
actcctccagatccagtgaatggcatggtg

SEQ ID NO: 206678 - DNA, 29 bp, Artificial Sequence
  Description of Artificial Sequence: Synthetic oligonucleotide
ctcctccagatccagtgaatggcatggtg

SEQ ID NO: 206679 - DNA, 29 bp, Artificial Sequence
  Description of Artificial Sequence: Synthetic oligonucleotide
tcctccagatccagtgaatggcatggtgc

SEQ ID NO: 206680 - DNA, 28 bp, Artificial Sequence
  Description of Artificial Sequence: Synthetic oligonucleotide
cctccagatccagtgaatggcatggtgc

SEQ ID NO: 206681 - DNA, 30 bp, Artificial Sequence
  Description of Artificial Sequence: Synthetic oligonucleotide
ctccagatccagtgaatggcatggtgcatg

SEQ ID NO: 206682 - DNA, 31 bp, Artificial Sequence
  Description of Artificial Sequence: Synthetic oligonucleotide
tccagatccagtgaatggcatggtgcatgtg

SEQ ID NO: 206683 - DNA, 30 bp, Artificial Sequence
  Description of Artificial Sequence: Synthetic oligonucleotide
ccagatccagtgaatggcatggtgcatgtg

SEQ ID NO: 206684 - DNA, 32 bp, Artificial Sequence
  Description of Artificial Sequence: Synthetic oligonucleotide
cagatccagtgaatggcatggtgcatgtgatc

SEQ ID NO: 206685 - DNA, 33 bp, Artificial Sequence
  Description of Artificial Sequence: Synthetic oligonucleotide
agatccagtgaatggcatggtgcatgtgatcac

SEQ ID NO: 206686 - DNA, 32 bp, Artificial Sequence
  Description of Artificial Sequence: Synthetic oligonucleotide
gatccagtgaatggcatggtgcatgtgatcac

SEQ ID NO: 206687 - DNA, 33 bp, Artificial Sequence
  Description of Artificial Sequence: Synthetic oligonucleotide
atccagtgaatggcatggtgcatgtgatcacag

SEQ ID NO: 206688 - DNA, 32 bp, Artificial Sequence
  Description of Artificial Sequence: Synthetic oligonucleotide
tccagtgaatggcatggtgcatgtgatcacag

SEQ ID NO: 206689 - DNA, 31 bp, Artificial Sequence
  Description of Artificial Sequence: Synthetic oligonucleotide
ccagtgaatggcatggtgcatgtgatcacag

SEQ ID NO: 206690 - DNA, 32 bp, Artificial Sequence
  Description of Artificial Sequence: Synthetic oligonucleotide
cagtgaatggcatggtgcatgtgatcacagac

SEQ ID NO: 206691 - DNA, 34 bp, Artificial Sequence
  Description of Artificial Sequence: Synthetic oligonucleotide
agtgaatggcatggtgcatgtgatcacagacatc

SEQ ID NO: 206692 - DNA, 33 bp, Artificial Sequence
  Description of Artificial Sequence: Synthetic oligonucleotide
gtgaatggcatggtgcatgtgatcacagacatc

SEQ ID NO: 206693 - DNA, 33 bp, Artificial Sequence
  Description of Artificial Sequence: Synthetic oligonucleotide
tgaatggcatggtgcatgtgatcacagacatcc

SEQ ID NO: 206694 - DNA, 32 bp, Artificial Sequence
  Description of Artificial Sequence: Synthetic oligonucleotide
gaatggcatggtgcatgtgatcacagacatcc

SEQ ID NO: 206695 - DNA, 33 bp, Artificial Sequence
  Description of Artificial Sequence: Synthetic oligonucleotide
aatggcatggtgcatgtgatcacagacatccag

SEQ ID NO: 206696 - DNA, 32 bp, Artificial Sequence
  Description of Artificial Sequence: Synthetic oligonucleotide
atggcatggtgcatgtgatcacagacatccag

SEQ ID NO: 206697 - DNA, 31 bp, Artificial Sequence
  Description of Artificial Sequence: Synthetic oligonucleotide
tggcatggtgcatgtgatcacagacatccag

SEQ ID NO: 206698 - DNA, 30 bp, Artificial Sequence
  Description of Artificial Sequence: Synthetic oligonucleotide
ggcatggtgcatgtgatcacagacatccag

SEQ ID NO: 206699 - DNA, 30 bp, Artificial Sequence
  Description of Artificial Sequence: Synthetic oligonucleotide
gcatggtgcatgtgatcacagacatccagg

SEQ ID NO: 206700 - DNA, 32 bp, Artificial Sequence
  Description of Artificial Sequence: Synthetic oligonucleotide
catggtgcatgtgatcacagacatccaggttg

SEQ ID NO: 206701 - DNA, 32 bp, Artificial Sequence
  Description of Artificial Sequence: Synthetic oligonucleotide
atggtgcatgtgatcacagacatccaggttgg

SEQ ID NO: 206702 - DNA, 31 bp, Artificial Sequence
  Description of Artificial Sequence: Synthetic oligonucleotide
tggtgcatgtgatcacagacatccaggttgg

SEQ ID NO: 206703 - DNA, 30 bp, Artificial Sequence
  Description of Artificial Sequence: Synthetic oligonucleotide
ggtgcatgtgatcacagacatccaggttgg

SEQ ID NO: 206704 - DNA, 32 bp, Artificial Sequence
  Description of Artificial Sequence: Synthetic oligonucleotide
gtgcatgtgatcacagacatccaggttggatc

SEQ ID NO: 206705 - DNA, 32 bp, Artificial Sequence
  Description of Artificial Sequence: Synthetic oligonucleotide
tgcatgtgatcacagacatccaggttggatcc

SEQ ID NO: 206706 - DNA, 31 bp, Artificial Sequence
  Description of Artificial Sequence: Synthetic oligonucleotide
gcatgtgatcacagacatccaggttggatcc

SEQ ID NO: 206707 - DNA, 32 bp, Artificial Sequence
  Description of Artificial Sequence: Synthetic oligonucleotide
catgtgatcacagacatccaggttggatccag

SEQ ID NO: 206708 - DNA, 35 bp, Artificial Sequence
  Description of Artificial Sequence: Synthetic oligonucleotide
atgtgatcacagacatccaggttggatccagaatc

SEQ ID NO: 206709 - DNA, 34 bp, Artificial Sequence
  Description of Artificial Sequence: Synthetic oligonucleotide
tgtgatcacagacatccaggttggatccagaatc

SEQ ID NO: 206710 - DNA, 33 bp, Artificial Sequence
  Description of Artificial Sequence: Synthetic oligonucleotide
gtgatcacagacatccaggttggatccagaatc

SEQ ID NO: 206711 - DNA, 35 bp, Artificial Sequence
  Description of Artificial Sequence: Synthetic oligonucleotide
tgatcacagacatccaggttggatccagaatcaac

SEQ ID NO: 206712 - DNA, 34 bp, Artificial Sequence
  Description of Artificial Sequence: Synthetic oligonucleotide
gatcacagacatccaggttggatccagaatcaac

SEQ ID NO: 206713 - DNA, 38 bp, Artificial Sequence
  Description of Artificial Sequence: Synthetic oligonucleotide
atcacagacatccaggttggatccagaatcaactattc

SEQ ID NO: 206714 - DNA, 37 bp, Artificial Sequence
  Description of Artificial Sequence: Synthetic oligonucleotide
tcacagacatccaggttggatccagaatcaactattc

SEQ ID NO: 206715 - DNA, 36 bp, Artificial Sequence
  Description of Artificial Sequence: Synthetic oligonucleotide
cacagacatccaggttggatccagaatcaactattc

SEQ ID NO: 206716 - DNA, 38 bp, Artificial Sequence
  Description of Artificial Sequence: Synthetic oligonucleotide
acagacatccaggttggatccagaatcaactattcttg

SEQ ID NO: 206717 - DNA, 37 bp, Artificial Sequence
  Description of Artificial Sequence: Synthetic oligonucleotide
cagacatccaggttggatccagaatcaactattcttg

SEQ ID NO: 206718 - DNA, 39 bp, Artificial Sequence
  Description of Artificial Sequence: Synthetic oligonucleotide
agacatccaggttggatccagaatcaactattcttgtac

SEQ ID NO: 206719 - DNA, 38 bp, Artificial Sequence
  Description of Artificial Sequence: Synthetic oligonucleotide
gacatccaggttggatccagaatcaactattcttgtac

SEQ ID NO: 206720 - DNA, 40 bp, Artificial Sequence
  Description of Artificial Sequence: Synthetic oligonucleotide
acatccaggttggatccagaatcaactattcttgtactac

SEQ ID NO: 206721 - DNA, 39 bp, Artificial Sequence
  Description of Artificial Sequence: Synthetic oligonucleotide
catccaggttggatccagaatcaactattcttgtactac

SEQ ID NO: 206722 - DNA, 40 bp, Artificial Sequence
  Description of Artificial Sequence: Synthetic oligonucleotide
atccaggttggatccagaatcaactattcttgtactacag

SEQ ID NO: 206723 - DNA, 39 bp, Artificial Sequence
  Description of Artificial Sequence: Synthetic oligonucleotide
tccaggttggatccagaatcaactattcttgtactacag

SEQ ID NO: 206724 - DNA, 38 bp, Artificial Sequence
  Description of Artificial Sequence: Synthetic oligonucleotide
ccaggttggatccagaatcaactattcttgtactacag

SEQ ID NO: 206725 - DNA, 38 bp, Artificial Sequence
  Description of Artificial Sequence: Synthetic oligonucleotide
caggttggatccagaatcaactattcttgtactacagg

SEQ ID NO: 206726 - DNA, 38 bp, Artificial Sequence
  Description of Artificial Sequence: Synthetic oligonucleotide
aggttggatccagaatcaactattcttgtactacaggg

SEQ ID NO: 206727 - DNA, 37 bp, Artificial Sequence
  Description of Artificial Sequence: Synthetic oligonucleotide
ggttggatccagaatcaactattcttgtactacaggg

SEQ ID NO: 206728 - DNA, 37 bp, Artificial Sequence
  Description of Artificial Sequence: Synthetic oligonucleotide
gttggatccagaatcaactattcttgtactacagggc

SEQ ID NO: 206729 - DNA, 38 bp, Artificial Sequence
  Description of Artificial Sequence: Synthetic oligonucleotide
ttggatccagaatcaactattcttgtactacagggcac

SEQ ID NO: 206730 - DNA, 37 bp, Artificial Sequence
  Description of Artificial Sequence: Synthetic oligonucleotide
tggatccagaatcaactattcttgtactacagggcac

SEQ ID NO: 206731 - DNA, 36 bp, Artificial Sequence
  Description of Artificial Sequence: Synthetic oligonucleotide
ggatccagaatcaactattcttgtactacagggcac

SEQ ID NO: 206732 - DNA, 36 bp, Artificial Sequence
  Description of Artificial Sequence: Synthetic oligonucleotide
gatccagaatcaactattcttgtactacagggcacc

SEQ ID NO: 206733 - DNA, 36 bp, Artificial Sequence
  Description of Artificial Sequence: Synthetic oligonucleotide
atccagaatcaactattcttgtactacagggcaccg

SEQ ID NO: 206734 - DNA, 35 bp, Artificial Sequence
  Description of Artificial Sequence: Synthetic oligonucleotide
tccagaatcaactattcttgtactacagggcaccg

SEQ ID NO: 206735 - DNA, 34 bp, Artificial Sequence
  Description of Artificial Sequence: Synthetic oligonucleotide
ccagaatcaactattcttgtactacagggcaccg

SEQ ID NO: 206736 - DNA, 35 bp, Artificial Sequence
  Description of Artificial Sequence: Synthetic oligonucleotide
cagaatcaactattcttgtactacagggcaccgac

SEQ ID NO: 206737 - DNA, 36 bp, Artificial Sequence
  Description of Artificial Sequence: Synthetic oligonucleotide
agaatcaactattcttgtactacagggcaccgactc

SEQ ID NO: 206738 - DNA, 35 bp, Artificial Sequence
  Description of Artificial Sequence: Synthetic oligonucleotide
gaatcaactattcttgtactacagggcaccgactc

SEQ ID NO: 206739 - DNA, 38 bp, Artificial Sequence
  Description of Artificial Sequence: Synthetic oligonucleotide
aatcaactattcttgtactacagggcaccgactcattg

SEQ ID NO: 206740 - DNA, 37 bp, Artificial Sequence
  Description of Artificial Sequence: Synthetic oligonucleotide
atcaactattcttgtactacagggcaccgactcattg

SEQ ID NO: 206741 - DNA, 36 bp, Artificial Sequence
  Description of Artificial Sequence: Synthetic oligonucleotide
tcaactattcttgtactacagggcaccgactcattg

SEQ ID NO: 206742 - DNA, 35 bp, Artificial Sequence
  Description of Artificial Sequence: Synthetic oligonucleotide
caactattcttgtactacagggcaccgactcattg

SEQ ID NO: 206743 - DNA, 35 bp, Artificial Sequence
  Description of Artificial Sequence: Synthetic oligonucleotide
aactattcttgtactacagggcaccgactcattgg

SEQ ID NO: 206744 - DNA, 34 bp, Artificial Sequence
  Description of Artificial Sequence: Synthetic oligonucleotide
actattcttgtactacagggcaccgactcattgg

SEQ ID NO: 206745 - DNA, 33 bp, Artificial Sequence
  Description of Artificial Sequence: Synthetic oligonucleotide
ctattcttgtactacagggcaccgactcattgg

SEQ ID NO: 206746 - DNA, 34 bp, Artificial Sequence
  Description of Artificial Sequence: Synthetic oligonucleotide
tattcttgtactacagggcaccgactcattggtc

SEQ ID NO: 206747 - DNA, 33 bp, Artificial Sequence
  Description of Artificial Sequence: Synthetic oligonucleotide
attcttgtactacagggcaccgactcattggtc

SEQ ID NO: 206748 - DNA, 32 bp, Artificial Sequence
  Description of Artificial Sequence: Synthetic oligonucleotide
ttcttgtactacagggcaccgactcattggtc

SEQ ID NO: 206749 - DNA, 31 bp, Artificial Sequence
  Description of Artificial Sequence: Synthetic oligonucleotide
tcttgtactacagggcaccgactcattggtc

SEQ ID NO: 206750 - DNA, 30 bp, Artificial Sequence
  Description of Artificial Sequence: Synthetic oligonucleotide
cttgtactacagggcaccgactcattggtc

SEQ ID NO: 206751 - DNA, 31 bp, Artificial Sequence
  Description of Artificial Sequence: Synthetic oligonucleotide
ttgtactacagggcaccgactcattggtcac

SEQ ID NO: 206752 - DNA, 30 bp, Artificial Sequence
  Description of Artificial Sequence: Synthetic oligonucleotide
tgtactacagggcaccgactcattggtcac

SEQ ID NO: 206753 - DNA, 29 bp, Artificial Sequence
  Description of Artificial Sequence: Synthetic oligonucleotide
gtactacagggcaccgactcattggtcac

SEQ ID NO: 206754 - DNA, 30 bp, Artificial Sequence
  Description of Artificial Sequence: Synthetic oligonucleotide
tactacagggcaccgactcattggtcactc

SEQ ID NO: 206755 - DNA, 29 bp, Artificial Sequence
  Description of Artificial Sequence: Synthetic oligonucleotide
actacagggcaccgactcattggtcactc

SEQ ID NO: 206756 - DNA, 28 bp, Artificial Sequence
  Description of Artificial Sequence: Synthetic oligonucleotide
ctacagggcaccgactcattggtcactc

SEQ ID NO: 206757 - DNA, 30 bp, Artificial Sequence
  Description of Artificial Sequence: Synthetic oligonucleotide
tacagggcaccgactcattggtcactcatc

SEQ ID NO: 206758 - DNA, 29 bp, Artificial Sequence
  Description of Artificial Sequence: Synthetic oligonucleotide
acagggcaccgactcattggtcactcatc

SEQ ID NO: 206759 - DNA, 28 bp, Artificial Sequence
  Description of Artificial Sequence: Synthetic oligonucleotide
cagggcaccgactcattggtcactcatc

SEQ ID NO: 206760 - DNA, 29 bp, Artificial Sequence
  Description of Artificial Sequence: Synthetic oligonucleotide
agggcaccgactcattggtcactcatctg

SEQ ID NO: 206761 - DNA, 28 bp, Artificial Sequence
  Description of Artificial Sequence: Synthetic oligonucleotide
gggcaccgactcattggtcactcatctg

SEQ ID NO: 206762 - DNA, 28 bp, Artificial Sequence
  Description of Artificial Sequence: Synthetic oligonucleotide
ggcaccgactcattggtcactcatctgc

SEQ ID NO: 206763 - DNA, 29 bp, Artificial Sequence
  Description of Artificial Sequence: Synthetic oligonucleotide
gcaccgactcattggtcactcatctgctg

SEQ ID NO: 206764 - DNA, 32 bp, Artificial Sequence
  Description of Artificial Sequence: Synthetic oligonucleotide
caccgactcattggtcactcatctgctgaatg

SEQ ID NO: 206765 - DNA, 35 bp, Artificial Sequence
  Description of Artificial Sequence: Synthetic oligonucleotide
accgactcattggtcactcatctgctgaatgtatc

SEQ ID NO: 206766 - DNA, 34 bp, Artificial Sequence
  Description of Artificial Sequence: Synthetic oligonucleotide
ccgactcattggtcactcatctgctgaatgtatc

SEQ ID NO: 206767 - DNA, 34 bp, Artificial Sequence
  Description of Artificial Sequence: Synthetic oligonucleotide
cgactcattggtcactcatctgctgaatgtatcc

SEQ ID NO: 206768 - DNA, 35 bp, Artificial Sequence
  Description of Artificial Sequence: Synthetic oligonucleotide
gactcattggtcactcatctgctgaatgtatcctc

SEQ ID NO: 206769 - DNA, 36 bp, Artificial Sequence
  Description of Artificial Sequence: Synthetic oligonucleotide
actcattggtcactcatctgctgaatgtatcctctc

SEQ ID NO: 206770 - DNA, 35 bp, Artificial Sequence
  Description of Artificial Sequence: Synthetic oligonucleotide
ctcattggtcactcatctgctgaatgtatcctctc

SEQ ID NO: 206771 - DNA, 35 bp, Artificial Sequence
  Description of Artificial Sequence: Synthetic oligonucleotide
tcattggtcactcatctgctgaatgtatcctctcg

SEQ ID NO: 206772 - DNA, 34 bp, Artificial Sequence
  Description of Artificial Sequence: Synthetic oligonucleotide
cattggtcactcatctgctgaatgtatcctctcg

SEQ ID NO: 206773 - DNA, 34 bp, Artificial Sequence
  Description of Artificial Sequence: Synthetic oligonucleotide
attggtcactcatctgctgaatgtatcctctcgg

SEQ ID NO: 206774 - DNA, 33 bp, Artificial Sequence
  Description of Artificial Sequence: Synthetic oligonucleotide
ttggtcactcatctgctgaatgtatcctctcgg

SEQ ID NO: 206775 - DNA, 32 bp, Artificial Sequence
  Description of Artificial Sequence: Synthetic oligonucleotide
tggtcactcatctgctgaatgtatcctctcgg

SEQ ID NO: 206776 - DNA, 31 bp, Artificial Sequence
  Description of Artificial Sequence: Synthetic oligonucleotide
ggtcactcatctgctgaatgtatcctctcgg

SEQ ID NO: 206777 - DNA, 31 bp, Artificial Sequence
  Description of Artificial Sequence: Synthetic oligonucleotide
gtcactcatctgctgaatgtatcctctcggg

SEQ ID NO: 206778 - DNA, 31 bp, Artificial Sequence
  Description of Artificial Sequence: Synthetic oligonucleotide
tcactcatctgctgaatgtatcctctcgggc

SEQ ID NO: 206779 - DNA, 30 bp, Artificial Sequence
  Description of Artificial Sequence: Synthetic oligonucleotide
cactcatctgctgaatgtatcctctcgggc

SEQ ID NO: 206780 - DNA, 33 bp, Artificial Sequence
  Description of Artificial Sequence: Synthetic oligonucleotide
actcatctgctgaatgtatcctctcgggcaatg

SEQ ID NO: 206781 - DNA, 32 bp, Artificial Sequence
  Description of Artificial Sequence: Synthetic oligonucleotide
ctcatctgctgaatgtatcctctcgggcaatg

SEQ ID NO: 206782 - DNA, 32 bp, Artificial Sequence
  Description of Artificial Sequence: Synthetic oligonucleotide
tcatctgctgaatgtatcctctcgggcaatgc

SEQ ID NO: 206783 - DNA, 31 bp, Artificial Sequence
  Description of Artificial Sequence: Synthetic oligonucleotide
catctgctgaatgtatcctctcgggcaatgc

SEQ ID NO: 206784 - DNA, 32 bp, Artificial Sequence
  Description of Artificial Sequence: Synthetic oligonucleotide
atctgctgaatgtatcctctcgggcaatgctg

SEQ ID NO: 206785 - DNA, 31 bp, Artificial Sequence
  Description of Artificial Sequence: Synthetic oligonucleotide
tctgctgaatgtatcctctcgggcaatgctg

SEQ ID NO: 206786 - DNA, 30 bp, Artificial Sequence
  Description of Artificial Sequence: Synthetic oligonucleotide
ctgctgaatgtatcctctcgggcaatgctg

SEQ ID NO: 206787 - DNA, 30 bp, Artificial Sequence
  Description of Artificial Sequence: Synthetic oligonucleotide
tgctgaatgtatcctctcgggcaatgctgc

SEQ ID NO: 206788 - DNA, 29 bp, Artificial Sequence
  Description of Artificial Sequence: Synthetic oligonucleotide
gctgaatgtatcctctcgggcaatgctgc

SEQ ID NO: 206789 - DNA, 29 bp, Artificial Sequence
  Description of Artificial Sequence: Synthetic oligonucleotide
ctgaatgtatcctctcgggcaatgctgcc

SEQ ID NO: 206790 - DNA, 29 bp, Artificial Sequence
  Description of Artificial Sequence: Synthetic oligonucleotide
tgaatgtatcctctcgggcaatgctgccc

SEQ ID NO: 206791 - DNA, 28 bp, Artificial Sequence
  Description of Artificial Sequence: Synthetic oligonucleotide
gaatgtatcctctcgggcaatgctgccc

SEQ ID NO: 206792 - DNA, 31 bp, Artificial Sequence
  Description of Artificial Sequence: Synthetic oligonucleotide
aatgtatcctctcgggcaatgctgcccattg

SEQ ID NO: 206793 - DNA, 30 bp, Artificial Sequence
  Description of Artificial Sequence: Synthetic oligonucleotide
atgtatcctctcgggcaatgctgcccattg

SEQ ID NO: 206794 - DNA, 29 bp, Artificial Sequence
  Description of Artificial Sequence: Synthetic oligonucleotide
tgtatcctctcgggcaatgctgcccattg

SEQ ID NO: 206795 - DNA, 28 bp, Artificial Sequence
  Description of Artificial Sequence: Synthetic oligonucleotide
gtatcctctcgggcaatgctgcccattg

SEQ ID NO: 206796 - DNA, 28 bp, Artificial Sequence
  Description of Artificial Sequence: Synthetic oligonucleotide
tatcctctcgggcaatgctgcccattgg

SEQ ID NO: 206797 - DNA, 27 bp, Artificial Sequence
  Description of Artificial Sequence: Synthetic oligonucleotide
atcctctcgggcaatgctgcccattgg

SEQ ID NO: 206798 - DNA, 27 bp, Artificial Sequence
  Description of Artificial Sequence: Synthetic oligonucleotide
tcctctcgggcaatgctgcccattgga

SEQ ID NO: 206799 - DNA, 26 bp, Artificial Sequence
  Description of Artificial Sequence: Synthetic oligonucleotide
cctctcgggcaatgctgcccattgga

SEQ ID NO: 206800 - DNA, 26 bp, Artificial Sequence
  Description of Artificial Sequence: Synthetic oligonucleotide
ctctcgggcaatgctgcccattggag

SEQ ID NO: 206801 - DNA, 27 bp, Artificial Sequence
  Description of Artificial Sequence: Synthetic oligonucleotide
tctcgggcaatgctgcccattggagca

SEQ ID NO: 206802 - DNA, 26 bp, Artificial Sequence
  Description of Artificial Sequence: Synthetic oligonucleotide
ctcgggcaatgctgcccattggagca

SEQ ID NO: 206803 - DNA, 26 bp, Artificial Sequence
  Description of Artificial Sequence: Synthetic oligonucleotide
tcgggcaatgctgcccattggagcac

SEQ ID NO: 206804 - DNA, 25 bp, Artificial Sequence
  Description of Artificial Sequence: Synthetic oligonucleotide
cgggcaatgctgcccattggagcac

SEQ ID NO: 206805 - DNA, 27 bp, Artificial Sequence
  Description of Artificial Sequence: Synthetic oligonucleotide
gggcaatgctgcccattggagcacgaa

SEQ ID NO: 206806 - DNA, 27 bp, Artificial Sequence
  Description of Artificial Sequence: Synthetic oligonucleotide
ggcaatgctgcccattggagcacgaag

SEQ ID NO: 206807 - DNA, 27 bp, Artificial Sequence
  Description of Artificial Sequence: Synthetic oligonucleotide
gcaatgctgcccattggagcacgaagc

SEQ ID NO: 206808 - DNA, 27 bp, Artificial Sequence
  Description of Artificial Sequence: Synthetic oligonucleotide
caatgctgcccattggagcacgaagcc

SEQ ID NO: 206809 - DNA, 27 bp, Artificial Sequence
  Description of Artificial Sequence: Synthetic oligonucleotide
aatgctgcccattggagcacgaagccg

SEQ ID NO: 206810 - DNA, 26 bp, Artificial Sequence
  Description of Artificial Sequence: Synthetic oligonucleotide
atgctgcccattggagcacgaagccg

SEQ ID NO: 206811 - DNA, 25 bp, Artificial Sequence
  Description of Artificial Sequence: Synthetic oligonucleotide
tgctgcccattggagcacgaagccg

SEQ ID NO: 206812 - DNA, 24 bp, Artificial Sequence
  Description of Artificial Sequence: Synthetic oligonucleotide
gctgcccattggagcacgaagccg

SEQ ID NO: 206813 - DNA, 24 bp, Artificial Sequence
  Description of Artificial Sequence: Synthetic oligonucleotide
ctgcccattggagcacgaagccgc

SEQ ID NO: 206814 - DNA, 27 bp, Artificial Sequence
  Description of Artificial Sequence: Synthetic oligonucleotide
tgcccattggagcacgaagccgccaat

SEQ ID NO: 206815 - DNA, 27 bp, Artificial Sequence
  Description of Artificial Sequence: Synthetic oligonucleotide
gcccattggagcacgaagccgccaatt

SEQ ID NO: 206816 - DNA, 28 bp, Artificial Sequence
  Description of Artificial Sequence: Synthetic oligonucleotide
cccattggagcacgaagccgccaatttg

SEQ ID NO: 206817 - DNA, 29 bp, Artificial Sequence
  Description of Artificial Sequence: Synthetic oligonucleotide
ccattggagcacgaagccgccaatttgtc

SEQ ID NO: 206818 - DNA, 31 bp, Artificial Sequence
  Description of Artificial Sequence: Synthetic oligonucleotide
cattggagcacgaagccgccaatttgtcaac

SEQ ID NO: 206819 - DNA, 31 bp, Artificial Sequence
  Description of Artificial Sequence: Synthetic oligonucleotide
attggagcacgaagccgccaatttgtcaacg

SEQ ID NO: 206820 - DNA, 30 bp, Artificial Sequence
  Description of Artificial Sequence: Synthetic oligonucleotide
ttggagcacgaagccgccaatttgtcaacg

SEQ ID NO: 206821 - DNA, 29 bp, Artificial Sequence
  Description of Artificial Sequence: Synthetic oligonucleotide
tggagcacgaagccgccaatttgtcaacg

SEQ ID NO: 206822 - DNA, 28 bp, Artificial Sequence
  Description of Artificial Sequence: Synthetic oligonucleotide
ggagcacgaagccgccaatttgtcaacg

SEQ ID NO: 206823 - DNA, 32 bp, Artificial Sequence
  Description of Artificial Sequence: Synthetic oligonucleotide
gagcacgaagccgccaatttgtcaacgaattc

SEQ ID NO: 206824 - DNA, 32 bp, Artificial Sequence
  Description of Artificial Sequence: Synthetic oligonucleotide
agcacgaagccgccaatttgtcaacgaattcc

SEQ ID NO: 206825 - DNA, 31 bp, Artificial Sequence
  Description of Artificial Sequence: Synthetic oligonucleotide
gcacgaagccgccaatttgtcaacgaattcc

SEQ ID NO: 206826 - DNA, 33 bp, Artificial Sequence
  Description of Artificial Sequence: Synthetic oligonucleotide
cacgaagccgccaatttgtcaacgaattccttg

SEQ ID NO: 206827 - DNA, 34 bp, Artificial Sequence
  Description of Artificial Sequence: Synthetic oligonucleotide
acgaagccgccaatttgtcaacgaattccttgtg

SEQ ID NO: 206828 - DNA, 33 bp, Artificial Sequence
  Description of Artificial Sequence: Synthetic oligonucleotide
cgaagccgccaatttgtcaacgaattccttgtg

SEQ ID NO: 206829 - DNA, 33 bp, Artificial Sequence
  Description of Artificial Sequence: Synthetic oligonucleotide
gaagccgccaatttgtcaacgaattccttgtgg

SEQ ID NO: 206830 - DNA, 33 bp, Artificial Sequence
  Description of Artificial Sequence: Synthetic oligonucleotide
aagccgccaatttgtcaacgaattccttgtggg

SEQ ID NO: 206831 - DNA, 32 bp, Artificial Sequence
  Description of Artificial Sequence: Synthetic oligonucleotide
agccgccaatttgtcaacgaattccttgtggg

SEQ ID NO: 206832 - DNA, 31 bp, Artificial Sequence
  Description of Artificial Sequence: Synthetic oligonucleotide
gccgccaatttgtcaacgaattccttgtggg

SEQ ID NO: 206833 - DNA, 31 bp, Artificial Sequence
  Description of Artificial Sequence: Synthetic oligonucleotide
ccgccaatttgtcaacgaattccttgtgggc

SEQ ID NO: 206834 - DNA, 33 bp, Artificial Sequence
  Description of Artificial Sequence: Synthetic oligonucleotide
cgccaatttgtcaacgaattccttgtgggctac

SEQ ID NO: 206835 - DNA, 33 bp, Artificial Sequence
  Description of Artificial Sequence: Synthetic oligonucleotide
gccaatttgtcaacgaattccttgtgggctacc

SEQ ID NO: 206836 - DNA, 33 bp, Artificial Sequence
  Description of Artificial Sequence: Synthetic oligonucleotide
ccaatttgtcaacgaattccttgtgggctaccc

SEQ ID NO: 206837 - DNA, 33 bp, Artificial Sequence
  Description of Artificial Sequence: Synthetic oligonucleotide
caatttgtcaacgaattccttgtgggctacccc

SEQ ID NO: 206838 - DNA, 33 bp, Artificial Sequence
  Description of Artificial Sequence: Synthetic oligonucleotide
aatttgtcaacgaattccttgtgggctaccccc

SEQ ID NO: 206839 - DNA, 32 bp, Artificial Sequence
  Description of Artificial Sequence: Synthetic oligonucleotide
atttgtcaacgaattccttgtgggctaccccc

SEQ ID NO: 206840 - DNA, 31 bp, Artificial Sequence
  Description of Artificial Sequence: Synthetic oligonucleotide
tttgtcaacgaattccttgtgggctaccccc

SEQ ID NO: 206841 - DNA, 30 bp, Artificial Sequence
  Description of Artificial Sequence: Synthetic oligonucleotide
ttgtcaacgaattccttgtgggctaccccc

SEQ ID NO: 206842 - DNA, 29 bp, Artificial Sequence
  Description of Artificial Sequence: Synthetic oligonucleotide
tgtcaacgaattccttgtgggctaccccc

SEQ ID NO: 206843 - DNA, 28 bp, Artificial Sequence
  Description of Artificial Sequence: Synthetic oligonucleotide
gtcaacgaattccttgtgggctaccccc

SEQ ID NO: 206844 - DNA, 28 bp, Artificial Sequence
  Description of Artificial Sequence: Synthetic oligonucleotide
tcaacgaattccttgtgggctacccccc

SEQ ID NO: 206845 - DNA, 27 bp, Artificial Sequence
  Description of Artificial Sequence: Synthetic oligonucleotide
caacgaattccttgtgggctacccccc

SEQ ID NO: 206846 - DNA, 28 bp, Artificial Sequence
  Description of Artificial Sequence: Synthetic oligonucleotide
aacgaattccttgtgggctaccccccac

SEQ ID NO: 206847 - DNA, 27 bp, Artificial Sequence
  Description of Artificial Sequence: Synthetic oligonucleotide
acgaattccttgtgggctaccccccac

SEQ ID NO: 206848 - DNA, 26 bp, Artificial Sequence
  Description of Artificial Sequence: Synthetic oligonucleotide
cgaattccttgtgggctaccccccac

SEQ ID NO: 206849 - DNA, 26 bp, Artificial Sequence
  Description of Artificial Sequence: Synthetic oligonucleotide
ttccttgtgggctaccccccaccatc

SEQ ID NO: 206850 - DNA, 25 bp, Artificial Sequence
  Description of Artificial Sequence: Synthetic oligonucleotide
tccttgtgggctaccccccaccatc

SEQ ID NO: 206851 - DNA, 24 bp, Artificial Sequence
  Description of Artificial Sequence: Synthetic oligonucleotide
ccttgtgggctaccccccaccatc

SEQ ID NO: 206852 - DNA, 24 bp, Artificial Sequence
  Description of Artificial Sequence: Synthetic oligonucleotide
cttgtgggctaccccccaccatcg

SEQ ID NO: 206853 - DNA, 24 bp, Artificial Sequence
  Description of Artificial Sequence: Synthetic oligonucleotide
ttgtgggctaccccccaccatcgc

SEQ ID NO: 206854 - DNA, 23 bp, Artificial Sequence
  Description of Artificial Sequence: Synthetic oligonucleotide
tgtgggctaccccccaccatcgc

SEQ ID NO: 206855 - DNA, 22 bp, Artificial Sequence
  Description of Artificial Sequence: Synthetic oligonucleotide
gtgggctaccccccaccatcgc

SEQ ID NO: 206856 - DNA, 25 bp, Artificial Sequence
  Description of Artificial Sequence: Synthetic oligonucleotide
tgggctaccccccaccatcgccaat

SEQ ID NO: 206857 - DNA, 24 bp, Artificial Sequence
  Description of Artificial Sequence: Synthetic oligonucleotide
gggctaccccccaccatcgccaat

SEQ ID NO: 206858 - DNA, 24 bp, Artificial Sequence
  Description of Artificial Sequence: Synthetic oligonucleotide
ggctaccccccaccatcgccaatg

SEQ ID NO: 206859 - DNA, 25 bp, Artificial Sequence
  Description of Artificial Sequence: Synthetic oligonucleotide
gctaccccccaccatcgccaatgga

SEQ ID NO: 206860 - DNA, 27 bp, Artificial Sequence
  Description of Artificial Sequence: Synthetic oligonucleotide
ctaccccccaccatcgccaatggagat

SEQ ID NO: 206861 - DNA, 29 bp, Artificial Sequence
  Description of Artificial Sequence: Synthetic oligonucleotide
taccccccaccatcgccaatggagatttc

SEQ ID NO: 206862 - DNA, 28 bp, Artificial Sequence
  Description of Artificial Sequence: Synthetic oligonucleotide
accccccaccatcgccaatggagatttc

SEQ ID NO: 206863 - DNA, 27 bp, Artificial Sequence
  Description of Artificial Sequence: Synthetic oligonucleotide
ccccccaccatcgccaatggagatttc

SEQ ID NO: 206864 - DNA, 31 bp, Artificial Sequence
  Description of Artificial Sequence: Synthetic oligonucleotide
cccccaccatcgccaatggagatttcattag

SEQ ID NO: 206865 - DNA, 31 bp, Artificial Sequence
  Description of Artificial Sequence: Synthetic oligonucleotide
ccccaccatcgccaatggagatttcattagc

SEQ ID NO: 206866 - DNA, 32 bp, Artificial Sequence
  Description of Artificial Sequence: Synthetic oligonucleotide
cccaccatcgccaatggagatttcattagcac

SEQ ID NO: 206867 - DNA, 32 bp, Artificial Sequence
  Description of Artificial Sequence: Synthetic oligonucleotide
ccaccatcgccaatggagatttcattagcacc

SEQ ID NO: 206868 - DNA, 34 bp, Artificial Sequence
  Description of Artificial Sequence: Synthetic oligonucleotide
caccatcgccaatggagatttcattagcaccaac

SEQ ID NO: 206869 - DNA, 35 bp, Artificial Sequence
  Description of Artificial Sequence: Synthetic oligonucleotide
accatcgccaatggagatttcattagcaccaacag

SEQ ID NO: 206870 - DNA, 34 bp, Artificial Sequence
  Description of Artificial Sequence: Synthetic oligonucleotide
ccatcgccaatggagatttcattagcaccaacag

SEQ ID NO: 206871 - DNA, 35 bp, Artificial Sequence
  Description of Artificial Sequence: Synthetic oligonucleotide
catcgccaatggagatttcattagcaccaacagag

SEQ ID NO: 206872 - DNA, 36 bp, Artificial Sequence
  Description of Artificial Sequence: Synthetic oligonucleotide
atcgccaatggagatttcattagcaccaacagagag

SEQ ID NO: 206873 - DNA, 35 bp, Artificial Sequence
  Description of Artificial Sequence: Synthetic oligonucleotide
tcgccaatggagatttcattagcaccaacagagag

SEQ ID NO: 206874 - DNA, 34 bp, Artificial Sequence
  Description of Artificial Sequence: Synthetic oligonucleotide
cgccaatggagatttcattagcaccaacagagag

SEQ ID NO: 206875 - DNA, 40 bp, Artificial Sequence
  Description of Artificial Sequence: Synthetic oligonucleotide
gccaatggagatttcattagcaccaacagagagaattttc

SEQ ID NO: 206876 - DNA, 23 bp, Artificial Sequence
  Description of Artificial Sequence: Synthetic oligonucleotide
aagtgggcatctggagcggcccg

SEQ ID NO: 206877 - DNA, 22 bp, Artificial Sequence
  Description of Artificial Sequence: Synthetic oligonucleotide
agtgggcatctggagcggcccg

SEQ ID NO: 206878 - DNA, 21 bp, Artificial Sequence
  Description of Artificial Sequence: Synthetic oligonucleotide
gtgggcatctggagcggcccg

SEQ ID NO: 206879 - DNA, 21 bp, Artificial Sequence
  Description of Artificial Sequence: Synthetic oligonucleotide
tgggcatctggagcggcccgg

SEQ ID NO: 206880 - DNA, 20 bp, Artificial Sequence
  Description of Artificial Sequence: Synthetic oligonucleotide
gggcatctggagcggcccgg

SEQ ID NO: 206881 - DNA, 20 bp, Artificial Sequence
  Description of Artificial Sequence: Synthetic oligonucleotide
ggcatctggagcggcccggc

SEQ ID NO: 206882 - DNA, 20 bp, Artificial Sequence
  Description of Artificial Sequence: Synthetic oligonucleotide
gcatctggagcggcccggcc

SEQ ID NO: 206883 - DNA, 20 bp, Artificial Sequence
  Description of Artificial Sequence: Synthetic oligonucleotide
catctggagcggcccggccc

SEQ ID NO: 206884 - DNA, 21 bp, Artificial Sequence
  Description of Artificial Sequence: Synthetic oligonucleotide
atctggagcggcccggcccct

SEQ ID NO: 206885 - DNA, 20 bp, Artificial Sequence
  Description of Artificial Sequence: Synthetic oligonucleotide
tctggagcggcccggcccct

SEQ ID NO: 206886 - DNA, 20 bp, Artificial Sequence
  Description of Artificial Sequence: Synthetic oligonucleotide
ctggagcggcccggcccctt

SEQ ID NO: 206887 - DNA, 20 bp, Artificial Sequence
  Description of Artificial Sequence: Synthetic oligonucleotide
tggagcggcccggcccctca

SEQ ID NO: 206888 - DNA, 20 bp, Artificial Sequence
  Description of Artificial Sequence: Synthetic oligonucleotide
ggagcggcccggcccctcat

SEQ ID NO: 206889 - DNA, 20 bp, Artificial Sequence
  Description of Artificial Sequence: Synthetic oligonucleotide
gagcggcccggcccctcagt

SEQ ID NO: 206890 - DNA, 20 bp, Artificial Sequence
  Description of Artificial Sequence: Synthetic oligonucleotide
agcggcccggcccctcagtg

SEQ ID NO: 206891 - DNA, 20 bp, Artificial Sequence
  Description of Artificial Sequence: Synthetic oligonucleotide
gcggcccggcccctcagtgt

SEQ ID NO: 206892 - DNA, 25 bp, Artificial Sequence
  Description of Artificial Sequence: Synthetic oligonucleotide
cggcccggcccctcagtgcattata

SEQ ID NO: 206893 - DNA, 25 bp, Artificial Sequence
  Description of Artificial Sequence: Synthetic oligonucleotide
ggcccggcccctcagtgcattatac

SEQ ID NO: 206894 - DNA, 27 bp, Artificial Sequence
  Description of Artificial Sequence: Synthetic oligonucleotide
gcccggcccctcagtgcattataccta

SEQ ID NO: 206895 - DNA, 28 bp, Artificial Sequence
  Description of Artificial Sequence: Synthetic oligonucleotide
cccggcccctcagtgcattatacctaac

SEQ ID NO: 206896 - DNA, 32 bp, Artificial Sequence
  Description of Artificial Sequence: Synthetic oligonucleotide
ccggcccctcagtgcattatacctaacaaatg

SEQ ID NO: 206897 - DNA, 32 bp, Artificial Sequence
  Description of Artificial Sequence: Synthetic oligonucleotide
cggcccctcagtgcattatacctaacaaatgc

SEQ ID NO: 206898 - DNA, 33 bp, Artificial Sequence
  Description of Artificial Sequence: Synthetic oligonucleotide
ggcccctcagtgcattatacctaacaaatgcac

SEQ ID NO: 206899 - DNA, 32 bp, Artificial Sequence
  Description of Artificial Sequence: Synthetic oligonucleotide
gtacccaaagggacaaggacaacttttcaccc

SEQ ID NO: 206900 - DNA, 32 bp, Artificial Sequence
  Description of Artificial Sequence: Synthetic oligonucleotide
tacccaaagggacaaggacaacttttcacccg

SEQ ID NO: 206901 - DNA, 31 bp, Artificial Sequence
  Description of Artificial Sequence: Synthetic oligonucleotide
acccaaagggacaaggacaacttttcacccg

SEQ ID NO: 206902 - DNA, 30 bp, Artificial Sequence
  Description of Artificial Sequence: Synthetic oligonucleotide
cccaaagggacaaggacaacttttcacccg

SEQ ID NO: 206903 - DNA, 30 bp, Artificial Sequence
  Description of Artificial Sequence: Synthetic oligonucleotide
ccaaagggacaaggacaacttttcacccgg

SEQ ID NO: 206904 - DNA, 30 bp, Artificial Sequence
  Description of Artificial Sequence: Synthetic oligonucleotide
caaagggacaaggacaacttttcacccggg

SEQ ID NO: 206905 - DNA, 30 bp, Artificial Sequence
  Description of Artificial Sequence: Synthetic oligonucleotide
aaagggacaaggacaacttttcacccgggc

SEQ ID NO: 206906 - DNA, 29 bp, Artificial Sequence
  Description of Artificial Sequence: Synthetic oligonucleotide
aagggacaaggacaacttttcacccgggc

SEQ ID NO: 206907 - DNA, 28 bp, Artificial Sequence
  Description of Artificial Sequence: Synthetic oligonucleotide
agggacaaggacaacttttcacccgggc

SEQ ID NO: 206908 - DNA, 27 bp, Artificial Sequence
  Description of Artificial Sequence: Synthetic oligonucleotide
gggacaaggacaacttttcacccgggc

SEQ ID NO: 206909 - DNA, 28 bp, Artificial Sequence
  Description of Artificial Sequence: Synthetic oligonucleotide
ggacaaggacaacttttcacccgggcag

SEQ ID NO: 206910 - DNA, 28 bp, Artificial Sequence
  Description of Artificial Sequence: Synthetic oligonucleotide
gacaaggacaacttttcacccgggcagg

SEQ ID NO: 206911 - DNA, 30 bp, Artificial Sequence
  Description of Artificial Sequence: Synthetic oligonucleotide
acaaggacaacttttcacccgggcaggaag

SEQ ID NO: 206912 - DNA, 29 bp, Artificial Sequence
  Description of Artificial Sequence: Synthetic oligonucleotide
caaggacaacttttcacccgggcaggaag

SEQ ID NO: 206913 - DNA, 30 bp, Artificial Sequence
  Description of Artificial Sequence: Synthetic oligonucleotide
aaggacaacttttcacccgggcaggaagtg

SEQ ID NO: 206914 - DNA, 29 bp, Artificial Sequence
  Description of Artificial Sequence: Synthetic oligonucleotide
aggacaacttttcacccgggcaggaagtg

SEQ ID NO: 206915 - DNA, 28 bp, Artificial Sequence
  Description of Artificial Sequence: Synthetic oligonucleotide
ggacaacttttcacccgggcaggaagtg

SEQ ID NO: 206916 - DNA, 30 bp, Artificial Sequence
  Description of Artificial Sequence: Synthetic oligonucleotide
gacaacttttcacccgggcaggaagtgttc

SEQ ID NO: 206917 - DNA, 32 bp, Artificial Sequence
  Description of Artificial Sequence: Synthetic oligonucleotide
acaacttttcacccgggcaggaagtgttctac

SEQ ID NO: 206918 - DNA, 31 bp, Artificial Sequence
  Description of Artificial Sequence: Synthetic oligonucleotide
caacttttcacccgggcaggaagtgttctac

SEQ ID NO: 206919 - DNA, 32 bp, Artificial Sequence
  Description of Artificial Sequence: Synthetic oligonucleotide
aacttttcacccgggcaggaagtgttctacag

SEQ ID NO: 206920 - DNA, 31 bp, Artificial Sequence
  Description of Artificial Sequence: Synthetic oligonucleotide
acttttcacccgggcaggaagtgttctacag

SEQ ID NO: 206921 - DNA, 30 bp, Artificial Sequence
  Description of Artificial Sequence: Synthetic oligonucleotide
cttttcacccgggcaggaagtgttctacag

SEQ ID NO: 206922 - DNA, 30 bp, Artificial Sequence
  Description of Artificial Sequence: Synthetic oligonucleotide
ttttcacccgggcaggaagtgttctacagc

SEQ ID NO: 206923 - DNA, 29 bp, Artificial Sequence
  Description of Artificial Sequence: Synthetic oligonucleotide
tttcacccgggcaggaagtgttctacagc

SEQ ID NO: 206924 - DNA, 28 bp, Artificial Sequence
  Description of Artificial Sequence: Synthetic oligonucleotide
ttcacccgggcaggaagtgttctacagc

SEQ ID NO: 206925 - DNA, 27 bp, Artificial Sequence
  Description of Artificial Sequence: Synthetic oligonucleotide
tcacccgggcaggaagtgttctacagc

SEQ ID NO: 206926 - DNA, 27 bp, Artificial Sequence
  Description of Artificial Sequence: Synthetic oligonucleotide
cacccgggcaggaagtgttctacagct

SEQ ID NO: 206927 - DNA, 27 bp, Artificial Sequence
  Description of Artificial Sequence: Synthetic oligonucleotide
acccgggcaggaagtgttctacagctg

SEQ ID NO: 206928 - DNA, 27 bp, Artificial Sequence
  Description of Artificial Sequence: Synthetic oligonucleotide
cccgggcaggaagtgttctacagctgt

SEQ ID NO: 206929 - DNA, 27 bp, Artificial Sequence
  Description of Artificial Sequence: Synthetic oligonucleotide
ccgggcaggaagtgttctacagctgtg

SEQ ID NO: 206930 - DNA, 28 bp, Artificial Sequence
  Description of Artificial Sequence: Synthetic oligonucleotide
cgggcaggaagtgttctacagctgtgag

SEQ ID NO: 206931 - DNA, 30 bp, Artificial Sequence
  Description of Artificial Sequence: Synthetic oligonucleotide
aagtgttctacagctgtgagcccggctatg

SEQ ID NO: 206932 - DNA, 29 bp, Artificial Sequence
  Description of Artificial Sequence: Synthetic oligonucleotide
agtgttctacagctgtgagcccggctatg

SEQ ID NO: 206933 - DNA, 28 bp, Artificial Sequence
  Description of Artificial Sequence: Synthetic oligonucleotide
gtgttctacagctgtgagcccggctatg

SEQ ID NO: 206934 - DNA, 29 bp, Artificial Sequence
  Description of Artificial Sequence: Synthetic oligonucleotide
tgttctacagctgtgagcccggctatgac

SEQ ID NO: 206935 - DNA, 28 bp, Artificial Sequence
  Description of Artificial Sequence: Synthetic oligonucleotide
gttctacagctgtgagcccggctatgac

SEQ ID NO: 206936 - DNA, 28 bp, Artificial Sequence
  Description of Artificial Sequence: Synthetic oligonucleotide
ttctacagctgtgagcccggctatgacc

SEQ ID NO: 206937 - DNA, 27 bp, Artificial Sequence
  Description of Artificial Sequence: Synthetic oligonucleotide
tctacagctgtgagcccggctatgacc

SEQ ID NO: 206938 - DNA, 27 bp, Artificial Sequence
  Description of Artificial Sequence: Synthetic oligonucleotide
ctacagctgtgagcccggctatgacct

SEQ ID NO: 206939 - DNA, 27 bp, Artificial Sequence
  Description of Artificial Sequence: Synthetic oligonucleotide
tacagctgtgagcccggctatgacctc

SEQ ID NO: 206940 - DNA, 27 bp, Artificial Sequence
  Description of Artificial Sequence: Synthetic oligonucleotide
acagctgtgagcccggctatgacctca

SEQ ID NO: 206941 - DNA, 26 bp, Artificial Sequence
  Description of Artificial Sequence: Synthetic oligonucleotide
cagctgtgagcccggctatgacctca

SEQ ID NO: 206942 - DNA, 27 bp, Artificial Sequence
  Description of Artificial Sequence: Synthetic oligonucleotide
agctgtgagcccggctatgacctcaga

SEQ ID NO: 206943 - DNA, 26 bp, Artificial Sequence
  Description of Artificial Sequence: Synthetic oligonucleotide
gctgtgagcccggctatgacctcaga

SEQ ID NO: 206944 - DNA, 26 bp, Artificial Sequence
  Description of Artificial Sequence: Synthetic oligonucleotide
ctgtgagcccggctatgacctcagag

SEQ ID NO: 206945 - DNA, 26 bp, Artificial Sequence
  Description of Artificial Sequence: Synthetic oligonucleotide
tgtgagcccggctatgacctcagagg

SEQ ID NO: 206946 - DNA, 25 bp, Artificial Sequence
  Description of Artificial Sequence: Synthetic oligonucleotide
gtgagcccggctatgacctcagagg

SEQ ID NO: 206947 - DNA, 25 bp, Artificial Sequence
  Description of Artificial Sequence: Synthetic oligonucleotide
tgagcccggctatgacctcagaggg

SEQ ID NO: 206948 - DNA, 24 bp, Artificial Sequence
  Description of Artificial Sequence: Synthetic oligonucleotide
gagcccggctatgacctcagaggg

SEQ ID NO: 206949 - DNA, 24 bp, Artificial Sequence
  Description of Artificial Sequence: Synthetic oligonucleotide
agcccggctatgacctcagagggg

SEQ ID NO: 206950 - DNA, 23 bp, Artificial Sequence
  Description of Artificial Sequence: Synthetic oligonucleotide
gcccggctatgacctcagagggg

SEQ ID NO: 206951 - DNA, 24 bp, Artificial Sequence
  Description of Artificial Sequence: Synthetic oligonucleotide
cccggctatgacctcagaggggct

SEQ ID NO: 206952 - DNA, 24 bp, Artificial Sequence
  Description of Artificial Sequence: Synthetic oligonucleotide
ccggctatgacctcagaggggctg

SEQ ID NO: 206953 - DNA, 24 bp, Artificial Sequence
  Description of Artificial Sequence: Synthetic oligonucleotide
cggctatgacctcagaggggctgc

SEQ ID NO: 206954 - DNA, 25 bp, Artificial Sequence
  Description of Artificial Sequence: Synthetic oligonucleotide
ggctatgacctcagaggggctgcgt

SEQ ID NO: 206955 - DNA, 27 bp, Artificial Sequence
  Description of Artificial Sequence: Synthetic oligonucleotide
gctatgacctcagaggggctgcgtcta

SEQ ID NO: 206956 - DNA, 28 bp, Artificial Sequence
  Description of Artificial Sequence: Synthetic oligonucleotide
ctatgacctcagaggggctgcgtctatg

SEQ ID NO: 206957 - DNA, 28 bp, Artificial Sequence
  Description of Artificial Sequence: Synthetic oligonucleotide
tatgacctcagaggggctgcgtctatgc

SEQ ID NO: 206958 - DNA, 27 bp, Artificial Sequence
  Description of Artificial Sequence: Synthetic oligonucleotide
atgacctcagaggggctgcgtctatgc

SEQ ID NO: 206959 - DNA, 26 bp, Artificial Sequence
  Description of Artificial Sequence: Synthetic oligonucleotide
tgacctcagaggggctgcgtctatgc

SEQ ID NO: 206960 - DNA, 46 bp, Artificial Sequence
  Description of Artificial Sequence: Synthetic oligonucleotide
tttgtgatgaaggatttcaattaaaaggcagctctgctagttattg

SEQ ID NO: 206961 - DNA, 45 bp, Artificial Sequence
  Description of Artificial Sequence: Synthetic oligonucleotide
ttgtgatgaaggatttcaattaaaaggcagctctgctagttattg

SEQ ID NO: 206962 - DNA, 44 bp, Artificial Sequence
  Description of Artificial Sequence: Synthetic oligonucleotide
tgtgatgaaggatttcaattaaaaggcagctctgctagttattg

SEQ ID NO: 206963 - DNA, 43 bp, Artificial Sequence
  Description of Artificial Sequence: Synthetic oligonucleotide
gtgatgaaggatttcaattaaaaggcagctctgctagttattg

SEQ ID NO: 206964 - DNA, 44 bp, Artificial Sequence
  Description of Artificial Sequence: Synthetic oligonucleotide
tgatgaaggatttcaattaaaaggcagctctgctagttattgtg

SEQ ID NO: 206965 - DNA, 43 bp, Artificial Sequence
  Description of Artificial Sequence: Synthetic oligonucleotide
gatgaaggatttcaattaaaaggcagctctgctagttattgtg

SEQ ID NO: 206966 - DNA, 44 bp, Artificial Sequence
  Description of Artificial Sequence: Synthetic oligonucleotide
atgaaggatttcaattaaaaggcagctctgctagttattgtgtc

SEQ ID NO: 206967 - DNA, 43 bp, Artificial Sequence
  Description of Artificial Sequence: Synthetic oligonucleotide
tgaaggatttcaattaaaaggcagctctgctagttattgtgtc

SEQ ID NO: 206968 - DNA, 42 bp, Artificial Sequence
  Description of Artificial Sequence: Synthetic oligonucleotide
gaaggatttcaattaaaaggcagctctgctagttattgtgtc

SEQ ID NO: 206969 - DNA, 44 bp, Artificial Sequence
  Description of Artificial Sequence: Synthetic oligonucleotide
aaggatttcaattaaaaggcagctctgctagttattgtgtcttg

SEQ ID NO: 206970 - DNA, 43 bp, Artificial Sequence
  Description of Artificial Sequence: Synthetic oligonucleotide
aggatttcaattaaaaggcagctctgctagttattgtgtcttg

SEQ ID NO: 206971 - DNA, 42 bp, Artificial Sequence
  Description of Artificial Sequence: Synthetic oligonucleotide
ggatttcaattaaaaggcagctctgctagttattgtgtcttg

SEQ ID NO: 206972 - DNA, 42 bp, Artificial Sequence
  Description of Artificial Sequence: Synthetic oligonucleotide
gatttcaattaaaaggcagctctgctagttattgtgtcttgg

SEQ ID NO: 206973 - DNA, 42 bp, Artificial Sequence
  Description of Artificial Sequence: Synthetic oligonucleotide
atttcaattaaaaggcagctctgctagttattgtgtcttggc

SEQ ID NO: 206974 - DNA, 41 bp, Artificial Sequence
  Description of Artificial Sequence: Synthetic oligonucleotide
tttcaattaaaaggcagctctgctagttattgtgtcttggc

SEQ ID NO: 206975 - DNA, 40 bp, Artificial Sequence
  Description of Artificial Sequence: Synthetic oligonucleotide
ttcaattaaaaggcagctctgctagttattgtgtcttggc

SEQ ID NO: 206976 - DNA, 39 bp, Artificial Sequence
  Description of Artificial Sequence: Synthetic oligonucleotide
tcaattaaaaggcagctctgctagttattgtgtcttggc

SEQ ID NO: 206977 - DNA, 38 bp, Artificial Sequence
  Description of Artificial Sequence: Synthetic oligonucleotide
caattaaaaggcagctctgctagttattgtgtcttggc

SEQ ID NO: 206978 - DNA, 39 bp, Artificial Sequence
  Description of Artificial Sequence: Synthetic oligonucleotide
aattaaaaggcagctctgctagttattgtgtcttggctg

SEQ ID NO: 206979 - DNA, 38 bp, Artificial Sequence
  Description of Artificial Sequence: Synthetic oligonucleotide
attaaaaggcagctctgctagttattgtgtcttggctg

SEQ ID NO: 206980 - DNA, 37 bp, Artificial Sequence
  Description of Artificial Sequence: Synthetic oligonucleotide
ttaaaaggcagctctgctagttattgtgtcttggctg

SEQ ID NO: 206981 - DNA, 36 bp, Artificial Sequence
  Description of Artificial Sequence: Synthetic oligonucleotide
taaaaggcagctctgctagttattgtgtcttggctg

SEQ ID NO: 206982 - DNA, 35 bp, Artificial Sequence
  Description of Artificial Sequence: Synthetic oligonucleotide
aaaaggcagctctgctagttattgtgtcttggctg

SEQ ID NO: 206983 - DNA, 34 bp, Artificial Sequence
  Description of Artificial Sequence: Synthetic oligonucleotide
aaaggcagctctgctagttattgtgtcttggctg

SEQ ID NO: 206984 - DNA, 33 bp, Artificial Sequence
  Description of Artificial Sequence: Synthetic oligonucleotide
aaggcagctctgctagttattgtgtcttggctg

SEQ ID NO: 206985 - DNA, 32 bp, Artificial Sequence
  Description of Artificial Sequence: Synthetic oligonucleotide
aggcagctctgctagttattgtgtcttggctg

SEQ ID NO: 206986 - DNA, 31 bp, Artificial Sequence
  Description of Artificial Sequence: Synthetic oligonucleotide
ggcagctctgctagttattgtgtcttggctg

SEQ ID NO: 206987 - DNA, 31 bp, Artificial Sequence
  Description of Artificial Sequence: Synthetic oligonucleotide
gcagctctgctagttattgtgtcttggctgg

SEQ ID NO: 206988 - DNA, 34 bp, Artificial Sequence
  Description of Artificial Sequence: Synthetic oligonucleotide
cagctctgctagttattgtgtcttggctggaatg

SEQ ID NO: 206989 - DNA, 34 bp, Artificial Sequence
  Description of Artificial Sequence: Synthetic oligonucleotide
agctctgctagttattgtgtcttggctggaatgg

SEQ ID NO: 206990 - DNA, 33 bp, Artificial Sequence
  Description of Artificial Sequence: Synthetic oligonucleotide
gctctgctagttattgtgtcttggctggaatgg

SEQ ID NO: 206991 - DNA, 36 bp, Artificial Sequence
  Description of Artificial Sequence: Synthetic oligonucleotide
ctctgctagttattgtgtcttggctggaatggaaag

SEQ ID NO: 206992 - DNA, 36 bp, Artificial Sequence
  Description of Artificial Sequence: Synthetic oligonucleotide
tctgctagttattgtgtcttggctggaatggaaagc

SEQ ID NO: 206993 - DNA, 35 bp, Artificial Sequence
  Description of Artificial Sequence: Synthetic oligonucleotide
ctgctagttattgtgtcttggctggaatggaaagc

SEQ ID NO: 206994 - DNA, 35 bp, Artificial Sequence
  Description of Artificial Sequence: Synthetic oligonucleotide
tgctagttattgtgtcttggctggaatggaaagcc

SEQ ID NO: 206995 - DNA, 34 bp, Artificial Sequence
  Description of Artificial Sequence: Synthetic oligonucleotide
gctagttattgtgtcttggctggaatggaaagcc

SEQ ID NO: 206996 - DNA, 37 bp, Artificial Sequence
  Description of Artificial Sequence: Synthetic oligonucleotide
ctagttattgtgtcttggctggaatggaaagcctttg

SEQ ID NO: 206997 - DNA, 37 bp, Artificial Sequence
  Description of Artificial Sequence: Synthetic oligonucleotide
tagttattgtgtcttggctggaatggaaagcctttgg

SEQ ID NO: 206998 - DNA, 36 bp, Artificial Sequence
  Description of Artificial Sequence: Synthetic oligonucleotide
agttattgtgtcttggctggaatggaaagcctttgg

SEQ ID NO: 206999 - DNA, 35 bp, Artificial Sequence
  Description of Artificial Sequence: Synthetic oligonucleotide
gttattgtgtcttggctggaatggaaagcctttgg

SEQ ID NO: 207000 - DNA, 39 bp, Artificial Sequence
  Description of Artificial Sequence: Synthetic oligonucleotide
ttattgtgtcttggctggaatggaaagcctttggaatag

SEQ ID NO: 207001 - DNA, 38 bp, Artificial Sequence
  Description of Artificial Sequence: Synthetic oligonucleotide
tattgtgtcttggctggaatggaaagcctttggaatag

SEQ ID NO: 207002 - DNA, 37 bp, Artificial Sequence
  Description of Artificial Sequence: Synthetic oligonucleotide
attgtgtcttggctggaatggaaagcctttggaatag

SEQ ID NO: 207003 - DNA, 36 bp, Artificial Sequence
  Description of Artificial Sequence: Synthetic oligonucleotide
ttgtgtcttggctggaatggaaagcctttggaatag

SEQ ID NO: 207004 - DNA, 37 bp, Artificial Sequence
  Description of Artificial Sequence: Synthetic oligonucleotide
acaggaaaacctctggaagtctttccctttggaaaag

SEQ ID NO: 207005 - DNA, 36 bp, Artificial Sequence
  Description of Artificial Sequence: Synthetic oligonucleotide
caggaaaacctctggaagtctttccctttggaaaag

SEQ ID NO: 207006 - DNA, 36 bp, Artificial Sequence
  Description of Artificial Sequence: Synthetic oligonucleotide
aggaaaacctctggaagtctttccctttggaaaagc

SEQ ID NO: 207007 - DNA, 35 bp, Artificial Sequence
  Description of Artificial Sequence: Synthetic oligonucleotide
ggaaaacctctggaagtctttccctttggaaaagc

SEQ ID NO: 207008 - DNA, 36 bp, Artificial Sequence
  Description of Artificial Sequence: Synthetic oligonucleotide
gaaaacctctggaagtctttccctttggaaaagcag

SEQ ID NO: 207009 - DNA, 43 bp, Artificial Sequence
  Description of Artificial Sequence: Synthetic oligonucleotide
aaaacctctggaagtctttccctttggaaaagcagtaaattac

SEQ ID NO: 207010 - DNA, 42 bp, Artificial Sequence
  Description of Artificial Sequence: Synthetic oligonucleotide
aaacctctggaagtctttccctttggaaaagcagtaaattac

SEQ ID NO: 207011 - DNA, 41 bp, Artificial Sequence
  Description of Artificial Sequence: Synthetic oligonucleotide
aacctctggaagtctttccctttggaaaagcagtaaattac

SEQ ID NO: 207012 - DNA, 40 bp, Artificial Sequence
  Description of Artificial Sequence: Synthetic oligonucleotide
acctctggaagtctttccctttggaaaagcagtaaattac

SEQ ID NO: 207013 - DNA, 39 bp, Artificial Sequence
  Description of Artificial Sequence: Synthetic oligonucleotide
cctctggaagtctttccctttggaaaagcagtaaattac

SEQ ID NO: 207014 - DNA, 40 bp, Artificial Sequence
  Description of Artificial Sequence: Synthetic oligonucleotide
ctctggaagtctttccctttggaaaagcagtaaattacac

SEQ ID NO: 207015 - DNA, 42 bp, Artificial Sequence
  Description of Artificial Sequence: Synthetic oligonucleotide
tctggaagtctttccctttggaaaagcagtaaattacacatg

SEQ ID NO: 207016 - DNA, 41 bp, Artificial Sequence
  Description of Artificial Sequence: Synthetic oligonucleotide
ctggaagtctttccctttggaaaagcagtaaattacacatg

SEQ ID NO: 207017 - DNA, 41 bp, Artificial Sequence
  Description of Artificial Sequence: Synthetic oligonucleotide
tggaagtctttccctttggaaaagcagtaaattacacatgc

SEQ ID NO: 207018 - DNA, 40 bp, Artificial Sequence
  Description of Artificial Sequence: Synthetic oligonucleotide
ggaagtctttccctttggaaaagcagtaaattacacatgc

SEQ ID NO: 207019 - DNA, 40 bp, Artificial Sequence
  Description of Artificial Sequence: Synthetic oligonucleotide
gaagtctttccctttggaaaagcagtaaattacacatgcg

SEQ ID NO: 207020 - DNA, 41 bp, Artificial Sequence
  Description of Artificial Sequence: Synthetic oligonucleotide
aagtctttccctttggaaaagcagtaaattacacatgcgac

SEQ ID NO: 207021 - DNA, 40 bp, Artificial Sequence
  Description of Artificial Sequence: Synthetic oligonucleotide
agtctttccctttggaaaagcagtaaattacacatgcgac

SEQ ID NO: 207022 - DNA, 39 bp, Artificial Sequence
  Description of Artificial Sequence: Synthetic oligonucleotide
gtctttccctttggaaaagcagtaaattacacatgcgac

SEQ ID NO: 207023 - DNA, 39 bp, Artificial Sequence
  Description of Artificial Sequence: Synthetic oligonucleotide
tctttccctttggaaaagcagtaaattacacatgcgacc

SEQ ID NO: 207024 - DNA, 38 bp, Artificial Sequence
  Description of Artificial Sequence: Synthetic oligonucleotide
ctttccctttggaaaagcagtaaattacacatgcgacc

SEQ ID NO: 207025 - DNA, 38 bp, Artificial Sequence
  Description of Artificial Sequence: Synthetic oligonucleotide
tttccctttggaaaagcagtaaattacacatgcgaccc

SEQ ID NO: 207026 - DNA, 37 bp, Artificial Sequence
  Description of Artificial Sequence: Synthetic oligonucleotide
ttccctttggaaaagcagtaaattacacatgcgaccc

SEQ ID NO: 207027 - DNA, 36 bp, Artificial Sequence
  Description of Artificial Sequence: Synthetic oligonucleotide
tccctttggaaaagcagtaaattacacatgcgaccc

SEQ ID NO: 207028 - DNA, 35 bp, Artificial Sequence
  Description of Artificial Sequence: Synthetic oligonucleotide
ccctttggaaaagcagtaaattacacatgcgaccc

SEQ ID NO: 207029 - DNA, 35 bp, Artificial Sequence
  Description of Artificial Sequence: Synthetic oligonucleotide
cctttggaaaagcagtaaattacacatgcgacccc

SEQ ID NO: 207030 - DNA, 35 bp, Artificial Sequence
  Description of Artificial Sequence: Synthetic oligonucleotide
ctttggaaaagcagtaaattacacatgcgaccccc

SEQ ID NO: 207031 - DNA, 36 bp, Artificial Sequence
  Description of Artificial Sequence: Synthetic oligonucleotide
tttggaaaagcagtaaattacacatgcgacccccac

SEQ ID NO: 207032 - DNA, 35 bp, Artificial Sequence
  Description of Artificial Sequence: Synthetic oligonucleotide
ttggaaaagcagtaaattacacatgcgacccccac

SEQ ID NO: 207033 - DNA, 34 bp, Artificial Sequence
  Description of Artificial Sequence: Synthetic oligonucleotide
tggaaaagcagtaaattacacatgcgacccccac

SEQ ID NO: 207034 - DNA, 33 bp, Artificial Sequence
  Description of Artificial Sequence: Synthetic oligonucleotide
ggaaaagcagtaaattacacatgcgacccccac

SEQ ID NO: 207035 - DNA, 33 bp, Artificial Sequence
  Description of Artificial Sequence: Synthetic oligonucleotide
gaaaagcagtaaattacacatgcgacccccacc

SEQ ID NO: 207036 - DNA, 33 bp, Artificial Sequence
  Description of Artificial Sequence: Synthetic oligonucleotide
aaaagcagtaaattacacatgcgacccccaccc

SEQ ID NO: 207037 - DNA, 32 bp, Artificial Sequence
  Description of Artificial Sequence: Synthetic oligonucleotide
aaagcagtaaattacacatgcgacccccaccc

SEQ ID NO: 207038 - DNA, 31 bp, Artificial Sequence
  Description of Artificial Sequence: Synthetic oligonucleotide
aagcagtaaattacacatgcgacccccaccc

SEQ ID NO: 207039 - DNA, 30 bp, Artificial Sequence
  Description of Artificial Sequence: Synthetic oligonucleotide
agcagtaaattacacatgcgacccccaccc

SEQ ID NO: 207040 - DNA, 29 bp, Artificial Sequence
  Description of Artificial Sequence: Synthetic oligonucleotide
gcagtaaattacacatgcgacccccaccc

SEQ ID NO: 207041 - DNA, 37 bp, Artificial Sequence
  Description of Artificial Sequence: Synthetic oligonucleotide
gttggatccagaatcaactattcttgtactacagggg

SEQ ID NO: 207042 - DNA, 37 bp, Artificial Sequence
  Description of Artificial Sequence: Synthetic oligonucleotide
ttggatccagaatcaactattcttgtactacaggggc

SEQ ID NO: 207043 - DNA, 36 bp, Artificial Sequence
  Description of Artificial Sequence: Synthetic oligonucleotide
tggatccagaatcaactattcttgtactacaggggc

SEQ ID NO: 207044 - DNA, 35 bp, Artificial Sequence
  Description of Artificial Sequence: Synthetic oligonucleotide
ggatccagaatcaactattcttgtactacaggggc

SEQ ID NO: 207045 - DNA, 36 bp, Artificial Sequence
  Description of Artificial Sequence: Synthetic oligonucleotide
gatccagaatcaactattcttgtactacaggggcac

SEQ ID NO: 207046 - DNA, 36 bp, Artificial Sequence
  Description of Artificial Sequence: Synthetic oligonucleotide
atccagaatcaactattcttgtactacaggggcacc

SEQ ID NO: 207047 - DNA, 35 bp, Artificial Sequence
  Description of Artificial Sequence: Synthetic oligonucleotide
tccagaatcaactattcttgtactacaggggcacc

SEQ ID NO: 207048 - DNA, 34 bp, Artificial Sequence
  Description of Artificial Sequence: Synthetic oligonucleotide
ccagaatcaactattcttgtactacaggggcacc

SEQ ID NO: 207049 - DNA, 34 bp, Artificial Sequence
  Description of Artificial Sequence: Synthetic oligonucleotide
cagaatcaactattcttgtactacaggggcaccg

SEQ ID NO: 207050 - DNA, 35 bp, Artificial Sequence
  Description of Artificial Sequence: Synthetic oligonucleotide
agaatcaactattcttgtactacaggggcaccgac

SEQ ID NO: 207051 - DNA, 34 bp, Artificial Sequence
  Description of Artificial Sequence: Synthetic oligonucleotide
gaatcaactattcttgtactacaggggcaccgac

SEQ ID NO: 207052 - DNA, 35 bp, Artificial Sequence
  Description of Artificial Sequence: Synthetic oligonucleotide
aatcaactattcttgtactacaggggcaccgactc

SEQ ID NO: 207053 - DNA, 34 bp, Artificial Sequence
  Description of Artificial Sequence: Synthetic oligonucleotide
atcaactattcttgtactacaggggcaccgactc

SEQ ID NO: 207054 - DNA, 33 bp, Artificial Sequence
  Description of Artificial Sequence: Synthetic oligonucleotide
tcaactattcttgtactacaggggcaccgactc

SEQ ID NO: 207055 - DNA, 32 bp, Artificial Sequence
  Description of Artificial Sequence: Synthetic oligonucleotide
caactattcttgtactacaggggcaccgactc

SEQ ID NO: 207056 - DNA, 35 bp, Artificial Sequence
  Description of Artificial Sequence: Synthetic oligonucleotide
aactattcttgtactacaggggcaccgactcattg

SEQ ID NO: 207057 - DNA, 34 bp, Artificial Sequence
  Description of Artificial Sequence: Synthetic oligonucleotide
actattcttgtactacaggggcaccgactcattg

SEQ ID NO: 207058 - DNA, 33 bp, Artificial Sequence
  Description of Artificial Sequence: Synthetic oligonucleotide
ctattcttgtactacaggggcaccgactcattg

SEQ ID NO: 207059 - DNA, 33 bp, Artificial Sequence
  Description of Artificial Sequence: Synthetic oligonucleotide
tattcttgtactacaggggcaccgactcattgg

SEQ ID NO: 207060 - DNA, 32 bp, Artificial Sequence
  Description of Artificial Sequence: Synthetic oligonucleotide
attcttgtactacaggggcaccgactcattgg

SEQ ID NO: 207061 - DNA, 31 bp, Artificial Sequence
  Description of Artificial Sequence: Synthetic oligonucleotide
ttcttgtactacaggggcaccgactcattgg

SEQ ID NO: 207062 - DNA, 30 bp, Artificial Sequence
  Description of Artificial Sequence: Synthetic oligonucleotide
tcttgtactacaggggcaccgactcattgg

SEQ ID NO: 207063 - DNA, 29 bp, Artificial Sequence
  Description of Artificial Sequence: Synthetic oligonucleotide
cttgtactacaggggcaccgactcattgg

SEQ ID NO: 207064 - DNA, 30 bp, Artificial Sequence
  Description of Artificial Sequence: Synthetic oligonucleotide
ttgtactacaggggcaccgactcattggtc

SEQ ID NO: 207065 - DNA, 29 bp, Artificial Sequence
  Description of Artificial Sequence: Synthetic oligonucleotide
tgtactacaggggcaccgactcattggtc

SEQ ID NO: 207066 - DNA, 28 bp, Artificial Sequence
  Description of Artificial Sequence: Synthetic oligonucleotide
gtactacaggggcaccgactcattggtc

SEQ ID NO: 207067 - DNA, 29 bp, Artificial Sequence
  Description of Artificial Sequence: Synthetic oligonucleotide
tactacaggggcaccgactcattggtcac

SEQ ID NO: 207068 - DNA, 28 bp, Artificial Sequence
  Description of Artificial Sequence: Synthetic oligonucleotide
actacaggggcaccgactcattggtcac

SEQ ID NO: 207069 - DNA, 27 bp, Artificial Sequence
  Description of Artificial Sequence: Synthetic oligonucleotide
ctacaggggcaccgactcattggtcac

SEQ ID NO: 207070 - DNA, 28 bp, Artificial Sequence
  Description of Artificial Sequence: Synthetic oligonucleotide
tacaggggcaccgactcattggtcactc

SEQ ID NO: 207071 - DNA, 27 bp, Artificial Sequence
  Description of Artificial Sequence: Synthetic oligonucleotide
acaggggcaccgactcattggtcactc

SEQ ID NO: 207072 - DNA, 27 bp, Artificial Sequence
  Description of Artificial Sequence: Synthetic oligonucleotide
caggggcaccgactcattggtcactca

SEQ ID NO: 207073 - DNA, 28 bp, Artificial Sequence
  Description of Artificial Sequence: Synthetic oligonucleotide
aggggcaccgactcattggtcactcatc

SEQ ID NO: 207074 - DNA, 27 bp, Artificial Sequence
  Description of Artificial Sequence: Synthetic oligonucleotide
ggggcaccgactcattggtcactcatc

SEQ ID NO: 207075 - DNA, 36 bp, Artificial Sequence
  Description of Artificial Sequence: Synthetic oligonucleotide
tcattggtcactcatctgctgaatgtatcctctcag

SEQ ID NO: 207076 - DNA, 35 bp, Artificial Sequence
  Description of Artificial Sequence: Synthetic oligonucleotide
cattggtcactcatctgctgaatgtatcctctcag

SEQ ID NO: 207077 - DNA, 35 bp, Artificial Sequence
  Description of Artificial Sequence: Synthetic oligonucleotide
attggtcactcatctgctgaatgtatcctctcagg

SEQ ID NO: 207078 - DNA, 34 bp, Artificial Sequence
  Description of Artificial Sequence: Synthetic oligonucleotide
ttggtcactcatctgctgaatgtatcctctcagg

SEQ ID NO: 207079 - DNA, 33 bp, Artificial Sequence
  Description of Artificial Sequence: Synthetic oligonucleotide
tggtcactcatctgctgaatgtatcctctcagg

SEQ ID NO: 207080 - DNA, 32 bp, Artificial Sequence
  Description of Artificial Sequence: Synthetic oligonucleotide
ggtcactcatctgctgaatgtatcctctcagg

SEQ ID NO: 207081 - DNA, 32 bp, Artificial Sequence
  Description of Artificial Sequence: Synthetic oligonucleotide
gtcactcatctgctgaatgtatcctctcaggc

SEQ ID NO: 207082 - DNA, 36 bp, Artificial Sequence
  Description of Artificial Sequence: Synthetic oligonucleotide
tcactcatctgctgaatgtatcctctcaggcaatac

SEQ ID NO: 207083 - DNA, 35 bp, Artificial Sequence
  Description of Artificial Sequence: Synthetic oligonucleotide
cactcatctgctgaatgtatcctctcaggcaatac

SEQ ID NO: 207084 - DNA, 36 bp, Artificial Sequence
  Description of Artificial Sequence: Synthetic oligonucleotide
actcatctgctgaatgtatcctctcaggcaatactg

SEQ ID NO: 207085 - DNA, 35 bp, Artificial Sequence
  Description of Artificial Sequence: Synthetic oligonucleotide
ctcatctgctgaatgtatcctctcaggcaatactg

SEQ ID NO: 207086 - DNA, 35 bp, Artificial Sequence
  Description of Artificial Sequence: Synthetic oligonucleotide
tcatctgctgaatgtatcctctcaggcaatactgc

SEQ ID NO: 207087 - DNA, 34 bp, Artificial Sequence
  Description of Artificial Sequence: Synthetic oligonucleotide
catctgctgaatgtatcctctcaggcaatactgc

SEQ ID NO: 207088 - DNA, 34 bp, Artificial Sequence
  Description of Artificial Sequence: Synthetic oligonucleotide
atctgctgaatgtatcctctcaggcaatactgcc

SEQ ID NO: 207089 - DNA, 33 bp, Artificial Sequence
  Description of Artificial Sequence: Synthetic oligonucleotide
tctgctgaatgtatcctctcaggcaatactgcc

SEQ ID NO: 207090 - DNA, 32 bp, Artificial Sequence
  Description of Artificial Sequence: Synthetic oligonucleotide
ctgctgaatgtatcctctcaggcaatactgcc

SEQ ID NO: 207091 - DNA, 32 bp, Artificial Sequence
  Description of Artificial Sequence: Synthetic oligonucleotide
tgctgaatgtatcctctcaggcaatactgccc

SEQ ID NO: 207092 - DNA, 31 bp, Artificial Sequence
  Description of Artificial Sequence: Synthetic oligonucleotide
gctgaatgtatcctctcaggcaatactgccc

SEQ ID NO: 207093 - DNA, 34 bp, Artificial Sequence
  Description of Artificial Sequence: Synthetic oligonucleotide
ctgaatgtatcctctcaggcaatactgcccattg

SEQ ID NO: 207094 - DNA, 34 bp, Artificial Sequence
  Description of Artificial Sequence: Synthetic oligonucleotide
tgaatgtatcctctcaggcaatactgcccattgg

SEQ ID NO: 207095 - DNA, 33 bp, Artificial Sequence
  Description of Artificial Sequence: Synthetic oligonucleotide
gaatgtatcctctcaggcaatactgcccattgg

SEQ ID NO: 207096 - DNA, 34 bp, Artificial Sequence
  Description of Artificial Sequence: Synthetic oligonucleotide
aatgtatcctctcaggcaatactgcccattggag

SEQ ID NO: 207097 - DNA, 33 bp, Artificial Sequence
  Description of Artificial Sequence: Synthetic oligonucleotide
atgtatcctctcaggcaatactgcccattggag

SEQ ID NO: 207098 - DNA, 32 bp, Artificial Sequence
  Description of Artificial Sequence: Synthetic oligonucleotide
tgtatcctctcaggcaatactgcccattggag

SEQ ID NO: 207099 - DNA, 31 bp, Artificial Sequence
  Description of Artificial Sequence: Synthetic oligonucleotide
gtatcctctcaggcaatactgcccattggag

SEQ ID NO: 207100 - DNA, 31 bp, Artificial Sequence
  Description of Artificial Sequence: Synthetic oligonucleotide
tatcctctcaggcaatactgcccattggagc

SEQ ID NO: 207101 - DNA, 30 bp, Artificial Sequence
  Description of Artificial Sequence: Synthetic oligonucleotide
atcctctcaggcaatactgcccattggagc

SEQ ID NO: 207102 - DNA, 29 bp, Artificial Sequence
  Description of Artificial Sequence: Synthetic oligonucleotide
tcctctcaggcaatactgcccattggagc

SEQ ID NO: 207103 - DNA, 28 bp, Artificial Sequence
  Description of Artificial Sequence: Synthetic oligonucleotide
cctctcaggcaatactgcccattggagc

SEQ ID NO: 207104 - DNA, 29 bp, Artificial Sequence
  Description of Artificial Sequence: Synthetic oligonucleotide
ctctcaggcaatactgcccattggagcac

SEQ ID NO: 207105 - DNA, 29 bp, Artificial Sequence
  Description of Artificial Sequence: Synthetic oligonucleotide
tctcaggcaatactgcccattggagcacg

SEQ ID NO: 207106 - DNA, 28 bp, Artificial Sequence
  Description of Artificial Sequence: Synthetic oligonucleotide
ctcaggcaatactgcccattggagcacg

SEQ ID NO: 207107 - DNA, 30 bp, Artificial Sequence
  Description of Artificial Sequence: Synthetic oligonucleotide
tcaggcaatactgcccattggagcacgaag

SEQ ID NO: 207108 - DNA, 29 bp, Artificial Sequence
  Description of Artificial Sequence: Synthetic oligonucleotide
caggcaatactgcccattggagcacgaag

SEQ ID NO: 207109 - DNA, 29 bp, Artificial Sequence
  Description of Artificial Sequence: Synthetic oligonucleotide
aggcaatactgcccattggagcacgaagc

SEQ ID NO: 207110 - DNA, 28 bp, Artificial Sequence
  Description of Artificial Sequence: Synthetic oligonucleotide
ggcaatactgcccattggagcacgaagc

SEQ ID NO: 207111 - DNA, 28 bp, Artificial Sequence
  Description of Artificial Sequence: Synthetic oligonucleotide
gcaatactgcccattggagcacgaagcc

SEQ ID NO: 207112 - DNA, 28 bp, Artificial Sequence
  Description of Artificial Sequence: Synthetic oligonucleotide
caatactgcccattggagcacgaagccg

SEQ ID NO: 207113 - DNA, 28 bp, Artificial Sequence
  Description of Artificial Sequence: Synthetic oligonucleotide
aatactgcccattggagcacgaagccgc

SEQ ID NO: 207114 - DNA, 27 bp, Artificial Sequence
  Description of Artificial Sequence: Synthetic oligonucleotide
atactgcccattggagcacgaagccgc

SEQ ID NO: 207115 - DNA, 26 bp, Artificial Sequence
  Description of Artificial Sequence: Synthetic oligonucleotide
tactgcccattggagcacgaagccgc

SEQ ID NO: 207116 - DNA, 25 bp, Artificial Sequence
  Description of Artificial Sequence: Synthetic oligonucleotide
actgcccattggagcacgaagccgc

SEQ ID NO: 207117 - DNA, 30 bp, Artificial Sequence
  Description of Artificial Sequence: Synthetic oligonucleotide
tcaacgaattccttgtgggctacccccaac

SEQ ID NO: 207118 - DNA, 29 bp, Artificial Sequence
  Description of Artificial Sequence: Synthetic oligonucleotide
caacgaattccttgtgggctacccccaac

SEQ ID NO: 207119 - DNA, 29 bp, Artificial Sequence
  Description of Artificial Sequence: Synthetic oligonucleotide
aacgaattccttgtgggctacccccaacc

SEQ ID NO: 207120 - DNA, 28 bp, Artificial Sequence
  Description of Artificial Sequence: Synthetic oligonucleotide
acgaattccttgtgggctacccccaacc

SEQ ID NO: 207121 - DNA, 27 bp, Artificial Sequence
  Description of Artificial Sequence: Synthetic oligonucleotide
cgaattccttgtgggctacccccaacc

SEQ ID NO: 207122 - DNA, 29 bp, Artificial Sequence
  Description of Artificial Sequence: Synthetic oligonucleotide
gaattccttgtgggctacccccaaccatc

SEQ ID NO: 207123 - DNA, 29 bp, Artificial Sequence
  Description of Artificial Sequence: Synthetic oligonucleotide
aattccttgtgggctacccccaaccatcg

SEQ ID NO: 207124 - DNA, 28 bp, Artificial Sequence
  Description of Artificial Sequence: Synthetic oligonucleotide
attccttgtgggctacccccaaccatcg

SEQ ID NO: 207125 - DNA, 27 bp, Artificial Sequence
  Description of Artificial Sequence: Synthetic oligonucleotide
ttccttgtgggctacccccaaccatcg

SEQ ID NO: 207126 - DNA, 26 bp, Artificial Sequence
  Description of Artificial Sequence: Synthetic oligonucleotide
tccttgtgggctacccccaaccatcg

SEQ ID NO: 207127 - DNA, 25 bp, Artificial Sequence
  Description of Artificial Sequence: Synthetic oligonucleotide
ccttgtgggctacccccaaccatcg

SEQ ID NO: 207128 - DNA, 25 bp, Artificial Sequence
  Description of Artificial Sequence: Synthetic oligonucleotide
cttgtgggctacccccaaccatcgc

SEQ ID NO: 207129 - DNA, 27 bp, Artificial Sequence
  Description of Artificial Sequence: Synthetic oligonucleotide
ttgtgggctacccccaaccatcgccaa

SEQ ID NO: 207130 - DNA, 27 bp, Artificial Sequence
  Description of Artificial Sequence: Synthetic oligonucleotide
tgtgggctacccccaaccatcgccaat

SEQ ID NO: 207131 - DNA, 26 bp, Artificial Sequence
  Description of Artificial Sequence: Synthetic oligonucleotide
gtgggctacccccaaccatcgccaat

SEQ ID NO: 207132 - DNA, 26 bp, Artificial Sequence
  Description of Artificial Sequence: Synthetic oligonucleotide
tgggctacccccaaccatcgccaatg

SEQ ID NO: 207133 - DNA, 25 bp, Artificial Sequence
  Description of Artificial Sequence: Synthetic oligonucleotide
gggctacccccaaccatcgccaatg

SEQ ID NO: 207134 - DNA, 26 bp, Artificial Sequence
  Description of Artificial Sequence: Synthetic oligonucleotide
ggctacccccaaccatcgccaatgga

SEQ ID NO: 207135 - DNA, 27 bp, Artificial Sequence
  Description of Artificial Sequence: Synthetic oligonucleotide
gctacccccaaccatcgccaatggaga

SEQ ID NO: 207136 - DNA, 30 bp, Artificial Sequence
  Description of Artificial Sequence: Synthetic oligonucleotide
ctacccccaaccatcgccaatggagatttc

SEQ ID NO: 207137 - DNA, 34 bp, Artificial Sequence
  Description of Artificial Sequence: Synthetic oligonucleotide
tacccccaaccatcgccaatggagatttcattag

SEQ ID NO: 207138 - DNA, 33 bp, Artificial Sequence
  Description of Artificial Sequence: Synthetic oligonucleotide
acccccaaccatcgccaatggagatttcattag

SEQ ID NO: 207139 - DNA, 32 bp, Artificial Sequence
  Description of Artificial Sequence: Synthetic oligonucleotide
cccccaaccatcgccaatggagatttcattag

SEQ ID NO: 207140 - DNA, 32 bp, Artificial Sequence
  Description of Artificial Sequence: Synthetic oligonucleotide
ccccaaccatcgccaatggagatttcattagc

SEQ ID NO: 207141 - DNA, 33 bp, Artificial Sequence
  Description of Artificial Sequence: Synthetic oligonucleotide
cccaaccatcgccaatggagatttcattagcac

SEQ ID NO: 207142 - DNA, 33 bp, Artificial Sequence
  Description of Artificial Sequence: Synthetic oligonucleotide
ccaaccatcgccaatggagatttcattagcacc

SEQ ID NO: 207143 - DNA, 35 bp, Artificial Sequence
  Description of Artificial Sequence: Synthetic oligonucleotide
caaccatcgccaatggagatttcattagcaccaac

SEQ ID NO: 207144 - DNA, 36 bp, Artificial Sequence
  Description of Artificial Sequence: Synthetic oligonucleotide
aaccatcgccaatggagatttcattagcaccaacag

SEQ ID NO: 207145 - DNA, 30 bp, Artificial Sequence
  Description of Artificial Sequence: Synthetic oligonucleotide
gatcagtggtgacctaccgctgcaatcttg

SEQ ID NO: 207146 - DNA, 30 bp, Artificial Sequence
  Description of Artificial Sequence: Synthetic oligonucleotide
atcagtggtgacctaccgctgcaatcttgg

SEQ ID NO: 207147 - DNA, 29 bp, Artificial Sequence
  Description of Artificial Sequence: Synthetic oligonucleotide
tcagtggtgacctaccgctgcaatcttgg

SEQ ID NO: 207148 - DNA, 28 bp, Artificial Sequence
  Description of Artificial Sequence: Synthetic oligonucleotide
cagtggtgacctaccgctgcaatcttgg

SEQ ID NO: 207149 - DNA, 30 bp, Artificial Sequence
  Description of Artificial Sequence: Synthetic oligonucleotide
agtggtgacctaccgctgcaatcttggaag

SEQ ID NO: 207150 - DNA, 29 bp, Artificial Sequence
  Description of Artificial Sequence: Synthetic oligonucleotide
gtggtgacctaccgctgcaatcttggaag

SEQ ID NO: 207151 - DNA, 29 bp, Artificial Sequence
  Description of Artificial Sequence: Synthetic oligonucleotide
tggtgacctaccgctgcaatcttggaagc

SEQ ID NO: 207152 - DNA, 28 bp, Artificial Sequence
  Description of Artificial Sequence: Synthetic oligonucleotide
ggtgacctaccgctgcaatcttggaagc

SEQ ID NO: 207153 - DNA, 29 bp, Artificial Sequence
  Description of Artificial Sequence: Synthetic oligonucleotide
gtgacctaccgctgcaatcttggaagcag

SEQ ID NO: 207154 - DNA, 30 bp, Artificial Sequence
  Description of Artificial Sequence: Synthetic oligonucleotide
tgacctaccgctgcaatcttggaagcagag

SEQ ID NO: 207155 - DNA, 29 bp, Artificial Sequence
  Description of Artificial Sequence: Synthetic oligonucleotide
gacctaccgctgcaatcttggaagcagag

SEQ ID NO: 207156 - DNA, 29 bp, Artificial Sequence
  Description of Artificial Sequence: Synthetic oligonucleotide
acctaccgctgcaatcttggaagcagagg

SEQ ID NO: 207157 - DNA, 28 bp, Artificial Sequence
  Description of Artificial Sequence: Synthetic oligonucleotide
cctaccgctgcaatcttggaagcagagg

SEQ ID NO: 207158 - DNA, 28 bp, Artificial Sequence
  Description of Artificial Sequence: Synthetic oligonucleotide
ctaccgctgcaatcttggaagcagaggg

SEQ ID NO: 207159 - DNA, 29 bp, Artificial Sequence
  Description of Artificial Sequence: Synthetic oligonucleotide
taccgctgcaatcttggaagcagagggag

SEQ ID NO: 207160 - DNA, 28 bp, Artificial Sequence
  Description of Artificial Sequence: Synthetic oligonucleotide
accgctgcaatcttggaagcagagggag

SEQ ID NO: 207161 - DNA, 27 bp, Artificial Sequence
  Description of Artificial Sequence: Synthetic oligonucleotide
ccgctgcaatcttggaagcagagggag

SEQ ID NO: 207162 - DNA, 30 bp, Artificial Sequence
  Description of Artificial Sequence: Synthetic oligonucleotide
cgctgcaatcttggaagcagagggagaaag

SEQ ID NO: 207163 - DNA, 30 bp, Artificial Sequence
  Description of Artificial Sequence: Synthetic oligonucleotide
gctgcaatcttggaagcagagggagaaagg

SEQ ID NO: 207164 - DNA, 31 bp, Artificial Sequence
  Description of Artificial Sequence: Synthetic oligonucleotide
ctgcaatcttggaagcagagggagaaaggtg

SEQ ID NO: 207165 - DNA, 34 bp, Artificial Sequence
  Description of Artificial Sequence: Synthetic oligonucleotide
tgcaatcttggaagcagagggagaaaggtgtttg

SEQ ID NO: 207166 - DNA, 33 bp, Artificial Sequence
  Description of Artificial Sequence: Synthetic oligonucleotide
gcaatcttggaagcagagggagaaaggtgtttg

SEQ ID NO: 207167 - DNA, 34 bp, Artificial Sequence
  Description of Artificial Sequence: Synthetic oligonucleotide
caatcttggaagcagagggagaaaggtgtttgag

SEQ ID NO: 207168 - DNA, 34 bp, Artificial Sequence
  Description of Artificial Sequence: Synthetic oligonucleotide
aatcttggaagcagagggagaaaggtgtttgagc

SEQ ID NO: 207169 - DNA, 33 bp, Artificial Sequence
  Description of Artificial Sequence: Synthetic oligonucleotide
atcttggaagcagagggagaaaggtgtttgagc

SEQ ID NO: 207170 - DNA, 32 bp, Artificial Sequence
  Description of Artificial Sequence: Synthetic oligonucleotide
tcttggaagcagagggagaaaggtgtttgagc

SEQ ID NO: 207171 - DNA, 31 bp, Artificial Sequence
  Description of Artificial Sequence: Synthetic oligonucleotide
cttggaagcagagggagaaaggtgtttgagc

SEQ ID NO: 207172 - DNA, 33 bp, Artificial Sequence
  Description of Artificial Sequence: Synthetic oligonucleotide
ttggaagcagagggagaaaggtgtttgagcttg

SEQ ID NO: 207173 - DNA, 32 bp, Artificial Sequence
  Description of Artificial Sequence: Synthetic oligonucleotide
tggaagcagagggagaaaggtgtttgagcttg

SEQ ID NO: 207174 - DNA, 31 bp, Artificial Sequence
  Description of Artificial Sequence: Synthetic oligonucleotide
ggaagcagagggagaaaggtgtttgagcttg

SEQ ID NO: 207175 - DNA, 32 bp, Artificial Sequence
  Description of Artificial Sequence: Synthetic oligonucleotide
gaagcagagggagaaaggtgtttgagcttgtg

SEQ ID NO: 207176 - DNA, 32 bp, Artificial Sequence
  Description of Artificial Sequence: Synthetic oligonucleotide
aagcagagggagaaaggtgtttgagcttgtgg

SEQ ID NO: 207177 - DNA, 31 bp, Artificial Sequence
  Description of Artificial Sequence: Synthetic oligonucleotide
agcagagggagaaaggtgtttgagcttgtgg

SEQ ID NO: 207178 - DNA, 30 bp, Artificial Sequence
  Description of Artificial Sequence: Synthetic oligonucleotide
gcagagggagaaaggtgtttgagcttgtgg

SEQ ID NO: 207179 - DNA, 30 bp, Artificial Sequence
  Description of Artificial Sequence: Synthetic oligonucleotide
cagagggagaaaggtgtttgagcttgtggg

SEQ ID NO: 207180 - DNA, 31 bp, Artificial Sequence
  Description of Artificial Sequence: Synthetic oligonucleotide
agagggagaaaggtgtttgagcttgtgggtg

SEQ ID NO: 207181 - DNA, 27 bp, Artificial Sequence
  Description of Artificial Sequence: Synthetic oligonucleotide
tgccaggccctgaacaaatgggagcca

SEQ ID NO: 207182 - DNA, 26 bp, Artificial Sequence
  Description of Artificial Sequence: Synthetic oligonucleotide
gccaggccctgaacaaatgggagcca

SEQ ID NO: 207183 - DNA, 27 bp, Artificial Sequence
  Description of Artificial Sequence: Synthetic oligonucleotide
ccaggccctgaacaaatgggagccaga

SEQ ID NO: 207184 - DNA, 27 bp, Artificial Sequence
  Description of Artificial Sequence: Synthetic oligonucleotide
caggccctgaacaaatgggagccagag

SEQ ID NO: 207185 - DNA, 30 bp, Artificial Sequence
  Description of Artificial Sequence: Synthetic oligonucleotide
aggccctgaacaaatgggagccagagttac

SEQ ID NO: 207186 - DNA, 29 bp, Artificial Sequence
  Description of Artificial Sequence: Synthetic oligonucleotide
ggccctgaacaaatgggagccagagttac

SEQ ID NO: 207187 - DNA, 29 bp, Artificial Sequence
  Description of Artificial Sequence: Synthetic oligonucleotide
gccctgaacaaatgggagccagagttacc

SEQ ID NO: 207188 - DNA, 31 bp, Artificial Sequence
  Description of Artificial Sequence: Synthetic oligonucleotide
ccctgaacaaatgggagccagagttaccaag

SEQ ID NO: 207189 - DNA, 31 bp, Artificial Sequence
  Description of Artificial Sequence: Synthetic oligonucleotide
cctgaacaaatgggagccagagttaccaagc

SEQ ID NO: 207190 - DNA, 32 bp, Artificial Sequence
  Description of Artificial Sequence: Synthetic oligonucleotide
ctgaacaaatgggagccagagttaccaagctg

SEQ ID NO: 207191 - DNA, 32 bp, Artificial Sequence
  Description of Artificial Sequence: Synthetic oligonucleotide
tgaacaaatgggagccagagttaccaagctgc

SEQ ID NO: 207192 - DNA, 31 bp, Artificial Sequence
  Description of Artificial Sequence: Synthetic oligonucleotide
gaacaaatgggagccagagttaccaagctgc

SEQ ID NO: 207193 - DNA, 32 bp, Artificial Sequence
  Description of Artificial Sequence: Synthetic oligonucleotide
aacaaatgggagccagagttaccaagctgctc

SEQ ID NO: 207194 - DNA, 31 bp, Artificial Sequence
  Description of Artificial Sequence: Synthetic oligonucleotide
acaaatgggagccagagttaccaagctgctc

SEQ ID NO: 207195 - DNA, 30 bp, Artificial Sequence
  Description of Artificial Sequence: Synthetic oligonucleotide
caaatgggagccagagttaccaagctgctc

SEQ ID NO: 207196 - DNA, 30 bp, Artificial Sequence
  Description of Artificial Sequence: Synthetic oligonucleotide
aaatgggagccagagttaccaagctgctcc

SEQ ID NO: 207197 - DNA, 29 bp, Artificial Sequence
  Description of Artificial Sequence: Synthetic oligonucleotide
aatgggagccagagttaccaagctgctcc

SEQ ID NO: 207198 - DNA, 28 bp, Artificial Sequence
  Description of Artificial Sequence: Synthetic oligonucleotide
atgggagccagagttaccaagctgctcc

SEQ ID NO: 207199 - DNA, 27 bp, Artificial Sequence
  Description of Artificial Sequence: Synthetic oligonucleotide
tgggagccagagttaccaagctgctcc

SEQ ID NO: 207200 - DNA, 27 bp, Artificial Sequence
  Description of Artificial Sequence: Synthetic oligonucleotide
gggagccagagttaccaagctgctcca

SEQ ID NO: 207201 - DNA, 27 bp, Artificial Sequence
  Description of Artificial Sequence: Synthetic oligonucleotide
ggagccagagttaccaagctgctccag

SEQ ID NO: 207202 - DNA, 27 bp, Artificial Sequence
  Description of Artificial Sequence: Synthetic oligonucleotide
gagccagagttaccaagctgctccagg

SEQ ID NO: 207203 - DNA, 27 bp, Artificial Sequence
  Description of Artificial Sequence: Synthetic oligonucleotide
agccagagttaccaagctgctccaggg

SEQ ID NO: 207204 - DNA, 27 bp, Artificial Sequence
  Description of Artificial Sequence: Synthetic oligonucleotide
gccagagttaccaagctgctccagggt

SEQ ID NO: 207205 - DNA, 27 bp, Artificial Sequence
  Description of Artificial Sequence: Synthetic oligonucleotide
ccagagttaccaagctgctccagggtg

SEQ ID NO: 207206 - DNA, 28 bp, Artificial Sequence
  Description of Artificial Sequence: Synthetic oligonucleotide
cagagttaccaagctgctccagggtgtg

SEQ ID NO: 207207 - DNA, 29 bp, Artificial Sequence
  Description of Artificial Sequence: Synthetic oligonucleotide
agagttaccaagctgctccagggtgtgtc

SEQ ID NO: 207208 - DNA, 28 bp, Artificial Sequence
  Description of Artificial Sequence: Synthetic oligonucleotide
gagttaccaagctgctccagggtgtgtc

SEQ ID NO: 207209 - DNA, 29 bp, Artificial Sequence
  Description of Artificial Sequence: Synthetic oligonucleotide
agttaccaagctgctccagggtgtgtcag

SEQ ID NO: 207210 - DNA, 28 bp, Artificial Sequence
  Description of Artificial Sequence: Synthetic oligonucleotide
gttaccaagctgctccagggtgtgtcag

SEQ ID NO: 207211 - DNA, 28 bp, Artificial Sequence
  Description of Artificial Sequence: Synthetic oligonucleotide
ttaccaagctgctccagggtgtgtcagc

SEQ ID NO: 207212 - DNA, 27 bp, Artificial Sequence
  Description of Artificial Sequence: Synthetic oligonucleotide
taccaagctgctccagggtgtgtcagc

SEQ ID NO: 207213 - DNA, 26 bp, Artificial Sequence
  Description of Artificial Sequence: Synthetic oligonucleotide
accaagctgctccagggtgtgtcagc

SEQ ID NO: 207214 - DNA, 25 bp, Artificial Sequence
  Description of Artificial Sequence: Synthetic oligonucleotide
ccaagctgctccagggtgtgtcagc

SEQ ID NO: 207215 - DNA, 25 bp, Artificial Sequence
  Description of Artificial Sequence: Synthetic oligonucleotide
caagctgctccagggtgtgtcagcc

SEQ ID NO: 207216 - DNA, 25 bp, Artificial Sequence
  Description of Artificial Sequence: Synthetic oligonucleotide
aagctgctccagggtgtgtcagccg

SEQ ID NO: 207217 - DNA, 24 bp, Artificial Sequence
  Description of Artificial Sequence: Synthetic oligonucleotide
agctgctccagggtgtgtcagccg

SEQ ID NO: 207218 - DNA, 23 bp, Artificial Sequence
  Description of Artificial Sequence: Synthetic oligonucleotide
gctgctccagggtgtgtcagccg

SEQ ID NO: 207219 - DNA, 23 bp, Artificial Sequence
  Description of Artificial Sequence: Synthetic oligonucleotide
ctgctccagggtgtgtcagccgc

SEQ ID NO: 207220 - DNA, 24 bp, Artificial Sequence
  Description of Artificial Sequence: Synthetic oligonucleotide
tgctccagggtgtgtcagccgcct

SEQ ID NO: 207221 - DNA, 23 bp, Artificial Sequence
  Description of Artificial Sequence: Synthetic oligonucleotide
gctccagggtgtgtcagccgcct

SEQ ID NO: 207222 - DNA, 23 bp, Artificial Sequence
  Description of Artificial Sequence: Synthetic oligonucleotide
ctccagggtgtgtcagccgcctc

SEQ ID NO: 207223 - DNA, 24 bp, Artificial Sequence
  Description of Artificial Sequence: Synthetic oligonucleotide
tccagggtgtgtcagccgcctcca

SEQ ID NO: 207224 - DNA, 23 bp, Artificial Sequence
  Description of Artificial Sequence: Synthetic oligonucleotide
ccagggtgtgtcagccgcctcca

SEQ ID NO: 207225 - DNA, 27 bp, Artificial Sequence
  Description of Artificial Sequence: Synthetic oligonucleotide
cagggtgtgtcagccgcctccagaaat

SEQ ID NO: 207226 - DNA, 27 bp, Artificial Sequence
  Description of Artificial Sequence: Synthetic oligonucleotide
agggtgtgtcagccgcctccagaaatc

SEQ ID NO: 207227 - DNA, 26 bp, Artificial Sequence
  Description of Artificial Sequence: Synthetic oligonucleotide
gggtgtgtcagccgcctccagaaatc

SEQ ID NO: 207228 - DNA, 27 bp, Artificial Sequence
  Description of Artificial Sequence: Synthetic oligonucleotide
ggtgtgtcagccgcctccagaaatcct

SEQ ID NO: 207229 - DNA, 27 bp, Artificial Sequence
  Description of Artificial Sequence: Synthetic oligonucleotide
gtgtgtcagccgcctccagaaatcctg

SEQ ID NO: 207230 - DNA, 27 bp, Artificial Sequence
  Description of Artificial Sequence: Synthetic oligonucleotide
tgtgtcagccgcctccagaaatcctgc

SEQ ID NO: 207231 - DNA, 27 bp, Artificial Sequence
  Description of Artificial Sequence: Synthetic oligonucleotide
gtgtcagccgcctccagaaatcctgca

SEQ ID NO: 207232 - DNA, 28 bp, Artificial Sequence
  Description of Artificial Sequence: Synthetic oligonucleotide
tgtcagccgcctccagaaatcctgcatg

SEQ ID NO: 207233 - DNA, 27 bp, Artificial Sequence
  Description of Artificial Sequence: Synthetic oligonucleotide
gtcagccgcctccagaaatcctgcatg

SEQ ID NO: 207234 - DNA, 27 bp, Artificial Sequence
  Description of Artificial Sequence: Synthetic oligonucleotide
tcagccgcctccagaaatcctgcatgg

SEQ ID NO: 207235 - DNA, 27 bp, Artificial Sequence
  Description of Artificial Sequence: Synthetic oligonucleotide
cagccgcctccagaaatcctgcatggt

SEQ ID NO: 207236 - DNA, 27 bp, Artificial Sequence
  Description of Artificial Sequence: Synthetic oligonucleotide
agccgcctccagaaatcctgcatggtg

SEQ ID NO: 207237 - DNA, 27 bp, Artificial Sequence
  Description of Artificial Sequence: Synthetic oligonucleotide
gccgcctccagaaatcctgcatggtga

SEQ ID NO: 207238 - DNA, 27 bp, Artificial Sequence
  Description of Artificial Sequence: Synthetic oligonucleotide
ccgcctccagaaatcctgcatggtgag

SEQ ID NO: 207239 - DNA, 27 bp, Artificial Sequence
  Description of Artificial Sequence: Synthetic oligonucleotide
cgcctccagaaatcctgcatggtgagc

SEQ ID NO: 207240 - DNA, 30 bp, Artificial Sequence
  Description of Artificial Sequence: Synthetic oligonucleotide
gcctccagaaatcctgcatggtgagcatac

SEQ ID NO: 207241 - DNA, 30 bp, Artificial Sequence
  Description of Artificial Sequence: Synthetic oligonucleotide
cctccagaaatcctgcatggtgagcatacc

SEQ ID NO: 207242 - DNA, 30 bp, Artificial Sequence
  Description of Artificial Sequence: Synthetic oligonucleotide
ctccagaaatcctgcatggtgagcataccc

SEQ ID NO: 207243 - DNA, 30 bp, Artificial Sequence
  Description of Artificial Sequence: Synthetic oligonucleotide
tccagaaatcctgcatggtgagcatacccc

SEQ ID NO: 207244 - DNA, 29 bp, Artificial Sequence
  Description of Artificial Sequence: Synthetic oligonucleotide
ccagaaatcctgcatggtgagcatacccc

SEQ ID NO: 207245 - DNA, 31 bp, Artificial Sequence
  Description of Artificial Sequence: Synthetic oligonucleotide
cagaaatcctgcatggtgagcataccccaag

SEQ ID NO: 207246 - DNA, 31 bp, Artificial Sequence
  Description of Artificial Sequence: Synthetic oligonucleotide
agaaatcctgcatggtgagcataccccaagc

SEQ ID NO: 207247 - DNA, 30 bp, Artificial Sequence
  Description of Artificial Sequence: Synthetic oligonucleotide
gaaatcctgcatggtgagcataccccaagc

SEQ ID NO: 207248 - DNA, 30 bp, Artificial Sequence
  Description of Artificial Sequence: Synthetic oligonucleotide
aaatcctgcatggtgagcataccccaagcc

SEQ ID NO: 207249 - DNA, 29 bp, Artificial Sequence
  Description of Artificial Sequence: Synthetic oligonucleotide
aatcctgcatggtgagcataccccaagcc

SEQ ID NO: 207250 - DNA, 28 bp, Artificial Sequence
  Description of Artificial Sequence: Synthetic oligonucleotide
atcctgcatggtgagcataccccaagcc

SEQ ID NO: 207251 - DNA, 27 bp, Artificial Sequence
  Description of Artificial Sequence: Synthetic oligonucleotide
tcctgcatggtgagcataccccaagcc

SEQ ID NO: 207252 - DNA, 27 bp, Artificial Sequence
  Description of Artificial Sequence: Synthetic oligonucleotide
cctgcatggtgagcataccccaagcca

SEQ ID NO: 207253 - DNA, 28 bp, Artificial Sequence
  Description of Artificial Sequence: Synthetic oligonucleotide
ctgcatggtgagcataccccaagccatc

SEQ ID NO: 207254 - DNA, 29 bp, Artificial Sequence
  Description of Artificial Sequence: Synthetic oligonucleotide
tgcatggtgagcataccccaagccatcag

SEQ ID NO: 207255 - DNA, 28 bp, Artificial Sequence
  Description of Artificial Sequence: Synthetic oligonucleotide
gcatggtgagcataccccaagccatcag

SEQ ID NO: 207256 - DNA, 28 bp, Artificial Sequence
  Description of Artificial Sequence: Synthetic oligonucleotide
catggtgagcataccccaagccatcagg

SEQ ID NO: 207257 - DNA, 29 bp, Artificial Sequence
  Description of Artificial Sequence: Synthetic oligonucleotide
atggtgagcataccccaagccatcaggac

SEQ ID NO: 207258 - DNA, 28 bp, Artificial Sequence
  Description of Artificial Sequence: Synthetic oligonucleotide
tggtgagcataccccaagccatcaggac

SEQ ID NO: 207259 - DNA, 27 bp, Artificial Sequence
  Description of Artificial Sequence: Synthetic oligonucleotide
ggtgagcataccccaagccatcaggac

SEQ ID NO: 207260 - DNA, 29 bp, Artificial Sequence
  Description of Artificial Sequence: Synthetic oligonucleotide
gtgagcataccccaagccatcaggacaac

SEQ ID NO: 207261 - DNA, 33 bp, Artificial Sequence
  Description of Artificial Sequence: Synthetic oligonucleotide
tgagcataccccaagccatcaggacaacttttc

SEQ ID NO: 207262 - DNA, 32 bp, Artificial Sequence
  Description of Artificial Sequence: Synthetic oligonucleotide
gagcataccccaagccatcaggacaacttttc

SEQ ID NO: 207263 - DNA, 33 bp, Artificial Sequence
  Description of Artificial Sequence: Synthetic oligonucleotide
agcataccccaagccatcaggacaacttttcac

SEQ ID NO: 207264 - DNA, 32 bp, Artificial Sequence
  Description of Artificial Sequence: Synthetic oligonucleotide
gcataccccaagccatcaggacaacttttcac

SEQ ID NO: 207265 - DNA, 32 bp, Artificial Sequence
  Description of Artificial Sequence: Synthetic oligonucleotide
cataccccaagccatcaggacaacttttcacc

SEQ ID NO: 207266 - DNA, 33 bp, Artificial Sequence
  Description of Artificial Sequence: Synthetic oligonucleotide
ataccccaagccatcaggacaacttttcacctg

SEQ ID NO: 207267 - DNA, 32 bp, Artificial Sequence
  Description of Artificial Sequence: Synthetic oligonucleotide
taccccaagccatcaggacaacttttcacctg

SEQ ID NO: 207268 - DNA, 31 bp, Artificial Sequence
  Description of Artificial Sequence: Synthetic oligonucleotide
accccaagccatcaggacaacttttcacctg

SEQ ID NO: 207269 - DNA, 30 bp, Artificial Sequence
  Description of Artificial Sequence: Synthetic oligonucleotide
ccccaagccatcaggacaacttttcacctg

SEQ ID NO: 207270 - DNA, 30 bp, Artificial Sequence
  Description of Artificial Sequence: Synthetic oligonucleotide
cccaagccatcaggacaacttttcacctgg

SEQ ID NO: 207271 - DNA, 30 bp, Artificial Sequence
  Description of Artificial Sequence: Synthetic oligonucleotide
ccaagccatcaggacaacttttcacctggg

SEQ ID NO: 207272 - DNA, 30 bp, Artificial Sequence
  Description of Artificial Sequence: Synthetic oligonucleotide
caagccatcaggacaacttttcacctgggc

SEQ ID NO: 207273 - DNA, 31 bp, Artificial Sequence
  Description of Artificial Sequence: Synthetic oligonucleotide
aagccatcaggacaacttttcacctgggcag

SEQ ID NO: 207274 - DNA, 30 bp, Artificial Sequence
  Description of Artificial Sequence: Synthetic oligonucleotide
agccatcaggacaacttttcacctgggcag

SEQ ID NO: 207275 - DNA, 29 bp, Artificial Sequence
  Description of Artificial Sequence: Synthetic oligonucleotide
gccatcaggacaacttttcacctgggcag

SEQ ID NO: 207276 - DNA, 29 bp, Artificial Sequence
  Description of Artificial Sequence: Synthetic oligonucleotide
ccatcaggacaacttttcacctgggcagg

SEQ ID NO: 207277 - DNA, 31 bp, Artificial Sequence
  Description of Artificial Sequence: Synthetic oligonucleotide
catcaggacaacttttcacctgggcaggaag

SEQ ID NO: 207278 - DNA, 32 bp, Artificial Sequence
  Description of Artificial Sequence: Synthetic oligonucleotide
atcaggacaacttttcacctgggcaggaagtg

SEQ ID NO: 207279 - DNA, 31 bp, Artificial Sequence
  Description of Artificial Sequence: Synthetic oligonucleotide
tcaggacaacttttcacctgggcaggaagtg

SEQ ID NO: 207280 - DNA, 30 bp, Artificial Sequence
  Description of Artificial Sequence: Synthetic oligonucleotide
caggacaacttttcacctgggcaggaagtg

SEQ ID NO: 207281 - DNA, 29 bp, Artificial Sequence
  Description of Artificial Sequence: Synthetic oligonucleotide
gcaggaagtgttctacagctgtgagcctg

SEQ ID NO: 207282 - DNA, 29 bp, Artificial Sequence
  Description of Artificial Sequence: Synthetic oligonucleotide
caggaagtgttctacagctgtgagcctgg

SEQ ID NO: 207283 - DNA, 29 bp, Artificial Sequence
  Description of Artificial Sequence: Synthetic oligonucleotide
aggaagtgttctacagctgtgagcctggc

SEQ ID NO: 207284 - DNA, 28 bp, Artificial Sequence
  Description of Artificial Sequence: Synthetic oligonucleotide
ggaagtgttctacagctgtgagcctggc

SEQ ID NO: 207285 - DNA, 31 bp, Artificial Sequence
  Description of Artificial Sequence: Synthetic oligonucleotide
gaagtgttctacagctgtgagcctggctatg

SEQ ID NO: 207286 - DNA, 32 bp, Artificial Sequence
  Description of Artificial Sequence: Synthetic oligonucleotide
aagtgttctacagctgtgagcctggctatgac

SEQ ID NO: 207287 - DNA, 31 bp, Artificial Sequence
  Description of Artificial Sequence: Synthetic oligonucleotide
agtgttctacagctgtgagcctggctatgac

SEQ ID NO: 207288 - DNA, 30 bp, Artificial Sequence
  Description of Artificial Sequence: Synthetic oligonucleotide
gtgttctacagctgtgagcctggctatgac

SEQ ID NO: 207289 - DNA, 30 bp, Artificial Sequence
  Description of Artificial Sequence: Synthetic oligonucleotide
tgttctacagctgtgagcctggctatgacc

SEQ ID NO: 207290 - DNA, 29 bp, Artificial Sequence
  Description of Artificial Sequence: Synthetic oligonucleotide
gttctacagctgtgagcctggctatgacc

SEQ ID NO: 207291 - DNA, 30 bp, Artificial Sequence
  Description of Artificial Sequence: Synthetic oligonucleotide
ttctacagctgtgagcctggctatgacctc

SEQ ID NO: 207292 - DNA, 29 bp, Artificial Sequence
  Description of Artificial Sequence: Synthetic oligonucleotide
tctacagctgtgagcctggctatgacctc

SEQ ID NO: 207293 - DNA, 28 bp, Artificial Sequence
  Description of Artificial Sequence: Synthetic oligonucleotide
ctacagctgtgagcctggctatgacctc

SEQ ID NO: 207294 - DNA, 29 bp, Artificial Sequence
  Description of Artificial Sequence: Synthetic oligonucleotide
tacagctgtgagcctggctatgacctcag

SEQ ID NO: 207295 - DNA, 28 bp, Artificial Sequence
  Description of Artificial Sequence: Synthetic oligonucleotide
acagctgtgagcctggctatgacctcag

SEQ ID NO: 207296 - DNA, 27 bp, Artificial Sequence
  Description of Artificial Sequence: Synthetic oligonucleotide
cagctgtgagcctggctatgacctcag

SEQ ID NO: 207297 - DNA, 28 bp, Artificial Sequence
  Description of Artificial Sequence: Synthetic oligonucleotide
agctgtgagcctggctatgacctcagag

SEQ ID NO: 207298 - DNA, 27 bp, Artificial Sequence
  Description of Artificial Sequence: Synthetic oligonucleotide
gctgtgagcctggctatgacctcagag

SEQ ID NO: 207299 - DNA, 27 bp, Artificial Sequence
  Description of Artificial Sequence: Synthetic oligonucleotide
ctgtgagcctggctatgacctcagagg

SEQ ID NO: 207300 - DNA, 27 bp, Artificial Sequence
  Description of Artificial Sequence: Synthetic oligonucleotide
tgtgagcctggctatgacctcagaggg

SEQ ID NO: 207301 - DNA, 26 bp, Artificial Sequence
  Description of Artificial Sequence: Synthetic oligonucleotide
gtgagcctggctatgacctcagaggg

SEQ ID NO: 207302 - DNA, 26 bp, Artificial Sequence
  Description of Artificial Sequence: Synthetic oligonucleotide
tgagcctggctatgacctcagagggg

SEQ ID NO: 207303 - DNA, 25 bp, Artificial Sequence
  Description of Artificial Sequence: Synthetic oligonucleotide
gagcctggctatgacctcagagggg

SEQ ID NO: 207304 - DNA, 26 bp, Artificial Sequence
  Description of Artificial Sequence: Synthetic oligonucleotide
agcctggctatgacctcagaggggct

SEQ ID NO: 207305 - DNA, 25 bp, Artificial Sequence
  Description of Artificial Sequence: Synthetic oligonucleotide
gcctggctatgacctcagaggggct

SEQ ID NO: 207306 - DNA, 25 bp, Artificial Sequence
  Description of Artificial Sequence: Synthetic oligonucleotide
cctggctatgacctcagaggggctg

SEQ ID NO: 207307 - DNA, 25 bp, Artificial Sequence
  Description of Artificial Sequence: Synthetic oligonucleotide
ctggctatgacctcagaggggctgc

SEQ ID NO: 207308 - DNA, 26 bp, Artificial Sequence
  Description of Artificial Sequence: Synthetic oligonucleotide
tggctatgacctcagaggggctgcgt

SEQ ID NO: 207309 - DNA, 26 bp, Artificial Sequence
  Description of Artificial Sequence: Synthetic oligonucleotide
gctatgacctcagaggggctgcgtct

SEQ ID NO: 207310 - DNA, 27 bp, Artificial Sequence
  Description of Artificial Sequence: Synthetic oligonucleotide
ctatgacctcagaggggctgcgtctct

SEQ ID NO: 207311 - DNA, 27 bp, Artificial Sequence
  Description of Artificial Sequence: Synthetic oligonucleotide
tatgacctcagaggggctgcgtctctg

SEQ ID NO: 207312 - DNA, 26 bp, Artificial Sequence
  Description of Artificial Sequence: Synthetic oligonucleotide
atgacctcagaggggctgcgtctctg

SEQ ID NO: 207313 - DNA, 25 bp, Artificial Sequence
  Description of Artificial Sequence: Synthetic oligonucleotide
tgacctcagaggggctgcgtctctg

SEQ ID NO: 207314 - DNA, 24 bp, Artificial Sequence
  Description of Artificial Sequence: Synthetic oligonucleotide
gacctcagaggggctgcgtctctg

SEQ ID NO: 207315 - DNA, 25 bp, Artificial Sequence
  Description of Artificial Sequence: Synthetic oligonucleotide
acctcagaggggctgcgtctctgca

SEQ ID NO: 207316 - DNA, 24 bp, Artificial Sequence
  Description of Artificial Sequence: Synthetic oligonucleotide
cctcagaggggctgcgtctctgca

SEQ ID NO: 207317 - DNA, 25 bp, Artificial Sequence
  Description of Artificial Sequence: Synthetic oligonucleotide
ctcagaggggctgcgtctctgcact

SEQ ID NO: 207318 - DNA, 25 bp, Artificial Sequence
  Description of Artificial Sequence: Synthetic oligonucleotide
tcagaggggctgcgtctctgcactg

SEQ ID NO: 207319 - DNA, 24 bp, Artificial Sequence
  Description of Artificial Sequence: Synthetic oligonucleotide
cagaggggctgcgtctctgcactg

SEQ ID NO: 207320 - DNA, 25 bp, Artificial Sequence
  Description of Artificial Sequence: Synthetic oligonucleotide
agaggggctgcgtctctgcactgca

SEQ ID NO: 207321 - DNA, 24 bp, Artificial Sequence
  Description of Artificial Sequence: Synthetic oligonucleotide
gaggggctgcgtctctgcactgca

SEQ ID NO: 207322 - DNA, 25 bp, Artificial Sequence
  Description of Artificial Sequence: Synthetic oligonucleotide
aggggctgcgtctctgcactgcaca

SEQ ID NO: 207323 - DNA, 24 bp, Artificial Sequence
  Description of Artificial Sequence: Synthetic oligonucleotide
ggggctgcgtctctgcactgcaca

SEQ ID NO: 207324 - DNA, 24 bp, Artificial Sequence
  Description of Artificial Sequence: Synthetic oligonucleotide
gggctgcgtctctgcactgcacac

SEQ ID NO: 207325 - DNA, 24 bp, Artificial Sequence
  Description of Artificial Sequence: Synthetic oligonucleotide
ggctgcgtctctgcactgcacacc

SEQ ID NO: 207326 - DNA, 24 bp, Artificial Sequence
  Description of Artificial Sequence: Synthetic oligonucleotide
gctgcgtctctgcactgcacaccc

SEQ ID NO: 207327 - DNA, 25 bp, Artificial Sequence
  Description of Artificial Sequence: Synthetic oligonucleotide
ctgcgtctctgcactgcacacccca

SEQ ID NO: 207328 - DNA, 25 bp, Artificial Sequence
  Description of Artificial Sequence: Synthetic oligonucleotide
tgcgtctctgcactgcacaccccag

SEQ ID NO: 207329 - DNA, 24 bp, Artificial Sequence
  Description of Artificial Sequence: Synthetic oligonucleotide
gcgtctctgcactgcacaccccag

SEQ ID NO: 207330 - DNA, 24 bp, Artificial Sequence
  Description of Artificial Sequence: Synthetic oligonucleotide
cgtctctgcactgcacaccccagg

SEQ ID NO: 207331 - DNA, 25 bp, Artificial Sequence
  Description of Artificial Sequence: Synthetic oligonucleotide
gtctctgcactgcacaccccaggga

SEQ ID NO: 207332 - DNA, 26 bp, Artificial Sequence
  Description of Artificial Sequence: Synthetic oligonucleotide
tctctgcactgcacaccccagggaga

SEQ ID NO: 207333 - DNA, 25 bp, Artificial Sequence
  Description of Artificial Sequence: Synthetic oligonucleotide
ctctgcactgcacaccccagggaga

SEQ ID NO: 207334 - DNA, 26 bp, Artificial Sequence
  Description of Artificial Sequence: Synthetic oligonucleotide
tctgcactgcacaccccagggagact

SEQ ID NO: 207335 - DNA, 25 bp, Artificial Sequence
  Description of Artificial Sequence: Synthetic oligonucleotide
ctgcactgcacaccccagggagact

SEQ ID NO: 207336 - DNA, 25 bp, Artificial Sequence
  Description of Artificial Sequence: Synthetic oligonucleotide
tgcactgcacaccccagggagactg

SEQ ID NO: 207337 - DNA, 24 bp, Artificial Sequence
  Description of Artificial Sequence: Synthetic oligonucleotide
gcactgcacaccccagggagactg

SEQ ID NO: 207338 - DNA, 25 bp, Artificial Sequence
  Description of Artificial Sequence: Synthetic oligonucleotide
cactgcacaccccagggagactgga

SEQ ID NO: 207339 - DNA, 25 bp, Artificial Sequence
  Description of Artificial Sequence: Synthetic oligonucleotide
actgcacaccccagggagactggag

SEQ ID NO: 207340 - DNA, 25 bp, Artificial Sequence
  Description of Artificial Sequence: Synthetic oligonucleotide
accccagggagactggagccctgaa

SEQ ID NO: 207341 - DNA, 24 bp, Artificial Sequence
  Description of Artificial Sequence: Synthetic oligonucleotide
ccccagggagactggagccctgaa

SEQ ID NO: 207342 - DNA, 24 bp, Artificial Sequence
  Description of Artificial Sequence: Synthetic oligonucleotide
cccagggagactggagccctgaag

SEQ ID NO: 207343 - DNA, 24 bp, Artificial Sequence
  Description of Artificial Sequence: Synthetic oligonucleotide
ccagggagactggagccctgaagc

SEQ ID NO: 207344 - DNA, 24 bp, Artificial Sequence
  Description of Artificial Sequence: Synthetic oligonucleotide
cagggagactggagccctgaagcc

SEQ ID NO: 207345 - DNA, 24 bp, Artificial Sequence
  Description of Artificial Sequence: Synthetic oligonucleotide
agggagactggagccctgaagccc

SEQ ID NO: 207346 - DNA, 23 bp, Artificial Sequence
  Description of Artificial Sequence: Synthetic oligonucleotide
gggagactggagccctgaagccc

SEQ ID NO: 207347 - DNA, 23 bp, Artificial Sequence
  Description of Artificial Sequence: Synthetic oligonucleotide
ggagactggagccctgaagcccc

SEQ ID NO: 207348 - DNA, 24 bp, Artificial Sequence
  Description of Artificial Sequence: Synthetic oligonucleotide
gagactggagccctgaagccccga

SEQ ID NO: 207349 - DNA, 26 bp, Artificial Sequence
  Description of Artificial Sequence: Synthetic oligonucleotide
agactggagccctgaagccccgagat

SEQ ID NO: 207350 - DNA, 25 bp, Artificial Sequence
  Description of Artificial Sequence: Synthetic oligonucleotide
gactggagccctgaagccccgagat

SEQ ID NO: 207351 - DNA, 26 bp, Artificial Sequence
  Description of Artificial Sequence: Synthetic oligonucleotide
actggagccctgaagccccgagatgt

SEQ ID NO: 207352 - DNA, 25 bp, Artificial Sequence
  Description of Artificial Sequence: Synthetic oligonucleotide
ctggagccctgaagccccgagatgt

SEQ ID NO: 207353 - DNA, 25 bp, Artificial Sequence
  Description of Artificial Sequence: Synthetic oligonucleotide
tggagccctgaagccccgagatgtg

SEQ ID NO: 207354 - DNA, 24 bp, Artificial Sequence
  Description of Artificial Sequence: Synthetic oligonucleotide
ggagccctgaagccccgagatgtg

SEQ ID NO: 207355 - DNA, 25 bp, Artificial Sequence
  Description of Artificial Sequence: Synthetic oligonucleotide
gagccctgaagccccgagatgtgca

SEQ ID NO: 207356 - DNA, 26 bp, Artificial Sequence
  Description of Artificial Sequence: Synthetic oligonucleotide
agccctgaagccccgagatgtgcagt

SEQ ID NO: 207357 - DNA, 25 bp, Artificial Sequence
  Description of Artificial Sequence: Synthetic oligonucleotide
gccctgaagccccgagatgtgcagt

SEQ ID NO: 207358 - DNA, 27 bp, Artificial Sequence
  Description of Artificial Sequence: Synthetic oligonucleotide
ccctgaagccccgagatgtgcagtgaa

SEQ ID NO: 207359 - DNA, 29 bp, Artificial Sequence
  Description of Artificial Sequence: Synthetic oligonucleotide
cctgaagccccgagatgtgcagtgaaatc

SEQ ID NO: 207360 - DNA, 29 bp, Artificial Sequence
  Description of Artificial Sequence: Synthetic oligonucleotide
ctgaagccccgagatgtgcagtgaaatcc

SEQ ID NO: 207361 - DNA, 30 bp, Artificial Sequence
  Description of Artificial Sequence: Synthetic oligonucleotide
tgaagccccgagatgtgcagtgaaatcctg

SEQ ID NO: 207362 - DNA, 29 bp, Artificial Sequence
  Description of Artificial Sequence: Synthetic oligonucleotide
gaagccccgagatgtgcagtgaaatcctg

SEQ ID NO: 207363 - DNA, 30 bp, Artificial Sequence
  Description of Artificial Sequence: Synthetic oligonucleotide
aagccccgagatgtgcagtgaaatcctgtg

SEQ ID NO: 207364 - DNA, 29 bp, Artificial Sequence
  Description of Artificial Sequence: Synthetic oligonucleotide
agccccgagatgtgcagtgaaatcctgtg

SEQ ID NO: 207365 - DNA, 28 bp, Artificial Sequence
  Description of Artificial Sequence: Synthetic oligonucleotide
gccccgagatgtgcagtgaaatcctgtg

SEQ ID NO: 207366 - DNA, 30 bp, Artificial Sequence
  Description of Artificial Sequence: Synthetic oligonucleotide
ccccgagatgtgcagtgaaatcctgtgatg

SEQ ID NO: 207367 - DNA, 31 bp, Artificial Sequence
  Description of Artificial Sequence: Synthetic oligonucleotide
cccgagatgtgcagtgaaatcctgtgatgac

SEQ ID NO: 207368 - DNA, 33 bp, Artificial Sequence
  Description of Artificial Sequence: Synthetic oligonucleotide
ccgagatgtgcagtgaaatcctgtgatgacttc

SEQ ID NO: 207369 - DNA, 35 bp, Artificial Sequence
  Description of Artificial Sequence: Synthetic oligonucleotide
cgagatgtgcagtgaaatcctgtgatgacttcttg

SEQ ID NO: 207370 - DNA, 35 bp, Artificial Sequence
  Description of Artificial Sequence: Synthetic oligonucleotide
gagatgtgcagtgaaatcctgtgatgacttcttgg

SEQ ID NO: 207371 - DNA, 35 bp, Artificial Sequence
  Description of Artificial Sequence: Synthetic oligonucleotide
agatgtgcagtgaaatcctgtgatgacttcttggg

SEQ ID NO: 207372 - DNA, 34 bp, Artificial Sequence
  Description of Artificial Sequence: Synthetic oligonucleotide
gatgtgcagtgaaatcctgtgatgacttcttggg

SEQ ID NO: 207373 - DNA, 35 bp, Artificial Sequence
  Description of Artificial Sequence: Synthetic oligonucleotide
atgtgcagtgaaatcctgtgatgacttcttgggtc

SEQ ID NO: 207374 - DNA, 34 bp, Artificial Sequence
  Description of Artificial Sequence: Synthetic oligonucleotide
tgtgcagtgaaatcctgtgatgacttcttgggtc

SEQ ID NO: 207375 - DNA, 33 bp, Artificial Sequence
  Description of Artificial Sequence: Synthetic oligonucleotide
gtgcagtgaaatcctgtgatgacttcttgggtc

SEQ ID NO: 207376 - DNA, 35 bp, Artificial Sequence
  Description of Artificial Sequence: Synthetic oligonucleotide
tgcagtgaaatcctgtgatgacttcttgggtcaac

SEQ ID NO: 207377 - DNA, 34 bp, Artificial Sequence
  Description of Artificial Sequence: Synthetic oligonucleotide
gcagtgaaatcctgtgatgacttcttgggtcaac

SEQ ID NO: 207378 - DNA, 35 bp, Artificial Sequence
  Description of Artificial Sequence: Synthetic oligonucleotide
cagtgaaatcctgtgatgacttcttgggtcaactc

SEQ ID NO: 207379 - DNA, 35 bp, Artificial Sequence
  Description of Artificial Sequence: Synthetic oligonucleotide
agtgaaatcctgtgatgacttcttgggtcaactcc

SEQ ID NO: 207380 - DNA, 34 bp, Artificial Sequence
  Description of Artificial Sequence: Synthetic oligonucleotide
gtgaaatcctgtgatgacttcttgggtcaactcc

SEQ ID NO: 207381 - DNA, 34 bp, Artificial Sequence
  Description of Artificial Sequence: Synthetic oligonucleotide
tgaaatcctgtgatgacttcttgggtcaactccc

SEQ ID NO: 207382 - DNA, 33 bp, Artificial Sequence
  Description of Artificial Sequence: Synthetic oligonucleotide
gaaatcctgtgatgacttcttgggtcaactccc

SEQ ID NO: 207383 - DNA, 34 bp, Artificial Sequence
  Description of Artificial Sequence: Synthetic oligonucleotide
aaatcctgtgatgacttcttgggtcaactccctc

SEQ ID NO: 207384 - DNA, 33 bp, Artificial Sequence
  Description of Artificial Sequence: Synthetic oligonucleotide
aatcctgtgatgacttcttgggtcaactccctc

SEQ ID NO: 207385 - DNA, 32 bp, Artificial Sequence
  Description of Artificial Sequence: Synthetic oligonucleotide
atcctgtgatgacttcttgggtcaactccctc

SEQ ID NO: 207386 - DNA, 31 bp, Artificial Sequence
  Description of Artificial Sequence: Synthetic oligonucleotide
tcctgtgatgacttcttgggtcaactccctc

SEQ ID NO: 207387 - DNA, 30 bp, Artificial Sequence
  Description of Artificial Sequence: Synthetic oligonucleotide
cctgtgatgacttcttgggtcaactccctc

SEQ ID NO: 207388 - DNA, 32 bp, Artificial Sequence
  Description of Artificial Sequence: Synthetic oligonucleotide
ctgtgatgacttcttgggtcaactccctcatg

SEQ ID NO: 207389 - DNA, 32 bp, Artificial Sequence
  Description of Artificial Sequence: Synthetic oligonucleotide
tgtgatgacttcttgggtcaactccctcatgg

SEQ ID NO: 207390 - DNA, 31 bp, Artificial Sequence
  Description of Artificial Sequence: Synthetic oligonucleotide
gtgatgacttcttgggtcaactccctcatgg

SEQ ID NO: 207391 - DNA, 31 bp, Artificial Sequence
  Description of Artificial Sequence: Synthetic oligonucleotide
tgatgacttcttgggtcaactccctcatggc

SEQ ID NO: 207392 - DNA, 30 bp, Artificial Sequence
  Description of Artificial Sequence: Synthetic oligonucleotide
gatgacttcttgggtcaactccctcatggc

SEQ ID NO: 207393 - DNA, 30 bp, Artificial Sequence
  Description of Artificial Sequence: Synthetic oligonucleotide
atgacttcttgggtcaactccctcatggcc

SEQ ID NO: 207394 - DNA, 29 bp, Artificial Sequence
  Description of Artificial Sequence: Synthetic oligonucleotide
tgacttcttgggtcaactccctcatggcc

SEQ ID NO: 207395 - DNA, 28 bp, Artificial Sequence
  Description of Artificial Sequence: Synthetic oligonucleotide
gacttcttgggtcaactccctcatggcc

SEQ ID NO: 207396 - DNA, 28 bp, Artificial Sequence
  Description of Artificial Sequence: Synthetic oligonucleotide
acttcttgggtcaactccctcatggccg

SEQ ID NO: 207397 - DNA, 27 bp, Artificial Sequence
  Description of Artificial Sequence: Synthetic oligonucleotide
cttcttgggtcaactccctcatggccg

SEQ ID NO: 207398 - DNA, 28 bp, Artificial Sequence
  Description of Artificial Sequence: Synthetic oligonucleotide
ttcttgggtcaactccctcatggccgtg

SEQ ID NO: 207399 - DNA, 27 bp, Artificial Sequence
  Description of Artificial Sequence: Synthetic oligonucleotide
tcttgggtcaactccctcatggccgtg

SEQ ID NO: 207400 - DNA, 27 bp, Artificial Sequence
  Description of Artificial Sequence: Synthetic oligonucleotide
cttgggtcaactccctcatggccgtgt

SEQ ID NO: 207401 - DNA, 27 bp, Artificial Sequence
  Description of Artificial Sequence: Synthetic oligonucleotide
ttgggtcaactccctcatggccgtgtg

SEQ ID NO: 207402 - DNA, 26 bp, Artificial Sequence
  Description of Artificial Sequence: Synthetic oligonucleotide
tgggtcaactccctcatggccgtgtg

SEQ ID NO: 207403 - DNA, 25 bp, Artificial Sequence
  Description of Artificial Sequence: Synthetic oligonucleotide
gggtcaactccctcatggccgtgtg

SEQ ID NO: 207404 - DNA, 27 bp, Artificial Sequence
  Description of Artificial Sequence: Synthetic oligonucleotide
ggtcaactccctcatggccgtgtgcta

SEQ ID NO: 207405 - DNA, 30 bp, Artificial Sequence
  Description of Artificial Sequence: Synthetic oligonucleotide
gtcaactccctcatggccgtgtgctatttc

SEQ ID NO: 207406 - DNA, 30 bp, Artificial Sequence
  Description of Artificial Sequence: Synthetic oligonucleotide
tcaactccctcatggccgtgtgctatttcc

SEQ ID NO: 207407 - DNA, 29 bp, Artificial Sequence
  Description of Artificial Sequence: Synthetic oligonucleotide
caactccctcatggccgtgtgctatttcc

SEQ ID NO: 207408 - DNA, 30 bp, Artificial Sequence
  Description of Artificial Sequence: Synthetic oligonucleotide
aactccctcatggccgtgtgctatttccac

SEQ ID NO: 207409 - DNA, 29 bp, Artificial Sequence
  Description of Artificial Sequence: Synthetic oligonucleotide
actccctcatggccgtgtgctatttccac

SEQ ID NO: 207410 - DNA, 28 bp, Artificial Sequence
  Description of Artificial Sequence: Synthetic oligonucleotide
ctccctcatggccgtgtgctatttccac

SEQ ID NO: 207411 - DNA, 33 bp, Artificial Sequence
  Description of Artificial Sequence: Synthetic oligonucleotide
tccctcatggccgtgtgctatttccacttaatc

SEQ ID NO: 207412 - DNA, 32 bp, Artificial Sequence
  Description of Artificial Sequence: Synthetic oligonucleotide
ccctcatggccgtgtgctatttccacttaatc

SEQ ID NO: 207413 - DNA, 33 bp, Artificial Sequence
  Description of Artificial Sequence: Synthetic oligonucleotide
cctcatggccgtgtgctatttccacttaatctc

SEQ ID NO: 207414 - DNA, 33 bp, Artificial Sequence
  Description of Artificial Sequence: Synthetic oligonucleotide
ctcatggccgtgtgctatttccacttaatctcc

SEQ ID NO: 207415 - DNA, 34 bp, Artificial Sequence
  Description of Artificial Sequence: Synthetic oligonucleotide
tcatggccgtgtgctatttccacttaatctccag

SEQ ID NO: 207416 - DNA, 33 bp, Artificial Sequence
  Description of Artificial Sequence: Synthetic oligonucleotide
catggccgtgtgctatttccacttaatctccag

SEQ ID NO: 207417 - DNA, 33 bp, Artificial Sequence
  Description of Artificial Sequence: Synthetic oligonucleotide
atggccgtgtgctatttccacttaatctccagc

SEQ ID NO: 207418 - DNA, 32 bp, Artificial Sequence
  Description of Artificial Sequence: Synthetic oligonucleotide
tggccgtgtgctatttccacttaatctccagc

SEQ ID NO: 207419 - DNA, 31 bp, Artificial Sequence
  Description of Artificial Sequence: Synthetic oligonucleotide
ggccgtgtgctatttccacttaatctccagc

SEQ ID NO: 207420 - DNA, 33 bp, Artificial Sequence
  Description of Artificial Sequence: Synthetic oligonucleotide
gccgtgtgctatttccacttaatctccagcttg

SEQ ID NO: 207421 - DNA, 33 bp, Artificial Sequence
  Description of Artificial Sequence: Synthetic oligonucleotide
ccgtgtgctatttccacttaatctccagcttgg

SEQ ID NO: 207422 - DNA, 33 bp, Artificial Sequence
  Description of Artificial Sequence: Synthetic oligonucleotide
cgtgtgctatttccacttaatctccagcttggg

SEQ ID NO: 207423 - DNA, 33 bp, Artificial Sequence
  Description of Artificial Sequence: Synthetic oligonucleotide
gtgtgctatttccacttaatctccagcttgggg

SEQ ID NO: 207424 - DNA, 33 bp, Artificial Sequence
  Description of Artificial Sequence: Synthetic oligonucleotide
tgtgctatttccacttaatctccagcttggggc

SEQ ID NO: 207425 - DNA, 32 bp, Artificial Sequence
  Description of Artificial Sequence: Synthetic oligonucleotide
gtgctatttccacttaatctccagcttggggc

SEQ ID NO: 207426 - DNA, 35 bp, Artificial Sequence
  Description of Artificial Sequence: Synthetic oligonucleotide
tgctatttccacttaatctccagcttggggcaaag

SEQ ID NO: 207427 - DNA, 34 bp, Artificial Sequence
  Description of Artificial Sequence: Synthetic oligonucleotide
gctatttccacttaatctccagcttggggcaaag

SEQ ID NO: 207428 - DNA, 34 bp, Artificial Sequence
  Description of Artificial Sequence: Synthetic oligonucleotide
ctatttccacttaatctccagcttggggcaaagg

SEQ ID NO: 207429 - DNA, 35 bp, Artificial Sequence
  Description of Artificial Sequence: Synthetic oligonucleotide
tatttccacttaatctccagcttggggcaaaggtg

SEQ ID NO: 207430 - DNA, 34 bp, Artificial Sequence
  Description of Artificial Sequence: Synthetic oligonucleotide
atttccacttaatctccagcttggggcaaaggtg

SEQ ID NO: 207431 - DNA, 33 bp, Artificial Sequence
  Description of Artificial Sequence: Synthetic oligonucleotide
tttccacttaatctccagcttggggcaaaggtg

SEQ ID NO: 207432 - DNA, 32 bp, Artificial Sequence
  Description of Artificial Sequence: Synthetic oligonucleotide
ttccacttaatctccagcttggggcaaaggtg

SEQ ID NO: 207433 - DNA, 31 bp, Artificial Sequence
  Description of Artificial Sequence: Synthetic oligonucleotide
tccacttaatctccagcttggggcaaaggtg

SEQ ID NO: 207434 - DNA, 30 bp, Artificial Sequence
  Description of Artificial Sequence: Synthetic oligonucleotide
ccacttaatctccagcttggggcaaaggtg

SEQ ID NO: 207435 - DNA, 31 bp, Artificial Sequence
  Description of Artificial Sequence: Synthetic oligonucleotide
cacttaatctccagcttggggcaaaggtgtc

SEQ ID NO: 207436 - DNA, 31 bp, Artificial Sequence
  Description of Artificial Sequence: Synthetic oligonucleotide
acttaatctccagcttggggcaaaggtgtcc

SEQ ID NO: 207437 - DNA, 30 bp, Artificial Sequence
  Description of Artificial Sequence: Synthetic oligonucleotide
cttaatctccagcttggggcaaaggtgtcc

SEQ ID NO: 207438 - DNA, 33 bp, Artificial Sequence
  Description of Artificial Sequence: Synthetic oligonucleotide
ttaatctccagcttggggcaaaggtgtcctttg

SEQ ID NO: 207439 - DNA, 32 bp, Artificial Sequence
  Description of Artificial Sequence: Synthetic oligonucleotide
taatctccagcttggggcaaaggtgtcctttg

SEQ ID NO: 207440 - DNA, 31 bp, Artificial Sequence
  Description of Artificial Sequence: Synthetic oligonucleotide
aatctccagcttggggcaaaggtgtcctttg

SEQ ID NO: 207441 - DNA, 30 bp, Artificial Sequence
  Description of Artificial Sequence: Synthetic oligonucleotide
atctccagcttggggcaaaggtgtcctttg

SEQ ID NO: 207442 - DNA, 29 bp, Artificial Sequence
  Description of Artificial Sequence: Synthetic oligonucleotide
tctccagcttggggcaaaggtgtcctttg

SEQ ID NO: 207443 - DNA, 28 bp, Artificial Sequence
  Description of Artificial Sequence: Synthetic oligonucleotide
ctccagcttggggcaaaggtgtcctttg

SEQ ID NO: 207444 - DNA, 29 bp, Artificial Sequence
  Description of Artificial Sequence: Synthetic oligonucleotide
tccagcttggggcaaaggtgtcctttgtc

SEQ ID NO: 207445 - DNA, 28 bp, Artificial Sequence
  Description of Artificial Sequence: Synthetic oligonucleotide
ccagcttggggcaaaggtgtcctttgtc

SEQ ID NO: 207446 - DNA, 29 bp, Artificial Sequence
  Description of Artificial Sequence: Synthetic oligonucleotide
cagcttggggcaaaggtgtcctttgtctg

SEQ ID NO: 207447 - DNA, 30 bp, Artificial Sequence
  Description of Artificial Sequence: Synthetic oligonucleotide
agcttggggcaaaggtgtcctttgtctgtg

SEQ ID NO: 207448 - DNA, 29 bp, Artificial Sequence
  Description of Artificial Sequence: Synthetic oligonucleotide
gcttggggcaaaggtgtcctttgtctgtg

SEQ ID NO: 207449 - DNA, 31 bp, Artificial Sequence
  Description of Artificial Sequence: Synthetic oligonucleotide
cttggggcaaaggtgtcctttgtctgtgatg

SEQ ID NO: 207450 - DNA, 33 bp, Artificial Sequence
  Description of Artificial Sequence: Synthetic oligonucleotide
ttggggcaaaggtgtcctttgtctgtgatgaag

SEQ ID NO: 207451 - DNA, 32 bp, Artificial Sequence
  Description of Artificial Sequence: Synthetic oligonucleotide
tggggcaaaggtgtcctttgtctgtgatgaag

SEQ ID NO: 207452 - DNA, 31 bp, Artificial Sequence
  Description of Artificial Sequence: Synthetic oligonucleotide
ggggcaaaggtgtcctttgtctgtgatgaag

SEQ ID NO: 207453 - DNA, 31 bp, Artificial Sequence
  Description of Artificial Sequence: Synthetic oligonucleotide
gggcaaaggtgtcctttgtctgtgatgaagg

SEQ ID NO: 207454 - DNA, 31 bp, Artificial Sequence
  Description of Artificial Sequence: Synthetic oligonucleotide
ggcaaaggtgtcctttgtctgtgatgaaggg

SEQ ID NO: 207455 - DNA, 34 bp, Artificial Sequence
  Description of Artificial Sequence: Synthetic oligonucleotide
gcaaaggtgtcctttgtctgtgatgaagggtttc

SEQ ID NO: 207456 - DNA, 34 bp, Artificial Sequence
  Description of Artificial Sequence: Synthetic oligonucleotide
caaaggtgtcctttgtctgtgatgaagggtttcg

SEQ ID NO: 207457 - DNA, 34 bp, Artificial Sequence
  Description of Artificial Sequence: Synthetic oligonucleotide
aaaggtgtcctttgtctgtgatgaagggtttcgc

SEQ ID NO: 207458 - DNA, 33 bp, Artificial Sequence
  Description of Artificial Sequence: Synthetic oligonucleotide
aaggtgtcctttgtctgtgatgaagggtttcgc

SEQ ID NO: 207459 - DNA, 32 bp, Artificial Sequence
  Description of Artificial Sequence: Synthetic oligonucleotide
aggtgtcctttgtctgtgatgaagggtttcgc

SEQ ID NO: 207460 - DNA, 31 bp, Artificial Sequence
  Description of Artificial Sequence: Synthetic oligonucleotide
ggtgtcctttgtctgtgatgaagggtttcgc

SEQ ID NO: 207461 - DNA, 36 bp, Artificial Sequence
  Description of Artificial Sequence: Synthetic oligonucleotide
gtgtcctttgtctgtgatgaagggtttcgcttaaag

SEQ ID NO: 207462 - DNA, 36 bp, Artificial Sequence
  Description of Artificial Sequence: Synthetic oligonucleotide
tgtcctttgtctgtgatgaagggtttcgcttaaagg

SEQ ID NO: 207463 - DNA, 35 bp, Artificial Sequence
  Description of Artificial Sequence: Synthetic oligonucleotide
gtcctttgtctgtgatgaagggtttcgcttaaagg

SEQ ID NO: 207464 - DNA, 35 bp, Artificial Sequence
  Description of Artificial Sequence: Synthetic oligonucleotide
tcctttgtctgtgatgaagggtttcgcttaaaggg

SEQ ID NO: 207465 - DNA, 34 bp, Artificial Sequence
  Description of Artificial Sequence: Synthetic oligonucleotide
cctttgtctgtgatgaagggtttcgcttaaaggg

SEQ ID NO: 207466 - DNA, 34 bp, Artificial Sequence
  Description of Artificial Sequence: Synthetic oligonucleotide
ctttgtctgtgatgaagggtttcgcttaaagggc

SEQ ID NO: 207467 - DNA, 35 bp, Artificial Sequence
  Description of Artificial Sequence: Synthetic oligonucleotide
tttgtctgtgatgaagggtttcgcttaaagggcag

SEQ ID NO: 207468 - DNA, 34 bp, Artificial Sequence
  Description of Artificial Sequence: Synthetic oligonucleotide
ttgtctgtgatgaagggtttcgcttaaagggcag

SEQ ID NO: 207469 - DNA, 33 bp, Artificial Sequence
  Description of Artificial Sequence: Synthetic oligonucleotide
tgtctgtgatgaagggtttcgcttaaagggcag

SEQ ID NO: 207470 - DNA, 32 bp, Artificial Sequence
  Description of Artificial Sequence: Synthetic oligonucleotide
gtctgtgatgaagggtttcgcttaaagggcag

SEQ ID NO: 207471 - DNA, 34 bp, Artificial Sequence
  Description of Artificial Sequence: Synthetic oligonucleotide
tctgtgatgaagggtttcgcttaaagggcagttc

SEQ ID NO: 207472 - DNA, 33 bp, Artificial Sequence
  Description of Artificial Sequence: Synthetic oligonucleotide
ctgtgatgaagggtttcgcttaaagggcagttc

SEQ ID NO: 207473 - DNA, 33 bp, Artificial Sequence
  Description of Artificial Sequence: Synthetic oligonucleotide
tgtgatgaagggtttcgcttaaagggcagttcc

SEQ ID NO: 207474 - DNA, 32 bp, Artificial Sequence
  Description of Artificial Sequence: Synthetic oligonucleotide
gtgatgaagggtttcgcttaaagggcagttcc

SEQ ID NO: 207475 - DNA, 32 bp, Artificial Sequence
  Description of Artificial Sequence: Synthetic oligonucleotide
tgatgaagggtttcgcttaaagggcagttccg

SEQ ID NO: 207476 - DNA, 31 bp, Artificial Sequence
  Description of Artificial Sequence: Synthetic oligonucleotide
gatgaagggtttcgcttaaagggcagttccg

SEQ ID NO: 207477 - DNA, 34 bp, Artificial Sequence
  Description of Artificial Sequence: Synthetic oligonucleotide
atgaagggtttcgcttaaagggcagttccgttag

SEQ ID NO: 207478 - DNA, 33 bp, Artificial Sequence
  Description of Artificial Sequence: Synthetic oligonucleotide
tgaagggtttcgcttaaagggcagttccgttag

SEQ ID NO: 207479 - DNA, 32 bp, Artificial Sequence
  Description of Artificial Sequence: Synthetic oligonucleotide
gaagggtttcgcttaaagggcagttccgttag

SEQ ID NO: 207480 - DNA, 33 bp, Artificial Sequence
  Description of Artificial Sequence: Synthetic oligonucleotide
aagggtttcgcttaaagggcagttccgttagtc

SEQ ID NO: 207481 - DNA, 32 bp, Artificial Sequence
  Description of Artificial Sequence: Synthetic oligonucleotide
agggtttcgcttaaagggcagttccgttagtc

SEQ ID NO: 207482 - DNA, 31 bp, Artificial Sequence
  Description of Artificial Sequence: Synthetic oligonucleotide
gggtttcgcttaaagggcagttccgttagtc

SEQ ID NO: 207483 - DNA, 34 bp, Artificial Sequence
  Description of Artificial Sequence: Synthetic oligonucleotide
ggtttcgcttaaagggcagttccgttagtcattg

SEQ ID NO: 207484 - DNA, 35 bp, Artificial Sequence
  Description of Artificial Sequence: Synthetic oligonucleotide
gtttcgcttaaagggcagttccgttagtcattgtg

SEQ ID NO: 207485 - DNA, 36 bp, Artificial Sequence
  Description of Artificial Sequence: Synthetic oligonucleotide
tttcgcttaaagggcagttccgttagtcattgtgtc

SEQ ID NO: 207486 - DNA, 35 bp, Artificial Sequence
  Description of Artificial Sequence: Synthetic oligonucleotide
ttcgcttaaagggcagttccgttagtcattgtgtc

SEQ ID NO: 207487 - DNA, 34 bp, Artificial Sequence
  Description of Artificial Sequence: Synthetic oligonucleotide
tcgcttaaagggcagttccgttagtcattgtgtc

SEQ ID NO: 207488 - DNA, 33 bp, Artificial Sequence
  Description of Artificial Sequence: Synthetic oligonucleotide
cgcttaaagggcagttccgttagtcattgtgtc

SEQ ID NO: 207489 - DNA, 35 bp, Artificial Sequence
  Description of Artificial Sequence: Synthetic oligonucleotide
gcttaaagggcagttccgttagtcattgtgtcttg

SEQ ID NO: 207490 - DNA, 35 bp, Artificial Sequence
  Description of Artificial Sequence: Synthetic oligonucleotide
cttaaagggcagttccgttagtcattgtgtcttgg

SEQ ID NO: 207491 - DNA, 37 bp, Artificial Sequence
  Description of Artificial Sequence: Synthetic oligonucleotide
ttaaagggcagttccgttagtcattgtgtcttggttg

SEQ ID NO: 207492 - DNA, 36 bp, Artificial Sequence
  Description of Artificial Sequence: Synthetic oligonucleotide
taaagggcagttccgttagtcattgtgtcttggttg

SEQ ID NO: 207493 - DNA, 35 bp, Artificial Sequence
  Description of Artificial Sequence: Synthetic oligonucleotide
aaagggcagttccgttagtcattgtgtcttggttg

SEQ ID NO: 207494 - DNA, 34 bp, Artificial Sequence
  Description of Artificial Sequence: Synthetic oligonucleotide
aagggcagttccgttagtcattgtgtcttggttg

SEQ ID NO: 207495 - DNA, 33 bp, Artificial Sequence
  Description of Artificial Sequence: Synthetic oligonucleotide
agggcagttccgttagtcattgtgtcttggttg

SEQ ID NO: 207496 - DNA, 32 bp, Artificial Sequence
  Description of Artificial Sequence: Synthetic oligonucleotide
gggcagttccgttagtcattgtgtcttggttg

SEQ ID NO: 207497 - DNA, 32 bp, Artificial Sequence
  Description of Artificial Sequence: Synthetic oligonucleotide
ggcagttccgttagtcattgtgtcttggttgg

SEQ ID NO: 207498 - DNA, 35 bp, Artificial Sequence
  Description of Artificial Sequence: Synthetic oligonucleotide
gcagttccgttagtcattgtgtcttggttggaatg

SEQ ID NO: 207499 - DNA, 36 bp, Artificial Sequence
  Description of Artificial Sequence: Synthetic oligonucleotide
cagttccgttagtcattgtgtcttggttggaatgag

SEQ ID NO: 207500 - DNA, 38 bp, Artificial Sequence
  Description of Artificial Sequence: Synthetic oligonucleotide
agttccgttagtcattgtgtcttggttggaatgagaag

SEQ ID NO: 207501 - DNA, 37 bp, Artificial Sequence
  Description of Artificial Sequence: Synthetic oligonucleotide
gttccgttagtcattgtgtcttggttggaatgagaag

SEQ ID NO: 207502 - DNA, 37 bp, Artificial Sequence
  Description of Artificial Sequence: Synthetic oligonucleotide
ttccgttagtcattgtgtcttggttggaatgagaagc

SEQ ID NO: 207503 - DNA, 36 bp, Artificial Sequence
  Description of Artificial Sequence: Synthetic oligonucleotide
tccgttagtcattgtgtcttggttggaatgagaagc

SEQ ID NO: 207504 - DNA, 35 bp, Artificial Sequence
  Description of Artificial Sequence: Synthetic oligonucleotide
ccgttagtcattgtgtcttggttggaatgagaagc

SEQ ID NO: 207505 - DNA, 35 bp, Artificial Sequence
  Description of Artificial Sequence: Synthetic oligonucleotide
cgttagtcattgtgtcttggttggaatgagaagcc

SEQ ID NO: 207506 - DNA, 38 bp, Artificial Sequence
  Description of Artificial Sequence: Synthetic oligonucleotide
gttagtcattgtgtcttggttggaatgagaagcctttg

SEQ ID NO: 207507 - DNA, 38 bp, Artificial Sequence
  Description of Artificial Sequence: Synthetic oligonucleotide
ttagtcattgtgtcttggttggaatgagaagcctttgg

SEQ ID NO: 207508 - DNA, 37 bp, Artificial Sequence
  Description of Artificial Sequence: Synthetic oligonucleotide
tagtcattgtgtcttggttggaatgagaagcctttgg

SEQ ID NO: 207509 - DNA, 36 bp, Artificial Sequence
  Description of Artificial Sequence: Synthetic oligonucleotide
agtcattgtgtcttggttggaatgagaagcctttgg

SEQ ID NO: 207510 - DNA, 35 bp, Artificial Sequence
  Description of Artificial Sequence: Synthetic oligonucleotide
gtcattgtgtcttggttggaatgagaagcctttgg

SEQ ID NO: 207511 - DNA, 40 bp, Artificial Sequence
  Description of Artificial Sequence: Synthetic oligonucleotide
tcattgtgtcttggttggaatgagaagcctttggaataac

SEQ ID NO: 207512 - DNA, 39 bp, Artificial Sequence
  Description of Artificial Sequence: Synthetic oligonucleotide
cattgtgtcttggttggaatgagaagcctttggaataac

SEQ ID NO: 207513 - DNA, 40 bp, Artificial Sequence
  Description of Artificial Sequence: Synthetic oligonucleotide
attgtgtcttggttggaatgagaagcctttggaataacag

SEQ ID NO: 207514 - DNA, 39 bp, Artificial Sequence
  Description of Artificial Sequence: Synthetic oligonucleotide
ttgtgtcttggttggaatgagaagcctttggaataacag

SEQ ID NO: 207515 - DNA, 38 bp, Artificial Sequence
  Description of Artificial Sequence: Synthetic oligonucleotide
tgtgtcttggttggaatgagaagcctttggaataacag

SEQ ID NO: 207516 - DNA, 37 bp, Artificial Sequence
  Description of Artificial Sequence: Synthetic oligonucleotide
gtgtcttggttggaatgagaagcctttggaataacag

SEQ ID NO: 207517 - DNA, 38 bp, Artificial Sequence
  Description of Artificial Sequence: Synthetic oligonucleotide
tgtcttggttggaatgagaagcctttggaataacagtg

SEQ ID NO: 207518 - DNA, 37 bp, Artificial Sequence
  Description of Artificial Sequence: Synthetic oligonucleotide
gtcttggttggaatgagaagcctttggaataacagtg

SEQ ID NO: 207519 - DNA, 39 bp, Artificial Sequence
  Description of Artificial Sequence: Synthetic oligonucleotide
tcttggttggaatgagaagcctttggaataacagtgttc

SEQ ID NO: 207520 - DNA, 38 bp, Artificial Sequence
  Description of Artificial Sequence: Synthetic oligonucleotide
cttggttggaatgagaagcctttggaataacagtgttc

SEQ ID NO: 207521 - DNA, 38 bp, Artificial Sequence
  Description of Artificial Sequence: Synthetic oligonucleotide
ttggttggaatgagaagcctttggaataacagtgttcc

SEQ ID NO: 207522 - DNA, 37 bp, Artificial Sequence
  Description of Artificial Sequence: Synthetic oligonucleotide
tggttggaatgagaagcctttggaataacagtgttcc

SEQ ID NO: 207523 - DNA, 36 bp, Artificial Sequence
  Description of Artificial Sequence: Synthetic oligonucleotide
ggttggaatgagaagcctttggaataacagtgttcc

SEQ ID NO: 207524 - DNA, 37 bp, Artificial Sequence
  Description of Artificial Sequence: Synthetic oligonucleotide
gttggaatgagaagcctttggaataacagtgttcctg

SEQ ID NO: 207525 - DNA, 38 bp, Artificial Sequence
  Description of Artificial Sequence: Synthetic oligonucleotide
ttggaatgagaagcctttggaataacagtgttcctgtg

SEQ ID NO: 207526 - DNA, 37 bp, Artificial Sequence
  Description of Artificial Sequence: Synthetic oligonucleotide
tggaatgagaagcctttggaataacagtgttcctgtg

SEQ ID NO: 207527 - DNA, 36 bp, Artificial Sequence
  Description of Artificial Sequence: Synthetic oligonucleotide
ggaatgagaagcctttggaataacagtgttcctgtg

SEQ ID NO: 207528 - DNA, 37 bp, Artificial Sequence
  Description of Artificial Sequence: Synthetic oligonucleotide
gaatgagaagcctttggaataacagtgttcctgtgtg

SEQ ID NO: 207529 - DNA, 38 bp, Artificial Sequence
  Description of Artificial Sequence: Synthetic oligonucleotide
aatgagaagcctttggaataacagtgttcctgtgtgtg

SEQ ID NO: 207530 - DNA, 37 bp, Artificial Sequence
  Description of Artificial Sequence: Synthetic oligonucleotide
atgagaagcctttggaataacagtgttcctgtgtgtg

SEQ ID NO: 207531 - DNA, 36 bp, Artificial Sequence
  Description of Artificial Sequence: Synthetic oligonucleotide
tgagaagcctttggaataacagtgttcctgtgtgtg

SEQ ID NO: 207532 - DNA, 35 bp, Artificial Sequence
  Description of Artificial Sequence: Synthetic oligonucleotide
gagaagcctttggaataacagtgttcctgtgtgtg

SEQ ID NO: 207533 - DNA, 37 bp, Artificial Sequence
  Description of Artificial Sequence: Synthetic oligonucleotide
agaagcctttggaataacagtgttcctgtgtgtgaac

SEQ ID NO: 207534 - DNA, 36 bp, Artificial Sequence
  Description of Artificial Sequence: Synthetic oligonucleotide
gaagcctttggaataacagtgttcctgtgtgtgaac

SEQ ID NO: 207535 - DNA, 40 bp, Artificial Sequence
  Description of Artificial Sequence: Synthetic oligonucleotide
aagcctttggaataacagtgttcctgtgtgtgaacatatc

SEQ ID NO: 207536 - DNA, 39 bp, Artificial Sequence
  Description of Artificial Sequence: Synthetic oligonucleotide
agcctttggaataacagtgttcctgtgtgtgaacatatc

SEQ ID NO: 207537 - DNA, 38 bp, Artificial Sequence
  Description of Artificial Sequence: Synthetic oligonucleotide
gcctttggaataacagtgttcctgtgtgtgaacatatc

SEQ ID NO: 207538 - DNA, 42 bp, Artificial Sequence
  Description of Artificial Sequence: Synthetic oligonucleotide
cctttggaataacagtgttcctgtgtgtgaacatatcttttg

SEQ ID NO: 207539 - DNA, 43 bp, Artificial Sequence
  Description of Artificial Sequence: Synthetic oligonucleotide
ctttggaataacagtgttcctgtgtgtgaacatatcttttgtc

SEQ ID NO: 207540 - DNA, 43 bp, Artificial Sequence
  Description of Artificial Sequence: Synthetic oligonucleotide
tttggaataacagtgttcctgtgtgtgaacatatcttttgtcc

SEQ ID NO: 207541 - DNA, 42 bp, Artificial Sequence
  Description of Artificial Sequence: Synthetic oligonucleotide
ttggaataacagtgttcctgtgtgtgaacatatcttttgtcc

SEQ ID NO: 207542 - DNA, 41 bp, Artificial Sequence
  Description of Artificial Sequence: Synthetic oligonucleotide
tggaataacagtgttcctgtgtgtgaacatatcttttgtcc

SEQ ID NO: 207543 - DNA, 40 bp, Artificial Sequence
  Description of Artificial Sequence: Synthetic oligonucleotide
ggaataacagtgttcctgtgtgtgaacatatcttttgtcc

SEQ ID NO: 207544 - DNA, 44 bp, Artificial Sequence
  Description of Artificial Sequence: Synthetic oligonucleotide
gaataacagtgttcctgtgtgtgaacatatcttttgtccaaatc

SEQ ID NO: 207545 - DNA, 44 bp, Artificial Sequence
  Description of Artificial Sequence: Synthetic oligonucleotide
aataacagtgttcctgtgtgtgaacatatcttttgtccaaatcc

SEQ ID NO: 207546 - DNA, 43 bp, Artificial Sequence
  Description of Artificial Sequence: Synthetic oligonucleotide
ataacagtgttcctgtgtgtgaacatatcttttgtccaaatcc

SEQ ID NO: 207547 - DNA, 42 bp, Artificial Sequence
  Description of Artificial Sequence: Synthetic oligonucleotide
taacagtgttcctgtgtgtgaacatatcttttgtccaaatcc

SEQ ID NO: 207548 - DNA, 41 bp, Artificial Sequence
  Description of Artificial Sequence: Synthetic oligonucleotide
aacagtgttcctgtgtgtgaacatatcttttgtccaaatcc

SEQ ID NO: 207549 - DNA, 40 bp, Artificial Sequence
  Description of Artificial Sequence: Synthetic oligonucleotide
acagtgttcctgtgtgtgaacatatcttttgtccaaatcc

SEQ ID NO: 207550 - DNA, 39 bp, Artificial Sequence
  Description of Artificial Sequence: Synthetic oligonucleotide
cagtgttcctgtgtgtgaacatatcttttgtccaaatcc

SEQ ID NO: 207551 - DNA, 40 bp, Artificial Sequence
  Description of Artificial Sequence: Synthetic oligonucleotide
agtgttcctgtgtgtgaacatatcttttgtccaaatcctc

SEQ ID NO: 207552 - DNA, 39 bp, Artificial Sequence
  Description of Artificial Sequence: Synthetic oligonucleotide
gtgttcctgtgtgtgaacatatcttttgtccaaatcctc

SEQ ID NO: 207553 - DNA, 39 bp, Artificial Sequence
  Description of Artificial Sequence: Synthetic oligonucleotide
tgttcctgtgtgtgaacatatcttttgtccaaatcctcc

SEQ ID NO: 207554 - DNA, 38 bp, Artificial Sequence
  Description of Artificial Sequence: Synthetic oligonucleotide
gttcctgtgtgtgaacatatcttttgtccaaatcctcc

SEQ ID NO: 207555 - DNA, 39 bp, Artificial Sequence
  Description of Artificial Sequence: Synthetic oligonucleotide
ttcctgtgtgtgaacatatcttttgtccaaatcctccag

SEQ ID NO: 207556 - DNA, 38 bp, Artificial Sequence
  Description of Artificial Sequence: Synthetic oligonucleotide
tcctgtgtgtgaacatatcttttgtccaaatcctccag

SEQ ID NO: 207557 - DNA, 37 bp, Artificial Sequence
  Description of Artificial Sequence: Synthetic oligonucleotide
cctgtgtgtgaacatatcttttgtccaaatcctccag

SEQ ID NO: 207558 - DNA, 37 bp, Artificial Sequence
  Description of Artificial Sequence: Synthetic oligonucleotide
ctgtgtgtgaacatatcttttgtccaaatcctccagc

SEQ ID NO: 207559 - DNA, 40 bp, Artificial Sequence
  Description of Artificial Sequence: Synthetic oligonucleotide
tgtgtgtgaacatatcttttgtccaaatcctccagctatc

SEQ ID NO: 207560 - DNA, 39 bp, Artificial Sequence
  Description of Artificial Sequence: Synthetic oligonucleotide
gtgtgtgaacatatcttttgtccaaatcctccagctatc

SEQ ID NO: 207561 - DNA, 39 bp, Artificial Sequence
  Description of Artificial Sequence: Synthetic oligonucleotide
tgtgtgaacatatcttttgtccaaatcctccagctatcc

SEQ ID NO: 207562 - DNA, 38 bp, Artificial Sequence
  Description of Artificial Sequence: Synthetic oligonucleotide
gtgtgaacatatcttttgtccaaatcctccagctatcc

SEQ ID NO: 207563 - DNA, 43 bp, Artificial Sequence
  Description of Artificial Sequence: Synthetic oligonucleotide
tgtgaacatatcttttgtccaaatcctccagctatccttaatg

SEQ ID NO: 207564 - DNA, 42 bp, Artificial Sequence
  Description of Artificial Sequence: Synthetic oligonucleotide
gtgaacatatcttttgtccaaatcctccagctatccttaatg

SEQ ID NO: 207565 - DNA, 42 bp, Artificial Sequence
  Description of Artificial Sequence: Synthetic oligonucleotide
tgaacatatcttttgtccaaatcctccagctatccttaatgg

SEQ ID NO: 207566 - DNA, 41 bp, Artificial Sequence
  Description of Artificial Sequence: Synthetic oligonucleotide
gaacatatcttttgtccaaatcctccagctatccttaatgg

SEQ ID NO: 207567 - DNA, 41 bp, Artificial Sequence
  Description of Artificial Sequence: Synthetic oligonucleotide
aacatatcttttgtccaaatcctccagctatccttaatggg

SEQ ID NO: 207568 - DNA, 40 bp, Artificial Sequence
  Description of Artificial Sequence: Synthetic oligonucleotide
acatatcttttgtccaaatcctccagctatccttaatggg

SEQ ID NO: 207569 - DNA, 39 bp, Artificial Sequence
  Description of Artificial Sequence: Synthetic oligonucleotide
catatcttttgtccaaatcctccagctatccttaatggg

SEQ ID NO: 207570 - DNA, 40 bp, Artificial Sequence
  Description of Artificial Sequence: Synthetic oligonucleotide
atatcttttgtccaaatcctccagctatccttaatgggag

SEQ ID NO: 207571 - DNA, 39 bp, Artificial Sequence
  Description of Artificial Sequence: Synthetic oligonucleotide
tatcttttgtccaaatcctccagctatccttaatgggag

SEQ ID NO: 207572 - DNA, 38 bp, Artificial Sequence
  Description of Artificial Sequence: Synthetic oligonucleotide
atcttttgtccaaatcctccagctatccttaatgggag

SEQ ID NO: 207573 - DNA, 37 bp, Artificial Sequence
  Description of Artificial Sequence: Synthetic oligonucleotide
tcttttgtccaaatcctccagctatccttaatgggag

SEQ ID NO: 207574 - DNA, 36 bp, Artificial Sequence
  Description of Artificial Sequence: Synthetic oligonucleotide
cttttgtccaaatcctccagctatccttaatgggag

SEQ ID NO: 207575 - DNA, 37 bp, Artificial Sequence
  Description of Artificial Sequence: Synthetic oligonucleotide
ttttgtccaaatcctccagctatccttaatgggagac

SEQ ID NO: 207576 - DNA, 36 bp, Artificial Sequence
  Description of Artificial Sequence: Synthetic oligonucleotide
tttgtccaaatcctccagctatccttaatgggagac

SEQ ID NO: 207577 - DNA, 35 bp, Artificial Sequence
  Description of Artificial Sequence: Synthetic oligonucleotide
ttgtccaaatcctccagctatccttaatgggagac

SEQ ID NO: 207578 - DNA, 34 bp, Artificial Sequence
  Description of Artificial Sequence: Synthetic oligonucleotide
tgtccaaatcctccagctatccttaatgggagac

SEQ ID NO: 207579 - DNA, 33 bp, Artificial Sequence
  Description of Artificial Sequence: Synthetic oligonucleotide
gtccaaatcctccagctatccttaatgggagac

SEQ ID NO: 207580 - DNA, 34 bp, Artificial Sequence
  Description of Artificial Sequence: Synthetic oligonucleotide
tccaaatcctccagctatccttaatgggagacac

SEQ ID NO: 207581 - DNA, 33 bp, Artificial Sequence
  Description of Artificial Sequence: Synthetic oligonucleotide
ccaaatcctccagctatccttaatgggagacac

SEQ ID NO: 207582 - DNA, 34 bp, Artificial Sequence
  Description of Artificial Sequence: Synthetic oligonucleotide
caaatcctccagctatccttaatgggagacacac

SEQ ID NO: 207583 - DNA, 35 bp, Artificial Sequence
  Description of Artificial Sequence: Synthetic oligonucleotide
aaatcctccagctatccttaatgggagacacacag

SEQ ID NO: 207584 - DNA, 34 bp, Artificial Sequence
  Description of Artificial Sequence: Synthetic oligonucleotide
aatcctccagctatccttaatgggagacacacag

SEQ ID NO: 207585 - DNA, 33 bp, Artificial Sequence
  Description of Artificial Sequence: Synthetic oligonucleotide
atcctccagctatccttaatgggagacacacag

SEQ ID NO: 207586 - DNA, 32 bp, Artificial Sequence
  Description of Artificial Sequence: Synthetic oligonucleotide
tcctccagctatccttaatgggagacacacag

SEQ ID NO: 207587 - DNA, 31 bp, Artificial Sequence
  Description of Artificial Sequence: Synthetic oligonucleotide
cctccagctatccttaatgggagacacacag

SEQ ID NO: 207588 - DNA, 31 bp, Artificial Sequence
  Description of Artificial Sequence: Synthetic oligonucleotide
ctccagctatccttaatgggagacacacagg

SEQ ID NO: 207589 - DNA, 33 bp, Artificial Sequence
  Description of Artificial Sequence: Synthetic oligonucleotide
tccagctatccttaatgggagacacacaggaac

SEQ ID NO: 207590 - DNA, 32 bp, Artificial Sequence
  Description of Artificial Sequence: Synthetic oligonucleotide
ccagctatccttaatgggagacacacaggaac

SEQ ID NO: 207591 - DNA, 33 bp, Artificial Sequence
  Description of Artificial Sequence: Synthetic oligonucleotide
cagctatccttaatgggagacacacaggaactc

SEQ ID NO: 207592 - DNA, 33 bp, Artificial Sequence
  Description of Artificial Sequence: Synthetic oligonucleotide
agctatccttaatgggagacacacaggaactcc

SEQ ID NO: 207593 - DNA, 32 bp, Artificial Sequence
  Description of Artificial Sequence: Synthetic oligonucleotide
gctatccttaatgggagacacacaggaactcc

SEQ ID NO: 207594 - DNA, 32 bp, Artificial Sequence
  Description of Artificial Sequence: Synthetic oligonucleotide
ctatccttaatgggagacacacaggaactccc

SEQ ID NO: 207595 - DNA, 33 bp, Artificial Sequence
  Description of Artificial Sequence: Synthetic oligonucleotide
tatccttaatgggagacacacaggaactccctc

SEQ ID NO: 207596 - DNA, 32 bp, Artificial Sequence
  Description of Artificial Sequence: Synthetic oligonucleotide
atccttaatgggagacacacaggaactccctc

SEQ ID NO: 207597 - DNA, 31 bp, Artificial Sequence
  Description of Artificial Sequence: Synthetic oligonucleotide
tccttaatgggagacacacaggaactccctc

SEQ ID NO: 207598 - DNA, 30 bp, Artificial Sequence
  Description of Artificial Sequence: Synthetic oligonucleotide
ccttaatgggagacacacaggaactccctc

SEQ ID NO: 207599 - DNA, 31 bp, Artificial Sequence
  Description of Artificial Sequence: Synthetic oligonucleotide
cttaatgggagacacacaggaactccctctg

SEQ ID NO: 207600 - DNA, 31 bp, Artificial Sequence
  Description of Artificial Sequence: Synthetic oligonucleotide
ttaatgggagacacacaggaactccctctgg

SEQ ID NO: 207601 - DNA, 30 bp, Artificial Sequence
  Description of Artificial Sequence: Synthetic oligonucleotide
taatgggagacacacaggaactccctctgg

SEQ ID NO: 207602 - DNA, 29 bp, Artificial Sequence
  Description of Artificial Sequence: Synthetic oligonucleotide
aatgggagacacacaggaactccctctgg

SEQ ID NO: 207603 - DNA, 28 bp, Artificial Sequence
  Description of Artificial Sequence: Synthetic oligonucleotide
atgggagacacacaggaactccctctgg

SEQ ID NO: 207604 - DNA, 27 bp, Artificial Sequence
  Description of Artificial Sequence: Synthetic oligonucleotide
tgggagacacacaggaactccctctgg

SEQ ID NO: 207605 - DNA, 27 bp, Artificial Sequence
  Description of Artificial Sequence: Synthetic oligonucleotide
gggagacacacaggaactccctctgga

SEQ ID NO: 207606 - DNA, 27 bp, Artificial Sequence
  Description of Artificial Sequence: Synthetic oligonucleotide
ggagacacacaggaactccctctggag

SEQ ID NO: 207607 - DNA, 32 bp, Artificial Sequence
  Description of Artificial Sequence: Synthetic oligonucleotide
gagacacacaggaactccctctggagatattc

SEQ ID NO: 207608 - DNA, 32 bp, Artificial Sequence
  Description of Artificial Sequence: Synthetic oligonucleotide
agacacacaggaactccctctggagatattcc

SEQ ID NO: 207609 - DNA, 31 bp, Artificial Sequence
  Description of Artificial Sequence: Synthetic oligonucleotide
gacacacaggaactccctctggagatattcc

SEQ ID NO: 207610 - DNA, 31 bp, Artificial Sequence
  Description of Artificial Sequence: Synthetic oligonucleotide
acacacaggaactccctctggagatattccc

SEQ ID NO: 207611 - DNA, 30 bp, Artificial Sequence
  Description of Artificial Sequence: Synthetic oligonucleotide
cacacaggaactccctctggagatattccc

SEQ ID NO: 207612 - DNA, 33 bp, Artificial Sequence
  Description of Artificial Sequence: Synthetic oligonucleotide
acacaggaactccctctggagatattccctatg

SEQ ID NO: 207613 - DNA, 32 bp, Artificial Sequence
  Description of Artificial Sequence: Synthetic oligonucleotide
cacaggaactccctctggagatattccctatg

SEQ ID NO: 207614 - DNA, 32 bp, Artificial Sequence
  Description of Artificial Sequence: Synthetic oligonucleotide
acaggaactccctctggagatattccctatgg

SEQ ID NO: 207615 - DNA, 31 bp, Artificial Sequence
  Description of Artificial Sequence: Synthetic oligonucleotide
caggaactccctctggagatattccctatgg

SEQ ID NO: 207616 - DNA, 35 bp, Artificial Sequence
  Description of Artificial Sequence: Synthetic oligonucleotide
aggaactccctctggagatattccctatggaaaag

SEQ ID NO: 207617 - DNA, 34 bp, Artificial Sequence
  Description of Artificial Sequence: Synthetic oligonucleotide
ggaactccctctggagatattccctatggaaaag

SEQ ID NO: 207618 - DNA, 40 bp, Artificial Sequence
  Description of Artificial Sequence: Synthetic oligonucleotide
gaactccctctggagatattccctatggaaaagaaatatc

SEQ ID NO: 207619 - DNA, 43 bp, Artificial Sequence
  Description of Artificial Sequence: Synthetic oligonucleotide
aactccctctggagatattccctatggaaaagaaatatcttac

SEQ ID NO: 207620 - DNA, 42 bp, Artificial Sequence
  Description of Artificial Sequence: Synthetic oligonucleotide
actccctctggagatattccctatggaaaagaaatatcttac

SEQ ID NO: 207621 - DNA, 41 bp, Artificial Sequence
  Description of Artificial Sequence: Synthetic oligonucleotide
ctccctctggagatattccctatggaaaagaaatatcttac

SEQ ID NO: 207622 - DNA, 42 bp, Artificial Sequence
  Description of Artificial Sequence: Synthetic oligonucleotide
tccctctggagatattccctatggaaaagaaatatcttacac

SEQ ID NO: 207623 - DNA, 41 bp, Artificial Sequence
  Description of Artificial Sequence: Synthetic oligonucleotide
ccctctggagatattccctatggaaaagaaatatcttacac

SEQ ID NO: 207624 - DNA, 43 bp, Artificial Sequence
  Description of Artificial Sequence: Synthetic oligonucleotide
cctctggagatattccctatggaaaagaaatatcttacacatg

SEQ ID NO: 207625 - DNA, 44 bp, Artificial Sequence
  Description of Artificial Sequence: Synthetic oligonucleotide
ctctggagatattccctatggaaaagaaatatcttacacatgtg

SEQ ID NO: 207626 - DNA, 45 bp, Artificial Sequence
  Description of Artificial Sequence: Synthetic oligonucleotide
tctggagatattccctatggaaaagaaatatcttacacatgtgac

SEQ ID NO: 207627 - DNA, 44 bp, Artificial Sequence
  Description of Artificial Sequence: Synthetic oligonucleotide
ctggagatattccctatggaaaagaaatatcttacacatgtgac

SEQ ID NO: 207628 - DNA, 44 bp, Artificial Sequence
  Description of Artificial Sequence: Synthetic oligonucleotide
tggagatattccctatggaaaagaaatatcttacacatgtgacc

SEQ ID NO: 207629 - DNA, 43 bp, Artificial Sequence
  Description of Artificial Sequence: Synthetic oligonucleotide
ggagatattccctatggaaaagaaatatcttacacatgtgacc

SEQ ID NO: 207630 - DNA, 43 bp, Artificial Sequence
  Description of Artificial Sequence: Synthetic oligonucleotide
gagatattccctatggaaaagaaatatcttacacatgtgaccc

SEQ ID NO: 207631 - DNA, 43 bp, Artificial Sequence
  Description of Artificial Sequence: Synthetic oligonucleotide
agatattccctatggaaaagaaatatcttacacatgtgacccc

SEQ ID NO: 207632 - DNA, 42 bp, Artificial Sequence
  Description of Artificial Sequence: Synthetic oligonucleotide
gatattccctatggaaaagaaatatcttacacatgtgacccc

SEQ ID NO: 207633 - DNA, 42 bp, Artificial Sequence
  Description of Artificial Sequence: Synthetic oligonucleotide
atattccctatggaaaagaaatatcttacacatgtgaccccc

SEQ ID NO: 207634 - DNA, 41 bp, Artificial Sequence
  Description of Artificial Sequence: Synthetic oligonucleotide
tattccctatggaaaagaaatatcttacacatgtgaccccc

SEQ ID NO: 207635 - DNA, 40 bp, Artificial Sequence
  Description of Artificial Sequence: Synthetic oligonucleotide
attccctatggaaaagaaatatcttacacatgtgaccccc

SEQ ID NO: 207636 - DNA, 39 bp, Artificial Sequence
  Description of Artificial Sequence: Synthetic oligonucleotide
ttccctatggaaaagaaatatcttacacatgtgaccccc

SEQ ID NO: 207637 - DNA, 38 bp, Artificial Sequence
  Description of Artificial Sequence: Synthetic oligonucleotide
tccctatggaaaagaaatatcttacacatgtgaccccc

SEQ ID NO: 207638 - DNA, 37 bp, Artificial Sequence
  Description of Artificial Sequence: Synthetic oligonucleotide
ccctatggaaaagaaatatcttacacatgtgaccccc

SEQ ID NO: 207639 - DNA, 38 bp, Artificial Sequence
  Description of Artificial Sequence: Synthetic oligonucleotide
cctatggaaaagaaatatcttacacatgtgacccccac

SEQ ID NO: 207640 - DNA, 38 bp, Artificial Sequence
  Description of Artificial Sequence: Synthetic oligonucleotide
ctatggaaaagaaatatcttacacatgtgacccccacc

SEQ ID NO: 207641 - DNA, 38 bp, Artificial Sequence
  Description of Artificial Sequence: Synthetic oligonucleotide
tatggaaaagaaatatcttacacatgtgacccccaccc

SEQ ID NO: 207642 - DNA, 37 bp, Artificial Sequence
  Description of Artificial Sequence: Synthetic oligonucleotide
atggaaaagaaatatcttacacatgtgacccccaccc

SEQ ID NO: 207643 - DNA, 36 bp, Artificial Sequence
  Description of Artificial Sequence: Synthetic oligonucleotide
tggaaaagaaatatcttacacatgtgacccccaccc

SEQ ID NO: 207644 - DNA, 35 bp, Artificial Sequence
  Description of Artificial Sequence: Synthetic oligonucleotide
ggaaaagaaatatcttacacatgtgacccccaccc

SEQ ID NO: 207645 - DNA, 36 bp, Artificial Sequence
  Description of Artificial Sequence: Synthetic oligonucleotide
gaaaagaaatatcttacacatgtgacccccacccag

SEQ ID NO: 207646 - DNA, 37 bp, Artificial Sequence
  Description of Artificial Sequence: Synthetic oligonucleotide
aaaagaaatatcttacacatgtgacccccacccagac

SEQ ID NO: 207647 - DNA, 36 bp, Artificial Sequence
  Description of Artificial Sequence: Synthetic oligonucleotide
aaagaaatatcttacacatgtgacccccacccagac

SEQ ID NO: 207648 - DNA, 35 bp, Artificial Sequence
  Description of Artificial Sequence: Synthetic oligonucleotide
aagaaatatcttacacatgtgacccccacccagac

SEQ ID NO: 207649 - DNA, 34 bp, Artificial Sequence
  Description of Artificial Sequence: Synthetic oligonucleotide
agaaatatcttacacatgtgacccccacccagac

SEQ ID NO: 207650 - DNA, 33 bp, Artificial Sequence
  Description of Artificial Sequence: Synthetic oligonucleotide
gaaatatcttacacatgtgacccccacccagac

SEQ ID NO: 207651 - DNA, 34 bp, Artificial Sequence
  Description of Artificial Sequence: Synthetic oligonucleotide
aaatatcttacacatgtgacccccacccagacag

SEQ ID NO: 207652 - DNA, 33 bp, Artificial Sequence
  Description of Artificial Sequence: Synthetic oligonucleotide
aatatcttacacatgtgacccccacccagacag

SEQ ID NO: 207653 - DNA, 32 bp, Artificial Sequence
  Description of Artificial Sequence: Synthetic oligonucleotide
atatcttacacatgtgacccccacccagacag

SEQ ID NO: 207654 - DNA, 31 bp, Artificial Sequence
  Description of Artificial Sequence: Synthetic oligonucleotide
tatcttacacatgtgacccccacccagacag

SEQ ID NO: 207655 - DNA, 30 bp, Artificial Sequence
  Description of Artificial Sequence: Synthetic oligonucleotide
atcttacacatgtgacccccacccagacag

SEQ ID NO: 207656 - DNA, 29 bp, Artificial Sequence
  Description of Artificial Sequence: Synthetic oligonucleotide
tcttacacatgtgacccccacccagacag

SEQ ID NO: 207657 - DNA, 28 bp, Artificial Sequence
  Description of Artificial Sequence: Synthetic oligonucleotide
cttacacatgtgacccccacccagacag

SEQ ID NO: 207658 - DNA, 29 bp, Artificial Sequence
  Description of Artificial Sequence: Synthetic oligonucleotide
ttacacatgtgacccccacccagacagag

SEQ ID NO: 207659 - DNA, 28 bp, Artificial Sequence
  Description of Artificial Sequence: Synthetic oligonucleotide
tacacatgtgacccccacccagacagag

SEQ ID NO: 207660 - DNA, 27 bp, Artificial Sequence
  Description of Artificial Sequence: Synthetic oligonucleotide
acacatgtgacccccacccagacagag

SEQ ID NO: 207661 - DNA, 26 bp, Artificial Sequence
  Description of Artificial Sequence: Synthetic oligonucleotide
cacatgtgacccccacccagacagag

SEQ ID NO: 207662 - DNA, 26 bp, Artificial Sequence
  Description of Artificial Sequence: Synthetic oligonucleotide
acatgtgacccccacccagacagagg

SEQ ID NO: 207663 - DNA, 25 bp, Artificial Sequence
  Description of Artificial Sequence: Synthetic oligonucleotide
catgtgacccccacccagacagagg

SEQ ID NO: 207664 - DNA, 27 bp, Artificial Sequence
  Description of Artificial Sequence: Synthetic oligonucleotide
atgtgacccccacccagacagagggat

SEQ ID NO: 207665 - DNA, 26 bp, Artificial Sequence
  Description of Artificial Sequence: Synthetic oligonucleotide
tgtgacccccacccagacagagggat

SEQ ID NO: 207666 - DNA, 25 bp, Artificial Sequence
  Description of Artificial Sequence: Synthetic oligonucleotide
gtgacccccacccagacagagggat

SEQ ID NO: 207667 - DNA, 26 bp, Artificial Sequence
  Description of Artificial Sequence: Synthetic oligonucleotide
tgacccccacccagacagagggatga

SEQ ID NO: 207668 - DNA, 25 bp, Artificial Sequence
  Description of Artificial Sequence: Synthetic oligonucleotide
gacccccacccagacagagggatga

SEQ ID NO: 207669 - DNA, 25 bp, Artificial Sequence
  Description of Artificial Sequence: Synthetic oligonucleotide
acccccacccagacagagggatgac

SEQ ID NO: 207670 - DNA, 24 bp, Artificial Sequence
  Description of Artificial Sequence: Synthetic oligonucleotide
cccccacccagacagagggatgac

SEQ ID NO: 207671 - DNA, 26 bp, Artificial Sequence
  Description of Artificial Sequence: Synthetic oligonucleotide
ccccacccagacagagggatgacctt

SEQ ID NO: 207672 - DNA, 27 bp, Artificial Sequence
  Description of Artificial Sequence: Synthetic oligonucleotide
cccacccagacagagggatgaccttca

SEQ ID NO: 207673 - DNA, 28 bp, Artificial Sequence
  Description of Artificial Sequence: Synthetic oligonucleotide
ccacccagacagagggatgaccttcaac

SEQ ID NO: 207674 - DNA, 28 bp, Artificial Sequence
  Description of Artificial Sequence: Synthetic oligonucleotide
cacccagacagagggatgaccttcaacc

SEQ ID NO: 207675 - DNA, 29 bp, Artificial Sequence
  Description of Artificial Sequence: Synthetic oligonucleotide
acccagacagagggatgaccttcaacctc

SEQ ID NO: 207676 - DNA, 28 bp, Artificial Sequence
  Description of Artificial Sequence: Synthetic oligonucleotide
cccagacagagggatgaccttcaacctc

SEQ ID NO: 207677 - DNA, 31 bp, Artificial Sequence
  Description of Artificial Sequence: Synthetic oligonucleotide
ccagacagagggatgaccttcaacctcattg

SEQ ID NO: 207678 - DNA, 31 bp, Artificial Sequence
  Description of Artificial Sequence: Synthetic oligonucleotide
cagacagagggatgaccttcaacctcattgg

SEQ ID NO: 207679 - DNA, 31 bp, Artificial Sequence
  Description of Artificial Sequence: Synthetic oligonucleotide
agacagagggatgaccttcaacctcattggg

SEQ ID NO: 207680 - DNA, 30 bp, Artificial Sequence
  Description of Artificial Sequence: Synthetic oligonucleotide
gacagagggatgaccttcaacctcattggg

SEQ ID NO: 207681 - DNA, 30 bp, Artificial Sequence
  Description of Artificial Sequence: Synthetic oligonucleotide
acagagggatgaccttcaacctcattgggg

SEQ ID NO: 207682 - DNA, 29 bp, Artificial Sequence
  Description of Artificial Sequence: Synthetic oligonucleotide
cagagggatgaccttcaacctcattgggg

SEQ ID NO: 207683 - DNA, 30 bp, Artificial Sequence
  Description of Artificial Sequence: Synthetic oligonucleotide
agagggatgaccttcaacctcattggggag

SEQ ID NO: 207684 - DNA, 29 bp, Artificial Sequence
  Description of Artificial Sequence: Synthetic oligonucleotide
gagggatgaccttcaacctcattggggag

SEQ ID NO: 207685 - DNA, 30 bp, Artificial Sequence
  Description of Artificial Sequence: Synthetic oligonucleotide
agggatgaccttcaacctcattggggagag

SEQ ID NO: 207686 - DNA, 29 bp, Artificial Sequence
  Description of Artificial Sequence: Synthetic oligonucleotide
gggatgaccttcaacctcattggggagag

SEQ ID NO: 207687 - DNA, 29 bp, Artificial Sequence
  Description of Artificial Sequence: Synthetic oligonucleotide
ggatgaccttcaacctcattggggagagc

SEQ ID NO: 207688 - DNA, 30 bp, Artificial Sequence
  Description of Artificial Sequence: Synthetic oligonucleotide
gatgaccttcaacctcattggggagagcac

SEQ ID NO: 207689 - DNA, 30 bp, Artificial Sequence
  Description of Artificial Sequence: Synthetic oligonucleotide
atgaccttcaacctcattggggagagcacc

SEQ ID NO: 207690 - DNA, 29 bp, Artificial Sequence
  Description of Artificial Sequence: Synthetic oligonucleotide
tgaccttcaacctcattggggagagcacc

SEQ ID NO: 207691 - DNA, 28 bp, Artificial Sequence
  Description of Artificial Sequence: Synthetic oligonucleotide
gaccttcaacctcattggggagagcacc

SEQ ID NO: 207692 - DNA, 30 bp, Artificial Sequence
  Description of Artificial Sequence: Synthetic oligonucleotide
accttcaacctcattggggagagcaccatc

SEQ ID NO: 207693 - DNA, 29 bp, Artificial Sequence
  Description of Artificial Sequence: Synthetic oligonucleotide
ccttcaacctcattggggagagcaccatc

SEQ ID NO: 207694 - DNA, 29 bp, Artificial Sequence
  Description of Artificial Sequence: Synthetic oligonucleotide
cttcaacctcattggggagagcaccatcc

SEQ ID NO: 207695 - DNA, 29 bp, Artificial Sequence
  Description of Artificial Sequence: Synthetic oligonucleotide
ttcaacctcattggggagagcaccatccg

SEQ ID NO: 207696 - DNA, 28 bp, Artificial Sequence
  Description of Artificial Sequence: Synthetic oligonucleotide
tcaacctcattggggagagcaccatccg

SEQ ID NO: 207697 - DNA, 27 bp, Artificial Sequence
  Description of Artificial Sequence: Synthetic oligonucleotide
caacctcattggggagagcaccatccg

SEQ ID NO: 207698 - DNA, 27 bp, Artificial Sequence
  Description of Artificial Sequence: Synthetic oligonucleotide
aacctcattggggagagcaccatccgc

SEQ ID NO: 207699 - DNA, 27 bp, Artificial Sequence
  Description of Artificial Sequence: Synthetic oligonucleotide
acctcattggggagagcaccatccgct

SEQ ID NO: 207700 - DNA, 26 bp, Artificial Sequence
  Description of Artificial Sequence: Synthetic oligonucleotide
cctcattggggagagcaccatccgct

SEQ ID NO: 207701 - DNA, 26 bp, Artificial Sequence
  Description of Artificial Sequence: Synthetic oligonucleotide
ctcattggggagagcaccatccgctg

SEQ ID NO: 207702 - DNA, 27 bp, Artificial Sequence
  Description of Artificial Sequence: Synthetic oligonucleotide
tcattggggagagcaccatccgctgca

SEQ ID NO: 207703 - DNA, 26 bp, Artificial Sequence
  Description of Artificial Sequence: Synthetic oligonucleotide
cattggggagagcaccatccgctgca

SEQ ID NO: 207704 - DNA, 27 bp, Artificial Sequence
  Description of Artificial Sequence: Synthetic oligonucleotide
attggggagagcaccatccgctgcaca

SEQ ID NO: 207705 - DNA, 27 bp, Artificial Sequence
  Description of Artificial Sequence: Synthetic oligonucleotide
ttggggagagcaccatccgctgcacaa

SEQ ID NO: 207706 - DNA, 26 bp, Artificial Sequence
  Description of Artificial Sequence: Synthetic oligonucleotide
tggggagagcaccatccgctgcacaa

SEQ ID NO: 207707 - DNA, 25 bp, Artificial Sequence
  Description of Artificial Sequence: Synthetic oligonucleotide
ggggagagcaccatccgctgcacaa

SEQ ID NO: 207708 - DNA, 26 bp, Artificial Sequence
  Description of Artificial Sequence: Synthetic oligonucleotide
gggagagcaccatccgctgcacaagt

SEQ ID NO: 207709 - DNA, 27 bp, Artificial Sequence
  Description of Artificial Sequence: Synthetic oligonucleotide
ggagagcaccatccgctgcacaagtga

SEQ ID NO: 207710 - DNA, 28 bp, Artificial Sequence
  Description of Artificial Sequence: Synthetic oligonucleotide
accatccgctgcacaagtgaccctcatg

SEQ ID NO: 207711 - DNA, 27 bp, Artificial Sequence
  Description of Artificial Sequence: Synthetic oligonucleotide
ccatccgctgcacaagtgaccctcatg

SEQ ID NO: 207712 - DNA, 27 bp, Artificial Sequence
  Description of Artificial Sequence: Synthetic oligonucleotide
catccgctgcacaagtgaccctcatgg

SEQ ID NO: 207713 - DNA, 27 bp, Artificial Sequence
  Description of Artificial Sequence: Synthetic oligonucleotide
atccgctgcacaagtgaccctcatggg

SEQ ID NO: 207714 - DNA, 27 bp, Artificial Sequence
  Description of Artificial Sequence: Synthetic oligonucleotide
tccgctgcacaagtgaccctcatggga

SEQ ID NO: 207715 - DNA, 27 bp, Artificial Sequence
  Description of Artificial Sequence: Synthetic oligonucleotide
ccgctgcacaagtgaccctcatgggaa

SEQ ID NO: 207716 - DNA, 28 bp, Artificial Sequence
  Description of Artificial Sequence: Synthetic oligonucleotide
cgctgcacaagtgaccctcatgggaatg

SEQ ID NO: 207717 - DNA, 28 bp, Artificial Sequence
  Description of Artificial Sequence: Synthetic oligonucleotide
gctgcacaagtgaccctcatgggaatgg

SEQ ID NO: 207718 - DNA, 28 bp, Artificial Sequence
  Description of Artificial Sequence: Synthetic oligonucleotide
ctgcacaagtgaccctcatgggaatggg

SEQ ID NO: 207719 - DNA, 28 bp, Artificial Sequence
  Description of Artificial Sequence: Synthetic oligonucleotide
tgcacaagtgaccctcatgggaatgggg

SEQ ID NO: 207720 - DNA, 27 bp, Artificial Sequence
  Description of Artificial Sequence: Synthetic oligonucleotide
gcacaagtgaccctcatgggaatgggg

SEQ ID NO: 207721 - DNA, 30 bp, Artificial Sequence
  Description of Artificial Sequence: Synthetic oligonucleotide
cacaagtgaccctcatgggaatggggtttg

SEQ ID NO: 207722 - DNA, 30 bp, Artificial Sequence
  Description of Artificial Sequence: Synthetic oligonucleotide
acaagtgaccctcatgggaatggggtttgg

SEQ ID NO: 207723 - DNA, 29 bp, Artificial Sequence
  Description of Artificial Sequence: Synthetic oligonucleotide
caagtgaccctcatgggaatggggtttgg

SEQ ID NO: 207724 - DNA, 30 bp, Artificial Sequence
  Description of Artificial Sequence: Synthetic oligonucleotide
aagtgaccctcatgggaatggggtttggag

SEQ ID NO: 207725 - DNA, 29 bp, Artificial Sequence
  Description of Artificial Sequence: Synthetic oligonucleotide
agtgaccctcatgggaatggggtttggag

SEQ ID NO: 207726 - DNA, 28 bp, Artificial Sequence
  Description of Artificial Sequence: Synthetic oligonucleotide
gtgaccctcatgggaatggggtttggag

SEQ ID NO: 207727 - DNA, 28 bp, Artificial Sequence
  Description of Artificial Sequence: Synthetic oligonucleotide
tgaccctcatgggaatggggtttggagc

SEQ ID NO: 207728 - DNA, 27 bp, Artificial Sequence
  Description of Artificial Sequence: Synthetic oligonucleotide
gaccctcatgggaatggggtttggagc

SEQ ID NO: 207729 - DNA, 28 bp, Artificial Sequence
  Description of Artificial Sequence: Synthetic oligonucleotide
accctcatgggaatggggtttggagcag

SEQ ID NO: 207730 - DNA, 27 bp, Artificial Sequence
  Description of Artificial Sequence: Synthetic oligonucleotide
ccctcatgggaatggggtttggagcag

SEQ ID NO: 207731 - DNA, 27 bp, Artificial Sequence
  Description of Artificial Sequence: Synthetic oligonucleotide
cctcatgggaatggggtttggagcagc

SEQ ID NO: 207732 - DNA, 27 bp, Artificial Sequence
  Description of Artificial Sequence: Synthetic oligonucleotide
ctcatgggaatggggtttggagcagcc

SEQ ID NO: 207733 - DNA, 27 bp, Artificial Sequence
  Description of Artificial Sequence: Synthetic oligonucleotide
tcatgggaatggggtttggagcagccc

SEQ ID NO: 207734 - DNA, 27 bp, Artificial Sequence
  Description of Artificial Sequence: Synthetic oligonucleotide
catgggaatggggtttggagcagccct

SEQ ID NO: 207735 - DNA, 27 bp, Artificial Sequence
  Description of Artificial Sequence: Synthetic oligonucleotide
atgggaatggggtttggagcagccctg

SEQ ID NO: 207736 - DNA, 26 bp, Artificial Sequence
  Description of Artificial Sequence: Synthetic oligonucleotide
tgggaatggggtttggagcagccctg

SEQ ID NO: 207737 - DNA, 24 bp, Artificial Sequence
  Description of Artificial Sequence: Synthetic oligonucleotide
agcagccctgcccctcgctgtgaa

SEQ ID NO: 207738 - DNA, 23 bp, Artificial Sequence
  Description of Artificial Sequence: Synthetic oligonucleotide
gcagccctgcccctcgctgtgaa

SEQ ID NO: 207739 - DNA, 26 bp, Artificial Sequence
  Description of Artificial Sequence: Synthetic oligonucleotide
cagccctgcccctcgctgtgaacttt

SEQ ID NO: 207740 - DNA, 27 bp, Artificial Sequence
  Description of Artificial Sequence: Synthetic oligonucleotide
agccctgcccctcgctgtgaactttct

SEQ ID NO: 207741 - DNA, 26 bp, Artificial Sequence
  Description of Artificial Sequence: Synthetic oligonucleotide
gccctgcccctcgctgtgaactttct

SEQ ID NO: 207742 - DNA, 27 bp, Artificial Sequence
  Description of Artificial Sequence: Synthetic oligonucleotide
ccctgcccctcgctgtgaactttctgt

SEQ ID NO: 207743 - DNA, 28 bp, Artificial Sequence
  Description of Artificial Sequence: Synthetic oligonucleotide
cctgcccctcgctgtgaactttctgttc

SEQ ID NO: 207744 - DNA, 28 bp, Artificial Sequence
  Description of Artificial Sequence: Synthetic oligonucleotide
ctgcccctcgctgtgaactttctgttcg

SEQ ID NO: 207745 - DNA, 29 bp, Artificial Sequence
  Description of Artificial Sequence: Synthetic oligonucleotide
tgcccctcgctgtgaactttctgttcgtg

SEQ ID NO: 207746 - DNA, 28 bp, Artificial Sequence
  Description of Artificial Sequence: Synthetic oligonucleotide
gcccctcgctgtgaactttctgttcgtg

SEQ ID NO: 207747 - DNA, 28 bp, Artificial Sequence
  Description of Artificial Sequence: Synthetic oligonucleotide
cccctcgctgtgaactttctgttcgtgc

SEQ ID NO: 207748 - DNA, 29 bp, Artificial Sequence
  Description of Artificial Sequence: Synthetic oligonucleotide
ccctcgctgtgaactttctgttcgtgctg

SEQ ID NO: 207749 - DNA, 29 bp, Artificial Sequence
  Description of Artificial Sequence: Synthetic oligonucleotide
cctcgctgtgaactttctgttcgtgctgg

SEQ ID NO: 207750 - DNA, 30 bp, Artificial Sequence
  Description of Artificial Sequence: Synthetic oligonucleotide
ctcgctgtgaactttctgttcgtgctggtc

SEQ ID NO: 207751 - DNA, 31 bp, Artificial Sequence
  Description of Artificial Sequence: Synthetic oligonucleotide
tcgctgtgaactttctgttcgtgctggtcac

SEQ ID NO: 207752 - DNA, 30 bp, Artificial Sequence
  Description of Artificial Sequence: Synthetic oligonucleotide
cgctgtgaactttctgttcgtgctggtcac

SEQ ID NO: 207753 - DNA, 31 bp, Artificial Sequence
  Description of Artificial Sequence: Synthetic oligonucleotide
gctgtgaactttctgttcgtgctggtcactg

SEQ ID NO: 207754 - DNA, 36 bp, Artificial Sequence
  Description of Artificial Sequence: Synthetic oligonucleotide
ctgtgaactttctgttcgtgctggtcactgtaaaac

SEQ ID NO: 207755 - DNA, 36 bp, Artificial Sequence
  Description of Artificial Sequence: Synthetic oligonucleotide
tgtgaactttctgttcgtgctggtcactgtaaaacc

SEQ ID NO: 207756 - DNA, 35 bp, Artificial Sequence
  Description of Artificial Sequence: Synthetic oligonucleotide
gtgaactttctgttcgtgctggtcactgtaaaacc

SEQ ID NO: 207757 - DNA, 35 bp, Artificial Sequence
  Description of Artificial Sequence: Synthetic oligonucleotide
tgaactttctgttcgtgctggtcactgtaaaaccc

SEQ ID NO: 207758 - DNA, 34 bp, Artificial Sequence
  Description of Artificial Sequence: Synthetic oligonucleotide
gaactttctgttcgtgctggtcactgtaaaaccc

SEQ ID NO: 207759 - DNA, 34 bp, Artificial Sequence
  Description of Artificial Sequence: Synthetic oligonucleotide
aactttctgttcgtgctggtcactgtaaaacccc

SEQ ID NO: 207760 - DNA, 33 bp, Artificial Sequence
  Description of Artificial Sequence: Synthetic oligonucleotide
actttctgttcgtgctggtcactgtaaaacccc

SEQ ID NO: 207761 - DNA, 32 bp, Artificial Sequence
  Description of Artificial Sequence: Synthetic oligonucleotide
ctttctgttcgtgctggtcactgtaaaacccc

SEQ ID NO: 207762 - DNA, 33 bp, Artificial Sequence
  Description of Artificial Sequence: Synthetic oligonucleotide
tttctgttcgtgctggtcactgtaaaaccccag

SEQ ID NO: 207763 - DNA, 32 bp, Artificial Sequence
  Description of Artificial Sequence: Synthetic oligonucleotide
ttctgttcgtgctggtcactgtaaaaccccag

SEQ ID NO: 207764 - DNA, 31 bp, Artificial Sequence
  Description of Artificial Sequence: Synthetic oligonucleotide
tctgttcgtgctggtcactgtaaaaccccag

SEQ ID NO: 207765 - DNA, 30 bp, Artificial Sequence
  Description of Artificial Sequence: Synthetic oligonucleotide
ctgttcgtgctggtcactgtaaaaccccag

SEQ ID NO: 207766 - DNA, 31 bp, Artificial Sequence
  Description of Artificial Sequence: Synthetic oligonucleotide
tgttcgtgctggtcactgtaaaaccccagag

SEQ ID NO: 207767 - DNA, 30 bp, Artificial Sequence
  Description of Artificial Sequence: Synthetic oligonucleotide
gttcgtgctggtcactgtaaaaccccagag

SEQ ID NO: 207768 - DNA, 30 bp, Artificial Sequence
  Description of Artificial Sequence: Synthetic oligonucleotide
ttcgtgctggtcactgtaaaaccccagagc

SEQ ID NO: 207769 - DNA, 29 bp, Artificial Sequence
  Description of Artificial Sequence: Synthetic oligonucleotide
tcgtgctggtcactgtaaaaccccagagc

SEQ ID NO: 207770 - DNA, 28 bp, Artificial Sequence
  Description of Artificial Sequence: Synthetic oligonucleotide
cgtgctggtcactgtaaaaccccagagc

SEQ ID NO: 207771 - DNA, 29 bp, Artificial Sequence
  Description of Artificial Sequence: Synthetic oligonucleotide
gtgctggtcactgtaaaaccccagagcag

SEQ ID NO: 207772 - DNA, 32 bp, Artificial Sequence
  Description of Artificial Sequence: Synthetic oligonucleotide
tgctggtcactgtaaaaccccagagcagtttc

SEQ ID NO: 207773 - DNA, 31 bp, Artificial Sequence
  Description of Artificial Sequence: Synthetic oligonucleotide
gctggtcactgtaaaaccccagagcagtttc

SEQ ID NO: 207774 - DNA, 31 bp, Artificial Sequence
  Description of Artificial Sequence: Synthetic oligonucleotide
ctggtcactgtaaaaccccagagcagtttcc

SEQ ID NO: 207775 - DNA, 35 bp, Artificial Sequence
  Description of Artificial Sequence: Synthetic oligonucleotide
tggtcactgtaaaaccccagagcagtttccatttg

SEQ ID NO: 207776 - DNA, 34 bp, Artificial Sequence
  Description of Artificial Sequence: Synthetic oligonucleotide
ggtcactgtaaaaccccagagcagtttccatttg

SEQ ID NO: 207777 - DNA, 34 bp, Artificial Sequence
  Description of Artificial Sequence: Synthetic oligonucleotide
gtcactgtaaaaccccagagcagtttccatttgc

SEQ ID NO: 207778 - DNA, 34 bp, Artificial Sequence
  Description of Artificial Sequence: Synthetic oligonucleotide
tcactgtaaaaccccagagcagtttccatttgcc

SEQ ID NO: 207779 - DNA, 33 bp, Artificial Sequence
  Description of Artificial Sequence: Synthetic oligonucleotide
cactgtaaaaccccagagcagtttccatttgcc

SEQ ID NO: 207780 - DNA, 34 bp, Artificial Sequence
  Description of Artificial Sequence: Synthetic oligonucleotide
actgtaaaaccccagagcagtttccatttgccag

SEQ ID NO: 207781 - DNA, 33 bp, Artificial Sequence
  Description of Artificial Sequence: Synthetic oligonucleotide
ctgtaaaaccccagagcagtttccatttgccag

SEQ ID NO: 207782 - DNA, 34 bp, Artificial Sequence
  Description of Artificial Sequence: Synthetic oligonucleotide
tgtaaaaccccagagcagtttccatttgccagtc

SEQ ID NO: 207783 - DNA, 33 bp, Artificial Sequence
  Description of Artificial Sequence: Synthetic oligonucleotide
gtaaaaccccagagcagtttccatttgccagtc

SEQ ID NO: 207784 - DNA, 33 bp, Artificial Sequence
  Description of Artificial Sequence: Synthetic oligonucleotide
taaaaccccagagcagtttccatttgccagtcc

SEQ ID NO: 207785 - DNA, 32 bp, Artificial Sequence
  Description of Artificial Sequence: Synthetic oligonucleotide
aaaaccccagagcagtttccatttgccagtcc

SEQ ID NO: 207786 - DNA, 31 bp, Artificial Sequence
  Description of Artificial Sequence: Synthetic oligonucleotide
aaaccccagagcagtttccatttgccagtcc

SEQ ID NO: 207787 - DNA, 30 bp, Artificial Sequence
  Description of Artificial Sequence: Synthetic oligonucleotide
aaccccagagcagtttccatttgccagtcc

SEQ ID NO: 207788 - DNA, 29 bp, Artificial Sequence
  Description of Artificial Sequence: Synthetic oligonucleotide
accccagagcagtttccatttgccagtcc

SEQ ID NO: 207789 - DNA, 28 bp, Artificial Sequence
  Description of Artificial Sequence: Synthetic oligonucleotide
ccccagagcagtttccatttgccagtcc

SEQ ID NO: 207790 - DNA, 30 bp, Artificial Sequence
  Description of Artificial Sequence: Synthetic oligonucleotide
cccagagcagtttccatttgccagtcctac

SEQ ID NO: 207791 - DNA, 30 bp, Artificial Sequence
  Description of Artificial Sequence: Synthetic oligonucleotide
ccagagcagtttccatttgccagtcctacg

SEQ ID NO: 207792 - DNA, 32 bp, Artificial Sequence
  Description of Artificial Sequence: Synthetic oligonucleotide
cagagcagtttccatttgccagtcctacgatc

SEQ ID NO: 207793 - DNA, 32 bp, Artificial Sequence
  Description of Artificial Sequence: Synthetic oligonucleotide
agagcagtttccatttgccagtcctacgatcc

SEQ ID NO: 207794 - DNA, 31 bp, Artificial Sequence
  Description of Artificial Sequence: Synthetic oligonucleotide
gagcagtttccatttgccagtcctacgatcc

SEQ ID NO: 207795 - DNA, 31 bp, Artificial Sequence
  Description of Artificial Sequence: Synthetic oligonucleotide
agcagtttccatttgccagtcctacgatccc

SEQ ID NO: 207796 - DNA, 30 bp, Artificial Sequence
  Description of Artificial Sequence: Synthetic oligonucleotide
gcagtttccatttgccagtcctacgatccc

SEQ ID NO: 207797 - DNA, 37 bp, Artificial Sequence
  Description of Artificial Sequence: Synthetic oligonucleotide
cagtttccatttgccagtcctacgatcccaattaatg

SEQ ID NO: 207798 - DNA, 38 bp, Artificial Sequence
  Description of Artificial Sequence: Synthetic oligonucleotide
agtttccatttgccagtcctacgatcccaattaatgac

SEQ ID NO: 207799 - DNA, 37 bp, Artificial Sequence
  Description of Artificial Sequence: Synthetic oligonucleotide
gtttccatttgccagtcctacgatcccaattaatgac

SEQ ID NO: 207800 - DNA, 40 bp, Artificial Sequence
  Description of Artificial Sequence: Synthetic oligonucleotide
tttccatttgccagtcctacgatcccaattaatgactttg

SEQ ID NO: 207801 - DNA, 39 bp, Artificial Sequence
  Description of Artificial Sequence: Synthetic oligonucleotide
ttccatttgccagtcctacgatcccaattaatgactttg

SEQ ID NO: 207802 - DNA, 38 bp, Artificial Sequence
  Description of Artificial Sequence: Synthetic oligonucleotide
tccatttgccagtcctacgatcccaattaatgactttg

SEQ ID NO: 207803 - DNA, 37 bp, Artificial Sequence
  Description of Artificial Sequence: Synthetic oligonucleotide
ccatttgccagtcctacgatcccaattaatgactttg

SEQ ID NO: 207804 - DNA, 38 bp, Artificial Sequence
  Description of Artificial Sequence: Synthetic oligonucleotide
catttgccagtcctacgatcccaattaatgactttgag

SEQ ID NO: 207805 - DNA, 41 bp, Artificial Sequence
  Description of Artificial Sequence: Synthetic oligonucleotide
atttgccagtcctacgatcccaattaatgactttgagtttc

SEQ ID NO: 207806 - DNA, 40 bp, Artificial Sequence
  Description of Artificial Sequence: Synthetic oligonucleotide
tttgccagtcctacgatcccaattaatgactttgagtttc

SEQ ID NO: 207807 - DNA, 39 bp, Artificial Sequence
  Description of Artificial Sequence: Synthetic oligonucleotide
ttgccagtcctacgatcccaattaatgactttgagtttc

SEQ ID NO: 207808 - DNA, 38 bp, Artificial Sequence
  Description of Artificial Sequence: Synthetic oligonucleotide
tgccagtcctacgatcccaattaatgactttgagtttc

SEQ ID NO: 207809 - DNA, 37 bp, Artificial Sequence
  Description of Artificial Sequence: Synthetic oligonucleotide
gccagtcctacgatcccaattaatgactttgagtttc

SEQ ID NO: 207810 - DNA, 37 bp, Artificial Sequence
  Description of Artificial Sequence: Synthetic oligonucleotide
ccagtcctacgatcccaattaatgactttgagtttcc

SEQ ID NO: 207811 - DNA, 38 bp, Artificial Sequence
  Description of Artificial Sequence: Synthetic oligonucleotide
cagtcctacgatcccaattaatgactttgagtttccag

SEQ ID NO: 207812 - DNA, 39 bp, Artificial Sequence
  Description of Artificial Sequence: Synthetic oligonucleotide
agtcctacgatcccaattaatgactttgagtttccagtc

SEQ ID NO: 207813 - DNA, 38 bp, Artificial Sequence
  Description of Artificial Sequence: Synthetic oligonucleotide
gtcctacgatcccaattaatgactttgagtttccagtc

SEQ ID NO: 207814 - DNA, 38 bp, Artificial Sequence
  Description of Artificial Sequence: Synthetic oligonucleotide
tcctacgatcccaattaatgactttgagtttccagtcg

SEQ ID NO: 207815 - DNA, 37 bp, Artificial Sequence
  Description of Artificial Sequence: Synthetic oligonucleotide
cctacgatcccaattaatgactttgagtttccagtcg

SEQ ID NO: 207816 - DNA, 37 bp, Artificial Sequence
  Description of Artificial Sequence: Synthetic oligonucleotide
ctacgatcccaattaatgactttgagtttccagtcgg

SEQ ID NO: 207817 - DNA, 37 bp, Artificial Sequence
  Description of Artificial Sequence: Synthetic oligonucleotide
tacgatcccaattaatgactttgagtttccagtcggg

SEQ ID NO: 207818 - DNA, 36 bp, Artificial Sequence
  Description of Artificial Sequence: Synthetic oligonucleotide
acgatcccaattaatgactttgagtttccagtcggg

SEQ ID NO: 207819 - DNA, 35 bp, Artificial Sequence
  Description of Artificial Sequence: Synthetic oligonucleotide
cgatcccaattaatgactttgagtttccagtcggg

SEQ ID NO: 207820 - DNA, 36 bp, Artificial Sequence
  Description of Artificial Sequence: Synthetic oligonucleotide
gatcccaattaatgactttgagtttccagtcgggac

SEQ ID NO: 207821 - DNA, 38 bp, Artificial Sequence
  Description of Artificial Sequence: Synthetic oligonucleotide
atcccaattaatgactttgagtttccagtcgggacatc

SEQ ID NO: 207822 - DNA, 37 bp, Artificial Sequence
  Description of Artificial Sequence: Synthetic oligonucleotide
tcccaattaatgactttgagtttccagtcgggacatc

SEQ ID NO: 207823 - DNA, 36 bp, Artificial Sequence
  Description of Artificial Sequence: Synthetic oligonucleotide
cccaattaatgactttgagtttccagtcgggacatc

SEQ ID NO: 207824 - DNA, 39 bp, Artificial Sequence
  Description of Artificial Sequence: Synthetic oligonucleotide
ccaattaatgactttgagtttccagtcgggacatctttg

SEQ ID NO: 207825 - DNA, 45 bp, Artificial Sequence
  Description of Artificial Sequence: Synthetic oligonucleotide
caattaatgactttgagtttccagtcgggacatctttgaattatg

SEQ ID NO: 207826 - DNA, 48 bp, Artificial Sequence
  Description of Artificial Sequence: Synthetic oligonucleotide
aattaatgactttgagtttccagtcgggacatctttgaattatgaatg

SEQ ID NO: 207827 - DNA, 47 bp, Artificial Sequence
  Description of Artificial Sequence: Synthetic oligonucleotide
attaatgactttgagtttccagtcgggacatctttgaattatgaatg

SEQ ID NO: 207828 - DNA, 46 bp, Artificial Sequence
  Description of Artificial Sequence: Synthetic oligonucleotide
ttaatgactttgagtttccagtcgggacatctttgaattatgaatg

SEQ ID NO: 207829 - DNA, 45 bp, Artificial Sequence
  Description of Artificial Sequence: Synthetic oligonucleotide
taatgactttgagtttccagtcgggacatctttgaattatgaatg

SEQ ID NO: 207830 - DNA, 44 bp, Artificial Sequence
  Description of Artificial Sequence: Synthetic oligonucleotide
aatgactttgagtttccagtcgggacatctttgaattatgaatg

SEQ ID NO: 207831 - DNA, 43 bp, Artificial Sequence
  Description of Artificial Sequence: Synthetic oligonucleotide
atgactttgagtttccagtcgggacatctttgaattatgaatg

SEQ ID NO: 207832 - DNA, 42 bp, Artificial Sequence
  Description of Artificial Sequence: Synthetic oligonucleotide
tgactttgagtttccagtcgggacatctttgaattatgaatg

SEQ ID NO: 207833 - DNA, 41 bp, Artificial Sequence
  Description of Artificial Sequence: Synthetic oligonucleotide
gactttgagtttccagtcgggacatctttgaattatgaatg

SEQ ID NO: 207834 - DNA, 41 bp, Artificial Sequence
  Description of Artificial Sequence: Synthetic oligonucleotide
actttgagtttccagtcgggacatctttgaattatgaatgc

SEQ ID NO: 207835 - DNA, 40 bp, Artificial Sequence
  Description of Artificial Sequence: Synthetic oligonucleotide
ctttgagtttccagtcgggacatctttgaattatgaatgc

SEQ ID NO: 207836 - DNA, 40 bp, Artificial Sequence
  Description of Artificial Sequence: Synthetic oligonucleotide
tttgagtttccagtcgggacatctttgaattatgaatgcc

SEQ ID NO: 207837 - DNA, 39 bp, Artificial Sequence
  Description of Artificial Sequence: Synthetic oligonucleotide
ttgagtttccagtcgggacatctttgaattatgaatgcc

SEQ ID NO: 207838 - DNA, 38 bp, Artificial Sequence
  Description of Artificial Sequence: Synthetic oligonucleotide
tgagtttccagtcgggacatctttgaattatgaatgcc

SEQ ID NO: 207839 - DNA, 37 bp, Artificial Sequence
  Description of Artificial Sequence: Synthetic oligonucleotide
gagtttccagtcgggacatctttgaattatgaatgcc

SEQ ID NO: 207840 - DNA, 37 bp, Artificial Sequence
  Description of Artificial Sequence: Synthetic oligonucleotide
agtttccagtcgggacatctttgaattatgaatgccg

SEQ ID NO: 207841 - DNA, 36 bp, Artificial Sequence
  Description of Artificial Sequence: Synthetic oligonucleotide
gtttccagtcgggacatctttgaattatgaatgccg

SEQ ID NO: 207842 - DNA, 37 bp, Artificial Sequence
  Description of Artificial Sequence: Synthetic oligonucleotide
tttccagtcgggacatctttgaattatgaatgccgtc

SEQ ID NO: 207843 - DNA, 36 bp, Artificial Sequence
  Description of Artificial Sequence: Synthetic oligonucleotide
ttccagtcgggacatctttgaattatgaatgccgtc

SEQ ID NO: 207844 - DNA, 35 bp, Artificial Sequence
  Description of Artificial Sequence: Synthetic oligonucleotide
tccagtcgggacatctttgaattatgaatgccgtc

SEQ ID NO: 207845 - DNA, 34 bp, Artificial Sequence
  Description of Artificial Sequence: Synthetic oligonucleotide
ccagtcgggacatctttgaattatgaatgccgtc

SEQ ID NO: 207846 - DNA, 34 bp, Artificial Sequence
  Description of Artificial Sequence: Synthetic oligonucleotide
cagtcgggacatctttgaattatgaatgccgtcc

SEQ ID NO: 207847 - DNA, 35 bp, Artificial Sequence
  Description of Artificial Sequence: Synthetic oligonucleotide
agtcgggacatctttgaattatgaatgccgtcctg

SEQ ID NO: 207848 - DNA, 34 bp, Artificial Sequence
  Description of Artificial Sequence: Synthetic oligonucleotide
gtcgggacatctttgaattatgaatgccgtcctg

SEQ ID NO: 207849 - DNA, 34 bp, Artificial Sequence
  Description of Artificial Sequence: Synthetic oligonucleotide
tcgggacatctttgaattatgaatgccgtcctgg

SEQ ID NO: 207850 - DNA, 33 bp, Artificial Sequence
  Description of Artificial Sequence: Synthetic oligonucleotide
cgggacatctttgaattatgaatgccgtcctgg

SEQ ID NO: 207851 - DNA, 33 bp, Artificial Sequence
  Description of Artificial Sequence: Synthetic oligonucleotide
gggacatctttgaattatgaatgccgtcctggg

SEQ ID NO: 207852 - DNA, 39 bp, Artificial Sequence
  Description of Artificial Sequence: Synthetic oligonucleotide
ggacatctttgaattatgaatgccgtcctgggtattttg

SEQ ID NO: 207853 - DNA, 39 bp, Artificial Sequence
  Description of Artificial Sequence: Synthetic oligonucleotide
gacatctttgaattatgaatgccgtcctgggtattttgg

SEQ ID NO: 207854 - DNA, 39 bp, Artificial Sequence
  Description of Artificial Sequence: Synthetic oligonucleotide
acatctttgaattatgaatgccgtcctgggtattttggg

SEQ ID NO: 207855 - DNA, 38 bp, Artificial Sequence
  Description of Artificial Sequence: Synthetic oligonucleotide
catctttgaattatgaatgccgtcctgggtattttggg

SEQ ID NO: 207856 - DNA, 43 bp, Artificial Sequence
  Description of Artificial Sequence: Synthetic oligonucleotide
atctttgaattatgaatgccgtcctgggtattttgggaaaatg

SEQ ID NO: 207857 - DNA, 42 bp, Artificial Sequence
  Description of Artificial Sequence: Synthetic oligonucleotide
tctttgaattatgaatgccgtcctgggtattttgggaaaatg

SEQ ID NO: 207858 - DNA, 41 bp, Artificial Sequence
  Description of Artificial Sequence: Synthetic oligonucleotide
ctttgaattatgaatgccgtcctgggtattttgggaaaatg

SEQ ID NO: 207859 - DNA, 43 bp, Artificial Sequence
  Description of Artificial Sequence: Synthetic oligonucleotide
tttgaattatgaatgccgtcctgggtattttgggaaaatgttc

SEQ ID NO: 207860 - DNA, 42 bp, Artificial Sequence
  Description of Artificial Sequence: Synthetic oligonucleotide
ttgaattatgaatgccgtcctgggtattttgggaaaatgttc

SEQ ID NO: 207861 - DNA, 41 bp, Artificial Sequence
  Description of Artificial Sequence: Synthetic oligonucleotide
tgaattatgaatgccgtcctgggtattttgggaaaatgttc

SEQ ID NO: 207862 - DNA, 40 bp, Artificial Sequence
  Description of Artificial Sequence: Synthetic oligonucleotide
gaattatgaatgccgtcctgggtattttgggaaaatgttc

SEQ ID NO: 207863 - DNA, 41 bp, Artificial Sequence
  Description of Artificial Sequence: Synthetic oligonucleotide
aattatgaatgccgtcctgggtattttgggaaaatgttctc

SEQ ID NO: 207864 - DNA, 40 bp, Artificial Sequence
  Description of Artificial Sequence: Synthetic oligonucleotide
attatgaatgccgtcctgggtattttgggaaaatgttctc

SEQ ID NO: 207865 - DNA, 39 bp, Artificial Sequence
  Description of Artificial Sequence: Synthetic oligonucleotide
ttatgaatgccgtcctgggtattttgggaaaatgttctc

SEQ ID NO: 207866 - DNA, 38 bp, Artificial Sequence
  Description of Artificial Sequence: Synthetic oligonucleotide
tatgaatgccgtcctgggtattttgggaaaatgttctc

SEQ ID NO: 207867 - DNA, 37 bp, Artificial Sequence
  Description of Artificial Sequence: Synthetic oligonucleotide
atgaatgccgtcctgggtattttgggaaaatgttctc

SEQ ID NO: 207868 - DNA, 36 bp, Artificial Sequence
  Description of Artificial Sequence: Synthetic oligonucleotide
tgaatgccgtcctgggtattttgggaaaatgttctc

SEQ ID NO: 207869 - DNA, 35 bp, Artificial Sequence
  Description of Artificial Sequence: Synthetic oligonucleotide
gaatgccgtcctgggtattttgggaaaatgttctc

SEQ ID NO: 207870 - DNA, 38 bp, Artificial Sequence
  Description of Artificial Sequence: Synthetic oligonucleotide
aatgccgtcctgggtattttgggaaaatgttctctatc

SEQ ID NO: 207871 - DNA, 37 bp, Artificial Sequence
  Description of Artificial Sequence: Synthetic oligonucleotide
atgccgtcctgggtattttgggaaaatgttctctatc

SEQ ID NO: 207872 - DNA, 36 bp, Artificial Sequence
  Description of Artificial Sequence: Synthetic oligonucleotide
tgccgtcctgggtattttgggaaaatgttctctatc

SEQ ID NO: 207873 - DNA, 35 bp, Artificial Sequence
  Description of Artificial Sequence: Synthetic oligonucleotide
gccgtcctgggtattttgggaaaatgttctctatc

SEQ ID NO: 207874 - DNA, 36 bp, Artificial Sequence
  Description of Artificial Sequence: Synthetic oligonucleotide
ccgtcctgggtattttgggaaaatgttctctatctc

SEQ ID NO: 207875 - DNA, 36 bp, Artificial Sequence
  Description of Artificial Sequence: Synthetic oligonucleotide
cgtcctgggtattttgggaaaatgttctctatctcc

SEQ ID NO: 207876 - DNA, 37 bp, Artificial Sequence
  Description of Artificial Sequence: Synthetic oligonucleotide
gtcctgggtattttgggaaaatgttctctatctcctg

SEQ ID NO: 207877 - DNA, 37 bp, Artificial Sequence
  Description of Artificial Sequence: Synthetic oligonucleotide
tcctgggtattttgggaaaatgttctctatctcctgc

SEQ ID NO: 207878 - DNA, 36 bp, Artificial Sequence
  Description of Artificial Sequence: Synthetic oligonucleotide
cctgggtattttgggaaaatgttctctatctcctgc

SEQ ID NO: 207879 - DNA, 36 bp, Artificial Sequence
  Description of Artificial Sequence: Synthetic oligonucleotide
ctgggtattttgggaaaatgttctctatctcctgcc

SEQ ID NO: 207880 - DNA, 38 bp, Artificial Sequence
  Description of Artificial Sequence: Synthetic oligonucleotide
tgggtattttgggaaaatgttctctatctcctgcctag

SEQ ID NO: 207881 - DNA, 37 bp, Artificial Sequence
  Description of Artificial Sequence: Synthetic oligonucleotide
gggtattttgggaaaatgttctctatctcctgcctag

SEQ ID NO: 207882 - DNA, 41 bp, Artificial Sequence
  Description of Artificial Sequence: Synthetic oligonucleotide
ggtattttgggaaaatgttctctatctcctgcctagaaaac

SEQ ID NO: 207883 - DNA, 43 bp, Artificial Sequence
  Description of Artificial Sequence: Synthetic oligonucleotide
gtattttgggaaaatgttctctatctcctgcctagaaaacttg

SEQ ID NO: 207884 - DNA, 43 bp, Artificial Sequence
  Description of Artificial Sequence: Synthetic oligonucleotide
tattttgggaaaatgttctctatctcctgcctagaaaacttgg

SEQ ID NO: 207885 - DNA, 42 bp, Artificial Sequence
  Description of Artificial Sequence: Synthetic oligonucleotide
attttgggaaaatgttctctatctcctgcctagaaaacttgg

SEQ ID NO: 207886 - DNA, 41 bp, Artificial Sequence
  Description of Artificial Sequence: Synthetic oligonucleotide
ttttgggaaaatgttctctatctcctgcctagaaaacttgg

SEQ ID NO: 207887 - DNA, 40 bp, Artificial Sequence
  Description of Artificial Sequence: Synthetic oligonucleotide
tttgggaaaatgttctctatctcctgcctagaaaacttgg

SEQ ID NO: 207888 - DNA, 39 bp, Artificial Sequence
  Description of Artificial Sequence: Synthetic oligonucleotide
ttgggaaaatgttctctatctcctgcctagaaaacttgg

SEQ ID NO: 207889 - DNA, 38 bp, Artificial Sequence
  Description of Artificial Sequence: Synthetic oligonucleotide
tgggaaaatgttctctatctcctgcctagaaaacttgg

SEQ ID NO: 207890 - DNA, 37 bp, Artificial Sequence
  Description of Artificial Sequence: Synthetic oligonucleotide
gggaaaatgttctctatctcctgcctagaaaacttgg

SEQ ID NO: 207891 - DNA, 38 bp, Artificial Sequence
  Description of Artificial Sequence: Synthetic oligonucleotide
ggaaaatgttctctatctcctgcctagaaaacttggtc

SEQ ID NO: 207892 - DNA, 39 bp, Artificial Sequence
  Description of Artificial Sequence: Synthetic oligonucleotide
gaaaatgttctctatctcctgcctagaaaacttggtctg

SEQ ID NO: 207893 - DNA, 39 bp, Artificial Sequence
  Description of Artificial Sequence: Synthetic oligonucleotide
aaaatgttctctatctcctgcctagaaaacttggtctgg

SEQ ID NO: 207894 - DNA, 38 bp, Artificial Sequence
  Description of Artificial Sequence: Synthetic oligonucleotide
aaatgttctctatctcctgcctagaaaacttggtctgg

SEQ ID NO: 207895 - DNA, 37 bp, Artificial Sequence
  Description of Artificial Sequence: Synthetic oligonucleotide
aatgttctctatctcctgcctagaaaacttggtctgg

SEQ ID NO: 207896 - DNA, 36 bp, Artificial Sequence
  Description of Artificial Sequence: Synthetic oligonucleotide
atgttctctatctcctgcctagaaaacttggtctgg

SEQ ID NO: 207897 - DNA, 35 bp, Artificial Sequence
  Description of Artificial Sequence: Synthetic oligonucleotide
tgttctctatctcctgcctagaaaacttggtctgg

SEQ ID NO: 207898 - DNA, 34 bp, Artificial Sequence
  Description of Artificial Sequence: Synthetic oligonucleotide
gttctctatctcctgcctagaaaacttggtctgg

SEQ ID NO: 207899 - DNA, 35 bp, Artificial Sequence
  Description of Artificial Sequence: Synthetic oligonucleotide
ttctctatctcctgcctagaaaacttggtctggtc

SEQ ID NO: 207900 - DNA, 34 bp, Artificial Sequence
  Description of Artificial Sequence: Synthetic oligonucleotide
tctctatctcctgcctagaaaacttggtctggtc

SEQ ID NO: 207901 - DNA, 33 bp, Artificial Sequence
  Description of Artificial Sequence: Synthetic oligonucleotide
ctctatctcctgcctagaaaacttggtctggtc

SEQ ID NO: 207902 - DNA, 35 bp, Artificial Sequence
  Description of Artificial Sequence: Synthetic oligonucleotide
tctatctcctgcctagaaaacttggtctggtcaag

SEQ ID NO: 207903 - DNA, 34 bp, Artificial Sequence
  Description of Artificial Sequence: Synthetic oligonucleotide
ctatctcctgcctagaaaacttggtctggtcaag

SEQ ID NO: 207904 - DNA, 35 bp, Artificial Sequence
  Description of Artificial Sequence: Synthetic oligonucleotide
tatctcctgcctagaaaacttggtctggtcaagtg

SEQ ID NO: 207905 - DNA, 34 bp, Artificial Sequence
  Description of Artificial Sequence: Synthetic oligonucleotide
atctcctgcctagaaaacttggtctggtcaagtg

SEQ ID NO: 207906 - DNA, 33 bp, Artificial Sequence
  Description of Artificial Sequence: Synthetic oligonucleotide
tctcctgcctagaaaacttggtctggtcaagtg

SEQ ID NO: 207907 - DNA, 32 bp, Artificial Sequence
  Description of Artificial Sequence: Synthetic oligonucleotide
ctcctgcctagaaaacttggtctggtcaagtg

SEQ ID NO: 207908 - DNA, 34 bp, Artificial Sequence
  Description of Artificial Sequence: Synthetic oligonucleotide
tcctgcctagaaaacttggtctggtcaagtgttg

SEQ ID NO: 207909 - DNA, 33 bp, Artificial Sequence
  Description of Artificial Sequence: Synthetic oligonucleotide
cctgcctagaaaacttggtctggtcaagtgttg

SEQ ID NO: 207910 - DNA, 35 bp, Artificial Sequence
  Description of Artificial Sequence: Synthetic oligonucleotide
ctgcctagaaaacttggtctggtcaagtgttgaag

SEQ ID NO: 207911 - DNA, 36 bp, Artificial Sequence
  Description of Artificial Sequence: Synthetic oligonucleotide
tgcctagaaaacttggtctggtcaagtgttgaagac

SEQ ID NO: 207912 - DNA, 35 bp, Artificial Sequence
  Description of Artificial Sequence: Synthetic oligonucleotide
gcctagaaaacttggtctggtcaagtgttgaagac

SEQ ID NO: 207913 - DNA, 37 bp, Artificial Sequence
  Description of Artificial Sequence: Synthetic oligonucleotide
cctagaaaacttggtctggtcaagtgttgaagacaac

SEQ ID NO: 207914 - DNA, 38 bp, Artificial Sequence
  Description of Artificial Sequence: Synthetic oligonucleotide
ctagaaaacttggtctggtcaagtgttgaagacaactg

SEQ ID NO: 207915 - DNA, 40 bp, Artificial Sequence
  Description of Artificial Sequence: Synthetic oligonucleotide
tagaaaacttggtctggtcaagtgttgaagacaactgtag

SEQ ID NO: 207916 - DNA, 39 bp, Artificial Sequence
  Description of Artificial Sequence: Synthetic oligonucleotide
agaaaacttggtctggtcaagtgttgaagacaactgtag

SEQ ID NO: 207917 - DNA, 38 bp, Artificial Sequence
  Description of Artificial Sequence: Synthetic oligonucleotide
gaaaacttggtctggtcaagtgttgaagacaactgtag

SEQ ID NO: 207918 - DNA, 39 bp, Artificial Sequence
  Description of Artificial Sequence: Synthetic oligonucleotide
aaaacttggtctggtcaagtgttgaagacaactgtagac

SEQ ID NO: 207919 - DNA, 38 bp, Artificial Sequence
  Description of Artificial Sequence: Synthetic oligonucleotide
aaacttggtctggtcaagtgttgaagacaactgtagac

SEQ ID NO: 207920 - DNA, 37 bp, Artificial Sequence
  Description of Artificial Sequence: Synthetic oligonucleotide
aacttggtctggtcaagtgttgaagacaactgtagac

SEQ ID NO: 207921 - DNA, 36 bp, Artificial Sequence
  Description of Artificial Sequence: Synthetic oligonucleotide
acttggtctggtcaagtgttgaagacaactgtagac

SEQ ID NO: 207922 - DNA, 35 bp, Artificial Sequence
  Description of Artificial Sequence: Synthetic oligonucleotide
cttggtctggtcaagtgttgaagacaactgtagac

SEQ ID NO: 207923 - DNA, 35 bp, Artificial Sequence
  Description of Artificial Sequence: Synthetic oligonucleotide
ttggtctggtcaagtgttgaagacaactgtagacg

SEQ ID NO: 207924 - DNA, 34 bp, Artificial Sequence
  Description of Artificial Sequence: Synthetic oligonucleotide
tggtctggtcaagtgttgaagacaactgtagacg

SEQ ID NO: 207925 - DNA, 33 bp, Artificial Sequence
  Description of Artificial Sequence: Synthetic oligonucleotide
ggtctggtcaagtgttgaagacaactgtagacg

SEQ ID NO: 207926 - DNA, 38 bp, Artificial Sequence
  Description of Artificial Sequence: Synthetic oligonucleotide
gtctggtcaagtgttgaagacaactgtagacgaaaatc

SEQ ID NO: 207927 - DNA, 40 bp, Artificial Sequence
  Description of Artificial Sequence: Synthetic oligonucleotide
tctggtcaagtgttgaagacaactgtagacgaaaatcatg

SEQ ID NO: 207928 - DNA, 39 bp, Artificial Sequence
  Description of Artificial Sequence: Synthetic oligonucleotide
ctggtcaagtgttgaagacaactgtagacgaaaatcatg

SEQ ID NO: 207929 - DNA, 40 bp, Artificial Sequence
  Description of Artificial Sequence: Synthetic oligonucleotide
tggtcaagtgttgaagacaactgtagacgaaaatcatgtg

SEQ ID NO: 207930 - DNA, 39 bp, Artificial Sequence
  Description of Artificial Sequence: Synthetic oligonucleotide
ggtcaagtgttgaagacaactgtagacgaaaatcatgtg

SEQ ID NO: 207931 - DNA, 39 bp, Artificial Sequence
  Description of Artificial Sequence: Synthetic oligonucleotide
gtcaagtgttgaagacaactgtagacgaaaatcatgtgg

SEQ ID NO: 207932 - DNA, 40 bp, Artificial Sequence
  Description of Artificial Sequence: Synthetic oligonucleotide
tcaagtgttgaagacaactgtagacgaaaatcatgtggac

SEQ ID NO: 207933 - DNA, 39 bp, Artificial Sequence
  Description of Artificial Sequence: Synthetic oligonucleotide
caagtgttgaagacaactgtagacgaaaatcatgtggac

SEQ ID NO: 207934 - DNA, 39 bp, Artificial Sequence
  Description of Artificial Sequence: Synthetic oligonucleotide
aagtgttgaagacaactgtagacgaaaatcatgtggacc

SEQ ID NO: 207935 - DNA, 38 bp, Artificial Sequence
  Description of Artificial Sequence: Synthetic oligonucleotide
agtgttgaagacaactgtagacgaaaatcatgtggacc

SEQ ID NO: 207936 - DNA, 37 bp, Artificial Sequence
  Description of Artificial Sequence: Synthetic oligonucleotide
gtgttgaagacaactgtagacgaaaatcatgtggacc

SEQ ID NO: 207937 - DNA, 38 bp, Artificial Sequence
  Description of Artificial Sequence: Synthetic oligonucleotide
tgttgaagacaactgtagacgaaaatcatgtggacctc

SEQ ID NO: 207938 - DNA, 37 bp, Artificial Sequence
  Description of Artificial Sequence: Synthetic oligonucleotide
gttgaagacaactgtagacgaaaatcatgtggacctc

SEQ ID NO: 207939 - DNA, 37 bp, Artificial Sequence
  Description of Artificial Sequence: Synthetic oligonucleotide
ttgaagacaactgtagacgaaaatcatgtggacctcc

SEQ ID NO: 207940 - DNA, 36 bp, Artificial Sequence
  Description of Artificial Sequence: Synthetic oligonucleotide
tgaagacaactgtagacgaaaatcatgtggacctcc

SEQ ID NO: 207941 - DNA, 35 bp, Artificial Sequence
  Description of Artificial Sequence: Synthetic oligonucleotide
gaagacaactgtagacgaaaatcatgtggacctcc

SEQ ID NO: 207942 - DNA, 36 bp, Artificial Sequence
  Description of Artificial Sequence: Synthetic oligonucleotide
aagacaactgtagacgaaaatcatgtggacctccac

SEQ ID NO: 207943 - DNA, 35 bp, Artificial Sequence
  Description of Artificial Sequence: Synthetic oligonucleotide
agacaactgtagacgaaaatcatgtggacctccac

SEQ ID NO: 207944 - DNA, 34 bp, Artificial Sequence
  Description of Artificial Sequence: Synthetic oligonucleotide
gacaactgtagacgaaaatcatgtggacctccac

SEQ ID NO: 207945 - DNA, 34 bp, Artificial Sequence
  Description of Artificial Sequence: Synthetic oligonucleotide
acaactgtagacgaaaatcatgtggacctccacc

SEQ ID NO: 207946 - DNA, 33 bp, Artificial Sequence
  Description of Artificial Sequence: Synthetic oligonucleotide
caactgtagacgaaaatcatgtggacctccacc

SEQ ID NO: 207947 - DNA, 34 bp, Artificial Sequence
  Description of Artificial Sequence: Synthetic oligonucleotide
aactgtagacgaaaatcatgtggacctccaccag

SEQ ID NO: 207948 - DNA, 33 bp, Artificial Sequence
  Description of Artificial Sequence: Synthetic oligonucleotide
actgtagacgaaaatcatgtggacctccaccag

SEQ ID NO: 207949 - DNA, 32 bp, Artificial Sequence
  Description of Artificial Sequence: Synthetic oligonucleotide
ctgtagacgaaaatcatgtggacctccaccag

SEQ ID NO: 207950 - DNA, 34 bp, Artificial Sequence
  Description of Artificial Sequence: Synthetic oligonucleotide
tgtagacgaaaatcatgtggacctccaccagaac

SEQ ID NO: 207951 - DNA, 33 bp, Artificial Sequence
  Description of Artificial Sequence: Synthetic oligonucleotide
gtagacgaaaatcatgtggacctccaccagaac

SEQ ID NO: 207952 - DNA, 33 bp, Artificial Sequence
  Description of Artificial Sequence: Synthetic oligonucleotide
tagacgaaaatcatgtggacctccaccagaacc

SEQ ID NO: 207953 - DNA, 32 bp, Artificial Sequence
  Description of Artificial Sequence: Synthetic oligonucleotide
agacgaaaatcatgtggacctccaccagaacc

SEQ ID NO: 207954 - DNA, 31 bp, Artificial Sequence
  Description of Artificial Sequence: Synthetic oligonucleotide
gacgaaaatcatgtggacctccaccagaacc

SEQ ID NO: 207955 - DNA, 31 bp, Artificial Sequence
  Description of Artificial Sequence: Synthetic oligonucleotide
acgaaaatcatgtggacctccaccagaaccc

SEQ ID NO: 207956 - DNA, 30 bp, Artificial Sequence
  Description of Artificial Sequence: Synthetic oligonucleotide
cgaaaatcatgtggacctccaccagaaccc

SEQ ID NO: 207957 - DNA, 32 bp, Artificial Sequence
  Description of Artificial Sequence: Synthetic oligonucleotide
gaaaatcatgtggacctccaccagaacccttc

SEQ ID NO: 207958 - DNA, 35 bp, Artificial Sequence
  Description of Artificial Sequence: Synthetic oligonucleotide
aaaatcatgtggacctccaccagaacccttcaatg

SEQ ID NO: 207959 - DNA, 34 bp, Artificial Sequence
  Description of Artificial Sequence: Synthetic oligonucleotide
aaatcatgtggacctccaccagaacccttcaatg

SEQ ID NO: 207960 - DNA, 33 bp, Artificial Sequence
  Description of Artificial Sequence: Synthetic oligonucleotide
aatcatgtggacctccaccagaacccttcaatg

SEQ ID NO: 207961 - DNA, 32 bp, Artificial Sequence
  Description of Artificial Sequence: Synthetic oligonucleotide
atcatgtggacctccaccagaacccttcaatg

SEQ ID NO: 207962 - DNA, 31 bp, Artificial Sequence
  Description of Artificial Sequence: Synthetic oligonucleotide
tcatgtggacctccaccagaacccttcaatg

SEQ ID NO: 207963 - DNA, 30 bp, Artificial Sequence
  Description of Artificial Sequence: Synthetic oligonucleotide
catgtggacctccaccagaacccttcaatg

SEQ ID NO: 207964 - DNA, 30 bp, Artificial Sequence
  Description of Artificial Sequence: Synthetic oligonucleotide
atgtggacctccaccagaacccttcaatgg

SEQ ID NO: 207965 - DNA, 29 bp, Artificial Sequence
  Description of Artificial Sequence: Synthetic oligonucleotide
tgtggacctccaccagaacccttcaatgg

SEQ ID NO: 207966 - DNA, 28 bp, Artificial Sequence
  Description of Artificial Sequence: Synthetic oligonucleotide
gtggacctccaccagaacccttcaatgg

SEQ ID NO: 207967 - DNA, 31 bp, Artificial Sequence
  Description of Artificial Sequence: Synthetic oligonucleotide
tggacctccaccagaacccttcaatggaatg

SEQ ID NO: 207968 - DNA, 30 bp, Artificial Sequence
  Description of Artificial Sequence: Synthetic oligonucleotide
ggacctccaccagaacccttcaatggaatg

SEQ ID NO: 207969 - DNA, 30 bp, Artificial Sequence
  Description of Artificial Sequence: Synthetic oligonucleotide
gacctccaccagaacccttcaatggaatgg

SEQ ID NO: 207970 - DNA, 31 bp, Artificial Sequence
  Description of Artificial Sequence: Synthetic oligonucleotide
acctccaccagaacccttcaatggaatggtg

SEQ ID NO: 207971 - DNA, 30 bp, Artificial Sequence
  Description of Artificial Sequence: Synthetic oligonucleotide
cctccaccagaacccttcaatggaatggtg

SEQ ID NO: 207972 - DNA, 30 bp, Artificial Sequence
  Description of Artificial Sequence: Synthetic oligonucleotide
ctccaccagaacccttcaatggaatggtgc

SEQ ID NO: 207973 - DNA, 37 bp, Artificial Sequence
  Description of Artificial Sequence: Synthetic oligonucleotide
tccaccagaacccttcaatggaatggtgcatataaac

SEQ ID NO: 207974 - DNA, 36 bp, Artificial Sequence
  Description of Artificial Sequence: Synthetic oligonucleotide
ccaccagaacccttcaatggaatggtgcatataaac

SEQ ID NO: 207975 - DNA, 37 bp, Artificial Sequence
  Description of Artificial Sequence: Synthetic oligonucleotide
caccagaacccttcaatggaatggtgcatataaacac

SEQ ID NO: 207976 - DNA, 38 bp, Artificial Sequence
  Description of Artificial Sequence: Synthetic oligonucleotide
accagaacccttcaatggaatggtgcatataaacacag

SEQ ID NO: 207977 - DNA, 37 bp, Artificial Sequence
  Description of Artificial Sequence: Synthetic oligonucleotide
ccagaacccttcaatggaatggtgcatataaacacag

SEQ ID NO: 207978 - DNA, 40 bp, Artificial Sequence
  Description of Artificial Sequence: Synthetic oligonucleotide
cagaacccttcaatggaatggtgcatataaacacagatac

SEQ ID NO: 207979 - DNA, 41 bp, Artificial Sequence
  Description of Artificial Sequence: Synthetic oligonucleotide
agaacccttcaatggaatggtgcatataaacacagatacac

SEQ ID NO: 207980 - DNA, 40 bp, Artificial Sequence
  Description of Artificial Sequence: Synthetic oligonucleotide
gaacccttcaatggaatggtgcatataaacacagatacac

SEQ ID NO: 207981 - DNA, 41 bp, Artificial Sequence
  Description of Artificial Sequence: Synthetic oligonucleotide
aacccttcaatggaatggtgcatataaacacagatacacag

SEQ ID NO: 207982 - DNA, 40 bp, Artificial Sequence
  Description of Artificial Sequence: Synthetic oligonucleotide
acccttcaatggaatggtgcatataaacacagatacacag

SEQ ID NO: 207983 - DNA, 39 bp, Artificial Sequence
  Description of Artificial Sequence: Synthetic oligonucleotide
cccttcaatggaatggtgcatataaacacagatacacag

SEQ ID NO: 207984 - DNA, 42 bp, Artificial Sequence
  Description of Artificial Sequence: Synthetic oligonucleotide
ccttcaatggaatggtgcatataaacacagatacacagtttg

SEQ ID NO: 207985 - DNA, 42 bp, Artificial Sequence
  Description of Artificial Sequence: Synthetic oligonucleotide
cttcaatggaatggtgcatataaacacagatacacagtttgg

SEQ ID NO: 207986 - DNA, 44 bp, Artificial Sequence
  Description of Artificial Sequence: Synthetic oligonucleotide
ttcaatggaatggtgcatataaacacagatacacagtttggatc

SEQ ID NO: 207987 - DNA, 43 bp, Artificial Sequence
  Description of Artificial Sequence: Synthetic oligonucleotide
tcaatggaatggtgcatataaacacagatacacagtttggatc

SEQ ID NO: 207988 - DNA, 42 bp, Artificial Sequence
  Description of Artificial Sequence: Synthetic oligonucleotide
caatggaatggtgcatataaacacagatacacagtttggatc

SEQ ID NO: 207989 - DNA, 44 bp, Artificial Sequence
  Description of Artificial Sequence: Synthetic oligonucleotide
aatggaatggtgcatataaacacagatacacagtttggatcaac

SEQ ID NO: 207990 - DNA, 43 bp, Artificial Sequence
  Description of Artificial Sequence: Synthetic oligonucleotide
atggaatggtgcatataaacacagatacacagtttggatcaac

SEQ ID NO: 207991 - DNA, 42 bp, Artificial Sequence
  Description of Artificial Sequence: Synthetic oligonucleotide
tggaatggtgcatataaacacagatacacagtttggatcaac

SEQ ID NO: 207992 - DNA, 41 bp, Artificial Sequence
  Description of Artificial Sequence: Synthetic oligonucleotide
ggaatggtgcatataaacacagatacacagtttggatcaac

SEQ ID NO: 207993 - DNA, 42 bp, Artificial Sequence
  Description of Artificial Sequence: Synthetic oligonucleotide
gaatggtgcatataaacacagatacacagtttggatcaacag

SEQ ID NO: 207994 - DNA, 51 bp, Artificial Sequence
  Description of Artificial Sequence: Synthetic oligonucleotide
aatggtgcatataaacacagatacacagtttggatcaacagttaattattc

SEQ ID NO: 207995 - DNA, 50 bp, Artificial Sequence
  Description of Artificial Sequence: Synthetic oligonucleotide
atggtgcatataaacacagatacacagtttggatcaacagttaattattc

SEQ ID NO: 207996 - DNA, 49 bp, Artificial Sequence
  Description of Artificial Sequence: Synthetic oligonucleotide
tggtgcatataaacacagatacacagtttggatcaacagttaattattc

SEQ ID NO: 207997 - DNA, 48 bp, Artificial Sequence
  Description of Artificial Sequence: Synthetic oligonucleotide
ggtgcatataaacacagatacacagtttggatcaacagttaattattc

SEQ ID NO: 207998 - DNA, 50 bp, Artificial Sequence
  Description of Artificial Sequence: Synthetic oligonucleotide
gtgcatataaacacagatacacagtttggatcaacagttaattattcttg

SEQ ID NO: 207999 - DNA, 54 bp, Artificial Sequence
  Description of Artificial Sequence: Synthetic oligonucleotide
tgcatataaacacagatacacagtttggatcaacagttaattattcttgtaatg

SEQ ID NO: 208000 - DNA, 53 bp, Artificial Sequence
  Description of Artificial Sequence: Synthetic oligonucleotide
gcatataaacacagatacacagtttggatcaacagttaattattcttgtaatg

SEQ ID NO: 208001 - DNA, 55 bp, Artificial Sequence
  Description of Artificial Sequence: Synthetic oligonucleotide
catataaacacagatacacagtttggatcaacagttaattattcttgtaatgaag

SEQ ID NO: 208002 - DNA, 55 bp, Artificial Sequence
  Description of Artificial Sequence: Synthetic oligonucleotide
atataaacacagatacacagtttggatcaacagttaattattcttgtaatgaagg

SEQ ID NO: 208003 - DNA, 54 bp, Artificial Sequence
  Description of Artificial Sequence: Synthetic oligonucleotide
tataaacacagatacacagtttggatcaacagttaattattcttgtaatgaagg

SEQ ID NO: 208004 - DNA, 53 bp, Artificial Sequence
  Description of Artificial Sequence: Synthetic oligonucleotide
ataaacacagatacacagtttggatcaacagttaattattcttgtaatgaagg

SEQ ID NO: 208005 - DNA, 52 bp, Artificial Sequence
  Description of Artificial Sequence: Synthetic oligonucleotide
taaacacagatacacagtttggatcaacagttaattattcttgtaatgaagg

SEQ ID NO: 208006 - DNA, 51 bp, Artificial Sequence
  Description of Artificial Sequence: Synthetic oligonucleotide
aaacacagatacacagtttggatcaacagttaattattcttgtaatgaagg

SEQ ID NO: 208007 - DNA, 50 bp, Artificial Sequence
  Description of Artificial Sequence: Synthetic oligonucleotide
aacacagatacacagtttggatcaacagttaattattcttgtaatgaagg

SEQ ID NO: 208008 - DNA, 49 bp, Artificial Sequence
  Description of Artificial Sequence: Synthetic oligonucleotide
acacagatacacagtttggatcaacagttaattattcttgtaatgaagg

SEQ ID NO: 208009 - DNA, 48 bp, Artificial Sequence
  Description of Artificial Sequence: Synthetic oligonucleotide
cacagatacacagtttggatcaacagttaattattcttgtaatgaagg

SEQ ID NO: 208010 - DNA, 48 bp, Artificial Sequence
  Description of Artificial Sequence: Synthetic oligonucleotide
acagatacacagtttggatcaacagttaattattcttgtaatgaaggg

SEQ ID NO: 208011 - DNA, 47 bp, Artificial Sequence
  Description of Artificial Sequence: Synthetic oligonucleotide
cagatacacagtttggatcaacagttaattattcttgtaatgaaggg

SEQ ID NO: 208012 - DNA, 50 bp, Artificial Sequence
  Description of Artificial Sequence: Synthetic oligonucleotide
agatacacagtttggatcaacagttaattattcttgtaatgaagggtttc

SEQ ID NO: 208013 - DNA, 49 bp, Artificial Sequence
  Description of Artificial Sequence: Synthetic oligonucleotide
gatacacagtttggatcaacagttaattattcttgtaatgaagggtttc

SEQ ID NO: 208014 - DNA, 49 bp, Artificial Sequence
  Description of Artificial Sequence: Synthetic oligonucleotide
atacacagtttggatcaacagttaattattcttgtaatgaagggtttcg

SEQ ID NO: 208015 - DNA, 48 bp, Artificial Sequence
  Description of Artificial Sequence: Synthetic oligonucleotide
tacacagtttggatcaacagttaattattcttgtaatgaagggtttcg

SEQ ID NO: 208016 - DNA, 47 bp, Artificial Sequence
  Description of Artificial Sequence: Synthetic oligonucleotide
acacagtttggatcaacagttaattattcttgtaatgaagggtttcg

SEQ ID NO: 208017 - DNA, 46 bp, Artificial Sequence
  Description of Artificial Sequence: Synthetic oligonucleotide
cacagtttggatcaacagttaattattcttgtaatgaagggtttcg

SEQ ID NO: 208018 - DNA, 47 bp, Artificial Sequence
  Description of Artificial Sequence: Synthetic oligonucleotide
acagtttggatcaacagttaattattcttgtaatgaagggtttcgac

SEQ ID NO: 208019 - DNA, 46 bp, Artificial Sequence
  Description of Artificial Sequence: Synthetic oligonucleotide
cagtttggatcaacagttaattattcttgtaatgaagggtttcgac

SEQ ID NO: 208020 - DNA, 47 bp, Artificial Sequence
  Description of Artificial Sequence: Synthetic oligonucleotide
agtttggatcaacagttaattattcttgtaatgaagggtttcgactc

SEQ ID NO: 208021 - DNA, 46 bp, Artificial Sequence
  Description of Artificial Sequence: Synthetic oligonucleotide
gtttggatcaacagttaattattcttgtaatgaagggtttcgactc

SEQ ID NO: 208022 - DNA, 49 bp, Artificial Sequence
  Description of Artificial Sequence: Synthetic oligonucleotide
tttggatcaacagttaattattcttgtaatgaagggtttcgactcattg

SEQ ID NO: 208023 - DNA, 48 bp, Artificial Sequence
  Description of Artificial Sequence: Synthetic oligonucleotide
ttggatcaacagttaattattcttgtaatgaagggtttcgactcattg

SEQ ID NO: 208024 - DNA, 47 bp, Artificial Sequence
  Description of Artificial Sequence: Synthetic oligonucleotide
tggatcaacagttaattattcttgtaatgaagggtttcgactcattg

SEQ ID NO: 208025 - DNA, 46 bp, Artificial Sequence
  Description of Artificial Sequence: Synthetic oligonucleotide
ggatcaacagttaattattcttgtaatgaagggtttcgactcattg

SEQ ID NO: 208026 - DNA, 46 bp, Artificial Sequence
  Description of Artificial Sequence: Synthetic oligonucleotide
gatcaacagttaattattcttgtaatgaagggtttcgactcattgg

SEQ ID NO: 208027 - DNA, 48 bp, Artificial Sequence
  Description of Artificial Sequence: Synthetic oligonucleotide
atcaacagttaattattcttgtaatgaagggtttcgactcattggttc

SEQ ID NO: 208028 - DNA, 47 bp, Artificial Sequence
  Description of Artificial Sequence: Synthetic oligonucleotide
tcaacagttaattattcttgtaatgaagggtttcgactcattggttc

SEQ ID NO: 208029 - DNA, 46 bp, Artificial Sequence
  Description of Artificial Sequence: Synthetic oligonucleotide
caacagttaattattcttgtaatgaagggtttcgactcattggttc

SEQ ID NO: 208030 - DNA, 46 bp, Artificial Sequence
  Description of Artificial Sequence: Synthetic oligonucleotide
aacagttaattattcttgtaatgaagggtttcgactcattggttcc

SEQ ID NO: 208031 - DNA, 45 bp, Artificial Sequence
  Description of Artificial Sequence: Synthetic oligonucleotide
acagttaattattcttgtaatgaagggtttcgactcattggttcc

SEQ ID NO: 208032 - DNA, 44 bp, Artificial Sequence
  Description of Artificial Sequence: Synthetic oligonucleotide
cagttaattattcttgtaatgaagggtttcgactcattggttcc

SEQ ID NO: 208033 - DNA, 44 bp, Artificial Sequence
  Description of Artificial Sequence: Synthetic oligonucleotide
agttaattattcttgtaatgaagggtttcgactcattggttccc

SEQ ID NO: 208034 - DNA, 43 bp, Artificial Sequence
  Description of Artificial Sequence: Synthetic oligonucleotide
gttaattattcttgtaatgaagggtttcgactcattggttccc

SEQ ID NO: 208035 - DNA, 43 bp, Artificial Sequence
  Description of Artificial Sequence: Synthetic oligonucleotide
ttaattattcttgtaatgaagggtttcgactcattggttcccc

SEQ ID NO: 208036 - DNA, 42 bp, Artificial Sequence
  Description of Artificial Sequence: Synthetic oligonucleotide
taattattcttgtaatgaagggtttcgactcattggttcccc

SEQ ID NO: 208037 - DNA, 41 bp, Artificial Sequence
  Description of Artificial Sequence: Synthetic oligonucleotide
aattattcttgtaatgaagggtttcgactcattggttcccc

SEQ ID NO: 208038 - DNA, 40 bp, Artificial Sequence
  Description of Artificial Sequence: Synthetic oligonucleotide
attattcttgtaatgaagggtttcgactcattggttcccc

SEQ ID NO: 208039 - DNA, 39 bp, Artificial Sequence
  Description of Artificial Sequence: Synthetic oligonucleotide
ttattcttgtaatgaagggtttcgactcattggttcccc

SEQ ID NO: 208040 - DNA, 38 bp, Artificial Sequence
  Description of Artificial Sequence: Synthetic oligonucleotide
tattcttgtaatgaagggtttcgactcattggttcccc

SEQ ID NO: 208041 - DNA, 37 bp, Artificial Sequence
  Description of Artificial Sequence: Synthetic oligonucleotide
attcttgtaatgaagggtttcgactcattggttcccc

SEQ ID NO: 208042 - DNA, 36 bp, Artificial Sequence
  Description of Artificial Sequence: Synthetic oligonucleotide
ttcttgtaatgaagggtttcgactcattggttcccc

SEQ ID NO: 208043 - DNA, 35 bp, Artificial Sequence
  Description of Artificial Sequence: Synthetic oligonucleotide
tcttgtaatgaagggtttcgactcattggttcccc

SEQ ID NO: 208044 - DNA, 34 bp, Artificial Sequence
  Description of Artificial Sequence: Synthetic oligonucleotide
cttgtaatgaagggtttcgactcattggttcccc

SEQ ID NO: 208045 - DNA, 36 bp, Artificial Sequence
  Description of Artificial Sequence: Synthetic oligonucleotide
ttgtaatgaagggtttcgactcattggttccccatc

SEQ ID NO: 208046 - DNA, 35 bp, Artificial Sequence
  Description of Artificial Sequence: Synthetic oligonucleotide
tgtaatgaagggtttcgactcattggttccccatc

SEQ ID NO: 208047 - DNA, 34 bp, Artificial Sequence
  Description of Artificial Sequence: Synthetic oligonucleotide
gtaatgaagggtttcgactcattggttccccatc

SEQ ID NO: 208048 - DNA, 36 bp, Artificial Sequence
  Description of Artificial Sequence: Synthetic oligonucleotide
taatgaagggtttcgactcattggttccccatctac

SEQ ID NO: 208049 - DNA, 35 bp, Artificial Sequence
  Description of Artificial Sequence: Synthetic oligonucleotide
aatgaagggtttcgactcattggttccccatctac

SEQ ID NO: 208050 - DNA, 34 bp, Artificial Sequence
  Description of Artificial Sequence: Synthetic oligonucleotide
atgaagggtttcgactcattggttccccatctac

SEQ ID NO: 208051 - DNA, 33 bp, Artificial Sequence
  Description of Artificial Sequence: Synthetic oligonucleotide
tgaagggtttcgactcattggttccccatctac

SEQ ID NO: 208052 - DNA, 32 bp, Artificial Sequence
  Description of Artificial Sequence: Synthetic oligonucleotide
gaagggtttcgactcattggttccccatctac

SEQ ID NO: 208053 - DNA, 34 bp, Artificial Sequence
  Description of Artificial Sequence: Synthetic oligonucleotide
aagggtttcgactcattggttccccatctactac

SEQ ID NO: 208054 - DNA, 33 bp, Artificial Sequence
  Description of Artificial Sequence: Synthetic oligonucleotide
agggtttcgactcattggttccccatctactac

SEQ ID NO: 208055 - DNA, 32 bp, Artificial Sequence
  Description of Artificial Sequence: Synthetic oligonucleotide
gggtttcgactcattggttccccatctactac

SEQ ID NO: 208056 - DNA, 34 bp, Artificial Sequence
  Description of Artificial Sequence: Synthetic oligonucleotide
ggtttcgactcattggttccccatctactacttg

SEQ ID NO: 208057 - DNA, 35 bp, Artificial Sequence
  Description of Artificial Sequence: Synthetic oligonucleotide
gtttcgactcattggttccccatctactacttgtc

SEQ ID NO: 208058 - DNA, 36 bp, Artificial Sequence
  Description of Artificial Sequence: Synthetic oligonucleotide
tttcgactcattggttccccatctactacttgtctc

SEQ ID NO: 208059 - DNA, 35 bp, Artificial Sequence
  Description of Artificial Sequence: Synthetic oligonucleotide
ttcgactcattggttccccatctactacttgtctc

SEQ ID NO: 208060 - DNA, 34 bp, Artificial Sequence
  Description of Artificial Sequence: Synthetic oligonucleotide
tcgactcattggttccccatctactacttgtctc

SEQ ID NO: 208061 - DNA, 33 bp, Artificial Sequence
  Description of Artificial Sequence: Synthetic oligonucleotide
cgactcattggttccccatctactacttgtctc

SEQ ID NO: 208062 - DNA, 33 bp, Artificial Sequence
  Description of Artificial Sequence: Synthetic oligonucleotide
gactcattggttccccatctactacttgtctcg

SEQ ID NO: 208063 - DNA, 34 bp, Artificial Sequence
  Description of Artificial Sequence: Synthetic oligonucleotide
actcattggttccccatctactacttgtctcgtc

SEQ ID NO: 208064 - DNA, 33 bp, Artificial Sequence
  Description of Artificial Sequence: Synthetic oligonucleotide
ctcattggttccccatctactacttgtctcgtc

SEQ ID NO: 208065 - DNA, 34 bp, Artificial Sequence
  Description of Artificial Sequence: Synthetic oligonucleotide
tcattggttccccatctactacttgtctcgtctc

SEQ ID NO: 208066 - DNA, 33 bp, Artificial Sequence
  Description of Artificial Sequence: Synthetic oligonucleotide
cattggttccccatctactacttgtctcgtctc

SEQ ID NO: 208067 - DNA, 34 bp, Artificial Sequence
  Description of Artificial Sequence: Synthetic oligonucleotide
attggttccccatctactacttgtctcgtctcag

SEQ ID NO: 208068 - DNA, 33 bp, Artificial Sequence
  Description of Artificial Sequence: Synthetic oligonucleotide
ttggttccccatctactacttgtctcgtctcag

SEQ ID NO: 208069 - DNA, 32 bp, Artificial Sequence
  Description of Artificial Sequence: Synthetic oligonucleotide
tggttccccatctactacttgtctcgtctcag

SEQ ID NO: 208070 - DNA, 31 bp, Artificial Sequence
  Description of Artificial Sequence: Synthetic oligonucleotide
ggttccccatctactacttgtctcgtctcag

SEQ ID NO: 208071 - DNA, 31 bp, Artificial Sequence
  Description of Artificial Sequence: Synthetic oligonucleotide
gttccccatctactacttgtctcgtctcagg

SEQ ID NO: 208072 - DNA, 31 bp, Artificial Sequence
  Description of Artificial Sequence: Synthetic oligonucleotide
ttccccatctactacttgtctcgtctcaggc

SEQ ID NO: 208073 - DNA, 30 bp, Artificial Sequence
  Description of Artificial Sequence: Synthetic oligonucleotide
tccccatctactacttgtctcgtctcaggc

SEQ ID NO: 208074 - DNA, 29 bp, Artificial Sequence
  Description of Artificial Sequence: Synthetic oligonucleotide
ccccatctactacttgtctcgtctcaggc

SEQ ID NO: 208075 - DNA, 35 bp, Artificial Sequence
  Description of Artificial Sequence: Synthetic oligonucleotide
cccatctactacttgtctcgtctcaggcaataatg

SEQ ID NO: 208076 - DNA, 36 bp, Artificial Sequence
  Description of Artificial Sequence: Synthetic oligonucleotide
ccatctactacttgtctcgtctcaggcaataatgtc

SEQ ID NO: 208077 - DNA, 37 bp, Artificial Sequence
  Description of Artificial Sequence: Synthetic oligonucleotide
catctactacttgtctcgtctcaggcaataatgtcac

SEQ ID NO: 208078 - DNA, 39 bp, Artificial Sequence
  Description of Artificial Sequence: Synthetic oligonucleotide
atctactacttgtctcgtctcaggcaataatgtcacatg

SEQ ID NO: 208079 - DNA, 38 bp, Artificial Sequence
  Description of Artificial Sequence: Synthetic oligonucleotide
tctactacttgtctcgtctcaggcaataatgtcacatg

SEQ ID NO: 208080 - DNA, 37 bp, Artificial Sequence
  Description of Artificial Sequence: Synthetic oligonucleotide
ctactacttgtctcgtctcaggcaataatgtcacatg

SEQ ID NO: 208081 - DNA, 37 bp, Artificial Sequence
  Description of Artificial Sequence: Synthetic oligonucleotide
tactacttgtctcgtctcaggcaataatgtcacatgg

SEQ ID NO: 208082 - DNA, 36 bp, Artificial Sequence
  Description of Artificial Sequence: Synthetic oligonucleotide
actacttgtctcgtctcaggcaataatgtcacatgg

SEQ ID NO: 208083 - DNA, 35 bp, Artificial Sequence
  Description of Artificial Sequence: Synthetic oligonucleotide
ctacttgtctcgtctcaggcaataatgtcacatgg

SEQ ID NO: 208084 - DNA, 35 bp, Artificial Sequence
  Description of Artificial Sequence: Synthetic oligonucleotide
tacttgtctcgtctcaggcaataatgtcacatggg

SEQ ID NO: 208085 - DNA, 34 bp, Artificial Sequence
  Description of Artificial Sequence: Synthetic oligonucleotide
acttgtctcgtctcaggcaataatgtcacatggg

SEQ ID NO: 208086 - DNA, 33 bp, Artificial Sequence
  Description of Artificial Sequence: Synthetic oligonucleotide
cttgtctcgtctcaggcaataatgtcacatggg

SEQ ID NO: 208087 - DNA, 37 bp, Artificial Sequence
  Description of Artificial Sequence: Synthetic oligonucleotide
ttgtctcgtctcaggcaataatgtcacatgggataag

SEQ ID NO: 208088 - DNA, 36 bp, Artificial Sequence
  Description of Artificial Sequence: Synthetic oligonucleotide
tgtctcgtctcaggcaataatgtcacatgggataag

SEQ ID NO: 208089 - DNA, 35 bp, Artificial Sequence
  Description of Artificial Sequence: Synthetic oligonucleotide
gtctcgtctcaggcaataatgtcacatgggataag

SEQ ID NO: 208090 - DNA, 37 bp, Artificial Sequence
  Description of Artificial Sequence: Synthetic oligonucleotide
tctcgtctcaggcaataatgtcacatgggataagaag

SEQ ID NO: 208091 - DNA, 36 bp, Artificial Sequence
  Description of Artificial Sequence: Synthetic oligonucleotide
ctcgtctcaggcaataatgtcacatgggataagaag

SEQ ID NO: 208092 - DNA, 36 bp, Artificial Sequence
  Description of Artificial Sequence: Synthetic oligonucleotide
tcgtctcaggcaataatgtcacatgggataagaagg

SEQ ID NO: 208093 - DNA, 35 bp, Artificial Sequence
  Description of Artificial Sequence: Synthetic oligonucleotide
cgtctcaggcaataatgtcacatgggataagaagg

SEQ ID NO: 208094 - DNA, 35 bp, Artificial Sequence
  Description of Artificial Sequence: Synthetic oligonucleotide
gtctcaggcaataatgtcacatgggataagaaggc

SEQ ID NO: 208095 - DNA, 36 bp, Artificial Sequence
  Description of Artificial Sequence: Synthetic oligonucleotide
tctcaggcaataatgtcacatgggataagaaggcac

SEQ ID NO: 208096 - DNA, 35 bp, Artificial Sequence
  Description of Artificial Sequence: Synthetic oligonucleotide
ctcaggcaataatgtcacatgggataagaaggcac

SEQ ID NO: 208097 - DNA, 35 bp, Artificial Sequence
  Description of Artificial Sequence: Synthetic oligonucleotide
tcaggcaataatgtcacatgggataagaaggcacc

SEQ ID NO: 208098 - DNA, 34 bp, Artificial Sequence
  Description of Artificial Sequence: Synthetic oligonucleotide
caggcaataatgtcacatgggataagaaggcacc

SEQ ID NO: 208099 - DNA, 39 bp, Artificial Sequence
  Description of Artificial Sequence: Synthetic oligonucleotide
aggcaataatgtcacatgggataagaaggcacctatttg

SEQ ID NO: 208100 - DNA, 38 bp, Artificial Sequence
  Description of Artificial Sequence: Synthetic oligonucleotide
ggcaataatgtcacatgggataagaaggcacctatttg

SEQ ID NO: 208101 - DNA, 39 bp, Artificial Sequence
  Description of Artificial Sequence: Synthetic oligonucleotide
gcaataatgtcacatgggataagaaggcacctatttgtg

SEQ ID NO: 208102 - DNA, 40 bp, Artificial Sequence
  Description of Artificial Sequence: Synthetic oligonucleotide
caataatgtcacatgggataagaaggcacctatttgtgag

SEQ ID NO: 208103 - DNA, 42 bp, Artificial Sequence
  Description of Artificial Sequence: Synthetic oligonucleotide
aataatgtcacatgggataagaaggcacctatttgtgagatc

SEQ ID NO: 208104 - DNA, 41 bp, Artificial Sequence
  Description of Artificial Sequence: Synthetic oligonucleotide
ataatgtcacatgggataagaaggcacctatttgtgagatc

SEQ ID NO: 208105 - DNA, 40 bp, Artificial Sequence
  Description of Artificial Sequence: Synthetic oligonucleotide
taatgtcacatgggataagaaggcacctatttgtgagatc

SEQ ID NO: 208106 - DNA, 39 bp, Artificial Sequence
  Description of Artificial Sequence: Synthetic oligonucleotide
aatgtcacatgggataagaaggcacctatttgtgagatc

SEQ ID NO: 208107 - DNA, 38 bp, Artificial Sequence
  Description of Artificial Sequence: Synthetic oligonucleotide
atgtcacatgggataagaaggcacctatttgtgagatc

SEQ ID NO: 208108 - DNA, 37 bp, Artificial Sequence
  Description of Artificial Sequence: Synthetic oligonucleotide
tgtcacatgggataagaaggcacctatttgtgagatc

SEQ ID NO: 208109 - DNA, 36 bp, Artificial Sequence
  Description of Artificial Sequence: Synthetic oligonucleotide
gtcacatgggataagaaggcacctatttgtgagatc

SEQ ID NO: 208110 - DNA, 40 bp, Artificial Sequence
  Description of Artificial Sequence: Synthetic oligonucleotide
tcacatgggataagaaggcacctatttgtgagatcatatc

SEQ ID NO: 208111 - DNA, 39 bp, Artificial Sequence
  Description of Artificial Sequence: Synthetic oligonucleotide
cacatgggataagaaggcacctatttgtgagatcatatc

SEQ ID NO: 208112 - DNA, 41 bp, Artificial Sequence
  Description of Artificial Sequence: Synthetic oligonucleotide
acatgggataagaaggcacctatttgtgagatcatatcttg

SEQ ID NO: 208113 - DNA, 40 bp, Artificial Sequence
  Description of Artificial Sequence: Synthetic oligonucleotide
catgggataagaaggcacctatttgtgagatcatatcttg

SEQ ID NO: 208114 - DNA, 41 bp, Artificial Sequence
  Description of Artificial Sequence: Synthetic oligonucleotide
atgggataagaaggcacctatttgtgagatcatatcttgtg

SEQ ID NO: 208115 - DNA, 40 bp, Artificial Sequence
  Description of Artificial Sequence: Synthetic oligonucleotide
tgggataagaaggcacctatttgtgagatcatatcttgtg

SEQ ID NO: 208116 - DNA, 39 bp, Artificial Sequence
  Description of Artificial Sequence: Synthetic oligonucleotide
gggataagaaggcacctatttgtgagatcatatcttgtg

SEQ ID NO: 208117 - DNA, 40 bp, Artificial Sequence
  Description of Artificial Sequence: Synthetic oligonucleotide
ggataagaaggcacctatttgtgagatcatatcttgtgag

SEQ ID NO: 208118 - DNA, 40 bp, Artificial Sequence
  Description of Artificial Sequence: Synthetic oligonucleotide
gataagaaggcacctatttgtgagatcatatcttgtgagc

SEQ ID NO: 208119 - DNA, 40 bp, Artificial Sequence
  Description of Artificial Sequence: Synthetic oligonucleotide
ataagaaggcacctatttgtgagatcatatcttgtgagcc

SEQ ID NO: 208120 - DNA, 39 bp, Artificial Sequence
  Description of Artificial Sequence: Synthetic oligonucleotide
taagaaggcacctatttgtgagatcatatcttgtgagcc

SEQ ID NO: 208121 - DNA, 38 bp, Artificial Sequence
  Description of Artificial Sequence: Synthetic oligonucleotide
aagaaggcacctatttgtgagatcatatcttgtgagcc

SEQ ID NO: 208122 - DNA, 37 bp, Artificial Sequence
  Description of Artificial Sequence: Synthetic oligonucleotide
agaaggcacctatttgtgagatcatatcttgtgagcc

SEQ ID NO: 208123 - DNA, 36 bp, Artificial Sequence
  Description of Artificial Sequence: Synthetic oligonucleotide
gaaggcacctatttgtgagatcatatcttgtgagcc

SEQ ID NO: 208124 - DNA, 37 bp, Artificial Sequence
  Description of Artificial Sequence: Synthetic oligonucleotide
aaggcacctatttgtgagatcatatcttgtgagccac

SEQ ID NO: 208125 - DNA, 36 bp, Artificial Sequence
  Description of Artificial Sequence: Synthetic oligonucleotide
aggcacctatttgtgagatcatatcttgtgagccac

SEQ ID NO: 208126 - DNA, 35 bp, Artificial Sequence
  Description of Artificial Sequence: Synthetic oligonucleotide
ggcacctatttgtgagatcatatcttgtgagccac

SEQ ID NO: 208127 - DNA, 35 bp, Artificial Sequence
  Description of Artificial Sequence: Synthetic oligonucleotide
gcacctatttgtgagatcatatcttgtgagccacc

SEQ ID NO: 208128 - DNA, 36 bp, Artificial Sequence
  Description of Artificial Sequence: Synthetic oligonucleotide
cacctatttgtgagatcatatcttgtgagccacctc

SEQ ID NO: 208129 - DNA, 36 bp, Artificial Sequence
  Description of Artificial Sequence: Synthetic oligonucleotide
acctatttgtgagatcatatcttgtgagccacctcc

SEQ ID NO: 208130 - DNA, 35 bp, Artificial Sequence
  Description of Artificial Sequence: Synthetic oligonucleotide
cctatttgtgagatcatatcttgtgagccacctcc

SEQ ID NO: 208131 - DNA, 37 bp, Artificial Sequence
  Description of Artificial Sequence: Synthetic oligonucleotide
ctatttgtgagatcatatcttgtgagccacctccaac

SEQ ID NO: 208132 - DNA, 37 bp, Artificial Sequence
  Description of Artificial Sequence: Synthetic oligonucleotide
tatttgtgagatcatatcttgtgagccacctccaacc

SEQ ID NO: 208133 - DNA, 36 bp, Artificial Sequence
  Description of Artificial Sequence: Synthetic oligonucleotide
atttgtgagatcatatcttgtgagccacctccaacc

SEQ ID NO: 208134 - DNA, 35 bp, Artificial Sequence
  Description of Artificial Sequence: Synthetic oligonucleotide
tttgtgagatcatatcttgtgagccacctccaacc

SEQ ID NO: 208135 - DNA, 34 bp, Artificial Sequence
  Description of Artificial Sequence: Synthetic oligonucleotide
ttgtgagatcatatcttgtgagccacctccaacc

SEQ ID NO: 208136 - DNA, 33 bp, Artificial Sequence
  Description of Artificial Sequence: Synthetic oligonucleotide
tgtgagatcatatcttgtgagccacctccaacc

SEQ ID NO: 208137 - DNA, 32 bp, Artificial Sequence
  Description of Artificial Sequence: Synthetic oligonucleotide
gtgagatcatatcttgtgagccacctccaacc

SEQ ID NO: 208138 - DNA, 36 bp, Artificial Sequence
  Description of Artificial Sequence: Synthetic oligonucleotide
tgagatcatatcttgtgagccacctccaaccatatc

SEQ ID NO: 208139 - DNA, 35 bp, Artificial Sequence
  Description of Artificial Sequence: Synthetic oligonucleotide
gagatcatatcttgtgagccacctccaaccatatc

SEQ ID NO: 208140 - DNA, 35 bp, Artificial Sequence
  Description of Artificial Sequence: Synthetic oligonucleotide
agatcatatcttgtgagccacctccaaccatatcc

SEQ ID NO: 208141 - DNA, 34 bp, Artificial Sequence
  Description of Artificial Sequence: Synthetic oligonucleotide
gatcatatcttgtgagccacctccaaccatatcc

SEQ ID NO: 208142 - DNA, 37 bp, Artificial Sequence
  Description of Artificial Sequence: Synthetic oligonucleotide
atcatatcttgtgagccacctccaaccatatccaatg

SEQ ID NO: 208143 - DNA, 36 bp, Artificial Sequence
  Description of Artificial Sequence: Synthetic oligonucleotide
tcatatcttgtgagccacctccaaccatatccaatg

SEQ ID NO: 208144 - DNA, 35 bp, Artificial Sequence
  Description of Artificial Sequence: Synthetic oligonucleotide
catatcttgtgagccacctccaaccatatccaatg

SEQ ID NO: 208145 - DNA, 35 bp, Artificial Sequence
  Description of Artificial Sequence: Synthetic oligonucleotide
atatcttgtgagccacctccaaccatatccaatgg

SEQ ID NO: 208146 - DNA, 34 bp, Artificial Sequence
  Description of Artificial Sequence: Synthetic oligonucleotide
tatcttgtgagccacctccaaccatatccaatgg

SEQ ID NO: 208147 - DNA, 33 bp, Artificial Sequence
  Description of Artificial Sequence: Synthetic oligonucleotide
atcttgtgagccacctccaaccatatccaatgg

SEQ ID NO: 208148 - DNA, 32 bp, Artificial Sequence
  Description of Artificial Sequence: Synthetic oligonucleotide
tcttgtgagccacctccaaccatatccaatgg

SEQ ID NO: 208149 - DNA, 31 bp, Artificial Sequence
  Description of Artificial Sequence: Synthetic oligonucleotide
cttgtgagccacctccaaccatatccaatgg

SEQ ID NO: 208150 - DNA, 32 bp, Artificial Sequence
  Description of Artificial Sequence: Synthetic oligonucleotide
ttgtgagccacctccaaccatatccaatggag

SEQ ID NO: 208151 - DNA, 31 bp, Artificial Sequence
  Description of Artificial Sequence: Synthetic oligonucleotide
tgtgagccacctccaaccatatccaatggag

SEQ ID NO: 208152 - DNA, 30 bp, Artificial Sequence
  Description of Artificial Sequence: Synthetic oligonucleotide
gtgagccacctccaaccatatccaatggag

SEQ ID NO: 208153 - DNA, 31 bp, Artificial Sequence
  Description of Artificial Sequence: Synthetic oligonucleotide
tgagccacctccaaccatatccaatggagac

SEQ ID NO: 208154 - DNA, 30 bp, Artificial Sequence
  Description of Artificial Sequence: Synthetic oligonucleotide
gagccacctccaaccatatccaatggagac

SEQ ID NO: 208155 - DNA, 32 bp, Artificial Sequence
  Description of Artificial Sequence: Synthetic oligonucleotide
agccacctccaaccatatccaatggagacttc

SEQ ID NO: 208156 - DNA, 31 bp, Artificial Sequence
  Description of Artificial Sequence: Synthetic oligonucleotide
gccacctccaaccatatccaatggagacttc

SEQ ID NO: 208157 - DNA, 33 bp, Artificial Sequence
  Description of Artificial Sequence: Synthetic oligonucleotide
ccacctccaaccatatccaatggagacttctac

SEQ ID NO: 208158 - DNA, 34 bp, Artificial Sequence
  Description of Artificial Sequence: Synthetic oligonucleotide
cacctccaaccatatccaatggagacttctacag

SEQ ID NO: 208159 - DNA, 34 bp, Artificial Sequence
  Description of Artificial Sequence: Synthetic oligonucleotide
acctccaaccatatccaatggagacttctacagc

SEQ ID NO: 208160 - DNA, 33 bp, Artificial Sequence
  Description of Artificial Sequence: Synthetic oligonucleotide
cctccaaccatatccaatggagacttctacagc

SEQ ID NO: 208161 - DNA, 35 bp, Artificial Sequence
  Description of Artificial Sequence: Synthetic oligonucleotide
ctccaaccatatccaatggagacttctacagcaac

SEQ ID NO: 208162 - DNA, 39 bp, Artificial Sequence
  Description of Artificial Sequence: Synthetic oligonucleotide
tccaaccatatccaatggagacttctacagcaacaatag

SEQ ID NO: 208163 - DNA, 38 bp, Artificial Sequence
  Description of Artificial Sequence: Synthetic oligonucleotide
ccaaccatatccaatggagacttctacagcaacaatag

SEQ ID NO: 208164 - DNA, 40 bp, Artificial Sequence
  Description of Artificial Sequence: Synthetic oligonucleotide
caaccatatccaatggagacttctacagcaacaatagaac

SEQ ID NO: 208165 - DNA, 42 bp, Artificial Sequence
  Description of Artificial Sequence: Synthetic oligonucleotide
aaccatatccaatggagacttctacagcaacaatagaacatc

SEQ ID NO: 208166 - DNA, 41 bp, Artificial Sequence
  Description of Artificial Sequence: Synthetic oligonucleotide
accatatccaatggagacttctacagcaacaatagaacatc

SEQ ID NO: 208167 - DNA, 40 bp, Artificial Sequence
  Description of Artificial Sequence: Synthetic oligonucleotide
ccatatccaatggagacttctacagcaacaatagaacatc

SEQ ID NO: 208168 - DNA, 44 bp, Artificial Sequence
  Description of Artificial Sequence: Synthetic oligonucleotide
catatccaatggagacttctacagcaacaatagaacatcttttc

SEQ ID NO: 208169 - DNA, 45 bp, Artificial Sequence
  Description of Artificial Sequence: Synthetic oligonucleotide
atatccaatggagacttctacagcaacaatagaacatcttttcac

SEQ ID NO: 208170 - DNA, 44 bp, Artificial Sequence
  Description of Artificial Sequence: Synthetic oligonucleotide
tatccaatggagacttctacagcaacaatagaacatcttttcac

SEQ ID NO: 208171 - DNA, 43 bp, Artificial Sequence
  Description of Artificial Sequence: Synthetic oligonucleotide
atccaatggagacttctacagcaacaatagaacatcttttcac

SEQ ID NO: 208172 - DNA, 42 bp, Artificial Sequence
  Description of Artificial Sequence: Synthetic oligonucleotide
tccaatggagacttctacagcaacaatagaacatcttttcac

SEQ ID NO: 208173 - DNA, 41 bp, Artificial Sequence
  Description of Artificial Sequence: Synthetic oligonucleotide
ccaatggagacttctacagcaacaatagaacatcttttcac

SEQ ID NO: 208174 - DNA, 44 bp, Artificial Sequence
  Description of Artificial Sequence: Synthetic oligonucleotide
caatggagacttctacagcaacaatagaacatcttttcacaatg

SEQ ID NO: 208175 - DNA, 44 bp, Artificial Sequence
  Description of Artificial Sequence: Synthetic oligonucleotide
aatggagacttctacagcaacaatagaacatcttttcacaatgg

SEQ ID NO: 208176 - DNA, 43 bp, Artificial Sequence
  Description of Artificial Sequence: Synthetic oligonucleotide
atggagacttctacagcaacaatagaacatcttttcacaatgg

SEQ ID NO: 208177 - DNA, 42 bp, Artificial Sequence
  Description of Artificial Sequence: Synthetic oligonucleotide
tggagacttctacagcaacaatagaacatcttttcacaatgg

SEQ ID NO: 208178 - DNA, 41 bp, Artificial Sequence
  Description of Artificial Sequence: Synthetic oligonucleotide
ggagacttctacagcaacaatagaacatcttttcacaatgg

SEQ ID NO: 208179 - DNA, 43 bp, Artificial Sequence
  Description of Artificial Sequence: Synthetic oligonucleotide
gagacttctacagcaacaatagaacatcttttcacaatggaac

SEQ ID NO: 208180 - DNA, 43 bp, Artificial Sequence
  Description of Artificial Sequence: Synthetic oligonucleotide
agacttctacagcaacaatagaacatcttttcacaatggaacg

SEQ ID NO: 208181 - DNA, 42 bp, Artificial Sequence
  Description of Artificial Sequence: Synthetic oligonucleotide
gacttctacagcaacaatagaacatcttttcacaatggaacg

SEQ ID NO: 208182 - DNA, 42 bp, Artificial Sequence
  Description of Artificial Sequence: Synthetic oligonucleotide
acttctacagcaacaatagaacatcttttcacaatggaacgg

SEQ ID NO: 208183 - DNA, 41 bp, Artificial Sequence
  Description of Artificial Sequence: Synthetic oligonucleotide
cttctacagcaacaatagaacatcttttcacaatggaacgg

SEQ ID NO: 208184 - DNA, 42 bp, Artificial Sequence
  Description of Artificial Sequence: Synthetic oligonucleotide
ttctacagcaacaatagaacatcttttcacaatggaacggtg

SEQ ID NO: 208185 - DNA, 41 bp, Artificial Sequence
  Description of Artificial Sequence: Synthetic oligonucleotide
tctacagcaacaatagaacatcttttcacaatggaacggtg

SEQ ID NO: 208186 - DNA, 40 bp, Artificial Sequence
  Description of Artificial Sequence: Synthetic oligonucleotide
ctacagcaacaatagaacatcttttcacaatggaacggtg

SEQ ID NO: 208187 - DNA, 40 bp, Artificial Sequence
  Description of Artificial Sequence: Synthetic oligonucleotide
tacagcaacaatagaacatcttttcacaatggaacggtgg

SEQ ID NO: 208188 - DNA, 39 bp, Artificial Sequence
  Description of Artificial Sequence: Synthetic oligonucleotide
acagcaacaatagaacatcttttcacaatggaacggtgg

SEQ ID NO: 208189 - DNA, 38 bp, Artificial Sequence
  Description of Artificial Sequence: Synthetic oligonucleotide
cagcaacaatagaacatcttttcacaatggaacggtgg

SEQ ID NO: 208190 - DNA, 41 bp, Artificial Sequence
  Description of Artificial Sequence: Synthetic oligonucleotide
agcaacaatagaacatcttttcacaatggaacggtggtaac

SEQ ID NO: 208191 - DNA, 40 bp, Artificial Sequence
  Description of Artificial Sequence: Synthetic oligonucleotide
gcaacaatagaacatcttttcacaatggaacggtggtaac

SEQ ID NO: 208192 - DNA, 43 bp, Artificial Sequence
  Description of Artificial Sequence: Synthetic oligonucleotide
caacaatagaacatcttttcacaatggaacggtggtaacttac

SEQ ID NO: 208193 - DNA, 43 bp, Artificial Sequence
  Description of Artificial Sequence: Synthetic oligonucleotide
aacaatagaacatcttttcacaatggaacggtggtaacttacc

SEQ ID NO: 208194 - DNA, 42 bp, Artificial Sequence
  Description of Artificial Sequence: Synthetic oligonucleotide
acaatagaacatcttttcacaatggaacggtggtaacttacc

SEQ ID NO: 208195 - DNA, 41 bp, Artificial Sequence
  Description of Artificial Sequence: Synthetic oligonucleotide
caatagaacatcttttcacaatggaacggtggtaacttacc

SEQ ID NO: 208196 - DNA, 42 bp, Artificial Sequence
  Description of Artificial Sequence: Synthetic oligonucleotide
aatagaacatcttttcacaatggaacggtggtaacttaccag

SEQ ID NO: 208197 - DNA, 41 bp, Artificial Sequence
  Description of Artificial Sequence: Synthetic oligonucleotide
atagaacatcttttcacaatggaacggtggtaacttaccag

SEQ ID NO: 208198 - DNA, 40 bp, Artificial Sequence
  Description of Artificial Sequence: Synthetic oligonucleotide
tagaacatcttttcacaatggaacggtggtaacttaccag

SEQ ID NO: 208199 - DNA, 39 bp, Artificial Sequence
  Description of Artificial Sequence: Synthetic oligonucleotide
agaacatcttttcacaatggaacggtggtaacttaccag

SEQ ID NO: 208200 - DNA, 38 bp, Artificial Sequence
  Description of Artificial Sequence: Synthetic oligonucleotide
gaacatcttttcacaatggaacggtggtaacttaccag

SEQ ID NO: 208201 - DNA, 39 bp, Artificial Sequence
  Description of Artificial Sequence: Synthetic oligonucleotide
aacatcttttcacaatggaacggtggtaacttaccagtg

SEQ ID NO: 208202 - DNA, 38 bp, Artificial Sequence
  Description of Artificial Sequence: Synthetic oligonucleotide
acatcttttcacaatggaacggtggtaacttaccagtg

SEQ ID NO: 208203 - DNA, 37 bp, Artificial Sequence
  Description of Artificial Sequence: Synthetic oligonucleotide
catcttttcacaatggaacggtggtaacttaccagtg

SEQ ID NO: 208204 - DNA, 37 bp, Artificial Sequence
  Description of Artificial Sequence: Synthetic oligonucleotide
atcttttcacaatggaacggtggtaacttaccagtgc

SEQ ID NO: 208205 - DNA, 36 bp, Artificial Sequence
  Description of Artificial Sequence: Synthetic oligonucleotide
tcttttcacaatggaacggtggtaacttaccagtgc

SEQ ID NO: 208206 - DNA, 35 bp, Artificial Sequence
  Description of Artificial Sequence: Synthetic oligonucleotide
cttttcacaatggaacggtggtaacttaccagtgc

SEQ ID NO: 208207 - DNA, 35 bp, Artificial Sequence
  Description of Artificial Sequence: Synthetic oligonucleotide
ttttcacaatggaacggtggtaacttaccagtgcc

SEQ ID NO: 208208 - DNA, 34 bp, Artificial Sequence
  Description of Artificial Sequence: Synthetic oligonucleotide
tttcacaatggaacggtggtaacttaccagtgcc

SEQ ID NO: 208209 - DNA, 33 bp, Artificial Sequence
  Description of Artificial Sequence: Synthetic oligonucleotide
ttcacaatggaacggtggtaacttaccagtgcc

SEQ ID NO: 208210 - DNA, 32 bp, Artificial Sequence
  Description of Artificial Sequence: Synthetic oligonucleotide
tcacaatggaacggtggtaacttaccagtgcc

SEQ ID NO: 208211 - DNA, 31 bp, Artificial Sequence
  Description of Artificial Sequence: Synthetic oligonucleotide
cacaatggaacggtggtaacttaccagtgcc

SEQ ID NO: 208212 - DNA, 32 bp, Artificial Sequence
  Description of Artificial Sequence: Synthetic oligonucleotide
acaatggaacggtggtaacttaccagtgccac

SEQ ID NO: 208213 - DNA, 31 bp, Artificial Sequence
  Description of Artificial Sequence: Synthetic oligonucleotide
caatggaacggtggtaacttaccagtgccac

SEQ ID NO: 208214 - DNA, 32 bp, Artificial Sequence
  Description of Artificial Sequence: Synthetic oligonucleotide
aatggaacggtggtaacttaccagtgccacac

SEQ ID NO: 208215 - DNA, 31 bp, Artificial Sequence
  Description of Artificial Sequence: Synthetic oligonucleotide
atggaacggtggtaacttaccagtgccacac

SEQ ID NO: 208216 - DNA, 30 bp, Artificial Sequence
  Description of Artificial Sequence: Synthetic oligonucleotide
tggaacggtggtaacttaccagtgccacac

SEQ ID NO: 208217 - DNA, 29 bp, Artificial Sequence
  Description of Artificial Sequence: Synthetic oligonucleotide
ggaacggtggtaacttaccagtgccacac

SEQ ID NO: 208218 - DNA, 30 bp, Artificial Sequence
  Description of Artificial Sequence: Synthetic oligonucleotide
gaacggtggtaacttaccagtgccacactg

SEQ ID NO: 208219 - DNA, 30 bp, Artificial Sequence
  Description of Artificial Sequence: Synthetic oligonucleotide
aacggtggtaacttaccagtgccacactgg

SEQ ID NO: 208220 - DNA, 29 bp, Artificial Sequence
  Description of Artificial Sequence: Synthetic oligonucleotide
acggtggtaacttaccagtgccacactgg

SEQ ID NO: 208221 - DNA, 28 bp, Artificial Sequence
  Description of Artificial Sequence: Synthetic oligonucleotide
cggtggtaacttaccagtgccacactgg

SEQ ID NO: 208222 - DNA, 29 bp, Artificial Sequence
  Description of Artificial Sequence: Synthetic oligonucleotide
ggtggtaacttaccagtgccacactggac

SEQ ID NO: 208223 - DNA, 29 bp, Artificial Sequence
  Description of Artificial Sequence: Synthetic oligonucleotide
gtggtaacttaccagtgccacactggacc

SEQ ID NO: 208224 - DNA, 30 bp, Artificial Sequence
  Description of Artificial Sequence: Synthetic oligonucleotide
tggtaacttaccagtgccacactggaccag

SEQ ID NO: 208225 - DNA, 29 bp, Artificial Sequence
  Description of Artificial Sequence: Synthetic oligonucleotide
ggtaacttaccagtgccacactggaccag

SEQ ID NO: 208226 - DNA, 31 bp, Artificial Sequence
  Description of Artificial Sequence: Synthetic oligonucleotide
gtaacttaccagtgccacactggaccagatg

SEQ ID NO: 208227 - DNA, 31 bp, Artificial Sequence
  Description of Artificial Sequence: Synthetic oligonucleotide
taacttaccagtgccacactggaccagatgg

SEQ ID NO: 208228 - DNA, 30 bp, Artificial Sequence
  Description of Artificial Sequence: Synthetic oligonucleotide
aacttaccagtgccacactggaccagatgg

SEQ ID NO: 208229 - DNA, 29 bp, Artificial Sequence
  Description of Artificial Sequence: Synthetic oligonucleotide
acttaccagtgccacactggaccagatgg

SEQ ID NO: 208230 - DNA, 28 bp, Artificial Sequence
  Description of Artificial Sequence: Synthetic oligonucleotide
cttaccagtgccacactggaccagatgg

SEQ ID NO: 208231 - DNA, 29 bp, Artificial Sequence
  Description of Artificial Sequence: Synthetic oligonucleotide
ttaccagtgccacactggaccagatggag

SEQ ID NO: 208232 - DNA, 28 bp, Artificial Sequence
  Description of Artificial Sequence: Synthetic oligonucleotide
taccagtgccacactggaccagatggag

SEQ ID NO: 208233 - DNA, 27 bp, Artificial Sequence
  Description of Artificial Sequence: Synthetic oligonucleotide
accagtgccacactggaccagatggag

SEQ ID NO: 208234 - DNA, 27 bp, Artificial Sequence
  Description of Artificial Sequence: Synthetic oligonucleotide
ccagtgccacactggaccagatggaga

SEQ ID NO: 208235 - DNA, 28 bp, Artificial Sequence
  Description of Artificial Sequence: Synthetic oligonucleotide
cagtgccacactggaccagatggagaac

SEQ ID NO: 208236 - DNA, 29 bp, Artificial Sequence
  Description of Artificial Sequence: Synthetic oligonucleotide
agtgccacactggaccagatggagaacag

SEQ ID NO: 208237 - DNA, 28 bp, Artificial Sequence
  Description of Artificial Sequence: Synthetic oligonucleotide
gtgccacactggaccagatggagaacag

SEQ ID NO: 208238 - DNA, 28 bp, Artificial Sequence
  Description of Artificial Sequence: Synthetic oligonucleotide
tgccacactggaccagatggagaacagc

SEQ ID NO: 208239 - DNA, 27 bp, Artificial Sequence
  Description of Artificial Sequence: Synthetic oligonucleotide
gccacactggaccagatggagaacagc

SEQ ID NO: 208240 - DNA, 28 bp, Artificial Sequence
  Description of Artificial Sequence: Synthetic oligonucleotide
ccacactggaccagatggagaacagctg

SEQ ID NO: 208241 - DNA, 31 bp, Artificial Sequence
  Description of Artificial Sequence: Synthetic oligonucleotide
cacactggaccagatggagaacagctgtttg

SEQ ID NO: 208242 - DNA, 32 bp, Artificial Sequence
  Description of Artificial Sequence: Synthetic oligonucleotide
acactggaccagatggagaacagctgtttgag

SEQ ID NO: 208243 - DNA, 31 bp, Artificial Sequence
  Description of Artificial Sequence: Synthetic oligonucleotide
cactggaccagatggagaacagctgtttgag

SEQ ID NO: 208244 - DNA, 31 bp, Artificial Sequence
  Description of Artificial Sequence: Synthetic oligonucleotide
actggaccagatggagaacagctgtttgagc

SEQ ID NO: 208245 - DNA, 30 bp, Artificial Sequence
  Description of Artificial Sequence: Synthetic oligonucleotide
ctggaccagatggagaacagctgtttgagc

SEQ ID NO: 208246 - DNA, 32 bp, Artificial Sequence
  Description of Artificial Sequence: Synthetic oligonucleotide
tggaccagatggagaacagctgtttgagcttg

SEQ ID NO: 208247 - DNA, 31 bp, Artificial Sequence
  Description of Artificial Sequence: Synthetic oligonucleotide
ggaccagatggagaacagctgtttgagcttg

SEQ ID NO: 208248 - DNA, 32 bp, Artificial Sequence
  Description of Artificial Sequence: Synthetic oligonucleotide
gaccagatggagaacagctgtttgagcttgtg

SEQ ID NO: 208249 - DNA, 32 bp, Artificial Sequence
  Description of Artificial Sequence: Synthetic oligonucleotide
accagatggagaacagctgtttgagcttgtgg

SEQ ID NO: 208250 - DNA, 31 bp, Artificial Sequence
  Description of Artificial Sequence: Synthetic oligonucleotide
ccagatggagaacagctgtttgagcttgtgg

SEQ ID NO: 208251 - DNA, 31 bp, Artificial Sequence
  Description of Artificial Sequence: Synthetic oligonucleotide
cagatggagaacagctgtttgagcttgtggg

SEQ ID NO: 208252 - DNA, 32 bp, Artificial Sequence
  Description of Artificial Sequence: Synthetic oligonucleotide
agatggagaacagctgtttgagcttgtgggag

SEQ ID NO: 208253 - DNA, 31 bp, Artificial Sequence
  Description of Artificial Sequence: Synthetic oligonucleotide
gatggagaacagctgtttgagcttgtgggag

SEQ ID NO: 208254 - DNA, 33 bp, Artificial Sequence
  Description of Artificial Sequence: Synthetic oligonucleotide
atggagaacagctgtttgagcttgtgggagaac

SEQ ID NO: 208255 - DNA, 32 bp, Artificial Sequence
  Description of Artificial Sequence: Synthetic oligonucleotide
tggagaacagctgtttgagcttgtgggagaac

SEQ ID NO: 208256 - DNA, 31 bp, Artificial Sequence
  Description of Artificial Sequence: Synthetic oligonucleotide
ggagaacagctgtttgagcttgtgggagaac

SEQ ID NO: 208257 - DNA, 31 bp, Artificial Sequence
  Description of Artificial Sequence: Synthetic oligonucleotide
gagaacagctgtttgagcttgtgggagaacg

SEQ ID NO: 208258 - DNA, 31 bp, Artificial Sequence
  Description of Artificial Sequence: Synthetic oligonucleotide
agaacagctgtttgagcttgtgggagaacgg

SEQ ID NO: 208259 - DNA, 30 bp, Artificial Sequence
  Description of Artificial Sequence: Synthetic oligonucleotide
gaacagctgtttgagcttgtgggagaacgg

SEQ ID NO: 208260 - DNA, 31 bp, Artificial Sequence
  Description of Artificial Sequence: Synthetic oligonucleotide
aacagctgtttgagcttgtgggagaacggtc

SEQ ID NO: 208261 - DNA, 30 bp, Artificial Sequence
  Description of Artificial Sequence: Synthetic oligonucleotide
acagctgtttgagcttgtgggagaacggtc

SEQ ID NO: 208262 - DNA, 29 bp, Artificial Sequence
  Description of Artificial Sequence: Synthetic oligonucleotide
cagctgtttgagcttgtgggagaacggtc

SEQ ID NO: 208263 - DNA, 37 bp, Artificial Sequence
  Description of Artificial Sequence: Synthetic oligonucleotide
agctgtttgagcttgtgggagaacggtcaatatattg

SEQ ID NO: 208264 - DNA, 36 bp, Artificial Sequence
  Description of Artificial Sequence: Synthetic oligonucleotide
gctgtttgagcttgtgggagaacggtcaatatattg

SEQ ID NO: 208265 - DNA, 36 bp, Artificial Sequence
  Description of Artificial Sequence: Synthetic oligonucleotide
ctgtttgagcttgtgggagaacggtcaatatattgc

SEQ ID NO: 208266 - DNA, 37 bp, Artificial Sequence
  Description of Artificial Sequence: Synthetic oligonucleotide
tgtttgagcttgtgggagaacggtcaatatattgcac

SEQ ID NO: 208267 - DNA, 36 bp, Artificial Sequence
  Description of Artificial Sequence: Synthetic oligonucleotide
gtttgagcttgtgggagaacggtcaatatattgcac

SEQ ID NO: 208268 - DNA, 36 bp, Artificial Sequence
  Description of Artificial Sequence: Synthetic oligonucleotide
tttgagcttgtgggagaacggtcaatatattgcacc

SEQ ID NO: 208269 - DNA, 35 bp, Artificial Sequence
  Description of Artificial Sequence: Synthetic oligonucleotide
ttgagcttgtgggagaacggtcaatatattgcacc

SEQ ID NO: 208270 - DNA, 34 bp, Artificial Sequence
  Description of Artificial Sequence: Synthetic oligonucleotide
tgagcttgtgggagaacggtcaatatattgcacc

SEQ ID NO: 208271 - DNA, 33 bp, Artificial Sequence
  Description of Artificial Sequence: Synthetic oligonucleotide
gagcttgtgggagaacggtcaatatattgcacc

SEQ ID NO: 208272 - DNA, 34 bp, Artificial Sequence
  Description of Artificial Sequence: Synthetic oligonucleotide
agcttgtgggagaacggtcaatatattgcaccag

SEQ ID NO: 208273 - DNA, 33 bp, Artificial Sequence
  Description of Artificial Sequence: Synthetic oligonucleotide
gcttgtgggagaacggtcaatatattgcaccag

SEQ ID NO: 208274 - DNA, 33 bp, Artificial Sequence
  Description of Artificial Sequence: Synthetic oligonucleotide
cttgtgggagaacggtcaatatattgcaccagc

SEQ ID NO: 208275 - DNA, 36 bp, Artificial Sequence
  Description of Artificial Sequence: Synthetic oligonucleotide
ttgtgggagaacggtcaatatattgcaccagcaaag

SEQ ID NO: 208276 - DNA, 35 bp, Artificial Sequence
  Description of Artificial Sequence: Synthetic oligonucleotide
tgtgggagaacggtcaatatattgcaccagcaaag

SEQ ID NO: 208277 - DNA, 34 bp, Artificial Sequence
  Description of Artificial Sequence: Synthetic oligonucleotide
gtgggagaacggtcaatatattgcaccagcaaag

SEQ ID NO: 208278 - DNA, 36 bp, Artificial Sequence
  Description of Artificial Sequence: Synthetic oligonucleotide
tgggagaacggtcaatatattgcaccagcaaagatg

SEQ ID NO: 208279 - DNA, 35 bp, Artificial Sequence
  Description of Artificial Sequence: Synthetic oligonucleotide
gggagaacggtcaatatattgcaccagcaaagatg

SEQ ID NO: 208280 - DNA, 37 bp, Artificial Sequence
  Description of Artificial Sequence: Synthetic oligonucleotide
ggagaacggtcaatatattgcaccagcaaagatgatc

SEQ ID NO: 208281 - DNA, 39 bp, Artificial Sequence
  Description of Artificial Sequence: Synthetic oligonucleotide
gagaacggtcaatatattgcaccagcaaagatgatcaag

SEQ ID NO: 208282 - DNA, 41 bp, Artificial Sequence
  Description of Artificial Sequence: Synthetic oligonucleotide
agaacggtcaatatattgcaccagcaaagatgatcaagttg

SEQ ID NO: 208283 - DNA, 40 bp, Artificial Sequence
  Description of Artificial Sequence: Synthetic oligonucleotide
gaacggtcaatatattgcaccagcaaagatgatcaagttg

SEQ ID NO: 208284 - DNA, 40 bp, Artificial Sequence
  Description of Artificial Sequence: Synthetic oligonucleotide
aacggtcaatatattgcaccagcaaagatgatcaagttgg

SEQ ID NO: 208285 - DNA, 39 bp, Artificial Sequence
  Description of Artificial Sequence: Synthetic oligonucleotide
acggtcaatatattgcaccagcaaagatgatcaagttgg

SEQ ID NO: 208286 - DNA, 38 bp, Artificial Sequence
  Description of Artificial Sequence: Synthetic oligonucleotide
cggtcaatatattgcaccagcaaagatgatcaagttgg

SEQ ID NO: 208287 - DNA, 39 bp, Artificial Sequence
  Description of Artificial Sequence: Synthetic oligonucleotide
ggtcaatatattgcaccagcaaagatgatcaagttggtg

SEQ ID NO: 208288 - DNA, 42 bp, Artificial Sequence
  Description of Artificial Sequence: Synthetic oligonucleotide
gtcaatatattgcaccagcaaagatgatcaagttggtgtttg

SEQ ID NO: 208289 - DNA, 42 bp, Artificial Sequence
  Description of Artificial Sequence: Synthetic oligonucleotide
tcaatatattgcaccagcaaagatgatcaagttggtgtttgg

SEQ ID NO: 208290 - DNA, 41 bp, Artificial Sequence
  Description of Artificial Sequence: Synthetic oligonucleotide
caatatattgcaccagcaaagatgatcaagttggtgtttgg

SEQ ID NO: 208291 - DNA, 42 bp, Artificial Sequence
  Description of Artificial Sequence: Synthetic oligonucleotide
aatatattgcaccagcaaagatgatcaagttggtgtttggag

SEQ ID NO: 208292 - DNA, 41 bp, Artificial Sequence
  Description of Artificial Sequence: Synthetic oligonucleotide
atatattgcaccagcaaagatgatcaagttggtgtttggag

SEQ ID NO: 208293 - DNA, 40 bp, Artificial Sequence
  Description of Artificial Sequence: Synthetic oligonucleotide
tatattgcaccagcaaagatgatcaagttggtgtttggag

SEQ ID NO: 208294 - DNA, 39 bp, Artificial Sequence
  Description of Artificial Sequence: Synthetic oligonucleotide
atattgcaccagcaaagatgatcaagttggtgtttggag

SEQ ID NO: 208295 - DNA, 38 bp, Artificial Sequence
  Description of Artificial Sequence: Synthetic oligonucleotide
tattgcaccagcaaagatgatcaagttggtgtttggag

SEQ ID NO: 208296 - DNA, 37 bp, Artificial Sequence
  Description of Artificial Sequence: Synthetic oligonucleotide
attgcaccagcaaagatgatcaagttggtgtttggag

SEQ ID NO: 208297 - DNA, 36 bp, Artificial Sequence
  Description of Artificial Sequence: Synthetic oligonucleotide
ttgcaccagcaaagatgatcaagttggtgtttggag

SEQ ID NO: 208298 - DNA, 35 bp, Artificial Sequence
  Description of Artificial Sequence: Synthetic oligonucleotide
tgcaccagcaaagatgatcaagttggtgtttggag

SEQ ID NO: 208299 - DNA, 34 bp, Artificial Sequence
  Description of Artificial Sequence: Synthetic oligonucleotide
gcaccagcaaagatgatcaagttggtgtttggag

SEQ ID NO: 208300 - DNA, 34 bp, Artificial Sequence
  Description of Artificial Sequence: Synthetic oligonucleotide
caccagcaaagatgatcaagttggtgtttggagc

SEQ ID NO: 208301 - DNA, 35 bp, Artificial Sequence
  Description of Artificial Sequence: Synthetic oligonucleotide
accagcaaagatgatcaagttggtgtttggagcag

SEQ ID NO: 208302 - DNA, 34 bp, Artificial Sequence
  Description of Artificial Sequence: Synthetic oligonucleotide
ccagcaaagatgatcaagttggtgtttggagcag

SEQ ID NO: 208303 - DNA, 34 bp, Artificial Sequence
  Description of Artificial Sequence: Synthetic oligonucleotide
cagcaaagatgatcaagttggtgtttggagcagc

SEQ ID NO: 208304 - DNA, 34 bp, Artificial Sequence
  Description of Artificial Sequence: Synthetic oligonucleotide
agcaaagatgatcaagttggtgtttggagcagcc

SEQ ID NO: 208305 - DNA, 33 bp, Artificial Sequence
  Description of Artificial Sequence: Synthetic oligonucleotide
gcaaagatgatcaagttggtgtttggagcagcc

SEQ ID NO: 208306 - DNA, 33 bp, Artificial Sequence
  Description of Artificial Sequence: Synthetic oligonucleotide
caaagatgatcaagttggtgtttggagcagccc

SEQ ID NO: 208307 - DNA, 34 bp, Artificial Sequence
  Description of Artificial Sequence: Synthetic oligonucleotide
aaagatgatcaagttggtgtttggagcagccctc

SEQ ID NO: 208308 - DNA, 33 bp, Artificial Sequence
  Description of Artificial Sequence: Synthetic oligonucleotide
aagatgatcaagttggtgtttggagcagccctc

SEQ ID NO: 208309 - DNA, 32 bp, Artificial Sequence
  Description of Artificial Sequence: Synthetic oligonucleotide
agatgatcaagttggtgtttggagcagccctc

SEQ ID NO: 208310 - DNA, 31 bp, Artificial Sequence
  Description of Artificial Sequence: Synthetic oligonucleotide
gatgatcaagttggtgtttggagcagccctc

SEQ ID NO: 208311 - DNA, 31 bp, Artificial Sequence
  Description of Artificial Sequence: Synthetic oligonucleotide
atgatcaagttggtgtttggagcagccctcc

SEQ ID NO: 208312 - DNA, 30 bp, Artificial Sequence
  Description of Artificial Sequence: Synthetic oligonucleotide
tgatcaagttggtgtttggagcagccctcc

SEQ ID NO: 208313 - DNA, 29 bp, Artificial Sequence
  Description of Artificial Sequence: Synthetic oligonucleotide
gatcaagttggtgtttggagcagccctcc

SEQ ID NO: 208314 - DNA, 29 bp, Artificial Sequence
  Description of Artificial Sequence: Synthetic oligonucleotide
atcaagttggtgtttggagcagccctccc

SEQ ID NO: 208315 - DNA, 28 bp, Artificial Sequence
  Description of Artificial Sequence: Synthetic oligonucleotide
tcaagttggtgtttggagcagccctccc

SEQ ID NO: 208316 - DNA, 27 bp, Artificial Sequence
  Description of Artificial Sequence: Synthetic oligonucleotide
caagttggtgtttggagcagccctccc

SEQ ID NO: 208317 - DNA, 27 bp, Artificial Sequence
  Description of Artificial Sequence: Synthetic oligonucleotide
aagttggtgtttggagcagccctcccc

SEQ ID NO: 208318 - DNA, 26 bp, Artificial Sequence
  Description of Artificial Sequence: Synthetic oligonucleotide
agttggtgtttggagcagccctcccc

SEQ ID NO: 208319 - DNA, 25 bp, Artificial Sequence
  Description of Artificial Sequence: Synthetic oligonucleotide
gttggtgtttggagcagccctcccc

SEQ ID NO: 208320 - DNA, 26 bp, Artificial Sequence
  Description of Artificial Sequence: Synthetic oligonucleotide
ttggtgtttggagcagccctccccct

SEQ ID NO: 208321 - DNA, 25 bp, Artificial Sequence
  Description of Artificial Sequence: Synthetic oligonucleotide
tggtgtttggagcagccctccccct

SEQ ID NO: 208322 - DNA, 24 bp, Artificial Sequence
  Description of Artificial Sequence: Synthetic oligonucleotide
ggtgtttggagcagccctccccct

SEQ ID NO: 208323 - DNA, 24 bp, Artificial Sequence
  Description of Artificial Sequence: Synthetic oligonucleotide
gtgtttggagcagccctccccctc

SEQ ID NO: 208324 - DNA, 24 bp, Artificial Sequence
  Description of Artificial Sequence: Synthetic oligonucleotide
tgtttggagcagccctccccctcg

SEQ ID NO: 208325 - DNA, 23 bp, Artificial Sequence
  Description of Artificial Sequence: Synthetic oligonucleotide
gtttggagcagccctccccctcg

SEQ ID NO: 208326 - DNA, 24 bp, Artificial Sequence
  Description of Artificial Sequence: Synthetic oligonucleotide
tttggagcagccctccccctcggt

SEQ ID NO: 208327 - DNA, 23 bp, Artificial Sequence
  Description of Artificial Sequence: Synthetic oligonucleotide
ttggagcagccctccccctcggt

SEQ ID NO: 208328 - DNA, 22 bp, Artificial Sequence
  Description of Artificial Sequence: Synthetic oligonucleotide
tggagcagccctccccctcggt

SEQ ID NO: 208329 - DNA, 21 bp, Artificial Sequence
  Description of Artificial Sequence: Synthetic oligonucleotide
ggagcagccctccccctcggt

SEQ ID NO: 208330 - DNA, 26 bp, Artificial Sequence
  Description of Artificial Sequence: Synthetic oligonucleotide
gagcagccctccccctcggtgtattt

SEQ ID NO: 208331 - DNA, 27 bp, Artificial Sequence
  Description of Artificial Sequence: Synthetic oligonucleotide
agcagccctccccctcggtgtatttct

SEQ ID NO: 208332 - DNA, 27 bp, Artificial Sequence
  Description of Artificial Sequence: Synthetic oligonucleotide
gcagccctccccctcggtgtatttcta

SEQ ID NO: 208333 - DNA, 27 bp, Artificial Sequence
  Description of Artificial Sequence: Synthetic oligonucleotide
cagccctccccctcggtgtatttctac

SEQ ID NO: 208334 - DNA, 35 bp, Artificial Sequence
  Description of Artificial Sequence: Synthetic oligonucleotide
agccctccccctcggtgtatttctactaataaatg

SEQ ID NO: 208335 - DNA, 34 bp, Artificial Sequence
  Description of Artificial Sequence: Synthetic oligonucleotide
gccctccccctcggtgtatttctactaataaatg

SEQ ID NO: 208336 - DNA, 34 bp, Artificial Sequence
  Description of Artificial Sequence: Synthetic oligonucleotide
ccctccccctcggtgtatttctactaataaatgc

SEQ ID NO: 208337 - DNA, 35 bp, Artificial Sequence
  Description of Artificial Sequence: Synthetic oligonucleotide
cctccccctcggtgtatttctactaataaatgcac

SEQ ID NO: 208338 - DNA, 36 bp, Artificial Sequence
  Description of Artificial Sequence: Synthetic oligonucleotide
ctccccctcggtgtatttctactaataaatgcacag

SEQ ID NO: 208339 - DNA, 36 bp, Artificial Sequence
  Description of Artificial Sequence: Synthetic oligonucleotide
tccccctcggtgtatttctactaataaatgcacagc

SEQ ID NO: 208340 - DNA, 35 bp, Artificial Sequence
  Description of Artificial Sequence: Synthetic oligonucleotide
ccccctcggtgtatttctactaataaatgcacagc

SEQ ID NO: 208341 - DNA, 36 bp, Artificial Sequence
  Description of Artificial Sequence: Synthetic oligonucleotide
cccctcggtgtatttctactaataaatgcacagctc

SEQ ID NO: 208342 - DNA, 36 bp, Artificial Sequence
  Description of Artificial Sequence: Synthetic oligonucleotide
ccctcggtgtatttctactaataaatgcacagctcc

SEQ ID NO: 208343 - DNA, 37 bp, Artificial Sequence
  Description of Artificial Sequence: Synthetic oligonucleotide
cctcggtgtatttctactaataaatgcacagctccag

SEQ ID NO: 208344 - DNA, 39 bp, Artificial Sequence
  Description of Artificial Sequence: Synthetic oligonucleotide
ctcggtgtatttctactaataaatgcacagctccagaag

SEQ ID NO: 208345 - DNA, 41 bp, Artificial Sequence
  Description of Artificial Sequence: Synthetic oligonucleotide
tcggtgtatttctactaataaatgcacagctccagaagttg

SEQ ID NO: 208346 - DNA, 40 bp, Artificial Sequence
  Description of Artificial Sequence: Synthetic oligonucleotide
cggtgtatttctactaataaatgcacagctccagaagttg

SEQ ID NO: 208347 - DNA, 45 bp, Artificial Sequence
  Description of Artificial Sequence: Synthetic oligonucleotide
ggtgtatttctactaataaatgcacagctccagaagttgaaaatg

SEQ ID NO: 208348 - DNA, 45 bp, Artificial Sequence
  Description of Artificial Sequence: Synthetic oligonucleotide
gtgtatttctactaataaatgcacagctccagaagttgaaaatgc

SEQ ID NO: 208349 - DNA, 50 bp, Artificial Sequence
  Description of Artificial Sequence: Synthetic oligonucleotide
tgtatttctactaataaatgcacagctccagaagttgaaaatgcaattag

SEQ ID NO: 208350 - DNA, 49 bp, Artificial Sequence
  Description of Artificial Sequence: Synthetic oligonucleotide
gtatttctactaataaatgcacagctccagaagttgaaaatgcaattag

SEQ ID NO: 208351 - DNA, 50 bp, Artificial Sequence
  Description of Artificial Sequence: Synthetic oligonucleotide
tatttctactaataaatgcacagctccagaagttgaaaatgcaattagag

SEQ ID NO: 208352 - DNA, 49 bp, Artificial Sequence
  Description of Artificial Sequence: Synthetic oligonucleotide
atttctactaataaatgcacagctccagaagttgaaaatgcaattagag

SEQ ID NO: 208353 - DNA, 48 bp, Artificial Sequence
  Description of Artificial Sequence: Synthetic oligonucleotide
tttctactaataaatgcacagctccagaagttgaaaatgcaattagag

SEQ ID NO: 208354 - DNA, 47 bp, Artificial Sequence
  Description of Artificial Sequence: Synthetic oligonucleotide
ttctactaataaatgcacagctccagaagttgaaaatgcaattagag

SEQ ID NO: 208355 - DNA, 46 bp, Artificial Sequence
  Description of Artificial Sequence: Synthetic oligonucleotide
tctactaataaatgcacagctccagaagttgaaaatgcaattagag

SEQ ID NO: 208356 - DNA, 45 bp, Artificial Sequence
  Description of Artificial Sequence: Synthetic oligonucleotide
ctactaataaatgcacagctccagaagttgaaaatgcaattagag

SEQ ID NO: 208357 - DNA, 47 bp, Artificial Sequence
  Description of Artificial Sequence: Synthetic oligonucleotide
tactaataaatgcacagctccagaagttgaaaatgcaattagagtac

SEQ ID NO: 208358 - DNA, 46 bp, Artificial Sequence
  Description of Artificial Sequence: Synthetic oligonucleotide
actaataaatgcacagctccagaagttgaaaatgcaattagagtac

SEQ ID NO: 208359 - DNA, 45 bp, Artificial Sequence
  Description of Artificial Sequence: Synthetic oligonucleotide
ctaataaatgcacagctccagaagttgaaaatgcaattagagtac

SEQ ID NO: 208360 - DNA, 45 bp, Artificial Sequence
  Description of Artificial Sequence: Synthetic oligonucleotide
taataaatgcacagctccagaagttgaaaatgcaattagagtacc

SEQ ID NO: 208361 - DNA, 44 bp, Artificial Sequence
  Description of Artificial Sequence: Synthetic oligonucleotide
aataaatgcacagctccagaagttgaaaatgcaattagagtacc

SEQ ID NO: 208362 - DNA, 43 bp, Artificial Sequence
  Description of Artificial Sequence: Synthetic oligonucleotide
ataaatgcacagctccagaagttgaaaatgcaattagagtacc

SEQ ID NO: 208363 - DNA, 42 bp, Artificial Sequence
  Description of Artificial Sequence: Synthetic oligonucleotide
taaatgcacagctccagaagttgaaaatgcaattagagtacc

SEQ ID NO: 208364 - DNA, 41 bp, Artificial Sequence
  Description of Artificial Sequence: Synthetic oligonucleotide
aaatgcacagctccagaagttgaaaatgcaattagagtacc

SEQ ID NO: 208365 - DNA, 40 bp, Artificial Sequence
  Description of Artificial Sequence: Synthetic oligonucleotide
aatgcacagctccagaagttgaaaatgcaattagagtacc

SEQ ID NO: 208366 - DNA, 39 bp, Artificial Sequence
  Description of Artificial Sequence: Synthetic oligonucleotide
atgcacagctccagaagttgaaaatgcaattagagtacc

SEQ ID NO: 208367 - DNA, 38 bp, Artificial Sequence
  Description of Artificial Sequence: Synthetic oligonucleotide
tgcacagctccagaagttgaaaatgcaattagagtacc

SEQ ID NO: 208368 - DNA, 37 bp, Artificial Sequence
  Description of Artificial Sequence: Synthetic oligonucleotide
gcacagctccagaagttgaaaatgcaattagagtacc

SEQ ID NO: 208369 - DNA, 38 bp, Artificial Sequence
  Description of Artificial Sequence: Synthetic oligonucleotide
cacagctccagaagttgaaaatgcaattagagtaccag

SEQ ID NO: 208370 - DNA, 38 bp, Artificial Sequence
  Description of Artificial Sequence: Synthetic oligonucleotide
acagctccagaagttgaaaatgcaattagagtaccagg

SEQ ID NO: 208371 - DNA, 37 bp, Artificial Sequence
  Description of Artificial Sequence: Synthetic oligonucleotide
cagctccagaagttgaaaatgcaattagagtaccagg

SEQ ID NO: 208372 - DNA, 40 bp, Artificial Sequence
  Description of Artificial Sequence: Synthetic oligonucleotide
agctccagaagttgaaaatgcaattagagtaccaggaaac

SEQ ID NO: 208373 - DNA, 39 bp, Artificial Sequence
  Description of Artificial Sequence: Synthetic oligonucleotide
gctccagaagttgaaaatgcaattagagtaccaggaaac

SEQ ID NO: 208374 - DNA, 40 bp, Artificial Sequence
  Description of Artificial Sequence: Synthetic oligonucleotide
ctccagaagttgaaaatgcaattagagtaccaggaaacag

SEQ ID NO: 208375 - DNA, 40 bp, Artificial Sequence
  Description of Artificial Sequence: Synthetic oligonucleotide
tccagaagttgaaaatgcaattagagtaccaggaaacagg

SEQ ID NO: 208376 - DNA, 39 bp, Artificial Sequence
  Description of Artificial Sequence: Synthetic oligonucleotide
ccagaagttgaaaatgcaattagagtaccaggaaacagg

SEQ ID NO: 208377 - DNA, 40 bp, Artificial Sequence
  Description of Artificial Sequence: Synthetic oligonucleotide
cagaagttgaaaatgcaattagagtaccaggaaacaggag

SEQ ID NO: 208378 - DNA, 43 bp, Artificial Sequence
  Description of Artificial Sequence: Synthetic oligonucleotide
agaagttgaaaatgcaattagagtaccaggaaacaggagtttc

SEQ ID NO: 208379 - DNA, 42 bp, Artificial Sequence
  Description of Artificial Sequence: Synthetic oligonucleotide
gaagttgaaaatgcaattagagtaccaggaaacaggagtttc

SEQ ID NO: 208380 - DNA, 46 bp, Artificial Sequence
  Description of Artificial Sequence: Synthetic oligonucleotide
aagttgaaaatgcaattagagtaccaggaaacaggagtttctttac

SEQ ID NO: 208381 - DNA, 45 bp, Artificial Sequence
  Description of Artificial Sequence: Synthetic oligonucleotide
agttgaaaatgcaattagagtaccaggaaacaggagtttctttac

SEQ ID NO: 208382 - DNA, 44 bp, Artificial Sequence
  Description of Artificial Sequence: Synthetic oligonucleotide
gttgaaaatgcaattagagtaccaggaaacaggagtttctttac

SEQ ID NO: 208383 - DNA, 44 bp, Artificial Sequence
  Description of Artificial Sequence: Synthetic oligonucleotide
ttgaaaatgcaattagagtaccaggaaacaggagtttctttacc

SEQ ID NO: 208384 - DNA, 43 bp, Artificial Sequence
  Description of Artificial Sequence: Synthetic oligonucleotide
tgaaaatgcaattagagtaccaggaaacaggagtttctttacc

SEQ ID NO: 208385 - DNA, 42 bp, Artificial Sequence
  Description of Artificial Sequence: Synthetic oligonucleotide
gaaaatgcaattagagtaccaggaaacaggagtttctttacc

SEQ ID NO: 208386 - DNA, 42 bp, Artificial Sequence
  Description of Artificial Sequence: Synthetic oligonucleotide
aaaatgcaattagagtaccaggaaacaggagtttctttaccc

SEQ ID NO: 208387 - DNA, 41 bp, Artificial Sequence
  Description of Artificial Sequence: Synthetic oligonucleotide
aaatgcaattagagtaccaggaaacaggagtttctttaccc

SEQ ID NO: 208388 - DNA, 40 bp, Artificial Sequence
  Description of Artificial Sequence: Synthetic oligonucleotide
aatgcaattagagtaccaggaaacaggagtttctttaccc

SEQ ID NO: 208389 - DNA, 39 bp, Artificial Sequence
  Description of Artificial Sequence: Synthetic oligonucleotide
atgcaattagagtaccaggaaacaggagtttctttaccc

SEQ ID NO: 208390 - DNA, 38 bp, Artificial Sequence
  Description of Artificial Sequence: Synthetic oligonucleotide
tgcaattagagtaccaggaaacaggagtttctttaccc

SEQ ID NO: 208391 - DNA, 37 bp, Artificial Sequence
  Description of Artificial Sequence: Synthetic oligonucleotide
gcaattagagtaccaggaaacaggagtttctttaccc

SEQ ID NO: 208392 - DNA, 38 bp, Artificial Sequence
  Description of Artificial Sequence: Synthetic oligonucleotide
caattagagtaccaggaaacaggagtttctttaccctc

SEQ ID NO: 208393 - DNA, 39 bp, Artificial Sequence
  Description of Artificial Sequence: Synthetic oligonucleotide
aattagagtaccaggaaacaggagtttctttaccctcac

SEQ ID NO: 208394 - DNA, 38 bp, Artificial Sequence
  Description of Artificial Sequence: Synthetic oligonucleotide
attagagtaccaggaaacaggagtttctttaccctcac

SEQ ID NO: 208395 - DNA, 37 bp, Artificial Sequence
  Description of Artificial Sequence: Synthetic oligonucleotide
ttagagtaccaggaaacaggagtttctttaccctcac

SEQ ID NO: 208396 - DNA, 36 bp, Artificial Sequence
  Description of Artificial Sequence: Synthetic oligonucleotide
tagagtaccaggaaacaggagtttctttaccctcac

SEQ ID NO: 208397 - DNA, 35 bp, Artificial Sequence
  Description of Artificial Sequence: Synthetic oligonucleotide
agagtaccaggaaacaggagtttctttaccctcac

SEQ ID NO: 208398 - DNA, 34 bp, Artificial Sequence
  Description of Artificial Sequence: Synthetic oligonucleotide
gagtaccaggaaacaggagtttctttaccctcac

SEQ ID NO: 208399 - DNA, 35 bp, Artificial Sequence
  Description of Artificial Sequence: Synthetic oligonucleotide
agtaccaggaaacaggagtttctttaccctcactg

SEQ ID NO: 208400 - DNA, 34 bp, Artificial Sequence
  Description of Artificial Sequence: Synthetic oligonucleotide
gtaccaggaaacaggagtttctttaccctcactg

SEQ ID NO: 208401 - DNA, 35 bp, Artificial Sequence
  Description of Artificial Sequence: Synthetic oligonucleotide
taccaggaaacaggagtttctttaccctcactgag

SEQ ID NO: 208402 - DNA, 34 bp, Artificial Sequence
  Description of Artificial Sequence: Synthetic oligonucleotide
accaggaaacaggagtttctttaccctcactgag

SEQ ID NO: 208403 - DNA, 33 bp, Artificial Sequence
  Description of Artificial Sequence: Synthetic oligonucleotide
ccaggaaacaggagtttctttaccctcactgag

SEQ ID NO: 208404 - DNA, 35 bp, Artificial Sequence
  Description of Artificial Sequence: Synthetic oligonucleotide
caggaaacaggagtttctttaccctcactgagatc

SEQ ID NO: 208405 - DNA, 37 bp, Artificial Sequence
  Description of Artificial Sequence: Synthetic oligonucleotide
aggaaacaggagtttctttaccctcactgagatcatc

SEQ ID NO: 208406 - DNA, 36 bp, Artificial Sequence
  Description of Artificial Sequence: Synthetic oligonucleotide
ggaaacaggagtttctttaccctcactgagatcatc

SEQ ID NO: 208407 - DNA, 37 bp, Artificial Sequence
  Description of Artificial Sequence: Synthetic oligonucleotide
gaaacaggagtttctttaccctcactgagatcatcag

SEQ ID NO: 208408 - DNA, 42 bp, Artificial Sequence
  Description of Artificial Sequence: Synthetic oligonucleotide
aaacaggagtttctttaccctcactgagatcatcagatttag

SEQ ID NO: 208409 - DNA, 41 bp, Artificial Sequence
  Description of Artificial Sequence: Synthetic oligonucleotide
aacaggagtttctttaccctcactgagatcatcagatttag

SEQ ID NO: 208410 - DNA, 40 bp, Artificial Sequence
  Description of Artificial Sequence: Synthetic oligonucleotide
acaggagtttctttaccctcactgagatcatcagatttag

SEQ ID NO: 208411 - DNA, 39 bp, Artificial Sequence
  Description of Artificial Sequence: Synthetic oligonucleotide
caggagtttctttaccctcactgagatcatcagatttag

SEQ ID NO: 208412 - DNA, 41 bp, Artificial Sequence
  Description of Artificial Sequence: Synthetic oligonucleotide
aggagtttctttaccctcactgagatcatcagatttagatg

SEQ ID NO: 208413 - DNA, 40 bp, Artificial Sequence
  Description of Artificial Sequence: Synthetic oligonucleotide
ggagtttctttaccctcactgagatcatcagatttagatg

SEQ ID NO: 208414 - DNA, 41 bp, Artificial Sequence
  Description of Artificial Sequence: Synthetic oligonucleotide
gagtttctttaccctcactgagatcatcagatttagatgtc

SEQ ID NO: 208415 - DNA, 42 bp, Artificial Sequence
  Description of Artificial Sequence: Synthetic oligonucleotide
agtttctttaccctcactgagatcatcagatttagatgtcag

SEQ ID NO: 208416 - DNA, 41 bp, Artificial Sequence
  Description of Artificial Sequence: Synthetic oligonucleotide
gtttctttaccctcactgagatcatcagatttagatgtcag

SEQ ID NO: 208417 - DNA, 41 bp, Artificial Sequence
  Description of Artificial Sequence: Synthetic oligonucleotide
tttctttaccctcactgagatcatcagatttagatgtcagc

SEQ ID NO: 208418 - DNA, 40 bp, Artificial Sequence
  Description of Artificial Sequence: Synthetic oligonucleotide
ttctttaccctcactgagatcatcagatttagatgtcagc

SEQ ID NO: 208419 - DNA, 39 bp, Artificial Sequence
  Description of Artificial Sequence: Synthetic oligonucleotide
tctttaccctcactgagatcatcagatttagatgtcagc

SEQ ID NO: 208420 - DNA, 38 bp, Artificial Sequence
  Description of Artificial Sequence: Synthetic oligonucleotide
ctttaccctcactgagatcatcagatttagatgtcagc

SEQ ID NO: 208421 - DNA, 38 bp, Artificial Sequence
  Description of Artificial Sequence: Synthetic oligonucleotide
tttaccctcactgagatcatcagatttagatgtcagcc

SEQ ID NO: 208422 - DNA, 37 bp, Artificial Sequence
  Description of Artificial Sequence: Synthetic oligonucleotide
ttaccctcactgagatcatcagatttagatgtcagcc

SEQ ID NO: 208423 - DNA, 36 bp, Artificial Sequence
  Description of Artificial Sequence: Synthetic oligonucleotide
taccctcactgagatcatcagatttagatgtcagcc

SEQ ID NO: 208424 - DNA, 35 bp, Artificial Sequence
  Description of Artificial Sequence: Synthetic oligonucleotide
accctcactgagatcatcagatttagatgtcagcc

SEQ ID NO: 208425 - DNA, 34 bp, Artificial Sequence
  Description of Artificial Sequence: Synthetic oligonucleotide
ccctcactgagatcatcagatttagatgtcagcc

SEQ ID NO: 208426 - DNA, 34 bp, Artificial Sequence
  Description of Artificial Sequence: Synthetic oligonucleotide
cctcactgagatcatcagatttagatgtcagccc

SEQ ID NO: 208427 - DNA, 34 bp, Artificial Sequence
  Description of Artificial Sequence: Synthetic oligonucleotide
ctcactgagatcatcagatttagatgtcagcccg

SEQ ID NO: 208428 - DNA, 34 bp, Artificial Sequence
  Description of Artificial Sequence: Synthetic oligonucleotide
tcactgagatcatcagatttagatgtcagcccgg

SEQ ID NO: 208429 - DNA, 33 bp, Artificial Sequence
  Description of Artificial Sequence: Synthetic oligonucleotide
cactgagatcatcagatttagatgtcagcccgg

SEQ ID NO: 208430 - DNA, 33 bp, Artificial Sequence
  Description of Artificial Sequence: Synthetic oligonucleotide
actgagatcatcagatttagatgtcagcccggg

SEQ ID NO: 208431 - DNA, 32 bp, Artificial Sequence
  Description of Artificial Sequence: Synthetic oligonucleotide
ctgagatcatcagatttagatgtcagcccggg

SEQ ID NO: 208432 - DNA, 35 bp, Artificial Sequence
  Description of Artificial Sequence: Synthetic oligonucleotide
tgagatcatcagatttagatgtcagcccgggtttg

SEQ ID NO: 208433 - DNA, 34 bp, Artificial Sequence
  Description of Artificial Sequence: Synthetic oligonucleotide
gagatcatcagatttagatgtcagcccgggtttg

SEQ ID NO: 208434 - DNA, 35 bp, Artificial Sequence
  Description of Artificial Sequence: Synthetic oligonucleotide
agatcatcagatttagatgtcagcccgggtttgtc

SEQ ID NO: 208435 - DNA, 34 bp, Artificial Sequence
  Description of Artificial Sequence: Synthetic oligonucleotide
gatcatcagatttagatgtcagcccgggtttgtc

SEQ ID NO: 208436 - DNA, 36 bp, Artificial Sequence
  Description of Artificial Sequence: Synthetic oligonucleotide
atcatcagatttagatgtcagcccgggtttgtcatg

SEQ ID NO: 208437 - DNA, 35 bp, Artificial Sequence
  Description of Artificial Sequence: Synthetic oligonucleotide
tcatcagatttagatgtcagcccgggtttgtcatg

SEQ ID NO: 208438 - DNA, 34 bp, Artificial Sequence
  Description of Artificial Sequence: Synthetic oligonucleotide
catcagatttagatgtcagcccgggtttgtcatg

SEQ ID NO: 208439 - DNA, 34 bp, Artificial Sequence
  Description of Artificial Sequence: Synthetic oligonucleotide
atcagatttagatgtcagcccgggtttgtcatgg

SEQ ID NO: 208440 - DNA, 33 bp, Artificial Sequence
  Description of Artificial Sequence: Synthetic oligonucleotide
tcagatttagatgtcagcccgggtttgtcatgg

SEQ ID NO: 208441 - DNA, 32 bp, Artificial Sequence
  Description of Artificial Sequence: Synthetic oligonucleotide
cagatttagatgtcagcccgggtttgtcatgg

SEQ ID NO: 208442 - DNA, 34 bp, Artificial Sequence
  Description of Artificial Sequence: Synthetic oligonucleotide
agatttagatgtcagcccgggtttgtcatggtag

SEQ ID NO: 208443 - DNA, 33 bp, Artificial Sequence
  Description of Artificial Sequence: Synthetic oligonucleotide
gatttagatgtcagcccgggtttgtcatggtag

SEQ ID NO: 208444 - DNA, 33 bp, Artificial Sequence
  Description of Artificial Sequence: Synthetic oligonucleotide
atttagatgtcagcccgggtttgtcatggtagg

SEQ ID NO: 208445 - DNA, 32 bp, Artificial Sequence
  Description of Artificial Sequence: Synthetic oligonucleotide
tttagatgtcagcccgggtttgtcatggtagg

SEQ ID NO: 208446 - DNA, 31 bp, Artificial Sequence
  Description of Artificial Sequence: Synthetic oligonucleotide
ttagatgtcagcccgggtttgtcatggtagg

SEQ ID NO: 208447 - DNA, 30 bp, Artificial Sequence
  Description of Artificial Sequence: Synthetic oligonucleotide
tagatgtcagcccgggtttgtcatggtagg

SEQ ID NO: 208448 - DNA, 29 bp, Artificial Sequence
  Description of Artificial Sequence: Synthetic oligonucleotide
agatgtcagcccgggtttgtcatggtagg

SEQ ID NO: 208449 - DNA, 28 bp, Artificial Sequence
  Description of Artificial Sequence: Synthetic oligonucleotide
gatgtcagcccgggtttgtcatggtagg

SEQ ID NO: 208450 - DNA, 28 bp, Artificial Sequence
  Description of Artificial Sequence: Synthetic oligonucleotide
atgtcagcccgggtttgtcatggtaggg

SEQ ID NO: 208451 - DNA, 27 bp, Artificial Sequence
  Description of Artificial Sequence: Synthetic oligonucleotide
tgtcagcccgggtttgtcatggtaggg

SEQ ID NO: 208452 - DNA, 27 bp, Artificial Sequence
  Description of Artificial Sequence: Synthetic oligonucleotide
gtcagcccgggtttgtcatggtagggt

SEQ ID NO: 208453 - DNA, 27 bp, Artificial Sequence
  Description of Artificial Sequence: Synthetic oligonucleotide
tcagcccgggtttgtcatggtagggtc

SEQ ID NO: 208454 - DNA, 26 bp, Artificial Sequence
  Description of Artificial Sequence: Synthetic oligonucleotide
cagcccgggtttgtcatggtagggtc

SEQ ID NO: 208455 - DNA, 26 bp, Artificial Sequence
  Description of Artificial Sequence: Synthetic oligonucleotide
agcccgggtttgtcatggtagggtcc

SEQ ID NO: 208456 - DNA, 25 bp, Artificial Sequence
  Description of Artificial Sequence: Synthetic oligonucleotide
gcccgggtttgtcatggtagggtcc

SEQ ID NO: 208457 - DNA, 26 bp, Artificial Sequence
  Description of Artificial Sequence: Synthetic oligonucleotide
cccgggtttgtcatggtagggtccca

SEQ ID NO: 208458 - DNA, 27 bp, Artificial Sequence
  Description of Artificial Sequence: Synthetic oligonucleotide
ccgggtttgtcatggtagggtcccaca

SEQ ID NO: 208459 - DNA, 27 bp, Artificial Sequence
  Description of Artificial Sequence: Synthetic oligonucleotide
cgggtttgtcatggtagggtcccacac

SEQ ID NO: 208460 - DNA, 28 bp, Artificial Sequence
  Description of Artificial Sequence: Synthetic oligonucleotide
gggtttgtcatggtagggtcccacactg

SEQ ID NO: 208461 - DNA, 29 bp, Artificial Sequence
  Description of Artificial Sequence: Synthetic oligonucleotide
ggtttgtcatggtagggtcccacactgtg

SEQ ID NO: 208462 - DNA, 29 bp, Artificial Sequence
  Description of Artificial Sequence: Synthetic oligonucleotide
gtttgtcatggtagggtcccacactgtgc

SEQ ID NO: 208463 - DNA, 30 bp, Artificial Sequence
  Description of Artificial Sequence: Synthetic oligonucleotide
tttgtcatggtagggtcccacactgtgcag

SEQ ID NO: 208464 - DNA, 29 bp, Artificial Sequence
  Description of Artificial Sequence: Synthetic oligonucleotide
ttgtcatggtagggtcccacactgtgcag

SEQ ID NO: 208465 - DNA, 28 bp, Artificial Sequence
  Description of Artificial Sequence: Synthetic oligonucleotide
tgtcatggtagggtcccacactgtgcag

SEQ ID NO: 208466 - DNA, 27 bp, Artificial Sequence
  Description of Artificial Sequence: Synthetic oligonucleotide
gtcatggtagggtcccacactgtgcag

SEQ ID NO: 208467 - DNA, 28 bp, Artificial Sequence
  Description of Artificial Sequence: Synthetic oligonucleotide
tcatggtagggtcccacactgtgcagtg

SEQ ID NO: 208468 - DNA, 27 bp, Artificial Sequence
  Description of Artificial Sequence: Synthetic oligonucleotide
catggtagggtcccacactgtgcagtg

SEQ ID NO: 208469 - DNA, 27 bp, Artificial Sequence
  Description of Artificial Sequence: Synthetic oligonucleotide
atggtagggtcccacactgtgcagtgc

SEQ ID NO: 208470 - DNA, 26 bp, Artificial Sequence
  Description of Artificial Sequence: Synthetic oligonucleotide
tggtagggtcccacactgtgcagtgc

SEQ ID NO: 208471 - DNA, 25 bp, Artificial Sequence
  Description of Artificial Sequence: Synthetic oligonucleotide
ggtagggtcccacactgtgcagtgc

SEQ ID NO: 208472 - DNA, 26 bp, Artificial Sequence
  Description of Artificial Sequence: Synthetic oligonucleotide
gtagggtcccacactgtgcagtgcca

SEQ ID NO: 208473 - DNA, 27 bp, Artificial Sequence
  Description of Artificial Sequence: Synthetic oligonucleotide
tagggtcccacactgtgcagtgccaga

SEQ ID NO: 208474 - DNA, 26 bp, Artificial Sequence
  Description of Artificial Sequence: Synthetic oligonucleotide
agggtcccacactgtgcagtgccaga

SEQ ID NO: 208475 - DNA, 25 bp, Artificial Sequence
  Description of Artificial Sequence: Synthetic oligonucleotide
gggtcccacactgtgcagtgccaga

SEQ ID NO: 208476 - DNA, 25 bp, Artificial Sequence
  Description of Artificial Sequence: Synthetic oligonucleotide
ggtcccacactgtgcagtgccagac

SEQ ID NO: 208477 - DNA, 27 bp, Artificial Sequence
  Description of Artificial Sequence: Synthetic oligonucleotide
gtcccacactgtgcagtgccagaccaa

SEQ ID NO: 208478 - DNA, 28 bp, Artificial Sequence
  Description of Artificial Sequence: Synthetic oligonucleotide
tcccacactgtgcagtgccagaccaatg

SEQ ID NO: 208479 - DNA, 27 bp, Artificial Sequence
  Description of Artificial Sequence: Synthetic oligonucleotide
cccacactgtgcagtgccagaccaatg

SEQ ID NO: 208480 - DNA, 27 bp, Artificial Sequence
  Description of Artificial Sequence: Synthetic oligonucleotide
ccacactgtgcagtgccagaccaatgg

SEQ ID NO: 208481 - DNA, 27 bp, Artificial Sequence
  Description of Artificial Sequence: Synthetic oligonucleotide
cacactgtgcagtgccagaccaatggc

SEQ ID NO: 208482 - DNA, 28 bp, Artificial Sequence
  Description of Artificial Sequence: Synthetic oligonucleotide
acactgtgcagtgccagaccaatggcag

SEQ ID NO: 208483 - DNA, 27 bp, Artificial Sequence
  Description of Artificial Sequence: Synthetic oligonucleotide
cactgtgcagtgccagaccaatggcag

SEQ ID NO: 208484 - DNA, 29 bp, Artificial Sequence
  Description of Artificial Sequence: Synthetic oligonucleotide
actgtgcagtgccagaccaatggcagatg

SEQ ID NO: 208485 - DNA, 28 bp, Artificial Sequence
  Description of Artificial Sequence: Synthetic oligonucleotide
ctgtgcagtgccagaccaatggcagatg

SEQ ID NO: 208486 - DNA, 28 bp, Artificial Sequence
  Description of Artificial Sequence: Synthetic oligonucleotide
tgtgcagtgccagaccaatggcagatgg

SEQ ID NO: 208487 - DNA, 27 bp, Artificial Sequence
  Description of Artificial Sequence: Synthetic oligonucleotide
gtgcagtgccagaccaatggcagatgg

SEQ ID NO: 208488 - DNA, 27 bp, Artificial Sequence
  Description of Artificial Sequence: Synthetic oligonucleotide
tgcagtgccagaccaatggcagatggg

SEQ ID NO: 208489 - DNA, 26 bp, Artificial Sequence
  Description of Artificial Sequence: Synthetic oligonucleotide
gcagtgccagaccaatggcagatggg

SEQ ID NO: 208490 - DNA, 26 bp, Artificial Sequence
  Description of Artificial Sequence: Synthetic oligonucleotide
cagtgccagaccaatggcagatgggg

SEQ ID NO: 208491 - DNA, 26 bp, Artificial Sequence
  Description of Artificial Sequence: Synthetic oligonucleotide
agtgccagaccaatggcagatggggg

SEQ ID NO: 208492 - DNA, 25 bp, Artificial Sequence
  Description of Artificial Sequence: Synthetic oligonucleotide
gtgccagaccaatggcagatggggg

SEQ ID NO: 208493 - DNA, 25 bp, Artificial Sequence
  Description of Artificial Sequence: Synthetic oligonucleotide
tgccagaccaatggcagatgggggc

SEQ ID NO: 208494 - DNA, 24 bp, Artificial Sequence
  Description of Artificial Sequence: Synthetic oligonucleotide
gccagaccaatggcagatgggggc

SEQ ID NO: 208495 - DNA, 24 bp, Artificial Sequence
  Description of Artificial Sequence: Synthetic oligonucleotide
ccagaccaatggcagatgggggcc

SEQ ID NO: 208496 - DNA, 26 bp, Artificial Sequence
  Description of Artificial Sequence: Synthetic oligonucleotide
cagaccaatggcagatgggggcccaa

SEQ ID NO: 208497 - DNA, 26 bp, Artificial Sequence
  Description of Artificial Sequence: Synthetic oligonucleotide
agaccaatggcagatgggggcccaag

SEQ ID NO: 208498 - DNA, 25 bp, Artificial Sequence
  Description of Artificial Sequence: Synthetic oligonucleotide
gaccaatggcagatgggggcccaag

SEQ ID NO: 208499 - DNA, 26 bp, Artificial Sequence
  Description of Artificial Sequence: Synthetic oligonucleotide
accaatggcagatgggggcccaagct

SEQ ID NO: 208500 - DNA, 25 bp, Artificial Sequence
  Description of Artificial Sequence: Synthetic oligonucleotide
ccaatggcagatgggggcccaagct

SEQ ID NO: 208501 - DNA, 25 bp, Artificial Sequence
  Description of Artificial Sequence: Synthetic oligonucleotide
caatggcagatgggggcccaagctg

SEQ ID NO: 208502 - DNA, 25 bp, Artificial Sequence
  Description of Artificial Sequence: Synthetic oligonucleotide
aatggcagatgggggcccaagctgc

SEQ ID NO: 208503 - DNA, 24 bp, Artificial Sequence
  Description of Artificial Sequence: Synthetic oligonucleotide
atggcagatgggggcccaagctgc

SEQ ID NO: 208504 - DNA, 23 bp, Artificial Sequence
  Description of Artificial Sequence: Synthetic oligonucleotide
tggcagatgggggcccaagctgc

SEQ ID NO: 208505 - DNA, 22 bp, Artificial Sequence
  Description of Artificial Sequence: Synthetic oligonucleotide
ggcagatgggggcccaagctgc

SEQ ID NO: 208506 - DNA, 23 bp, Artificial Sequence
  Description of Artificial Sequence: Synthetic oligonucleotide
gcagatgggggcccaagctgcca

SEQ ID NO: 208507 - DNA, 24 bp, Artificial Sequence
  Description of Artificial Sequence: Synthetic oligonucleotide
cagatgggggcccaagctgccaca

SEQ ID NO: 208508 - DNA, 25 bp, Artificial Sequence
  Description of Artificial Sequence: Synthetic oligonucleotide
agatgggggcccaagctgccacact

SEQ ID NO: 208509 - DNA, 24 bp, Artificial Sequence
  Description of Artificial Sequence: Synthetic oligonucleotide
gatgggggcccaagctgccacact

SEQ ID NO: 208510 - DNA, 24 bp, Artificial Sequence
  Description of Artificial Sequence: Synthetic oligonucleotide
atgggggcccaagctgccacactg

SEQ ID NO: 208511 - DNA, 23 bp, Artificial Sequence
  Description of Artificial Sequence: Synthetic oligonucleotide
tgggggcccaagctgccacactg

SEQ ID NO: 208512 - DNA, 22 bp, Artificial Sequence
  Description of Artificial Sequence: Synthetic oligonucleotide
gggggcccaagctgccacactg

SEQ ID NO: 208513 - DNA, 23 bp, Artificial Sequence
  Description of Artificial Sequence: Synthetic oligonucleotide
ggggcccaagctgccacactgct

SEQ ID NO: 208514 - DNA, 23 bp, Artificial Sequence
  Description of Artificial Sequence: Synthetic oligonucleotide
gggcccaagctgccacactgctc

SEQ ID NO: 208515 - DNA, 24 bp, Artificial Sequence
  Description of Artificial Sequence: Synthetic oligonucleotide
ggcccaagctgccacactgctcca

SEQ ID NO: 208516 - DNA, 24 bp, Artificial Sequence
  Description of Artificial Sequence: Synthetic oligonucleotide
gcccaagctgccacactgctccag

SEQ ID NO: 208517 - DNA, 24 bp, Artificial Sequence
  Description of Artificial Sequence: Synthetic oligonucleotide
cccaagctgccacactgctccagg

SEQ ID NO: 208518 - DNA, 25 bp, Artificial Sequence
  Description of Artificial Sequence: Synthetic oligonucleotide
ccaagctgccacactgctccagggt

SEQ ID NO: 208519 - DNA, 26 bp, Artificial Sequence
  Description of Artificial Sequence: Synthetic oligonucleotide
caagctgccacactgctccagggtgt

SEQ ID NO: 208520 - DNA, 27 bp, Artificial Sequence
  Description of Artificial Sequence: Synthetic oligonucleotide
aagctgccacactgctccagggtgtgt

SEQ ID NO: 208521 - DNA, 26 bp, Artificial Sequence
  Description of Artificial Sequence: Synthetic oligonucleotide
agctgccacactgctccagggtgtgt

SEQ ID NO: 208522 - DNA, 25 bp, Artificial Sequence
  Description of Artificial Sequence: Synthetic oligonucleotide
gctgccacactgctccagggtgtgt

SEQ ID NO: 208523 - DNA, 26 bp, Artificial Sequence
  Description of Artificial Sequence: Synthetic oligonucleotide
ctgccacactgctccagggtgtgtca

SEQ ID NO: 208524 - DNA, 26 bp, Artificial Sequence
  Description of Artificial Sequence: Synthetic oligonucleotide
tgccacactgctccagggtgtgtcag

SEQ ID NO: 208525 - DNA, 25 bp, Artificial Sequence
  Description of Artificial Sequence: Synthetic oligonucleotide
gccacactgctccagggtgtgtcag

SEQ ID NO: 208526 - DNA, 25 bp, Artificial Sequence
  Description of Artificial Sequence: Synthetic oligonucleotide
ccacactgctccagggtgtgtcagc

SEQ ID NO: 208527 - DNA, 25 bp, Artificial Sequence
  Description of Artificial Sequence: Synthetic oligonucleotide
cacactgctccagggtgtgtcagcc

SEQ ID NO: 208528 - DNA, 25 bp, Artificial Sequence
  Description of Artificial Sequence: Synthetic oligonucleotide
acactgctccagggtgtgtcagccg

SEQ ID NO: 208529 - DNA, 24 bp, Artificial Sequence
  Description of Artificial Sequence: Synthetic oligonucleotide
cactgctccagggtgtgtcagccg

SEQ ID NO: 208530 - DNA, 24 bp, Artificial Sequence
  Description of Artificial Sequence: Synthetic oligonucleotide
actgctccagggtgtgtcagccgc

SEQ ID NO: 208531 - DNA, 33 bp, Artificial Sequence
  Description of Artificial Sequence: Synthetic oligonucleotide
tccagaaatcctgcatggtgagcataccctaag

SEQ ID NO: 208532 - DNA, 32 bp, Artificial Sequence
  Description of Artificial Sequence: Synthetic oligonucleotide
ccagaaatcctgcatggtgagcataccctaag

SEQ ID NO: 208533 - DNA, 32 bp, Artificial Sequence
  Description of Artificial Sequence: Synthetic oligonucleotide
cagaaatcctgcatggtgagcataccctaagc

SEQ ID NO: 208534 - DNA, 32 bp, Artificial Sequence
  Description of Artificial Sequence: Synthetic oligonucleotide
agaaatcctgcatggtgagcataccctaagcc

SEQ ID NO: 208535 - DNA, 31 bp, Artificial Sequence
  Description of Artificial Sequence: Synthetic oligonucleotide
gaaatcctgcatggtgagcataccctaagcc

SEQ ID NO: 208536 - DNA, 33 bp, Artificial Sequence
  Description of Artificial Sequence: Synthetic oligonucleotide
aaatcctgcatggtgagcataccctaagccatc

SEQ ID NO: 208537 - DNA, 32 bp, Artificial Sequence
  Description of Artificial Sequence: Synthetic oligonucleotide
aatcctgcatggtgagcataccctaagccatc

SEQ ID NO: 208538 - DNA, 31 bp, Artificial Sequence
  Description of Artificial Sequence: Synthetic oligonucleotide
atcctgcatggtgagcataccctaagccatc

SEQ ID NO: 208539 - DNA, 30 bp, Artificial Sequence
  Description of Artificial Sequence: Synthetic oligonucleotide
tcctgcatggtgagcataccctaagccatc

SEQ ID NO: 208540 - DNA, 29 bp, Artificial Sequence
  Description of Artificial Sequence: Synthetic oligonucleotide
cctgcatggtgagcataccctaagccatc

SEQ ID NO: 208541 - DNA, 30 bp, Artificial Sequence
  Description of Artificial Sequence: Synthetic oligonucleotide
ctgcatggtgagcataccctaagccatcag

SEQ ID NO: 208542 - DNA, 30 bp, Artificial Sequence
  Description of Artificial Sequence: Synthetic oligonucleotide
tgcatggtgagcataccctaagccatcagg

SEQ ID NO: 208543 - DNA, 29 bp, Artificial Sequence
  Description of Artificial Sequence: Synthetic oligonucleotide
gcatggtgagcataccctaagccatcagg

SEQ ID NO: 208544 - DNA, 30 bp, Artificial Sequence
  Description of Artificial Sequence: Synthetic oligonucleotide
catggtgagcataccctaagccatcaggac

SEQ ID NO: 208545 - DNA, 32 bp, Artificial Sequence
  Description of Artificial Sequence: Synthetic oligonucleotide
atggtgagcataccctaagccatcaggacaac

SEQ ID NO: 208546 - DNA, 31 bp, Artificial Sequence
  Description of Artificial Sequence: Synthetic oligonucleotide
tggtgagcataccctaagccatcaggacaac

SEQ ID NO: 208547 - DNA, 30 bp, Artificial Sequence
  Description of Artificial Sequence: Synthetic oligonucleotide
ggtgagcataccctaagccatcaggacaac

SEQ ID NO: 208548 - DNA, 34 bp, Artificial Sequence
  Description of Artificial Sequence: Synthetic oligonucleotide
gtgagcataccctaagccatcaggacaacttttc

SEQ ID NO: 208549 - DNA, 35 bp, Artificial Sequence
  Description of Artificial Sequence: Synthetic oligonucleotide
tgagcataccctaagccatcaggacaacttttcac

SEQ ID NO: 208550 - DNA, 34 bp, Artificial Sequence
  Description of Artificial Sequence: Synthetic oligonucleotide
gagcataccctaagccatcaggacaacttttcac

SEQ ID NO: 208551 - DNA, 34 bp, Artificial Sequence
  Description of Artificial Sequence: Synthetic oligonucleotide
agcataccctaagccatcaggacaacttttcacc

SEQ ID NO: 208552 - DNA, 33 bp, Artificial Sequence
  Description of Artificial Sequence: Synthetic oligonucleotide
gcataccctaagccatcaggacaacttttcacc

SEQ ID NO: 208553 - DNA, 34 bp, Artificial Sequence
  Description of Artificial Sequence: Synthetic oligonucleotide
cataccctaagccatcaggacaacttttcacctg

SEQ ID NO: 208554 - DNA, 34 bp, Artificial Sequence
  Description of Artificial Sequence: Synthetic oligonucleotide
ataccctaagccatcaggacaacttttcacctgg

SEQ ID NO: 208555 - DNA, 33 bp, Artificial Sequence
  Description of Artificial Sequence: Synthetic oligonucleotide
taccctaagccatcaggacaacttttcacctgg

SEQ ID NO: 208556 - DNA, 32 bp, Artificial Sequence
  Description of Artificial Sequence: Synthetic oligonucleotide
accctaagccatcaggacaacttttcacctgg

SEQ ID NO: 208557 - DNA, 31 bp, Artificial Sequence
  Description of Artificial Sequence: Synthetic oligonucleotide
ccctaagccatcaggacaacttttcacctgg

SEQ ID NO: 208558 - DNA, 31 bp, Artificial Sequence
  Description of Artificial Sequence: Synthetic oligonucleotide
cctaagccatcaggacaacttttcacctggg

SEQ ID NO: 208559 - DNA, 31 bp, Artificial Sequence
  Description of Artificial Sequence: Synthetic oligonucleotide
ctaagccatcaggacaacttttcacctgggc

SEQ ID NO: 208560 - DNA, 32 bp, Artificial Sequence
  Description of Artificial Sequence: Synthetic oligonucleotide
taagccatcaggacaacttttcacctgggcag

SEQ ID NO: 208561 - DNA, 29 bp, Artificial Sequence
  Description of Artificial Sequence: Synthetic oligonucleotide
caggaagtgttctacagctgtgagcccag

SEQ ID NO: 208562 - DNA, 29 bp, Artificial Sequence
  Description of Artificial Sequence: Synthetic oligonucleotide
aggaagtgttctacagctgtgagcccagc

SEQ ID NO: 208563 - DNA, 28 bp, Artificial Sequence
  Description of Artificial Sequence: Synthetic oligonucleotide
ggaagtgttctacagctgtgagcccagc

SEQ ID NO: 208564 - DNA, 31 bp, Artificial Sequence
  Description of Artificial Sequence: Synthetic oligonucleotide
gaagtgttctacagctgtgagcccagctatg

SEQ ID NO: 208565 - DNA, 32 bp, Artificial Sequence
  Description of Artificial Sequence: Synthetic oligonucleotide
aagtgttctacagctgtgagcccagctatgac

SEQ ID NO: 208566 - DNA, 31 bp, Artificial Sequence
  Description of Artificial Sequence: Synthetic oligonucleotide
agtgttctacagctgtgagcccagctatgac

SEQ ID NO: 208567 - DNA, 30 bp, Artificial Sequence
  Description of Artificial Sequence: Synthetic oligonucleotide
gtgttctacagctgtgagcccagctatgac

SEQ ID NO: 208568 - DNA, 30 bp, Artificial Sequence
  Description of Artificial Sequence: Synthetic oligonucleotide
tgttctacagctgtgagcccagctatgacc

SEQ ID NO: 208569 - DNA, 29 bp, Artificial Sequence
  Description of Artificial Sequence: Synthetic oligonucleotide
gttctacagctgtgagcccagctatgacc

SEQ ID NO: 208570 - DNA, 30 bp, Artificial Sequence
  Description of Artificial Sequence: Synthetic oligonucleotide
ttctacagctgtgagcccagctatgacctc

SEQ ID NO: 208571 - DNA, 29 bp, Artificial Sequence
  Description of Artificial Sequence: Synthetic oligonucleotide
tctacagctgtgagcccagctatgacctc

SEQ ID NO: 208572 - DNA, 28 bp, Artificial Sequence
  Description of Artificial Sequence: Synthetic oligonucleotide
ctacagctgtgagcccagctatgacctc

SEQ ID NO: 208573 - DNA, 29 bp, Artificial Sequence
  Description of Artificial Sequence: Synthetic oligonucleotide
tacagctgtgagcccagctatgacctcag

SEQ ID NO: 208574 - DNA, 28 bp, Artificial Sequence
  Description of Artificial Sequence: Synthetic oligonucleotide
acagctgtgagcccagctatgacctcag

SEQ ID NO: 208575 - DNA, 27 bp, Artificial Sequence
  Description of Artificial Sequence: Synthetic oligonucleotide
cagctgtgagcccagctatgacctcag

SEQ ID NO: 208576 - DNA, 28 bp, Artificial Sequence
  Description of Artificial Sequence: Synthetic oligonucleotide
agctgtgagcccagctatgacctcagag

SEQ ID NO: 208577 - DNA, 27 bp, Artificial Sequence
  Description of Artificial Sequence: Synthetic oligonucleotide
gctgtgagcccagctatgacctcagag

SEQ ID NO: 208578 - DNA, 27 bp, Artificial Sequence
  Description of Artificial Sequence: Synthetic oligonucleotide
ctgtgagcccagctatgacctcagagg

SEQ ID NO: 208579 - DNA, 27 bp, Artificial Sequence
  Description of Artificial Sequence: Synthetic oligonucleotide
tgtgagcccagctatgacctcagaggg

SEQ ID NO: 208580 - DNA, 26 bp, Artificial Sequence
  Description of Artificial Sequence: Synthetic oligonucleotide
gtgagcccagctatgacctcagaggg

SEQ ID NO: 208581 - DNA, 26 bp, Artificial Sequence
  Description of Artificial Sequence: Synthetic oligonucleotide
tgagcccagctatgacctcagagggg

SEQ ID NO: 208582 - DNA, 25 bp, Artificial Sequence
  Description of Artificial Sequence: Synthetic oligonucleotide
gagcccagctatgacctcagagggg

SEQ ID NO: 208583 - DNA, 26 bp, Artificial Sequence
  Description of Artificial Sequence: Synthetic oligonucleotide
agcccagctatgacctcagaggggct

SEQ ID NO: 208584 - DNA, 25 bp, Artificial Sequence
  Description of Artificial Sequence: Synthetic oligonucleotide
gcccagctatgacctcagaggggct

SEQ ID NO: 208585 - DNA, 25 bp, Artificial Sequence
  Description of Artificial Sequence: Synthetic oligonucleotide
cccagctatgacctcagaggggctg

SEQ ID NO: 208586 - DNA, 25 bp, Artificial Sequence
  Description of Artificial Sequence: Synthetic oligonucleotide
ccagctatgacctcagaggggctgc

SEQ ID NO: 208587 - DNA, 26 bp, Artificial Sequence
  Description of Artificial Sequence: Synthetic oligonucleotide
cagctatgacctcagaggggctgcgt

SEQ ID NO: 208588 - DNA, 27 bp, Artificial Sequence
  Description of Artificial Sequence: Synthetic oligonucleotide
agctatgacctcagaggggctgcgtct

SEQ ID NO: 208589 - DNA, 24 bp, Artificial Sequence
  Description of Artificial Sequence: Synthetic oligonucleotide
aggggctgcgtctctgcactgcac

SEQ ID NO: 208590 - DNA, 23 bp, Artificial Sequence
  Description of Artificial Sequence: Synthetic oligonucleotide
ggggctgcgtctctgcactgcac

SEQ ID NO: 208591 - DNA, 23 bp, Artificial Sequence
  Description of Artificial Sequence: Synthetic oligonucleotide
gggctgcgtctctgcactgcacg

SEQ ID NO: 208592 - DNA, 23 bp, Artificial Sequence
  Description of Artificial Sequence: Synthetic oligonucleotide
ggctgcgtctctgcactgcacgc

SEQ ID NO: 208593 - DNA, 23 bp, Artificial Sequence
  Description of Artificial Sequence: Synthetic oligonucleotide
gctgcgtctctgcactgcacgcc

SEQ ID NO: 208594 - DNA, 23 bp, Artificial Sequence
  Description of Artificial Sequence: Synthetic oligonucleotide
ctgcgtctctgcactgcacgccc

SEQ ID NO: 208595 - DNA, 24 bp, Artificial Sequence
  Description of Artificial Sequence: Synthetic oligonucleotide
tgcgtctctgcactgcacgcccca

SEQ ID NO: 208596 - DNA, 23 bp, Artificial Sequence
  Description of Artificial Sequence: Synthetic oligonucleotide
gcgtctctgcactgcacgcccca

SEQ ID NO: 208597 - DNA, 23 bp, Artificial Sequence
  Description of Artificial Sequence: Synthetic oligonucleotide
cgtctctgcactgcacgccccag

SEQ ID NO: 208598 - DNA, 23 bp, Artificial Sequence
  Description of Artificial Sequence: Synthetic oligonucleotide
gtctctgcactgcacgccccagg

SEQ ID NO: 208599 - DNA, 24 bp, Artificial Sequence
  Description of Artificial Sequence: Synthetic oligonucleotide
tctctgcactgcacgccccaggga

SEQ ID NO: 208600 - DNA, 23 bp, Artificial Sequence
  Description of Artificial Sequence: Synthetic oligonucleotide
ctctgcactgcacgccccaggga

SEQ ID NO: 208601 - DNA, 24 bp, Artificial Sequence
  Description of Artificial Sequence: Synthetic oligonucleotide
tctgcactgcacgccccagggaga

SEQ ID NO: 208602 - DNA, 23 bp, Artificial Sequence
  Description of Artificial Sequence: Synthetic oligonucleotide
ctgcactgcacgccccagggaga

SEQ ID NO: 208603 - DNA, 24 bp, Artificial Sequence
  Description of Artificial Sequence: Synthetic oligonucleotide
tgcactgcacgccccagggagact

SEQ ID NO: 208604 - DNA, 23 bp, Artificial Sequence
  Description of Artificial Sequence: Synthetic oligonucleotide
gcactgcacgccccagggagact

SEQ ID NO: 208605 - DNA, 23 bp, Artificial Sequence
  Description of Artificial Sequence: Synthetic oligonucleotide
cactgcacgccccagggagactg

SEQ ID NO: 208606 - DNA, 24 bp, Artificial Sequence
  Description of Artificial Sequence: Synthetic oligonucleotide
actgcacgccccagggagactgga

SEQ ID NO: 208607 - DNA, 23 bp, Artificial Sequence
  Description of Artificial Sequence: Synthetic oligonucleotide
ctgcacgccccagggagactgga

SEQ ID NO: 208608 - DNA, 23 bp, Artificial Sequence
  Description of Artificial Sequence: Synthetic oligonucleotide
tgcacgccccagggagactggag

SEQ ID NO: 208609 - DNA, 22 bp, Artificial Sequence
  Description of Artificial Sequence: Synthetic oligonucleotide
gcacgccccagggagactggag

SEQ ID NO: 208610 - DNA, 22 bp, Artificial Sequence
  Description of Artificial Sequence: Synthetic oligonucleotide
cacgccccagggagactggagc

SEQ ID NO: 208611 - DNA, 22 bp, Artificial Sequence
  Description of Artificial Sequence: Synthetic oligonucleotide
acgccccagggagactggagcc

SEQ ID NO: 208612 - DNA, 21 bp, Artificial Sequence
  Description of Artificial Sequence: Synthetic oligonucleotide
cgccccagggagactggagcc

SEQ ID NO: 208613 - DNA, 22 bp, Artificial Sequence
  Description of Artificial Sequence: Synthetic oligonucleotide
gccccagggagactggagccct

SEQ ID NO: 208614 - DNA, 25 bp, Artificial Sequence
  Description of Artificial Sequence: Synthetic oligonucleotide
ggagactggagccctgaagccccta

SEQ ID NO: 208615 - DNA, 27 bp, Artificial Sequence
  Description of Artificial Sequence: Synthetic oligonucleotide
gagactggagccctgaagcccctagat

SEQ ID NO: 208616 - DNA, 27 bp, Artificial Sequence
  Description of Artificial Sequence: Synthetic oligonucleotide
agactggagccctgaagcccctagatg

SEQ ID NO: 208617 - DNA, 27 bp, Artificial Sequence
  Description of Artificial Sequence: Synthetic oligonucleotide
gactggagccctgaagcccctagatgt

SEQ ID NO: 208618 - DNA, 28 bp, Artificial Sequence
  Description of Artificial Sequence: Synthetic oligonucleotide
actggagccctgaagcccctagatgtac

SEQ ID NO: 208619 - DNA, 27 bp, Artificial Sequence
  Description of Artificial Sequence: Synthetic oligonucleotide
ctggagccctgaagcccctagatgtac

SEQ ID NO: 208620 - DNA, 28 bp, Artificial Sequence
  Description of Artificial Sequence: Synthetic oligonucleotide
tggagccctgaagcccctagatgtacag

SEQ ID NO: 208621 - DNA, 27 bp, Artificial Sequence
  Description of Artificial Sequence: Synthetic oligonucleotide
ggagccctgaagcccctagatgtacag

SEQ ID NO: 208622 - DNA, 28 bp, Artificial Sequence
  Description of Artificial Sequence: Synthetic oligonucleotide
gagccctgaagcccctagatgtacagtg

SEQ ID NO: 208623 - DNA, 32 bp, Artificial Sequence
  Description of Artificial Sequence: Synthetic oligonucleotide
agccctgaagcccctagatgtacagtgaaatc

SEQ ID NO: 208624 - DNA, 31 bp, Artificial Sequence
  Description of Artificial Sequence: Synthetic oligonucleotide
gccctgaagcccctagatgtacagtgaaatc

SEQ ID NO: 208625 - DNA, 31 bp, Artificial Sequence
  Description of Artificial Sequence: Synthetic oligonucleotide
ccctgaagcccctagatgtacagtgaaatcc

SEQ ID NO: 208626 - DNA, 32 bp, Artificial Sequence
  Description of Artificial Sequence: Synthetic oligonucleotide
cctgaagcccctagatgtacagtgaaatcctg

SEQ ID NO: 208627 - DNA, 33 bp, Artificial Sequence
  Description of Artificial Sequence: Synthetic oligonucleotide
ctgaagcccctagatgtacagtgaaatcctgtg

SEQ ID NO: 208628 - DNA, 35 bp, Artificial Sequence
  Description of Artificial Sequence: Synthetic oligonucleotide
tgaagcccctagatgtacagtgaaatcctgtgatg

SEQ ID NO: 208629 - DNA, 34 bp, Artificial Sequence
  Description of Artificial Sequence: Synthetic oligonucleotide
gaagcccctagatgtacagtgaaatcctgtgatg

SEQ ID NO: 208630 - DNA, 35 bp, Artificial Sequence
  Description of Artificial Sequence: Synthetic oligonucleotide
aagcccctagatgtacagtgaaatcctgtgatgac

SEQ ID NO: 208631 - DNA, 34 bp, Artificial Sequence
  Description of Artificial Sequence: Synthetic oligonucleotide
agcccctagatgtacagtgaaatcctgtgatgac

SEQ ID NO: 208632 - DNA, 33 bp, Artificial Sequence
  Description of Artificial Sequence: Synthetic oligonucleotide
gcccctagatgtacagtgaaatcctgtgatgac

SEQ ID NO: 208633 - DNA, 35 bp, Artificial Sequence
  Description of Artificial Sequence: Synthetic oligonucleotide
cccctagatgtacagtgaaatcctgtgatgacttc

SEQ ID NO: 208634 - DNA, 35 bp, Artificial Sequence
  Description of Artificial Sequence: Synthetic oligonucleotide
ccctagatgtacagtgaaatcctgtgatgacttcc

SEQ ID NO: 208635 - DNA, 36 bp, Artificial Sequence
  Description of Artificial Sequence: Synthetic oligonucleotide
cctagatgtacagtgaaatcctgtgatgacttcctg

SEQ ID NO: 208636 - DNA, 36 bp, Artificial Sequence
  Description of Artificial Sequence: Synthetic oligonucleotide
ctagatgtacagtgaaatcctgtgatgacttcctgg

SEQ ID NO: 208637 - DNA, 36 bp, Artificial Sequence
  Description of Artificial Sequence: Synthetic oligonucleotide
tagatgtacagtgaaatcctgtgatgacttcctggg

SEQ ID NO: 208638 - DNA, 35 bp, Artificial Sequence
  Description of Artificial Sequence: Synthetic oligonucleotide
agatgtacagtgaaatcctgtgatgacttcctggg

SEQ ID NO: 208639 - DNA, 34 bp, Artificial Sequence
  Description of Artificial Sequence: Synthetic oligonucleotide
gatgtacagtgaaatcctgtgatgacttcctggg

SEQ ID NO: 208640 - DNA, 34 bp, Artificial Sequence
  Description of Artificial Sequence: Synthetic oligonucleotide
atgtacagtgaaatcctgtgatgacttcctgggc

SEQ ID NO: 208641 - DNA, 33 bp, Artificial Sequence
  Description of Artificial Sequence: Synthetic oligonucleotide
tgtacagtgaaatcctgtgatgacttcctgggc

SEQ ID NO: 208642 - DNA, 32 bp, Artificial Sequence
  Description of Artificial Sequence: Synthetic oligonucleotide
gtacagtgaaatcctgtgatgacttcctgggc

SEQ ID NO: 208643 - DNA, 32 bp, Artificial Sequence
  Description of Artificial Sequence: Synthetic oligonucleotide
tacagtgaaatcctgtgatgacttcctgggcc

SEQ ID NO: 208644 - DNA, 31 bp, Artificial Sequence
  Description of Artificial Sequence: Synthetic oligonucleotide
acagtgaaatcctgtgatgacttcctgggcc

SEQ ID NO: 208645 - DNA, 30 bp, Artificial Sequence
  Description of Artificial Sequence: Synthetic oligonucleotide
cagtgaaatcctgtgatgacttcctgggcc

SEQ ID NO: 208646 - DNA, 32 bp, Artificial Sequence
  Description of Artificial Sequence: Synthetic oligonucleotide
agtgaaatcctgtgatgacttcctgggccaac

SEQ ID NO: 208647 - DNA, 31 bp, Artificial Sequence
  Description of Artificial Sequence: Synthetic oligonucleotide
gtgaaatcctgtgatgacttcctgggccaac

SEQ ID NO: 208648 - DNA, 32 bp, Artificial Sequence
  Description of Artificial Sequence: Synthetic oligonucleotide
tgaaatcctgtgatgacttcctgggccaactc

SEQ ID NO: 208649 - DNA, 31 bp, Artificial Sequence
  Description of Artificial Sequence: Synthetic oligonucleotide
gaaatcctgtgatgacttcctgggccaactc

SEQ ID NO: 208650 - DNA, 31 bp, Artificial Sequence
  Description of Artificial Sequence: Synthetic oligonucleotide
aaatcctgtgatgacttcctgggccaactcc

SEQ ID NO: 208651 - DNA, 30 bp, Artificial Sequence
  Description of Artificial Sequence: Synthetic oligonucleotide
aatcctgtgatgacttcctgggccaactcc

SEQ ID NO: 208652 - DNA, 29 bp, Artificial Sequence
  Description of Artificial Sequence: Synthetic oligonucleotide
atcctgtgatgacttcctgggccaactcc

SEQ ID NO: 208653 - DNA, 28 bp, Artificial Sequence
  Description of Artificial Sequence: Synthetic oligonucleotide
tcctgtgatgacttcctgggccaactcc

SEQ ID NO: 208654 - DNA, 27 bp, Artificial Sequence
  Description of Artificial Sequence: Synthetic oligonucleotide
cctgtgatgacttcctgggccaactcc

SEQ ID NO: 208655 - DNA, 27 bp, Artificial Sequence
  Description of Artificial Sequence: Synthetic oligonucleotide
ctgtgatgacttcctgggccaactccc

SEQ ID NO: 208656 - DNA, 28 bp, Artificial Sequence
  Description of Artificial Sequence: Synthetic oligonucleotide
tgtgatgacttcctgggccaactccctc

SEQ ID NO: 208657 - DNA, 27 bp, Artificial Sequence
  Description of Artificial Sequence: Synthetic oligonucleotide
gtgatgacttcctgggccaactccctc

SEQ ID NO: 208658 - DNA, 29 bp, Artificial Sequence
  Description of Artificial Sequence: Synthetic oligonucleotide
tgatgacttcctgggccaactccctcatg

SEQ ID NO: 208659 - DNA, 28 bp, Artificial Sequence
  Description of Artificial Sequence: Synthetic oligonucleotide
gatgacttcctgggccaactccctcatg

SEQ ID NO: 208660 - DNA, 28 bp, Artificial Sequence
  Description of Artificial Sequence: Synthetic oligonucleotide
atgacttcctgggccaactccctcatgg

SEQ ID NO: 208661 - DNA, 27 bp, Artificial Sequence
  Description of Artificial Sequence: Synthetic oligonucleotide
tgacttcctgggccaactccctcatgg

SEQ ID NO: 208662 - DNA, 26 bp, Artificial Sequence
  Description of Artificial Sequence: Synthetic oligonucleotide
gacttcctgggccaactccctcatgg

SEQ ID NO: 208663 - DNA, 26 bp, Artificial Sequence
  Description of Artificial Sequence: Synthetic oligonucleotide
acttcctgggccaactccctcatggc

SEQ ID NO: 208664 - DNA, 25 bp, Artificial Sequence
  Description of Artificial Sequence: Synthetic oligonucleotide
cttcctgggccaactccctcatggc

SEQ ID NO: 208665 - DNA, 25 bp, Artificial Sequence
  Description of Artificial Sequence: Synthetic oligonucleotide
ttcctgggccaactccctcatggcc

SEQ ID NO: 208666 - DNA, 24 bp, Artificial Sequence
  Description of Artificial Sequence: Synthetic oligonucleotide
tcctgggccaactccctcatggcc

SEQ ID NO: 208667 - DNA, 23 bp, Artificial Sequence
  Description of Artificial Sequence: Synthetic oligonucleotide
cctgggccaactccctcatggcc

SEQ ID NO: 208668 - DNA, 24 bp, Artificial Sequence
  Description of Artificial Sequence: Synthetic oligonucleotide
ctgggccaactccctcatggccgt

SEQ ID NO: 208669 - DNA, 25 bp, Artificial Sequence
  Description of Artificial Sequence: Synthetic oligonucleotide
tgggccaactccctcatggccgtgt

SEQ ID NO: 208670 - DNA, 24 bp, Artificial Sequence
  Description of Artificial Sequence: Synthetic oligonucleotide
gggccaactccctcatggccgtgt

SEQ ID NO: 208671 - DNA, 24 bp, Artificial Sequence
  Description of Artificial Sequence: Synthetic oligonucleotide
ggccaactccctcatggccgtgtg

SEQ ID NO: 208672 - DNA, 26 bp, Artificial Sequence
  Description of Artificial Sequence: Synthetic oligonucleotide
gccaactccctcatggccgtgtgcta

SEQ ID NO: 208673 - DNA, 27 bp, Artificial Sequence
  Description of Artificial Sequence: Synthetic oligonucleotide
ccaactccctcatggccgtgtgctact

SEQ ID NO: 208674 - DNA, 28 bp, Artificial Sequence
  Description of Artificial Sequence: Synthetic oligonucleotide
caactccctcatggccgtgtgctacttc

SEQ ID NO: 208675 - DNA, 28 bp, Artificial Sequence
  Description of Artificial Sequence: Synthetic oligonucleotide
aactccctcatggccgtgtgctacttcc

SEQ ID NO: 208676 - DNA, 27 bp, Artificial Sequence
  Description of Artificial Sequence: Synthetic oligonucleotide
actccctcatggccgtgtgctacttcc

SEQ ID NO: 208677 - DNA, 27 bp, Artificial Sequence
  Description of Artificial Sequence: Synthetic oligonucleotide
ctccctcatggccgtgtgctacttcca

SEQ ID NO: 208678 - DNA, 27 bp, Artificial Sequence
  Description of Artificial Sequence: Synthetic oligonucleotide
tccctcatggccgtgtgctacttccac

SEQ ID NO: 208679 - DNA, 27 bp, Artificial Sequence
  Description of Artificial Sequence: Synthetic oligonucleotide
ccctcatggccgtgtgctacttccact

SEQ ID NO: 208680 - DNA, 31 bp, Artificial Sequence
  Description of Artificial Sequence: Synthetic oligonucleotide
cctcatggccgtgtgctacttccacttaatc

SEQ ID NO: 208681 - DNA, 32 bp, Artificial Sequence
  Description of Artificial Sequence: Synthetic oligonucleotide
ctcatggccgtgtgctacttccacttaatctc

SEQ ID NO: 208682 - DNA, 32 bp, Artificial Sequence
  Description of Artificial Sequence: Synthetic oligonucleotide
tcatggccgtgtgctacttccacttaatctcc

SEQ ID NO: 208683 - DNA, 31 bp, Artificial Sequence
  Description of Artificial Sequence: Synthetic oligonucleotide
catggccgtgtgctacttccacttaatctcc

SEQ ID NO: 208684 - DNA, 32 bp, Artificial Sequence
  Description of Artificial Sequence: Synthetic oligonucleotide
atggccgtgtgctacttccacttaatctccag

SEQ ID NO: 208685 - DNA, 31 bp, Artificial Sequence
  Description of Artificial Sequence: Synthetic oligonucleotide
tggccgtgtgctacttccacttaatctccag

SEQ ID NO: 208686 - DNA, 30 bp, Artificial Sequence
  Description of Artificial Sequence: Synthetic oligonucleotide
ggccgtgtgctacttccacttaatctccag

SEQ ID NO: 208687 - DNA, 30 bp, Artificial Sequence
  Description of Artificial Sequence: Synthetic oligonucleotide
gccgtgtgctacttccacttaatctccagc

SEQ ID NO: 208688 - DNA, 32 bp, Artificial Sequence
  Description of Artificial Sequence: Synthetic oligonucleotide
ccgtgtgctacttccacttaatctccagcttg

SEQ ID NO: 208689 - DNA, 32 bp, Artificial Sequence
  Description of Artificial Sequence: Synthetic oligonucleotide
cgtgtgctacttccacttaatctccagcttgg

SEQ ID NO: 208690 - DNA, 32 bp, Artificial Sequence
  Description of Artificial Sequence: Synthetic oligonucleotide
gtgtgctacttccacttaatctccagcttggg

SEQ ID NO: 208691 - DNA, 32 bp, Artificial Sequence
  Description of Artificial Sequence: Synthetic oligonucleotide
tgtgctacttccacttaatctccagcttgggg

SEQ ID NO: 208692 - DNA, 31 bp, Artificial Sequence
  Description of Artificial Sequence: Synthetic oligonucleotide
gtgctacttccacttaatctccagcttgggg

SEQ ID NO: 208693 - DNA, 31 bp, Artificial Sequence
  Description of Artificial Sequence: Synthetic oligonucleotide
tgctacttccacttaatctccagcttggggc

SEQ ID NO: 208694 - DNA, 30 bp, Artificial Sequence
  Description of Artificial Sequence: Synthetic oligonucleotide
gctacttccacttaatctccagcttggggc

SEQ ID NO: 208695 - DNA, 33 bp, Artificial Sequence
  Description of Artificial Sequence: Synthetic oligonucleotide
ctacttccacttaatctccagcttggggcaaag

SEQ ID NO: 208696 - DNA, 33 bp, Artificial Sequence
  Description of Artificial Sequence: Synthetic oligonucleotide
tacttccacttaatctccagcttggggcaaagg

SEQ ID NO: 208697 - DNA, 32 bp, Artificial Sequence
  Description of Artificial Sequence: Synthetic oligonucleotide
acttccacttaatctccagcttggggcaaagg

SEQ ID NO: 208698 - DNA, 31 bp, Artificial Sequence
  Description of Artificial Sequence: Synthetic oligonucleotide
cttccacttaatctccagcttggggcaaagg

SEQ ID NO: 208699 - DNA, 31 bp, Artificial Sequence
  Description of Artificial Sequence: Synthetic oligonucleotide
tccagcttggggcaaaggtgtcctttgtttg

SEQ ID NO: 208700 - DNA, 30 bp, Artificial Sequence
  Description of Artificial Sequence: Synthetic oligonucleotide
ccagcttggggcaaaggtgtcctttgtttg

SEQ ID NO: 208701 - DNA, 30 bp, Artificial Sequence
  Description of Artificial Sequence: Synthetic oligonucleotide
cagcttggggcaaaggtgtcctttgtttgc

SEQ ID NO: 208702 - DNA, 30 bp, Artificial Sequence
  Description of Artificial Sequence: Synthetic oligonucleotide
agcttggggcaaaggtgtcctttgtttgcg

SEQ ID NO: 208703 - DNA, 29 bp, Artificial Sequence
  Description of Artificial Sequence: Synthetic oligonucleotide
gcttggggcaaaggtgtcctttgtttgcg

SEQ ID NO: 208704 - DNA, 31 bp, Artificial Sequence
  Description of Artificial Sequence: Synthetic oligonucleotide
cttggggcaaaggtgtcctttgtttgcgatg

SEQ ID NO: 208705 - DNA, 33 bp, Artificial Sequence
  Description of Artificial Sequence: Synthetic oligonucleotide
ttggggcaaaggtgtcctttgtttgcgatgaag

SEQ ID NO: 208706 - DNA, 32 bp, Artificial Sequence
  Description of Artificial Sequence: Synthetic oligonucleotide
tggggcaaaggtgtcctttgtttgcgatgaag

SEQ ID NO: 208707 - DNA, 31 bp, Artificial Sequence
  Description of Artificial Sequence: Synthetic oligonucleotide
ggggcaaaggtgtcctttgtttgcgatgaag

SEQ ID NO: 208708 - DNA, 31 bp, Artificial Sequence
  Description of Artificial Sequence: Synthetic oligonucleotide
gggcaaaggtgtcctttgtttgcgatgaagg

SEQ ID NO: 208709 - DNA, 31 bp, Artificial Sequence
  Description of Artificial Sequence: Synthetic oligonucleotide
ggcaaaggtgtcctttgtttgcgatgaaggg

SEQ ID NO: 208710 - DNA, 33 bp, Artificial Sequence
  Description of Artificial Sequence: Synthetic oligonucleotide
gcaaaggtgtcctttgtttgcgatgaagggttc

SEQ ID NO: 208711 - DNA, 33 bp, Artificial Sequence
  Description of Artificial Sequence: Synthetic oligonucleotide
caaaggtgtcctttgtttgcgatgaagggttcc

SEQ ID NO: 208712 - DNA, 33 bp, Artificial Sequence
  Description of Artificial Sequence: Synthetic oligonucleotide
aaaggtgtcctttgtttgcgatgaagggttccg

SEQ ID NO: 208713 - DNA, 32 bp, Artificial Sequence
  Description of Artificial Sequence: Synthetic oligonucleotide
aaggtgtcctttgtttgcgatgaagggttccg

SEQ ID NO: 208714 - DNA, 31 bp, Artificial Sequence
  Description of Artificial Sequence: Synthetic oligonucleotide
aggtgtcctttgtttgcgatgaagggttccg

SEQ ID NO: 208715 - DNA, 30 bp, Artificial Sequence
  Description of Artificial Sequence: Synthetic oligonucleotide
ggtgtcctttgtttgcgatgaagggttccg

SEQ ID NO: 208716 - DNA, 37 bp, Artificial Sequence
  Description of Artificial Sequence: Synthetic oligonucleotide
gtgtcctttgtttgcgatgaagggttccgattaaaag

SEQ ID NO: 208717 - DNA, 37 bp, Artificial Sequence
  Description of Artificial Sequence: Synthetic oligonucleotide
tgtcctttgtttgcgatgaagggttccgattaaaagg

SEQ ID NO: 208718 - DNA, 36 bp, Artificial Sequence
  Description of Artificial Sequence: Synthetic oligonucleotide
gtcctttgtttgcgatgaagggttccgattaaaagg

SEQ ID NO: 208719 - DNA, 36 bp, Artificial Sequence
  Description of Artificial Sequence: Synthetic oligonucleotide
tcctttgtttgcgatgaagggttccgattaaaaggc

SEQ ID NO: 208720 - DNA, 35 bp, Artificial Sequence
  Description of Artificial Sequence: Synthetic oligonucleotide
cctttgtttgcgatgaagggttccgattaaaaggc

SEQ ID NO: 208721 - DNA, 36 bp, Artificial Sequence
  Description of Artificial Sequence: Synthetic oligonucleotide
ctttgtttgcgatgaagggttccgattaaaaggcag

SEQ ID NO: 208722 - DNA, 36 bp, Artificial Sequence
  Description of Artificial Sequence: Synthetic oligonucleotide
tttgtttgcgatgaagggttccgattaaaaggcagg

SEQ ID NO: 208723 - DNA, 35 bp, Artificial Sequence
  Description of Artificial Sequence: Synthetic oligonucleotide
ttgtttgcgatgaagggttccgattaaaaggcagg

SEQ ID NO: 208724 - DNA, 34 bp, Artificial Sequence
  Description of Artificial Sequence: Synthetic oligonucleotide
tgtttgcgatgaagggttccgattaaaaggcagg

SEQ ID NO: 208725 - DNA, 33 bp, Artificial Sequence
  Description of Artificial Sequence: Synthetic oligonucleotide
gtttgcgatgaagggttccgattaaaaggcagg

SEQ ID NO: 208726 - DNA, 34 bp, Artificial Sequence
  Description of Artificial Sequence: Synthetic oligonucleotide
tttgcgatgaagggttccgattaaaaggcaggtc

SEQ ID NO: 208727 - DNA, 33 bp, Artificial Sequence
  Description of Artificial Sequence: Synthetic oligonucleotide
ttgcgatgaagggttccgattaaaaggcaggtc

SEQ ID NO: 208728 - DNA, 32 bp, Artificial Sequence
  Description of Artificial Sequence: Synthetic oligonucleotide
tgcgatgaagggttccgattaaaaggcaggtc

SEQ ID NO: 208729 - DNA, 31 bp, Artificial Sequence
  Description of Artificial Sequence: Synthetic oligonucleotide
gcgatgaagggttccgattaaaaggcaggtc

SEQ ID NO: 208730 - DNA, 32 bp, Artificial Sequence
  Description of Artificial Sequence: Synthetic oligonucleotide
cgatgaagggttccgattaaaaggcaggtctg

SEQ ID NO: 208731 - DNA, 32 bp, Artificial Sequence
  Description of Artificial Sequence: Synthetic oligonucleotide
gatgaagggttccgattaaaaggcaggtctgc

SEQ ID NO: 208732 - DNA, 34 bp, Artificial Sequence
  Description of Artificial Sequence: Synthetic oligonucleotide
atgaagggttccgattaaaaggcaggtctgctag

SEQ ID NO: 208733 - DNA, 33 bp, Artificial Sequence
  Description of Artificial Sequence: Synthetic oligonucleotide
tgaagggttccgattaaaaggcaggtctgctag

SEQ ID NO: 208734 - DNA, 32 bp, Artificial Sequence
  Description of Artificial Sequence: Synthetic oligonucleotide
gaagggttccgattaaaaggcaggtctgctag

SEQ ID NO: 208735 - DNA, 33 bp, Artificial Sequence
  Description of Artificial Sequence: Synthetic oligonucleotide
aagggttccgattaaaaggcaggtctgctagtc

SEQ ID NO: 208736 - DNA, 32 bp, Artificial Sequence
  Description of Artificial Sequence: Synthetic oligonucleotide
agggttccgattaaaaggcaggtctgctagtc

SEQ ID NO: 208737 - DNA, 31 bp, Artificial Sequence
  Description of Artificial Sequence: Synthetic oligonucleotide
gggttccgattaaaaggcaggtctgctagtc

SEQ ID NO: 208738 - DNA, 34 bp, Artificial Sequence
  Description of Artificial Sequence: Synthetic oligonucleotide
ggttccgattaaaaggcaggtctgctagtcattg

SEQ ID NO: 208739 - DNA, 35 bp, Artificial Sequence
  Description of Artificial Sequence: Synthetic oligonucleotide
gttccgattaaaaggcaggtctgctagtcattgtg

SEQ ID NO: 208740 - DNA, 36 bp, Artificial Sequence
  Description of Artificial Sequence: Synthetic oligonucleotide
ttccgattaaaaggcaggtctgctagtcattgtgtc

SEQ ID NO: 208741 - DNA, 35 bp, Artificial Sequence
  Description of Artificial Sequence: Synthetic oligonucleotide
tccgattaaaaggcaggtctgctagtcattgtgtc

SEQ ID NO: 208742 - DNA, 34 bp, Artificial Sequence
  Description of Artificial Sequence: Synthetic oligonucleotide
ccgattaaaaggcaggtctgctagtcattgtgtc

SEQ ID NO: 208743 - DNA, 36 bp, Artificial Sequence
  Description of Artificial Sequence: Synthetic oligonucleotide
cgattaaaaggcaggtctgctagtcattgtgtcttg

SEQ ID NO: 208744 - DNA, 36 bp, Artificial Sequence
  Description of Artificial Sequence: Synthetic oligonucleotide
gattaaaaggcaggtctgctagtcattgtgtcttgg

SEQ ID NO: 208745 - DNA, 36 bp, Artificial Sequence
  Description of Artificial Sequence: Synthetic oligonucleotide
attaaaaggcaggtctgctagtcattgtgtcttggc

SEQ ID NO: 208746 - DNA, 35 bp, Artificial Sequence
  Description of Artificial Sequence: Synthetic oligonucleotide
ttaaaaggcaggtctgctagtcattgtgtcttggc

SEQ ID NO: 208747 - DNA, 34 bp, Artificial Sequence
  Description of Artificial Sequence: Synthetic oligonucleotide
taaaaggcaggtctgctagtcattgtgtcttggc

SEQ ID NO: 208748 - DNA, 33 bp, Artificial Sequence
  Description of Artificial Sequence: Synthetic oligonucleotide
aaaaggcaggtctgctagtcattgtgtcttggc

SEQ ID NO: 208749 - DNA, 32 bp, Artificial Sequence
  Description of Artificial Sequence: Synthetic oligonucleotide
aaaggcaggtctgctagtcattgtgtcttggc

SEQ ID NO: 208750 - DNA, 31 bp, Artificial Sequence
  Description of Artificial Sequence: Synthetic oligonucleotide
aaggcaggtctgctagtcattgtgtcttggc

SEQ ID NO: 208751 - DNA, 30 bp, Artificial Sequence
  Description of Artificial Sequence: Synthetic oligonucleotide
aggcaggtctgctagtcattgtgtcttggc

SEQ ID NO: 208752 - DNA, 29 bp, Artificial Sequence
  Description of Artificial Sequence: Synthetic oligonucleotide
ggcaggtctgctagtcattgtgtcttggc

SEQ ID NO: 208753 - DNA, 30 bp, Artificial Sequence
  Description of Artificial Sequence: Synthetic oligonucleotide
gcaggtctgctagtcattgtgtcttggctg

SEQ ID NO: 208754 - DNA, 30 bp, Artificial Sequence
  Description of Artificial Sequence: Synthetic oligonucleotide
caggtctgctagtcattgtgtcttggctgg

SEQ ID NO: 208755 - DNA, 33 bp, Artificial Sequence
  Description of Artificial Sequence: Synthetic oligonucleotide
aggtctgctagtcattgtgtcttggctggaatg

SEQ ID NO: 208756 - DNA, 32 bp, Artificial Sequence
  Description of Artificial Sequence: Synthetic oligonucleotide
ggtctgctagtcattgtgtcttggctggaatg

SEQ ID NO: 208757 - DNA, 35 bp, Artificial Sequence
  Description of Artificial Sequence: Synthetic oligonucleotide
gtctgctagtcattgtgtcttggctggaatgaaag

SEQ ID NO: 208758 - DNA, 35 bp, Artificial Sequence
  Description of Artificial Sequence: Synthetic oligonucleotide
tctgctagtcattgtgtcttggctggaatgaaagc

SEQ ID NO: 208759 - DNA, 34 bp, Artificial Sequence
  Description of Artificial Sequence: Synthetic oligonucleotide
ctgctagtcattgtgtcttggctggaatgaaagc

SEQ ID NO: 208760 - DNA, 34 bp, Artificial Sequence
  Description of Artificial Sequence: Synthetic oligonucleotide
tgctagtcattgtgtcttggctggaatgaaagcc

SEQ ID NO: 208761 - DNA, 33 bp, Artificial Sequence
  Description of Artificial Sequence: Synthetic oligonucleotide
gctagtcattgtgtcttggctggaatgaaagcc

SEQ ID NO: 208762 - DNA, 33 bp, Artificial Sequence
  Description of Artificial Sequence: Synthetic oligonucleotide
ctagtcattgtgtcttggctggaatgaaagccc

SEQ ID NO: 208763 - DNA, 36 bp, Artificial Sequence
  Description of Artificial Sequence: Synthetic oligonucleotide
tagtcattgtgtcttggctggaatgaaagccctttg

SEQ ID NO: 208764 - DNA, 35 bp, Artificial Sequence
  Description of Artificial Sequence: Synthetic oligonucleotide
agtcattgtgtcttggctggaatgaaagccctttg

SEQ ID NO: 208765 - DNA, 34 bp, Artificial Sequence
  Description of Artificial Sequence: Synthetic oligonucleotide
gtcattgtgtcttggctggaatgaaagccctttg

SEQ ID NO: 208766 - DNA, 34 bp, Artificial Sequence
  Description of Artificial Sequence: Synthetic oligonucleotide
tcattgtgtcttggctggaatgaaagccctttgg

SEQ ID NO: 208767 - DNA, 33 bp, Artificial Sequence
  Description of Artificial Sequence: Synthetic oligonucleotide
cattgtgtcttggctggaatgaaagccctttgg

SEQ ID NO: 208768 - DNA, 37 bp, Artificial Sequence
  Description of Artificial Sequence: Synthetic oligonucleotide
attgtgtcttggctggaatgaaagccctttggaatag

SEQ ID NO: 208769 - DNA, 36 bp, Artificial Sequence
  Description of Artificial Sequence: Synthetic oligonucleotide
ttgtgtcttggctggaatgaaagccctttggaatag

SEQ ID NO: 208770 - DNA, 35 bp, Artificial Sequence
  Description of Artificial Sequence: Synthetic oligonucleotide
tgtgtcttggctggaatgaaagccctttggaatag

SEQ ID NO: 208771 - DNA, 34 bp, Artificial Sequence
  Description of Artificial Sequence: Synthetic oligonucleotide
gtgtcttggctggaatgaaagccctttggaatag

SEQ ID NO: 208772 - DNA, 34 bp, Artificial Sequence
  Description of Artificial Sequence: Synthetic oligonucleotide
tgtcttggctggaatgaaagccctttggaatagc

SEQ ID NO: 208773 - DNA, 33 bp, Artificial Sequence
  Description of Artificial Sequence: Synthetic oligonucleotide
gtcttggctggaatgaaagccctttggaatagc

SEQ ID NO: 208774 - DNA, 34 bp, Artificial Sequence
  Description of Artificial Sequence: Synthetic oligonucleotide
tcttggctggaatgaaagccctttggaatagcag

SEQ ID NO: 208775 - DNA, 33 bp, Artificial Sequence
  Description of Artificial Sequence: Synthetic oligonucleotide
cttggctggaatgaaagccctttggaatagcag

SEQ ID NO: 208776 - DNA, 34 bp, Artificial Sequence
  Description of Artificial Sequence: Synthetic oligonucleotide
ttggctggaatgaaagccctttggaatagcagtg

SEQ ID NO: 208777 - DNA, 33 bp, Artificial Sequence
  Description of Artificial Sequence: Synthetic oligonucleotide
tggctggaatgaaagccctttggaatagcagtg

SEQ ID NO: 208778 - DNA, 32 bp, Artificial Sequence
  Description of Artificial Sequence: Synthetic oligonucleotide
ggctggaatgaaagccctttggaatagcagtg

SEQ ID NO: 208779 - DNA, 34 bp, Artificial Sequence
  Description of Artificial Sequence: Synthetic oligonucleotide
gctggaatgaaagccctttggaatagcagtgttc

SEQ ID NO: 208780 - DNA, 34 bp, Artificial Sequence
  Description of Artificial Sequence: Synthetic oligonucleotide
ctggaatgaaagccctttggaatagcagtgttcc

SEQ ID NO: 208781 - DNA, 35 bp, Artificial Sequence
  Description of Artificial Sequence: Synthetic oligonucleotide
tggaatgaaagccctttggaatagcagtgttccag

SEQ ID NO: 208782 - DNA, 34 bp, Artificial Sequence
  Description of Artificial Sequence: Synthetic oligonucleotide
ggaatgaaagccctttggaatagcagtgttccag

SEQ ID NO: 208783 - DNA, 35 bp, Artificial Sequence
  Description of Artificial Sequence: Synthetic oligonucleotide
gaatgaaagccctttggaatagcagtgttccagtg

SEQ ID NO: 208784 - DNA, 36 bp, Artificial Sequence
  Description of Artificial Sequence: Synthetic oligonucleotide
aatgaaagccctttggaatagcagtgttccagtgtg

SEQ ID NO: 208785 - DNA, 35 bp, Artificial Sequence
  Description of Artificial Sequence: Synthetic oligonucleotide
atgaaagccctttggaatagcagtgttccagtgtg

SEQ ID NO: 208786 - DNA, 34 bp, Artificial Sequence
  Description of Artificial Sequence: Synthetic oligonucleotide
tgaaagccctttggaatagcagtgttccagtgtg

SEQ ID NO: 208787 - DNA, 33 bp, Artificial Sequence
  Description of Artificial Sequence: Synthetic oligonucleotide
gaaagccctttggaatagcagtgttccagtgtg

SEQ ID NO: 208788 - DNA, 34 bp, Artificial Sequence
  Description of Artificial Sequence: Synthetic oligonucleotide
aaagccctttggaatagcagtgttccagtgtgtg

SEQ ID NO: 208789 - DNA, 33 bp, Artificial Sequence
  Description of Artificial Sequence: Synthetic oligonucleotide
aagccctttggaatagcagtgttccagtgtgtg

SEQ ID NO: 208790 - DNA, 32 bp, Artificial Sequence
  Description of Artificial Sequence: Synthetic oligonucleotide
agccctttggaatagcagtgttccagtgtgtg

SEQ ID NO: 208791 - DNA, 31 bp, Artificial Sequence
  Description of Artificial Sequence: Synthetic oligonucleotide
gccctttggaatagcagtgttccagtgtgtg

SEQ ID NO: 208792 - DNA, 33 bp, Artificial Sequence
  Description of Artificial Sequence: Synthetic oligonucleotide
ccctttggaatagcagtgttccagtgtgtgaac

SEQ ID NO: 208793 - DNA, 43 bp, Artificial Sequence
  Description of Artificial Sequence: Synthetic oligonucleotide
aatagcagtgttccagtgtgtgaacaaatcttttgtccaaatc

SEQ ID NO: 208794 - DNA, 42 bp, Artificial Sequence
  Description of Artificial Sequence: Synthetic oligonucleotide
atagcagtgttccagtgtgtgaacaaatcttttgtccaaatc

SEQ ID NO: 208795 - DNA, 41 bp, Artificial Sequence
  Description of Artificial Sequence: Synthetic oligonucleotide
tagcagtgttccagtgtgtgaacaaatcttttgtccaaatc

SEQ ID NO: 208796 - DNA, 40 bp, Artificial Sequence
  Description of Artificial Sequence: Synthetic oligonucleotide
agcagtgttccagtgtgtgaacaaatcttttgtccaaatc

SEQ ID NO: 208797 - DNA, 39 bp, Artificial Sequence
  Description of Artificial Sequence: Synthetic oligonucleotide
gcagtgttccagtgtgtgaacaaatcttttgtccaaatc

SEQ ID NO: 208798 - DNA, 39 bp, Artificial Sequence
  Description of Artificial Sequence: Synthetic oligonucleotide
cagtgttccagtgtgtgaacaaatcttttgtccaaatcc

SEQ ID NO: 208799 - DNA, 40 bp, Artificial Sequence
  Description of Artificial Sequence: Synthetic oligonucleotide
agtgttccagtgtgtgaacaaatcttttgtccaaatcctc

SEQ ID NO: 208800 - DNA, 39 bp, Artificial Sequence
  Description of Artificial Sequence: Synthetic oligonucleotide
gtgttccagtgtgtgaacaaatcttttgtccaaatcctc

SEQ ID NO: 208801 - DNA, 39 bp, Artificial Sequence
  Description of Artificial Sequence: Synthetic oligonucleotide
tgttccagtgtgtgaacaaatcttttgtccaaatcctcc

SEQ ID NO: 208802 - DNA, 38 bp, Artificial Sequence
  Description of Artificial Sequence: Synthetic oligonucleotide
gttccagtgtgtgaacaaatcttttgtccaaatcctcc

SEQ ID NO: 208803 - DNA, 39 bp, Artificial Sequence
  Description of Artificial Sequence: Synthetic oligonucleotide
ttccagtgtgtgaacaaatcttttgtccaaatcctccag

SEQ ID NO: 208804 - DNA, 38 bp, Artificial Sequence
  Description of Artificial Sequence: Synthetic oligonucleotide
tccagtgtgtgaacaaatcttttgtccaaatcctccag

SEQ ID NO: 208805 - DNA, 37 bp, Artificial Sequence
  Description of Artificial Sequence: Synthetic oligonucleotide
ccagtgtgtgaacaaatcttttgtccaaatcctccag

SEQ ID NO: 208806 - DNA, 37 bp, Artificial Sequence
  Description of Artificial Sequence: Synthetic oligonucleotide
cagtgtgtgaacaaatcttttgtccaaatcctccagc

SEQ ID NO: 208807 - DNA, 40 bp, Artificial Sequence
  Description of Artificial Sequence: Synthetic oligonucleotide
agtgtgtgaacaaatcttttgtccaaatcctccagctatc

SEQ ID NO: 208808 - DNA, 39 bp, Artificial Sequence
  Description of Artificial Sequence: Synthetic oligonucleotide
gtgtgtgaacaaatcttttgtccaaatcctccagctatc

SEQ ID NO: 208809 - DNA, 39 bp, Artificial Sequence
  Description of Artificial Sequence: Synthetic oligonucleotide
tgtgtgaacaaatcttttgtccaaatcctccagctatcc

SEQ ID NO: 208810 - DNA, 38 bp, Artificial Sequence
  Description of Artificial Sequence: Synthetic oligonucleotide
gtgtgaacaaatcttttgtccaaatcctccagctatcc

SEQ ID NO: 208811 - DNA, 43 bp, Artificial Sequence
  Description of Artificial Sequence: Synthetic oligonucleotide
tgtgaacaaatcttttgtccaaatcctccagctatccttaatg

SEQ ID NO: 208812 - DNA, 42 bp, Artificial Sequence
  Description of Artificial Sequence: Synthetic oligonucleotide
gtgaacaaatcttttgtccaaatcctccagctatccttaatg

SEQ ID NO: 208813 - DNA, 42 bp, Artificial Sequence
  Description of Artificial Sequence: Synthetic oligonucleotide
tgaacaaatcttttgtccaaatcctccagctatccttaatgg

SEQ ID NO: 208814 - DNA, 41 bp, Artificial Sequence
  Description of Artificial Sequence: Synthetic oligonucleotide
gaacaaatcttttgtccaaatcctccagctatccttaatgg

SEQ ID NO: 208815 - DNA, 41 bp, Artificial Sequence
  Description of Artificial Sequence: Synthetic oligonucleotide
aacaaatcttttgtccaaatcctccagctatccttaatggg

SEQ ID NO: 208816 - DNA, 40 bp, Artificial Sequence
  Description of Artificial Sequence: Synthetic oligonucleotide
acaaatcttttgtccaaatcctccagctatccttaatggg

SEQ ID NO: 208817 - DNA, 39 bp, Artificial Sequence
  Description of Artificial Sequence: Synthetic oligonucleotide
caaatcttttgtccaaatcctccagctatccttaatggg

SEQ ID NO: 208818 - DNA, 40 bp, Artificial Sequence
  Description of Artificial Sequence: Synthetic oligonucleotide
aaatcttttgtccaaatcctccagctatccttaatgggag

SEQ ID NO: 208819 - DNA, 39 bp, Artificial Sequence
  Description of Artificial Sequence: Synthetic oligonucleotide
aatcttttgtccaaatcctccagctatccttaatgggag

SEQ ID NO: 208820 - DNA, 35 bp, Artificial Sequence
  Description of Artificial Sequence: Synthetic oligonucleotide
tatccttaatgggagacacacaggaactccctttg

SEQ ID NO: 208821 - DNA, 34 bp, Artificial Sequence
  Description of Artificial Sequence: Synthetic oligonucleotide
atccttaatgggagacacacaggaactccctttg

SEQ ID NO: 208822 - DNA, 33 bp, Artificial Sequence
  Description of Artificial Sequence: Synthetic oligonucleotide
tccttaatgggagacacacaggaactccctttg

SEQ ID NO: 208823 - DNA, 32 bp, Artificial Sequence
  Description of Artificial Sequence: Synthetic oligonucleotide
ccttaatgggagacacacaggaactccctttg

SEQ ID NO: 208824 - DNA, 32 bp, Artificial Sequence
  Description of Artificial Sequence: Synthetic oligonucleotide
cttaatgggagacacacaggaactccctttgg

SEQ ID NO: 208825 - DNA, 33 bp, Artificial Sequence
  Description of Artificial Sequence: Synthetic oligonucleotide
ttaatgggagacacacaggaactccctttggag

SEQ ID NO: 208826 - DNA, 32 bp, Artificial Sequence
  Description of Artificial Sequence: Synthetic oligonucleotide
taatgggagacacacaggaactccctttggag

SEQ ID NO: 208827 - DNA, 31 bp, Artificial Sequence
  Description of Artificial Sequence: Synthetic oligonucleotide
aatgggagacacacaggaactccctttggag

SEQ ID NO: 208828 - DNA, 30 bp, Artificial Sequence
  Description of Artificial Sequence: Synthetic oligonucleotide
atgggagacacacaggaactccctttggag

SEQ ID NO: 208829 - DNA, 29 bp, Artificial Sequence
  Description of Artificial Sequence: Synthetic oligonucleotide
tgggagacacacaggaactccctttggag

SEQ ID NO: 208830 - DNA, 28 bp, Artificial Sequence
  Description of Artificial Sequence: Synthetic oligonucleotide
gggagacacacaggaactccctttggag

SEQ ID NO: 208831 - DNA, 33 bp, Artificial Sequence
  Description of Artificial Sequence: Synthetic oligonucleotide
ggagacacacaggaactccctttggagatattc

SEQ ID NO: 208832 - DNA, 33 bp, Artificial Sequence
  Description of Artificial Sequence: Synthetic oligonucleotide
gagacacacaggaactccctttggagatattcc

SEQ ID NO: 208833 - DNA, 33 bp, Artificial Sequence
  Description of Artificial Sequence: Synthetic oligonucleotide
agacacacaggaactccctttggagatattccc

SEQ ID NO: 208834 - DNA, 32 bp, Artificial Sequence
  Description of Artificial Sequence: Synthetic oligonucleotide
gacacacaggaactccctttggagatattccc

SEQ ID NO: 208835 - DNA, 35 bp, Artificial Sequence
  Description of Artificial Sequence: Synthetic oligonucleotide
acacacaggaactccctttggagatattccctatg

SEQ ID NO: 208836 - DNA, 34 bp, Artificial Sequence
  Description of Artificial Sequence: Synthetic oligonucleotide
cacacaggaactccctttggagatattccctatg

SEQ ID NO: 208837 - DNA, 34 bp, Artificial Sequence
  Description of Artificial Sequence: Synthetic oligonucleotide
acacaggaactccctttggagatattccctatgg

SEQ ID NO: 208838 - DNA, 33 bp, Artificial Sequence
  Description of Artificial Sequence: Synthetic oligonucleotide
cacaggaactccctttggagatattccctatgg

SEQ ID NO: 208839 - DNA, 37 bp, Artificial Sequence
  Description of Artificial Sequence: Synthetic oligonucleotide
acaggaactccctttggagatattccctatggaaaag

SEQ ID NO: 208840 - DNA, 36 bp, Artificial Sequence
  Description of Artificial Sequence: Synthetic oligonucleotide
caggaactccctttggagatattccctatggaaaag

SEQ ID NO: 208841 - DNA, 42 bp, Artificial Sequence
  Description of Artificial Sequence: Synthetic oligonucleotide
aggaactccctttggagatattccctatggaaaagaaatatc

SEQ ID NO: 208842 - DNA, 41 bp, Artificial Sequence
  Description of Artificial Sequence: Synthetic oligonucleotide
ggaactccctttggagatattccctatggaaaagaaatatc

SEQ ID NO: 208843 - DNA, 44 bp, Artificial Sequence
  Description of Artificial Sequence: Synthetic oligonucleotide
gaactccctttggagatattccctatggaaaagaaatatcttac

SEQ ID NO: 208844 - DNA, 44 bp, Artificial Sequence
  Description of Artificial Sequence: Synthetic oligonucleotide
aactccctttggagatattccctatggaaaagaaatatcttacg

SEQ ID NO: 208845 - DNA, 43 bp, Artificial Sequence
  Description of Artificial Sequence: Synthetic oligonucleotide
actccctttggagatattccctatggaaaagaaatatcttacg

SEQ ID NO: 208846 - DNA, 42 bp, Artificial Sequence
  Description of Artificial Sequence: Synthetic oligonucleotide
ctccctttggagatattccctatggaaaagaaatatcttacg

SEQ ID NO: 208847 - DNA, 42 bp, Artificial Sequence
  Description of Artificial Sequence: Synthetic oligonucleotide
tccctttggagatattccctatggaaaagaaatatcttacgc

SEQ ID NO: 208848 - DNA, 41 bp, Artificial Sequence
  Description of Artificial Sequence: Synthetic oligonucleotide
ccctttggagatattccctatggaaaagaaatatcttacgc

SEQ ID NO: 208849 - DNA, 43 bp, Artificial Sequence
  Description of Artificial Sequence: Synthetic oligonucleotide
cctttggagatattccctatggaaaagaaatatcttacgcatg

SEQ ID NO: 208850 - DNA, 43 bp, Artificial Sequence
  Description of Artificial Sequence: Synthetic oligonucleotide
ctttggagatattccctatggaaaagaaatatcttacgcatgc

SEQ ID NO: 208851 - DNA, 43 bp, Artificial Sequence
  Description of Artificial Sequence: Synthetic oligonucleotide
tttggagatattccctatggaaaagaaatatcttacgcatgcg

SEQ ID NO: 208852 - DNA, 42 bp, Artificial Sequence
  Description of Artificial Sequence: Synthetic oligonucleotide
ttggagatattccctatggaaaagaaatatcttacgcatgcg

SEQ ID NO: 208853 - DNA, 41 bp, Artificial Sequence
  Description of Artificial Sequence: Synthetic oligonucleotide
tggagatattccctatggaaaagaaatatcttacgcatgcg

SEQ ID NO: 208854 - DNA, 40 bp, Artificial Sequence
  Description of Artificial Sequence: Synthetic oligonucleotide
ggagatattccctatggaaaagaaatatcttacgcatgcg

SEQ ID NO: 208855 - DNA, 41 bp, Artificial Sequence
  Description of Artificial Sequence: Synthetic oligonucleotide
gagatattccctatggaaaagaaatatcttacgcatgcgac

SEQ ID NO: 208856 - DNA, 42 bp, Artificial Sequence
  Description of Artificial Sequence: Synthetic oligonucleotide
agatattccctatggaaaagaaatatcttacgcatgcgacac

SEQ ID NO: 208857 - DNA, 41 bp, Artificial Sequence
  Description of Artificial Sequence: Synthetic oligonucleotide
gatattccctatggaaaagaaatatcttacgcatgcgacac

SEQ ID NO: 208858 - DNA, 41 bp, Artificial Sequence
  Description of Artificial Sequence: Synthetic oligonucleotide
atattccctatggaaaagaaatatcttacgcatgcgacacc

SEQ ID NO: 208859 - DNA, 40 bp, Artificial Sequence
  Description of Artificial Sequence: Synthetic oligonucleotide
tattccctatggaaaagaaatatcttacgcatgcgacacc

SEQ ID NO: 208860 - DNA, 39 bp, Artificial Sequence
  Description of Artificial Sequence: Synthetic oligonucleotide
attccctatggaaaagaaatatcttacgcatgcgacacc

SEQ ID NO: 208861 - DNA, 38 bp, Artificial Sequence
  Description of Artificial Sequence: Synthetic oligonucleotide
ttccctatggaaaagaaatatcttacgcatgcgacacc

SEQ ID NO: 208862 - DNA, 37 bp, Artificial Sequence
  Description of Artificial Sequence: Synthetic oligonucleotide
tccctatggaaaagaaatatcttacgcatgcgacacc

SEQ ID NO: 208863 - DNA, 36 bp, Artificial Sequence
  Description of Artificial Sequence: Synthetic oligonucleotide
ccctatggaaaagaaatatcttacgcatgcgacacc

SEQ ID NO: 208864 - DNA, 36 bp, Artificial Sequence
  Description of Artificial Sequence: Synthetic oligonucleotide
cctatggaaaagaaatatcttacgcatgcgacaccc

SEQ ID NO: 208865 - DNA, 37 bp, Artificial Sequence
  Description of Artificial Sequence: Synthetic oligonucleotide
ctatggaaaagaaatatcttacgcatgcgacacccac

SEQ ID NO: 208866 - DNA, 37 bp, Artificial Sequence
  Description of Artificial Sequence: Synthetic oligonucleotide
tatggaaaagaaatatcttacgcatgcgacacccacc

SEQ ID NO: 208867 - DNA, 36 bp, Artificial Sequence
  Description of Artificial Sequence: Synthetic oligonucleotide
atggaaaagaaatatcttacgcatgcgacacccacc

SEQ ID NO: 208868 - DNA, 35 bp, Artificial Sequence
  Description of Artificial Sequence: Synthetic oligonucleotide
tggaaaagaaatatcttacgcatgcgacacccacc

SEQ ID NO: 208869 - DNA, 34 bp, Artificial Sequence
  Description of Artificial Sequence: Synthetic oligonucleotide
ggaaaagaaatatcttacgcatgcgacacccacc

SEQ ID NO: 208870 - DNA, 34 bp, Artificial Sequence
  Description of Artificial Sequence: Synthetic oligonucleotide
gaaaagaaatatcttacgcatgcgacacccaccc

SEQ ID NO: 208871 - DNA, 35 bp, Artificial Sequence
  Description of Artificial Sequence: Synthetic oligonucleotide
aaaagaaatatcttacgcatgcgacacccacccag

SEQ ID NO: 208872 - DNA, 34 bp, Artificial Sequence
  Description of Artificial Sequence: Synthetic oligonucleotide
aaagaaatatcttacgcatgcgacacccacccag

SEQ ID NO: 208873 - DNA, 33 bp, Artificial Sequence
  Description of Artificial Sequence: Synthetic oligonucleotide
aagaaatatcttacgcatgcgacacccacccag

SEQ ID NO: 208874 - DNA, 32 bp, Artificial Sequence
  Description of Artificial Sequence: Synthetic oligonucleotide
agaaatatcttacgcatgcgacacccacccag

SEQ ID NO: 208875 - DNA, 31 bp, Artificial Sequence
  Description of Artificial Sequence: Synthetic oligonucleotide
gaaatatcttacgcatgcgacacccacccag

SEQ ID NO: 208876 - DNA, 32 bp, Artificial Sequence
  Description of Artificial Sequence: Synthetic oligonucleotide
aaatatcttacgcatgcgacacccacccagac

SEQ ID NO: 208877 - DNA, 31 bp, Artificial Sequence
  Description of Artificial Sequence: Synthetic oligonucleotide
aatatcttacgcatgcgacacccacccagac

SEQ ID NO: 208878 - DNA, 30 bp, Artificial Sequence
  Description of Artificial Sequence: Synthetic oligonucleotide
atatcttacgcatgcgacacccacccagac

SEQ ID NO: 208879 - DNA, 29 bp, Artificial Sequence
  Description of Artificial Sequence: Synthetic oligonucleotide
tatcttacgcatgcgacacccacccagac

SEQ ID NO: 208880 - DNA, 28 bp, Artificial Sequence
  Description of Artificial Sequence: Synthetic oligonucleotide
atcttacgcatgcgacacccacccagac

SEQ ID NO: 208881 - DNA, 27 bp, Artificial Sequence
  Description of Artificial Sequence: Synthetic oligonucleotide
tcttacgcatgcgacacccacccagac

SEQ ID NO: 208882 - DNA, 27 bp, Artificial Sequence
  Description of Artificial Sequence: Synthetic oligonucleotide
cttacgcatgcgacacccacccagaca

SEQ ID NO: 208883 - DNA, 27 bp, Artificial Sequence
  Description of Artificial Sequence: Synthetic oligonucleotide
ttacgcatgcgacacccacccagacag

SEQ ID NO: 208884 - DNA, 27 bp, Artificial Sequence
  Description of Artificial Sequence: Synthetic oligonucleotide
tacgcatgcgacacccacccagacaga

SEQ ID NO: 208885 - DNA, 26 bp, Artificial Sequence
  Description of Artificial Sequence: Synthetic oligonucleotide
acgcatgcgacacccacccagacaga

SEQ ID NO: 208886 - DNA, 25 bp, Artificial Sequence
  Description of Artificial Sequence: Synthetic oligonucleotide
cgcatgcgacacccacccagacaga

SEQ ID NO: 208887 - DNA, 25 bp, Artificial Sequence
  Description of Artificial Sequence: Synthetic oligonucleotide
gcatgcgacacccacccagacagag

SEQ ID NO: 208888 - DNA, 25 bp, Artificial Sequence
  Description of Artificial Sequence: Synthetic oligonucleotide
catgcgacacccacccagacagagg

SEQ ID NO: 208889 - DNA, 27 bp, Artificial Sequence
  Description of Artificial Sequence: Synthetic oligonucleotide
atgcgacacccacccagacagagggat

SEQ ID NO: 208890 - DNA, 26 bp, Artificial Sequence
  Description of Artificial Sequence: Synthetic oligonucleotide
tgcgacacccacccagacagagggat

SEQ ID NO: 208891 - DNA, 25 bp, Artificial Sequence
  Description of Artificial Sequence: Synthetic oligonucleotide
gcgacacccacccagacagagggat

SEQ ID NO: 208892 - DNA, 26 bp, Artificial Sequence
  Description of Artificial Sequence: Synthetic oligonucleotide
cgacacccacccagacagagggatga

SEQ ID NO: 208893 - DNA, 26 bp, Artificial Sequence
  Description of Artificial Sequence: Synthetic oligonucleotide
gacacccacccagacagagggatgac

SEQ ID NO: 208894 - DNA, 27 bp, Artificial Sequence
  Description of Artificial Sequence: Synthetic oligonucleotide
acacccacccagacagagggatgacct

SEQ ID NO: 208895 - DNA, 27 bp, Artificial Sequence
  Description of Artificial Sequence: Synthetic oligonucleotide
cacccacccagacagagggatgacctt

SEQ ID NO: 208896 - DNA, 27 bp, Artificial Sequence
  Description of Artificial Sequence: Synthetic oligonucleotide
acccacccagacagagggatgaccttc

SEQ ID NO: 208897 - DNA, 30 bp, Artificial Sequence
  Description of Artificial Sequence: Synthetic oligonucleotide
gatgaccttcaacctcattggggagagctc

SEQ ID NO: 208898 - DNA, 30 bp, Artificial Sequence
  Description of Artificial Sequence: Synthetic oligonucleotide
atgaccttcaacctcattggggagagctcc

SEQ ID NO: 208899 - DNA, 29 bp, Artificial Sequence
  Description of Artificial Sequence: Synthetic oligonucleotide
tgaccttcaacctcattggggagagctcc

SEQ ID NO: 208900 - DNA, 28 bp, Artificial Sequence
  Description of Artificial Sequence: Synthetic oligonucleotide
gaccttcaacctcattggggagagctcc

SEQ ID NO: 208901 - DNA, 30 bp, Artificial Sequence
  Description of Artificial Sequence: Synthetic oligonucleotide
accttcaacctcattggggagagctccatc

SEQ ID NO: 208902 - DNA, 29 bp, Artificial Sequence
  Description of Artificial Sequence: Synthetic oligonucleotide
ccttcaacctcattggggagagctccatc

SEQ ID NO: 208903 - DNA, 29 bp, Artificial Sequence
  Description of Artificial Sequence: Synthetic oligonucleotide
cttcaacctcattggggagagctccatcc

SEQ ID NO: 208904 - DNA, 29 bp, Artificial Sequence
  Description of Artificial Sequence: Synthetic oligonucleotide
ttcaacctcattggggagagctccatccg

SEQ ID NO: 208905 - DNA, 28 bp, Artificial Sequence
  Description of Artificial Sequence: Synthetic oligonucleotide
tcaacctcattggggagagctccatccg

SEQ ID NO: 208906 - DNA, 27 bp, Artificial Sequence
  Description of Artificial Sequence: Synthetic oligonucleotide
caacctcattggggagagctccatccg

SEQ ID NO: 208907 - DNA, 27 bp, Artificial Sequence
  Description of Artificial Sequence: Synthetic oligonucleotide
aacctcattggggagagctccatccgc

SEQ ID NO: 208908 - DNA, 27 bp, Artificial Sequence
  Description of Artificial Sequence: Synthetic oligonucleotide
acctcattggggagagctccatccgct

SEQ ID NO: 208909 - DNA, 26 bp, Artificial Sequence
  Description of Artificial Sequence: Synthetic oligonucleotide
cctcattggggagagctccatccgct

SEQ ID NO: 208910 - DNA, 26 bp, Artificial Sequence
  Description of Artificial Sequence: Synthetic oligonucleotide
ctcattggggagagctccatccgctg

SEQ ID NO: 208911 - DNA, 27 bp, Artificial Sequence
  Description of Artificial Sequence: Synthetic oligonucleotide
tcattggggagagctccatccgctgca

SEQ ID NO: 208912 - DNA, 26 bp, Artificial Sequence
  Description of Artificial Sequence: Synthetic oligonucleotide
cattggggagagctccatccgctgca

SEQ ID NO: 208913 - DNA, 27 bp, Artificial Sequence
  Description of Artificial Sequence: Synthetic oligonucleotide
attggggagagctccatccgctgcaca

SEQ ID NO: 208914 - DNA, 27 bp, Artificial Sequence
  Description of Artificial Sequence: Synthetic oligonucleotide
ttggggagagctccatccgctgcacaa

SEQ ID NO: 208915 - DNA, 26 bp, Artificial Sequence
  Description of Artificial Sequence: Synthetic oligonucleotide
tggggagagctccatccgctgcacaa

SEQ ID NO: 208916 - DNA, 25 bp, Artificial Sequence
  Description of Artificial Sequence: Synthetic oligonucleotide
ggggagagctccatccgctgcacaa

SEQ ID NO: 208917 - DNA, 26 bp, Artificial Sequence
  Description of Artificial Sequence: Synthetic oligonucleotide
gggagagctccatccgctgcacaagt

SEQ ID NO: 208918 - DNA, 27 bp, Artificial Sequence
  Description of Artificial Sequence: Synthetic oligonucleotide
ggagagctccatccgctgcacaagtga

SEQ ID NO: 208919 - DNA, 27 bp, Artificial Sequence
  Description of Artificial Sequence: Synthetic oligonucleotide
gagagctccatccgctgcacaagtgac

SEQ ID NO: 208920 - DNA, 27 bp, Artificial Sequence
  Description of Artificial Sequence: Synthetic oligonucleotide
agagctccatccgctgcacaagtgacc

SEQ ID NO: 208921 - DNA, 26 bp, Artificial Sequence
  Description of Artificial Sequence: Synthetic oligonucleotide
gagctccatccgctgcacaagtgacc

SEQ ID NO: 208922 - DNA, 27 bp, Artificial Sequence
  Description of Artificial Sequence: Synthetic oligonucleotide
agctccatccgctgcacaagtgaccct

SEQ ID NO: 208923 - DNA, 26 bp, Artificial Sequence
  Description of Artificial Sequence: Synthetic oligonucleotide
gctccatccgctgcacaagtgaccct

SEQ ID NO: 208924 - DNA, 27 bp, Artificial Sequence
  Description of Artificial Sequence: Synthetic oligonucleotide
ctccatccgctgcacaagtgaccctca

SEQ ID NO: 208925 - DNA, 28 bp, Artificial Sequence
  Description of Artificial Sequence: Synthetic oligonucleotide
tccatccgctgcacaagtgaccctcaag

SEQ ID NO: 208926 - DNA, 28 bp, Artificial Sequence
  Description of Artificial Sequence: Synthetic oligonucleotide
ctgcccctcgctgtgaactttctgttcc

SEQ ID NO: 208927 - DNA, 29 bp, Artificial Sequence
  Description of Artificial Sequence: Synthetic oligonucleotide
tgcccctcgctgtgaactttctgttcctg

SEQ ID NO: 208928 - DNA, 28 bp, Artificial Sequence
  Description of Artificial Sequence: Synthetic oligonucleotide
gcccctcgctgtgaactttctgttcctg

SEQ ID NO: 208929 - DNA, 28 bp, Artificial Sequence
  Description of Artificial Sequence: Synthetic oligonucleotide
cccctcgctgtgaactttctgttcctgc

SEQ ID NO: 208930 - DNA, 29 bp, Artificial Sequence
  Description of Artificial Sequence: Synthetic oligonucleotide
ccctcgctgtgaactttctgttcctgctg

SEQ ID NO: 208931 - DNA, 29 bp, Artificial Sequence
  Description of Artificial Sequence: Synthetic oligonucleotide
cctcgctgtgaactttctgttcctgctgc

SEQ ID NO: 208932 - DNA, 29 bp, Artificial Sequence
  Description of Artificial Sequence: Synthetic oligonucleotide
ctcgctgtgaactttctgttcctgctgcc

SEQ ID NO: 208933 - DNA, 30 bp, Artificial Sequence
  Description of Artificial Sequence: Synthetic oligonucleotide
tcgctgtgaactttctgttcctgctgcctg

SEQ ID NO: 208934 - DNA, 29 bp, Artificial Sequence
  Description of Artificial Sequence: Synthetic oligonucleotide
cgctgtgaactttctgttcctgctgcctg

SEQ ID NO: 208935 - DNA, 29 bp, Artificial Sequence
  Description of Artificial Sequence: Synthetic oligonucleotide
gctgtgaactttctgttcctgctgcctgc

SEQ ID NO: 208936 - DNA, 29 bp, Artificial Sequence
  Description of Artificial Sequence: Synthetic oligonucleotide
ctgtgaactttctgttcctgctgcctgcc

SEQ ID NO: 208937 - DNA, 29 bp, Artificial Sequence
  Description of Artificial Sequence: Synthetic oligonucleotide
tgtgaactttctgttcctgctgcctgccc

SEQ ID NO: 208938 - DNA, 28 bp, Artificial Sequence
  Description of Artificial Sequence: Synthetic oligonucleotide
gtgaactttctgttcctgctgcctgccc

SEQ ID NO: 208939 - DNA, 29 bp, Artificial Sequence
  Description of Artificial Sequence: Synthetic oligonucleotide
tgaactttctgttcctgctgcctgcccac

SEQ ID NO: 208940 - DNA, 28 bp, Artificial Sequence
  Description of Artificial Sequence: Synthetic oligonucleotide
gaactttctgttcctgctgcctgcccac

SEQ ID NO: 208941 - DNA, 30 bp, Artificial Sequence
  Description of Artificial Sequence: Synthetic oligonucleotide
aactttctgttcctgctgcctgcccacatc

SEQ ID NO: 208942 - DNA, 29 bp, Artificial Sequence
  Description of Artificial Sequence: Synthetic oligonucleotide
actttctgttcctgctgcctgcccacatc

SEQ ID NO: 208943 - DNA, 28 bp, Artificial Sequence
  Description of Artificial Sequence: Synthetic oligonucleotide
ctttctgttcctgctgcctgcccacatc

SEQ ID NO: 208944 - DNA, 28 bp, Artificial Sequence
  Description of Artificial Sequence: Synthetic oligonucleotide
tttctgttcctgctgcctgcccacatcc

SEQ ID NO: 208945 - DNA, 27 bp, Artificial Sequence
  Description of Artificial Sequence: Synthetic oligonucleotide
ttctgttcctgctgcctgcccacatcc

SEQ ID NO: 208946 - DNA, 27 bp, Artificial Sequence
  Description of Artificial Sequence: Synthetic oligonucleotide
tctgttcctgctgcctgcccacatcca

SEQ ID NO: 208947 - DNA, 26 bp, Artificial Sequence
  Description of Artificial Sequence: Synthetic oligonucleotide
ctgttcctgctgcctgcccacatcca

SEQ ID NO: 208948 - DNA, 26 bp, Artificial Sequence
  Description of Artificial Sequence: Synthetic oligonucleotide
tgttcctgctgcctgcccacatccac

SEQ ID NO: 208949 - DNA, 25 bp, Artificial Sequence
  Description of Artificial Sequence: Synthetic oligonucleotide
gttcctgctgcctgcccacatccac

SEQ ID NO: 208950 - DNA, 25 bp, Artificial Sequence
  Description of Artificial Sequence: Synthetic oligonucleotide
ttcctgctgcctgcccacatccacc

SEQ ID NO: 208951 - DNA, 24 bp, Artificial Sequence
  Description of Artificial Sequence: Synthetic oligonucleotide
tcctgctgcctgcccacatccacc

SEQ ID NO: 208952 - DNA, 23 bp, Artificial Sequence
  Description of Artificial Sequence: Synthetic oligonucleotide
cctgctgcctgcccacatccacc

SEQ ID NO: 208953 - DNA, 25 bp, Artificial Sequence
  Description of Artificial Sequence: Synthetic oligonucleotide
ctgctgcctgcccacatccacccaa

SEQ ID NO: 208954 - DNA, 27 bp, Artificial Sequence
  Description of Artificial Sequence: Synthetic oligonucleotide
tgctgcctgcccacatccacccaagat

SEQ ID NO: 208955 - DNA, 26 bp, Artificial Sequence
  Description of Artificial Sequence: Synthetic oligonucleotide
gctgcctgcccacatccacccaagat

SEQ ID NO: 208956 - DNA, 26 bp, Artificial Sequence
  Description of Artificial Sequence: Synthetic oligonucleotide
ctgcctgcccacatccacccaagatc

SEQ ID NO: 208957 - DNA, 27 bp, Artificial Sequence
  Description of Artificial Sequence: Synthetic oligonucleotide
tgcctgcccacatccacccaagatcca

SEQ ID NO: 208958 - DNA, 27 bp, Artificial Sequence
  Description of Artificial Sequence: Synthetic oligonucleotide
gcctgcccacatccacccaagatccaa

SEQ ID NO: 208959 - DNA, 29 bp, Artificial Sequence
  Description of Artificial Sequence: Synthetic oligonucleotide
cctgcccacatccacccaagatccaaaac

SEQ ID NO: 208960 - DNA, 29 bp, Artificial Sequence
  Description of Artificial Sequence: Synthetic oligonucleotide
ctgcccacatccacccaagatccaaaacg

SEQ ID NO: 208961 - DNA, 29 bp, Artificial Sequence
  Description of Artificial Sequence: Synthetic oligonucleotide
tgcccacatccacccaagatccaaaacgg

SEQ ID NO: 208962 - DNA, 28 bp, Artificial Sequence
  Description of Artificial Sequence: Synthetic oligonucleotide
gcccacatccacccaagatccaaaacgg

SEQ ID NO: 208963 - DNA, 28 bp, Artificial Sequence
  Description of Artificial Sequence: Synthetic oligonucleotide
cccacatccacccaagatccaaaacggg

SEQ ID NO: 208964 - DNA, 28 bp, Artificial Sequence
  Description of Artificial Sequence: Synthetic oligonucleotide
ccacatccacccaagatccaaaacgggc

SEQ ID NO: 208965 - DNA, 32 bp, Artificial Sequence
  Description of Artificial Sequence: Synthetic oligonucleotide
cacatccacccaagatccaaaacgggcattac

SEQ ID NO: 208966 - DNA, 35 bp, Artificial Sequence
  Description of Artificial Sequence: Synthetic oligonucleotide
acatccacccaagatccaaaacgggcattacattg

SEQ ID NO: 208967 - DNA, 34 bp, Artificial Sequence
  Description of Artificial Sequence: Synthetic oligonucleotide
catccacccaagatccaaaacgggcattacattg

SEQ ID NO: 208968 - DNA, 34 bp, Artificial Sequence
  Description of Artificial Sequence: Synthetic oligonucleotide
atccacccaagatccaaaacgggcattacattgg

SEQ ID NO: 208969 - DNA, 33 bp, Artificial Sequence
  Description of Artificial Sequence: Synthetic oligonucleotide
tccacccaagatccaaaacgggcattacattgg

SEQ ID NO: 208970 - DNA, 32 bp, Artificial Sequence
  Description of Artificial Sequence: Synthetic oligonucleotide
ccacccaagatccaaaacgggcattacattgg

SEQ ID NO: 208971 - DNA, 33 bp, Artificial Sequence
  Description of Artificial Sequence: Synthetic oligonucleotide
cacccaagatccaaaacgggcattacattggag

SEQ ID NO: 208972 - DNA, 33 bp, Artificial Sequence
  Description of Artificial Sequence: Synthetic oligonucleotide
acccaagatccaaaacgggcattacattggagg

SEQ ID NO: 208973 - DNA, 32 bp, Artificial Sequence
  Description of Artificial Sequence: Synthetic oligonucleotide
cccaagatccaaaacgggcattacattggagg

SEQ ID NO: 208974 - DNA, 33 bp, Artificial Sequence
  Description of Artificial Sequence: Synthetic oligonucleotide
ccaagatccaaaacgggcattacattggaggac

SEQ ID NO: 208975 - DNA, 34 bp, Artificial Sequence
  Description of Artificial Sequence: Synthetic oligonucleotide
caagatccaaaacgggcattacattggaggacac

SEQ ID NO: 208976 - DNA, 34 bp, Artificial Sequence
  Description of Artificial Sequence: Synthetic oligonucleotide
aagatccaaaacgggcattacattggaggacacg

SEQ ID NO: 208977 - DNA, 33 bp, Artificial Sequence
  Description of Artificial Sequence: Synthetic oligonucleotide
agatccaaaacgggcattacattggaggacacg

SEQ ID NO: 208978 - DNA, 32 bp, Artificial Sequence
  Description of Artificial Sequence: Synthetic oligonucleotide
gatccaaaacgggcattacattggaggacacg

SEQ ID NO: 208979 - DNA, 35 bp, Artificial Sequence
  Description of Artificial Sequence: Synthetic oligonucleotide
atccaaaacgggcattacattggaggacacgtatc

SEQ ID NO: 208980 - DNA, 34 bp, Artificial Sequence
  Description of Artificial Sequence: Synthetic oligonucleotide
tccaaaacgggcattacattggaggacacgtatc

SEQ ID NO: 208981 - DNA, 33 bp, Artificial Sequence
  Description of Artificial Sequence: Synthetic oligonucleotide
ccaaaacgggcattacattggaggacacgtatc

SEQ ID NO: 208982 - DNA, 34 bp, Artificial Sequence
  Description of Artificial Sequence: Synthetic oligonucleotide
caaaacgggcattacattggaggacacgtatctc

SEQ ID NO: 208983 - DNA, 39 bp, Artificial Sequence
  Description of Artificial Sequence: Synthetic oligonucleotide
aaaacgggcattacattggaggacacgtatctctatatc

SEQ ID NO: 208984 - DNA, 38 bp, Artificial Sequence
  Description of Artificial Sequence: Synthetic oligonucleotide
aaacgggcattacattggaggacacgtatctctatatc

SEQ ID NO: 208985 - DNA, 37 bp, Artificial Sequence
  Description of Artificial Sequence: Synthetic oligonucleotide
aacgggcattacattggaggacacgtatctctatatc

SEQ ID NO: 208986 - DNA, 36 bp, Artificial Sequence
  Description of Artificial Sequence: Synthetic oligonucleotide
acgggcattacattggaggacacgtatctctatatc

SEQ ID NO: 208987 - DNA, 35 bp, Artificial Sequence
  Description of Artificial Sequence: Synthetic oligonucleotide
cgggcattacattggaggacacgtatctctatatc

SEQ ID NO: 208988 - DNA, 37 bp, Artificial Sequence
  Description of Artificial Sequence: Synthetic oligonucleotide
gggcattacattggaggacacgtatctctatatcttc

SEQ ID NO: 208989 - DNA, 37 bp, Artificial Sequence
  Description of Artificial Sequence: Synthetic oligonucleotide
ggcattacattggaggacacgtatctctatatcttcc

SEQ ID NO: 208990 - DNA, 38 bp, Artificial Sequence
  Description of Artificial Sequence: Synthetic oligonucleotide
gcattacattggaggacacgtatctctatatcttcctg

SEQ ID NO: 208991 - DNA, 38 bp, Artificial Sequence
  Description of Artificial Sequence: Synthetic oligonucleotide
cattacattggaggacacgtatctctatatcttcctgg

SEQ ID NO: 208992 - DNA, 38 bp, Artificial Sequence
  Description of Artificial Sequence: Synthetic oligonucleotide
attacattggaggacacgtatctctatatcttcctggg

SEQ ID NO: 208993 - DNA, 37 bp, Artificial Sequence
  Description of Artificial Sequence: Synthetic oligonucleotide
ttacattggaggacacgtatctctatatcttcctggg

SEQ ID NO: 208994 - DNA, 36 bp, Artificial Sequence
  Description of Artificial Sequence: Synthetic oligonucleotide
tacattggaggacacgtatctctatatcttcctggg

SEQ ID NO: 208995 - DNA, 35 bp, Artificial Sequence
  Description of Artificial Sequence: Synthetic oligonucleotide
acattggaggacacgtatctctatatcttcctggg

SEQ ID NO: 208996 - DNA, 34 bp, Artificial Sequence
  Description of Artificial Sequence: Synthetic oligonucleotide
cattggaggacacgtatctctatatcttcctggg

SEQ ID NO: 208997 - DNA, 36 bp, Artificial Sequence
  Description of Artificial Sequence: Synthetic oligonucleotide
attggaggacacgtatctctatatcttcctgggatg

SEQ ID NO: 208998 - DNA, 35 bp, Artificial Sequence
  Description of Artificial Sequence: Synthetic oligonucleotide
ttggaggacacgtatctctatatcttcctgggatg

SEQ ID NO: 208999 - DNA, 34 bp, Artificial Sequence
  Description of Artificial Sequence: Synthetic oligonucleotide
tggaggacacgtatctctatatcttcctgggatg

SEQ ID NO: 209000 - DNA, 33 bp, Artificial Sequence
  Description of Artificial Sequence: Synthetic oligonucleotide
ggaggacacgtatctctatatcttcctgggatg

SEQ ID NO: 209001 - DNA, 34 bp, Artificial Sequence
  Description of Artificial Sequence: Synthetic oligonucleotide
gaggacacgtatctctatatcttcctgggatgac

SEQ ID NO: 209002 - DNA, 37 bp, Artificial Sequence
  Description of Artificial Sequence: Synthetic oligonucleotide
aggacacgtatctctatatcttcctgggatgacaatc

SEQ ID NO: 209003 - DNA, 36 bp, Artificial Sequence
  Description of Artificial Sequence: Synthetic oligonucleotide
ggacacgtatctctatatcttcctgggatgacaatc

SEQ ID NO: 209004 - DNA, 37 bp, Artificial Sequence
  Description of Artificial Sequence: Synthetic oligonucleotide
gacacgtatctctatatcttcctgggatgacaatcag

SEQ ID NO: 209005 - DNA, 37 bp, Artificial Sequence
  Description of Artificial Sequence: Synthetic oligonucleotide
acacgtatctctatatcttcctgggatgacaatcagc

SEQ ID NO: 209006 - DNA, 36 bp, Artificial Sequence
  Description of Artificial Sequence: Synthetic oligonucleotide
cacgtatctctatatcttcctgggatgacaatcagc

SEQ ID NO: 209007 - DNA, 38 bp, Artificial Sequence
  Description of Artificial Sequence: Synthetic oligonucleotide
acgtatctctatatcttcctgggatgacaatcagctac

SEQ ID NO: 209008 - DNA, 37 bp, Artificial Sequence
  Description of Artificial Sequence: Synthetic oligonucleotide
cgtatctctatatcttcctgggatgacaatcagctac

SEQ ID NO: 209009 - DNA, 41 bp, Artificial Sequence
  Description of Artificial Sequence: Synthetic oligonucleotide
gtatctctatatcttcctgggatgacaatcagctacatttg

SEQ ID NO: 209010 - DNA, 42 bp, Artificial Sequence
  Description of Artificial Sequence: Synthetic oligonucleotide
tatctctatatcttcctgggatgacaatcagctacatttgtg

SEQ ID NO: 209011 - DNA, 41 bp, Artificial Sequence
  Description of Artificial Sequence: Synthetic oligonucleotide
atctctatatcttcctgggatgacaatcagctacatttgtg

SEQ ID NO: 209012 - DNA, 40 bp, Artificial Sequence
  Description of Artificial Sequence: Synthetic oligonucleotide
tctctatatcttcctgggatgacaatcagctacatttgtg

SEQ ID NO: 209013 - DNA, 39 bp, Artificial Sequence
  Description of Artificial Sequence: Synthetic oligonucleotide
ctctatatcttcctgggatgacaatcagctacatttgtg

SEQ ID NO: 209014 - DNA, 40 bp, Artificial Sequence
  Description of Artificial Sequence: Synthetic oligonucleotide
tctatatcttcctgggatgacaatcagctacatttgtgac

SEQ ID NO: 209015 - DNA, 39 bp, Artificial Sequence
  Description of Artificial Sequence: Synthetic oligonucleotide
ctatatcttcctgggatgacaatcagctacatttgtgac

SEQ ID NO: 209016 - DNA, 39 bp, Artificial Sequence
  Description of Artificial Sequence: Synthetic oligonucleotide
tatatcttcctgggatgacaatcagctacatttgtgacc

SEQ ID NO: 209017 - DNA, 38 bp, Artificial Sequence
  Description of Artificial Sequence: Synthetic oligonucleotide
atatcttcctgggatgacaatcagctacatttgtgacc

SEQ ID NO: 209018 - DNA, 37 bp, Artificial Sequence
  Description of Artificial Sequence: Synthetic oligonucleotide
tatcttcctgggatgacaatcagctacatttgtgacc

SEQ ID NO: 209019 - DNA, 36 bp, Artificial Sequence
  Description of Artificial Sequence: Synthetic oligonucleotide
atcttcctgggatgacaatcagctacatttgtgacc

SEQ ID NO: 209020 - DNA, 35 bp, Artificial Sequence
  Description of Artificial Sequence: Synthetic oligonucleotide
tcttcctgggatgacaatcagctacatttgtgacc

SEQ ID NO: 209021 - DNA, 34 bp, Artificial Sequence
  Description of Artificial Sequence: Synthetic oligonucleotide
cttcctgggatgacaatcagctacatttgtgacc

SEQ ID NO: 209022 - DNA, 34 bp, Artificial Sequence
  Description of Artificial Sequence: Synthetic oligonucleotide
ttcctgggatgacaatcagctacatttgtgaccc

SEQ ID NO: 209023 - DNA, 33 bp, Artificial Sequence
  Description of Artificial Sequence: Synthetic oligonucleotide
tcctgggatgacaatcagctacatttgtgaccc

SEQ ID NO: 209024 - DNA, 32 bp, Artificial Sequence
  Description of Artificial Sequence: Synthetic oligonucleotide
cctgggatgacaatcagctacatttgtgaccc

SEQ ID NO: 209025 - DNA, 32 bp, Artificial Sequence
  Description of Artificial Sequence: Synthetic oligonucleotide
ctgggatgacaatcagctacatttgtgacccc

SEQ ID NO: 209026 - DNA, 32 bp, Artificial Sequence
  Description of Artificial Sequence: Synthetic oligonucleotide
tgggatgacaatcagctacatttgtgaccccg

SEQ ID NO: 209027 - DNA, 31 bp, Artificial Sequence
  Description of Artificial Sequence: Synthetic oligonucleotide
gggatgacaatcagctacatttgtgaccccg

SEQ ID NO: 209028 - DNA, 31 bp, Artificial Sequence
  Description of Artificial Sequence: Synthetic oligonucleotide
ggatgacaatcagctacatttgtgaccccgg

SEQ ID NO: 209029 - DNA, 31 bp, Artificial Sequence
  Description of Artificial Sequence: Synthetic oligonucleotide
gatgacaatcagctacatttgtgaccccggc

SEQ ID NO: 209030 - DNA, 33 bp, Artificial Sequence
  Description of Artificial Sequence: Synthetic oligonucleotide
atgacaatcagctacatttgtgaccccggctac

SEQ ID NO: 209031 - DNA, 32 bp, Artificial Sequence
  Description of Artificial Sequence: Synthetic oligonucleotide
tgacaatcagctacatttgtgaccccggctac

SEQ ID NO: 209032 - DNA, 31 bp, Artificial Sequence
  Description of Artificial Sequence: Synthetic oligonucleotide
gacaatcagctacatttgtgaccccggctac

SEQ ID NO: 209033 - DNA, 31 bp, Artificial Sequence
  Description of Artificial Sequence: Synthetic oligonucleotide
acaatcagctacatttgtgaccccggctacc

SEQ ID NO: 209034 - DNA, 30 bp, Artificial Sequence
  Description of Artificial Sequence: Synthetic oligonucleotide
caatcagctacatttgtgaccccggctacc

SEQ ID NO: 209035 - DNA, 31 bp, Artificial Sequence
  Description of Artificial Sequence: Synthetic oligonucleotide
aatcagctacatttgtgaccccggctacctg

SEQ ID NO: 209036 - DNA, 30 bp, Artificial Sequence
  Description of Artificial Sequence: Synthetic oligonucleotide
atcagctacatttgtgaccccggctacctg

SEQ ID NO: 209037 - DNA, 29 bp, Artificial Sequence
  Description of Artificial Sequence: Synthetic oligonucleotide
tcagctacatttgtgaccccggctacctg

SEQ ID NO: 209038 - DNA, 28 bp, Artificial Sequence
  Description of Artificial Sequence: Synthetic oligonucleotide
cagctacatttgtgaccccggctacctg

SEQ ID NO: 209039 - DNA, 31 bp, Artificial Sequence
  Description of Artificial Sequence: Synthetic oligonucleotide
agctacatttgtgaccccggctacctgttag

SEQ ID NO: 209040 - DNA, 30 bp, Artificial Sequence
  Description of Artificial Sequence: Synthetic oligonucleotide
gctacatttgtgaccccggctacctgttag

SEQ ID NO: 209041 - DNA, 31 bp, Artificial Sequence
  Description of Artificial Sequence: Synthetic oligonucleotide
ctacatttgtgaccccggctacctgttagtg

SEQ ID NO: 209042 - DNA, 31 bp, Artificial Sequence
  Description of Artificial Sequence: Synthetic oligonucleotide
tacatttgtgaccccggctacctgttagtgg

SEQ ID NO: 209043 - DNA, 30 bp, Artificial Sequence
  Description of Artificial Sequence: Synthetic oligonucleotide
acatttgtgaccccggctacctgttagtgg

SEQ ID NO: 209044 - DNA, 29 bp, Artificial Sequence
  Description of Artificial Sequence: Synthetic oligonucleotide
catttgtgaccccggctacctgttagtgg

SEQ ID NO: 209045 - DNA, 29 bp, Artificial Sequence
  Description of Artificial Sequence: Synthetic oligonucleotide
atttgtgaccccggctacctgttagtggg

SEQ ID NO: 209046 - DNA, 28 bp, Artificial Sequence
  Description of Artificial Sequence: Synthetic oligonucleotide
tttgtgaccccggctacctgttagtggg

SEQ ID NO: 209047 - DNA, 27 bp, Artificial Sequence
  Description of Artificial Sequence: Synthetic oligonucleotide
ttgtgaccccggctacctgttagtggg

SEQ ID NO: 209048 - DNA, 27 bp, Artificial Sequence
  Description of Artificial Sequence: Synthetic oligonucleotide
tgtgaccccggctacctgttagtggga

SEQ ID NO: 209049 - DNA, 27 bp, Artificial Sequence
  Description of Artificial Sequence: Synthetic oligonucleotide
gtgaccccggctacctgttagtgggaa

SEQ ID NO: 209050 - DNA, 28 bp, Artificial Sequence
  Description of Artificial Sequence: Synthetic oligonucleotide
tgaccccggctacctgttagtgggaaag

SEQ ID NO: 209051 - DNA, 27 bp, Artificial Sequence
  Description of Artificial Sequence: Synthetic oligonucleotide
gaccccggctacctgttagtgggaaag

SEQ ID NO: 209052 - DNA, 27 bp, Artificial Sequence
  Description of Artificial Sequence: Synthetic oligonucleotide
accccggctacctgttagtgggaaagg

SEQ ID NO: 209053 - DNA, 26 bp, Artificial Sequence
  Description of Artificial Sequence: Synthetic oligonucleotide
ccccggctacctgttagtgggaaagg

SEQ ID NO: 209054 - DNA, 26 bp, Artificial Sequence
  Description of Artificial Sequence: Synthetic oligonucleotide
cccggctacctgttagtgggaaaggg

SEQ ID NO: 209055 - DNA, 27 bp, Artificial Sequence
  Description of Artificial Sequence: Synthetic oligonucleotide
ccggctacctgttagtgggaaagggct

SEQ ID NO: 209056 - DNA, 28 bp, Artificial Sequence
  Description of Artificial Sequence: Synthetic oligonucleotide
cggctacctgttagtgggaaagggcttc

SEQ ID NO: 209057 - DNA, 33 bp, Artificial Sequence
  Description of Artificial Sequence: Synthetic oligonucleotide
ggctacctgttagtgggaaagggcttcattttc

SEQ ID NO: 209058 - DNA, 34 bp, Artificial Sequence
  Description of Artificial Sequence: Synthetic oligonucleotide
gctacctgttagtgggaaagggcttcattttctg

SEQ ID NO: 209059 - DNA, 36 bp, Artificial Sequence
  Description of Artificial Sequence: Synthetic oligonucleotide
ctacctgttagtgggaaagggcttcattttctgtac

SEQ ID NO: 209060 - DNA, 37 bp, Artificial Sequence
  Description of Artificial Sequence: Synthetic oligonucleotide
tacctgttagtgggaaagggcttcattttctgtacag

SEQ ID NO: 209061 - DNA, 36 bp, Artificial Sequence
  Description of Artificial Sequence: Synthetic oligonucleotide
acctgttagtgggaaagggcttcattttctgtacag

SEQ ID NO: 209062 - DNA, 35 bp, Artificial Sequence
  Description of Artificial Sequence: Synthetic oligonucleotide
cctgttagtgggaaagggcttcattttctgtacag

SEQ ID NO: 209063 - DNA, 36 bp, Artificial Sequence
  Description of Artificial Sequence: Synthetic oligonucleotide
ctgttagtgggaaagggcttcattttctgtacagac

SEQ ID NO: 209064 - DNA, 36 bp, Artificial Sequence
  Description of Artificial Sequence: Synthetic oligonucleotide
tgttagtgggaaagggcttcattttctgtacagacc

SEQ ID NO: 209065 - DNA, 35 bp, Artificial Sequence
  Description of Artificial Sequence: Synthetic oligonucleotide
gttagtgggaaagggcttcattttctgtacagacc

SEQ ID NO: 209066 - DNA, 36 bp, Artificial Sequence
  Description of Artificial Sequence: Synthetic oligonucleotide
ttagtgggaaagggcttcattttctgtacagaccag

SEQ ID NO: 209067 - DNA, 35 bp, Artificial Sequence
  Description of Artificial Sequence: Synthetic oligonucleotide
tagtgggaaagggcttcattttctgtacagaccag

SEQ ID NO: 209068 - DNA, 34 bp, Artificial Sequence
  Description of Artificial Sequence: Synthetic oligonucleotide
agtgggaaagggcttcattttctgtacagaccag

SEQ ID NO: 209069 - DNA, 33 bp, Artificial Sequence
  Description of Artificial Sequence: Synthetic oligonucleotide
gtgggaaagggcttcattttctgtacagaccag

SEQ ID NO: 209070 - DNA, 33 bp, Artificial Sequence
  Description of Artificial Sequence: Synthetic oligonucleotide
tgggaaagggcttcattttctgtacagaccagg

SEQ ID NO: 209071 - DNA, 32 bp, Artificial Sequence
  Description of Artificial Sequence: Synthetic oligonucleotide
gggaaagggcttcattttctgtacagaccagg

SEQ ID NO: 209072 - DNA, 32 bp, Artificial Sequence
  Description of Artificial Sequence: Synthetic oligonucleotide
ggaaagggcttcattttctgtacagaccaggg

SEQ ID NO: 209073 - DNA, 35 bp, Artificial Sequence
  Description of Artificial Sequence: Synthetic oligonucleotide
gaaagggcttcattttctgtacagaccagggaatc

SEQ ID NO: 209074 - DNA, 36 bp, Artificial Sequence
  Description of Artificial Sequence: Synthetic oligonucleotide
aaagggcttcattttctgtacagaccagggaatctg

SEQ ID NO: 209075 - DNA, 35 bp, Artificial Sequence
  Description of Artificial Sequence: Synthetic oligonucleotide
aagggcttcattttctgtacagaccagggaatctg

SEQ ID NO: 209076 - DNA, 34 bp, Artificial Sequence
  Description of Artificial Sequence: Synthetic oligonucleotide
agggcttcattttctgtacagaccagggaatctg

SEQ ID NO: 209077 - DNA, 33 bp, Artificial Sequence
  Description of Artificial Sequence: Synthetic oligonucleotide
gggcttcattttctgtacagaccagggaatctg

SEQ ID NO: 209078 - DNA, 33 bp, Artificial Sequence
  Description of Artificial Sequence: Synthetic oligonucleotide
ggcttcattttctgtacagaccagggaatctgg

SEQ ID NO: 209079 - DNA, 34 bp, Artificial Sequence
  Description of Artificial Sequence: Synthetic oligonucleotide
gcttcattttctgtacagaccagggaatctggag

SEQ ID NO: 209080 - DNA, 34 bp, Artificial Sequence
  Description of Artificial Sequence: Synthetic oligonucleotide
cttcattttctgtacagaccagggaatctggagc

SEQ ID NO: 209081 - DNA, 34 bp, Artificial Sequence
  Description of Artificial Sequence: Synthetic oligonucleotide
ttcattttctgtacagaccagggaatctggagcc

SEQ ID NO: 209082 - DNA, 33 bp, Artificial Sequence
  Description of Artificial Sequence: Synthetic oligonucleotide
tcattttctgtacagaccagggaatctggagcc

SEQ ID NO: 209083 - DNA, 32 bp, Artificial Sequence
  Description of Artificial Sequence: Synthetic oligonucleotide
cattttctgtacagaccagggaatctggagcc

SEQ ID NO: 209084 - DNA, 36 bp, Artificial Sequence
  Description of Artificial Sequence: Synthetic oligonucleotide
attttctgtacagaccagggaatctggagccaattg

SEQ ID NO: 209085 - DNA, 35 bp, Artificial Sequence
  Description of Artificial Sequence: Synthetic oligonucleotide
ttttctgtacagaccagggaatctggagccaattg

SEQ ID NO: 209086 - DNA, 34 bp, Artificial Sequence
  Description of Artificial Sequence: Synthetic oligonucleotide
tttctgtacagaccagggaatctggagccaattg

SEQ ID NO: 209087 - DNA, 33 bp, Artificial Sequence
  Description of Artificial Sequence: Synthetic oligonucleotide
ttctgtacagaccagggaatctggagccaattg

SEQ ID NO: 209088 - DNA, 32 bp, Artificial Sequence
  Description of Artificial Sequence: Synthetic oligonucleotide
tctgtacagaccagggaatctggagccaattg

SEQ ID NO: 209089 - DNA, 31 bp, Artificial Sequence
  Description of Artificial Sequence: Synthetic oligonucleotide
ctgtacagaccagggaatctggagccaattg

SEQ ID NO: 209090 - DNA, 31 bp, Artificial Sequence
  Description of Artificial Sequence: Synthetic oligonucleotide
tgtacagaccagggaatctggagccaattgg

SEQ ID NO: 209091 - DNA, 30 bp, Artificial Sequence
  Description of Artificial Sequence: Synthetic oligonucleotide
gtacagaccagggaatctggagccaattgg

SEQ ID NO: 209092 - DNA, 32 bp, Artificial Sequence
  Description of Artificial Sequence: Synthetic oligonucleotide
tacagaccagggaatctggagccaattggatc

SEQ ID NO: 209093 - DNA, 31 bp, Artificial Sequence
  Description of Artificial Sequence: Synthetic oligonucleotide
acagaccagggaatctggagccaattggatc

SEQ ID NO: 209094 - DNA, 30 bp, Artificial Sequence
  Description of Artificial Sequence: Synthetic oligonucleotide
cagaccagggaatctggagccaattggatc

SEQ ID NO: 209095 - DNA, 36 bp, Artificial Sequence
  Description of Artificial Sequence: Synthetic oligonucleotide
agaccagggaatctggagccaattggatcattattg

SEQ ID NO: 209096 - DNA, 35 bp, Artificial Sequence
  Description of Artificial Sequence: Synthetic oligonucleotide
gaccagggaatctggagccaattggatcattattg

SEQ ID NO: 209097 - DNA, 35 bp, Artificial Sequence
  Description of Artificial Sequence: Synthetic oligonucleotide
accagggaatctggagccaattggatcattattgc

SEQ ID NO: 209098 - DNA, 34 bp, Artificial Sequence
  Description of Artificial Sequence: Synthetic oligonucleotide
ccagggaatctggagccaattggatcattattgc

SEQ ID NO: 209099 - DNA, 37 bp, Artificial Sequence
  Description of Artificial Sequence: Synthetic oligonucleotide
cagggaatctggagccaattggatcattattgcaaag

SEQ ID NO: 209100 - DNA, 39 bp, Artificial Sequence
  Description of Artificial Sequence: Synthetic oligonucleotide
agggaatctggagccaattggatcattattgcaaagaag

SEQ ID NO: 209101 - DNA, 38 bp, Artificial Sequence
  Description of Artificial Sequence: Synthetic oligonucleotide
gggaatctggagccaattggatcattattgcaaagaag

SEQ ID NO: 209102 - DNA, 44 bp, Artificial Sequence
  Description of Artificial Sequence: Synthetic oligonucleotide
ggaatctggagccaattggatcattattgcaaagaagtaaattg

SEQ ID NO: 209103 - DNA, 46 bp, Artificial Sequence
  Description of Artificial Sequence: Synthetic oligonucleotide
gaatctggagccaattggatcattattgcaaagaagtaaattgtag

SEQ ID NO: 209104 - DNA, 46 bp, Artificial Sequence
  Description of Artificial Sequence: Synthetic oligonucleotide
aatctggagccaattggatcattattgcaaagaagtaaattgtagc

SEQ ID NO: 209105 - DNA, 45 bp, Artificial Sequence
  Description of Artificial Sequence: Synthetic oligonucleotide
atctggagccaattggatcattattgcaaagaagtaaattgtagc

SEQ ID NO: 209106 - DNA, 44 bp, Artificial Sequence
  Description of Artificial Sequence: Synthetic oligonucleotide
tctggagccaattggatcattattgcaaagaagtaaattgtagc

SEQ ID NO: 209107 - DNA, 43 bp, Artificial Sequence
  Description of Artificial Sequence: Synthetic oligonucleotide
ctggagccaattggatcattattgcaaagaagtaaattgtagc

SEQ ID NO: 209108 - DNA, 45 bp, Artificial Sequence
  Description of Artificial Sequence: Synthetic oligonucleotide
tggagccaattggatcattattgcaaagaagtaaattgtagcttc

SEQ ID NO: 209109 - DNA, 44 bp, Artificial Sequence
  Description of Artificial Sequence: Synthetic oligonucleotide
ggagccaattggatcattattgcaaagaagtaaattgtagcttc

SEQ ID NO: 209110 - DNA, 44 bp, Artificial Sequence
  Description of Artificial Sequence: Synthetic oligonucleotide
gagccaattggatcattattgcaaagaagtaaattgtagcttcc

SEQ ID NO: 209111 - DNA, 44 bp, Artificial Sequence
  Description of Artificial Sequence: Synthetic oligonucleotide
agccaattggatcattattgcaaagaagtaaattgtagcttccc

SEQ ID NO: 209112 - DNA, 43 bp, Artificial Sequence
  Description of Artificial Sequence: Synthetic oligonucleotide
gccaattggatcattattgcaaagaagtaaattgtagcttccc

SEQ ID NO: 209113 - DNA, 44 bp, Artificial Sequence
  Description of Artificial Sequence: Synthetic oligonucleotide
ccaattggatcattattgcaaagaagtaaattgtagcttcccac

SEQ ID NO: 209114 - DNA, 45 bp, Artificial Sequence
  Description of Artificial Sequence: Synthetic oligonucleotide
caattggatcattattgcaaagaagtaaattgtagcttcccactg

SEQ ID NO: 209115 - DNA, 50 bp, Artificial Sequence
  Description of Artificial Sequence: Synthetic oligonucleotide
aattggatcattattgcaaagaagtaaattgtagcttcccactgtttatg

SEQ ID NO: 209116 - DNA, 49 bp, Artificial Sequence
  Description of Artificial Sequence: Synthetic oligonucleotide
attggatcattattgcaaagaagtaaattgtagcttcccactgtttatg

SEQ ID NO: 209117 - DNA, 48 bp, Artificial Sequence
  Description of Artificial Sequence: Synthetic oligonucleotide
ttggatcattattgcaaagaagtaaattgtagcttcccactgtttatg

SEQ ID NO: 209118 - DNA, 47 bp, Artificial Sequence
  Description of Artificial Sequence: Synthetic oligonucleotide
tggatcattattgcaaagaagtaaattgtagcttcccactgtttatg

SEQ ID NO: 209119 - DNA, 46 bp, Artificial Sequence
  Description of Artificial Sequence: Synthetic oligonucleotide
ggatcattattgcaaagaagtaaattgtagcttcccactgtttatg

SEQ ID NO: 209120 - DNA, 49 bp, Artificial Sequence
  Description of Artificial Sequence: Synthetic oligonucleotide
gatcattattgcaaagaagtaaattgtagcttcccactgtttatgaatg

SEQ ID NO: 209121 - DNA, 49 bp, Artificial Sequence
  Description of Artificial Sequence: Synthetic oligonucleotide
atcattattgcaaagaagtaaattgtagcttcccactgtttatgaatgg

SEQ ID NO: 209122 - DNA, 48 bp, Artificial Sequence
  Description of Artificial Sequence: Synthetic oligonucleotide
tcattattgcaaagaagtaaattgtagcttcccactgtttatgaatgg

SEQ ID NO: 209123 - DNA, 47 bp, Artificial Sequence
  Description of Artificial Sequence: Synthetic oligonucleotide
cattattgcaaagaagtaaattgtagcttcccactgtttatgaatgg

SEQ ID NO: 209124 - DNA, 50 bp, Artificial Sequence
  Description of Artificial Sequence: Synthetic oligonucleotide
attattgcaaagaagtaaattgtagcttcccactgtttatgaatggaatc

SEQ ID NO: 209125 - DNA, 49 bp, Artificial Sequence
  Description of Artificial Sequence: Synthetic oligonucleotide
ttattgcaaagaagtaaattgtagcttcccactgtttatgaatggaatc

SEQ ID NO: 209126 - DNA, 48 bp, Artificial Sequence
  Description of Artificial Sequence: Synthetic oligonucleotide
tattgcaaagaagtaaattgtagcttcccactgtttatgaatggaatc

SEQ ID NO: 209127 - DNA, 47 bp, Artificial Sequence
  Description of Artificial Sequence: Synthetic oligonucleotide
attgcaaagaagtaaattgtagcttcccactgtttatgaatggaatc

SEQ ID NO: 209128 - DNA, 46 bp, Artificial Sequence
  Description of Artificial Sequence: Synthetic oligonucleotide
ttgcaaagaagtaaattgtagcttcccactgtttatgaatggaatc

SEQ ID NO: 209129 - DNA, 45 bp, Artificial Sequence
  Description of Artificial Sequence: Synthetic oligonucleotide
tgcaaagaagtaaattgtagcttcccactgtttatgaatggaatc

SEQ ID NO: 209130 - DNA, 44 bp, Artificial Sequence
  Description of Artificial Sequence: Synthetic oligonucleotide
gcaaagaagtaaattgtagcttcccactgtttatgaatggaatc

SEQ ID NO: 209131 - DNA, 45 bp, Artificial Sequence
  Description of Artificial Sequence: Synthetic oligonucleotide
caaagaagtaaattgtagcttcccactgtttatgaatggaatctc

SEQ ID NO: 209132 - DNA, 45 bp, Artificial Sequence
  Description of Artificial Sequence: Synthetic oligonucleotide
aaagaagtaaattgtagcttcccactgtttatgaatggaatctcg

SEQ ID NO: 209133 - DNA, 44 bp, Artificial Sequence
  Description of Artificial Sequence: Synthetic oligonucleotide
aagaagtaaattgtagcttcccactgtttatgaatggaatctcg

SEQ ID NO: 209134 - DNA, 43 bp, Artificial Sequence
  Description of Artificial Sequence: Synthetic oligonucleotide
agaagtaaattgtagcttcccactgtttatgaatggaatctcg

SEQ ID NO: 209135 - DNA, 42 bp, Artificial Sequence
  Description of Artificial Sequence: Synthetic oligonucleotide
gaagtaaattgtagcttcccactgtttatgaatggaatctcg

SEQ ID NO: 209136 - DNA, 44 bp, Artificial Sequence
  Description of Artificial Sequence: Synthetic oligonucleotide
aagtaaattgtagcttcccactgtttatgaatggaatctcgaag

SEQ ID NO: 209137 - DNA, 43 bp, Artificial Sequence
  Description of Artificial Sequence: Synthetic oligonucleotide
agtaaattgtagcttcccactgtttatgaatggaatctcgaag

SEQ ID NO: 209138 - DNA, 42 bp, Artificial Sequence
  Description of Artificial Sequence: Synthetic oligonucleotide
gtaaattgtagcttcccactgtttatgaatggaatctcgaag

SEQ ID NO: 209139 - DNA, 42 bp, Artificial Sequence
  Description of Artificial Sequence: Synthetic oligonucleotide
taaattgtagcttcccactgtttatgaatggaatctcgaagg

SEQ ID NO: 209140 - DNA, 41 bp, Artificial Sequence
  Description of Artificial Sequence: Synthetic oligonucleotide
aaattgtagcttcccactgtttatgaatggaatctcgaagg

SEQ ID NO: 209141 - DNA, 40 bp, Artificial Sequence
  Description of Artificial Sequence: Synthetic oligonucleotide
aattgtagcttcccactgtttatgaatggaatctcgaagg

SEQ ID NO: 209142 - DNA, 39 bp, Artificial Sequence
  Description of Artificial Sequence: Synthetic oligonucleotide
attgtagcttcccactgtttatgaatggaatctcgaagg

SEQ ID NO: 209143 - DNA, 38 bp, Artificial Sequence
  Description of Artificial Sequence: Synthetic oligonucleotide
ttgtagcttcccactgtttatgaatggaatctcgaagg

SEQ ID NO: 209144 - DNA, 37 bp, Artificial Sequence
  Description of Artificial Sequence: Synthetic oligonucleotide
tgtagcttcccactgtttatgaatggaatctcgaagg

SEQ ID NO: 209145 - DNA, 36 bp, Artificial Sequence
  Description of Artificial Sequence: Synthetic oligonucleotide
gtagcttcccactgtttatgaatggaatctcgaagg

SEQ ID NO: 209146 - DNA, 37 bp, Artificial Sequence
  Description of Artificial Sequence: Synthetic oligonucleotide
tagcttcccactgtttatgaatggaatctcgaaggag

SEQ ID NO: 209147 - DNA, 36 bp, Artificial Sequence
  Description of Artificial Sequence: Synthetic oligonucleotide
agcttcccactgtttatgaatggaatctcgaaggag

SEQ ID NO: 209148 - DNA, 35 bp, Artificial Sequence
  Description of Artificial Sequence: Synthetic oligonucleotide
gcttcccactgtttatgaatggaatctcgaaggag

SEQ ID NO: 209149 - DNA, 38 bp, Artificial Sequence
  Description of Artificial Sequence: Synthetic oligonucleotide
cttcccactgtttatgaatggaatctcgaaggagttag

SEQ ID NO: 209150 - DNA, 42 bp, Artificial Sequence
  Description of Artificial Sequence: Synthetic oligonucleotide
ttcccactgtttatgaatggaatctcgaaggagttagaaatg

SEQ ID NO: 209151 - DNA, 41 bp, Artificial Sequence
  Description of Artificial Sequence: Synthetic oligonucleotide
tcccactgtttatgaatggaatctcgaaggagttagaaatg

SEQ ID NO: 209152 - DNA, 40 bp, Artificial Sequence
  Description of Artificial Sequence: Synthetic oligonucleotide
cccactgtttatgaatggaatctcgaaggagttagaaatg

SEQ ID NO: 209153 - DNA, 46 bp, Artificial Sequence
  Description of Artificial Sequence: Synthetic oligonucleotide
ccactgtttatgaatggaatctcgaaggagttagaaatgaaaaaag

SEQ ID NO: 209154 - DNA, 51 bp, Artificial Sequence
  Description of Artificial Sequence: Synthetic oligonucleotide
cactgtttatgaatggaatctcgaaggagttagaaatgaaaaaagtatatc

SEQ ID NO: 209155 - DNA, 52 bp, Artificial Sequence
  Description of Artificial Sequence: Synthetic oligonucleotide
actgtttatgaatggaatctcgaaggagttagaaatgaaaaaagtatatcac

SEQ ID NO: 209156 - DNA, 51 bp, Artificial Sequence
  Description of Artificial Sequence: Synthetic oligonucleotide
ctgtttatgaatggaatctcgaaggagttagaaatgaaaaaagtatatcac

SEQ ID NO: 209157 - DNA, 54 bp, Artificial Sequence
  Description of Artificial Sequence: Synthetic oligonucleotide
tgtttatgaatggaatctcgaaggagttagaaatgaaaaaagtatatcactatg

SEQ ID NO: 209158 - DNA, 53 bp, Artificial Sequence
  Description of Artificial Sequence: Synthetic oligonucleotide
gtttatgaatggaatctcgaaggagttagaaatgaaaaaagtatatcactatg

SEQ ID NO: 209159 - DNA, 53 bp, Artificial Sequence
  Description of Artificial Sequence: Synthetic oligonucleotide
tttatgaatggaatctcgaaggagttagaaatgaaaaaagtatatcactatgg

SEQ ID NO: 209160 - DNA, 52 bp, Artificial Sequence
  Description of Artificial Sequence: Synthetic oligonucleotide
ttatgaatggaatctcgaaggagttagaaatgaaaaaagtatatcactatgg

SEQ ID NO: 209161 - DNA, 51 bp, Artificial Sequence
  Description of Artificial Sequence: Synthetic oligonucleotide
tatgaatggaatctcgaaggagttagaaatgaaaaaagtatatcactatgg

SEQ ID NO: 209162 - DNA, 50 bp, Artificial Sequence
  Description of Artificial Sequence: Synthetic oligonucleotide
atgaatggaatctcgaaggagttagaaatgaaaaaagtatatcactatgg

SEQ ID NO: 209163 - DNA, 49 bp, Artificial Sequence
  Description of Artificial Sequence: Synthetic oligonucleotide
tgaatggaatctcgaaggagttagaaatgaaaaaagtatatcactatgg

SEQ ID NO: 209164 - DNA, 48 bp, Artificial Sequence
  Description of Artificial Sequence: Synthetic oligonucleotide
gaatggaatctcgaaggagttagaaatgaaaaaagtatatcactatgg

SEQ ID NO: 209165 - DNA, 49 bp, Artificial Sequence
  Description of Artificial Sequence: Synthetic oligonucleotide
aatggaatctcgaaggagttagaaatgaaaaaagtatatcactatggag

SEQ ID NO: 209166 - DNA, 48 bp, Artificial Sequence
  Description of Artificial Sequence: Synthetic oligonucleotide
atggaatctcgaaggagttagaaatgaaaaaagtatatcactatggag

SEQ ID NO: 209167 - DNA, 47 bp, Artificial Sequence
  Description of Artificial Sequence: Synthetic oligonucleotide
tggaatctcgaaggagttagaaatgaaaaaagtatatcactatggag

SEQ ID NO: 209168 - DNA, 46 bp, Artificial Sequence
  Description of Artificial Sequence: Synthetic oligonucleotide
ggaatctcgaaggagttagaaatgaaaaaagtatatcactatggag

SEQ ID NO: 209169 - DNA, 51 bp, Artificial Sequence
  Description of Artificial Sequence: Synthetic oligonucleotide
gaatctcgaaggagttagaaatgaaaaaagtatatcactatggagattatg

SEQ ID NO: 209170 - DNA, 52 bp, Artificial Sequence
  Description of Artificial Sequence: Synthetic oligonucleotide
aatctcgaaggagttagaaatgaaaaaagtatatcactatggagattatgtg

SEQ ID NO: 209171 - DNA, 51 bp, Artificial Sequence
  Description of Artificial Sequence: Synthetic oligonucleotide
atctcgaaggagttagaaatgaaaaaagtatatcactatggagattatgtg

SEQ ID NO: 209172 - DNA, 50 bp, Artificial Sequence
  Description of Artificial Sequence: Synthetic oligonucleotide
tctcgaaggagttagaaatgaaaaaagtatatcactatggagattatgtg

SEQ ID NO: 209173 - DNA, 49 bp, Artificial Sequence
  Description of Artificial Sequence: Synthetic oligonucleotide
ctcgaaggagttagaaatgaaaaaagtatatcactatggagattatgtg

SEQ ID NO: 209174 - DNA, 50 bp, Artificial Sequence
  Description of Artificial Sequence: Synthetic oligonucleotide
tcgaaggagttagaaatgaaaaaagtatatcactatggagattatgtgac

SEQ ID NO: 209175 - DNA, 49 bp, Artificial Sequence
  Description of Artificial Sequence: Synthetic oligonucleotide
cgaaggagttagaaatgaaaaaagtatatcactatggagattatgtgac

SEQ ID NO: 209176 - DNA, 52 bp, Artificial Sequence
  Description of Artificial Sequence: Synthetic oligonucleotide
gaaggagttagaaatgaaaaaagtatatcactatggagattatgtgactttg

SEQ ID NO: 209177 - DNA, 54 bp, Artificial Sequence
  Description of Artificial Sequence: Synthetic oligonucleotide
aaggagttagaaatgaaaaaagtatatcactatggagattatgtgactttgaag

SEQ ID NO: 209178 - DNA, 53 bp, Artificial Sequence
  Description of Artificial Sequence: Synthetic oligonucleotide
aggagttagaaatgaaaaaagtatatcactatggagattatgtgactttgaag

SEQ ID NO: 209179 - DNA, 52 bp, Artificial Sequence
  Description of Artificial Sequence: Synthetic oligonucleotide
ggagttagaaatgaaaaaagtatatcactatggagattatgtgactttgaag

SEQ ID NO: 209180 - DNA, 53 bp, Artificial Sequence
  Description of Artificial Sequence: Synthetic oligonucleotide
gagttagaaatgaaaaaagtatatcactatggagattatgtgactttgaagtg

SEQ ID NO: 209181 - DNA, 54 bp, Artificial Sequence
  Description of Artificial Sequence: Synthetic oligonucleotide
agttagaaatgaaaaaagtatatcactatggagattatgtgactttgaagtgtg

SEQ ID NO: 209182 - DNA, 53 bp, Artificial Sequence
  Description of Artificial Sequence: Synthetic oligonucleotide
gttagaaatgaaaaaagtatatcactatggagattatgtgactttgaagtgtg

SEQ ID NO: 209183 - DNA, 55 bp, Artificial Sequence
  Description of Artificial Sequence: Synthetic oligonucleotide
ttagaaatgaaaaaagtatatcactatggagattatgtgactttgaagtgtgaag

SEQ ID NO: 209184 - DNA, 54 bp, Artificial Sequence
  Description of Artificial Sequence: Synthetic oligonucleotide
tagaaatgaaaaaagtatatcactatggagattatgtgactttgaagtgtgaag

SEQ ID NO: 209185 - DNA, 53 bp, Artificial Sequence
  Description of Artificial Sequence: Synthetic oligonucleotide
agaaatgaaaaaagtatatcactatggagattatgtgactttgaagtgtgaag

SEQ ID NO: 209186 - DNA, 52 bp, Artificial Sequence
  Description of Artificial Sequence: Synthetic oligonucleotide
gaaatgaaaaaagtatatcactatggagattatgtgactttgaagtgtgaag

SEQ ID NO: 209187 - DNA, 54 bp, Artificial Sequence
  Description of Artificial Sequence: Synthetic oligonucleotide
aaatgaaaaaagtatatcactatggagattatgtgactttgaagtgtgaagatg

SEQ ID NO: 209188 - DNA, 53 bp, Artificial Sequence
  Description of Artificial Sequence: Synthetic oligonucleotide
aatgaaaaaagtatatcactatggagattatgtgactttgaagtgtgaagatg

SEQ ID NO: 209189 - DNA, 52 bp, Artificial Sequence
  Description of Artificial Sequence: Synthetic oligonucleotide
atgaaaaaagtatatcactatggagattatgtgactttgaagtgtgaagatg

SEQ ID NO: 209190 - DNA, 51 bp, Artificial Sequence
  Description of Artificial Sequence: Synthetic oligonucleotide
tgaaaaaagtatatcactatggagattatgtgactttgaagtgtgaagatg

SEQ ID NO: 209191 - DNA, 50 bp, Artificial Sequence
  Description of Artificial Sequence: Synthetic oligonucleotide
gaaaaaagtatatcactatggagattatgtgactttgaagtgtgaagatg

SEQ ID NO: 209192 - DNA, 50 bp, Artificial Sequence
  Description of Artificial Sequence: Synthetic oligonucleotide
aaaaaagtatatcactatggagattatgtgactttgaagtgtgaagatgg

SEQ ID NO: 209193 - DNA, 49 bp, Artificial Sequence
  Description of Artificial Sequence: Synthetic oligonucleotide
aaaaagtatatcactatggagattatgtgactttgaagtgtgaagatgg

SEQ ID NO: 209194 - DNA, 48 bp, Artificial Sequence
  Description of Artificial Sequence: Synthetic oligonucleotide
aaaagtatatcactatggagattatgtgactttgaagtgtgaagatgg

SEQ ID NO: 209195 - DNA, 47 bp, Artificial Sequence
  Description of Artificial Sequence: Synthetic oligonucleotide
aaagtatatcactatggagattatgtgactttgaagtgtgaagatgg

SEQ ID NO: 209196 - DNA, 46 bp, Artificial Sequence
  Description of Artificial Sequence: Synthetic oligonucleotide
aagtatatcactatggagattatgtgactttgaagtgtgaagatgg

SEQ ID NO: 209197 - DNA, 45 bp, Artificial Sequence
  Description of Artificial Sequence: Synthetic oligonucleotide
agtatatcactatggagattatgtgactttgaagtgtgaagatgg

SEQ ID NO: 209198 - DNA, 44 bp, Artificial Sequence
  Description of Artificial Sequence: Synthetic oligonucleotide
gtatatcactatggagattatgtgactttgaagtgtgaagatgg

SEQ ID NO: 209199 - DNA, 44 bp, Artificial Sequence
  Description of Artificial Sequence: Synthetic oligonucleotide
tatatcactatggagattatgtgactttgaagtgtgaagatggg

SEQ ID NO: 209200 - DNA, 43 bp, Artificial Sequence
  Description of Artificial Sequence: Synthetic oligonucleotide
atatcactatggagattatgtgactttgaagtgtgaagatggg

SEQ ID NO: 209201 - DNA, 42 bp, Artificial Sequence
  Description of Artificial Sequence: Synthetic oligonucleotide
tatcactatggagattatgtgactttgaagtgtgaagatggg

SEQ ID NO: 209202 - DNA, 41 bp, Artificial Sequence
  Description of Artificial Sequence: Synthetic oligonucleotide
atcactatggagattatgtgactttgaagtgtgaagatggg

SEQ ID NO: 209203 - DNA, 40 bp, Artificial Sequence
  Description of Artificial Sequence: Synthetic oligonucleotide
tcactatggagattatgtgactttgaagtgtgaagatggg

SEQ ID NO: 209204 - DNA, 39 bp, Artificial Sequence
  Description of Artificial Sequence: Synthetic oligonucleotide
cactatggagattatgtgactttgaagtgtgaagatggg

SEQ ID NO: 209205 - DNA, 43 bp, Artificial Sequence
  Description of Artificial Sequence: Synthetic oligonucleotide
actatggagattatgtgactttgaagtgtgaagatgggtatac

SEQ ID NO: 209206 - DNA, 42 bp, Artificial Sequence
  Description of Artificial Sequence: Synthetic oligonucleotide
ctatggagattatgtgactttgaagtgtgaagatgggtatac

SEQ ID NO: 209207 - DNA, 43 bp, Artificial Sequence
  Description of Artificial Sequence: Synthetic oligonucleotide
tatggagattatgtgactttgaagtgtgaagatgggtatactc

SEQ ID NO: 209208 - DNA, 42 bp, Artificial Sequence
  Description of Artificial Sequence: Synthetic oligonucleotide
atggagattatgtgactttgaagtgtgaagatgggtatactc

SEQ ID NO: 209209 - DNA, 41 bp, Artificial Sequence
  Description of Artificial Sequence: Synthetic oligonucleotide
tggagattatgtgactttgaagtgtgaagatgggtatactc

SEQ ID NO: 209210 - DNA, 40 bp, Artificial Sequence
  Description of Artificial Sequence: Synthetic oligonucleotide
ggagattatgtgactttgaagtgtgaagatgggtatactc

SEQ ID NO: 209211 - DNA, 41 bp, Artificial Sequence
  Description of Artificial Sequence: Synthetic oligonucleotide
gagattatgtgactttgaagtgtgaagatgggtatactctg

SEQ ID NO: 209212 - DNA, 41 bp, Artificial Sequence
  Description of Artificial Sequence: Synthetic oligonucleotide
agattatgtgactttgaagtgtgaagatgggtatactctgg

SEQ ID NO: 209213 - DNA, 40 bp, Artificial Sequence
  Description of Artificial Sequence: Synthetic oligonucleotide
gattatgtgactttgaagtgtgaagatgggtatactctgg

SEQ ID NO: 209214 - DNA, 42 bp, Artificial Sequence
  Description of Artificial Sequence: Synthetic oligonucleotide
attatgtgactttgaagtgtgaagatgggtatactctggaag

SEQ ID NO: 209215 - DNA, 41 bp, Artificial Sequence
  Description of Artificial Sequence: Synthetic oligonucleotide
ttatgtgactttgaagtgtgaagatgggtatactctggaag

SEQ ID NO: 209216 - DNA, 40 bp, Artificial Sequence
  Description of Artificial Sequence: Synthetic oligonucleotide
tatgtgactttgaagtgtgaagatgggtatactctggaag

SEQ ID NO: 209217 - DNA, 39 bp, Artificial Sequence
  Description of Artificial Sequence: Synthetic oligonucleotide
atgtgactttgaagtgtgaagatgggtatactctggaag

SEQ ID NO: 209218 - DNA, 38 bp, Artificial Sequence
  Description of Artificial Sequence: Synthetic oligonucleotide
tgtgactttgaagtgtgaagatgggtatactctggaag

SEQ ID NO: 209219 - DNA, 37 bp, Artificial Sequence
  Description of Artificial Sequence: Synthetic oligonucleotide
gtgactttgaagtgtgaagatgggtatactctggaag

SEQ ID NO: 209220 - DNA, 37 bp, Artificial Sequence
  Description of Artificial Sequence: Synthetic oligonucleotide
tgactttgaagtgtgaagatgggtatactctggaagg

SEQ ID NO: 209221 - DNA, 36 bp, Artificial Sequence
  Description of Artificial Sequence: Synthetic oligonucleotide
gactttgaagtgtgaagatgggtatactctggaagg

SEQ ID NO: 209222 - DNA, 36 bp, Artificial Sequence
  Description of Artificial Sequence: Synthetic oligonucleotide
actttgaagtgtgaagatgggtatactctggaaggc

SEQ ID NO: 209223 - DNA, 35 bp, Artificial Sequence
  Description of Artificial Sequence: Synthetic oligonucleotide
ctttgaagtgtgaagatgggtatactctggaaggc

SEQ ID NO: 209224 - DNA, 36 bp, Artificial Sequence
  Description of Artificial Sequence: Synthetic oligonucleotide
tttgaagtgtgaagatgggtatactctggaaggcag

SEQ ID NO: 209225 - DNA, 35 bp, Artificial Sequence
  Description of Artificial Sequence: Synthetic oligonucleotide
ttgaagtgtgaagatgggtatactctggaaggcag

SEQ ID NO: 209226 - DNA, 34 bp, Artificial Sequence
  Description of Artificial Sequence: Synthetic oligonucleotide
tgaagtgtgaagatgggtatactctggaaggcag

SEQ ID NO: 209227 - DNA, 33 bp, Artificial Sequence
  Description of Artificial Sequence: Synthetic oligonucleotide
gaagtgtgaagatgggtatactctggaaggcag

SEQ ID NO: 209228 - DNA, 34 bp, Artificial Sequence
  Description of Artificial Sequence: Synthetic oligonucleotide
aagtgtgaagatgggtatactctggaaggcagtc

SEQ ID NO: 209229 - DNA, 33 bp, Artificial Sequence
  Description of Artificial Sequence: Synthetic oligonucleotide
agtgtgaagatgggtatactctggaaggcagtc

SEQ ID NO: 209230 - DNA, 32 bp, Artificial Sequence
  Description of Artificial Sequence: Synthetic oligonucleotide
gtgtgaagatgggtatactctggaaggcagtc

SEQ ID NO: 209231 - DNA, 32 bp, Artificial Sequence
  Description of Artificial Sequence: Synthetic oligonucleotide
tgtgaagatgggtatactctggaaggcagtcc

SEQ ID NO: 209232 - DNA, 31 bp, Artificial Sequence
  Description of Artificial Sequence: Synthetic oligonucleotide
gtgaagatgggtatactctggaaggcagtcc

SEQ ID NO: 209233 - DNA, 31 bp, Artificial Sequence
  Description of Artificial Sequence: Synthetic oligonucleotide
tgaagatgggtatactctggaaggcagtccc

SEQ ID NO: 209234 - DNA, 30 bp, Artificial Sequence
  Description of Artificial Sequence: Synthetic oligonucleotide
gaagatgggtatactctggaaggcagtccc

SEQ ID NO: 209235 - DNA, 31 bp, Artificial Sequence
  Description of Artificial Sequence: Synthetic oligonucleotide
aagatgggtatactctggaaggcagtccctg

SEQ ID NO: 209236 - DNA, 30 bp, Artificial Sequence
  Description of Artificial Sequence: Synthetic oligonucleotide
agatgggtatactctggaaggcagtccctg

SEQ ID NO: 209237 - DNA, 29 bp, Artificial Sequence
  Description of Artificial Sequence: Synthetic oligonucleotide
gatgggtatactctggaaggcagtccctg

SEQ ID NO: 209238 - DNA, 29 bp, Artificial Sequence
  Description of Artificial Sequence: Synthetic oligonucleotide
atgggtatactctggaaggcagtccctgg

SEQ ID NO: 209239 - DNA, 28 bp, Artificial Sequence
  Description of Artificial Sequence: Synthetic oligonucleotide
tgggtatactctggaaggcagtccctgg

SEQ ID NO: 209240 - DNA, 27 bp, Artificial Sequence
  Description of Artificial Sequence: Synthetic oligonucleotide
gggtatactctggaaggcagtccctgg

SEQ ID NO: 209241 - DNA, 28 bp, Artificial Sequence
  Description of Artificial Sequence: Synthetic oligonucleotide
ggtatactctggaaggcagtccctggag

SEQ ID NO: 209242 - DNA, 28 bp, Artificial Sequence
  Description of Artificial Sequence: Synthetic oligonucleotide
gtatactctggaaggcagtccctggagc

SEQ ID NO: 209243 - DNA, 28 bp, Artificial Sequence
  Description of Artificial Sequence: Synthetic oligonucleotide
tatactctggaaggcagtccctggagcc

SEQ ID NO: 209244 - DNA, 27 bp, Artificial Sequence
  Description of Artificial Sequence: Synthetic oligonucleotide
atactctggaaggcagtccctggagcc

SEQ ID NO: 209245 - DNA, 27 bp, Artificial Sequence
  Description of Artificial Sequence: Synthetic oligonucleotide
tactctggaaggcagtccctggagcca

SEQ ID NO: 209246 - DNA, 26 bp, Artificial Sequence
  Description of Artificial Sequence: Synthetic oligonucleotide
actctggaaggcagtccctggagcca

SEQ ID NO: 209247 - DNA, 25 bp, Artificial Sequence
  Description of Artificial Sequence: Synthetic oligonucleotide
ctctggaaggcagtccctggagcca

SEQ ID NO: 209248 - DNA, 26 bp, Artificial Sequence
  Description of Artificial Sequence: Synthetic oligonucleotide
tctggaaggcagtccctggagccagt

SEQ ID NO: 209249 - DNA, 25 bp, Artificial Sequence
  Description of Artificial Sequence: Synthetic oligonucleotide
ctggaaggcagtccctggagccagt

SEQ ID NO: 209250 - DNA, 25 bp, Artificial Sequence
  Description of Artificial Sequence: Synthetic oligonucleotide
tggaaggcagtccctggagccagtg

SEQ ID NO: 209251 - DNA, 24 bp, Artificial Sequence
  Description of Artificial Sequence: Synthetic oligonucleotide
ggaaggcagtccctggagccagtg

SEQ ID NO: 209252 - DNA, 24 bp, Artificial Sequence
  Description of Artificial Sequence: Synthetic oligonucleotide
gaaggcagtccctggagccagtgc

SEQ ID NO: 209253 - DNA, 25 bp, Artificial Sequence
  Description of Artificial Sequence: Synthetic oligonucleotide
aaggcagtccctggagccagtgcca

SEQ ID NO: 209254 - DNA, 24 bp, Artificial Sequence
  Description of Artificial Sequence: Synthetic oligonucleotide
aggcagtccctggagccagtgcca

SEQ ID NO: 209255 - DNA, 23 bp, Artificial Sequence
  Description of Artificial Sequence: Synthetic oligonucleotide
ggcagtccctggagccagtgcca

SEQ ID NO: 209256 - DNA, 23 bp, Artificial Sequence
  Description of Artificial Sequence: Synthetic oligonucleotide
gcagtccctggagccagtgccag

SEQ ID NO: 209257 - DNA, 23 bp, Artificial Sequence
  Description of Artificial Sequence: Synthetic oligonucleotide
cagtccctggagccagtgccagg

SEQ ID NO: 209258 - DNA, 23 bp, Artificial Sequence
  Description of Artificial Sequence: Synthetic oligonucleotide
agtccctggagccagtgccaggc

SEQ ID NO: 209259 - DNA, 22 bp, Artificial Sequence
  Description of Artificial Sequence: Synthetic oligonucleotide
gtccctggagccagtgccaggc

SEQ ID NO: 209260 - DNA, 22 bp, Artificial Sequence
  Description of Artificial Sequence: Synthetic oligonucleotide
tccctggagccagtgccaggcg

SEQ ID NO: 209261 - DNA, 21 bp, Artificial Sequence
  Description of Artificial Sequence: Synthetic oligonucleotide
ccctggagccagtgccaggcg

SEQ ID NO: 209262 - DNA, 23 bp, Artificial Sequence
  Description of Artificial Sequence: Synthetic oligonucleotide
cctggagccagtgccaggcggat

SEQ ID NO: 209263 - DNA, 24 bp, Artificial Sequence
  Description of Artificial Sequence: Synthetic oligonucleotide
ctggagccagtgccaggcggatga

SEQ ID NO: 209264 - DNA, 25 bp, Artificial Sequence
  Description of Artificial Sequence: Synthetic oligonucleotide
tggagccagtgccaggcggatgaca

SEQ ID NO: 209265 - DNA, 24 bp, Artificial Sequence
  Description of Artificial Sequence: Synthetic oligonucleotide
ggagccagtgccaggcggatgaca

SEQ ID NO: 209266 - DNA, 26 bp, Artificial Sequence
  Description of Artificial Sequence: Synthetic oligonucleotide
gagccagtgccaggcggatgacagat

SEQ ID NO: 209267 - DNA, 26 bp, Artificial Sequence
  Description of Artificial Sequence: Synthetic oligonucleotide
agccagtgccaggcggatgacagatg

SEQ ID NO: 209268 - DNA, 25 bp, Artificial Sequence
  Description of Artificial Sequence: Synthetic oligonucleotide
gccagtgccaggcggatgacagatg

SEQ ID NO: 209269 - DNA, 25 bp, Artificial Sequence
  Description of Artificial Sequence: Synthetic oligonucleotide
ccagtgccaggcggatgacagatgg

SEQ ID NO: 209270 - DNA, 26 bp, Artificial Sequence
  Description of Artificial Sequence: Synthetic oligonucleotide
cagtgccaggcggatgacagatggga

SEQ ID NO: 209271 - DNA, 26 bp, Artificial Sequence
  Description of Artificial Sequence: Synthetic oligonucleotide
agtgccaggcggatgacagatgggac

SEQ ID NO: 209272 - DNA, 25 bp, Artificial Sequence
  Description of Artificial Sequence: Synthetic oligonucleotide
gtgccaggcggatgacagatgggac

SEQ ID NO: 209273 - DNA, 25 bp, Artificial Sequence
  Description of Artificial Sequence: Synthetic oligonucleotide
tgccaggcggatgacagatgggacc

SEQ ID NO: 209274 - DNA, 24 bp, Artificial Sequence
  Description of Artificial Sequence: Synthetic oligonucleotide
gccaggcggatgacagatgggacc

SEQ ID NO: 209275 - DNA, 25 bp, Artificial Sequence
  Description of Artificial Sequence: Synthetic oligonucleotide
ccaggcggatgacagatgggaccct

SEQ ID NO: 209276 - DNA, 25 bp, Artificial Sequence
  Description of Artificial Sequence: Synthetic oligonucleotide
caggcggatgacagatgggaccctc

SEQ ID NO: 209277 - DNA, 26 bp, Artificial Sequence
  Description of Artificial Sequence: Synthetic oligonucleotide
aggcggatgacagatgggaccctcct

SEQ ID NO: 209278 - DNA, 25 bp, Artificial Sequence
  Description of Artificial Sequence: Synthetic oligonucleotide
ggcggatgacagatgggaccctcct

SEQ ID NO: 209279 - DNA, 26 bp, Artificial Sequence
  Description of Artificial Sequence: Synthetic oligonucleotide
gcggatgacagatgggaccctcctct

SEQ ID NO: 209280 - DNA, 26 bp, Artificial Sequence
  Description of Artificial Sequence: Synthetic oligonucleotide
cggatgacagatgggaccctcctctg

SEQ ID NO: 209281 - DNA, 26 bp, Artificial Sequence
  Description of Artificial Sequence: Synthetic oligonucleotide
ggatgacagatgggaccctcctctgg

SEQ ID NO: 209282 - DNA, 26 bp, Artificial Sequence
  Description of Artificial Sequence: Synthetic oligonucleotide
gatgacagatgggaccctcctctggc

SEQ ID NO: 209283 - DNA, 27 bp, Artificial Sequence
  Description of Artificial Sequence: Synthetic oligonucleotide
atgacagatgggaccctcctctggcca

SEQ ID NO: 209284 - DNA, 27 bp, Artificial Sequence
  Description of Artificial Sequence: Synthetic oligonucleotide
tgacagatgggaccctcctctggccaa

SEQ ID NO: 209285 - DNA, 27 bp, Artificial Sequence
  Description of Artificial Sequence: Synthetic oligonucleotide
gacagatgggaccctcctctggccaaa

SEQ ID NO: 209286 - DNA, 28 bp, Artificial Sequence
  Description of Artificial Sequence: Synthetic oligonucleotide
acagatgggaccctcctctggccaaatg

SEQ ID NO: 209287 - DNA, 27 bp, Artificial Sequence
  Description of Artificial Sequence: Synthetic oligonucleotide
cagatgggaccctcctctggccaaatg

SEQ ID NO: 209288 - DNA, 29 bp, Artificial Sequence
  Description of Artificial Sequence: Synthetic oligonucleotide
agatgggaccctcctctggccaaatgtac

SEQ ID NO: 209289 - DNA, 28 bp, Artificial Sequence
  Description of Artificial Sequence: Synthetic oligonucleotide
gatgggaccctcctctggccaaatgtac

SEQ ID NO: 209290 - DNA, 28 bp, Artificial Sequence
  Description of Artificial Sequence: Synthetic oligonucleotide
atgggaccctcctctggccaaatgtacc

SEQ ID NO: 209291 - DNA, 27 bp, Artificial Sequence
  Description of Artificial Sequence: Synthetic oligonucleotide
tgggaccctcctctggccaaatgtacc

SEQ ID NO: 209292 - DNA, 27 bp, Artificial Sequence
  Description of Artificial Sequence: Synthetic oligonucleotide
gggaccctcctctggccaaatgtacct

SEQ ID NO: 209293 - DNA, 27 bp, Artificial Sequence
  Description of Artificial Sequence: Synthetic oligonucleotide
ggaccctcctctggccaaatgtacctc

SEQ ID NO: 209294 - DNA, 28 bp, Artificial Sequence
  Description of Artificial Sequence: Synthetic oligonucleotide
gaccctcctctggccaaatgtacctctc

SEQ ID NO: 209295 - DNA, 28 bp, Artificial Sequence
  Description of Artificial Sequence: Synthetic oligonucleotide
accctcctctggccaaatgtacctctcg

SEQ ID NO: 209296 - DNA, 27 bp, Artificial Sequence
  Description of Artificial Sequence: Synthetic oligonucleotide
ccctcctctggccaaatgtacctctcg

SEQ ID NO: 209297 - DNA, 29 bp, Artificial Sequence
  Description of Artificial Sequence: Synthetic oligonucleotide
cctcctctggccaaatgtacctctcgtac

SEQ ID NO: 209298 - DNA, 30 bp, Artificial Sequence
  Description of Artificial Sequence: Synthetic oligonucleotide
ctcctctggccaaatgtacctctcgtacac

SEQ ID NO: 209299 - DNA, 32 bp, Artificial Sequence
  Description of Artificial Sequence: Synthetic oligonucleotide
tcctctggccaaatgtacctctcgtacacatg

SEQ ID NO: 209300 - DNA, 31 bp, Artificial Sequence
  Description of Artificial Sequence: Synthetic oligonucleotide
cctctggccaaatgtacctctcgtacacatg

SEQ ID NO: 209301 - DNA, 33 bp, Artificial Sequence
  Description of Artificial Sequence: Synthetic oligonucleotide
ctctggccaaatgtacctctcgtacacatgatg

SEQ ID NO: 209302 - DNA, 33 bp, Artificial Sequence
  Description of Artificial Sequence: Synthetic oligonucleotide
tctggccaaatgtacctctcgtacacatgatgc

SEQ ID NO: 209303 - DNA, 32 bp, Artificial Sequence
  Description of Artificial Sequence: Synthetic oligonucleotide
ctggccaaatgtacctctcgtacacatgatgc

SEQ ID NO: 209304 - DNA, 33 bp, Artificial Sequence
  Description of Artificial Sequence: Synthetic oligonucleotide
tggccaaatgtacctctcgtacacatgatgctc

SEQ ID NO: 209305 - DNA, 32 bp, Artificial Sequence
  Description of Artificial Sequence: Synthetic oligonucleotide
ggccaaatgtacctctcgtacacatgatgctc

SEQ ID NO: 209306 - DNA, 33 bp, Artificial Sequence
  Description of Artificial Sequence: Synthetic oligonucleotide
gccaaatgtacctctcgtacacatgatgctctc

SEQ ID NO: 209307 - DNA, 36 bp, Artificial Sequence
  Description of Artificial Sequence: Synthetic oligonucleotide
ccaaatgtacctctcgtacacatgatgctctcatag

SEQ ID NO: 209308 - DNA, 38 bp, Artificial Sequence
  Description of Artificial Sequence: Synthetic oligonucleotide
caaatgtacctctcgtacacatgatgctctcatagttg

SEQ ID NO: 209309 - DNA, 38 bp, Artificial Sequence
  Description of Artificial Sequence: Synthetic oligonucleotide
aaatgtacctctcgtacacatgatgctctcatagttgg

SEQ ID NO: 209310 - DNA, 37 bp, Artificial Sequence
  Description of Artificial Sequence: Synthetic oligonucleotide
aatgtacctctcgtacacatgatgctctcatagttgg

SEQ ID NO: 209311 - DNA, 36 bp, Artificial Sequence
  Description of Artificial Sequence: Synthetic oligonucleotide
atgtacctctcgtacacatgatgctctcatagttgg

SEQ ID NO: 209312 - DNA, 35 bp, Artificial Sequence
  Description of Artificial Sequence: Synthetic oligonucleotide
tgtacctctcgtacacatgatgctctcatagttgg

SEQ ID NO: 209313 - DNA, 34 bp, Artificial Sequence
  Description of Artificial Sequence: Synthetic oligonucleotide
gtacctctcgtacacatgatgctctcatagttgg

SEQ ID NO: 209314 - DNA, 34 bp, Artificial Sequence
  Description of Artificial Sequence: Synthetic oligonucleotide
tacctctcgtacacatgatgctctcatagttggc

SEQ ID NO: 209315 - DNA, 33 bp, Artificial Sequence
  Description of Artificial Sequence: Synthetic oligonucleotide
acctctcgtacacatgatgctctcatagttggc

SEQ ID NO: 209316 - DNA, 32 bp, Artificial Sequence
  Description of Artificial Sequence: Synthetic oligonucleotide
cctctcgtacacatgatgctctcatagttggc

SEQ ID NO: 209317 - DNA, 33 bp, Artificial Sequence
  Description of Artificial Sequence: Synthetic oligonucleotide
ctctcgtacacatgatgctctcatagttggcac

SEQ ID NO: 209318 - DNA, 38 bp, Artificial Sequence
  Description of Artificial Sequence: Synthetic oligonucleotide
tctcgtacacatgatgctctcatagttggcactttatc

SEQ ID NO: 209319 - DNA, 37 bp, Artificial Sequence
  Description of Artificial Sequence: Synthetic oligonucleotide
ctcgtacacatgatgctctcatagttggcactttatc

SEQ ID NO: 209320 - DNA, 38 bp, Artificial Sequence
  Description of Artificial Sequence: Synthetic oligonucleotide
tcgtacacatgatgctctcatagttggcactttatctg

SEQ ID NO: 209321 - DNA, 37 bp, Artificial Sequence
  Description of Artificial Sequence: Synthetic oligonucleotide
cgtacacatgatgctctcatagttggcactttatctg

SEQ ID NO: 209322 - DNA, 37 bp, Artificial Sequence
  Description of Artificial Sequence: Synthetic oligonucleotide
gtacacatgatgctctcatagttggcactttatctgg

SEQ ID NO: 209323 - DNA, 39 bp, Artificial Sequence
  Description of Artificial Sequence: Synthetic oligonucleotide
tacacatgatgctctcatagttggcactttatctggtac

SEQ ID NO: 209324 - DNA, 38 bp, Artificial Sequence
  Description of Artificial Sequence: Synthetic oligonucleotide
acacatgatgctctcatagttggcactttatctggtac

SEQ ID NO: 209325 - DNA, 37 bp, Artificial Sequence
  Description of Artificial Sequence: Synthetic oligonucleotide
cacatgatgctctcatagttggcactttatctggtac

SEQ ID NO: 209326 - DNA, 37 bp, Artificial Sequence
  Description of Artificial Sequence: Synthetic oligonucleotide
acatgatgctctcatagttggcactttatctggtacg

SEQ ID NO: 209327 - DNA, 36 bp, Artificial Sequence
  Description of Artificial Sequence: Synthetic oligonucleotide
catgatgctctcatagttggcactttatctggtacg

SEQ ID NO: 209328 - DNA, 38 bp, Artificial Sequence
  Description of Artificial Sequence: Synthetic oligonucleotide
atgatgctctcatagttggcactttatctggtacgatc

SEQ ID NO: 209329 - DNA, 37 bp, Artificial Sequence
  Description of Artificial Sequence: Synthetic oligonucleotide
tgatgctctcatagttggcactttatctggtacgatc

SEQ ID NO: 209330 - DNA, 36 bp, Artificial Sequence
  Description of Artificial Sequence: Synthetic oligonucleotide
gatgctctcatagttggcactttatctggtacgatc

SEQ ID NO: 209331 - DNA, 38 bp, Artificial Sequence
  Description of Artificial Sequence: Synthetic oligonucleotide
atgctctcatagttggcactttatctggtacgatcttc

SEQ ID NO: 209332 - DNA, 37 bp, Artificial Sequence
  Description of Artificial Sequence: Synthetic oligonucleotide
tgctctcatagttggcactttatctggtacgatcttc

SEQ ID NO: 209333 - DNA, 36 bp, Artificial Sequence
  Description of Artificial Sequence: Synthetic oligonucleotide
gctctcatagttggcactttatctggtacgatcttc

SEQ ID NO: 209334 - DNA, 45 bp, Artificial Sequence
  Description of Artificial Sequence: Synthetic oligonucleotide
ctctcatagttggcactttatctggtacgatcttctttattttac

SEQ ID NO: 209335 - DNA, 46 bp, Artificial Sequence
  Description of Artificial Sequence: Synthetic oligonucleotide
tctcatagttggcactttatctggtacgatcttctttattttactc

SEQ ID NO: 209336 - DNA, 45 bp, Artificial Sequence
  Description of Artificial Sequence: Synthetic oligonucleotide
ctcatagttggcactttatctggtacgatcttctttattttactc

SEQ ID NO: 209337 - DNA, 47 bp, Artificial Sequence
  Description of Artificial Sequence: Synthetic oligonucleotide
tcatagttggcactttatctggtacgatcttctttattttactcatc

SEQ ID NO: 209338 - DNA, 46 bp, Artificial Sequence
  Description of Artificial Sequence: Synthetic oligonucleotide
catagttggcactttatctggtacgatcttctttattttactcatc

SEQ ID NO: 209339 - DNA, 51 bp, Artificial Sequence
  Description of Artificial Sequence: Synthetic oligonucleotide
atagttggcactttatctggtacgatcttctttattttactcatcattttc

SEQ ID NO: 209340 - DNA, 50 bp, Artificial Sequence
  Description of Artificial Sequence: Synthetic oligonucleotide
tagttggcactttatctggtacgatcttctttattttactcatcattttc

SEQ ID NO: 209341 - DNA, 49 bp, Artificial Sequence
  Description of Artificial Sequence: Synthetic oligonucleotide
agttggcactttatctggtacgatcttctttattttactcatcattttc

SEQ ID NO: 209342 - DNA, 48 bp, Artificial Sequence
  Description of Artificial Sequence: Synthetic oligonucleotide
gttggcactttatctggtacgatcttctttattttactcatcattttc

SEQ ID NO: 209343 - DNA, 48 bp, Artificial Sequence
  Description of Artificial Sequence: Synthetic oligonucleotide
ttggcactttatctggtacgatcttctttattttactcatcattttcc

SEQ ID NO: 209344 - DNA, 47 bp, Artificial Sequence
  Description of Artificial Sequence: Synthetic oligonucleotide
tggcactttatctggtacgatcttctttattttactcatcattttcc

SEQ ID NO: 209345 - DNA, 46 bp, Artificial Sequence
  Description of Artificial Sequence: Synthetic oligonucleotide
ggcactttatctggtacgatcttctttattttactcatcattttcc

SEQ ID NO: 209346 - DNA, 47 bp, Artificial Sequence
  Description of Artificial Sequence: Synthetic oligonucleotide
gcactttatctggtacgatcttctttattttactcatcattttcctc

SEQ ID NO: 209347 - DNA, 48 bp, Artificial Sequence
  Description of Artificial Sequence: Synthetic oligonucleotide
cactttatctggtacgatcttctttattttactcatcattttcctctc

SEQ ID NO: 209348 - DNA, 50 bp, Artificial Sequence
  Description of Artificial Sequence: Synthetic oligonucleotide
actttatctggtacgatcttctttattttactcatcattttcctctcttg

SEQ ID NO: 209349 - DNA, 49 bp, Artificial Sequence
  Description of Artificial Sequence: Synthetic oligonucleotide
ctttatctggtacgatcttctttattttactcatcattttcctctcttg

SEQ ID NO: 209350 - DNA, 49 bp, Artificial Sequence
  Description of Artificial Sequence: Synthetic oligonucleotide
tttatctggtacgatcttctttattttactcatcattttcctctcttgg

SEQ ID NO: 209351 - DNA, 48 bp, Artificial Sequence
  Description of Artificial Sequence: Synthetic oligonucleotide
ttatctggtacgatcttctttattttactcatcattttcctctcttgg

SEQ ID NO: 209352 - DNA, 47 bp, Artificial Sequence
  Description of Artificial Sequence: Synthetic oligonucleotide
tatctggtacgatcttctttattttactcatcattttcctctcttgg

SEQ ID NO: 209353 - DNA, 46 bp, Artificial Sequence
  Description of Artificial Sequence: Synthetic oligonucleotide
atctggtacgatcttctttattttactcatcattttcctctcttgg

SEQ ID NO: 209354 - DNA, 45 bp, Artificial Sequence
  Description of Artificial Sequence: Synthetic oligonucleotide
tctggtacgatcttctttattttactcatcattttcctctcttgg

SEQ ID NO: 209355 - DNA, 44 bp, Artificial Sequence
  Description of Artificial Sequence: Synthetic oligonucleotide
ctggtacgatcttctttattttactcatcattttcctctcttgg

SEQ ID NO: 209356 - DNA, 50 bp, Artificial Sequence
  Description of Artificial Sequence: Synthetic oligonucleotide
tggtacgatcttctttattttactcatcattttcctctcttggataattc

SEQ ID NO: 209357 - DNA, 49 bp, Artificial Sequence
  Description of Artificial Sequence: Synthetic oligonucleotide
ggtacgatcttctttattttactcatcattttcctctcttggataattc

SEQ ID NO: 209358 - DNA, 53 bp, Artificial Sequence
  Description of Artificial Sequence: Synthetic oligonucleotide
gtacgatcttctttattttactcatcattttcctctcttggataattctaaag

SEQ ID NO: 209359 - DNA, 53 bp, Artificial Sequence
  Description of Artificial Sequence: Synthetic oligonucleotide
tacgatcttctttattttactcatcattttcctctcttggataattctaaagc

SEQ ID NO: 209360 - DNA, 52 bp, Artificial Sequence
  Description of Artificial Sequence: Synthetic oligonucleotide
acgatcttctttattttactcatcattttcctctcttggataattctaaagc

SEQ ID NO: 209361 - DNA, 51 bp, Artificial Sequence
  Description of Artificial Sequence: Synthetic oligonucleotide
cgatcttctttattttactcatcattttcctctcttggataattctaaagc

SEQ ID NO: 209362 - DNA, 52 bp, Artificial Sequence
  Description of Artificial Sequence: Synthetic oligonucleotide
gatcttctttattttactcatcattttcctctcttggataattctaaagcac

SEQ ID NO: 209363 - DNA, 53 bp, Artificial Sequence
  Description of Artificial Sequence: Synthetic oligonucleotide
atcttctttattttactcatcattttcctctcttggataattctaaagcacag

SEQ ID NO: 209364 - DNA, 52 bp, Artificial Sequence
  Description of Artificial Sequence: Synthetic oligonucleotide
tcttctttattttactcatcattttcctctcttggataattctaaagcacag

SEQ ID NO: 209365 - DNA, 51 bp, Artificial Sequence
  Description of Artificial Sequence: Synthetic oligonucleotide
cttctttattttactcatcattttcctctcttggataattctaaagcacag

SEQ ID NO: 209366 - DNA, 55 bp, Artificial Sequence
  Description of Artificial Sequence: Synthetic oligonucleotide
ttctttattttactcatcattttcctctcttggataattctaaagcacagaaaag

SEQ ID NO: 209367 - DNA, 54 bp, Artificial Sequence
  Description of Artificial Sequence: Synthetic oligonucleotide
tctttattttactcatcattttcctctcttggataattctaaagcacagaaaag

SEQ ID NO: 209368 - DNA, 53 bp, Artificial Sequence
  Description of Artificial Sequence: Synthetic oligonucleotide
ctttattttactcatcattttcctctcttggataattctaaagcacagaaaag

SEQ ID NO: 209369 - DNA, 53 bp, Artificial Sequence
  Description of Artificial Sequence: Synthetic oligonucleotide
tttattttactcatcattttcctctcttggataattctaaagcacagaaaagg

SEQ ID NO: 209370 - DNA, 52 bp, Artificial Sequence
  Description of Artificial Sequence: Synthetic oligonucleotide
ttattttactcatcattttcctctcttggataattctaaagcacagaaaagg

SEQ ID NO: 209371 - DNA, 51 bp, Artificial Sequence
  Description of Artificial Sequence: Synthetic oligonucleotide
tattttactcatcattttcctctcttggataattctaaagcacagaaaagg

SEQ ID NO: 209372 - DNA, 50 bp, Artificial Sequence
  Description of Artificial Sequence: Synthetic oligonucleotide
attttactcatcattttcctctcttggataattctaaagcacagaaaagg

SEQ ID NO: 209373 - DNA, 49 bp, Artificial Sequence
  Description of Artificial Sequence: Synthetic oligonucleotide
ttttactcatcattttcctctcttggataattctaaagcacagaaaagg

SEQ ID NO: 209374 - DNA, 48 bp, Artificial Sequence
  Description of Artificial Sequence: Synthetic oligonucleotide
tttactcatcattttcctctcttggataattctaaagcacagaaaagg

SEQ ID NO: 209375 - DNA, 47 bp, Artificial Sequence
  Description of Artificial Sequence: Synthetic oligonucleotide
ttactcatcattttcctctcttggataattctaaagcacagaaaagg

SEQ ID NO: 209376 - DNA, 46 bp, Artificial Sequence
  Description of Artificial Sequence: Synthetic oligonucleotide
tactcatcattttcctctcttggataattctaaagcacagaaaagg

SEQ ID NO: 209377 - DNA, 45 bp, Artificial Sequence
  Description of Artificial Sequence: Synthetic oligonucleotide
actcatcattttcctctcttggataattctaaagcacagaaaagg

SEQ ID NO: 209378 - DNA, 44 bp, Artificial Sequence
  Description of Artificial Sequence: Synthetic oligonucleotide
ctcatcattttcctctcttggataattctaaagcacagaaaagg

SEQ ID NO: 209379 - DNA, 44 bp, Artificial Sequence
  Description of Artificial Sequence: Synthetic oligonucleotide
tcatcattttcctctcttggataattctaaagcacagaaaaggc

SEQ ID NO: 209380 - DNA, 43 bp, Artificial Sequence
  Description of Artificial Sequence: Synthetic oligonucleotide
catcattttcctctcttggataattctaaagcacagaaaaggc

SEQ ID NO: 209381 - DNA, 49 bp, Artificial Sequence
  Description of Artificial Sequence: Synthetic oligonucleotide
atcattttcctctcttggataattctaaagcacagaaaaggcaataatg

SEQ ID NO: 209382 - DNA, 48 bp, Artificial Sequence
  Description of Artificial Sequence: Synthetic oligonucleotide
tcattttcctctcttggataattctaaagcacagaaaaggcaataatg

SEQ ID NO: 209383 - DNA, 47 bp, Artificial Sequence
  Description of Artificial Sequence: Synthetic oligonucleotide
cattttcctctcttggataattctaaagcacagaaaaggcaataatg

SEQ ID NO: 209384 - DNA, 47 bp, Artificial Sequence
  Description of Artificial Sequence: Synthetic oligonucleotide
attttcctctcttggataattctaaagcacagaaaaggcaataatgc

SEQ ID NO: 209385 - DNA, 46 bp, Artificial Sequence
  Description of Artificial Sequence: Synthetic oligonucleotide
ttttcctctcttggataattctaaagcacagaaaaggcaataatgc

SEQ ID NO: 209386 - DNA, 45 bp, Artificial Sequence
  Description of Artificial Sequence: Synthetic oligonucleotide
tttcctctcttggataattctaaagcacagaaaaggcaataatgc

SEQ ID NO: 209387 - DNA, 44 bp, Artificial Sequence
  Description of Artificial Sequence: Synthetic oligonucleotide
ttcctctcttggataattctaaagcacagaaaaggcaataatgc

SEQ ID NO: 209388 - DNA, 43 bp, Artificial Sequence
  Description of Artificial Sequence: Synthetic oligonucleotide
tcctctcttggataattctaaagcacagaaaaggcaataatgc

SEQ ID NO: 209389 - DNA, 42 bp, Artificial Sequence
  Description of Artificial Sequence: Synthetic oligonucleotide
cctctcttggataattctaaagcacagaaaaggcaataatgc

SEQ ID NO: 209390 - DNA, 43 bp, Artificial Sequence
  Description of Artificial Sequence: Synthetic oligonucleotide
ctctcttggataattctaaagcacagaaaaggcaataatgcac

SEQ ID NO: 209391 - DNA, 45 bp, Artificial Sequence
  Description of Artificial Sequence: Synthetic oligonucleotide
tctcttggataattctaaagcacagaaaaggcaataatgcacatg

SEQ ID NO: 209392 - DNA, 44 bp, Artificial Sequence
  Description of Artificial Sequence: Synthetic oligonucleotide
ctcttggataattctaaagcacagaaaaggcaataatgcacatg

SEQ ID NO: 209393 - DNA, 48 bp, Artificial Sequence
  Description of Artificial Sequence: Synthetic oligonucleotide
tcttggataattctaaagcacagaaaaggcaataatgcacatgaaaac

SEQ ID NO: 209394 - DNA, 47 bp, Artificial Sequence
  Description of Artificial Sequence: Synthetic oligonucleotide
cttggataattctaaagcacagaaaaggcaataatgcacatgaaaac

SEQ ID NO: 209395 - DNA, 47 bp, Artificial Sequence
  Description of Artificial Sequence: Synthetic oligonucleotide
ttggataattctaaagcacagaaaaggcaataatgcacatgaaaacc

SEQ ID NO: 209396 - DNA, 46 bp, Artificial Sequence
  Description of Artificial Sequence: Synthetic oligonucleotide
tggataattctaaagcacagaaaaggcaataatgcacatgaaaacc

SEQ ID NO: 209397 - DNA, 45 bp, Artificial Sequence
  Description of Artificial Sequence: Synthetic oligonucleotide
ggataattctaaagcacagaaaaggcaataatgcacatgaaaacc

SEQ ID NO: 209398 - DNA, 45 bp, Artificial Sequence
  Description of Artificial Sequence: Synthetic oligonucleotide
gataattctaaagcacagaaaaggcaataatgcacatgaaaaccc

SEQ ID NO: 209399 - DNA, 49 bp, Artificial Sequence
  Description of Artificial Sequence: Synthetic oligonucleotide
ataattctaaagcacagaaaaggcaataatgcacatgaaaaccctaaag

SEQ ID NO: 209400 - DNA, 48 bp, Artificial Sequence
  Description of Artificial Sequence: Synthetic oligonucleotide
taattctaaagcacagaaaaggcaataatgcacatgaaaaccctaaag

SEQ ID NO: 209401 - DNA, 47 bp, Artificial Sequence
  Description of Artificial Sequence: Synthetic oligonucleotide
aattctaaagcacagaaaaggcaataatgcacatgaaaaccctaaag

SEQ ID NO: 209402 - DNA, 46 bp, Artificial Sequence
  Description of Artificial Sequence: Synthetic oligonucleotide
attctaaagcacagaaaaggcaataatgcacatgaaaaccctaaag

SEQ ID NO: 209403 - DNA, 45 bp, Artificial Sequence
  Description of Artificial Sequence: Synthetic oligonucleotide
ttctaaagcacagaaaaggcaataatgcacatgaaaaccctaaag

SEQ ID NO: 209404 - DNA, 44 bp, Artificial Sequence
  Description of Artificial Sequence: Synthetic oligonucleotide
tctaaagcacagaaaaggcaataatgcacatgaaaaccctaaag

SEQ ID NO: 209405 - DNA, 43 bp, Artificial Sequence
  Description of Artificial Sequence: Synthetic oligonucleotide
ctaaagcacagaaaaggcaataatgcacatgaaaaccctaaag

SEQ ID NO: 209406 - DNA, 45 bp, Artificial Sequence
  Description of Artificial Sequence: Synthetic oligonucleotide
taaagcacagaaaaggcaataatgcacatgaaaaccctaaagaag

SEQ ID NO: 209407 - DNA, 44 bp, Artificial Sequence
  Description of Artificial Sequence: Synthetic oligonucleotide
aaagcacagaaaaggcaataatgcacatgaaaaccctaaagaag

SEQ ID NO: 209408 - DNA, 43 bp, Artificial Sequence
  Description of Artificial Sequence: Synthetic oligonucleotide
aagcacagaaaaggcaataatgcacatgaaaaccctaaagaag

SEQ ID NO: 209409 - DNA, 42 bp, Artificial Sequence
  Description of Artificial Sequence: Synthetic oligonucleotide
agcacagaaaaggcaataatgcacatgaaaaccctaaagaag

SEQ ID NO: 209410 - DNA, 41 bp, Artificial Sequence
  Description of Artificial Sequence: Synthetic oligonucleotide
gcacagaaaaggcaataatgcacatgaaaaccctaaagaag

SEQ ID NO: 209411 - DNA, 42 bp, Artificial Sequence
  Description of Artificial Sequence: Synthetic oligonucleotide
cacagaaaaggcaataatgcacatgaaaaccctaaagaagtg

SEQ ID NO: 209412 - DNA, 42 bp, Artificial Sequence
  Description of Artificial Sequence: Synthetic oligonucleotide
acagaaaaggcaataatgcacatgaaaaccctaaagaagtgg

SEQ ID NO: 209413 - DNA, 41 bp, Artificial Sequence
  Description of Artificial Sequence: Synthetic oligonucleotide
cagaaaaggcaataatgcacatgaaaaccctaaagaagtgg

SEQ ID NO: 209414 - DNA, 41 bp, Artificial Sequence
  Description of Artificial Sequence: Synthetic oligonucleotide
agaaaaggcaataatgcacatgaaaaccctaaagaagtggc

SEQ ID NO: 209415 - DNA, 40 bp, Artificial Sequence
  Description of Artificial Sequence: Synthetic oligonucleotide
gaaaaggcaataatgcacatgaaaaccctaaagaagtggc

SEQ ID NO: 209416 - DNA, 43 bp, Artificial Sequence
  Description of Artificial Sequence: Synthetic oligonucleotide
aaaaggcaataatgcacatgaaaaccctaaagaagtggctatc

SEQ ID NO: 209417 - DNA, 42 bp, Artificial Sequence
  Description of Artificial Sequence: Synthetic oligonucleotide
aaaggcaataatgcacatgaaaaccctaaagaagtggctatc

SEQ ID NO: 209418 - DNA, 41 bp, Artificial Sequence
  Description of Artificial Sequence: Synthetic oligonucleotide
aaggcaataatgcacatgaaaaccctaaagaagtggctatc

SEQ ID NO: 209419 - DNA, 40 bp, Artificial Sequence
  Description of Artificial Sequence: Synthetic oligonucleotide
aggcaataatgcacatgaaaaccctaaagaagtggctatc

SEQ ID NO: 209420 - DNA, 39 bp, Artificial Sequence
  Description of Artificial Sequence: Synthetic oligonucleotide
ggcaataatgcacatgaaaaccctaaagaagtggctatc

SEQ ID NO: 209421 - DNA, 39 bp, Artificial Sequence
  Description of Artificial Sequence: Synthetic oligonucleotide
gcaataatgcacatgaaaaccctaaagaagtggctatcc

SEQ ID NO: 209422 - DNA, 44 bp, Artificial Sequence
  Description of Artificial Sequence: Synthetic oligonucleotide
caataatgcacatgaaaaccctaaagaagtggctatccatttac

SEQ ID NO: 209423 - DNA, 47 bp, Artificial Sequence
  Description of Artificial Sequence: Synthetic oligonucleotide
aataatgcacatgaaaaccctaaagaagtggctatccatttacattc

SEQ ID NO: 209424 - DNA, 46 bp, Artificial Sequence
  Description of Artificial Sequence: Synthetic oligonucleotide
ataatgcacatgaaaaccctaaagaagtggctatccatttacattc

SEQ ID NO: 209425 - DNA, 45 bp, Artificial Sequence
  Description of Artificial Sequence: Synthetic oligonucleotide
taatgcacatgaaaaccctaaagaagtggctatccatttacattc

SEQ ID NO: 209426 - DNA, 44 bp, Artificial Sequence
  Description of Artificial Sequence: Synthetic oligonucleotide
aatgcacatgaaaaccctaaagaagtggctatccatttacattc

SEQ ID NO: 209427 - DNA, 43 bp, Artificial Sequence
  Description of Artificial Sequence: Synthetic oligonucleotide
atgcacatgaaaaccctaaagaagtggctatccatttacattc

SEQ ID NO: 209428 - DNA, 42 bp, Artificial Sequence
  Description of Artificial Sequence: Synthetic oligonucleotide
tgcacatgaaaaccctaaagaagtggctatccatttacattc

SEQ ID NO: 209429 - DNA, 41 bp, Artificial Sequence
  Description of Artificial Sequence: Synthetic oligonucleotide
gcacatgaaaaccctaaagaagtggctatccatttacattc

SEQ ID NO: 209430 - DNA, 42 bp, Artificial Sequence
  Description of Artificial Sequence: Synthetic oligonucleotide
cacatgaaaaccctaaagaagtggctatccatttacattctc

SEQ ID NO: 209431 - DNA, 44 bp, Artificial Sequence
  Description of Artificial Sequence: Synthetic oligonucleotide
acatgaaaaccctaaagaagtggctatccatttacattctcaag

SEQ ID NO: 209432 - DNA, 43 bp, Artificial Sequence
  Description of Artificial Sequence: Synthetic oligonucleotide
catgaaaaccctaaagaagtggctatccatttacattctcaag

SEQ ID NO: 209433 - DNA, 43 bp, Artificial Sequence
  Description of Artificial Sequence: Synthetic oligonucleotide
atgaaaaccctaaagaagtggctatccatttacattctcaagg

SEQ ID NO: 209434 - DNA, 42 bp, Artificial Sequence
  Description of Artificial Sequence: Synthetic oligonucleotide
tgaaaaccctaaagaagtggctatccatttacattctcaagg

SEQ ID NO: 209435 - DNA, 41 bp, Artificial Sequence
  Description of Artificial Sequence: Synthetic oligonucleotide
gaaaaccctaaagaagtggctatccatttacattctcaagg

SEQ ID NO: 209436 - DNA, 42 bp, Artificial Sequence
  Description of Artificial Sequence: Synthetic oligonucleotide
aaaaccctaaagaagtggctatccatttacattctcaaggag

SEQ ID NO: 209437 - DNA, 41 bp, Artificial Sequence
  Description of Artificial Sequence: Synthetic oligonucleotide
aaaccctaaagaagtggctatccatttacattctcaaggag

SEQ ID NO: 209438 - DNA, 40 bp, Artificial Sequence
  Description of Artificial Sequence: Synthetic oligonucleotide
aaccctaaagaagtggctatccatttacattctcaaggag

SEQ ID NO: 209439 - DNA, 39 bp, Artificial Sequence
  Description of Artificial Sequence: Synthetic oligonucleotide
accctaaagaagtggctatccatttacattctcaaggag

SEQ ID NO: 209440 - DNA, 38 bp, Artificial Sequence
  Description of Artificial Sequence: Synthetic oligonucleotide
ccctaaagaagtggctatccatttacattctcaaggag

SEQ ID NO: 209441 - DNA, 38 bp, Artificial Sequence
  Description of Artificial Sequence: Synthetic oligonucleotide
cctaaagaagtggctatccatttacattctcaaggagg

SEQ ID NO: 209442 - DNA, 38 bp, Artificial Sequence
  Description of Artificial Sequence: Synthetic oligonucleotide
ctaaagaagtggctatccatttacattctcaaggaggc

SEQ ID NO: 209443 - DNA, 39 bp, Artificial Sequence
  Description of Artificial Sequence: Synthetic oligonucleotide
taaagaagtggctatccatttacattctcaaggaggcag

SEQ ID NO: 209444 - DNA, 38 bp, Artificial Sequence
  Description of Artificial Sequence: Synthetic oligonucleotide
aaagaagtggctatccatttacattctcaaggaggcag

SEQ ID NO: 209445 - DNA, 37 bp, Artificial Sequence
  Description of Artificial Sequence: Synthetic oligonucleotide
aagaagtggctatccatttacattctcaaggaggcag

SEQ ID NO: 209446 - DNA, 36 bp, Artificial Sequence
  Description of Artificial Sequence: Synthetic oligonucleotide
agaagtggctatccatttacattctcaaggaggcag

SEQ ID NO: 209447 - DNA, 35 bp, Artificial Sequence
  Description of Artificial Sequence: Synthetic oligonucleotide
gaagtggctatccatttacattctcaaggaggcag

SEQ ID NO: 209448 - DNA, 35 bp, Artificial Sequence
  Description of Artificial Sequence: Synthetic oligonucleotide
aagtggctatccatttacattctcaaggaggcagc

SEQ ID NO: 209449 - DNA, 34 bp, Artificial Sequence
  Description of Artificial Sequence: Synthetic oligonucleotide
agtggctatccatttacattctcaaggaggcagc

SEQ ID NO: 209450 - DNA, 33 bp, Artificial Sequence
  Description of Artificial Sequence: Synthetic oligonucleotide
gtggctatccatttacattctcaaggaggcagc

SEQ ID NO: 209451 - DNA, 34 bp, Artificial Sequence
  Description of Artificial Sequence: Synthetic oligonucleotide
tggctatccatttacattctcaaggaggcagcag

SEQ ID NO: 209452 - DNA, 33 bp, Artificial Sequence
  Description of Artificial Sequence: Synthetic oligonucleotide
ggctatccatttacattctcaaggaggcagcag

SEQ ID NO: 209453 - DNA, 33 bp, Artificial Sequence
  Description of Artificial Sequence: Synthetic oligonucleotide
gctatccatttacattctcaaggaggcagcagc

SEQ ID NO: 209454 - DNA, 33 bp, Artificial Sequence
  Description of Artificial Sequence: Synthetic oligonucleotide
ctatccatttacattctcaaggaggcagcagcg

SEQ ID NO: 209455 - DNA, 35 bp, Artificial Sequence
  Description of Artificial Sequence: Synthetic oligonucleotide
tatccatttacattctcaaggaggcagcagcgttc

SEQ ID NO: 209456 - DNA, 34 bp, Artificial Sequence
  Description of Artificial Sequence: Synthetic oligonucleotide
atccatttacattctcaaggaggcagcagcgttc

SEQ ID NO: 209457 - DNA, 33 bp, Artificial Sequence
  Description of Artificial Sequence: Synthetic oligonucleotide
tccatttacattctcaaggaggcagcagcgttc

SEQ ID NO: 209458 - DNA, 32 bp, Artificial Sequence
  Description of Artificial Sequence: Synthetic oligonucleotide
ccatttacattctcaaggaggcagcagcgttc

SEQ ID NO: 209459 - DNA, 34 bp, Artificial Sequence
  Description of Artificial Sequence: Synthetic oligonucleotide
catttacattctcaaggaggcagcagcgttcatc

SEQ ID NO: 209460 - DNA, 34 bp, Artificial Sequence
  Description of Artificial Sequence: Synthetic oligonucleotide
atttacattctcaaggaggcagcagcgttcatcc

SEQ ID NO: 209461 - DNA, 33 bp, Artificial Sequence
  Description of Artificial Sequence: Synthetic oligonucleotide
tttacattctcaaggaggcagcagcgttcatcc

SEQ ID NO: 209462 - DNA, 32 bp, Artificial Sequence
  Description of Artificial Sequence: Synthetic oligonucleotide
ttacattctcaaggaggcagcagcgttcatcc

SEQ ID NO: 209463 - DNA, 31 bp, Artificial Sequence
  Description of Artificial Sequence: Synthetic oligonucleotide
tacattctcaaggaggcagcagcgttcatcc

SEQ ID NO: 209464 - DNA, 30 bp, Artificial Sequence
  Description of Artificial Sequence: Synthetic oligonucleotide
acattctcaaggaggcagcagcgttcatcc

SEQ ID NO: 209465 - DNA, 29 bp, Artificial Sequence
  Description of Artificial Sequence: Synthetic oligonucleotide
cattctcaaggaggcagcagcgttcatcc

SEQ ID NO: 209466 - DNA, 29 bp, Artificial Sequence
  Description of Artificial Sequence: Synthetic oligonucleotide
attctcaaggaggcagcagcgttcatccc

SEQ ID NO: 209467 - DNA, 28 bp, Artificial Sequence
  Description of Artificial Sequence: Synthetic oligonucleotide
ttctcaaggaggcagcagcgttcatccc

SEQ ID NO: 209468 - DNA, 27 bp, Artificial Sequence
  Description of Artificial Sequence: Synthetic oligonucleotide
tctcaaggaggcagcagcgttcatccc

SEQ ID NO: 209469 - DNA, 26 bp, Artificial Sequence
  Description of Artificial Sequence: Synthetic oligonucleotide
ctcaaggaggcagcagcgttcatccc

SEQ ID NO: 209470 - DNA, 26 bp, Artificial Sequence
  Description of Artificial Sequence: Synthetic oligonucleotide
tcaaggaggcagcagcgttcatcccc

SEQ ID NO: 209471 - DNA, 25 bp, Artificial Sequence
  Description of Artificial Sequence: Synthetic oligonucleotide
caaggaggcagcagcgttcatcccc

SEQ ID NO: 209472 - DNA, 27 bp, Artificial Sequence
  Description of Artificial Sequence: Synthetic oligonucleotide
aaggaggcagcagcgttcatccccgaa

SEQ ID NO: 209473 - DNA, 26 bp, Artificial Sequence
  Description of Artificial Sequence: Synthetic oligonucleotide
aggaggcagcagcgttcatccccgaa

SEQ ID NO: 209474 - DNA, 25 bp, Artificial Sequence
  Description of Artificial Sequence: Synthetic oligonucleotide
ggaggcagcagcgttcatccccgaa

SEQ ID NO: 209475 - DNA, 26 bp, Artificial Sequence
  Description of Artificial Sequence: Synthetic oligonucleotide
gaggcagcagcgttcatccccgaact

SEQ ID NO: 209476 - DNA, 27 bp, Artificial Sequence
  Description of Artificial Sequence: Synthetic oligonucleotide
aggcagcagcgttcatccccgaactct

SEQ ID NO: 209477 - DNA, 26 bp, Artificial Sequence
  Description of Artificial Sequence: Synthetic oligonucleotide
ggcagcagcgttcatccccgaactct

SEQ ID NO: 209478 - DNA, 26 bp, Artificial Sequence
  Description of Artificial Sequence: Synthetic oligonucleotide
gcagcagcgttcatccccgaactctg

SEQ ID NO: 209479 - DNA, 27 bp, Artificial Sequence
  Description of Artificial Sequence: Synthetic oligonucleotide
cagcagcgttcatccccgaactctgca

SEQ ID NO: 209480 - DNA, 29 bp, Artificial Sequence
  Description of Artificial Sequence: Synthetic oligonucleotide
agcagcgttcatccccgaactctgcaaac

SEQ ID NO: 209481 - DNA, 28 bp, Artificial Sequence
  Description of Artificial Sequence: Synthetic oligonucleotide
gcagcgttcatccccgaactctgcaaac

SEQ ID NO: 209482 - DNA, 32 bp, Artificial Sequence
  Description of Artificial Sequence: Synthetic oligonucleotide
cagcgttcatccccgaactctgcaaacaaatg

SEQ ID NO: 209483 - DNA, 34 bp, Artificial Sequence
  Description of Artificial Sequence: Synthetic oligonucleotide
agcgttcatccccgaactctgcaaacaaatgaag

SEQ ID NO: 209484 - DNA, 33 bp, Artificial Sequence
  Description of Artificial Sequence: Synthetic oligonucleotide
gcgttcatccccgaactctgcaaacaaatgaag

SEQ ID NO: 209485 - DNA, 39 bp, Artificial Sequence
  Description of Artificial Sequence: Synthetic oligonucleotide
cgttcatccccgaactctgcaaacaaatgaagaaaatag

SEQ ID NO: 209486 - DNA, 39 bp, Artificial Sequence
  Description of Artificial Sequence: Synthetic oligonucleotide
gttcatccccgaactctgcaaacaaatgaagaaaatagc

SEQ ID NO: 209487 - DNA, 40 bp, Artificial Sequence
  Description of Artificial Sequence: Synthetic oligonucleotide
ttcatccccgaactctgcaaacaaatgaagaaaatagcag

SEQ ID NO: 209488 - DNA, 39 bp, Artificial Sequence
  Description of Artificial Sequence: Synthetic oligonucleotide
tcatccccgaactctgcaaacaaatgaagaaaatagcag

SEQ ID NO: 209489 - DNA, 38 bp, Artificial Sequence
  Description of Artificial Sequence: Synthetic oligonucleotide
catccccgaactctgcaaacaaatgaagaaaatagcag

SEQ ID NO: 209490 - DNA, 38 bp, Artificial Sequence
  Description of Artificial Sequence: Synthetic oligonucleotide
atccccgaactctgcaaacaaatgaagaaaatagcagg

SEQ ID NO: 209491 - DNA, 37 bp, Artificial Sequence
  Description of Artificial Sequence: Synthetic oligonucleotide
tccccgaactctgcaaacaaatgaagaaaatagcagg

SEQ ID NO: 209492 - DNA, 36 bp, Artificial Sequence
  Description of Artificial Sequence: Synthetic oligonucleotide
ccccgaactctgcaaacaaatgaagaaaatagcagg

SEQ ID NO: 209493 - DNA, 36 bp, Artificial Sequence
  Description of Artificial Sequence: Synthetic oligonucleotide
cccgaactctgcaaacaaatgaagaaaatagcaggg

SEQ ID NO: 209494 - DNA, 37 bp, Artificial Sequence
  Description of Artificial Sequence: Synthetic oligonucleotide
ccgaactctgcaaacaaatgaagaaaatagcagggtc

SEQ ID NO: 209495 - DNA, 37 bp, Artificial Sequence
  Description of Artificial Sequence: Synthetic oligonucleotide
cgaactctgcaaacaaatgaagaaaatagcagggtcc

SEQ ID NO: 209496 - DNA, 39 bp, Artificial Sequence
  Description of Artificial Sequence: Synthetic oligonucleotide
gaactctgcaaacaaatgaagaaaatagcagggtccttc

SEQ ID NO: 209497 - DNA, 39 bp, Artificial Sequence
  Description of Artificial Sequence: Synthetic oligonucleotide
aactctgcaaacaaatgaagaaaatagcagggtccttcc

SEQ ID NO: 209498 - DNA, 38 bp, Artificial Sequence
  Description of Artificial Sequence: Synthetic oligonucleotide
actctgcaaacaaatgaagaaaatagcagggtccttcc

SEQ ID NO: 209499 - DNA, 37 bp, Artificial Sequence
  Description of Artificial Sequence: Synthetic oligonucleotide
ctctgcaaacaaatgaagaaaatagcagggtccttcc

SEQ ID NO: 209500 - DNA, 39 bp, Artificial Sequence
  Description of Artificial Sequence: Synthetic oligonucleotide
tctgcaaacaaatgaagaaaatagcagggtccttccttg

SEQ ID NO: 209501 - DNA, 38 bp, Artificial Sequence
  Description of Artificial Sequence: Synthetic oligonucleotide
ctgcaaacaaatgaagaaaatagcagggtccttccttg

SEQ ID NO: 209502 - DNA, 49 bp, Artificial Sequence
  Description of Artificial Sequence: Synthetic oligonucleotide
tgtatttctactaataaatgcacagctccagaagttgaaaatgcaattg

SEQ ID NO: 209503 - DNA, 48 bp, Artificial Sequence
  Description of Artificial Sequence: Synthetic oligonucleotide
gtatttctactaataaatgcacagctccagaagttgaaaatgcaattg

SEQ ID NO: 209504 - DNA, 48 bp, Artificial Sequence
  Description of Artificial Sequence: Synthetic oligonucleotide
tatttctactaataaatgcacagctccagaagttgaaaatgcaattgg

SEQ ID NO: 209505 - DNA, 47 bp, Artificial Sequence
  Description of Artificial Sequence: Synthetic oligonucleotide
atttctactaataaatgcacagctccagaagttgaaaatgcaattgg

SEQ ID NO: 209506 - DNA, 46 bp, Artificial Sequence
  Description of Artificial Sequence: Synthetic oligonucleotide
tttctactaataaatgcacagctccagaagttgaaaatgcaattgg

SEQ ID NO: 209507 - DNA, 45 bp, Artificial Sequence
  Description of Artificial Sequence: Synthetic oligonucleotide
ttctactaataaatgcacagctccagaagttgaaaatgcaattgg

SEQ ID NO: 209508 - DNA, 44 bp, Artificial Sequence
  Description of Artificial Sequence: Synthetic oligonucleotide
tctactaataaatgcacagctccagaagttgaaaatgcaattgg

SEQ ID NO: 209509 - DNA, 43 bp, Artificial Sequence
  Description of Artificial Sequence: Synthetic oligonucleotide
ctactaataaatgcacagctccagaagttgaaaatgcaattgg

SEQ ID NO: 209510 - DNA, 44 bp, Artificial Sequence
  Description of Artificial Sequence: Synthetic oligonucleotide
tactaataaatgcacagctccagaagttgaaaatgcaattggag

SEQ ID NO: 209511 - DNA, 43 bp, Artificial Sequence
  Description of Artificial Sequence: Synthetic oligonucleotide
actaataaatgcacagctccagaagttgaaaatgcaattggag

SEQ ID NO: 209512 - DNA, 42 bp, Artificial Sequence
  Description of Artificial Sequence: Synthetic oligonucleotide
ctaataaatgcacagctccagaagttgaaaatgcaattggag

SEQ ID NO: 209513 - DNA, 44 bp, Artificial Sequence
  Description of Artificial Sequence: Synthetic oligonucleotide
taataaatgcacagctccagaagttgaaaatgcaattggagtac

SEQ ID NO: 209514 - DNA, 43 bp, Artificial Sequence
  Description of Artificial Sequence: Synthetic oligonucleotide
aataaatgcacagctccagaagttgaaaatgcaattggagtac

SEQ ID NO: 209515 - DNA, 42 bp, Artificial Sequence
  Description of Artificial Sequence: Synthetic oligonucleotide
ataaatgcacagctccagaagttgaaaatgcaattggagtac

SEQ ID NO: 209516 - DNA, 41 bp, Artificial Sequence
  Description of Artificial Sequence: Synthetic oligonucleotide
taaatgcacagctccagaagttgaaaatgcaattggagtac

SEQ ID NO: 209517 - DNA, 40 bp, Artificial Sequence
  Description of Artificial Sequence: Synthetic oligonucleotide
aaatgcacagctccagaagttgaaaatgcaattggagtac

SEQ ID NO: 209518 - DNA, 39 bp, Artificial Sequence
  Description of Artificial Sequence: Synthetic oligonucleotide
aatgcacagctccagaagttgaaaatgcaattggagtac

SEQ ID NO: 209519 - DNA, 38 bp, Artificial Sequence
  Description of Artificial Sequence: Synthetic oligonucleotide
atgcacagctccagaagttgaaaatgcaattggagtac

SEQ ID NO: 209520 - DNA, 37 bp, Artificial Sequence
  Description of Artificial Sequence: Synthetic oligonucleotide
tgcacagctccagaagttgaaaatgcaattggagtac

SEQ ID NO: 209521 - DNA, 36 bp, Artificial Sequence
  Description of Artificial Sequence: Synthetic oligonucleotide
gcacagctccagaagttgaaaatgcaattggagtac

SEQ ID NO: 209522 - DNA, 36 bp, Artificial Sequence
  Description of Artificial Sequence: Synthetic oligonucleotide
cacagctccagaagttgaaaatgcaattggagtacc

SEQ ID NO: 209523 - DNA, 37 bp, Artificial Sequence
  Description of Artificial Sequence: Synthetic oligonucleotide
acagctccagaagttgaaaatgcaattggagtaccag

SEQ ID NO: 209524 - DNA, 36 bp, Artificial Sequence
  Description of Artificial Sequence: Synthetic oligonucleotide
cagctccagaagttgaaaatgcaattggagtaccag

SEQ ID NO: 209525 - DNA, 36 bp, Artificial Sequence
  Description of Artificial Sequence: Synthetic oligonucleotide
agctccagaagttgaaaatgcaattggagtaccagg

SEQ ID NO: 209526 - DNA, 35 bp, Artificial Sequence
  Description of Artificial Sequence: Synthetic oligonucleotide
gctccagaagttgaaaatgcaattggagtaccagg

SEQ ID NO: 209527 - DNA, 38 bp, Artificial Sequence
  Description of Artificial Sequence: Synthetic oligonucleotide
ctccagaagttgaaaatgcaattggagtaccaggaaac

SEQ ID NO: 209528 - DNA, 39 bp, Artificial Sequence
  Description of Artificial Sequence: Synthetic oligonucleotide
tccagaagttgaaaatgcaattggagtaccaggaaacag

SEQ ID NO: 209529 - DNA, 38 bp, Artificial Sequence
  Description of Artificial Sequence: Synthetic oligonucleotide
ccagaagttgaaaatgcaattggagtaccaggaaacag

SEQ ID NO: 209530 - DNA, 38 bp, Artificial Sequence
  Description of Artificial Sequence: Synthetic oligonucleotide
cagaagttgaaaatgcaattggagtaccaggaaacagg

SEQ ID NO: 209531 - DNA, 39 bp, Artificial Sequence
  Description of Artificial Sequence: Synthetic oligonucleotide
agaagttgaaaatgcaattggagtaccaggaaacaggag

SEQ ID NO: 209532 - DNA, 38 bp, Artificial Sequence
  Description of Artificial Sequence: Synthetic oligonucleotide
gaagttgaaaatgcaattggagtaccaggaaacaggag

SEQ ID NO: 209533 - DNA, 41 bp, Artificial Sequence
  Description of Artificial Sequence: Synthetic oligonucleotide
aagttgaaaatgcaattggagtaccaggaaacaggagtttc

SEQ ID NO: 209534 - DNA, 40 bp, Artificial Sequence
  Description of Artificial Sequence: Synthetic oligonucleotide
agttgaaaatgcaattggagtaccaggaaacaggagtttc

SEQ ID NO: 209535 - DNA, 39 bp, Artificial Sequence
  Description of Artificial Sequence: Synthetic oligonucleotide
gttgaaaatgcaattggagtaccaggaaacaggagtttc

SEQ ID NO: 209536 - DNA, 43 bp, Artificial Sequence
  Description of Artificial Sequence: Synthetic oligonucleotide
ttgaaaatgcaattggagtaccaggaaacaggagtttcttttc

SEQ ID NO: 209537 - DNA, 42 bp, Artificial Sequence
  Description of Artificial Sequence: Synthetic oligonucleotide
tgaaaatgcaattggagtaccaggaaacaggagtttcttttc

SEQ ID NO: 209538 - DNA, 41 bp, Artificial Sequence
  Description of Artificial Sequence: Synthetic oligonucleotide
gaaaatgcaattggagtaccaggaaacaggagtttcttttc

SEQ ID NO: 209539 - DNA, 41 bp, Artificial Sequence
  Description of Artificial Sequence: Synthetic oligonucleotide
aaaatgcaattggagtaccaggaaacaggagtttcttttcc

SEQ ID NO: 209540 - DNA, 40 bp, Artificial Sequence
  Description of Artificial Sequence: Synthetic oligonucleotide
aaatgcaattggagtaccaggaaacaggagtttcttttcc

SEQ ID NO: 209541 - DNA, 39 bp, Artificial Sequence
  Description of Artificial Sequence: Synthetic oligonucleotide
aatgcaattggagtaccaggaaacaggagtttcttttcc

SEQ ID NO: 209542 - DNA, 38 bp, Artificial Sequence
  Description of Artificial Sequence: Synthetic oligonucleotide
atgcaattggagtaccaggaaacaggagtttcttttcc

SEQ ID NO: 209543 - DNA, 37 bp, Artificial Sequence
  Description of Artificial Sequence: Synthetic oligonucleotide
tgcaattggagtaccaggaaacaggagtttcttttcc

SEQ ID NO: 209544 - DNA, 36 bp, Artificial Sequence
  Description of Artificial Sequence: Synthetic oligonucleotide
gcaattggagtaccaggaaacaggagtttcttttcc

SEQ ID NO: 209545 - DNA, 36 bp, Artificial Sequence
  Description of Artificial Sequence: Synthetic oligonucleotide
caattggagtaccaggaaacaggagtttcttttccc

SEQ ID NO: 209546 - DNA, 37 bp, Artificial Sequence
  Description of Artificial Sequence: Synthetic oligonucleotide
aattggagtaccaggaaacaggagtttcttttccctc

SEQ ID NO: 209547 - DNA, 36 bp, Artificial Sequence
  Description of Artificial Sequence: Synthetic oligonucleotide
attggagtaccaggaaacaggagtttcttttccctc

SEQ ID NO: 209548 - DNA, 35 bp, Artificial Sequence
  Description of Artificial Sequence: Synthetic oligonucleotide
ttggagtaccaggaaacaggagtttcttttccctc

SEQ ID NO: 209549 - DNA, 34 bp, Artificial Sequence
  Description of Artificial Sequence: Synthetic oligonucleotide
tggagtaccaggaaacaggagtttcttttccctc

SEQ ID NO: 209550 - DNA, 33 bp, Artificial Sequence
  Description of Artificial Sequence: Synthetic oligonucleotide
ggagtaccaggaaacaggagtttcttttccctc

SEQ ID NO: 209551 - DNA, 34 bp, Artificial Sequence
  Description of Artificial Sequence: Synthetic oligonucleotide
gagtaccaggaaacaggagtttcttttccctcac

SEQ ID NO: 209552 - DNA, 35 bp, Artificial Sequence
  Description of Artificial Sequence: Synthetic oligonucleotide
agtaccaggaaacaggagtttcttttccctcactg

SEQ ID NO: 209553 - DNA, 34 bp, Artificial Sequence
  Description of Artificial Sequence: Synthetic oligonucleotide
gtaccaggaaacaggagtttcttttccctcactg

SEQ ID NO: 209554 - DNA, 35 bp, Artificial Sequence
  Description of Artificial Sequence: Synthetic oligonucleotide
taccaggaaacaggagtttcttttccctcactgag

SEQ ID NO: 209555 - DNA, 34 bp, Artificial Sequence
  Description of Artificial Sequence: Synthetic oligonucleotide
accaggaaacaggagtttcttttccctcactgag

SEQ ID NO: 209556 - DNA, 33 bp, Artificial Sequence
  Description of Artificial Sequence: Synthetic oligonucleotide
ccaggaaacaggagtttcttttccctcactgag

SEQ ID NO: 209557 - DNA, 35 bp, Artificial Sequence
  Description of Artificial Sequence: Synthetic oligonucleotide
caggaaacaggagtttcttttccctcactgagatc

SEQ ID NO: 209558 - DNA, 35 bp, Artificial Sequence
  Description of Artificial Sequence: Synthetic oligonucleotide
aggaaacaggagtttcttttccctcactgagatcg

SEQ ID NO: 209559 - DNA, 34 bp, Artificial Sequence
  Description of Artificial Sequence: Synthetic oligonucleotide
ggaaacaggagtttcttttccctcactgagatcg

SEQ ID NO: 209560 - DNA, 35 bp, Artificial Sequence
  Description of Artificial Sequence: Synthetic oligonucleotide
gaaacaggagtttcttttccctcactgagatcgtc

SEQ ID NO: 209561 - DNA, 36 bp, Artificial Sequence
  Description of Artificial Sequence: Synthetic oligonucleotide
aaacaggagtttcttttccctcactgagatcgtcag

SEQ ID NO: 209562 - DNA, 35 bp, Artificial Sequence
  Description of Artificial Sequence: Synthetic oligonucleotide
aacaggagtttcttttccctcactgagatcgtcag

SEQ ID NO: 209563 - DNA, 34 bp, Artificial Sequence
  Description of Artificial Sequence: Synthetic oligonucleotide
acaggagtttcttttccctcactgagatcgtcag

SEQ ID NO: 209564 - DNA, 33 bp, Artificial Sequence
  Description of Artificial Sequence: Synthetic oligonucleotide
caggagtttcttttccctcactgagatcgtcag

SEQ ID NO: 209565 - DNA, 38 bp, Artificial Sequence
  Description of Artificial Sequence: Synthetic oligonucleotide
aggagtttcttttccctcactgagatcgtcagatttag

SEQ ID NO: 209566 - DNA, 37 bp, Artificial Sequence
  Description of Artificial Sequence: Synthetic oligonucleotide
ggagtttcttttccctcactgagatcgtcagatttag

SEQ ID NO: 209567 - DNA, 39 bp, Artificial Sequence
  Description of Artificial Sequence: Synthetic oligonucleotide
gagtttcttttccctcactgagatcgtcagatttagatg

SEQ ID NO: 209568 - DNA, 40 bp, Artificial Sequence
  Description of Artificial Sequence: Synthetic oligonucleotide
agtttcttttccctcactgagatcgtcagatttagatgtc

SEQ ID NO: 209569 - DNA, 39 bp, Artificial Sequence
  Description of Artificial Sequence: Synthetic oligonucleotide
gtttcttttccctcactgagatcgtcagatttagatgtc

SEQ ID NO: 209570 - DNA, 40 bp, Artificial Sequence
  Description of Artificial Sequence: Synthetic oligonucleotide
tttcttttccctcactgagatcgtcagatttagatgtcag

SEQ ID NO: 209571 - DNA, 39 bp, Artificial Sequence
  Description of Artificial Sequence: Synthetic oligonucleotide
ttcttttccctcactgagatcgtcagatttagatgtcag

SEQ ID NO: 209572 - DNA, 38 bp, Artificial Sequence
  Description of Artificial Sequence: Synthetic oligonucleotide
tcttttccctcactgagatcgtcagatttagatgtcag

SEQ ID NO: 209573 - DNA, 37 bp, Artificial Sequence
  Description of Artificial Sequence: Synthetic oligonucleotide
cttttccctcactgagatcgtcagatttagatgtcag

SEQ ID NO: 209574 - DNA, 37 bp, Artificial Sequence
  Description of Artificial Sequence: Synthetic oligonucleotide
ttttccctcactgagatcgtcagatttagatgtcagc

SEQ ID NO: 209575 - DNA, 36 bp, Artificial Sequence
  Description of Artificial Sequence: Synthetic oligonucleotide
tttccctcactgagatcgtcagatttagatgtcagc

SEQ ID NO: 209576 - DNA, 35 bp, Artificial Sequence
  Description of Artificial Sequence: Synthetic oligonucleotide
ttccctcactgagatcgtcagatttagatgtcagc

SEQ ID NO: 209577 - DNA, 34 bp, Artificial Sequence
  Description of Artificial Sequence: Synthetic oligonucleotide
tccctcactgagatcgtcagatttagatgtcagc

SEQ ID NO: 209578 - DNA, 33 bp, Artificial Sequence
  Description of Artificial Sequence: Synthetic oligonucleotide
ccctcactgagatcgtcagatttagatgtcagc

SEQ ID NO: 209579 - DNA, 33 bp, Artificial Sequence
  Description of Artificial Sequence: Synthetic oligonucleotide
cctcactgagatcgtcagatttagatgtcagcc

SEQ ID NO: 209580 - DNA, 33 bp, Artificial Sequence
  Description of Artificial Sequence: Synthetic oligonucleotide
ctcactgagatcgtcagatttagatgtcagccc

SEQ ID NO: 209581 - DNA, 33 bp, Artificial Sequence
  Description of Artificial Sequence: Synthetic oligonucleotide
tcactgagatcgtcagatttagatgtcagcccg

SEQ ID NO: 209582 - DNA, 32 bp, Artificial Sequence
  Description of Artificial Sequence: Synthetic oligonucleotide
cactgagatcgtcagatttagatgtcagcccg

SEQ ID NO: 209583 - DNA, 32 bp, Artificial Sequence
  Description of Artificial Sequence: Synthetic oligonucleotide
actgagatcgtcagatttagatgtcagcccgg

SEQ ID NO: 209584 - DNA, 31 bp, Artificial Sequence
  Description of Artificial Sequence: Synthetic oligonucleotide
ctgagatcgtcagatttagatgtcagcccgg

SEQ ID NO: 209585 - DNA, 31 bp, Artificial Sequence
  Description of Artificial Sequence: Synthetic oligonucleotide
tgagatcgtcagatttagatgtcagcccggg

SEQ ID NO: 209586 - DNA, 30 bp, Artificial Sequence
  Description of Artificial Sequence: Synthetic oligonucleotide
gagatcgtcagatttagatgtcagcccggg

SEQ ID NO: 209587 - DNA, 33 bp, Artificial Sequence
  Description of Artificial Sequence: Synthetic oligonucleotide
agatcgtcagatttagatgtcagcccgggtttg

SEQ ID NO: 209588 - DNA, 32 bp, Artificial Sequence
  Description of Artificial Sequence: Synthetic oligonucleotide
gatcgtcagatttagatgtcagcccgggtttg

SEQ ID NO: 209589 - DNA, 33 bp, Artificial Sequence
  Description of Artificial Sequence: Synthetic oligonucleotide
atcgtcagatttagatgtcagcccgggtttgtc

SEQ ID NO: 209590 - DNA, 32 bp, Artificial Sequence
  Description of Artificial Sequence: Synthetic oligonucleotide
tcgtcagatttagatgtcagcccgggtttgtc

SEQ ID NO: 209591 - DNA, 31 bp, Artificial Sequence
  Description of Artificial Sequence: Synthetic oligonucleotide
cgtcagatttagatgtcagcccgggtttgtc

SEQ ID NO: 209592 - DNA, 33 bp, Artificial Sequence
  Description of Artificial Sequence: Synthetic oligonucleotide
gtcagatttagatgtcagcccgggtttgtcatg

SEQ ID NO: 209593 - DNA, 24 bp, Artificial Sequence
  Description of Artificial Sequence: Synthetic oligonucleotide
ccaagctgccacactgctccaggg

SEQ ID NO: 209594 - DNA, 31 bp, Artificial Sequence
  Description of Artificial Sequence: Synthetic oligonucleotide
agccctccccctcggtgtatttctactaatg

SEQ ID NO: 209595 - DNA, 30 bp, Artificial Sequence
  Description of Artificial Sequence: Synthetic oligonucleotide
gccctccccctcggtgtatttctactaatg

SEQ ID NO: 209596 - DNA, 33 bp, Artificial Sequence
  Description of Artificial Sequence: Synthetic oligonucleotide
ccctccccctcggtgtatttctactaatgaatg

SEQ ID NO: 209597 - DNA, 33 bp, Artificial Sequence
  Description of Artificial Sequence: Synthetic oligonucleotide
cctccccctcggtgtatttctactaatgaatgc

SEQ ID NO: 209598 - DNA, 34 bp, Artificial Sequence
  Description of Artificial Sequence: Synthetic oligonucleotide
ctccccctcggtgtatttctactaatgaatgcac

SEQ ID NO: 209599 - DNA, 35 bp, Artificial Sequence
  Description of Artificial Sequence: Synthetic oligonucleotide
tccccctcggtgtatttctactaatgaatgcacag

SEQ ID NO: 209600 - DNA, 34 bp, Artificial Sequence
  Description of Artificial Sequence: Synthetic oligonucleotide
ccccctcggtgtatttctactaatgaatgcacag

SEQ ID NO: 209601 - DNA, 34 bp, Artificial Sequence
  Description of Artificial Sequence: Synthetic oligonucleotide
cccctcggtgtatttctactaatgaatgcacagc

SEQ ID NO: 209602 - DNA, 35 bp, Artificial Sequence
  Description of Artificial Sequence: Synthetic oligonucleotide
ccctcggtgtatttctactaatgaatgcacagctc

SEQ ID NO: 209603 - DNA, 35 bp, Artificial Sequence
  Description of Artificial Sequence: Synthetic oligonucleotide
cctcggtgtatttctactaatgaatgcacagctcc

SEQ ID NO: 209604 - DNA, 36 bp, Artificial Sequence
  Description of Artificial Sequence: Synthetic oligonucleotide
ctcggtgtatttctactaatgaatgcacagctccag

SEQ ID NO: 209605 - DNA, 38 bp, Artificial Sequence
  Description of Artificial Sequence: Synthetic oligonucleotide
tcggtgtatttctactaatgaatgcacagctccagaag

SEQ ID NO: 209606 - DNA, 37 bp, Artificial Sequence
  Description of Artificial Sequence: Synthetic oligonucleotide
cggtgtatttctactaatgaatgcacagctccagaag

SEQ ID NO: 209607 - DNA, 39 bp, Artificial Sequence
  Description of Artificial Sequence: Synthetic oligonucleotide
ggtgtatttctactaatgaatgcacagctccagaagttg

SEQ ID NO: 209608 - DNA, 44 bp, Artificial Sequence
  Description of Artificial Sequence: Synthetic oligonucleotide
gtgtatttctactaatgaatgcacagctccagaagttgaaaatg

SEQ ID NO: 209609 - DNA, 44 bp, Artificial Sequence
  Description of Artificial Sequence: Synthetic oligonucleotide
tgtatttctactaatgaatgcacagctccagaagttgaaaatgc

SEQ ID NO: 209610 - DNA, 43 bp, Artificial Sequence
  Description of Artificial Sequence: Synthetic oligonucleotide
gtatttctactaatgaatgcacagctccagaagttgaaaatgc

SEQ ID NO: 209611 - DNA, 47 bp, Artificial Sequence
  Description of Artificial Sequence: Synthetic oligonucleotide
tatttctactaatgaatgcacagctccagaagttgaaaatgcaattg

SEQ ID NO: 209612 - DNA, 46 bp, Artificial Sequence
  Description of Artificial Sequence: Synthetic oligonucleotide
atttctactaatgaatgcacagctccagaagttgaaaatgcaattg

SEQ ID NO: 209613 - DNA, 45 bp, Artificial Sequence
  Description of Artificial Sequence: Synthetic oligonucleotide
tttctactaatgaatgcacagctccagaagttgaaaatgcaattg

SEQ ID NO: 209614 - DNA, 44 bp, Artificial Sequence
  Description of Artificial Sequence: Synthetic oligonucleotide
ttctactaatgaatgcacagctccagaagttgaaaatgcaattg

SEQ ID NO: 209615 - DNA, 43 bp, Artificial Sequence
  Description of Artificial Sequence: Synthetic oligonucleotide
tctactaatgaatgcacagctccagaagttgaaaatgcaattg

SEQ ID NO: 209616 - DNA, 42 bp, Artificial Sequence
  Description of Artificial Sequence: Synthetic oligonucleotide
ctactaatgaatgcacagctccagaagttgaaaatgcaattg

SEQ ID NO: 209617 - DNA, 42 bp, Artificial Sequence
  Description of Artificial Sequence: Synthetic oligonucleotide
tactaatgaatgcacagctccagaagttgaaaatgcaattgg

SEQ ID NO: 209618 - DNA, 41 bp, Artificial Sequence
  Description of Artificial Sequence: Synthetic oligonucleotide
actaatgaatgcacagctccagaagttgaaaatgcaattgg

SEQ ID NO: 209619 - DNA, 40 bp, Artificial Sequence
  Description of Artificial Sequence: Synthetic oligonucleotide
ctaatgaatgcacagctccagaagttgaaaatgcaattgg

SEQ ID NO: 209620 - DNA, 41 bp, Artificial Sequence
  Description of Artificial Sequence: Synthetic oligonucleotide
taatgaatgcacagctccagaagttgaaaatgcaattggag

SEQ ID NO: 209621 - DNA, 40 bp, Artificial Sequence
  Description of Artificial Sequence: Synthetic oligonucleotide
aatgaatgcacagctccagaagttgaaaatgcaattggag

SEQ ID NO: 209622 - DNA, 39 bp, Artificial Sequence
  Description of Artificial Sequence: Synthetic oligonucleotide
atgaatgcacagctccagaagttgaaaatgcaattggag

SEQ ID NO: 209623 - DNA, 38 bp, Artificial Sequence
  Description of Artificial Sequence: Synthetic oligonucleotide
tgaatgcacagctccagaagttgaaaatgcaattggag

SEQ ID NO: 209624 - DNA, 37 bp, Artificial Sequence
  Description of Artificial Sequence: Synthetic oligonucleotide
gaatgcacagctccagaagttgaaaatgcaattggag

SEQ ID NO: 209625 - DNA, 46 bp, Artificial Sequence
  Description of Artificial Sequence: Synthetic oligonucleotide
aagttgaaaatgcaattagagtaccaggaaacaggagtttcttttc

SEQ ID NO: 209626 - DNA, 45 bp, Artificial Sequence
  Description of Artificial Sequence: Synthetic oligonucleotide
agttgaaaatgcaattagagtaccaggaaacaggagtttcttttc

SEQ ID NO: 209627 - DNA, 44 bp, Artificial Sequence
  Description of Artificial Sequence: Synthetic oligonucleotide
gttgaaaatgcaattagagtaccaggaaacaggagtttcttttc

SEQ ID NO: 209628 - DNA, 44 bp, Artificial Sequence
  Description of Artificial Sequence: Synthetic oligonucleotide
ttgaaaatgcaattagagtaccaggaaacaggagtttcttttcc

SEQ ID NO: 209629 - DNA, 43 bp, Artificial Sequence
  Description of Artificial Sequence: Synthetic oligonucleotide
tgaaaatgcaattagagtaccaggaaacaggagtttcttttcc

SEQ ID NO: 209630 - DNA, 42 bp, Artificial Sequence
  Description of Artificial Sequence: Synthetic oligonucleotide
gaaaatgcaattagagtaccaggaaacaggagtttcttttcc

SEQ ID NO: 209631 - DNA, 42 bp, Artificial Sequence
  Description of Artificial Sequence: Synthetic oligonucleotide
aaaatgcaattagagtaccaggaaacaggagtttcttttccc

SEQ ID NO: 209632 - DNA, 41 bp, Artificial Sequence
  Description of Artificial Sequence: Synthetic oligonucleotide
aaatgcaattagagtaccaggaaacaggagtttcttttccc

SEQ ID NO: 209633 - DNA, 40 bp, Artificial Sequence
  Description of Artificial Sequence: Synthetic oligonucleotide
aatgcaattagagtaccaggaaacaggagtttcttttccc

SEQ ID NO: 209634 - DNA, 39 bp, Artificial Sequence
  Description of Artificial Sequence: Synthetic oligonucleotide
atgcaattagagtaccaggaaacaggagtttcttttccc

SEQ ID NO: 209635 - DNA, 38 bp, Artificial Sequence
  Description of Artificial Sequence: Synthetic oligonucleotide
tgcaattagagtaccaggaaacaggagtttcttttccc

SEQ ID NO: 209636 - DNA, 37 bp, Artificial Sequence
  Description of Artificial Sequence: Synthetic oligonucleotide
gcaattagagtaccaggaaacaggagtttcttttccc

SEQ ID NO: 209637 - DNA, 38 bp, Artificial Sequence
  Description of Artificial Sequence: Synthetic oligonucleotide
caattagagtaccaggaaacaggagtttcttttccctc

SEQ ID NO: 209638 - DNA, 39 bp, Artificial Sequence
  Description of Artificial Sequence: Synthetic oligonucleotide
aattagagtaccaggaaacaggagtttcttttccctcac

SEQ ID NO: 209639 - DNA, 38 bp, Artificial Sequence
  Description of Artificial Sequence: Synthetic oligonucleotide
attagagtaccaggaaacaggagtttcttttccctcac

SEQ ID NO: 209640 - DNA, 37 bp, Artificial Sequence
  Description of Artificial Sequence: Synthetic oligonucleotide
ttagagtaccaggaaacaggagtttcttttccctcac

SEQ ID NO: 209641 - DNA, 36 bp, Artificial Sequence
  Description of Artificial Sequence: Synthetic oligonucleotide
tagagtaccaggaaacaggagtttcttttccctcac

SEQ ID NO: 209642 - DNA, 35 bp, Artificial Sequence
  Description of Artificial Sequence: Synthetic oligonucleotide
agagtaccaggaaacaggagtttcttttccctcac

SEQ ID NO: 209643 - DNA, 37 bp, Artificial Sequence
  Description of Artificial Sequence: Synthetic oligonucleotide
aggaaacaggagtttcttttccctcactgagatcatc

SEQ ID NO: 209644 - DNA, 36 bp, Artificial Sequence
  Description of Artificial Sequence: Synthetic oligonucleotide
ggaaacaggagtttcttttccctcactgagatcatc

SEQ ID NO: 209645 - DNA, 37 bp, Artificial Sequence
  Description of Artificial Sequence: Synthetic oligonucleotide
gaaacaggagtttcttttccctcactgagatcatcag

SEQ ID NO: 209646 - DNA, 42 bp, Artificial Sequence
  Description of Artificial Sequence: Synthetic oligonucleotide
aaacaggagtttcttttccctcactgagatcatcagatttag

SEQ ID NO: 209647 - DNA, 41 bp, Artificial Sequence
  Description of Artificial Sequence: Synthetic oligonucleotide
aacaggagtttcttttccctcactgagatcatcagatttag

SEQ ID NO: 209648 - DNA, 40 bp, Artificial Sequence
  Description of Artificial Sequence: Synthetic oligonucleotide
acaggagtttcttttccctcactgagatcatcagatttag

SEQ ID NO: 209649 - DNA, 39 bp, Artificial Sequence
  Description of Artificial Sequence: Synthetic oligonucleotide
caggagtttcttttccctcactgagatcatcagatttag

SEQ ID NO: 209650 - DNA, 41 bp, Artificial Sequence
  Description of Artificial Sequence: Synthetic oligonucleotide
aggagtttcttttccctcactgagatcatcagatttagatg

SEQ ID NO: 209651 - DNA, 40 bp, Artificial Sequence
  Description of Artificial Sequence: Synthetic oligonucleotide
ggagtttcttttccctcactgagatcatcagatttagatg

SEQ ID NO: 209652 - DNA, 41 bp, Artificial Sequence
  Description of Artificial Sequence: Synthetic oligonucleotide
gagtttcttttccctcactgagatcatcagatttagatgtc

SEQ ID NO: 209653 - DNA, 42 bp, Artificial Sequence
  Description of Artificial Sequence: Synthetic oligonucleotide
agtttcttttccctcactgagatcatcagatttagatgtcag

SEQ ID NO: 209654 - DNA, 41 bp, Artificial Sequence
  Description of Artificial Sequence: Synthetic oligonucleotide
gtttcttttccctcactgagatcatcagatttagatgtcag

SEQ ID NO: 209655 - DNA, 41 bp, Artificial Sequence
  Description of Artificial Sequence: Synthetic oligonucleotide
tttcttttccctcactgagatcatcagatttagatgtcagc

SEQ ID NO: 209656 - DNA, 40 bp, Artificial Sequence
  Description of Artificial Sequence: Synthetic oligonucleotide
ttcttttccctcactgagatcatcagatttagatgtcagc

SEQ ID NO: 209657 - DNA, 39 bp, Artificial Sequence
  Description of Artificial Sequence: Synthetic oligonucleotide
tcttttccctcactgagatcatcagatttagatgtcagc

SEQ ID NO: 209658 - DNA, 38 bp, Artificial Sequence
  Description of Artificial Sequence: Synthetic oligonucleotide
cttttccctcactgagatcatcagatttagatgtcagc

SEQ ID NO: 209659 - DNA, 38 bp, Artificial Sequence
  Description of Artificial Sequence: Synthetic oligonucleotide
ttttccctcactgagatcatcagatttagatgtcagcc

SEQ ID NO: 209660 - DNA, 37 bp, Artificial Sequence
  Description of Artificial Sequence: Synthetic oligonucleotide
tttccctcactgagatcatcagatttagatgtcagcc

SEQ ID NO: 209661 - DNA, 36 bp, Artificial Sequence
  Description of Artificial Sequence: Synthetic oligonucleotide
ttccctcactgagatcatcagatttagatgtcagcc

SEQ ID NO: 209662 - DNA, 35 bp, Artificial Sequence
  Description of Artificial Sequence: Synthetic oligonucleotide
tccctcactgagatcatcagatttagatgtcagcc

SEQ ID NO: 209663 - DNA, 25 bp, Artificial Sequence
  Description of Artificial Sequence: Synthetic oligonucleotide
ccggagctaccaagctgctccagga

SEQ ID NO: 209664 - DNA, 25 bp, Artificial Sequence
  Description of Artificial Sequence: Synthetic oligonucleotide
cggagctaccaagctgctccaggag

SEQ ID NO: 209665 - DNA, 25 bp, Artificial Sequence
  Description of Artificial Sequence: Synthetic oligonucleotide
ggagctaccaagctgctccaggagg

SEQ ID NO: 209666 - DNA, 26 bp, Artificial Sequence
  Description of Artificial Sequence: Synthetic oligonucleotide
gagctaccaagctgctccaggaggga

SEQ ID NO: 209667 - DNA, 27 bp, Artificial Sequence
  Description of Artificial Sequence: Synthetic oligonucleotide
agctaccaagctgctccaggagggaca

SEQ ID NO: 209668 - DNA, 27 bp, Artificial Sequence
  Description of Artificial Sequence: Synthetic oligonucleotide
gctaccaagctgctccaggagggacaa

SEQ ID NO: 209669 - DNA, 27 bp, Artificial Sequence
  Description of Artificial Sequence: Synthetic oligonucleotide
ctaccaagctgctccaggagggacaag

SEQ ID NO: 209670 - DNA, 27 bp, Artificial Sequence
  Description of Artificial Sequence: Synthetic oligonucleotide
taccaagctgctccaggagggacaagg

SEQ ID NO: 209671 - DNA, 27 bp, Artificial Sequence
  Description of Artificial Sequence: Synthetic oligonucleotide
accaagctgctccaggagggacaagga

SEQ ID NO: 209672 - DNA, 26 bp, Artificial Sequence
  Description of Artificial Sequence: Synthetic oligonucleotide
ccaagctgctccaggagggacaagga

SEQ ID NO: 209673 - DNA, 27 bp, Artificial Sequence
  Description of Artificial Sequence: Synthetic oligonucleotide
caagctgctccaggagggacaaggaca

SEQ ID NO: 209674 - DNA, 28 bp, Artificial Sequence
  Description of Artificial Sequence: Synthetic oligonucleotide
aagctgctccaggagggacaaggacaac

SEQ ID NO: 209675 - DNA, 27 bp, Artificial Sequence
  Description of Artificial Sequence: Synthetic oligonucleotide
agctgctccaggagggacaaggacaac

SEQ ID NO: 209676 - DNA, 27 bp, Artificial Sequence
  Description of Artificial Sequence: Synthetic oligonucleotide
gctgctccaggagggacaaggacaact

SEQ ID NO: 209677 - DNA, 30 bp, Artificial Sequence
  Description of Artificial Sequence: Synthetic oligonucleotide
ctgctccaggagggacaaggacaacttttc

SEQ ID NO: 209678 - DNA, 31 bp, Artificial Sequence
  Description of Artificial Sequence: Synthetic oligonucleotide
tgctccaggagggacaaggacaacttttcac

SEQ ID NO: 209679 - DNA, 30 bp, Artificial Sequence
  Description of Artificial Sequence: Synthetic oligonucleotide
gctccaggagggacaaggacaacttttcac

SEQ ID NO: 209680 - DNA, 30 bp, Artificial Sequence
  Description of Artificial Sequence: Synthetic oligonucleotide
ctccaggagggacaaggacaacttttcacc

SEQ ID NO: 209681 - DNA, 30 bp, Artificial Sequence
  Description of Artificial Sequence: Synthetic oligonucleotide
tccaggagggacaaggacaacttttcaccc

SEQ ID NO: 209682 - DNA, 29 bp, Artificial Sequence
  Description of Artificial Sequence: Synthetic oligonucleotide
ccaggagggacaaggacaacttttcaccc

SEQ ID NO: 209683 - DNA, 29 bp, Artificial Sequence
  Description of Artificial Sequence: Synthetic oligonucleotide
caggagggacaaggacaacttttcacccg

SEQ ID NO: 209684 - DNA, 29 bp, Artificial Sequence
  Description of Artificial Sequence: Synthetic oligonucleotide
aggagggacaaggacaacttttcacccgg

SEQ ID NO: 209685 - DNA, 28 bp, Artificial Sequence
  Description of Artificial Sequence: Synthetic oligonucleotide
ggagggacaaggacaacttttcacccgg

SEQ ID NO: 209686 - DNA, 28 bp, Artificial Sequence
  Description of Artificial Sequence: Synthetic oligonucleotide
gagggacaaggacaacttttcacccggg

SEQ ID NO: 209687 - DNA, 27 bp, Artificial Sequence
  Description of Artificial Sequence: Synthetic oligonucleotide
gctgtgagcccggctatgacctcagaa

SEQ ID NO: 209688 - DNA, 29 bp, Artificial Sequence
  Description of Artificial Sequence: Synthetic oligonucleotide
ctgtgagcccggctatgacctcagaaaag

SEQ ID NO: 209689 - DNA, 30 bp, Artificial Sequence
  Description of Artificial Sequence: Synthetic oligonucleotide
tgtgagcccggctatgacctcagaaaagtg

SEQ ID NO: 209690 - DNA, 29 bp, Artificial Sequence
  Description of Artificial Sequence: Synthetic oligonucleotide
gtgagcccggctatgacctcagaaaagtg

SEQ ID NO: 209691 - DNA, 29 bp, Artificial Sequence
  Description of Artificial Sequence: Synthetic oligonucleotide
tgagcccggctatgacctcagaaaagtgg

SEQ ID NO: 209692 - DNA, 28 bp, Artificial Sequence
  Description of Artificial Sequence: Synthetic oligonucleotide
gagcccggctatgacctcagaaaagtgg

SEQ ID NO: 209693 - DNA, 33 bp, Artificial Sequence
  Description of Artificial Sequence: Synthetic oligonucleotide
agcccggctatgacctcagaaaagtggattttg

SEQ ID NO: 209694 - DNA, 32 bp, Artificial Sequence
  Description of Artificial Sequence: Synthetic oligonucleotide
gcccggctatgacctcagaaaagtggattttg

SEQ ID NO: 209695 - DNA, 35 bp, Artificial Sequence
  Description of Artificial Sequence: Synthetic oligonucleotide
cccggctatgacctcagaaaagtggattttgtttg

SEQ ID NO: 209696 - DNA, 36 bp, Artificial Sequence
  Description of Artificial Sequence: Synthetic oligonucleotide
ccggctatgacctcagaaaagtggattttgtttgtg

SEQ ID NO: 209697 - DNA, 38 bp, Artificial Sequence
  Description of Artificial Sequence: Synthetic oligonucleotide
cggctatgacctcagaaaagtggattttgtttgtgatg

SEQ ID NO: 209698 - DNA, 40 bp, Artificial Sequence
  Description of Artificial Sequence: Synthetic oligonucleotide
ggctatgacctcagaaaagtggattttgtttgtgatgaag

SEQ ID NO: 209699 - DNA, 40 bp, Artificial Sequence
  Description of Artificial Sequence: Synthetic oligonucleotide
gctatgacctcagaaaagtggattttgtttgtgatgaagg

SEQ ID NO: 209700 - DNA, 43 bp, Artificial Sequence
  Description of Artificial Sequence: Synthetic oligonucleotide
ctatgacctcagaaaagtggattttgtttgtgatgaaggattc

SEQ ID NO: 209701 - DNA, 43 bp, Artificial Sequence
  Description of Artificial Sequence: Synthetic oligonucleotide
tatgacctcagaaaagtggattttgtttgtgatgaaggattcc

SEQ ID NO: 209702 - DNA, 42 bp, Artificial Sequence
  Description of Artificial Sequence: Synthetic oligonucleotide
atgacctcagaaaagtggattttgtttgtgatgaaggattcc

SEQ ID NO: 209703 - DNA, 41 bp, Artificial Sequence
  Description of Artificial Sequence: Synthetic oligonucleotide
tgacctcagaaaagtggattttgtttgtgatgaaggattcc

SEQ ID NO: 209704 - DNA, 40 bp, Artificial Sequence
  Description of Artificial Sequence: Synthetic oligonucleotide
gacctcagaaaagtggattttgtttgtgatgaaggattcc

SEQ ID NO: 209705 - DNA, 48 bp, Artificial Sequence
  Description of Artificial Sequence: Synthetic oligonucleotide
acctcagaaaagtggattttgtttgtgatgaaggattccaattaaaag

SEQ ID NO: 209706 - DNA, 47 bp, Artificial Sequence
  Description of Artificial Sequence: Synthetic oligonucleotide
cctcagaaaagtggattttgtttgtgatgaaggattccaattaaaag

SEQ ID NO: 209707 - DNA, 47 bp, Artificial Sequence
  Description of Artificial Sequence: Synthetic oligonucleotide
ctcagaaaagtggattttgtttgtgatgaaggattccaattaaaagg

SEQ ID NO: 209708 - DNA, 47 bp, Artificial Sequence
  Description of Artificial Sequence: Synthetic oligonucleotide
tcagaaaagtggattttgtttgtgatgaaggattccaattaaaaggc

SEQ ID NO: 209709 - DNA, 46 bp, Artificial Sequence
  Description of Artificial Sequence: Synthetic oligonucleotide
cagaaaagtggattttgtttgtgatgaaggattccaattaaaaggc

SEQ ID NO: 209710 - DNA, 47 bp, Artificial Sequence
  Description of Artificial Sequence: Synthetic oligonucleotide
agaaaagtggattttgtttgtgatgaaggattccaattaaaaggcag

SEQ ID NO: 209711 - DNA, 46 bp, Artificial Sequence
  Description of Artificial Sequence: Synthetic oligonucleotide
gaaaagtggattttgtttgtgatgaaggattccaattaaaaggcag

SEQ ID NO: 209712 - DNA, 32 bp, Artificial Sequence
  Description of Artificial Sequence: Synthetic oligonucleotide
catttgccaggcctaccaacctaactgatgag

SEQ ID NO: 209713 - DNA, 35 bp, Artificial Sequence
  Description of Artificial Sequence: Synthetic oligonucleotide
atttgccaggcctaccaacctaactgatgagtttg

SEQ ID NO: 209714 - DNA, 34 bp, Artificial Sequence
  Description of Artificial Sequence: Synthetic oligonucleotide
tttgccaggcctaccaacctaactgatgagtttg

SEQ ID NO: 209715 - DNA, 33 bp, Artificial Sequence
  Description of Artificial Sequence: Synthetic oligonucleotide
ttgccaggcctaccaacctaactgatgagtttg

SEQ ID NO: 209716 - DNA, 32 bp, Artificial Sequence
  Description of Artificial Sequence: Synthetic oligonucleotide
tgccaggcctaccaacctaactgatgagtttg

SEQ ID NO: 209717 - DNA, 31 bp, Artificial Sequence
  Description of Artificial Sequence: Synthetic oligonucleotide
gccaggcctaccaacctaactgatgagtttg

SEQ ID NO: 209718 - DNA, 32 bp, Artificial Sequence
  Description of Artificial Sequence: Synthetic oligonucleotide
ccaggcctaccaacctaactgatgagtttgag

SEQ ID NO: 209719 - DNA, 35 bp, Artificial Sequence
  Description of Artificial Sequence: Synthetic oligonucleotide
caggcctaccaacctaactgatgagtttgagtttc

SEQ ID NO: 209720 - DNA, 35 bp, Artificial Sequence
  Description of Artificial Sequence: Synthetic oligonucleotide
aggcctaccaacctaactgatgagtttgagtttcc

SEQ ID NO: 209721 - DNA, 34 bp, Artificial Sequence
  Description of Artificial Sequence: Synthetic oligonucleotide
ggcctaccaacctaactgatgagtttgagtttcc

SEQ ID NO: 209722 - DNA, 34 bp, Artificial Sequence
  Description of Artificial Sequence: Synthetic oligonucleotide
gcctaccaacctaactgatgagtttgagtttccc

SEQ ID NO: 209723 - DNA, 37 bp, Artificial Sequence
  Description of Artificial Sequence: Synthetic oligonucleotide
cctaccaacctaactgatgagtttgagtttcccattg

SEQ ID NO: 209724 - DNA, 37 bp, Artificial Sequence
  Description of Artificial Sequence: Synthetic oligonucleotide
ctaccaacctaactgatgagtttgagtttcccattgg

SEQ ID NO: 209725 - DNA, 37 bp, Artificial Sequence
  Description of Artificial Sequence: Synthetic oligonucleotide
taccaacctaactgatgagtttgagtttcccattggg

SEQ ID NO: 209726 - DNA, 36 bp, Artificial Sequence
  Description of Artificial Sequence: Synthetic oligonucleotide
accaacctaactgatgagtttgagtttcccattggg

SEQ ID NO: 209727 - DNA, 35 bp, Artificial Sequence
  Description of Artificial Sequence: Synthetic oligonucleotide
ccaacctaactgatgagtttgagtttcccattggg

SEQ ID NO: 209728 - DNA, 36 bp, Artificial Sequence
  Description of Artificial Sequence: Synthetic oligonucleotide
caacctaactgatgagtttgagtttcccattgggac

SEQ ID NO: 209729 - DNA, 40 bp, Artificial Sequence
  Description of Artificial Sequence: Synthetic oligonucleotide
aacctaactgatgagtttgagtttcccattgggacatatc

SEQ ID NO: 209730 - DNA, 39 bp, Artificial Sequence
  Description of Artificial Sequence: Synthetic oligonucleotide
acctaactgatgagtttgagtttcccattgggacatatc

SEQ ID NO: 209731 - DNA, 38 bp, Artificial Sequence
  Description of Artificial Sequence: Synthetic oligonucleotide
cctaactgatgagtttgagtttcccattgggacatatc

SEQ ID NO: 209732 - DNA, 39 bp, Artificial Sequence
  Description of Artificial Sequence: Synthetic oligonucleotide
ctaactgatgagtttgagtttcccattgggacatatctg

SEQ ID NO: 209733 - DNA, 41 bp, Artificial Sequence
  Description of Artificial Sequence: Synthetic oligonucleotide
taactgatgagtttgagtttcccattgggacatatctgaac

SEQ ID NO: 209734 - DNA, 40 bp, Artificial Sequence
  Description of Artificial Sequence: Synthetic oligonucleotide
aactgatgagtttgagtttcccattgggacatatctgaac

SEQ ID NO: 209735 - DNA, 39 bp, Artificial Sequence
  Description of Artificial Sequence: Synthetic oligonucleotide
actgatgagtttgagtttcccattgggacatatctgaac

SEQ ID NO: 209736 - DNA, 38 bp, Artificial Sequence
  Description of Artificial Sequence: Synthetic oligonucleotide
ctgatgagtttgagtttcccattgggacatatctgaac

SEQ ID NO: 209737 - DNA, 41 bp, Artificial Sequence
  Description of Artificial Sequence: Synthetic oligonucleotide
tgatgagtttgagtttcccattgggacatatctgaactatg

SEQ ID NO: 209738 - DNA, 40 bp, Artificial Sequence
  Description of Artificial Sequence: Synthetic oligonucleotide
gatgagtttgagtttcccattgggacatatctgaactatg

SEQ ID NO: 209739 - DNA, 43 bp, Artificial Sequence
  Description of Artificial Sequence: Synthetic oligonucleotide
atgagtttgagtttcccattgggacatatctgaactatgaatg

SEQ ID NO: 209740 - DNA, 42 bp, Artificial Sequence
  Description of Artificial Sequence: Synthetic oligonucleotide
tgagtttgagtttcccattgggacatatctgaactatgaatg

SEQ ID NO: 209741 - DNA, 41 bp, Artificial Sequence
  Description of Artificial Sequence: Synthetic oligonucleotide
gagtttgagtttcccattgggacatatctgaactatgaatg

SEQ ID NO: 209742 - DNA, 41 bp, Artificial Sequence
  Description of Artificial Sequence: Synthetic oligonucleotide
agtttgagtttcccattgggacatatctgaactatgaatgc

SEQ ID NO: 209743 - DNA, 40 bp, Artificial Sequence
  Description of Artificial Sequence: Synthetic oligonucleotide
gtttgagtttcccattgggacatatctgaactatgaatgc

SEQ ID NO: 209744 - DNA, 46 bp, Artificial Sequence
  Description of Artificial Sequence: Synthetic oligonucleotide
gtgatactgtcatttgggataatgaaacacctatttgtgacatatg

SEQ ID NO: 209745 - DNA, 47 bp, Artificial Sequence
  Description of Artificial Sequence: Synthetic oligonucleotide
tgatactgtcatttgggataatgaaacacctatttgtgacatatgtc

SEQ ID NO: 209746 - DNA, 46 bp, Artificial Sequence
  Description of Artificial Sequence: Synthetic oligonucleotide
gatactgtcatttgggataatgaaacacctatttgtgacatatgtc

SEQ ID NO: 209747 - DNA, 47 bp, Artificial Sequence
  Description of Artificial Sequence: Synthetic oligonucleotide
atactgtcatttgggataatgaaacacctatttgtgacatatgtcag

SEQ ID NO: 209748 - DNA, 46 bp, Artificial Sequence
  Description of Artificial Sequence: Synthetic oligonucleotide
tactgtcatttgggataatgaaacacctatttgtgacatatgtcag

SEQ ID NO: 209749 - DNA, 45 bp, Artificial Sequence
  Description of Artificial Sequence: Synthetic oligonucleotide
actgtcatttgggataatgaaacacctatttgtgacatatgtcag

SEQ ID NO: 209750 - DNA, 44 bp, Artificial Sequence
  Description of Artificial Sequence: Synthetic oligonucleotide
ctgtcatttgggataatgaaacacctatttgtgacatatgtcag

SEQ ID NO: 209751 - DNA, 44 bp, Artificial Sequence
  Description of Artificial Sequence: Synthetic oligonucleotide
tgtcatttgggataatgaaacacctatttgtgacatatgtcagc

SEQ ID NO: 209752 - DNA, 43 bp, Artificial Sequence
  Description of Artificial Sequence: Synthetic oligonucleotide
gtcatttgggataatgaaacacctatttgtgacatatgtcagc

SEQ ID NO: 209753 - DNA, 43 bp, Artificial Sequence
  Description of Artificial Sequence: Synthetic oligonucleotide
tcatttgggataatgaaacacctatttgtgacatatgtcagcc

SEQ ID NO: 209754 - DNA, 42 bp, Artificial Sequence
  Description of Artificial Sequence: Synthetic oligonucleotide
catttgggataatgaaacacctatttgtgacatatgtcagcc

SEQ ID NO: 209755 - DNA, 43 bp, Artificial Sequence
  Description of Artificial Sequence: Synthetic oligonucleotide
atttgggataatgaaacacctatttgtgacatatgtcagccac

SEQ ID NO: 209756 - DNA, 42 bp, Artificial Sequence
  Description of Artificial Sequence: Synthetic oligonucleotide
tttgggataatgaaacacctatttgtgacatatgtcagccac

SEQ ID NO: 209757 - DNA, 41 bp, Artificial Sequence
  Description of Artificial Sequence: Synthetic oligonucleotide
ttgggataatgaaacacctatttgtgacatatgtcagccac

SEQ ID NO: 209758 - DNA, 40 bp, Artificial Sequence
  Description of Artificial Sequence: Synthetic oligonucleotide
tgggataatgaaacacctatttgtgacatatgtcagccac

SEQ ID NO: 209759 - DNA, 39 bp, Artificial Sequence
  Description of Artificial Sequence: Synthetic oligonucleotide
gggataatgaaacacctatttgtgacatatgtcagccac

SEQ ID NO: 209760 - DNA, 39 bp, Artificial Sequence
  Description of Artificial Sequence: Synthetic oligonucleotide
ggataatgaaacacctatttgtgacatatgtcagccacc

SEQ ID NO: 209761 - DNA, 40 bp, Artificial Sequence
  Description of Artificial Sequence: Synthetic oligonucleotide
gataatgaaacacctatttgtgacatatgtcagccacctc

SEQ ID NO: 209762 - DNA, 40 bp, Artificial Sequence
  Description of Artificial Sequence: Synthetic oligonucleotide
ataatgaaacacctatttgtgacatatgtcagccacctcc

SEQ ID NO: 209763 - DNA, 39 bp, Artificial Sequence
  Description of Artificial Sequence: Synthetic oligonucleotide
taatgaaacacctatttgtgacatatgtcagccacctcc

SEQ ID NO: 209764 - DNA, 38 bp, Artificial Sequence
  Description of Artificial Sequence: Synthetic oligonucleotide
aatgaaacacctatttgtgacatatgtcagccacctcc

SEQ ID NO: 209765 - DNA, 37 bp, Artificial Sequence
  Description of Artificial Sequence: Synthetic oligonucleotide
atgaaacacctatttgtgacatatgtcagccacctcc

SEQ ID NO: 209766 - DNA, 36 bp, Artificial Sequence
  Description of Artificial Sequence: Synthetic oligonucleotide
tgaaacacctatttgtgacatatgtcagccacctcc

SEQ ID NO: 209767 - DNA, 35 bp, Artificial Sequence
  Description of Artificial Sequence: Synthetic oligonucleotide
gaaacacctatttgtgacatatgtcagccacctcc

SEQ ID NO: 209768 - DNA, 36 bp, Artificial Sequence
  Description of Artificial Sequence: Synthetic oligonucleotide
aaacacctatttgtgacatatgtcagccacctccag

SEQ ID NO: 209769 - DNA, 35 bp, Artificial Sequence
  Description of Artificial Sequence: Synthetic oligonucleotide
aacacctatttgtgacatatgtcagccacctccag

SEQ ID NO: 209770 - DNA, 34 bp, Artificial Sequence
  Description of Artificial Sequence: Synthetic oligonucleotide
acacctatttgtgacatatgtcagccacctccag

SEQ ID NO: 209771 - DNA, 33 bp, Artificial Sequence
  Description of Artificial Sequence: Synthetic oligonucleotide
cacctatttgtgacatatgtcagccacctccag

SEQ ID NO: 209772 - DNA, 35 bp, Artificial Sequence
  Description of Artificial Sequence: Synthetic oligonucleotide
acctatttgtgacatatgtcagccacctccagatg

SEQ ID NO: 209773 - DNA, 34 bp, Artificial Sequence
  Description of Artificial Sequence: Synthetic oligonucleotide
cctatttgtgacatatgtcagccacctccagatg

SEQ ID NO: 209774 - DNA, 35 bp, Artificial Sequence
  Description of Artificial Sequence: Synthetic oligonucleotide
ctatttgtgacatatgtcagccacctccagatgtc

SEQ ID NO: 209775 - DNA, 35 bp, Artificial Sequence
  Description of Artificial Sequence: Synthetic oligonucleotide
tatttgtgacatatgtcagccacctccagatgtcc

SEQ ID NO: 209776 - DNA, 34 bp, Artificial Sequence
  Description of Artificial Sequence: Synthetic oligonucleotide
atttgtgacatatgtcagccacctccagatgtcc

SEQ ID NO: 209777 - DNA, 33 bp, Artificial Sequence
  Description of Artificial Sequence: Synthetic oligonucleotide
tttgtgacatatgtcagccacctccagatgtcc

SEQ ID NO: 209778 - DNA, 32 bp, Artificial Sequence
  Description of Artificial Sequence: Synthetic oligonucleotide
ttgtgacatatgtcagccacctccagatgtcc

SEQ ID NO: 209779 - DNA, 31 bp, Artificial Sequence
  Description of Artificial Sequence: Synthetic oligonucleotide
tgtgacatatgtcagccacctccagatgtcc

SEQ ID NO: 209780 - DNA, 30 bp, Artificial Sequence
  Description of Artificial Sequence: Synthetic oligonucleotide
gtgacatatgtcagccacctccagatgtcc

SEQ ID NO: 209781 - DNA, 31 bp, Artificial Sequence
  Description of Artificial Sequence: Synthetic oligonucleotide
tgacatatgtcagccacctccagatgtcctg

SEQ ID NO: 209782 - DNA, 30 bp, Artificial Sequence
  Description of Artificial Sequence: Synthetic oligonucleotide
gacatatgtcagccacctccagatgtcctg

SEQ ID NO: 209783 - DNA, 30 bp, Artificial Sequence
  Description of Artificial Sequence: Synthetic oligonucleotide
acatatgtcagccacctccagatgtcctgc

SEQ ID NO: 209784 - DNA, 29 bp, Artificial Sequence
  Description of Artificial Sequence: Synthetic oligonucleotide
catatgtcagccacctccagatgtcctgc

SEQ ID NO: 209785 - DNA, 31 bp, Artificial Sequence
  Description of Artificial Sequence: Synthetic oligonucleotide
atatgtcagccacctccagatgtcctgcatg

SEQ ID NO: 209786 - DNA, 27 bp, Artificial Sequence
  Description of Artificial Sequence: Synthetic oligonucleotide
agccctgcagcccccacatgtgaagat

SEQ ID NO: 209787 - DNA, 27 bp, Artificial Sequence
  Description of Artificial Sequence: Synthetic oligonucleotide
gccctgcagcccccacatgtgaagatt

SEQ ID NO: 209788 - DNA, 28 bp, Artificial Sequence
  Description of Artificial Sequence: Synthetic oligonucleotide
ccctgcagcccccacatgtgaagatttc

SEQ ID NO: 209789 - DNA, 36 bp, Artificial Sequence
  Description of Artificial Sequence: Synthetic oligonucleotide
cctgcagcccccacatgtgaagatttcaattaaaag

SEQ ID NO: 209790 - DNA, 36 bp, Artificial Sequence
  Description of Artificial Sequence: Synthetic oligonucleotide
ctgcagcccccacatgtgaagatttcaattaaaagg

SEQ ID NO: 209791 - DNA, 36 bp, Artificial Sequence
  Description of Artificial Sequence: Synthetic oligonucleotide
tgcagcccccacatgtgaagatttcaattaaaaggc

SEQ ID NO: 209792 - DNA, 35 bp, Artificial Sequence
  Description of Artificial Sequence: Synthetic oligonucleotide
gcagcccccacatgtgaagatttcaattaaaaggc

SEQ ID NO: 209793 - DNA, 36 bp, Artificial Sequence
  Description of Artificial Sequence: Synthetic oligonucleotide
cagcccccacatgtgaagatttcaattaaaaggcag

SEQ ID NO: 209794 - DNA, 36 bp, Artificial Sequence
  Description of Artificial Sequence: Synthetic oligonucleotide
agcccccacatgtgaagatttcaattaaaaggcagc

SEQ ID NO: 209795 - DNA, 35 bp, Artificial Sequence
  Description of Artificial Sequence: Synthetic oligonucleotide
gcccccacatgtgaagatttcaattaaaaggcagc

SEQ ID NO: 209796 - DNA, 36 bp, Artificial Sequence
  Description of Artificial Sequence: Synthetic oligonucleotide
cccccacatgtgaagatttcaattaaaaggcagctc

SEQ ID NO: 209797 - DNA, 37 bp, Artificial Sequence
  Description of Artificial Sequence: Synthetic oligonucleotide
ccccacatgtgaagatttcaattaaaaggcagctctg

SEQ ID NO: 209798 - DNA, 37 bp, Artificial Sequence
  Description of Artificial Sequence: Synthetic oligonucleotide
cccacatgtgaagatttcaattaaaaggcagctctgc

SEQ ID NO: 209799 - DNA, 39 bp, Artificial Sequence
  Description of Artificial Sequence: Synthetic oligonucleotide
ccacatgtgaagatttcaattaaaaggcagctctgctag

SEQ ID NO: 209800 - DNA, 42 bp, Artificial Sequence
  Description of Artificial Sequence: Synthetic oligonucleotide
cacatgtgaagatttcaattaaaaggcagctctgctagttac

SEQ ID NO: 209801 - DNA, 43 bp, Artificial Sequence
  Description of Artificial Sequence: Synthetic oligonucleotide
acatgtgaagatttcaattaaaaggcagctctgctagttactg

SEQ ID NO: 209802 - DNA, 42 bp, Artificial Sequence
  Description of Artificial Sequence: Synthetic oligonucleotide
catgtgaagatttcaattaaaaggcagctctgctagttactg

SEQ ID NO: 209803 - DNA, 43 bp, Artificial Sequence
  Description of Artificial Sequence: Synthetic oligonucleotide
atgtgaagatttcaattaaaaggcagctctgctagttactgtg

SEQ ID NO: 209804 - DNA, 42 bp, Artificial Sequence
  Description of Artificial Sequence: Synthetic oligonucleotide
tgtgaagatttcaattaaaaggcagctctgctagttactgtg

SEQ ID NO: 209805 - DNA, 41 bp, Artificial Sequence
  Description of Artificial Sequence: Synthetic oligonucleotide
gtgaagatttcaattaaaaggcagctctgctagttactgtg

SEQ ID NO: 209806 - DNA, 42 bp, Artificial Sequence
  Description of Artificial Sequence: Synthetic oligonucleotide
tgaagatttcaattaaaaggcagctctgctagttactgtgtc

SEQ ID NO: 209807 - DNA, 41 bp, Artificial Sequence
  Description of Artificial Sequence: Synthetic oligonucleotide
gaagatttcaattaaaaggcagctctgctagttactgtgtc

SEQ ID NO: 209808 - DNA, 43 bp, Artificial Sequence
  Description of Artificial Sequence: Synthetic oligonucleotide
aagatttcaattaaaaggcagctctgctagttactgtgtcttg

SEQ ID NO: 209809 - DNA, 42 bp, Artificial Sequence
  Description of Artificial Sequence: Synthetic oligonucleotide
agatttcaattaaaaggcagctctgctagttactgtgtcttg

SEQ ID NO: 209810 - DNA, 34 bp, Artificial Sequence
  Description of Artificial Sequence: Synthetic oligonucleotide
cctttggaatagcagtgttccagtgtgtgaactg

SEQ ID NO: 209811 - DNA, 38 bp, Artificial Sequence
  Description of Artificial Sequence: Synthetic oligonucleotide
ctttggaatagcagtgttccagtgtgtgaactgaaatc

SEQ ID NO: 209812 - DNA, 38 bp, Artificial Sequence
  Description of Artificial Sequence: Synthetic oligonucleotide
tttggaatagcagtgttccagtgtgtgaactgaaatcc

SEQ ID NO: 209813 - DNA, 37 bp, Artificial Sequence
  Description of Artificial Sequence: Synthetic oligonucleotide
ttggaatagcagtgttccagtgtgtgaactgaaatcc

SEQ ID NO: 209814 - DNA, 36 bp, Artificial Sequence
  Description of Artificial Sequence: Synthetic oligonucleotide
tggaatagcagtgttccagtgtgtgaactgaaatcc

SEQ ID NO: 209815 - DNA, 35 bp, Artificial Sequence
  Description of Artificial Sequence: Synthetic oligonucleotide
ggaatagcagtgttccagtgtgtgaactgaaatcc

SEQ ID NO: 209816 - DNA, 36 bp, Artificial Sequence
  Description of Artificial Sequence: Synthetic oligonucleotide
gaatagcagtgttccagtgtgtgaactgaaatcctg

SEQ ID NO: 209817 - DNA, 37 bp, Artificial Sequence
  Description of Artificial Sequence: Synthetic oligonucleotide
aatagcagtgttccagtgtgtgaactgaaatcctgtg

SEQ ID NO: 209818 - DNA, 36 bp, Artificial Sequence
  Description of Artificial Sequence: Synthetic oligonucleotide
atagcagtgttccagtgtgtgaactgaaatcctgtg

SEQ ID NO: 209819 - DNA, 35 bp, Artificial Sequence
  Description of Artificial Sequence: Synthetic oligonucleotide
tagcagtgttccagtgtgtgaactgaaatcctgtg

SEQ ID NO: 209820 - DNA, 34 bp, Artificial Sequence
  Description of Artificial Sequence: Synthetic oligonucleotide
agcagtgttccagtgtgtgaactgaaatcctgtg

SEQ ID NO: 209821 - DNA, 33 bp, Artificial Sequence
  Description of Artificial Sequence: Synthetic oligonucleotide
gcagtgttccagtgtgtgaactgaaatcctgtg

SEQ ID NO: 209822 - DNA, 35 bp, Artificial Sequence
  Description of Artificial Sequence: Synthetic oligonucleotide
cagtgttccagtgtgtgaactgaaatcctgtgatg

SEQ ID NO: 209823 - DNA, 36 bp, Artificial Sequence
  Description of Artificial Sequence: Synthetic oligonucleotide
agtgttccagtgtgtgaactgaaatcctgtgatgac

SEQ ID NO: 209824 - DNA, 35 bp, Artificial Sequence
  Description of Artificial Sequence: Synthetic oligonucleotide
gtgttccagtgtgtgaactgaaatcctgtgatgac

SEQ ID NO: 209825 - DNA, 37 bp, Artificial Sequence
  Description of Artificial Sequence: Synthetic oligonucleotide
tgttccagtgtgtgaactgaaatcctgtgatgacttc

SEQ ID NO: 209826 - DNA, 36 bp, Artificial Sequence
  Description of Artificial Sequence: Synthetic oligonucleotide
gttccagtgtgtgaactgaaatcctgtgatgacttc

SEQ ID NO: 209827 - DNA, 38 bp, Artificial Sequence
  Description of Artificial Sequence: Synthetic oligonucleotide
ttccagtgtgtgaactgaaatcctgtgatgacttcatg

SEQ ID NO: 209828 - DNA, 37 bp, Artificial Sequence
  Description of Artificial Sequence: Synthetic oligonucleotide
tccagtgtgtgaactgaaatcctgtgatgacttcatg

SEQ ID NO: 209829 - DNA, 36 bp, Artificial Sequence
  Description of Artificial Sequence: Synthetic oligonucleotide
ccagtgtgtgaactgaaatcctgtgatgacttcatg

SEQ ID NO: 209830 - DNA, 36 bp, Artificial Sequence
  Description of Artificial Sequence: Synthetic oligonucleotide
cagtgtgtgaactgaaatcctgtgatgacttcatgg

SEQ ID NO: 209831 - DNA, 36 bp, Artificial Sequence
  Description of Artificial Sequence: Synthetic oligonucleotide
agtgtgtgaactgaaatcctgtgatgacttcatggg

SEQ ID NO: 209832 - DNA, 35 bp, Artificial Sequence
  Description of Artificial Sequence: Synthetic oligonucleotide
gtgtgtgaactgaaatcctgtgatgacttcatggg

SEQ ID NO: 209833 - DNA, 35 bp, Artificial Sequence
  Description of Artificial Sequence: Synthetic oligonucleotide
tgtgtgaactgaaatcctgtgatgacttcatgggc

SEQ ID NO: 209834 - DNA, 34 bp, Artificial Sequence
  Description of Artificial Sequence: Synthetic oligonucleotide
gtgtgaactgaaatcctgtgatgacttcatgggc

SEQ ID NO: 209835 - DNA, 34 bp, Artificial Sequence
  Description of Artificial Sequence: Synthetic oligonucleotide
tgtgaactgaaatcctgtgatgacttcatgggcc

SEQ ID NO: 209836 - DNA, 33 bp, Artificial Sequence
  Description of Artificial Sequence: Synthetic oligonucleotide
gtgaactgaaatcctgtgatgacttcatgggcc

SEQ ID NO: 209837 - DNA, 35 bp, Artificial Sequence
  Description of Artificial Sequence: Synthetic oligonucleotide
tgaactgaaatcctgtgatgacttcatgggccaac

SEQ ID NO: 209838 - DNA, 34 bp, Artificial Sequence
  Description of Artificial Sequence: Synthetic oligonucleotide
gaactgaaatcctgtgatgacttcatgggccaac

SEQ ID NO: 209839 - DNA, 36 bp, Artificial Sequence
  Description of Artificial Sequence: Synthetic oligonucleotide
aactgaaatcctgtgatgacttcatgggccaacttc

SEQ ID NO: 209840 - DNA, 35 bp, Artificial Sequence
  Description of Artificial Sequence: Synthetic oligonucleotide
actgaaatcctgtgatgacttcatgggccaacttc

SEQ ID NO: 209841 - DNA, 34 bp, Artificial Sequence
  Description of Artificial Sequence: Synthetic oligonucleotide
ctgaaatcctgtgatgacttcatgggccaacttc

SEQ ID NO: 209842 - DNA, 26 bp, Artificial Sequence
  Description of Artificial Sequence: Synthetic oligonucleotide
atgggggtctcttctccgagaagccg

SEQ ID NO: 209843 - DNA, 25 bp, Artificial Sequence
  Description of Artificial Sequence: Synthetic oligonucleotide
tgggggtctcttctccgagaagccg

SEQ ID NO: 209844 - DNA, 24 bp, Artificial Sequence
  Description of Artificial Sequence: Synthetic oligonucleotide
gggggtctcttctccgagaagccg

SEQ ID NO: 209845 - DNA, 24 bp, Artificial Sequence
  Description of Artificial Sequence: Synthetic oligonucleotide
ggggtctcttctccgagaagccgg

SEQ ID NO: 209846 - DNA, 25 bp, Artificial Sequence
  Description of Artificial Sequence: Synthetic oligonucleotide
gggtctcttctccgagaagccggga

SEQ ID NO: 209847 - DNA, 25 bp, Artificial Sequence
  Description of Artificial Sequence: Synthetic oligonucleotide
ggtctcttctccgagaagccgggag

SEQ ID NO: 209848 - DNA, 25 bp, Artificial Sequence
  Description of Artificial Sequence: Synthetic oligonucleotide
gtctcttctccgagaagccgggagc

SEQ ID NO: 209849 - DNA, 26 bp, Artificial Sequence
  Description of Artificial Sequence: Synthetic oligonucleotide
tctcttctccgagaagccgggagcct

SEQ ID NO: 209850 - DNA, 25 bp, Artificial Sequence
  Description of Artificial Sequence: Synthetic oligonucleotide
ctcttctccgagaagccgggagcct

SEQ ID NO: 209851 - DNA, 27 bp, Artificial Sequence
  Description of Artificial Sequence: Synthetic oligonucleotide
tcttctccgagaagccgggagcctgtt

SEQ ID NO: 209852 - DNA, 26 bp, Artificial Sequence
  Description of Artificial Sequence: Synthetic oligonucleotide
cttctccgagaagccgggagcctgtt

SEQ ID NO: 209853 - DNA, 26 bp, Artificial Sequence
  Description of Artificial Sequence: Synthetic oligonucleotide
ttctccgagaagccgggagcctgttg

SEQ ID NO: 209854 - DNA, 25 bp, Artificial Sequence
  Description of Artificial Sequence: Synthetic oligonucleotide
tctccgagaagccgggagcctgttg

SEQ ID NO: 209855 - DNA, 24 bp, Artificial Sequence
  Description of Artificial Sequence: Synthetic oligonucleotide
ctccgagaagccgggagcctgttg

SEQ ID NO: 209856 - DNA, 24 bp, Artificial Sequence
  Description of Artificial Sequence: Synthetic oligonucleotide
tccgagaagccgggagcctgttgg

SEQ ID NO: 209857 - DNA, 23 bp, Artificial Sequence
  Description of Artificial Sequence: Synthetic oligonucleotide
ccgagaagccgggagcctgttgg

SEQ ID NO: 209858 - DNA, 23 bp, Artificial Sequence
  Description of Artificial Sequence: Synthetic oligonucleotide
cgagaagccgggagcctgttggg

SEQ ID NO: 209859 - DNA, 24 bp, Artificial Sequence
  Description of Artificial Sequence: Synthetic oligonucleotide
gagaagccgggagcctgttgggca

SEQ ID NO: 209860 - DNA, 24 bp, Artificial Sequence
  Description of Artificial Sequence: Synthetic oligonucleotide
agaagccgggagcctgttgggcag

SEQ ID NO: 209861 - DNA, 23 bp, Artificial Sequence
  Description of Artificial Sequence: Synthetic oligonucleotide
gaagccgggagcctgttgggcag

SEQ ID NO: 209862 - DNA, 23 bp, Artificial Sequence
  Description of Artificial Sequence: Synthetic oligonucleotide
aagccgggagcctgttgggcagc

SEQ ID NO: 209863 - DNA, 22 bp, Artificial Sequence
  Description of Artificial Sequence: Synthetic oligonucleotide
agccgggagcctgttgggcagc

SEQ ID NO: 209864 - DNA, 21 bp, Artificial Sequence
  Description of Artificial Sequence: Synthetic oligonucleotide
gccgggagcctgttgggcagc

SEQ ID NO: 209865 - DNA, 21 bp, Artificial Sequence
  Description of Artificial Sequence: Synthetic oligonucleotide
ccgggagcctgttgggcagcc

SEQ ID NO: 209866 - DNA, 21 bp, Artificial Sequence
  Description of Artificial Sequence: Synthetic oligonucleotide
cgggagcctgttgggcagccg

SEQ ID NO: 209867 - DNA, 21 bp, Artificial Sequence
  Description of Artificial Sequence: Synthetic oligonucleotide
gggagcctgttgggcagccgg

SEQ ID NO: 209868 - DNA, 21 bp, Artificial Sequence
  Description of Artificial Sequence: Synthetic oligonucleotide
ggagcctgttgggcagccggc

SEQ ID NO: 209869 - DNA, 21 bp, Artificial Sequence
  Description of Artificial Sequence: Synthetic oligonucleotide
gagcctgttgggcagccggcg

SEQ ID NO: 209870 - DNA, 21 bp, Artificial Sequence
  Description of Artificial Sequence: Synthetic oligonucleotide
agcctgttgggcagccggcgc

SEQ ID NO: 209871 - DNA, 20 bp, Artificial Sequence
  Description of Artificial Sequence: Synthetic oligonucleotide
gcctgttgggcagccggcgc

SEQ ID NO: 209872 - DNA, 20 bp, Artificial Sequence
  Description of Artificial Sequence: Synthetic oligonucleotide
cctgttgggcagccggcgcc

SEQ ID NO: 209873 - DNA, 20 bp, Artificial Sequence
  Description of Artificial Sequence: Synthetic oligonucleotide
ctgttgggcagccggcgccc

SEQ ID NO: 209874 - DNA, 20 bp, Artificial Sequence
  Description of Artificial Sequence: Synthetic oligonucleotide
tgttgggcagccggcgcccg

SEQ ID NO: 209875 - DNA, 20 bp, Artificial Sequence
  Description of Artificial Sequence: Synthetic oligonucleotide
gttgggcagccggcgcccgt

SEQ ID NO: 209876 - DNA, 20 bp, Artificial Sequence
  Description of Artificial Sequence: Synthetic oligonucleotide
ttgggcagccggcgcccggt

SEQ ID NO: 209877 - DNA, 20 bp, Artificial Sequence
  Description of Artificial Sequence: Synthetic oligonucleotide
tgggcagccggcgcccggtt

SEQ ID NO: 209878 - DNA, 20 bp, Artificial Sequence
  Description of Artificial Sequence: Synthetic oligonucleotide
gggcagccggcgcccggttt

SEQ ID NO: 209879 - DNA, 20 bp, Artificial Sequence
  Description of Artificial Sequence: Synthetic oligonucleotide
ggcagccggcgcccggtctt

SEQ ID NO: 209880 - DNA, 20 bp, Artificial Sequence
  Description of Artificial Sequence: Synthetic oligonucleotide
gcagccggcgcccggtctct

SEQ ID NO: 209881 - DNA, 20 bp, Artificial Sequence
  Description of Artificial Sequence: Synthetic oligonucleotide
cagccggcgcccggtctcct

SEQ ID NO: 209882 - DNA, 20 bp, Artificial Sequence
  Description of Artificial Sequence: Synthetic oligonucleotide
agccggcgcccggtctccct

SEQ ID NO: 209883 - DNA, 23 bp, Artificial Sequence
  Description of Artificial Sequence: Synthetic oligonucleotide
tgcggaggatccctgctggcggt

SEQ ID NO: 209884 - DNA, 22 bp, Artificial Sequence
  Description of Artificial Sequence: Synthetic oligonucleotide
gcggaggatccctgctggcggt

SEQ ID NO: 209885 - DNA, 22 bp, Artificial Sequence
  Description of Artificial Sequence: Synthetic oligonucleotide
cggaggatccctgctggcggtc

SEQ ID NO: 209886 - DNA, 23 bp, Artificial Sequence
  Description of Artificial Sequence: Synthetic oligonucleotide
ggaggatccctgctggcggtcgt

SEQ ID NO: 209887 - DNA, 23 bp, Artificial Sequence
  Description of Artificial Sequence: Synthetic oligonucleotide
gaggatccctgctggcggtcgtg

SEQ ID NO: 209888 - DNA, 24 bp, Artificial Sequence
  Description of Artificial Sequence: Synthetic oligonucleotide
aggatccctgctggcggtcgtggt

SEQ ID NO: 209889 - DNA, 23 bp, Artificial Sequence
  Description of Artificial Sequence: Synthetic oligonucleotide
ggatccctgctggcggtcgtggt

SEQ ID NO: 209890 - DNA, 23 bp, Artificial Sequence
  Description of Artificial Sequence: Synthetic oligonucleotide
gatccctgctggcggtcgtggtg

SEQ ID NO: 209891 - DNA, 24 bp, Artificial Sequence
  Description of Artificial Sequence: Synthetic oligonucleotide
atccctgctggcggtcgtggtgct

SEQ ID NO: 209892 - DNA, 23 bp, Artificial Sequence
  Description of Artificial Sequence: Synthetic oligonucleotide
tccctgctggcggtcgtggtgct

SEQ ID NO: 209893 - DNA, 22 bp, Artificial Sequence
  Description of Artificial Sequence: Synthetic oligonucleotide
ccctgctggcggtcgtggtgct

SEQ ID NO: 209894 - DNA, 22 bp, Artificial Sequence
  Description of Artificial Sequence: Synthetic oligonucleotide
cctgctggcggtcgtggtgctg

SEQ ID NO: 209895 - DNA, 23 bp, Artificial Sequence
  Description of Artificial Sequence: Synthetic oligonucleotide
ctgctggcggtcgtggtgctgct

SEQ ID NO: 209896 - DNA, 23 bp, Artificial Sequence
  Description of Artificial Sequence: Synthetic oligonucleotide
tgctggcggtcgtggtgctgctc

SEQ ID NO: 209897 - DNA, 22 bp, Artificial Sequence
  Description of Artificial Sequence: Synthetic oligonucleotide
gctggcggtcgtggtgctgctc

SEQ ID NO: 209898 - DNA, 22 bp, Artificial Sequence
  Description of Artificial Sequence: Synthetic oligonucleotide
ctggcggtcgtggtgctgctcg

SEQ ID NO: 209899 - DNA, 22 bp, Artificial Sequence
  Description of Artificial Sequence: Synthetic oligonucleotide
tggcggtcgtggtgctgctcgc

SEQ ID NO: 209900 - DNA, 21 bp, Artificial Sequence
  Description of Artificial Sequence: Synthetic oligonucleotide
ggcggtcgtggtgctgctcgc

SEQ ID NO: 209901 - DNA, 21 bp, Artificial Sequence
  Description of Artificial Sequence: Synthetic oligonucleotide
gcggtcgtggtgctgctcgcg

SEQ ID NO: 209902 - DNA, 22 bp, Artificial Sequence
  Description of Artificial Sequence: Synthetic oligonucleotide
cggtcgtggtgctgctcgcgct

SEQ ID NO: 209903 - DNA, 22 bp, Artificial Sequence
  Description of Artificial Sequence: Synthetic oligonucleotide
ggtcgtggtgctgctcgcgctg

SEQ ID NO: 209904 - DNA, 22 bp, Artificial Sequence
  Description of Artificial Sequence: Synthetic oligonucleotide
gtcgtggtgctgctcgcgctgc

SEQ ID NO: 209905 - DNA, 22 bp, Artificial Sequence
  Description of Artificial Sequence: Synthetic oligonucleotide
tcgtggtgctgctcgcgctgcc

SEQ ID NO: 209906 - DNA, 21 bp, Artificial Sequence
  Description of Artificial Sequence: Synthetic oligonucleotide
cgtggtgctgctcgcgctgcc

SEQ ID NO: 209907 - DNA, 21 bp, Artificial Sequence
  Description of Artificial Sequence: Synthetic oligonucleotide
gtggtgctgctcgcgctgccg

SEQ ID NO: 209908 - DNA, 22 bp, Artificial Sequence
  Description of Artificial Sequence: Synthetic oligonucleotide
tggtgctgctcgcgctgccggt

SEQ ID NO: 209909 - DNA, 21 bp, Artificial Sequence
  Description of Artificial Sequence: Synthetic oligonucleotide
ggtgctgctcgcgctgccggt

SEQ ID NO: 209910 - DNA, 21 bp, Artificial Sequence
  Description of Artificial Sequence: Synthetic oligonucleotide
gtgctgctcgcgctgccggtg

SEQ ID NO: 209911 - DNA, 21 bp, Artificial Sequence
  Description of Artificial Sequence: Synthetic oligonucleotide
tgctgctcgcgctgccggtgg

SEQ ID NO: 209912 - DNA, 20 bp, Artificial Sequence
  Description of Artificial Sequence: Synthetic oligonucleotide
gctgctcgcgctgccggtgg

SEQ ID NO: 209913 - DNA, 20 bp, Artificial Sequence
  Description of Artificial Sequence: Synthetic oligonucleotide
ctgctcgcgctgccggtggc

SEQ ID NO: 209914 - DNA, 21 bp, Artificial Sequence
  Description of Artificial Sequence: Synthetic oligonucleotide
tgctcgcgctgccggtggcct

SEQ ID NO: 209915 - DNA, 20 bp, Artificial Sequence
  Description of Artificial Sequence: Synthetic oligonucleotide
gctcgcgctgccggtggcct

SEQ ID NO: 209916 - DNA, 20 bp, Artificial Sequence
  Description of Artificial Sequence: Synthetic oligonucleotide
ctcgcgctgccggtggcctg

SEQ ID NO: 209917 - DNA, 20 bp, Artificial Sequence
  Description of Artificial Sequence: Synthetic oligonucleotide
tcgcgctgccggtggcctgg

SEQ ID NO: 209918 - DNA, 20 bp, Artificial Sequence
  Description of Artificial Sequence: Synthetic oligonucleotide
cgcgctgccggtggcctggt

SEQ ID NO: 209919 - DNA, 21 bp, Artificial Sequence
  Description of Artificial Sequence: Synthetic oligonucleotide
gcgctgccggtggcctgggat

SEQ ID NO: 209920 - DNA, 24 bp, Artificial Sequence
  Description of Artificial Sequence: Synthetic oligonucleotide
cgctgccggtggcctgggatcaat

SEQ ID NO: 209921 - DNA, 24 bp, Artificial Sequence
  Description of Artificial Sequence: Synthetic oligonucleotide
gctgccggtggcctgggatcaatg

SEQ ID NO: 209922 - DNA, 27 bp, Artificial Sequence
  Description of Artificial Sequence: Synthetic oligonucleotide
ctgccggtggcctgggatcaatgcaat

SEQ ID NO: 209923 - DNA, 27 bp, Artificial Sequence
  Description of Artificial Sequence: Synthetic oligonucleotide
tgccggtggcctgggatcaatgcaatg

SEQ ID NO: 209924 - DNA, 27 bp, Artificial Sequence
  Description of Artificial Sequence: Synthetic oligonucleotide
gccggtggcctgggatcaatgcaatgt

SEQ ID NO: 209925 - DNA, 27 bp, Artificial Sequence
  Description of Artificial Sequence: Synthetic oligonucleotide
ccggtggcctgggatcaatgcaatgtc

SEQ ID NO: 209926 - DNA, 27 bp, Artificial Sequence
  Description of Artificial Sequence: Synthetic oligonucleotide
cggtggcctgggatcaatgcaatgtcc

SEQ ID NO: 209927 - DNA, 27 bp, Artificial Sequence
  Description of Artificial Sequence: Synthetic oligonucleotide
ggtggcctgggatcaatgcaatgtccc

SEQ ID NO: 209928 - DNA, 27 bp, Artificial Sequence
  Description of Artificial Sequence: Synthetic oligonucleotide
gtggcctgggatcaatgcaatgtcccg

SEQ ID NO: 209929 - DNA, 27 bp, Artificial Sequence
  Description of Artificial Sequence: Synthetic oligonucleotide
tggcctgggatcaatgcaatgtcccgg

SEQ ID NO: 209930 - DNA, 27 bp, Artificial Sequence
  Description of Artificial Sequence: Synthetic oligonucleotide
ggcctgggatcaatgcaatgtcccgga

SEQ ID NO: 209931 - DNA, 29 bp, Artificial Sequence
  Description of Artificial Sequence: Synthetic oligonucleotide
gcctgggatcaatgcaatgtcccggaatg

SEQ ID NO: 209932 - DNA, 29 bp, Artificial Sequence
  Description of Artificial Sequence: Synthetic oligonucleotide
cctgggatcaatgcaatgtcccggaatgg

SEQ ID NO: 209933 - DNA, 29 bp, Artificial Sequence
  Description of Artificial Sequence: Synthetic oligonucleotide
ctgggatcaatgcaatgtcccggaatggc

SEQ ID NO: 209934 - DNA, 31 bp, Artificial Sequence
  Description of Artificial Sequence: Synthetic oligonucleotide
tgggatcaatgcaatgtcccggaatggcttc

SEQ ID NO: 209935 - DNA, 30 bp, Artificial Sequence
  Description of Artificial Sequence: Synthetic oligonucleotide
gggatcaatgcaatgtcccggaatggcttc

SEQ ID NO: 209936 - DNA, 30 bp, Artificial Sequence
  Description of Artificial Sequence: Synthetic oligonucleotide
ggatcaatgcaatgtcccggaatggcttcc

SEQ ID NO: 209937 - DNA, 34 bp, Artificial Sequence
  Description of Artificial Sequence: Synthetic oligonucleotide
gatcaatgcaatgtcccggaatggcttccatttg

SEQ ID NO: 209938 - DNA, 34 bp, Artificial Sequence
  Description of Artificial Sequence: Synthetic oligonucleotide
atcaatgcaatgtcccggaatggcttccatttgc

SEQ ID NO: 209939 - DNA, 33 bp, Artificial Sequence
  Description of Artificial Sequence: Synthetic oligonucleotide
tcaatgcaatgtcccggaatggcttccatttgc

SEQ ID NO: 209940 - DNA, 32 bp, Artificial Sequence
  Description of Artificial Sequence: Synthetic oligonucleotide
caatgcaatgtcccggaatggcttccatttgc

SEQ ID NO: 209941 - DNA, 32 bp, Artificial Sequence
  Description of Artificial Sequence: Synthetic oligonucleotide
aatgcaatgtcccggaatggcttccatttgcc

SEQ ID NO: 209942 - DNA, 31 bp, Artificial Sequence
  Description of Artificial Sequence: Synthetic oligonucleotide
atgcaatgtcccggaatggcttccatttgcc

SEQ ID NO: 209943 - DNA, 30 bp, Artificial Sequence
  Description of Artificial Sequence: Synthetic oligonucleotide
tgcaatgtcccggaatggcttccatttgcc

SEQ ID NO: 209944 - DNA, 29 bp, Artificial Sequence
  Description of Artificial Sequence: Synthetic oligonucleotide
gcaatgtcccggaatggcttccatttgcc

SEQ ID NO: 209945 - DNA, 30 bp, Artificial Sequence
  Description of Artificial Sequence: Synthetic oligonucleotide
caatgtcccggaatggcttccatttgccag

SEQ ID NO: 209946 - DNA, 30 bp, Artificial Sequence
  Description of Artificial Sequence: Synthetic oligonucleotide
aatgtcccggaatggcttccatttgccagg

SEQ ID NO: 209947 - DNA, 29 bp, Artificial Sequence
  Description of Artificial Sequence: Synthetic oligonucleotide
atgtcccggaatggcttccatttgccagg

SEQ ID NO: 209948 - DNA, 28 bp, Artificial Sequence
  Description of Artificial Sequence: Synthetic oligonucleotide
tgtcccggaatggcttccatttgccagg

SEQ ID NO: 209949 - DNA, 27 bp, Artificial Sequence
  Description of Artificial Sequence: Synthetic oligonucleotide
gtcccggaatggcttccatttgccagg

SEQ ID NO: 209950 - DNA, 27 bp, Artificial Sequence
  Description of Artificial Sequence: Synthetic oligonucleotide
tcccggaatggcttccatttgccaggc

SEQ ID NO: 209951 - DNA, 26 bp, Artificial Sequence
  Description of Artificial Sequence: Synthetic oligonucleotide
cccggaatggcttccatttgccaggc

SEQ ID NO: 209952 - DNA, 27 bp, Artificial Sequence
  Description of Artificial Sequence: Synthetic oligonucleotide
ccggaatggcttccatttgccaggcct

SEQ ID NO: 209953 - DNA, 28 bp, Artificial Sequence
  Description of Artificial Sequence: Synthetic oligonucleotide
cggaatggcttccatttgccaggcctac

SEQ ID NO: 209954 - DNA, 28 bp, Artificial Sequence
  Description of Artificial Sequence: Synthetic oligonucleotide
ggaatggcttccatttgccaggcctacc

SEQ ID NO: 209955 - DNA, 32 bp, Artificial Sequence
  Description of Artificial Sequence: Synthetic oligonucleotide
catttgccaggcctaccaacctaactgatgac

SEQ ID NO: 209956 - DNA, 35 bp, Artificial Sequence
  Description of Artificial Sequence: Synthetic oligonucleotide
atttgccaggcctaccaacctaactgatgactttg

SEQ ID NO: 209957 - DNA, 34 bp, Artificial Sequence
  Description of Artificial Sequence: Synthetic oligonucleotide
tttgccaggcctaccaacctaactgatgactttg

SEQ ID NO: 209958 - DNA, 33 bp, Artificial Sequence
  Description of Artificial Sequence: Synthetic oligonucleotide
ttgccaggcctaccaacctaactgatgactttg

SEQ ID NO: 209959 - DNA, 32 bp, Artificial Sequence
  Description of Artificial Sequence: Synthetic oligonucleotide
tgccaggcctaccaacctaactgatgactttg

SEQ ID NO: 209960 - DNA, 31 bp, Artificial Sequence
  Description of Artificial Sequence: Synthetic oligonucleotide
gccaggcctaccaacctaactgatgactttg

SEQ ID NO: 209961 - DNA, 32 bp, Artificial Sequence
  Description of Artificial Sequence: Synthetic oligonucleotide
ccaggcctaccaacctaactgatgactttgag

SEQ ID NO: 209962 - DNA, 35 bp, Artificial Sequence
  Description of Artificial Sequence: Synthetic oligonucleotide
caggcctaccaacctaactgatgactttgagtttc

SEQ ID NO: 209963 - DNA, 35 bp, Artificial Sequence
  Description of Artificial Sequence: Synthetic oligonucleotide
aggcctaccaacctaactgatgactttgagtttcc

SEQ ID NO: 209964 - DNA, 34 bp, Artificial Sequence
  Description of Artificial Sequence: Synthetic oligonucleotide
ggcctaccaacctaactgatgactttgagtttcc

SEQ ID NO: 209965 - DNA, 34 bp, Artificial Sequence
  Description of Artificial Sequence: Synthetic oligonucleotide
gcctaccaacctaactgatgactttgagtttccc

SEQ ID NO: 209966 - DNA, 37 bp, Artificial Sequence
  Description of Artificial Sequence: Synthetic oligonucleotide
cctaccaacctaactgatgactttgagtttcccattg

SEQ ID NO: 209967 - DNA, 37 bp, Artificial Sequence
  Description of Artificial Sequence: Synthetic oligonucleotide
ctaccaacctaactgatgactttgagtttcccattgg

SEQ ID NO: 209968 - DNA, 37 bp, Artificial Sequence
  Description of Artificial Sequence: Synthetic oligonucleotide
taccaacctaactgatgactttgagtttcccattggg

SEQ ID NO: 209969 - DNA, 36 bp, Artificial Sequence
  Description of Artificial Sequence: Synthetic oligonucleotide
accaacctaactgatgactttgagtttcccattggg

SEQ ID NO: 209970 - DNA, 35 bp, Artificial Sequence
  Description of Artificial Sequence: Synthetic oligonucleotide
ccaacctaactgatgactttgagtttcccattggg

SEQ ID NO: 209971 - DNA, 36 bp, Artificial Sequence
  Description of Artificial Sequence: Synthetic oligonucleotide
caacctaactgatgactttgagtttcccattgggac

SEQ ID NO: 209972 - DNA, 40 bp, Artificial Sequence
  Description of Artificial Sequence: Synthetic oligonucleotide
aacctaactgatgactttgagtttcccattgggacatatc

SEQ ID NO: 209973 - DNA, 39 bp, Artificial Sequence
  Description of Artificial Sequence: Synthetic oligonucleotide
acctaactgatgactttgagtttcccattgggacatatc

SEQ ID NO: 209974 - DNA, 38 bp, Artificial Sequence
  Description of Artificial Sequence: Synthetic oligonucleotide
cctaactgatgactttgagtttcccattgggacatatc

SEQ ID NO: 209975 - DNA, 39 bp, Artificial Sequence
  Description of Artificial Sequence: Synthetic oligonucleotide
ctaactgatgactttgagtttcccattgggacatatctg

SEQ ID NO: 209976 - DNA, 41 bp, Artificial Sequence
  Description of Artificial Sequence: Synthetic oligonucleotide
taactgatgactttgagtttcccattgggacatatctgaac

SEQ ID NO: 209977 - DNA, 40 bp, Artificial Sequence
  Description of Artificial Sequence: Synthetic oligonucleotide
aactgatgactttgagtttcccattgggacatatctgaac

SEQ ID NO: 209978 - DNA, 39 bp, Artificial Sequence
  Description of Artificial Sequence: Synthetic oligonucleotide
actgatgactttgagtttcccattgggacatatctgaac

SEQ ID NO: 209979 - DNA, 38 bp, Artificial Sequence
  Description of Artificial Sequence: Synthetic oligonucleotide
ctgatgactttgagtttcccattgggacatatctgaac

SEQ ID NO: 209980 - DNA, 41 bp, Artificial Sequence
  Description of Artificial Sequence: Synthetic oligonucleotide
tgatgactttgagtttcccattgggacatatctgaactatg

SEQ ID NO: 209981 - DNA, 40 bp, Artificial Sequence
  Description of Artificial Sequence: Synthetic oligonucleotide
gatgactttgagtttcccattgggacatatctgaactatg

SEQ ID NO: 209982 - DNA, 43 bp, Artificial Sequence
  Description of Artificial Sequence: Synthetic oligonucleotide
atgactttgagtttcccattgggacatatctgaactatgaatg

SEQ ID NO: 209983 - DNA, 42 bp, Artificial Sequence
  Description of Artificial Sequence: Synthetic oligonucleotide
tgactttgagtttcccattgggacatatctgaactatgaatg

SEQ ID NO: 209984 - DNA, 41 bp, Artificial Sequence
  Description of Artificial Sequence: Synthetic oligonucleotide
gactttgagtttcccattgggacatatctgaactatgaatg

SEQ ID NO: 209985 - DNA, 41 bp, Artificial Sequence
  Description of Artificial Sequence: Synthetic oligonucleotide
actttgagtttcccattgggacatatctgaactatgaatgc

SEQ ID NO: 209986 - DNA, 40 bp, Artificial Sequence
  Description of Artificial Sequence: Synthetic oligonucleotide
ctttgagtttcccattgggacatatctgaactatgaatgc

SEQ ID NO: 209987 - DNA, 40 bp, Artificial Sequence
  Description of Artificial Sequence: Synthetic oligonucleotide
cgttttctatcatctgcctaaaaaactcagtctggacaag

SEQ ID NO: 209988 - DNA, 41 bp, Artificial Sequence
  Description of Artificial Sequence: Synthetic oligonucleotide
gttttctatcatctgcctaaaaaactcagtctggacaagtg

SEQ ID NO: 209989 - DNA, 41 bp, Artificial Sequence
  Description of Artificial Sequence: Synthetic oligonucleotide
ttttctatcatctgcctaaaaaactcagtctggacaagtgc

SEQ ID NO: 209990 - DNA, 40 bp, Artificial Sequence
  Description of Artificial Sequence: Synthetic oligonucleotide
tttctatcatctgcctaaaaaactcagtctggacaagtgc

SEQ ID NO: 209991 - DNA, 39 bp, Artificial Sequence
  Description of Artificial Sequence: Synthetic oligonucleotide
ttctatcatctgcctaaaaaactcagtctggacaagtgc

SEQ ID NO: 209992 - DNA, 38 bp, Artificial Sequence
  Description of Artificial Sequence: Synthetic oligonucleotide
tctatcatctgcctaaaaaactcagtctggacaagtgc

SEQ ID NO: 209993 - DNA, 37 bp, Artificial Sequence
  Description of Artificial Sequence: Synthetic oligonucleotide
ctatcatctgcctaaaaaactcagtctggacaagtgc

SEQ ID NO: 209994 - DNA, 40 bp, Artificial Sequence
  Description of Artificial Sequence: Synthetic oligonucleotide
tatcatctgcctaaaaaactcagtctggacaagtgctaag

SEQ ID NO: 209995 - DNA, 39 bp, Artificial Sequence
  Description of Artificial Sequence: Synthetic oligonucleotide
atcatctgcctaaaaaactcagtctggacaagtgctaag

SEQ ID NO: 209996 - DNA, 38 bp, Artificial Sequence
  Description of Artificial Sequence: Synthetic oligonucleotide
tcatctgcctaaaaaactcagtctggacaagtgctaag

SEQ ID NO: 209997 - DNA, 37 bp, Artificial Sequence
  Description of Artificial Sequence: Synthetic oligonucleotide
catctgcctaaaaaactcagtctggacaagtgctaag

SEQ ID NO: 209998 - DNA, 37 bp, Artificial Sequence
  Description of Artificial Sequence: Synthetic oligonucleotide
atctgcctaaaaaactcagtctggacaagtgctaagg

SEQ ID NO: 209999 - DNA, 36 bp, Artificial Sequence
  Description of Artificial Sequence: Synthetic oligonucleotide
tctgcctaaaaaactcagtctggacaagtgctaagg

SEQ ID NO: 210000 - DNA, 35 bp, Artificial Sequence
  Description of Artificial Sequence: Synthetic oligonucleotide
ctgcctaaaaaactcagtctggacaagtgctaagg

SEQ ID NO: 210001 - DNA, 36 bp, Artificial Sequence
  Description of Artificial Sequence: Synthetic oligonucleotide
tgcctaaaaaactcagtctggacaagtgctaaggac

SEQ ID NO: 210002 - DNA, 35 bp, Artificial Sequence
  Description of Artificial Sequence: Synthetic oligonucleotide
gcctaaaaaactcagtctggacaagtgctaaggac

SEQ ID NO: 210003 - DNA, 37 bp, Artificial Sequence
  Description of Artificial Sequence: Synthetic oligonucleotide
cctaaaaaactcagtctggacaagtgctaaggacaag

SEQ ID NO: 210004 - DNA, 38 bp, Artificial Sequence
  Description of Artificial Sequence: Synthetic oligonucleotide
ctaaaaaactcagtctggacaagtgctaaggacaagtg

SEQ ID NO: 210005 - DNA, 38 bp, Artificial Sequence
  Description of Artificial Sequence: Synthetic oligonucleotide
taaaaaactcagtctggacaagtgctaaggacaagtgc

SEQ ID NO: 210006 - DNA, 37 bp, Artificial Sequence
  Description of Artificial Sequence: Synthetic oligonucleotide
aaaaaactcagtctggacaagtgctaaggacaagtgc

SEQ ID NO: 210007 - DNA, 36 bp, Artificial Sequence
  Description of Artificial Sequence: Synthetic oligonucleotide
aaaaactcagtctggacaagtgctaaggacaagtgc

SEQ ID NO: 210008 - DNA, 35 bp, Artificial Sequence
  Description of Artificial Sequence: Synthetic oligonucleotide
aaaactcagtctggacaagtgctaaggacaagtgc

SEQ ID NO: 210009 - DNA, 34 bp, Artificial Sequence
  Description of Artificial Sequence: Synthetic oligonucleotide
aaactcagtctggacaagtgctaaggacaagtgc

SEQ ID NO: 210010 - DNA, 33 bp, Artificial Sequence
  Description of Artificial Sequence: Synthetic oligonucleotide
aactcagtctggacaagtgctaaggacaagtgc

SEQ ID NO: 210011 - DNA, 32 bp, Artificial Sequence
  Description of Artificial Sequence: Synthetic oligonucleotide
actcagtctggacaagtgctaaggacaagtgc

SEQ ID NO: 210012 - DNA, 31 bp, Artificial Sequence
  Description of Artificial Sequence: Synthetic oligonucleotide
ctcagtctggacaagtgctaaggacaagtgc

SEQ ID NO: 210013 - DNA, 34 bp, Artificial Sequence
  Description of Artificial Sequence: Synthetic oligonucleotide
tcagtctggacaagtgctaaggacaagtgcaaac

SEQ ID NO: 210014 - DNA, 33 bp, Artificial Sequence
  Description of Artificial Sequence: Synthetic oligonucleotide
cagtctggacaagtgctaaggacaagtgcaaac

SEQ ID NO: 210015 - DNA, 33 bp, Artificial Sequence
  Description of Artificial Sequence: Synthetic oligonucleotide
agtctggacaagtgctaaggacaagtgcaaacg

SEQ ID NO: 210016 - DNA, 32 bp, Artificial Sequence
  Description of Artificial Sequence: Synthetic oligonucleotide
gtctggacaagtgctaaggacaagtgcaaacg

SEQ ID NO: 210017 - DNA, 37 bp, Artificial Sequence
  Description of Artificial Sequence: Synthetic oligonucleotide
tctggacaagtgctaaggacaagtgcaaacgtaaatc

SEQ ID NO: 210018 - DNA, 36 bp, Artificial Sequence
  Description of Artificial Sequence: Synthetic oligonucleotide
ctggacaagtgctaaggacaagtgcaaacgtaaatc

SEQ ID NO: 210019 - DNA, 38 bp, Artificial Sequence
  Description of Artificial Sequence: Synthetic oligonucleotide
tggacaagtgctaaggacaagtgcaaacgtaaatcatg

SEQ ID NO: 210020 - DNA, 37 bp, Artificial Sequence
  Description of Artificial Sequence: Synthetic oligonucleotide
ggacaagtgctaaggacaagtgcaaacgtaaatcatg

SEQ ID NO: 210021 - DNA, 38 bp, Artificial Sequence
  Description of Artificial Sequence: Synthetic oligonucleotide
gacaagtgctaaggacaagtgcaaacgtaaatcatgtc

SEQ ID NO: 210022 - DNA, 38 bp, Artificial Sequence
  Description of Artificial Sequence: Synthetic oligonucleotide
acaagtgctaaggacaagtgcaaacgtaaatcatgtcg

SEQ ID NO: 210023 - DNA, 37 bp, Artificial Sequence
  Description of Artificial Sequence: Synthetic oligonucleotide
caagtgctaaggacaagtgcaaacgtaaatcatgtcg

SEQ ID NO: 210024 - DNA, 41 bp, Artificial Sequence
  Description of Artificial Sequence: Synthetic oligonucleotide
aagtgctaaggacaagtgcaaacgtaaatcatgtcgtaatc

SEQ ID NO: 210025 - DNA, 40 bp, Artificial Sequence
  Description of Artificial Sequence: Synthetic oligonucleotide
agtgctaaggacaagtgcaaacgtaaatcatgtcgtaatc

SEQ ID NO: 210026 - DNA, 39 bp, Artificial Sequence
  Description of Artificial Sequence: Synthetic oligonucleotide
gtgctaaggacaagtgcaaacgtaaatcatgtcgtaatc

SEQ ID NO: 210027 - DNA, 39 bp, Artificial Sequence
  Description of Artificial Sequence: Synthetic oligonucleotide
tgctaaggacaagtgcaaacgtaaatcatgtcgtaatcc

SEQ ID NO: 210028 - DNA, 38 bp, Artificial Sequence
  Description of Artificial Sequence: Synthetic oligonucleotide
gctaaggacaagtgcaaacgtaaatcatgtcgtaatcc

SEQ ID NO: 210029 - DNA, 39 bp, Artificial Sequence
  Description of Artificial Sequence: Synthetic oligonucleotide
ctaaggacaagtgcaaacgtaaatcatgtcgtaatcctc

SEQ ID NO: 210030 - DNA, 39 bp, Artificial Sequence
  Description of Artificial Sequence: Synthetic oligonucleotide
taaggacaagtgcaaacgtaaatcatgtcgtaatcctcc

SEQ ID NO: 210031 - DNA, 38 bp, Artificial Sequence
  Description of Artificial Sequence: Synthetic oligonucleotide
aaggacaagtgcaaacgtaaatcatgtcgtaatcctcc

SEQ ID NO: 210032 - DNA, 37 bp, Artificial Sequence
  Description of Artificial Sequence: Synthetic oligonucleotide
aggacaagtgcaaacgtaaatcatgtcgtaatcctcc

SEQ ID NO: 210033 - DNA, 36 bp, Artificial Sequence
  Description of Artificial Sequence: Synthetic oligonucleotide
ggacaagtgcaaacgtaaatcatgtcgtaatcctcc

SEQ ID NO: 210034 - DNA, 37 bp, Artificial Sequence
  Description of Artificial Sequence: Synthetic oligonucleotide
gacaagtgcaaacgtaaatcatgtcgtaatcctccag

SEQ ID NO: 210035 - DNA, 39 bp, Artificial Sequence
  Description of Artificial Sequence: Synthetic oligonucleotide
acaagtgcaaacgtaaatcatgtcgtaatcctccagatc

SEQ ID NO: 210036 - DNA, 38 bp, Artificial Sequence
  Description of Artificial Sequence: Synthetic oligonucleotide
caagtgcaaacgtaaatcatgtcgtaatcctccagatc

SEQ ID NO: 210037 - DNA, 38 bp, Artificial Sequence
  Description of Artificial Sequence: Synthetic oligonucleotide
aagtgcaaacgtaaatcatgtcgtaatcctccagatcc

SEQ ID NO: 210038 - DNA, 37 bp, Artificial Sequence
  Description of Artificial Sequence: Synthetic oligonucleotide
agtgcaaacgtaaatcatgtcgtaatcctccagatcc

SEQ ID NO: 210039 - DNA, 36 bp, Artificial Sequence
  Description of Artificial Sequence: Synthetic oligonucleotide
gtgcaaacgtaaatcatgtcgtaatcctccagatcc

SEQ ID NO: 210040 - DNA, 37 bp, Artificial Sequence
  Description of Artificial Sequence: Synthetic oligonucleotide
tgcaaacgtaaatcatgtcgtaatcctccagatcctg

SEQ ID NO: 210041 - DNA, 36 bp, Artificial Sequence
  Description of Artificial Sequence: Synthetic oligonucleotide
gcaaacgtaaatcatgtcgtaatcctccagatcctg

SEQ ID NO: 210042 - DNA, 37 bp, Artificial Sequence
  Description of Artificial Sequence: Synthetic oligonucleotide
caaacgtaaatcatgtcgtaatcctccagatcctgtg

SEQ ID NO: 210043 - DNA, 40 bp, Artificial Sequence
  Description of Artificial Sequence: Synthetic oligonucleotide
aaacgtaaatcatgtcgtaatcctccagatcctgtgaatg

SEQ ID NO: 210044 - DNA, 39 bp, Artificial Sequence
  Description of Artificial Sequence: Synthetic oligonucleotide
aacgtaaatcatgtcgtaatcctccagatcctgtgaatg

SEQ ID NO: 210045 - DNA, 31 bp, Artificial Sequence
  Description of Artificial Sequence: Synthetic oligonucleotide
gtaatcctccagatcctgtgaatggcatggc

SEQ ID NO: 210046 - DNA, 32 bp, Artificial Sequence
  Description of Artificial Sequence: Synthetic oligonucleotide
taatcctccagatcctgtgaatggcatggcac

SEQ ID NO: 210047 - DNA, 31 bp, Artificial Sequence
  Description of Artificial Sequence: Synthetic oligonucleotide
aatcctccagatcctgtgaatggcatggcac

SEQ ID NO: 210048 - DNA, 30 bp, Artificial Sequence
  Description of Artificial Sequence: Synthetic oligonucleotide
atcctccagatcctgtgaatggcatggcac

SEQ ID NO: 210049 - DNA, 29 bp, Artificial Sequence
  Description of Artificial Sequence: Synthetic oligonucleotide
tcctccagatcctgtgaatggcatggcac

SEQ ID NO: 210050 - DNA, 28 bp, Artificial Sequence
  Description of Artificial Sequence: Synthetic oligonucleotide
cctccagatcctgtgaatggcatggcac

SEQ ID NO: 210051 - DNA, 30 bp, Artificial Sequence
  Description of Artificial Sequence: Synthetic oligonucleotide
ctccagatcctgtgaatggcatggcacatg

SEQ ID NO: 210052 - DNA, 31 bp, Artificial Sequence
  Description of Artificial Sequence: Synthetic oligonucleotide
tccagatcctgtgaatggcatggcacatgtg

SEQ ID NO: 210053 - DNA, 30 bp, Artificial Sequence
  Description of Artificial Sequence: Synthetic oligonucleotide
ccagatcctgtgaatggcatggcacatgtg

SEQ ID NO: 210054 - DNA, 32 bp, Artificial Sequence
  Description of Artificial Sequence: Synthetic oligonucleotide
cagatcctgtgaatggcatggcacatgtgatc

SEQ ID NO: 210055 - DNA, 35 bp, Artificial Sequence
  Description of Artificial Sequence: Synthetic oligonucleotide
agatcctgtgaatggcatggcacatgtgatcaaag

SEQ ID NO: 210056 - DNA, 34 bp, Artificial Sequence
  Description of Artificial Sequence: Synthetic oligonucleotide
gatcctgtgaatggcatggcacatgtgatcaaag

SEQ ID NO: 210057 - DNA, 35 bp, Artificial Sequence
  Description of Artificial Sequence: Synthetic oligonucleotide
atcctgtgaatggcatggcacatgtgatcaaagac

SEQ ID NO: 210058 - DNA, 34 bp, Artificial Sequence
  Description of Artificial Sequence: Synthetic oligonucleotide
tcctgtgaatggcatggcacatgtgatcaaagac

SEQ ID NO: 210059 - DNA, 33 bp, Artificial Sequence
  Description of Artificial Sequence: Synthetic oligonucleotide
cctgtgaatggcatggcacatgtgatcaaagac

SEQ ID NO: 210060 - DNA, 35 bp, Artificial Sequence
  Description of Artificial Sequence: Synthetic oligonucleotide
ctgtgaatggcatggcacatgtgatcaaagacatc

SEQ ID NO: 210061 - DNA, 35 bp, Artificial Sequence
  Description of Artificial Sequence: Synthetic oligonucleotide
tgtgaatggcatggcacatgtgatcaaagacatcc

SEQ ID NO: 210062 - DNA, 34 bp, Artificial Sequence
  Description of Artificial Sequence: Synthetic oligonucleotide
gtgaatggcatggcacatgtgatcaaagacatcc

SEQ ID NO: 210063 - DNA, 35 bp, Artificial Sequence
  Description of Artificial Sequence: Synthetic oligonucleotide
tgaatggcatggcacatgtgatcaaagacatccag

SEQ ID NO: 210064 - DNA, 34 bp, Artificial Sequence
  Description of Artificial Sequence: Synthetic oligonucleotide
gaatggcatggcacatgtgatcaaagacatccag

SEQ ID NO: 210065 - DNA, 36 bp, Artificial Sequence
  Description of Artificial Sequence: Synthetic oligonucleotide
aatggcatggcacatgtgatcaaagacatccagttc

SEQ ID NO: 210066 - DNA, 35 bp, Artificial Sequence
  Description of Artificial Sequence: Synthetic oligonucleotide
atggcatggcacatgtgatcaaagacatccagttc

SEQ ID NO: 210067 - DNA, 34 bp, Artificial Sequence
  Description of Artificial Sequence: Synthetic oligonucleotide
tggcatggcacatgtgatcaaagacatccagttc

SEQ ID NO: 210068 - DNA, 33 bp, Artificial Sequence
  Description of Artificial Sequence: Synthetic oligonucleotide
ggcatggcacatgtgatcaaagacatccagttc

SEQ ID NO: 210069 - DNA, 34 bp, Artificial Sequence
  Description of Artificial Sequence: Synthetic oligonucleotide
gcatggcacatgtgatcaaagacatccagttcag

SEQ ID NO: 210070 - DNA, 36 bp, Artificial Sequence
  Description of Artificial Sequence: Synthetic oligonucleotide
catggcacatgtgatcaaagacatccagttcagatc

SEQ ID NO: 210071 - DNA, 36 bp, Artificial Sequence
  Description of Artificial Sequence: Synthetic oligonucleotide
atggcacatgtgatcaaagacatccagttcagatcc

SEQ ID NO: 210072 - DNA, 35 bp, Artificial Sequence
  Description of Artificial Sequence: Synthetic oligonucleotide
tggcacatgtgatcaaagacatccagttcagatcc

SEQ ID NO: 210073 - DNA, 34 bp, Artificial Sequence
  Description of Artificial Sequence: Synthetic oligonucleotide
ggcacatgtgatcaaagacatccagttcagatcc

SEQ ID NO: 210074 - DNA, 34 bp, Artificial Sequence
  Description of Artificial Sequence: Synthetic oligonucleotide
gcacatgtgatcaaagacatccagttcagatccc

SEQ ID NO: 210075 - DNA, 46 bp, Artificial Sequence
  Description of Artificial Sequence: Synthetic oligonucleotide
cacatgtgatcaaagacatccagttcagatcccaaattaaatattc

SEQ ID NO: 210076 - DNA, 48 bp, Artificial Sequence
  Description of Artificial Sequence: Synthetic oligonucleotide
acatgtgatcaaagacatccagttcagatcccaaattaaatattcttg

SEQ ID NO: 210077 - DNA, 47 bp, Artificial Sequence
  Description of Artificial Sequence: Synthetic oligonucleotide
catgtgatcaaagacatccagttcagatcccaaattaaatattcttg

SEQ ID NO: 210078 - DNA, 48 bp, Artificial Sequence
  Description of Artificial Sequence: Synthetic oligonucleotide
atgtgatcaaagacatccagttcagatcccaaattaaatattcttgtc

SEQ ID NO: 210079 - DNA, 47 bp, Artificial Sequence
  Description of Artificial Sequence: Synthetic oligonucleotide
tgtgatcaaagacatccagttcagatcccaaattaaatattcttgtc

SEQ ID NO: 210080 - DNA, 46 bp, Artificial Sequence
  Description of Artificial Sequence: Synthetic oligonucleotide
gtgatcaaagacatccagttcagatcccaaattaaatattcttgtc

SEQ ID NO: 210081 - DNA, 46 bp, Artificial Sequence
  Description of Artificial Sequence: Synthetic oligonucleotide
tgatcaaagacatccagttcagatcccaaattaaatattcttgtcc

SEQ ID NO: 210082 - DNA, 45 bp, Artificial Sequence
  Description of Artificial Sequence: Synthetic oligonucleotide
gatcaaagacatccagttcagatcccaaattaaatattcttgtcc

SEQ ID NO: 210083 - DNA, 49 bp, Artificial Sequence
  Description of Artificial Sequence: Synthetic oligonucleotide
atcaaagacatccagttcagatcccaaattaaatattcttgtcctaaag

SEQ ID NO: 210084 - DNA, 48 bp, Artificial Sequence
  Description of Artificial Sequence: Synthetic oligonucleotide
tcaaagacatccagttcagatcccaaattaaatattcttgtcctaaag

SEQ ID NO: 210085 - DNA, 47 bp, Artificial Sequence
  Description of Artificial Sequence: Synthetic oligonucleotide
caaagacatccagttcagatcccaaattaaatattcttgtcctaaag

SEQ ID NO: 210086 - DNA, 47 bp, Artificial Sequence
  Description of Artificial Sequence: Synthetic oligonucleotide
aaagacatccagttcagatcccaaattaaatattcttgtcctaaagg

SEQ ID NO: 210087 - DNA, 46 bp, Artificial Sequence
  Description of Artificial Sequence: Synthetic oligonucleotide
aagacatccagttcagatcccaaattaaatattcttgtcctaaagg

SEQ ID NO: 210088 - DNA, 45 bp, Artificial Sequence
  Description of Artificial Sequence: Synthetic oligonucleotide
agacatccagttcagatcccaaattaaatattcttgtcctaaagg

SEQ ID NO: 210089 - DNA, 44 bp, Artificial Sequence
  Description of Artificial Sequence: Synthetic oligonucleotide
gacatccagttcagatcccaaattaaatattcttgtcctaaagg

SEQ ID NO: 210090 - DNA, 47 bp, Artificial Sequence
  Description of Artificial Sequence: Synthetic oligonucleotide
acatccagttcagatcccaaattaaatattcttgtcctaaaggtatg

SEQ ID NO: 210091 - DNA, 46 bp, Artificial Sequence
  Description of Artificial Sequence: Synthetic oligonucleotide
catccagttcagatcccaaattaaatattcttgtcctaaaggtatg

SEQ ID NO: 210092 - DNA, 47 bp, Artificial Sequence
  Description of Artificial Sequence: Synthetic oligonucleotide
atccagttcagatcccaaattaaatattcttgtcctaaaggtatgtc

SEQ ID NO: 210093 - DNA, 46 bp, Artificial Sequence
  Description of Artificial Sequence: Synthetic oligonucleotide
tccagttcagatcccaaattaaatattcttgtcctaaaggtatgtc

SEQ ID NO: 210094 - DNA, 45 bp, Artificial Sequence
  Description of Artificial Sequence: Synthetic oligonucleotide
ccagttcagatcccaaattaaatattcttgtcctaaaggtatgtc

SEQ ID NO: 210095 - DNA, 46 bp, Artificial Sequence
  Description of Artificial Sequence: Synthetic oligonucleotide
cagttcagatcccaaattaaatattcttgtcctaaaggtatgtcag

SEQ ID NO: 210096 - DNA, 46 bp, Artificial Sequence
  Description of Artificial Sequence: Synthetic oligonucleotide
agttcagatcccaaattaaatattcttgtcctaaaggtatgtcagc

SEQ ID NO: 210097 - DNA, 45 bp, Artificial Sequence
  Description of Artificial Sequence: Synthetic oligonucleotide
gttcagatcccaaattaaatattcttgtcctaaaggtatgtcagc

SEQ ID NO: 210098 - DNA, 45 bp, Artificial Sequence
  Description of Artificial Sequence: Synthetic oligonucleotide
ttcagatcccaaattaaatattcttgtcctaaaggtatgtcagcc

SEQ ID NO: 210099 - DNA, 44 bp, Artificial Sequence
  Description of Artificial Sequence: Synthetic oligonucleotide
tcagatcccaaattaaatattcttgtcctaaaggtatgtcagcc

SEQ ID NO: 210100 - DNA, 43 bp, Artificial Sequence
  Description of Artificial Sequence: Synthetic oligonucleotide
cagatcccaaattaaatattcttgtcctaaaggtatgtcagcc

SEQ ID NO: 210101 - DNA, 44 bp, Artificial Sequence
  Description of Artificial Sequence: Synthetic oligonucleotide
agatcccaaattaaatattcttgtcctaaaggtatgtcagccac

SEQ ID NO: 210102 - DNA, 43 bp, Artificial Sequence
  Description of Artificial Sequence: Synthetic oligonucleotide
gatcccaaattaaatattcttgtcctaaaggtatgtcagccac

SEQ ID NO: 210103 - DNA, 43 bp, Artificial Sequence
  Description of Artificial Sequence: Synthetic oligonucleotide
atcccaaattaaatattcttgtcctaaaggtatgtcagccacc

SEQ ID NO: 210104 - DNA, 42 bp, Artificial Sequence
  Description of Artificial Sequence: Synthetic oligonucleotide
tcccaaattaaatattcttgtcctaaaggtatgtcagccacc

SEQ ID NO: 210105 - DNA, 41 bp, Artificial Sequence
  Description of Artificial Sequence: Synthetic oligonucleotide
cccaaattaaatattcttgtcctaaaggtatgtcagccacc

SEQ ID NO: 210106 - DNA, 42 bp, Artificial Sequence
  Description of Artificial Sequence: Synthetic oligonucleotide
ccaaattaaatattcttgtcctaaaggtatgtcagccacctc

SEQ ID NO: 210107 - DNA, 42 bp, Artificial Sequence
  Description of Artificial Sequence: Synthetic oligonucleotide
caaattaaatattcttgtcctaaaggtatgtcagccacctcc

SEQ ID NO: 210108 - DNA, 43 bp, Artificial Sequence
  Description of Artificial Sequence: Synthetic oligonucleotide
aaattaaatattcttgtcctaaaggtatgtcagccacctccag

SEQ ID NO: 210109 - DNA, 42 bp, Artificial Sequence
  Description of Artificial Sequence: Synthetic oligonucleotide
aattaaatattcttgtcctaaaggtatgtcagccacctccag

SEQ ID NO: 210110 - DNA, 41 bp, Artificial Sequence
  Description of Artificial Sequence: Synthetic oligonucleotide
attaaatattcttgtcctaaaggtatgtcagccacctccag

SEQ ID NO: 210111 - DNA, 40 bp, Artificial Sequence
  Description of Artificial Sequence: Synthetic oligonucleotide
ttaaatattcttgtcctaaaggtatgtcagccacctccag

SEQ ID NO: 210112 - DNA, 39 bp, Artificial Sequence
  Description of Artificial Sequence: Synthetic oligonucleotide
taaatattcttgtcctaaaggtatgtcagccacctccag

SEQ ID NO: 210113 - DNA, 38 bp, Artificial Sequence
  Description of Artificial Sequence: Synthetic oligonucleotide
aaatattcttgtcctaaaggtatgtcagccacctccag

SEQ ID NO: 210114 - DNA, 37 bp, Artificial Sequence
  Description of Artificial Sequence: Synthetic oligonucleotide
aatattcttgtcctaaaggtatgtcagccacctccag

SEQ ID NO: 210115 - DNA, 36 bp, Artificial Sequence
  Description of Artificial Sequence: Synthetic oligonucleotide
atattcttgtcctaaaggtatgtcagccacctccag

SEQ ID NO: 210116 - DNA, 35 bp, Artificial Sequence
  Description of Artificial Sequence: Synthetic oligonucleotide
tattcttgtcctaaaggtatgtcagccacctccag

SEQ ID NO: 210117 - DNA, 34 bp, Artificial Sequence
  Description of Artificial Sequence: Synthetic oligonucleotide
attcttgtcctaaaggtatgtcagccacctccag

SEQ ID NO: 210118 - DNA, 33 bp, Artificial Sequence
  Description of Artificial Sequence: Synthetic oligonucleotide
ttcttgtcctaaaggtatgtcagccacctccag

SEQ ID NO: 210119 - DNA, 32 bp, Artificial Sequence
  Description of Artificial Sequence: Synthetic oligonucleotide
tcttgtcctaaaggtatgtcagccacctccag

SEQ ID NO: 210120 - DNA, 31 bp, Artificial Sequence
  Description of Artificial Sequence: Synthetic oligonucleotide
cttgtcctaaaggtatgtcagccacctccag

SEQ ID NO: 210121 - DNA, 33 bp, Artificial Sequence
  Description of Artificial Sequence: Synthetic oligonucleotide
ttgtcctaaaggtatgtcagccacctccagatg

SEQ ID NO: 210122 - DNA, 32 bp, Artificial Sequence
  Description of Artificial Sequence: Synthetic oligonucleotide
tgtcctaaaggtatgtcagccacctccagatg

SEQ ID NO: 210123 - DNA, 31 bp, Artificial Sequence
  Description of Artificial Sequence: Synthetic oligonucleotide
gtcctaaaggtatgtcagccacctccagatg

SEQ ID NO: 210124 - DNA, 32 bp, Artificial Sequence
  Description of Artificial Sequence: Synthetic oligonucleotide
tcctaaaggtatgtcagccacctccagatgtc

SEQ ID NO: 210125 - DNA, 31 bp, Artificial Sequence
  Description of Artificial Sequence: Synthetic oligonucleotide
cctaaaggtatgtcagccacctccagatgtc

SEQ ID NO: 210126 - DNA, 31 bp, Artificial Sequence
  Description of Artificial Sequence: Synthetic oligonucleotide
ctaaaggtatgtcagccacctccagatgtcc

SEQ ID NO: 210127 - DNA, 32 bp, Artificial Sequence
  Description of Artificial Sequence: Synthetic oligonucleotide
taaaggtatgtcagccacctccagatgtcctg

SEQ ID NO: 210128 - DNA, 31 bp, Artificial Sequence
  Description of Artificial Sequence: Synthetic oligonucleotide
aaaggtatgtcagccacctccagatgtcctg

SEQ ID NO: 210129 - DNA, 30 bp, Artificial Sequence
  Description of Artificial Sequence: Synthetic oligonucleotide
aaggtatgtcagccacctccagatgtcctg

SEQ ID NO: 210130 - DNA, 29 bp, Artificial Sequence
  Description of Artificial Sequence: Synthetic oligonucleotide
aggtatgtcagccacctccagatgtcctg

SEQ ID NO: 210131 - DNA, 26 bp, Artificial Sequence
  Description of Artificial Sequence: Synthetic oligonucleotide
tgagcccggctacgacctcagaggat

SEQ ID NO: 210132 - DNA, 25 bp, Artificial Sequence
  Description of Artificial Sequence: Synthetic oligonucleotide
gagcccggctacgacctcagaggat

SEQ ID NO: 210133 - DNA, 27 bp, Artificial Sequence
  Description of Artificial Sequence: Synthetic oligonucleotide
agcccggctacgacctcagaggatcta

SEQ ID NO: 210134 - DNA, 26 bp, Artificial Sequence
  Description of Artificial Sequence: Synthetic oligonucleotide
gcccggctacgacctcagaggatcta

SEQ ID NO: 210135 - DNA, 26 bp, Artificial Sequence
  Description of Artificial Sequence: Synthetic oligonucleotide
cccggctacgacctcagaggatctac

SEQ ID NO: 210136 - DNA, 27 bp, Artificial Sequence
  Description of Artificial Sequence: Synthetic oligonucleotide
ccggctacgacctcagaggatctacgt

SEQ ID NO: 210137 - DNA, 31 bp, Artificial Sequence
  Description of Artificial Sequence: Synthetic oligonucleotide
cggctacgacctcagaggatctacgtatttg

SEQ ID NO: 210138 - DNA, 31 bp, Artificial Sequence
  Description of Artificial Sequence: Synthetic oligonucleotide
ggctacgacctcagaggatctacgtatttgc

SEQ ID NO: 210139 - DNA, 32 bp, Artificial Sequence
  Description of Artificial Sequence: Synthetic oligonucleotide
gctacgacctcagaggatctacgtatttgcac

SEQ ID NO: 210140 - DNA, 33 bp, Artificial Sequence
  Description of Artificial Sequence: Synthetic oligonucleotide
ctacgacctcagaggatctacgtatttgcactg

SEQ ID NO: 210141 - DNA, 33 bp, Artificial Sequence
  Description of Artificial Sequence: Synthetic oligonucleotide
tacgacctcagaggatctacgtatttgcactgc

SEQ ID NO: 210142 - DNA, 32 bp, Artificial Sequence
  Description of Artificial Sequence: Synthetic oligonucleotide
acgacctcagaggatctacgtatttgcactgc

SEQ ID NO: 210143 - DNA, 31 bp, Artificial Sequence
  Description of Artificial Sequence: Synthetic oligonucleotide
cgacctcagaggatctacgtatttgcactgc

SEQ ID NO: 210144 - DNA, 32 bp, Artificial Sequence
  Description of Artificial Sequence: Synthetic oligonucleotide
gacctcagaggatctacgtatttgcactgcac

SEQ ID NO: 210145 - DNA, 33 bp, Artificial Sequence
  Description of Artificial Sequence: Synthetic oligonucleotide
acctcagaggatctacgtatttgcactgcacac

SEQ ID NO: 210146 - DNA, 32 bp, Artificial Sequence
  Description of Artificial Sequence: Synthetic oligonucleotide
cctcagaggatctacgtatttgcactgcacac

SEQ ID NO: 210147 - DNA, 32 bp, Artificial Sequence
  Description of Artificial Sequence: Synthetic oligonucleotide
ctcagaggatctacgtatttgcactgcacacc

SEQ ID NO: 210148 - DNA, 32 bp, Artificial Sequence
  Description of Artificial Sequence: Synthetic oligonucleotide
tcagaggatctacgtatttgcactgcacaccc

SEQ ID NO: 210149 - DNA, 31 bp, Artificial Sequence
  Description of Artificial Sequence: Synthetic oligonucleotide
cagaggatctacgtatttgcactgcacaccc

SEQ ID NO: 210150 - DNA, 31 bp, Artificial Sequence
  Description of Artificial Sequence: Synthetic oligonucleotide
agaggatctacgtatttgcactgcacacccc

SEQ ID NO: 210151 - DNA, 30 bp, Artificial Sequence
  Description of Artificial Sequence: Synthetic oligonucleotide
gaggatctacgtatttgcactgcacacccc

SEQ ID NO: 210152 - DNA, 31 bp, Artificial Sequence
  Description of Artificial Sequence: Synthetic oligonucleotide
aggatctacgtatttgcactgcacaccccag

SEQ ID NO: 210153 - DNA, 30 bp, Artificial Sequence
  Description of Artificial Sequence: Synthetic oligonucleotide
ggatctacgtatttgcactgcacaccccag

SEQ ID NO: 210154 - DNA, 30 bp, Artificial Sequence
  Description of Artificial Sequence: Synthetic oligonucleotide
gatctacgtatttgcactgcacaccccagg

SEQ ID NO: 210155 - DNA, 30 bp, Artificial Sequence
  Description of Artificial Sequence: Synthetic oligonucleotide
atctacgtatttgcactgcacaccccaggg

SEQ ID NO: 210156 - DNA, 29 bp, Artificial Sequence
  Description of Artificial Sequence: Synthetic oligonucleotide
tctacgtatttgcactgcacaccccaggg

SEQ ID NO: 210157 - DNA, 28 bp, Artificial Sequence
  Description of Artificial Sequence: Synthetic oligonucleotide
ctacgtatttgcactgcacaccccaggg

SEQ ID NO: 210158 - DNA, 29 bp, Artificial Sequence
  Description of Artificial Sequence: Synthetic oligonucleotide
tacgtatttgcactgcacaccccagggag

SEQ ID NO: 210159 - DNA, 28 bp, Artificial Sequence
  Description of Artificial Sequence: Synthetic oligonucleotide
acgtatttgcactgcacaccccagggag

SEQ ID NO: 210160 - DNA, 27 bp, Artificial Sequence
  Description of Artificial Sequence: Synthetic oligonucleotide
cgtatttgcactgcacaccccagggag

SEQ ID NO: 210161 - DNA, 28 bp, Artificial Sequence
  Description of Artificial Sequence: Synthetic oligonucleotide
gtatttgcactgcacaccccagggagac

SEQ ID NO: 210162 - DNA, 29 bp, Artificial Sequence
  Description of Artificial Sequence: Synthetic oligonucleotide
tatttgcactgcacaccccagggagactg

SEQ ID NO: 210163 - DNA, 28 bp, Artificial Sequence
  Description of Artificial Sequence: Synthetic oligonucleotide
atttgcactgcacaccccagggagactg

SEQ ID NO: 210164 - DNA, 27 bp, Artificial Sequence
  Description of Artificial Sequence: Synthetic oligonucleotide
tttgcactgcacaccccagggagactg

SEQ ID NO: 210165 - DNA, 26 bp, Artificial Sequence
  Description of Artificial Sequence: Synthetic oligonucleotide
ttgcactgcacaccccagggagactg

SEQ ID NO: 210166 - DNA, 24 bp, Artificial Sequence
  Description of Artificial Sequence: Synthetic oligonucleotide
actggagccctgcagcccccagat

SEQ ID NO: 210167 - DNA, 23 bp, Artificial Sequence
  Description of Artificial Sequence: Synthetic oligonucleotide
ctggagccctgcagcccccagat

SEQ ID NO: 210168 - DNA, 24 bp, Artificial Sequence
  Description of Artificial Sequence: Synthetic oligonucleotide
tggagccctgcagcccccagatgt

SEQ ID NO: 210169 - DNA, 23 bp, Artificial Sequence
  Description of Artificial Sequence: Synthetic oligonucleotide
ggagccctgcagcccccagatgt

SEQ ID NO: 210170 - DNA, 25 bp, Artificial Sequence
  Description of Artificial Sequence: Synthetic oligonucleotide
gagccctgcagcccccagatgtgaa

SEQ ID NO: 210171 - DNA, 26 bp, Artificial Sequence
  Description of Artificial Sequence: Synthetic oligonucleotide
agccctgcagcccccagatgtgaagt

SEQ ID NO: 210172 - DNA, 25 bp, Artificial Sequence
  Description of Artificial Sequence: Synthetic oligonucleotide
gccctgcagcccccagatgtgaagt

SEQ ID NO: 210173 - DNA, 27 bp, Artificial Sequence
  Description of Artificial Sequence: Synthetic oligonucleotide
ccctgcagcccccagatgtgaagtgaa

SEQ ID NO: 210174 - DNA, 29 bp, Artificial Sequence
  Description of Artificial Sequence: Synthetic oligonucleotide
cctgcagcccccagatgtgaagtgaaatc

SEQ ID NO: 210175 - DNA, 29 bp, Artificial Sequence
  Description of Artificial Sequence: Synthetic oligonucleotide
ctgcagcccccagatgtgaagtgaaatcc

SEQ ID NO: 210176 - DNA, 30 bp, Artificial Sequence
  Description of Artificial Sequence: Synthetic oligonucleotide
tgcagcccccagatgtgaagtgaaatcctg

SEQ ID NO: 210177 - DNA, 29 bp, Artificial Sequence
  Description of Artificial Sequence: Synthetic oligonucleotide
gcagcccccagatgtgaagtgaaatcctg

SEQ ID NO: 210178 - DNA, 30 bp, Artificial Sequence
  Description of Artificial Sequence: Synthetic oligonucleotide
cagcccccagatgtgaagtgaaatcctgtg

SEQ ID NO: 210179 - DNA, 32 bp, Artificial Sequence
  Description of Artificial Sequence: Synthetic oligonucleotide
agcccccagatgtgaagtgaaatcctgtgatg

SEQ ID NO: 210180 - DNA, 31 bp, Artificial Sequence
  Description of Artificial Sequence: Synthetic oligonucleotide
gcccccagatgtgaagtgaaatcctgtgatg

SEQ ID NO: 210181 - DNA, 32 bp, Artificial Sequence
  Description of Artificial Sequence: Synthetic oligonucleotide
cccccagatgtgaagtgaaatcctgtgatgac

SEQ ID NO: 210182 - DNA, 34 bp, Artificial Sequence
  Description of Artificial Sequence: Synthetic oligonucleotide
ccccagatgtgaagtgaaatcctgtgatgacttc

SEQ ID NO: 210183 - DNA, 34 bp, Artificial Sequence
  Description of Artificial Sequence: Synthetic oligonucleotide
cccagatgtgaagtgaaatcctgtgatgacttcc

SEQ ID NO: 210184 - DNA, 35 bp, Artificial Sequence
  Description of Artificial Sequence: Synthetic oligonucleotide
ccagatgtgaagtgaaatcctgtgatgacttcctg

SEQ ID NO: 210185 - DNA, 35 bp, Artificial Sequence
  Description of Artificial Sequence: Synthetic oligonucleotide
cagatgtgaagtgaaatcctgtgatgacttcctgg

SEQ ID NO: 210186 - DNA, 35 bp, Artificial Sequence
  Description of Artificial Sequence: Synthetic oligonucleotide
agatgtgaagtgaaatcctgtgatgacttcctggg

SEQ ID NO: 210187 - DNA, 34 bp, Artificial Sequence
  Description of Artificial Sequence: Synthetic oligonucleotide
gatgtgaagtgaaatcctgtgatgacttcctggg

SEQ ID NO: 210188 - DNA, 34 bp, Artificial Sequence
  Description of Artificial Sequence: Synthetic oligonucleotide
atgtgaagtgaaatcctgtgatgacttcctgggc

SEQ ID NO: 210189 - DNA, 33 bp, Artificial Sequence
  Description of Artificial Sequence: Synthetic oligonucleotide
tgtgaagtgaaatcctgtgatgacttcctgggc

SEQ ID NO: 210190 - DNA, 32 bp, Artificial Sequence
  Description of Artificial Sequence: Synthetic oligonucleotide
gtgaagtgaaatcctgtgatgacttcctgggc

SEQ ID NO: 210191 - DNA, 32 bp, Artificial Sequence
  Description of Artificial Sequence: Synthetic oligonucleotide
tgaagtgaaatcctgtgatgacttcctgggcc

SEQ ID NO: 210192 - DNA, 31 bp, Artificial Sequence
  Description of Artificial Sequence: Synthetic oligonucleotide
gaagtgaaatcctgtgatgacttcctgggcc

SEQ ID NO: 210193 - DNA, 33 bp, Artificial Sequence
  Description of Artificial Sequence: Synthetic oligonucleotide
aagtgaaatcctgtgatgacttcctgggccaac

SEQ ID NO: 210194 - DNA, 33 bp, Artificial Sequence
  Description of Artificial Sequence: Synthetic oligonucleotide
tgaaatcctgtgatgacttcctgggccaacttc

SEQ ID NO: 210195 - DNA, 32 bp, Artificial Sequence
  Description of Artificial Sequence: Synthetic oligonucleotide
gaaatcctgtgatgacttcctgggccaacttc

SEQ ID NO: 210196 - DNA, 32 bp, Artificial Sequence
  Description of Artificial Sequence: Synthetic oligonucleotide
aaatcctgtgatgacttcctgggccaacttcc

SEQ ID NO: 210197 - DNA, 31 bp, Artificial Sequence
  Description of Artificial Sequence: Synthetic oligonucleotide
aatcctgtgatgacttcctgggccaacttcc

SEQ ID NO: 210198 - DNA, 30 bp, Artificial Sequence
  Description of Artificial Sequence: Synthetic oligonucleotide
atcctgtgatgacttcctgggccaacttcc

SEQ ID NO: 210199 - DNA, 29 bp, Artificial Sequence
  Description of Artificial Sequence: Synthetic oligonucleotide
tcctgtgatgacttcctgggccaacttcc

SEQ ID NO: 210200 - DNA, 28 bp, Artificial Sequence
  Description of Artificial Sequence: Synthetic oligonucleotide
cctgtgatgacttcctgggccaacttcc

SEQ ID NO: 210201 - DNA, 32 bp, Artificial Sequence
  Description of Artificial Sequence: Synthetic oligonucleotide
ctgtgatgacttcctgggccaacttcctaatg

SEQ ID NO: 210202 - DNA, 32 bp, Artificial Sequence
  Description of Artificial Sequence: Synthetic oligonucleotide
tgtgatgacttcctgggccaacttcctaatgg

SEQ ID NO: 210203 - DNA, 31 bp, Artificial Sequence
  Description of Artificial Sequence: Synthetic oligonucleotide
gtgatgacttcctgggccaacttcctaatgg

SEQ ID NO: 210204 - DNA, 31 bp, Artificial Sequence
  Description of Artificial Sequence: Synthetic oligonucleotide
tgatgacttcctgggccaacttcctaatggc

SEQ ID NO: 210205 - DNA, 30 bp, Artificial Sequence
  Description of Artificial Sequence: Synthetic oligonucleotide
gatgacttcctgggccaacttcctaatggc

SEQ ID NO: 210206 - DNA, 30 bp, Artificial Sequence
  Description of Artificial Sequence: Synthetic oligonucleotide
atgacttcctgggccaacttcctaatggcc

SEQ ID NO: 210207 - DNA, 29 bp, Artificial Sequence
  Description of Artificial Sequence: Synthetic oligonucleotide
tgacttcctgggccaacttcctaatggcc

SEQ ID NO: 210208 - DNA, 28 bp, Artificial Sequence
  Description of Artificial Sequence: Synthetic oligonucleotide
gacttcctgggccaacttcctaatggcc

SEQ ID NO: 210209 - DNA, 30 bp, Artificial Sequence
  Description of Artificial Sequence: Synthetic oligonucleotide
acttcctgggccaacttcctaatggccatg

SEQ ID NO: 210210 - DNA, 29 bp, Artificial Sequence
  Description of Artificial Sequence: Synthetic oligonucleotide
cttcctgggccaacttcctaatggccatg

SEQ ID NO: 210211 - DNA, 30 bp, Artificial Sequence
  Description of Artificial Sequence: Synthetic oligonucleotide
ttcctgggccaacttcctaatggccatgtg

SEQ ID NO: 210212 - DNA, 29 bp, Artificial Sequence
  Description of Artificial Sequence: Synthetic oligonucleotide
tcctgggccaacttcctaatggccatgtg

SEQ ID NO: 210213 - DNA, 28 bp, Artificial Sequence
  Description of Artificial Sequence: Synthetic oligonucleotide
cctgggccaacttcctaatggccatgtg

SEQ ID NO: 210214 - DNA, 28 bp, Artificial Sequence
  Description of Artificial Sequence: Synthetic oligonucleotide
ctgggccaacttcctaatggccatgtgc

SEQ ID NO: 210215 - DNA, 33 bp, Artificial Sequence
  Description of Artificial Sequence: Synthetic oligonucleotide
tgggccaacttcctaatggccatgtgctatttc

SEQ ID NO: 210216 - DNA, 32 bp, Artificial Sequence
  Description of Artificial Sequence: Synthetic oligonucleotide
gggccaacttcctaatggccatgtgctatttc

SEQ ID NO: 210217 - DNA, 32 bp, Artificial Sequence
  Description of Artificial Sequence: Synthetic oligonucleotide
ggccaacttcctaatggccatgtgctatttcc

SEQ ID NO: 210218 - DNA, 33 bp, Artificial Sequence
  Description of Artificial Sequence: Synthetic oligonucleotide
gccaacttcctaatggccatgtgctatttccac

SEQ ID NO: 210219 - DNA, 38 bp, Artificial Sequence
  Description of Artificial Sequence: Synthetic oligonucleotide
ccaacttcctaatggccatgtgctatttccacttaatc

SEQ ID NO: 210220 - DNA, 39 bp, Artificial Sequence
  Description of Artificial Sequence: Synthetic oligonucleotide
caacttcctaatggccatgtgctatttccacttaatctc

SEQ ID NO: 210221 - DNA, 39 bp, Artificial Sequence
  Description of Artificial Sequence: Synthetic oligonucleotide
aacttcctaatggccatgtgctatttccacttaatctcc

SEQ ID NO: 210222 - DNA, 38 bp, Artificial Sequence
  Description of Artificial Sequence: Synthetic oligonucleotide
acttcctaatggccatgtgctatttccacttaatctcc

SEQ ID NO: 210223 - DNA, 37 bp, Artificial Sequence
  Description of Artificial Sequence: Synthetic oligonucleotide
cttcctaatggccatgtgctatttccacttaatctcc

SEQ ID NO: 210224 - DNA, 38 bp, Artificial Sequence
  Description of Artificial Sequence: Synthetic oligonucleotide
ttcctaatggccatgtgctatttccacttaatctccag

SEQ ID NO: 210225 - DNA, 37 bp, Artificial Sequence
  Description of Artificial Sequence: Synthetic oligonucleotide
tcctaatggccatgtgctatttccacttaatctccag

SEQ ID NO: 210226 - DNA, 36 bp, Artificial Sequence
  Description of Artificial Sequence: Synthetic oligonucleotide
cctaatggccatgtgctatttccacttaatctccag

SEQ ID NO: 210227 - DNA, 36 bp, Artificial Sequence
  Description of Artificial Sequence: Synthetic oligonucleotide
ctaatggccatgtgctatttccacttaatctccagc

SEQ ID NO: 210228 - DNA, 38 bp, Artificial Sequence
  Description of Artificial Sequence: Synthetic oligonucleotide
taatggccatgtgctatttccacttaatctccagcttg

SEQ ID NO: 210229 - DNA, 37 bp, Artificial Sequence
  Description of Artificial Sequence: Synthetic oligonucleotide
aatggccatgtgctatttccacttaatctccagcttg

SEQ ID NO: 210230 - DNA, 36 bp, Artificial Sequence
  Description of Artificial Sequence: Synthetic oligonucleotide
atggccatgtgctatttccacttaatctccagcttg

SEQ ID NO: 210231 - DNA, 35 bp, Artificial Sequence
  Description of Artificial Sequence: Synthetic oligonucleotide
tggccatgtgctatttccacttaatctccagcttg

SEQ ID NO: 210232 - DNA, 34 bp, Artificial Sequence
  Description of Artificial Sequence: Synthetic oligonucleotide
ggccatgtgctatttccacttaatctccagcttg

SEQ ID NO: 210233 - DNA, 34 bp, Artificial Sequence
  Description of Artificial Sequence: Synthetic oligonucleotide
gccatgtgctatttccacttaatctccagcttgg

SEQ ID NO: 210234 - DNA, 35 bp, Artificial Sequence
  Description of Artificial Sequence: Synthetic oligonucleotide
ccatgtgctatttccacttaatctccagcttggag

SEQ ID NO: 210235 - DNA, 35 bp, Artificial Sequence
  Description of Artificial Sequence: Synthetic oligonucleotide
catgtgctatttccacttaatctccagcttggagc

SEQ ID NO: 210236 - DNA, 39 bp, Artificial Sequence
  Description of Artificial Sequence: Synthetic oligonucleotide
atgtgctatttccacttaatctccagcttggagcaaaag

SEQ ID NO: 210237 - DNA, 38 bp, Artificial Sequence
  Description of Artificial Sequence: Synthetic oligonucleotide
tgtgctatttccacttaatctccagcttggagcaaaag

SEQ ID NO: 210238 - DNA, 37 bp, Artificial Sequence
  Description of Artificial Sequence: Synthetic oligonucleotide
gtgctatttccacttaatctccagcttggagcaaaag

SEQ ID NO: 210239 - DNA, 38 bp, Artificial Sequence
  Description of Artificial Sequence: Synthetic oligonucleotide
tgctatttccacttaatctccagcttggagcaaaagtg

SEQ ID NO: 210240 - DNA, 37 bp, Artificial Sequence
  Description of Artificial Sequence: Synthetic oligonucleotide
gctatttccacttaatctccagcttggagcaaaagtg

SEQ ID NO: 210241 - DNA, 37 bp, Artificial Sequence
  Description of Artificial Sequence: Synthetic oligonucleotide
ctatttccacttaatctccagcttggagcaaaagtgg

SEQ ID NO: 210242 - DNA, 42 bp, Artificial Sequence
  Description of Artificial Sequence: Synthetic oligonucleotide
tatttccacttaatctccagcttggagcaaaagtggattttg

SEQ ID NO: 210243 - DNA, 41 bp, Artificial Sequence
  Description of Artificial Sequence: Synthetic oligonucleotide
atttccacttaatctccagcttggagcaaaagtggattttg

SEQ ID NO: 210244 - DNA, 40 bp, Artificial Sequence
  Description of Artificial Sequence: Synthetic oligonucleotide
tttccacttaatctccagcttggagcaaaagtggattttg

SEQ ID NO: 210245 - DNA, 39 bp, Artificial Sequence
  Description of Artificial Sequence: Synthetic oligonucleotide
ttccacttaatctccagcttggagcaaaagtggattttg

SEQ ID NO: 210246 - DNA, 38 bp, Artificial Sequence
  Description of Artificial Sequence: Synthetic oligonucleotide
tccacttaatctccagcttggagcaaaagtggattttg

SEQ ID NO: 210247 - DNA, 37 bp, Artificial Sequence
  Description of Artificial Sequence: Synthetic oligonucleotide
ccacttaatctccagcttggagcaaaagtggattttg

SEQ ID NO: 210248 - DNA, 40 bp, Artificial Sequence
  Description of Artificial Sequence: Synthetic oligonucleotide
cacttaatctccagcttggagcaaaagtggattttgtttg

SEQ ID NO: 210249 - DNA, 41 bp, Artificial Sequence
  Description of Artificial Sequence: Synthetic oligonucleotide
acttaatctccagcttggagcaaaagtggattttgtttgtg

SEQ ID NO: 210250 - DNA, 40 bp, Artificial Sequence
  Description of Artificial Sequence: Synthetic oligonucleotide
cttaatctccagcttggagcaaaagtggattttgtttgtg

SEQ ID NO: 210251 - DNA, 42 bp, Artificial Sequence
  Description of Artificial Sequence: Synthetic oligonucleotide
ttaatctccagcttggagcaaaagtggattttgtttgtgatg

SEQ ID NO: 210252 - DNA, 41 bp, Artificial Sequence
  Description of Artificial Sequence: Synthetic oligonucleotide
taatctccagcttggagcaaaagtggattttgtttgtgatg

SEQ ID NO: 210253 - DNA, 44 bp, Artificial Sequence
  Description of Artificial Sequence: Synthetic oligonucleotide
aaggatttcaattaaaaggcagctctgctagttactgtgttttg

SEQ ID NO: 210254 - DNA, 43 bp, Artificial Sequence
  Description of Artificial Sequence: Synthetic oligonucleotide
aggatttcaattaaaaggcagctctgctagttactgtgttttg

SEQ ID NO: 210255 - DNA, 42 bp, Artificial Sequence
  Description of Artificial Sequence: Synthetic oligonucleotide
ggatttcaattaaaaggcagctctgctagttactgtgttttg

SEQ ID NO: 210256 - DNA, 42 bp, Artificial Sequence
  Description of Artificial Sequence: Synthetic oligonucleotide
gatttcaattaaaaggcagctctgctagttactgtgttttgg

SEQ ID NO: 210257 - DNA, 42 bp, Artificial Sequence
  Description of Artificial Sequence: Synthetic oligonucleotide
atttcaattaaaaggcagctctgctagttactgtgttttggc

SEQ ID NO: 210258 - DNA, 41 bp, Artificial Sequence
  Description of Artificial Sequence: Synthetic oligonucleotide
tttcaattaaaaggcagctctgctagttactgtgttttggc

SEQ ID NO: 210259 - DNA, 40 bp, Artificial Sequence
  Description of Artificial Sequence: Synthetic oligonucleotide
ttcaattaaaaggcagctctgctagttactgtgttttggc

SEQ ID NO: 210260 - DNA, 39 bp, Artificial Sequence
  Description of Artificial Sequence: Synthetic oligonucleotide
tcaattaaaaggcagctctgctagttactgtgttttggc

SEQ ID NO: 210261 - DNA, 38 bp, Artificial Sequence
  Description of Artificial Sequence: Synthetic oligonucleotide
caattaaaaggcagctctgctagttactgtgttttggc

SEQ ID NO: 210262 - DNA, 39 bp, Artificial Sequence
  Description of Artificial Sequence: Synthetic oligonucleotide
aattaaaaggcagctctgctagttactgtgttttggctg

SEQ ID NO: 210263 - DNA, 38 bp, Artificial Sequence
  Description of Artificial Sequence: Synthetic oligonucleotide
attaaaaggcagctctgctagttactgtgttttggctg

SEQ ID NO: 210264 - DNA, 37 bp, Artificial Sequence
  Description of Artificial Sequence: Synthetic oligonucleotide
ttaaaaggcagctctgctagttactgtgttttggctg

SEQ ID NO: 210265 - DNA, 36 bp, Artificial Sequence
  Description of Artificial Sequence: Synthetic oligonucleotide
taaaaggcagctctgctagttactgtgttttggctg

SEQ ID NO: 210266 - DNA, 35 bp, Artificial Sequence
  Description of Artificial Sequence: Synthetic oligonucleotide
aaaaggcagctctgctagttactgtgttttggctg

SEQ ID NO: 210267 - DNA, 34 bp, Artificial Sequence
  Description of Artificial Sequence: Synthetic oligonucleotide
aaaggcagctctgctagttactgtgttttggctg

SEQ ID NO: 210268 - DNA, 33 bp, Artificial Sequence
  Description of Artificial Sequence: Synthetic oligonucleotide
aaggcagctctgctagttactgtgttttggctg

SEQ ID NO: 210269 - DNA, 32 bp, Artificial Sequence
  Description of Artificial Sequence: Synthetic oligonucleotide
aggcagctctgctagttactgtgttttggctg

SEQ ID NO: 210270 - DNA, 31 bp, Artificial Sequence
  Description of Artificial Sequence: Synthetic oligonucleotide
ggcagctctgctagttactgtgttttggctg

SEQ ID NO: 210271 - DNA, 31 bp, Artificial Sequence
  Description of Artificial Sequence: Synthetic oligonucleotide
gcagctctgctagttactgtgttttggctgg

SEQ ID NO: 210272 - DNA, 34 bp, Artificial Sequence
  Description of Artificial Sequence: Synthetic oligonucleotide
cagctctgctagttactgtgttttggctggaatg

SEQ ID NO: 210273 - DNA, 34 bp, Artificial Sequence
  Description of Artificial Sequence: Synthetic oligonucleotide
agctctgctagttactgtgttttggctggaatgg

SEQ ID NO: 210274 - DNA, 33 bp, Artificial Sequence
  Description of Artificial Sequence: Synthetic oligonucleotide
gctctgctagttactgtgttttggctggaatgg

SEQ ID NO: 210275 - DNA, 36 bp, Artificial Sequence
  Description of Artificial Sequence: Synthetic oligonucleotide
ctctgctagttactgtgttttggctggaatggaaag

SEQ ID NO: 210276 - DNA, 36 bp, Artificial Sequence
  Description of Artificial Sequence: Synthetic oligonucleotide
tctgctagttactgtgttttggctggaatggaaagc

SEQ ID NO: 210277 - DNA, 35 bp, Artificial Sequence
  Description of Artificial Sequence: Synthetic oligonucleotide
ctgctagttactgtgttttggctggaatggaaagc

SEQ ID NO: 210278 - DNA, 35 bp, Artificial Sequence
  Description of Artificial Sequence: Synthetic oligonucleotide
tgctagttactgtgttttggctggaatggaaagcc

SEQ ID NO: 210279 - DNA, 34 bp, Artificial Sequence
  Description of Artificial Sequence: Synthetic oligonucleotide
gctagttactgtgttttggctggaatggaaagcc

SEQ ID NO: 210280 - DNA, 37 bp, Artificial Sequence
  Description of Artificial Sequence: Synthetic oligonucleotide
ctagttactgtgttttggctggaatggaaagcctttg

SEQ ID NO: 210281 - DNA, 37 bp, Artificial Sequence
  Description of Artificial Sequence: Synthetic oligonucleotide
tagttactgtgttttggctggaatggaaagcctttgg

SEQ ID NO: 210282 - DNA, 36 bp, Artificial Sequence
  Description of Artificial Sequence: Synthetic oligonucleotide
agttactgtgttttggctggaatggaaagcctttgg

SEQ ID NO: 210283 - DNA, 35 bp, Artificial Sequence
  Description of Artificial Sequence: Synthetic oligonucleotide
gttactgtgttttggctggaatggaaagcctttgg

SEQ ID NO: 210284 - DNA, 39 bp, Artificial Sequence
  Description of Artificial Sequence: Synthetic oligonucleotide
ttactgtgttttggctggaatggaaagcctttggaatag

SEQ ID NO: 210285 - DNA, 38 bp, Artificial Sequence
  Description of Artificial Sequence: Synthetic oligonucleotide
tactgtgttttggctggaatggaaagcctttggaatag

SEQ ID NO: 210286 - DNA, 37 bp, Artificial Sequence
  Description of Artificial Sequence: Synthetic oligonucleotide
actgtgttttggctggaatggaaagcctttggaatag

SEQ ID NO: 210287 - DNA, 36 bp, Artificial Sequence
  Description of Artificial Sequence: Synthetic oligonucleotide
ctgtgttttggctggaatggaaagcctttggaatag

SEQ ID NO: 210288 - DNA, 36 bp, Artificial Sequence
  Description of Artificial Sequence: Synthetic oligonucleotide
tgtgttttggctggaatggaaagcctttggaatagc

SEQ ID NO: 210289 - DNA, 35 bp, Artificial Sequence
  Description of Artificial Sequence: Synthetic oligonucleotide
gtgttttggctggaatggaaagcctttggaatagc

SEQ ID NO: 210290 - DNA, 36 bp, Artificial Sequence
  Description of Artificial Sequence: Synthetic oligonucleotide
tgttttggctggaatggaaagcctttggaatagcag

SEQ ID NO: 210291 - DNA, 35 bp, Artificial Sequence
  Description of Artificial Sequence: Synthetic oligonucleotide
gttttggctggaatggaaagcctttggaatagcag

SEQ ID NO: 210292 - DNA, 36 bp, Artificial Sequence
  Description of Artificial Sequence: Synthetic oligonucleotide
ttttggctggaatggaaagcctttggaatagcagtg

SEQ ID NO: 210293 - DNA, 35 bp, Artificial Sequence
  Description of Artificial Sequence: Synthetic oligonucleotide
tttggctggaatggaaagcctttggaatagcagtg

SEQ ID NO: 210294 - DNA, 33 bp, Artificial Sequence
  Description of Artificial Sequence: Synthetic oligonucleotide
cctttggaatagcagtgttccagtgtgtgaacg

SEQ ID NO: 210295 - DNA, 33 bp, Artificial Sequence
  Description of Artificial Sequence: Synthetic oligonucleotide
ctttggaatagcagtgttccagtgtgtgaacgg

SEQ ID NO: 210296 - DNA, 33 bp, Artificial Sequence
  Description of Artificial Sequence: Synthetic oligonucleotide
tttggaatagcagtgttccagtgtgtgaacggc

SEQ ID NO: 210297 - DNA, 32 bp, Artificial Sequence
  Description of Artificial Sequence: Synthetic oligonucleotide
ttggaatagcagtgttccagtgtgtgaacggc

SEQ ID NO: 210298 - DNA, 31 bp, Artificial Sequence
  Description of Artificial Sequence: Synthetic oligonucleotide
tggaatagcagtgttccagtgtgtgaacggc

SEQ ID NO: 210299 - DNA, 30 bp, Artificial Sequence
  Description of Artificial Sequence: Synthetic oligonucleotide
ggaatagcagtgttccagtgtgtgaacggc

SEQ ID NO: 210300 - DNA, 31 bp, Artificial Sequence
  Description of Artificial Sequence: Synthetic oligonucleotide
gaatagcagtgttccagtgtgtgaacggcac

SEQ ID NO: 210301 - DNA, 31 bp, Artificial Sequence
  Description of Artificial Sequence: Synthetic oligonucleotide
aatagcagtgttccagtgtgtgaacggcacc

SEQ ID NO: 210302 - DNA, 30 bp, Artificial Sequence
  Description of Artificial Sequence: Synthetic oligonucleotide
atagcagtgttccagtgtgtgaacggcacc

SEQ ID NO: 210303 - DNA, 29 bp, Artificial Sequence
  Description of Artificial Sequence: Synthetic oligonucleotide
tagcagtgttccagtgtgtgaacggcacc

SEQ ID NO: 210304 - DNA, 28 bp, Artificial Sequence
  Description of Artificial Sequence: Synthetic oligonucleotide
agcagtgttccagtgtgtgaacggcacc

SEQ ID NO: 210305 - DNA, 27 bp, Artificial Sequence
  Description of Artificial Sequence: Synthetic oligonucleotide
gcagtgttccagtgtgtgaacggcacc

SEQ ID NO: 210306 - DNA, 27 bp, Artificial Sequence
  Description of Artificial Sequence: Synthetic oligonucleotide
cagtgttccagtgtgtgaacggcaccg

SEQ ID NO: 210307 - DNA, 28 bp, Artificial Sequence
  Description of Artificial Sequence: Synthetic oligonucleotide
agtgttccagtgtgtgaacggcaccgac

SEQ ID NO: 210308 - DNA, 27 bp, Artificial Sequence
  Description of Artificial Sequence: Synthetic oligonucleotide
gtgttccagtgtgtgaacggcaccgac

SEQ ID NO: 210309 - DNA, 28 bp, Artificial Sequence
  Description of Artificial Sequence: Synthetic oligonucleotide
tgttccagtgtgtgaacggcaccgactc

SEQ ID NO: 210310 - DNA, 27 bp, Artificial Sequence
  Description of Artificial Sequence: Synthetic oligonucleotide
gttccagtgtgtgaacggcaccgactc

SEQ ID NO: 210311 - DNA, 30 bp, Artificial Sequence
  Description of Artificial Sequence: Synthetic oligonucleotide
ttccagtgtgtgaacggcaccgactcattg

SEQ ID NO: 210312 - DNA, 29 bp, Artificial Sequence
  Description of Artificial Sequence: Synthetic oligonucleotide
tccagtgtgtgaacggcaccgactcattg

SEQ ID NO: 210313 - DNA, 28 bp, Artificial Sequence
  Description of Artificial Sequence: Synthetic oligonucleotide
ccagtgtgtgaacggcaccgactcattg

SEQ ID NO: 210314 - DNA, 28 bp, Artificial Sequence
  Description of Artificial Sequence: Synthetic oligonucleotide
cagtgtgtgaacggcaccgactcattgg

SEQ ID NO: 210315 - DNA, 29 bp, Artificial Sequence
  Description of Artificial Sequence: Synthetic oligonucleotide
agtgtgtgaacggcaccgactcattggtc

SEQ ID NO: 210316 - DNA, 28 bp, Artificial Sequence
  Description of Artificial Sequence: Synthetic oligonucleotide
gtgtgtgaacggcaccgactcattggtc

SEQ ID NO: 210317 - DNA, 29 bp, Artificial Sequence
  Description of Artificial Sequence: Synthetic oligonucleotide
tgtgtgaacggcaccgactcattggtcac

SEQ ID NO: 210318 - DNA, 28 bp, Artificial Sequence
  Description of Artificial Sequence: Synthetic oligonucleotide
gtgtgaacggcaccgactcattggtcac

SEQ ID NO: 210319 - DNA, 29 bp, Artificial Sequence
  Description of Artificial Sequence: Synthetic oligonucleotide
tgtgaacggcaccgactcattggtcactc

SEQ ID NO: 210320 - DNA, 28 bp, Artificial Sequence
  Description of Artificial Sequence: Synthetic oligonucleotide
gtgaacggcaccgactcattggtcactc

SEQ ID NO: 210321 - DNA, 30 bp, Artificial Sequence
  Description of Artificial Sequence: Synthetic oligonucleotide
tgaacggcaccgactcattggtcactcatc

SEQ ID NO: 210322 - DNA, 29 bp, Artificial Sequence
  Description of Artificial Sequence: Synthetic oligonucleotide
gaacggcaccgactcattggtcactcatc

SEQ ID NO: 210323 - DNA, 30 bp, Artificial Sequence
  Description of Artificial Sequence: Synthetic oligonucleotide
aacggcaccgactcattggtcactcatctg

SEQ ID NO: 210324 - DNA, 29 bp, Artificial Sequence
  Description of Artificial Sequence: Synthetic oligonucleotide
acggcaccgactcattggtcactcatctg

SEQ ID NO: 210325 - DNA, 28 bp, Artificial Sequence
  Description of Artificial Sequence: Synthetic oligonucleotide
cggcaccgactcattggtcactcatctg

SEQ ID NO: 210326 - DNA, 37 bp, Artificial Sequence
  Description of Artificial Sequence: Synthetic oligonucleotide
gttctgattaaaaggcaggtctgctagtcattgtgtc

SEQ ID NO: 210327 - DNA, 39 bp, Artificial Sequence
  Description of Artificial Sequence: Synthetic oligonucleotide
ttctgattaaaaggcaggtctgctagtcattgtgtcttg

SEQ ID NO: 210328 - DNA, 38 bp, Artificial Sequence
  Description of Artificial Sequence: Synthetic oligonucleotide
tctgattaaaaggcaggtctgctagtcattgtgtcttg

SEQ ID NO: 210329 - DNA, 37 bp, Artificial Sequence
  Description of Artificial Sequence: Synthetic oligonucleotide
ctgattaaaaggcaggtctgctagtcattgtgtcttg

SEQ ID NO: 210330 - DNA, 37 bp, Artificial Sequence
  Description of Artificial Sequence: Synthetic oligonucleotide
tgattaaaaggcaggtctgctagtcattgtgtcttgg

SEQ ID NO: 210331 - DNA, 35 bp, Artificial Sequence
  Description of Artificial Sequence: Synthetic oligonucleotide
cctttggaatagcagtgttccagtgtgtgaactag

SEQ ID NO: 210332 - DNA, 39 bp, Artificial Sequence
  Description of Artificial Sequence: Synthetic oligonucleotide
ctttggaatagcagtgttccagtgtgtgaactagaaatc

SEQ ID NO: 210333 - DNA, 43 bp, Artificial Sequence
  Description of Artificial Sequence: Synthetic oligonucleotide
tttggaatagcagtgttccagtgtgtgaactagaaatcttttg

SEQ ID NO: 210334 - DNA, 42 bp, Artificial Sequence
  Description of Artificial Sequence: Synthetic oligonucleotide
ttggaatagcagtgttccagtgtgtgaactagaaatcttttg

SEQ ID NO: 210335 - DNA, 41 bp, Artificial Sequence
  Description of Artificial Sequence: Synthetic oligonucleotide
tggaatagcagtgttccagtgtgtgaactagaaatcttttg

SEQ ID NO: 210336 - DNA, 40 bp, Artificial Sequence
  Description of Artificial Sequence: Synthetic oligonucleotide
ggaatagcagtgttccagtgtgtgaactagaaatcttttg

SEQ ID NO: 210337 - DNA, 41 bp, Artificial Sequence
  Description of Artificial Sequence: Synthetic oligonucleotide
gaatagcagtgttccagtgtgtgaactagaaatcttttgtc

SEQ ID NO: 210338 - DNA, 41 bp, Artificial Sequence
  Description of Artificial Sequence: Synthetic oligonucleotide
aatagcagtgttccagtgtgtgaactagaaatcttttgtcc

SEQ ID NO: 210339 - DNA, 40 bp, Artificial Sequence
  Description of Artificial Sequence: Synthetic oligonucleotide
atagcagtgttccagtgtgtgaactagaaatcttttgtcc

SEQ ID NO: 210340 - DNA, 39 bp, Artificial Sequence
  Description of Artificial Sequence: Synthetic oligonucleotide
tagcagtgttccagtgtgtgaactagaaatcttttgtcc

SEQ ID NO: 210341 - DNA, 38 bp, Artificial Sequence
  Description of Artificial Sequence: Synthetic oligonucleotide
agcagtgttccagtgtgtgaactagaaatcttttgtcc

SEQ ID NO: 210342 - DNA, 37 bp, Artificial Sequence
  Description of Artificial Sequence: Synthetic oligonucleotide
gcagtgttccagtgtgtgaactagaaatcttttgtcc

SEQ ID NO: 210343 - DNA, 41 bp, Artificial Sequence
  Description of Artificial Sequence: Synthetic oligonucleotide
cagtgttccagtgtgtgaactagaaatcttttgtccaaatc

SEQ ID NO: 210344 - DNA, 41 bp, Artificial Sequence
  Description of Artificial Sequence: Synthetic oligonucleotide
agtgttccagtgtgtgaactagaaatcttttgtccaaatcc

SEQ ID NO: 210345 - DNA, 40 bp, Artificial Sequence
  Description of Artificial Sequence: Synthetic oligonucleotide
gtgttccagtgtgtgaactagaaatcttttgtccaaatcc

SEQ ID NO: 210346 - DNA, 41 bp, Artificial Sequence
  Description of Artificial Sequence: Synthetic oligonucleotide
tgttccagtgtgtgaactagaaatcttttgtccaaatcctc

SEQ ID NO: 210347 - DNA, 40 bp, Artificial Sequence
  Description of Artificial Sequence: Synthetic oligonucleotide
gttccagtgtgtgaactagaaatcttttgtccaaatcctc

SEQ ID NO: 210348 - DNA, 40 bp, Artificial Sequence
  Description of Artificial Sequence: Synthetic oligonucleotide
ttccagtgtgtgaactagaaatcttttgtccaaatcctcc

SEQ ID NO: 210349 - DNA, 39 bp, Artificial Sequence
  Description of Artificial Sequence: Synthetic oligonucleotide
tccagtgtgtgaactagaaatcttttgtccaaatcctcc

SEQ ID NO: 210350 - DNA, 38 bp, Artificial Sequence
  Description of Artificial Sequence: Synthetic oligonucleotide
ccagtgtgtgaactagaaatcttttgtccaaatcctcc

SEQ ID NO: 210351 - DNA, 39 bp, Artificial Sequence
  Description of Artificial Sequence: Synthetic oligonucleotide
cagtgtgtgaactagaaatcttttgtccaaatcctccag

SEQ ID NO: 210352 - DNA, 39 bp, Artificial Sequence
  Description of Artificial Sequence: Synthetic oligonucleotide
agtgtgtgaactagaaatcttttgtccaaatcctccagc

SEQ ID NO: 210353 - DNA, 38 bp, Artificial Sequence
  Description of Artificial Sequence: Synthetic oligonucleotide
gtgtgtgaactagaaatcttttgtccaaatcctccagc

SEQ ID NO: 210354 - DNA, 41 bp, Artificial Sequence
  Description of Artificial Sequence: Synthetic oligonucleotide
tgtgtgaactagaaatcttttgtccaaatcctccagctatc

SEQ ID NO: 210355 - DNA, 40 bp, Artificial Sequence
  Description of Artificial Sequence: Synthetic oligonucleotide
gtgtgaactagaaatcttttgtccaaatcctccagctatc

SEQ ID NO: 210356 - DNA, 40 bp, Artificial Sequence
  Description of Artificial Sequence: Synthetic oligonucleotide
tgtgaactagaaatcttttgtccaaatcctccagctatcc

SEQ ID NO: 210357 - DNA, 39 bp, Artificial Sequence
  Description of Artificial Sequence: Synthetic oligonucleotide
gtgaactagaaatcttttgtccaaatcctccagctatcc

SEQ ID NO: 210358 - DNA, 44 bp, Artificial Sequence
  Description of Artificial Sequence: Synthetic oligonucleotide
tgaactagaaatcttttgtccaaatcctccagctatccttaatg

SEQ ID NO: 210359 - DNA, 43 bp, Artificial Sequence
  Description of Artificial Sequence: Synthetic oligonucleotide
gaactagaaatcttttgtccaaatcctccagctatccttaatg

SEQ ID NO: 210360 - DNA, 43 bp, Artificial Sequence
  Description of Artificial Sequence: Synthetic oligonucleotide
aactagaaatcttttgtccaaatcctccagctatccttaatgg

SEQ ID NO: 210361 - DNA, 42 bp, Artificial Sequence
  Description of Artificial Sequence: Synthetic oligonucleotide
actagaaatcttttgtccaaatcctccagctatccttaatgg

SEQ ID NO: 210362 - DNA, 41 bp, Artificial Sequence
  Description of Artificial Sequence: Synthetic oligonucleotide
ctagaaatcttttgtccaaatcctccagctatccttaatgg

SEQ ID NO: 210363 - DNA, 41 bp, Artificial Sequence
  Description of Artificial Sequence: Synthetic oligonucleotide
tagaaatcttttgtccaaatcctccagctatccttaatggg

SEQ ID NO: 210364 - DNA, 40 bp, Artificial Sequence
  Description of Artificial Sequence: Synthetic oligonucleotide
agaaatcttttgtccaaatcctccagctatccttaatggg

SEQ ID NO: 210365 - DNA, 39 bp, Artificial Sequence
  Description of Artificial Sequence: Synthetic oligonucleotide
gaaatcttttgtccaaatcctccagctatccttaatggg

SEQ ID NO: 210366 - DNA, 32 bp, Artificial Sequence
  Description of Artificial Sequence: Synthetic oligonucleotide
tatccttaatgggagacacacaggaactcccc

SEQ ID NO: 210367 - DNA, 31 bp, Artificial Sequence
  Description of Artificial Sequence: Synthetic oligonucleotide
atccttaatgggagacacacaggaactcccc

SEQ ID NO: 210368 - DNA, 30 bp, Artificial Sequence
  Description of Artificial Sequence: Synthetic oligonucleotide
tccttaatgggagacacacaggaactcccc

SEQ ID NO: 210369 - DNA, 29 bp, Artificial Sequence
  Description of Artificial Sequence: Synthetic oligonucleotide
ccttaatgggagacacacaggaactcccc

SEQ ID NO: 210370 - DNA, 31 bp, Artificial Sequence
  Description of Artificial Sequence: Synthetic oligonucleotide
cttaatgggagacacacaggaactccccttg

SEQ ID NO: 210371 - DNA, 31 bp, Artificial Sequence
  Description of Artificial Sequence: Synthetic oligonucleotide
ttaatgggagacacacaggaactccccttgg

SEQ ID NO: 210372 - DNA, 30 bp, Artificial Sequence
  Description of Artificial Sequence: Synthetic oligonucleotide
taatgggagacacacaggaactccccttgg

SEQ ID NO: 210373 - DNA, 29 bp, Artificial Sequence
  Description of Artificial Sequence: Synthetic oligonucleotide
aatgggagacacacaggaactccccttgg

SEQ ID NO: 210374 - DNA, 28 bp, Artificial Sequence
  Description of Artificial Sequence: Synthetic oligonucleotide
atgggagacacacaggaactccccttgg

SEQ ID NO: 210375 - DNA, 27 bp, Artificial Sequence
  Description of Artificial Sequence: Synthetic oligonucleotide
tgggagacacacaggaactccccttgg

SEQ ID NO: 210376 - DNA, 27 bp, Artificial Sequence
  Description of Artificial Sequence: Synthetic oligonucleotide
gggagacacacaggaactccccttgga

SEQ ID NO: 210377 - DNA, 27 bp, Artificial Sequence
  Description of Artificial Sequence: Synthetic oligonucleotide
ggagacacacaggaactccccttggag

SEQ ID NO: 210378 - DNA, 32 bp, Artificial Sequence
  Description of Artificial Sequence: Synthetic oligonucleotide
gagacacacaggaactccccttggagatattc

SEQ ID NO: 210379 - DNA, 32 bp, Artificial Sequence
  Description of Artificial Sequence: Synthetic oligonucleotide
agacacacaggaactccccttggagatattcc

SEQ ID NO: 210380 - DNA, 31 bp, Artificial Sequence
  Description of Artificial Sequence: Synthetic oligonucleotide
gacacacaggaactccccttggagatattcc

SEQ ID NO: 210381 - DNA, 31 bp, Artificial Sequence
  Description of Artificial Sequence: Synthetic oligonucleotide
acacacaggaactccccttggagatattccc

SEQ ID NO: 210382 - DNA, 30 bp, Artificial Sequence
  Description of Artificial Sequence: Synthetic oligonucleotide
cacacaggaactccccttggagatattccc

SEQ ID NO: 210383 - DNA, 33 bp, Artificial Sequence
  Description of Artificial Sequence: Synthetic oligonucleotide
acacaggaactccccttggagatattccctatg

SEQ ID NO: 210384 - DNA, 32 bp, Artificial Sequence
  Description of Artificial Sequence: Synthetic oligonucleotide
cacaggaactccccttggagatattccctatg

SEQ ID NO: 210385 - DNA, 32 bp, Artificial Sequence
  Description of Artificial Sequence: Synthetic oligonucleotide
acaggaactccccttggagatattccctatgg

SEQ ID NO: 210386 - DNA, 31 bp, Artificial Sequence
  Description of Artificial Sequence: Synthetic oligonucleotide
caggaactccccttggagatattccctatgg

SEQ ID NO: 210387 - DNA, 35 bp, Artificial Sequence
  Description of Artificial Sequence: Synthetic oligonucleotide
aggaactccccttggagatattccctatggaaaag

SEQ ID NO: 210388 - DNA, 34 bp, Artificial Sequence
  Description of Artificial Sequence: Synthetic oligonucleotide
ggaactccccttggagatattccctatggaaaag

SEQ ID NO: 210389 - DNA, 36 bp, Artificial Sequence
  Description of Artificial Sequence: Synthetic oligonucleotide
gaactccccttggagatattccctatggaaaagaag

SEQ ID NO: 210390 - DNA, 39 bp, Artificial Sequence
  Description of Artificial Sequence: Synthetic oligonucleotide
aactccccttggagatattccctatggaaaagaagtatc

SEQ ID NO: 210391 - DNA, 38 bp, Artificial Sequence
  Description of Artificial Sequence: Synthetic oligonucleotide
actccccttggagatattccctatggaaaagaagtatc

SEQ ID NO: 210392 - DNA, 37 bp, Artificial Sequence
  Description of Artificial Sequence: Synthetic oligonucleotide
ctccccttggagatattccctatggaaaagaagtatc

SEQ ID NO: 210393 - DNA, 40 bp, Artificial Sequence
  Description of Artificial Sequence: Synthetic oligonucleotide
tccccttggagatattccctatggaaaagaagtatcttac

SEQ ID NO: 210394 - DNA, 39 bp, Artificial Sequence
  Description of Artificial Sequence: Synthetic oligonucleotide
ccccttggagatattccctatggaaaagaagtatcttac

SEQ ID NO: 210395 - DNA, 40 bp, Artificial Sequence
  Description of Artificial Sequence: Synthetic oligonucleotide
cccttggagatattccctatggaaaagaagtatcttacac

SEQ ID NO: 210396 - DNA, 42 bp, Artificial Sequence
  Description of Artificial Sequence: Synthetic oligonucleotide
ccttggagatattccctatggaaaagaagtatcttacacatg

SEQ ID NO: 210397 - DNA, 43 bp, Artificial Sequence
  Description of Artificial Sequence: Synthetic oligonucleotide
cttggagatattccctatggaaaagaagtatcttacacatgtg

SEQ ID NO: 210398 - DNA, 44 bp, Artificial Sequence
  Description of Artificial Sequence: Synthetic oligonucleotide
ttggagatattccctatggaaaagaagtatcttacacatgtgac

SEQ ID NO: 210399 - DNA, 43 bp, Artificial Sequence
  Description of Artificial Sequence: Synthetic oligonucleotide
tggagatattccctatggaaaagaagtatcttacacatgtgac

SEQ ID NO: 210400 - DNA, 42 bp, Artificial Sequence
  Description of Artificial Sequence: Synthetic oligonucleotide
ggagatattccctatggaaaagaagtatcttacacatgtgac

SEQ ID NO: 210401 - DNA, 42 bp, Artificial Sequence
  Description of Artificial Sequence: Synthetic oligonucleotide
gagatattccctatggaaaagaagtatcttacacatgtgacc

SEQ ID NO: 210402 - DNA, 42 bp, Artificial Sequence
  Description of Artificial Sequence: Synthetic oligonucleotide
agatattccctatggaaaagaagtatcttacacatgtgaccc

SEQ ID NO: 210403 - DNA, 41 bp, Artificial Sequence
  Description of Artificial Sequence: Synthetic oligonucleotide
gatattccctatggaaaagaagtatcttacacatgtgaccc

SEQ ID NO: 210404 - DNA, 41 bp, Artificial Sequence
  Description of Artificial Sequence: Synthetic oligonucleotide
atattccctatggaaaagaagtatcttacacatgtgacccc

SEQ ID NO: 210405 - DNA, 40 bp, Artificial Sequence
  Description of Artificial Sequence: Synthetic oligonucleotide
tattccctatggaaaagaagtatcttacacatgtgacccc

SEQ ID NO: 210406 - DNA, 39 bp, Artificial Sequence
  Description of Artificial Sequence: Synthetic oligonucleotide
attccctatggaaaagaagtatcttacacatgtgacccc

SEQ ID NO: 210407 - DNA, 38 bp, Artificial Sequence
  Description of Artificial Sequence: Synthetic oligonucleotide
ttccctatggaaaagaagtatcttacacatgtgacccc

SEQ ID NO: 210408 - DNA, 37 bp, Artificial Sequence
  Description of Artificial Sequence: Synthetic oligonucleotide
tccctatggaaaagaagtatcttacacatgtgacccc

SEQ ID NO: 210409 - DNA, 36 bp, Artificial Sequence
  Description of Artificial Sequence: Synthetic oligonucleotide
ccctatggaaaagaagtatcttacacatgtgacccc

SEQ ID NO: 210410 - DNA, 36 bp, Artificial Sequence
  Description of Artificial Sequence: Synthetic oligonucleotide
cctatggaaaagaagtatcttacacatgtgaccccc

SEQ ID NO: 210411 - DNA, 37 bp, Artificial Sequence
  Description of Artificial Sequence: Synthetic oligonucleotide
ctatggaaaagaagtatcttacacatgtgacccccac

SEQ ID NO: 210412 - DNA, 37 bp, Artificial Sequence
  Description of Artificial Sequence: Synthetic oligonucleotide
tatggaaaagaagtatcttacacatgtgacccccacc

SEQ ID NO: 210413 - DNA, 36 bp, Artificial Sequence
  Description of Artificial Sequence: Synthetic oligonucleotide
atggaaaagaagtatcttacacatgtgacccccacc

SEQ ID NO: 210414 - DNA, 35 bp, Artificial Sequence
  Description of Artificial Sequence: Synthetic oligonucleotide
tggaaaagaagtatcttacacatgtgacccccacc

SEQ ID NO: 210415 - DNA, 34 bp, Artificial Sequence
  Description of Artificial Sequence: Synthetic oligonucleotide
ggaaaagaagtatcttacacatgtgacccccacc

SEQ ID NO: 210416 - DNA, 34 bp, Artificial Sequence
  Description of Artificial Sequence: Synthetic oligonucleotide
gaaaagaagtatcttacacatgtgacccccaccc

SEQ ID NO: 210417 - DNA, 35 bp, Artificial Sequence
  Description of Artificial Sequence: Synthetic oligonucleotide
aaaagaagtatcttacacatgtgacccccacccag

SEQ ID NO: 210418 - DNA, 34 bp, Artificial Sequence
  Description of Artificial Sequence: Synthetic oligonucleotide
aaagaagtatcttacacatgtgacccccacccag

SEQ ID NO: 210419 - DNA, 33 bp, Artificial Sequence
  Description of Artificial Sequence: Synthetic oligonucleotide
aagaagtatcttacacatgtgacccccacccag

SEQ ID NO: 210420 - DNA, 32 bp, Artificial Sequence
  Description of Artificial Sequence: Synthetic oligonucleotide
agaagtatcttacacatgtgacccccacccag

SEQ ID NO: 210421 - DNA, 31 bp, Artificial Sequence
  Description of Artificial Sequence: Synthetic oligonucleotide
gaagtatcttacacatgtgacccccacccag

SEQ ID NO: 210422 - DNA, 32 bp, Artificial Sequence
  Description of Artificial Sequence: Synthetic oligonucleotide
aagtatcttacacatgtgacccccacccagac

SEQ ID NO: 210423 - DNA, 31 bp, Artificial Sequence
  Description of Artificial Sequence: Synthetic oligonucleotide
agtatcttacacatgtgacccccacccagac

SEQ ID NO: 210424 - DNA, 30 bp, Artificial Sequence
  Description of Artificial Sequence: Synthetic oligonucleotide
gtatcttacacatgtgacccccacccagac

SEQ ID NO: 210425 - DNA, 26 bp, Artificial Sequence
  Description of Artificial Sequence: Synthetic oligonucleotide
acctcattggggagagcaccatccgc

SEQ ID NO: 210426 - DNA, 25 bp, Artificial Sequence
  Description of Artificial Sequence: Synthetic oligonucleotide
cctcattggggagagcaccatccgc

SEQ ID NO: 210427 - DNA, 25 bp, Artificial Sequence
  Description of Artificial Sequence: Synthetic oligonucleotide
ctcattggggagagcaccatccgcc

SEQ ID NO: 210428 - DNA, 25 bp, Artificial Sequence
  Description of Artificial Sequence: Synthetic oligonucleotide
tcattggggagagcaccatccgccg

SEQ ID NO: 210429 - DNA, 24 bp, Artificial Sequence
  Description of Artificial Sequence: Synthetic oligonucleotide
cattggggagagcaccatccgccg

SEQ ID NO: 210430 - DNA, 25 bp, Artificial Sequence
  Description of Artificial Sequence: Synthetic oligonucleotide
attggggagagcaccatccgccgca

SEQ ID NO: 210431 - DNA, 24 bp, Artificial Sequence
  Description of Artificial Sequence: Synthetic oligonucleotide
ttggggagagcaccatccgccgca

SEQ ID NO: 210432 - DNA, 23 bp, Artificial Sequence
  Description of Artificial Sequence: Synthetic oligonucleotide
tggggagagcaccatccgccgca

SEQ ID NO: 210433 - DNA, 22 bp, Artificial Sequence
  Description of Artificial Sequence: Synthetic oligonucleotide
ggggagagcaccatccgccgca

SEQ ID NO: 210434 - DNA, 24 bp, Artificial Sequence
  Description of Artificial Sequence: Synthetic oligonucleotide
gggagagcaccatccgccgcacaa

SEQ ID NO: 210435 - DNA, 25 bp, Artificial Sequence
  Description of Artificial Sequence: Synthetic oligonucleotide
ggagagcaccatccgccgcacaagt

SEQ ID NO: 210436 - DNA, 27 bp, Artificial Sequence
  Description of Artificial Sequence: Synthetic oligonucleotide
gagagcaccatccgccgcacaagtgaa

SEQ ID NO: 210437 - DNA, 27 bp, Artificial Sequence
  Description of Artificial Sequence: Synthetic oligonucleotide
agagcaccatccgccgcacaagtgaac

SEQ ID NO: 210438 - DNA, 26 bp, Artificial Sequence
  Description of Artificial Sequence: Synthetic oligonucleotide
gagcaccatccgccgcacaagtgaac

SEQ ID NO: 210439 - DNA, 27 bp, Artificial Sequence
  Description of Artificial Sequence: Synthetic oligonucleotide
agcaccatccgccgcacaagtgaacct

SEQ ID NO: 210440 - DNA, 26 bp, Artificial Sequence
  Description of Artificial Sequence: Synthetic oligonucleotide
gcaccatccgccgcacaagtgaacct

SEQ ID NO: 210441 - DNA, 27 bp, Artificial Sequence
  Description of Artificial Sequence: Synthetic oligonucleotide
caccatccgccgcacaagtgaacctca

SEQ ID NO: 210442 - DNA, 28 bp, Artificial Sequence
  Description of Artificial Sequence: Synthetic oligonucleotide
accatccgccgcacaagtgaacctcatg

SEQ ID NO: 210443 - DNA, 27 bp, Artificial Sequence
  Description of Artificial Sequence: Synthetic oligonucleotide
ccatccgccgcacaagtgaacctcatg

SEQ ID NO: 210444 - DNA, 27 bp, Artificial Sequence
  Description of Artificial Sequence: Synthetic oligonucleotide
catccgccgcacaagtgaacctcatgg

SEQ ID NO: 210445 - DNA, 27 bp, Artificial Sequence
  Description of Artificial Sequence: Synthetic oligonucleotide
atccgccgcacaagtgaacctcatggg

SEQ ID NO: 210446 - DNA, 27 bp, Artificial Sequence
  Description of Artificial Sequence: Synthetic oligonucleotide
tccgccgcacaagtgaacctcatggga

SEQ ID NO: 210447 - DNA, 27 bp, Artificial Sequence
  Description of Artificial Sequence: Synthetic oligonucleotide
ccgccgcacaagtgaacctcatgggaa

SEQ ID NO: 210448 - DNA, 28 bp, Artificial Sequence
  Description of Artificial Sequence: Synthetic oligonucleotide
cgccgcacaagtgaacctcatgggaatg

SEQ ID NO: 210449 - DNA, 28 bp, Artificial Sequence
  Description of Artificial Sequence: Synthetic oligonucleotide
gccgcacaagtgaacctcatgggaatgg

SEQ ID NO: 210450 - DNA, 28 bp, Artificial Sequence
  Description of Artificial Sequence: Synthetic oligonucleotide
ccgcacaagtgaacctcatgggaatggg

SEQ ID NO: 210451 - DNA, 28 bp, Artificial Sequence
  Description of Artificial Sequence: Synthetic oligonucleotide
cgcacaagtgaacctcatgggaatgggg

SEQ ID NO: 210452 - DNA, 31 bp, Artificial Sequence
  Description of Artificial Sequence: Synthetic oligonucleotide
gcacaagtgaacctcatgggaatggggtttg

SEQ ID NO: 210453 - DNA, 31 bp, Artificial Sequence
  Description of Artificial Sequence: Synthetic oligonucleotide
cacaagtgaacctcatgggaatggggtttgg

SEQ ID NO: 210454 - DNA, 32 bp, Artificial Sequence
  Description of Artificial Sequence: Synthetic oligonucleotide
acaagtgaacctcatgggaatggggtttggag

SEQ ID NO: 210455 - DNA, 31 bp, Artificial Sequence
  Description of Artificial Sequence: Synthetic oligonucleotide
caagtgaacctcatgggaatggggtttggag

SEQ ID NO: 210456 - DNA, 31 bp, Artificial Sequence
  Description of Artificial Sequence: Synthetic oligonucleotide
aagtgaacctcatgggaatggggtttggagc

SEQ ID NO: 210457 - DNA, 30 bp, Artificial Sequence
  Description of Artificial Sequence: Synthetic oligonucleotide
agtgaacctcatgggaatggggtttggagc

SEQ ID NO: 210458 - DNA, 29 bp, Artificial Sequence
  Description of Artificial Sequence: Synthetic oligonucleotide
gtgaacctcatgggaatggggtttggagc

SEQ ID NO: 210459 - DNA, 30 bp, Artificial Sequence
  Description of Artificial Sequence: Synthetic oligonucleotide
tgaacctcatgggaatggggtttggagcag

SEQ ID NO: 210460 - DNA, 29 bp, Artificial Sequence
  Description of Artificial Sequence: Synthetic oligonucleotide
gaacctcatgggaatggggtttggagcag

SEQ ID NO: 210461 - DNA, 29 bp, Artificial Sequence
  Description of Artificial Sequence: Synthetic oligonucleotide
aacctcatgggaatggggtttggagcagc

SEQ ID NO: 210462 - DNA, 28 bp, Artificial Sequence
  Description of Artificial Sequence: Synthetic oligonucleotide
acctcatgggaatggggtttggagcagc

SEQ ID NO: 210463 - DNA, 25 bp, Artificial Sequence
  Description of Artificial Sequence: Synthetic oligonucleotide
cagccctgcccctcgctgtgaactt

SEQ ID NO: 210464 - DNA, 25 bp, Artificial Sequence
  Description of Artificial Sequence: Synthetic oligonucleotide
agccctgcccctcgctgtgaacttc

SEQ ID NO: 210465 - DNA, 24 bp, Artificial Sequence
  Description of Artificial Sequence: Synthetic oligonucleotide
gccctgcccctcgctgtgaacttc

SEQ ID NO: 210466 - DNA, 25 bp, Artificial Sequence
  Description of Artificial Sequence: Synthetic oligonucleotide
ccctgcccctcgctgtgaacttcct

SEQ ID NO: 210467 - DNA, 27 bp, Artificial Sequence
  Description of Artificial Sequence: Synthetic oligonucleotide
cctgcccctcgctgtgaacttcctgtt

SEQ ID NO: 210468 - DNA, 27 bp, Artificial Sequence
  Description of Artificial Sequence: Synthetic oligonucleotide
ctgcccctcgctgtgaacttcctgttg

SEQ ID NO: 210469 - DNA, 27 bp, Artificial Sequence
  Description of Artificial Sequence: Synthetic oligonucleotide
tgcccctcgctgtgaacttcctgttgg

SEQ ID NO: 210470 - DNA, 27 bp, Artificial Sequence
  Description of Artificial Sequence: Synthetic oligonucleotide
gcccctcgctgtgaacttcctgttggt

SEQ ID NO: 210471 - DNA, 27 bp, Artificial Sequence
  Description of Artificial Sequence: Synthetic oligonucleotide
cccctcgctgtgaacttcctgttggtg

SEQ ID NO: 210472 - DNA, 27 bp, Artificial Sequence
  Description of Artificial Sequence: Synthetic oligonucleotide
ccctcgctgtgaacttcctgttggtgc

SEQ ID NO: 210473 - DNA, 28 bp, Artificial Sequence
  Description of Artificial Sequence: Synthetic oligonucleotide
cctcgctgtgaacttcctgttggtgctg

SEQ ID NO: 210474 - DNA, 28 bp, Artificial Sequence
  Description of Artificial Sequence: Synthetic oligonucleotide
ctcgctgtgaacttcctgttggtgctgg

SEQ ID NO: 210475 - DNA, 28 bp, Artificial Sequence
  Description of Artificial Sequence: Synthetic oligonucleotide
tcgctgtgaacttcctgttggtgctggc

SEQ ID NO: 210476 - DNA, 27 bp, Artificial Sequence
  Description of Artificial Sequence: Synthetic oligonucleotide
cgctgtgaacttcctgttggtgctggc

SEQ ID NO: 210477 - DNA, 28 bp, Artificial Sequence
  Description of Artificial Sequence: Synthetic oligonucleotide
gctgtgaacttcctgttggtgctggcac

SEQ ID NO: 210478 - DNA, 28 bp, Artificial Sequence
  Description of Artificial Sequence: Synthetic oligonucleotide
ctgtgaacttcctgttggtgctggcacg

SEQ ID NO: 210479 - DNA, 29 bp, Artificial Sequence
  Description of Artificial Sequence: Synthetic oligonucleotide
tgtgaacttcctgttggtgctggcacgag

SEQ ID NO: 210480 - DNA, 28 bp, Artificial Sequence
  Description of Artificial Sequence: Synthetic oligonucleotide
gtgaacttcctgttggtgctggcacgag

SEQ ID NO: 210481 - DNA, 31 bp, Artificial Sequence
  Description of Artificial Sequence: Synthetic oligonucleotide
tgaacttcctgttggtgctggcacgagaatc

SEQ ID NO: 210482 - DNA, 30 bp, Artificial Sequence
  Description of Artificial Sequence: Synthetic oligonucleotide
gaacttcctgttggtgctggcacgagaatc

SEQ ID NO: 210483 - DNA, 30 bp, Artificial Sequence
  Description of Artificial Sequence: Synthetic oligonucleotide
aacttcctgttggtgctggcacgagaatcc

SEQ ID NO: 210484 - DNA, 29 bp, Artificial Sequence
  Description of Artificial Sequence: Synthetic oligonucleotide
acttcctgttggtgctggcacgagaatcc

SEQ ID NO: 210485 - DNA, 28 bp, Artificial Sequence
  Description of Artificial Sequence: Synthetic oligonucleotide
cttcctgttggtgctggcacgagaatcc

SEQ ID NO: 210486 - DNA, 28 bp, Artificial Sequence
  Description of Artificial Sequence: Synthetic oligonucleotide
ttcctgttggtgctggcacgagaatccc

SEQ ID NO: 210487 - DNA, 27 bp, Artificial Sequence
  Description of Artificial Sequence: Synthetic oligonucleotide
tcctgttggtgctggcacgagaatccc

SEQ ID NO: 210488 - DNA, 27 bp, Artificial Sequence
  Description of Artificial Sequence: Synthetic oligonucleotide
cctgttggtgctggcacgagaatccct

SEQ ID NO: 210489 - DNA, 28 bp, Artificial Sequence
  Description of Artificial Sequence: Synthetic oligonucleotide
ctgttggtgctggcacgagaatcccttg

SEQ ID NO: 210490 - DNA, 30 bp, Artificial Sequence
  Description of Artificial Sequence: Synthetic oligonucleotide
tgttggtgctggcacgagaatcccttgaac

SEQ ID NO: 210491 - DNA, 29 bp, Artificial Sequence
  Description of Artificial Sequence: Synthetic oligonucleotide
gttggtgctggcacgagaatcccttgaac

SEQ ID NO: 210492 - DNA, 29 bp, Artificial Sequence
  Description of Artificial Sequence: Synthetic oligonucleotide
ttggtgctggcacgagaatcccttgaacc

SEQ ID NO: 210493 - DNA, 28 bp, Artificial Sequence
  Description of Artificial Sequence: Synthetic oligonucleotide
tggtgctggcacgagaatcccttgaacc

SEQ ID NO: 210494 - DNA, 27 bp, Artificial Sequence
  Description of Artificial Sequence: Synthetic oligonucleotide
ggtgctggcacgagaatcccttgaacc

SEQ ID NO: 210495 - DNA, 27 bp, Artificial Sequence
  Description of Artificial Sequence: Synthetic oligonucleotide
gtgctggcacgagaatcccttgaaccc

SEQ ID NO: 210496 - DNA, 28 bp, Artificial Sequence
  Description of Artificial Sequence: Synthetic oligonucleotide
tgctggcacgagaatcccttgaacccag

SEQ ID NO: 210497 - DNA, 27 bp, Artificial Sequence
  Description of Artificial Sequence: Synthetic oligonucleotide
gctggcacgagaatcccttgaacccag

SEQ ID NO: 210498 - DNA, 27 bp, Artificial Sequence
  Description of Artificial Sequence: Synthetic oligonucleotide
ctggcacgagaatcccttgaacccagg

SEQ ID NO: 210499 - DNA, 28 bp, Artificial Sequence
  Description of Artificial Sequence: Synthetic oligonucleotide
tggcacgagaatcccttgaacccaggag

SEQ ID NO: 210500 - DNA, 27 bp, Artificial Sequence
  Description of Artificial Sequence: Synthetic oligonucleotide
ggcacgagaatcccttgaacccaggag

SEQ ID NO: 210501 - DNA, 27 bp, Artificial Sequence
  Description of Artificial Sequence: Synthetic oligonucleotide
gcacgagaatcccttgaacccaggagg

SEQ ID NO: 210502 - DNA, 27 bp, Artificial Sequence
  Description of Artificial Sequence: Synthetic oligonucleotide
cacgagaatcccttgaacccaggaggc

SEQ ID NO: 210503 - DNA, 28 bp, Artificial Sequence
  Description of Artificial Sequence: Synthetic oligonucleotide
acgagaatcccttgaacccaggaggcag

SEQ ID NO: 210504 - DNA, 27 bp, Artificial Sequence
  Description of Artificial Sequence: Synthetic oligonucleotide
cgagaatcccttgaacccaggaggcag

SEQ ID NO: 210505 - DNA, 28 bp, Artificial Sequence
  Description of Artificial Sequence: Synthetic oligonucleotide
gagaatcccttgaacccaggaggcagag

SEQ ID NO: 210506 - DNA, 28 bp, Artificial Sequence
  Description of Artificial Sequence: Synthetic oligonucleotide
agaatcccttgaacccaggaggcagagg

SEQ ID NO: 210507 - DNA, 27 bp, Artificial Sequence
  Description of Artificial Sequence: Synthetic oligonucleotide
gaatcccttgaacccaggaggcagagg

SEQ ID NO: 210508 - DNA, 28 bp, Artificial Sequence
  Description of Artificial Sequence: Synthetic oligonucleotide
aatcccttgaacccaggaggcagaggtc

SEQ ID NO: 210509 - DNA, 27 bp, Artificial Sequence
  Description of Artificial Sequence: Synthetic oligonucleotide
atcccttgaacccaggaggcagaggtc

SEQ ID NO: 210510 - DNA, 26 bp, Artificial Sequence
  Description of Artificial Sequence: Synthetic oligonucleotide
tcccttgaacccaggaggcagaggtc

SEQ ID NO: 210511 - DNA, 25 bp, Artificial Sequence
  Description of Artificial Sequence: Synthetic oligonucleotide
cccttgaacccaggaggcagaggtc

SEQ ID NO: 210512 - DNA, 25 bp, Artificial Sequence
  Description of Artificial Sequence: Synthetic oligonucleotide
ccttgaacccaggaggcagaggtcg

SEQ ID NO: 210513 - DNA, 26 bp, Artificial Sequence
  Description of Artificial Sequence: Synthetic oligonucleotide
cttgaacccaggaggcagaggtcgca

SEQ ID NO: 210514 - DNA, 27 bp, Artificial Sequence
  Description of Artificial Sequence: Synthetic oligonucleotide
ttgaacccaggaggcagaggtcgcagt

SEQ ID NO: 210515 - DNA, 26 bp, Artificial Sequence
  Description of Artificial Sequence: Synthetic oligonucleotide
tgaacccaggaggcagaggtcgcagt

SEQ ID NO: 210516 - DNA, 25 bp, Artificial Sequence
  Description of Artificial Sequence: Synthetic oligonucleotide
gaacccaggaggcagaggtcgcagt

SEQ ID NO: 210517 - DNA, 26 bp, Artificial Sequence
  Description of Artificial Sequence: Synthetic oligonucleotide
aacccaggaggcagaggtcgcagtga

SEQ ID NO: 210518 - DNA, 25 bp, Artificial Sequence
  Description of Artificial Sequence: Synthetic oligonucleotide
acccaggaggcagaggtcgcagtga

SEQ ID NO: 210519 - DNA, 24 bp, Artificial Sequence
  Description of Artificial Sequence: Synthetic oligonucleotide
cccaggaggcagaggtcgcagtga

SEQ ID NO: 210520 - DNA, 24 bp, Artificial Sequence
  Description of Artificial Sequence: Synthetic oligonucleotide
ccaggaggcagaggtcgcagtgag

SEQ ID NO: 210521 - DNA, 26 bp, Artificial Sequence
  Description of Artificial Sequence: Synthetic oligonucleotide
caggaggcagaggtcgcagtgaggtt

SEQ ID NO: 210522 - DNA, 26 bp, Artificial Sequence
  Description of Artificial Sequence: Synthetic oligonucleotide
aggaggcagaggtcgcagtgaggttg

SEQ ID NO: 210523 - DNA, 25 bp, Artificial Sequence
  Description of Artificial Sequence: Synthetic oligonucleotide
ggaggcagaggtcgcagtgaggttg

SEQ ID NO: 210524 - DNA, 26 bp, Artificial Sequence
  Description of Artificial Sequence: Synthetic oligonucleotide
gaggcagaggtcgcagtgaggttgca

SEQ ID NO: 210525 - DNA, 26 bp, Artificial Sequence
  Description of Artificial Sequence: Synthetic oligonucleotide
aggcagaggtcgcagtgaggttgcac

SEQ ID NO: 210526 - DNA, 25 bp, Artificial Sequence
  Description of Artificial Sequence: Synthetic oligonucleotide
ggcagaggtcgcagtgaggttgcac

SEQ ID NO: 210527 - DNA, 26 bp, Artificial Sequence
  Description of Artificial Sequence: Synthetic oligonucleotide
gcagaggtcgcagtgaggttgcacca

SEQ ID NO: 210528 - DNA, 27 bp, Artificial Sequence
  Description of Artificial Sequence: Synthetic oligonucleotide
cagaggtcgcagtgaggttgcaccact

SEQ ID NO: 210529 - DNA, 27 bp, Artificial Sequence
  Description of Artificial Sequence: Synthetic oligonucleotide
agaggtcgcagtgaggttgcaccactg

SEQ ID NO: 210530 - DNA, 26 bp, Artificial Sequence
  Description of Artificial Sequence: Synthetic oligonucleotide
gaggtcgcagtgaggttgcaccactg

SEQ ID NO: 210531 - DNA, 27 bp, Artificial Sequence
  Description of Artificial Sequence: Synthetic oligonucleotide
aggtcgcagtgaggttgcaccactgca

SEQ ID NO: 210532 - DNA, 26 bp, Artificial Sequence
  Description of Artificial Sequence: Synthetic oligonucleotide
ggtcgcagtgaggttgcaccactgca

SEQ ID NO: 210533 - DNA, 27 bp, Artificial Sequence
  Description of Artificial Sequence: Synthetic oligonucleotide
gtcgcagtgaggttgcaccactgcact

SEQ ID NO: 210534 - DNA, 27 bp, Artificial Sequence
  Description of Artificial Sequence: Synthetic oligonucleotide
tcgcagtgaggttgcaccactgcactc

SEQ ID NO: 210535 - DNA, 26 bp, Artificial Sequence
  Description of Artificial Sequence: Synthetic oligonucleotide
cgcagtgaggttgcaccactgcactc

SEQ ID NO: 210536 - DNA, 27 bp, Artificial Sequence
  Description of Artificial Sequence: Synthetic oligonucleotide
gcagtgaggttgcaccactgcactcca

SEQ ID NO: 210537 - DNA, 27 bp, Artificial Sequence
  Description of Artificial Sequence: Synthetic oligonucleotide
cagtgaggttgcaccactgcactccag

SEQ ID NO: 210538 - DNA, 27 bp, Artificial Sequence
  Description of Artificial Sequence: Synthetic oligonucleotide
agtgaggttgcaccactgcactccagc

SEQ ID NO: 210539 - DNA, 26 bp, Artificial Sequence
  Description of Artificial Sequence: Synthetic oligonucleotide
gtgaggttgcaccactgcactccagc

SEQ ID NO: 210540 - DNA, 27 bp, Artificial Sequence
  Description of Artificial Sequence: Synthetic oligonucleotide
tgaggttgcaccactgcactccagcct

SEQ ID NO: 210541 - DNA, 26 bp, Artificial Sequence
  Description of Artificial Sequence: Synthetic oligonucleotide
gaggttgcaccactgcactccagcct

SEQ ID NO: 210542 - DNA, 26 bp, Artificial Sequence
  Description of Artificial Sequence: Synthetic oligonucleotide
aggttgcaccactgcactccagcctg

SEQ ID NO: 210543 - DNA, 25 bp, Artificial Sequence
  Description of Artificial Sequence: Synthetic oligonucleotide
ggttgcaccactgcactccagcctg

SEQ ID NO: 210544 - DNA, 25 bp, Artificial Sequence
  Description of Artificial Sequence: Synthetic oligonucleotide
gttgcaccactgcactccagcctgg

SEQ ID NO: 210545 - DNA, 25 bp, Artificial Sequence
  Description of Artificial Sequence: Synthetic oligonucleotide
ttgcaccactgcactccagcctggc

SEQ ID NO: 210546 - DNA, 24 bp, Artificial Sequence
  Description of Artificial Sequence: Synthetic oligonucleotide
tgcaccactgcactccagcctggc

SEQ ID NO: 210547 - DNA, 23 bp, Artificial Sequence
  Description of Artificial Sequence: Synthetic oligonucleotide
gcaccactgcactccagcctggc

SEQ ID NO: 210548 - DNA, 24 bp, Artificial Sequence
  Description of Artificial Sequence: Synthetic oligonucleotide
caccactgcactccagcctggcga

SEQ ID NO: 210549 - DNA, 25 bp, Artificial Sequence
  Description of Artificial Sequence: Synthetic oligonucleotide
accactgcactccagcctggcgaca

SEQ ID NO: 210550 - DNA, 24 bp, Artificial Sequence
  Description of Artificial Sequence: Synthetic oligonucleotide
ccactgcactccagcctggcgaca

SEQ ID NO: 210551 - DNA, 25 bp, Artificial Sequence
  Description of Artificial Sequence: Synthetic oligonucleotide
cactgcactccagcctggcgacaga

SEQ ID NO: 210552 - DNA, 26 bp, Artificial Sequence
  Description of Artificial Sequence: Synthetic oligonucleotide
actgcactccagcctggcgacagagt

SEQ ID NO: 210553 - DNA, 25 bp, Artificial Sequence
  Description of Artificial Sequence: Synthetic oligonucleotide
ctgcactccagcctggcgacagagt

SEQ ID NO: 210554 - DNA, 26 bp, Artificial Sequence
  Description of Artificial Sequence: Synthetic oligonucleotide
tgcactccagcctggcgacagagtga

SEQ ID NO: 210555 - DNA, 25 bp, Artificial Sequence
  Description of Artificial Sequence: Synthetic oligonucleotide
gcactccagcctggcgacagagtga

SEQ ID NO: 210556 - DNA, 26 bp, Artificial Sequence
  Description of Artificial Sequence: Synthetic oligonucleotide
cactccagcctggcgacagagtgaga

SEQ ID NO: 210557 - DNA, 27 bp, Artificial Sequence
  Description of Artificial Sequence: Synthetic oligonucleotide
actccagcctggcgacagagtgagact

SEQ ID NO: 210558 - DNA, 27 bp, Artificial Sequence
  Description of Artificial Sequence: Synthetic oligonucleotide
ctccagcctggcgacagagtgagactt

SEQ ID NO: 210559 - DNA, 28 bp, Artificial Sequence
  Description of Artificial Sequence: Synthetic oligonucleotide
tccagcctggcgacagagtgagactttg

SEQ ID NO: 210560 - DNA, 27 bp, Artificial Sequence
  Description of Artificial Sequence: Synthetic oligonucleotide
ccagcctggcgacagagtgagactttg

SEQ ID NO: 210561 - DNA, 28 bp, Artificial Sequence
  Description of Artificial Sequence: Synthetic oligonucleotide
cagcctggcgacagagtgagactttgtc

SEQ ID NO: 210562 - DNA, 47 bp, Artificial Sequence
  Description of Artificial Sequence: Synthetic oligonucleotide
agcctggcgacagagtgagactttgtcaaaaaaaaaaaaaaaaaatc

SEQ ID NO: 210563 - DNA, 46 bp, Artificial Sequence
  Description of Artificial Sequence: Synthetic oligonucleotide
gcctggcgacagagtgagactttgtcaaaaaaaaaaaaaaaaaatc

SEQ ID NO: 210564 - DNA, 48 bp, Artificial Sequence
  Description of Artificial Sequence: Synthetic oligonucleotide
cctggcgacagagtgagactttgtcaaaaaaaaaaaaaaaaaatcttc

SEQ ID NO: 210565 - DNA, 49 bp, Artificial Sequence
  Description of Artificial Sequence: Synthetic oligonucleotide
ctggcgacagagtgagactttgtcaaaaaaaaaaaaaaaaaatcttctc

SEQ ID NO: 210566 - DNA, 50 bp, Artificial Sequence
  Description of Artificial Sequence: Synthetic oligonucleotide
tggcgacagagtgagactttgtcaaaaaaaaaaaaaaaaaatcttctctg

SEQ ID NO: 210567 - DNA, 49 bp, Artificial Sequence
  Description of Artificial Sequence: Synthetic oligonucleotide
ggcgacagagtgagactttgtcaaaaaaaaaaaaaaaaaatcttctctg

SEQ ID NO: 210568 - DNA, 50 bp, Artificial Sequence
  Description of Artificial Sequence: Synthetic oligonucleotide
gcgacagagtgagactttgtcaaaaaaaaaaaaaaaaaatcttctctgag

SEQ ID NO: 210569 - DNA, 51 bp, Artificial Sequence
  Description of Artificial Sequence: Synthetic oligonucleotide
cgacagagtgagactttgtcaaaaaaaaaaaaaaaaaatcttctctgagtg

SEQ ID NO: 210570 - DNA, 51 bp, Artificial Sequence
  Description of Artificial Sequence: Synthetic oligonucleotide
gacagagtgagactttgtcaaaaaaaaaaaaaaaaaatcttctctgagtgc

SEQ ID NO: 210571 - DNA, 52 bp, Artificial Sequence
  Description of Artificial Sequence: Synthetic oligonucleotide
acagagtgagactttgtcaaaaaaaaaaaaaaaaaatcttctctgagtgcag

SEQ ID NO: 210572 - DNA, 51 bp, Artificial Sequence
  Description of Artificial Sequence: Synthetic oligonucleotide
cagagtgagactttgtcaaaaaaaaaaaaaaaaaatcttctctgagtgcag

SEQ ID NO: 210573 - DNA, 53 bp, Artificial Sequence
  Description of Artificial Sequence: Synthetic oligonucleotide
agagtgagactttgtcaaaaaaaaaaaaaaaaaatcttctctgagtgcagaag

SEQ ID NO: 210574 - DNA, 52 bp, Artificial Sequence
  Description of Artificial Sequence: Synthetic oligonucleotide
gagtgagactttgtcaaaaaaaaaaaaaaaaaatcttctctgagtgcagaag

SEQ ID NO: 210575 - DNA, 52 bp, Artificial Sequence
  Description of Artificial Sequence: Synthetic oligonucleotide
agtgagactttgtcaaaaaaaaaaaaaaaaaatcttctctgagtgcagaagg

SEQ ID NO: 210576 - DNA, 51 bp, Artificial Sequence
  Description of Artificial Sequence: Synthetic oligonucleotide
gtgagactttgtcaaaaaaaaaaaaaaaaaatcttctctgagtgcagaagg

SEQ ID NO: 210577 - DNA, 57 bp, Artificial Sequence
  Description of Artificial Sequence: Synthetic oligonucleotide
tgagactttgtcaaaaaaaaaaaaaaaaaatcttctctgagtgcagaaggtaaaatg

SEQ ID NO: 210578 - DNA, 56 bp, Artificial Sequence
  Description of Artificial Sequence: Synthetic oligonucleotide
gagactttgtcaaaaaaaaaaaaaaaaaatcttctctgagtgcagaaggtaaaatg

SEQ ID NO: 210579 - DNA, 57 bp, Artificial Sequence
  Description of Artificial Sequence: Synthetic oligonucleotide
agactttgtcaaaaaaaaaaaaaaaaaatcttctctgagtgcagaaggtaaaatgag

SEQ ID NO: 210580 - DNA, 56 bp, Artificial Sequence
  Description of Artificial Sequence: Synthetic oligonucleotide
gactttgtcaaaaaaaaaaaaaaaaaatcttctctgagtgcagaaggtaaaatgag

SEQ ID NO: 210581 - DNA, 57 bp, Artificial Sequence
  Description of Artificial Sequence: Synthetic oligonucleotide
actttgtcaaaaaaaaaaaaaaaaaatcttctctgagtgcagaaggtaaaatgagag

SEQ ID NO: 210582 - DNA, 56 bp, Artificial Sequence
  Description of Artificial Sequence: Synthetic oligonucleotide
ctttgtcaaaaaaaaaaaaaaaaaatcttctctgagtgcagaaggtaaaatgagag

SEQ ID NO: 210583 - DNA, 60 bp, Artificial Sequence
  Description of Artificial Sequence: Synthetic oligonucleotide
tttgtcaaaaaaaaaaaaaaaaaatcttctctgagtgcagaaggtaaaatgagagtatat

SEQ ID NO: 210584 - DNA, 60 bp, Artificial Sequence
  Description of Artificial Sequence: Synthetic oligonucleotide
ttgtcaaaaaaaaaaaaaaaaaatcttctctgagtgcagaaggtaaaatgagagtatatg

SEQ ID NO: 210585 - DNA, 59 bp, Artificial Sequence
  Description of Artificial Sequence: Synthetic oligonucleotide
tgtcaaaaaaaaaaaaaaaaaatcttctctgagtgcagaaggtaaaatgagagtatatg

SEQ ID NO: 210586 - DNA, 58 bp, Artificial Sequence
  Description of Artificial Sequence: Synthetic oligonucleotide
gtcaaaaaaaaaaaaaaaaaatcttctctgagtgcagaaggtaaaatgagagtatatg

SEQ ID NO: 210587 - DNA, 59 bp, Artificial Sequence
  Description of Artificial Sequence: Synthetic oligonucleotide
tcaaaaaaaaaaaaaaaaaatcttctctgagtgcagaaggtaaaatgagagtatatgag

SEQ ID NO: 210588 - DNA, 58 bp, Artificial Sequence
  Description of Artificial Sequence: Synthetic oligonucleotide
caaaaaaaaaaaaaaaaaatcttctctgagtgcagaaggtaaaatgagagtatatgag

SEQ ID NO: 210589 - DNA, 59 bp, Artificial Sequence
  Description of Artificial Sequence: Synthetic oligonucleotide
aaaaaaaaaaaaaaaaaatcttctctgagtgcagaaggtaaaatgagagtatatgagtg

SEQ ID NO: 210590 - DNA, 58 bp, Artificial Sequence
  Description of Artificial Sequence: Synthetic oligonucleotide
aaaaaaaaaaaaaaaaatcttctctgagtgcagaaggtaaaatgagagtatatgagtg

SEQ ID NO: 210591 - DNA, 57 bp, Artificial Sequence
  Description of Artificial Sequence: Synthetic oligonucleotide
aaaaaaaaaaaaaaaatcttctctgagtgcagaaggtaaaatgagagtatatgagtg

SEQ ID NO: 210592 - DNA, 56 bp, Artificial Sequence
  Description of Artificial Sequence: Synthetic oligonucleotide
aaaaaaaaaaaaaaatcttctctgagtgcagaaggtaaaatgagagtatatgagtg

SEQ ID NO: 210593 - DNA, 55 bp, Artificial Sequence
  Description of Artificial Sequence: Synthetic oligonucleotide
aaaaaaaaaaaaaatcttctctgagtgcagaaggtaaaatgagagtatatgagtg

SEQ ID NO: 210594 - DNA, 54 bp, Artificial Sequence
  Description of Artificial Sequence: Synthetic oligonucleotide
aaaaaaaaaaaaatcttctctgagtgcagaaggtaaaatgagagtatatgagtg

SEQ ID NO: 210595 - DNA, 53 bp, Artificial Sequence
  Description of Artificial Sequence: Synthetic oligonucleotide
aaaaaaaaaaaatcttctctgagtgcagaaggtaaaatgagagtatatgagtg

SEQ ID NO: 210596 - DNA, 52 bp, Artificial Sequence
  Description of Artificial Sequence: Synthetic oligonucleotide
aaaaaaaaaaatcttctctgagtgcagaaggtaaaatgagagtatatgagtg

SEQ ID NO: 210597 - DNA, 51 bp, Artificial Sequence
  Description of Artificial Sequence: Synthetic oligonucleotide
aaaaaaaaaatcttctctgagtgcagaaggtaaaatgagagtatatgagtg

SEQ ID NO: 210598 - DNA, 50 bp, Artificial Sequence
  Description of Artificial Sequence: Synthetic oligonucleotide
aaaaaaaaatcttctctgagtgcagaaggtaaaatgagagtatatgagtg

SEQ ID NO: 210599 - DNA, 49 bp, Artificial Sequence
  Description of Artificial Sequence: Synthetic oligonucleotide
aaaaaaaatcttctctgagtgcagaaggtaaaatgagagtatatgagtg

SEQ ID NO: 210600 - DNA, 48 bp, Artificial Sequence
  Description of Artificial Sequence: Synthetic oligonucleotide
aaaaaaatcttctctgagtgcagaaggtaaaatgagagtatatgagtg

SEQ ID NO: 210601 - DNA, 47 bp, Artificial Sequence
  Description of Artificial Sequence: Synthetic oligonucleotide
aaaaaatcttctctgagtgcagaaggtaaaatgagagtatatgagtg

SEQ ID NO: 210602 - DNA, 46 bp, Artificial Sequence
  Description of Artificial Sequence: Synthetic oligonucleotide
aaaaatcttctctgagtgcagaaggtaaaatgagagtatatgagtg

SEQ ID NO: 210603 - DNA, 45 bp, Artificial Sequence
  Description of Artificial Sequence: Synthetic oligonucleotide
aaaatcttctctgagtgcagaaggtaaaatgagagtatatgagtg

SEQ ID NO: 210604 - DNA, 44 bp, Artificial Sequence
  Description of Artificial Sequence: Synthetic oligonucleotide
aaatcttctctgagtgcagaaggtaaaatgagagtatatgagtg

SEQ ID NO: 210605 - DNA, 43 bp, Artificial Sequence
  Description of Artificial Sequence: Synthetic oligonucleotide
aatcttctctgagtgcagaaggtaaaatgagagtatatgagtg

SEQ ID NO: 210606 - DNA, 42 bp, Artificial Sequence
  Description of Artificial Sequence: Synthetic oligonucleotide
atcttctctgagtgcagaaggtaaaatgagagtatatgagtg

SEQ ID NO: 210607 - DNA, 41 bp, Artificial Sequence
  Description of Artificial Sequence: Synthetic oligonucleotide
tcttctctgagtgcagaaggtaaaatgagagtatatgagtg

SEQ ID NO: 210608 - DNA, 40 bp, Artificial Sequence
  Description of Artificial Sequence: Synthetic oligonucleotide
cttctctgagtgcagaaggtaaaatgagagtatatgagtg

SEQ ID NO: 210609 - DNA, 44 bp, Artificial Sequence
  Description of Artificial Sequence: Synthetic oligonucleotide
ttctctgagtgcagaaggtaaaatgagagtatatgagtgaaatc

SEQ ID NO: 210610 - DNA, 43 bp, Artificial Sequence
  Description of Artificial Sequence: Synthetic oligonucleotide
tctctgagtgcagaaggtaaaatgagagtatatgagtgaaatc

SEQ ID NO: 210611 - DNA, 42 bp, Artificial Sequence
  Description of Artificial Sequence: Synthetic oligonucleotide
ctctgagtgcagaaggtaaaatgagagtatatgagtgaaatc

SEQ ID NO: 210612 - DNA, 45 bp, Artificial Sequence
  Description of Artificial Sequence: Synthetic oligonucleotide
tctgagtgcagaaggtaaaatgagagtatatgagtgaaatcaatg

SEQ ID NO: 210613 - DNA, 44 bp, Artificial Sequence
  Description of Artificial Sequence: Synthetic oligonucleotide
ctgagtgcagaaggtaaaatgagagtatatgagtgaaatcaatg

SEQ ID NO: 210614 - DNA, 44 bp, Artificial Sequence
  Description of Artificial Sequence: Synthetic oligonucleotide
tgagtgcagaaggtaaaatgagagtatatgagtgaaatcaatgg

SEQ ID NO: 210615 - DNA, 43 bp, Artificial Sequence
  Description of Artificial Sequence: Synthetic oligonucleotide
gagtgcagaaggtaaaatgagagtatatgagtgaaatcaatgg

SEQ ID NO: 210616 - DNA, 43 bp, Artificial Sequence
  Description of Artificial Sequence: Synthetic oligonucleotide
agtgcagaaggtaaaatgagagtatatgagtgaaatcaatggc

SEQ ID NO: 210617 - DNA, 42 bp, Artificial Sequence
  Description of Artificial Sequence: Synthetic oligonucleotide
gtgcagaaggtaaaatgagagtatatgagtgaaatcaatggc

SEQ ID NO: 210618 - DNA, 60 bp, Artificial Sequence
  Description of Artificial Sequence: Synthetic oligonucleotide
tgcagaaggtaaaatgagagtatatgagtgaaatcaatggctttttataaaaaatattag

SEQ ID NO: 210619 - DNA, 59 bp, Artificial Sequence
  Description of Artificial Sequence: Synthetic oligonucleotide
gcagaaggtaaaatgagagtatatgagtgaaatcaatggctttttataaaaaatattag

SEQ ID NO: 210620 - DNA, 60 bp, Artificial Sequence
  Description of Artificial Sequence: Synthetic oligonucleotide
cagaaggtaaaatgagagtatatgagtgaaatcaatggctttttataaaaaatattagtc

SEQ ID NO: 210621 - DNA, 60 bp, Artificial Sequence
  Description of Artificial Sequence: Synthetic oligonucleotide
agaaggtaaaatgagagtatatgagtgaaatcaatggctttttataaaaaatattagtct

SEQ ID NO: 210622 - DNA, 60 bp, Artificial Sequence
  Description of Artificial Sequence: Synthetic oligonucleotide
gaaggtaaaatgagagtatatgagtgaaatcaatggctttttataaaaaatattagtctg

SEQ ID NO: 210623 - DNA, 60 bp, Artificial Sequence
  Description of Artificial Sequence: Synthetic oligonucleotide
aaggtaaaatgagagtatatgagtgaaatcaatggctttttataaaaaatattagtctga

SEQ ID NO: 210624 - DNA, 60 bp, Artificial Sequence
  Description of Artificial Sequence: Synthetic oligonucleotide
aggtaaaatgagagtatatgagtgaaatcaatggctttttataaaaaatattagtctgag

SEQ ID NO: 210625 - DNA, 59 bp, Artificial Sequence
  Description of Artificial Sequence: Synthetic oligonucleotide
ggtaaaatgagagtatatgagtgaaatcaatggctttttataaaaaatattagtctgag

SEQ ID NO: 210626 - DNA, 60 bp, Artificial Sequence
  Description of Artificial Sequence: Synthetic oligonucleotide
gtaaaatgagagtatatgagtgaaatcaatggctttttataaaaaatattagtctgagtc

SEQ ID NO: 210627 - DNA, 60 bp, Artificial Sequence
  Description of Artificial Sequence: Synthetic oligonucleotide
taaaatgagagtatatgagtgaaatcaatggctttttataaaaaatattagtctgagtcc

SEQ ID NO: 210628 - DNA, 59 bp, Artificial Sequence
  Description of Artificial Sequence: Synthetic oligonucleotide
aaaatgagagtatatgagtgaaatcaatggctttttataaaaaatattagtctgagtcc

SEQ ID NO: 210629 - DNA, 58 bp, Artificial Sequence
  Description of Artificial Sequence: Synthetic oligonucleotide
aaatgagagtatatgagtgaaatcaatggctttttataaaaaatattagtctgagtcc

SEQ ID NO: 210630 - DNA, 57 bp, Artificial Sequence
  Description of Artificial Sequence: Synthetic oligonucleotide
aatgagagtatatgagtgaaatcaatggctttttataaaaaatattagtctgagtcc

SEQ ID NO: 210631 - DNA, 56 bp, Artificial Sequence
  Description of Artificial Sequence: Synthetic oligonucleotide
atgagagtatatgagtgaaatcaatggctttttataaaaaatattagtctgagtcc

SEQ ID NO: 210632 - DNA, 55 bp, Artificial Sequence
  Description of Artificial Sequence: Synthetic oligonucleotide
tgagagtatatgagtgaaatcaatggctttttataaaaaatattagtctgagtcc

SEQ ID NO: 210633 - DNA, 54 bp, Artificial Sequence
  Description of Artificial Sequence: Synthetic oligonucleotide
gagagtatatgagtgaaatcaatggctttttataaaaaatattagtctgagtcc

SEQ ID NO: 210634 - DNA, 55 bp, Artificial Sequence
  Description of Artificial Sequence: Synthetic oligonucleotide
agagtatatgagtgaaatcaatggctttttataaaaaatattagtctgagtcctg

SEQ ID NO: 210635 - DNA, 54 bp, Artificial Sequence
  Description of Artificial Sequence: Synthetic oligonucleotide
gagtatatgagtgaaatcaatggctttttataaaaaatattagtctgagtcctg

SEQ ID NO: 210636 - DNA, 60 bp, Artificial Sequence
  Description of Artificial Sequence: Synthetic oligonucleotide
agtatatgagtgaaatcaatggctttttataaaaaatattagtctgagtcctgaataaaa

SEQ ID NO: 210637 - DNA, 60 bp, Artificial Sequence
  Description of Artificial Sequence: Synthetic oligonucleotide
gtatatgagtgaaatcaatggctttttataaaaaatattagtctgagtcctgaataaaaa

SEQ ID NO: 210638 - DNA, 60 bp, Artificial Sequence
  Description of Artificial Sequence: Synthetic oligonucleotide
tatatgagtgaaatcaatggctttttataaaaaatattagtctgagtcctgaataaaaat

SEQ ID NO: 210639 - DNA, 60 bp, Artificial Sequence
  Description of Artificial Sequence: Synthetic oligonucleotide
atatgagtgaaatcaatggctttttataaaaaatattagtctgagtcctgaataaaaatc

SEQ ID NO: 210640 - DNA, 60 bp, Artificial Sequence
  Description of Artificial Sequence: Synthetic oligonucleotide
tatgagtgaaatcaatggctttttataaaaaatattagtctgagtcctgaataaaaatca

SEQ ID NO: 210641 - DNA, 60 bp, Artificial Sequence
  Description of Artificial Sequence: Synthetic oligonucleotide
atgagtgaaatcaatggctttttataaaaaatattagtctgagtcctgaataaaaatcag

SEQ ID NO: 210642 - DNA, 59 bp, Artificial Sequence
  Description of Artificial Sequence: Synthetic oligonucleotide
tgagtgaaatcaatggctttttataaaaaatattagtctgagtcctgaataaaaatcag

SEQ ID NO: 210643 - DNA, 58 bp, Artificial Sequence
  Description of Artificial Sequence: Synthetic oligonucleotide
gagtgaaatcaatggctttttataaaaaatattagtctgagtcctgaataaaaatcag

SEQ ID NO: 210644 - DNA, 58 bp, Artificial Sequence
  Description of Artificial Sequence: Synthetic oligonucleotide
agtgaaatcaatggctttttataaaaaatattagtctgagtcctgaataaaaatcagg

SEQ ID NO: 210645 - DNA, 57 bp, Artificial Sequence
  Description of Artificial Sequence: Synthetic oligonucleotide
gtgaaatcaatggctttttataaaaaatattagtctgagtcctgaataaaaatcagg

SEQ ID NO: 210646 - DNA, 60 bp, Artificial Sequence
  Description of Artificial Sequence: Synthetic oligonucleotide
tgaaatcaatggctttttataaaaaatattagtctgagtcctgaataaaaatcaggataa

SEQ ID NO: 210647 - DNA, 60 bp, Artificial Sequence
  Description of Artificial Sequence: Synthetic oligonucleotide
gaaatcaatggctttttataaaaaatattagtctgagtcctgaataaaaatcaggataaa

SEQ ID NO: 210648 - DNA, 60 bp, Artificial Sequence
  Description of Artificial Sequence: Synthetic oligonucleotide
aaatcaatggctttttataaaaaatattagtctgagtcctgaataaaaatcaggataaat

SEQ ID NO: 210649 - DNA, 60 bp, Artificial Sequence
  Description of Artificial Sequence: Synthetic oligonucleotide
aatcaatggctttttataaaaaatattagtctgagtcctgaataaaaatcaggataaatt

SEQ ID NO: 210650 - DNA, 60 bp, Artificial Sequence
  Description of Artificial Sequence: Synthetic oligonucleotide
atcaatggctttttataaaaaatattagtctgagtcctgaataaaaatcaggataaattg

SEQ ID NO: 210651 - DNA, 60 bp, Artificial Sequence
  Description of Artificial Sequence: Synthetic oligonucleotide
tcaatggctttttataaaaaatattagtctgagtcctgaataaaaatcaggataaattgt

SEQ ID NO: 210652 - DNA, 60 bp, Artificial Sequence
  Description of Artificial Sequence: Synthetic oligonucleotide
caatggctttttataaaaaatattagtctgagtcctgaataaaaatcaggataaattgtc

SEQ ID NO: 210653 - DNA, 60 bp, Artificial Sequence
  Description of Artificial Sequence: Synthetic oligonucleotide
aatggctttttataaaaaatattagtctgagtcctgaataaaaatcaggataaattgtca

SEQ ID NO: 210654 - DNA, 60 bp, Artificial Sequence
  Description of Artificial Sequence: Synthetic oligonucleotide
atggctttttataaaaaatattagtctgagtcctgaataaaaatcaggataaattgtcac

SEQ ID NO: 210655 - DNA, 59 bp, Artificial Sequence
  Description of Artificial Sequence: Synthetic oligonucleotide
tggctttttataaaaaatattagtctgagtcctgaataaaaatcaggataaattgtcac

SEQ ID NO: 210656 - DNA, 58 bp, Artificial Sequence
  Description of Artificial Sequence: Synthetic oligonucleotide
ggctttttataaaaaatattagtctgagtcctgaataaaaatcaggataaattgtcac

SEQ ID NO: 210657 - DNA, 59 bp, Artificial Sequence
  Description of Artificial Sequence: Synthetic oligonucleotide
gctttttataaaaaatattagtctgagtcctgaataaaaatcaggataaattgtcactg

SEQ ID NO: 210658 - DNA, 59 bp, Artificial Sequence
  Description of Artificial Sequence: Synthetic oligonucleotide
ctttttataaaaaatattagtctgagtcctgaataaaaatcaggataaattgtcactgg

SEQ ID NO: 210659 - DNA, 59 bp, Artificial Sequence
  Description of Artificial Sequence: Synthetic oligonucleotide
tttttataaaaaatattagtctgagtcctgaataaaaatcaggataaattgtcactggc

SEQ ID NO: 210660 - DNA, 58 bp, Artificial Sequence
  Description of Artificial Sequence: Synthetic oligonucleotide
ttttataaaaaatattagtctgagtcctgaataaaaatcaggataaattgtcactggc

SEQ ID NO: 210661 - DNA, 57 bp, Artificial Sequence
  Description of Artificial Sequence: Synthetic oligonucleotide
tttataaaaaatattagtctgagtcctgaataaaaatcaggataaattgtcactggc

SEQ ID NO: 210662 - DNA, 56 bp, Artificial Sequence
  Description of Artificial Sequence: Synthetic oligonucleotide
ttataaaaaatattagtctgagtcctgaataaaaatcaggataaattgtcactggc

SEQ ID NO: 210663 - DNA, 55 bp, Artificial Sequence
  Description of Artificial Sequence: Synthetic oligonucleotide
tataaaaaatattagtctgagtcctgaataaaaatcaggataaattgtcactggc

SEQ ID NO: 210664 - DNA, 54 bp, Artificial Sequence
  Description of Artificial Sequence: Synthetic oligonucleotide
ataaaaaatattagtctgagtcctgaataaaaatcaggataaattgtcactggc

SEQ ID NO: 210665 - DNA, 53 bp, Artificial Sequence
  Description of Artificial Sequence: Synthetic oligonucleotide
taaaaaatattagtctgagtcctgaataaaaatcaggataaattgtcactggc

SEQ ID NO: 210666 - DNA, 52 bp, Artificial Sequence
  Description of Artificial Sequence: Synthetic oligonucleotide
aaaaaatattagtctgagtcctgaataaaaatcaggataaattgtcactggc

SEQ ID NO: 210667 - DNA, 51 bp, Artificial Sequence
  Description of Artificial Sequence: Synthetic oligonucleotide
aaaaatattagtctgagtcctgaataaaaatcaggataaattgtcactggc

SEQ ID NO: 210668 - DNA, 50 bp, Artificial Sequence
  Description of Artificial Sequence: Synthetic oligonucleotide
aaaatattagtctgagtcctgaataaaaatcaggataaattgtcactggc

SEQ ID NO: 210669 - DNA, 49 bp, Artificial Sequence
  Description of Artificial Sequence: Synthetic oligonucleotide
aaatattagtctgagtcctgaataaaaatcaggataaattgtcactggc

SEQ ID NO: 210670 - DNA, 48 bp, Artificial Sequence
  Description of Artificial Sequence: Synthetic oligonucleotide
aatattagtctgagtcctgaataaaaatcaggataaattgtcactggc

SEQ ID NO: 210671 - DNA, 47 bp, Artificial Sequence
  Description of Artificial Sequence: Synthetic oligonucleotide
atattagtctgagtcctgaataaaaatcaggataaattgtcactggc

SEQ ID NO: 210672 - DNA, 46 bp, Artificial Sequence
  Description of Artificial Sequence: Synthetic oligonucleotide
tattagtctgagtcctgaataaaaatcaggataaattgtcactggc

SEQ ID NO: 210673 - DNA, 45 bp, Artificial Sequence
  Description of Artificial Sequence: Synthetic oligonucleotide
attagtctgagtcctgaataaaaatcaggataaattgtcactggc

SEQ ID NO: 210674 - DNA, 44 bp, Artificial Sequence
  Description of Artificial Sequence: Synthetic oligonucleotide
ttagtctgagtcctgaataaaaatcaggataaattgtcactggc

SEQ ID NO: 210675 - DNA, 43 bp, Artificial Sequence
  Description of Artificial Sequence: Synthetic oligonucleotide
tagtctgagtcctgaataaaaatcaggataaattgtcactggc

SEQ ID NO: 210676 - DNA, 42 bp, Artificial Sequence
  Description of Artificial Sequence: Synthetic oligonucleotide
agtctgagtcctgaataaaaatcaggataaattgtcactggc

SEQ ID NO: 210677 - DNA, 41 bp, Artificial Sequence
  Description of Artificial Sequence: Synthetic oligonucleotide
gtctgagtcctgaataaaaatcaggataaattgtcactggc

SEQ ID NO: 210678 - DNA, 42 bp, Artificial Sequence
  Description of Artificial Sequence: Synthetic oligonucleotide
tctgagtcctgaataaaaatcaggataaattgtcactggctg

SEQ ID NO: 210679 - DNA, 41 bp, Artificial Sequence
  Description of Artificial Sequence: Synthetic oligonucleotide
ctgagtcctgaataaaaatcaggataaattgtcactggctg

SEQ ID NO: 210680 - DNA, 42 bp, Artificial Sequence
  Description of Artificial Sequence: Synthetic oligonucleotide
tgagtcctgaataaaaatcaggataaattgtcactggctgag

SEQ ID NO: 210681 - DNA, 41 bp, Artificial Sequence
  Description of Artificial Sequence: Synthetic oligonucleotide
gagtcctgaataaaaatcaggataaattgtcactggctgag

SEQ ID NO: 210682 - DNA, 43 bp, Artificial Sequence
  Description of Artificial Sequence: Synthetic oligonucleotide
agtcctgaataaaaatcaggataaattgtcactggctgagaag

SEQ ID NO: 210683 - DNA, 42 bp, Artificial Sequence
  Description of Artificial Sequence: Synthetic oligonucleotide
gtcctgaataaaaatcaggataaattgtcactggctgagaag

SEQ ID NO: 210684 - DNA, 43 bp, Artificial Sequence
  Description of Artificial Sequence: Synthetic oligonucleotide
tcctgaataaaaatcaggataaattgtcactggctgagaagtc

SEQ ID NO: 210685 - DNA, 42 bp, Artificial Sequence
  Description of Artificial Sequence: Synthetic oligonucleotide
cctgaataaaaatcaggataaattgtcactggctgagaagtc

SEQ ID NO: 210686 - DNA, 42 bp, Artificial Sequence
  Description of Artificial Sequence: Synthetic oligonucleotide
ctgaataaaaatcaggataaattgtcactggctgagaagtcc

SEQ ID NO: 210687 - DNA, 43 bp, Artificial Sequence
  Description of Artificial Sequence: Synthetic oligonucleotide
tgaataaaaatcaggataaattgtcactggctgagaagtcctg

SEQ ID NO: 210688 - DNA, 42 bp, Artificial Sequence
  Description of Artificial Sequence: Synthetic oligonucleotide
gaataaaaatcaggataaattgtcactggctgagaagtcctg

SEQ ID NO: 210689 - DNA, 44 bp, Artificial Sequence
  Description of Artificial Sequence: Synthetic oligonucleotide
aataaaaatcaggataaattgtcactggctgagaagtcctgttc

SEQ ID NO: 210690 - DNA, 43 bp, Artificial Sequence
  Description of Artificial Sequence: Synthetic oligonucleotide
ataaaaatcaggataaattgtcactggctgagaagtcctgttc

SEQ ID NO: 210691 - DNA, 42 bp, Artificial Sequence
  Description of Artificial Sequence: Synthetic oligonucleotide
taaaaatcaggataaattgtcactggctgagaagtcctgttc

SEQ ID NO: 210692 - DNA, 41 bp, Artificial Sequence
  Description of Artificial Sequence: Synthetic oligonucleotide
aaaaatcaggataaattgtcactggctgagaagtcctgttc

SEQ ID NO: 210693 - DNA, 40 bp, Artificial Sequence
  Description of Artificial Sequence: Synthetic oligonucleotide
aaaatcaggataaattgtcactggctgagaagtcctgttc

SEQ ID NO: 210694 - DNA, 39 bp, Artificial Sequence
  Description of Artificial Sequence: Synthetic oligonucleotide
aaatcaggataaattgtcactggctgagaagtcctgttc

SEQ ID NO: 210695 - DNA, 38 bp, Artificial Sequence
  Description of Artificial Sequence: Synthetic oligonucleotide
aatcaggataaattgtcactggctgagaagtcctgttc

SEQ ID NO: 210696 - DNA, 37 bp, Artificial Sequence
  Description of Artificial Sequence: Synthetic oligonucleotide
atcaggataaattgtcactggctgagaagtcctgttc

SEQ ID NO: 210697 - DNA, 36 bp, Artificial Sequence
  Description of Artificial Sequence: Synthetic oligonucleotide
tcaggataaattgtcactggctgagaagtcctgttc

SEQ ID NO: 210698 - DNA, 35 bp, Artificial Sequence
  Description of Artificial Sequence: Synthetic oligonucleotide
caggataaattgtcactggctgagaagtcctgttc

SEQ ID NO: 210699 - DNA, 38 bp, Artificial Sequence
  Description of Artificial Sequence: Synthetic oligonucleotide
aggataaattgtcactggctgagaagtcctgttcaatc

SEQ ID NO: 210700 - DNA, 37 bp, Artificial Sequence
  Description of Artificial Sequence: Synthetic oligonucleotide
ggataaattgtcactggctgagaagtcctgttcaatc

SEQ ID NO: 210701 - DNA, 39 bp, Artificial Sequence
  Description of Artificial Sequence: Synthetic oligonucleotide
gataaattgtcactggctgagaagtcctgttcaatcatg

SEQ ID NO: 210702 - DNA, 41 bp, Artificial Sequence
  Description of Artificial Sequence: Synthetic oligonucleotide
ataaattgtcactggctgagaagtcctgttcaatcatgttg

SEQ ID NO: 210703 - DNA, 40 bp, Artificial Sequence
  Description of Artificial Sequence: Synthetic oligonucleotide
taaattgtcactggctgagaagtcctgttcaatcatgttg

SEQ ID NO: 210704 - DNA, 39 bp, Artificial Sequence
  Description of Artificial Sequence: Synthetic oligonucleotide
aaattgtcactggctgagaagtcctgttcaatcatgttg

SEQ ID NO: 210705 - DNA, 38 bp, Artificial Sequence
  Description of Artificial Sequence: Synthetic oligonucleotide
aattgtcactggctgagaagtcctgttcaatcatgttg

SEQ ID NO: 210706 - DNA, 37 bp, Artificial Sequence
  Description of Artificial Sequence: Synthetic oligonucleotide
attgtcactggctgagaagtcctgttcaatcatgttg

SEQ ID NO: 210707 - DNA, 36 bp, Artificial Sequence
  Description of Artificial Sequence: Synthetic oligonucleotide
ttgtcactggctgagaagtcctgttcaatcatgttg

SEQ ID NO: 210708 - DNA, 35 bp, Artificial Sequence
  Description of Artificial Sequence: Synthetic oligonucleotide
tgtcactggctgagaagtcctgttcaatcatgttg

SEQ ID NO: 210709 - DNA, 34 bp, Artificial Sequence
  Description of Artificial Sequence: Synthetic oligonucleotide
gtcactggctgagaagtcctgttcaatcatgttg

SEQ ID NO: 210710 - DNA, 34 bp, Artificial Sequence
  Description of Artificial Sequence: Synthetic oligonucleotide
tcactggctgagaagtcctgttcaatcatgttgc

SEQ ID NO: 210711 - DNA, 33 bp, Artificial Sequence
  Description of Artificial Sequence: Synthetic oligonucleotide
cactggctgagaagtcctgttcaatcatgttgc

SEQ ID NO: 210712 - DNA, 35 bp, Artificial Sequence
  Description of Artificial Sequence: Synthetic oligonucleotide
actggctgagaagtcctgttcaatcatgttgcatg

SEQ ID NO: 210713 - DNA, 34 bp, Artificial Sequence
  Description of Artificial Sequence: Synthetic oligonucleotide
ctggctgagaagtcctgttcaatcatgttgcatg

SEQ ID NO: 210714 - DNA, 34 bp, Artificial Sequence
  Description of Artificial Sequence: Synthetic oligonucleotide
tggctgagaagtcctgttcaatcatgttgcatgc

SEQ ID NO: 210715 - DNA, 33 bp, Artificial Sequence
  Description of Artificial Sequence: Synthetic oligonucleotide
ggctgagaagtcctgttcaatcatgttgcatgc

SEQ ID NO: 210716 - DNA, 33 bp, Artificial Sequence
  Description of Artificial Sequence: Synthetic oligonucleotide
gctgagaagtcctgttcaatcatgttgcatgcc

SEQ ID NO: 210717 - DNA, 34 bp, Artificial Sequence
  Description of Artificial Sequence: Synthetic oligonucleotide
ctgagaagtcctgttcaatcatgttgcatgccag

SEQ ID NO: 210718 - DNA, 35 bp, Artificial Sequence
  Description of Artificial Sequence: Synthetic oligonucleotide
tgagaagtcctgttcaatcatgttgcatgccagag

SEQ ID NO: 210719 - DNA, 34 bp, Artificial Sequence
  Description of Artificial Sequence: Synthetic oligonucleotide
gagaagtcctgttcaatcatgttgcatgccagag

SEQ ID NO: 210720 - DNA, 35 bp, Artificial Sequence
  Description of Artificial Sequence: Synthetic oligonucleotide
agaagtcctgttcaatcatgttgcatgccagagtg

SEQ ID NO: 210721 - DNA, 34 bp, Artificial Sequence
  Description of Artificial Sequence: Synthetic oligonucleotide
gaagtcctgttcaatcatgttgcatgccagagtg

SEQ ID NO: 210722 - DNA, 36 bp, Artificial Sequence
  Description of Artificial Sequence: Synthetic oligonucleotide
aagtcctgttcaatcatgttgcatgccagagtgatg

SEQ ID NO: 210723 - DNA, 35 bp, Artificial Sequence
  Description of Artificial Sequence: Synthetic oligonucleotide
agtcctgttcaatcatgttgcatgccagagtgatg

SEQ ID NO: 210724 - DNA, 34 bp, Artificial Sequence
  Description of Artificial Sequence: Synthetic oligonucleotide
gtcctgttcaatcatgttgcatgccagagtgatg

SEQ ID NO: 210725 - DNA, 39 bp, Artificial Sequence
  Description of Artificial Sequence: Synthetic oligonucleotide
tcctgttcaatcatgttgcatgccagagtgatgtttttg

SEQ ID NO: 210726 - DNA, 38 bp, Artificial Sequence
  Description of Artificial Sequence: Synthetic oligonucleotide
cctgttcaatcatgttgcatgccagagtgatgtttttg

SEQ ID NO: 210727 - DNA, 39 bp, Artificial Sequence
  Description of Artificial Sequence: Synthetic oligonucleotide
ctgttcaatcatgttgcatgccagagtgatgtttttgtg

SEQ ID NO: 210728 - DNA, 40 bp, Artificial Sequence
  Description of Artificial Sequence: Synthetic oligonucleotide
tgttcaatcatgttgcatgccagagtgatgtttttgtgac

SEQ ID NO: 210729 - DNA, 39 bp, Artificial Sequence
  Description of Artificial Sequence: Synthetic oligonucleotide
gttcaatcatgttgcatgccagagtgatgtttttgtgac

SEQ ID NO: 210730 - DNA, 43 bp, Artificial Sequence
  Description of Artificial Sequence: Synthetic oligonucleotide
ttcaatcatgttgcatgccagagtgatgtttttgtgacttttg

SEQ ID NO: 210731 - DNA, 42 bp, Artificial Sequence
  Description of Artificial Sequence: Synthetic oligonucleotide
tcaatcatgttgcatgccagagtgatgtttttgtgacttttg

SEQ ID NO: 210732 - DNA, 41 bp, Artificial Sequence
  Description of Artificial Sequence: Synthetic oligonucleotide
caatcatgttgcatgccagagtgatgtttttgtgacttttg

SEQ ID NO: 210733 - DNA, 42 bp, Artificial Sequence
  Description of Artificial Sequence: Synthetic oligonucleotide
aatcatgttgcatgccagagtgatgtttttgtgacttttgtc

SEQ ID NO: 210734 - DNA, 41 bp, Artificial Sequence
  Description of Artificial Sequence: Synthetic oligonucleotide
atcatgttgcatgccagagtgatgtttttgtgacttttgtc

SEQ ID NO: 210735 - DNA, 40 bp, Artificial Sequence
  Description of Artificial Sequence: Synthetic oligonucleotide
tcatgttgcatgccagagtgatgtttttgtgacttttgtc

SEQ ID NO: 210736 - DNA, 39 bp, Artificial Sequence
  Description of Artificial Sequence: Synthetic oligonucleotide
catgttgcatgccagagtgatgtttttgtgacttttgtc

SEQ ID NO: 210737 - DNA, 41 bp, Artificial Sequence
  Description of Artificial Sequence: Synthetic oligonucleotide
atgttgcatgccagagtgatgtttttgtgacttttgtcttc

SEQ ID NO: 210738 - DNA, 40 bp, Artificial Sequence
  Description of Artificial Sequence: Synthetic oligonucleotide
tgttgcatgccagagtgatgtttttgtgacttttgtcttc

SEQ ID NO: 210739 - DNA, 39 bp, Artificial Sequence
  Description of Artificial Sequence: Synthetic oligonucleotide
gttgcatgccagagtgatgtttttgtgacttttgtcttc

SEQ ID NO: 210740 - DNA, 39 bp, Artificial Sequence
  Description of Artificial Sequence: Synthetic oligonucleotide
ttgcatgccagagtgatgtttttgtgacttttgtcttcc

SEQ ID NO: 210741 - DNA, 38 bp, Artificial Sequence
  Description of Artificial Sequence: Synthetic oligonucleotide
tgcatgccagagtgatgtttttgtgacttttgtcttcc

SEQ ID NO: 210742 - DNA, 37 bp, Artificial Sequence
  Description of Artificial Sequence: Synthetic oligonucleotide
gcatgccagagtgatgtttttgtgacttttgtcttcc

SEQ ID NO: 210743 - DNA, 42 bp, Artificial Sequence
  Description of Artificial Sequence: Synthetic oligonucleotide
catgccagagtgatgtttttgtgacttttgtcttccttttag

SEQ ID NO: 210744 - DNA, 42 bp, Artificial Sequence
  Description of Artificial Sequence: Synthetic oligonucleotide
atgccagagtgatgtttttgtgacttttgtcttccttttagg

SEQ ID NO: 210745 - DNA, 41 bp, Artificial Sequence
  Description of Artificial Sequence: Synthetic oligonucleotide
tgccagagtgatgtttttgtgacttttgtcttccttttagg

SEQ ID NO: 210746 - DNA, 40 bp, Artificial Sequence
  Description of Artificial Sequence: Synthetic oligonucleotide
gccagagtgatgtttttgtgacttttgtcttccttttagg

SEQ ID NO: 210747 - DNA, 42 bp, Artificial Sequence
  Description of Artificial Sequence: Synthetic oligonucleotide
ccagagtgatgtttttgtgacttttgtcttccttttaggttc

SEQ ID NO: 210748 - DNA, 43 bp, Artificial Sequence
  Description of Artificial Sequence: Synthetic oligonucleotide
cagagtgatgtttttgtgacttttgtcttccttttaggttcac

SEQ ID NO: 210749 - DNA, 45 bp, Artificial Sequence
  Description of Artificial Sequence: Synthetic oligonucleotide
agagtgatgtttttgtgacttttgtcttccttttaggttcacatg

SEQ ID NO: 210750 - DNA, 44 bp, Artificial Sequence
  Description of Artificial Sequence: Synthetic oligonucleotide
gagtgatgtttttgtgacttttgtcttccttttaggttcacatg

SEQ ID NO: 210751 - DNA, 46 bp, Artificial Sequence
  Description of Artificial Sequence: Synthetic oligonucleotide
agtgatgtttttgtgacttttgtcttccttttaggttcacatgatg

SEQ ID NO: 210752 - DNA, 45 bp, Artificial Sequence
  Description of Artificial Sequence: Synthetic oligonucleotide
gtgatgtttttgtgacttttgtcttccttttaggttcacatgatg

SEQ ID NO: 210753 - DNA, 45 bp, Artificial Sequence
  Description of Artificial Sequence: Synthetic oligonucleotide
tgatgtttttgtgacttttgtcttccttttaggttcacatgatgc

SEQ ID NO: 210754 - DNA, 44 bp, Artificial Sequence
  Description of Artificial Sequence: Synthetic oligonucleotide
gatgtttttgtgacttttgtcttccttttaggttcacatgatgc

SEQ ID NO: 210755 - DNA, 45 bp, Artificial Sequence
  Description of Artificial Sequence: Synthetic oligonucleotide
atgtttttgtgacttttgtcttccttttaggttcacatgatgctc

SEQ ID NO: 210756 - DNA, 44 bp, Artificial Sequence
  Description of Artificial Sequence: Synthetic oligonucleotide
tgtttttgtgacttttgtcttccttttaggttcacatgatgctc

SEQ ID NO: 210757 - DNA, 43 bp, Artificial Sequence
  Description of Artificial Sequence: Synthetic oligonucleotide
gtttttgtgacttttgtcttccttttaggttcacatgatgctc

SEQ ID NO: 210758 - DNA, 48 bp, Artificial Sequence
  Description of Artificial Sequence: Synthetic oligonucleotide
tttttgtgacttttgtcttccttttaggttcacatgatgctcttatag

SEQ ID NO: 210759 - DNA, 47 bp, Artificial Sequence
  Description of Artificial Sequence: Synthetic oligonucleotide
ttttgtgacttttgtcttccttttaggttcacatgatgctcttatag

SEQ ID NO: 210760 - DNA, 46 bp, Artificial Sequence
  Description of Artificial Sequence: Synthetic oligonucleotide
tttgtgacttttgtcttccttttaggttcacatgatgctcttatag

SEQ ID NO: 210761 - DNA, 45 bp, Artificial Sequence
  Description of Artificial Sequence: Synthetic oligonucleotide
ttgtgacttttgtcttccttttaggttcacatgatgctcttatag

SEQ ID NO: 210762 - DNA, 44 bp, Artificial Sequence
  Description of Artificial Sequence: Synthetic oligonucleotide
tgtgacttttgtcttccttttaggttcacatgatgctcttatag

SEQ ID NO: 210763 - DNA, 43 bp, Artificial Sequence
  Description of Artificial Sequence: Synthetic oligonucleotide
gtgacttttgtcttccttttaggttcacatgatgctcttatag

SEQ ID NO: 210764 - DNA, 45 bp, Artificial Sequence
  Description of Artificial Sequence: Synthetic oligonucleotide
tgacttttgtcttccttttaggttcacatgatgctcttatagttg

SEQ ID NO: 210765 - DNA, 44 bp, Artificial Sequence
  Description of Artificial Sequence: Synthetic oligonucleotide
gacttttgtcttccttttaggttcacatgatgctcttatagttg

SEQ ID NO: 210766 - DNA, 44 bp, Artificial Sequence
  Description of Artificial Sequence: Synthetic oligonucleotide
acttttgtcttccttttaggttcacatgatgctcttatagttgg

SEQ ID NO: 210767 - DNA, 43 bp, Artificial Sequence
  Description of Artificial Sequence: Synthetic oligonucleotide
cttttgtcttccttttaggttcacatgatgctcttatagttgg

SEQ ID NO: 210768 - DNA, 43 bp, Artificial Sequence
  Description of Artificial Sequence: Synthetic oligonucleotide
ttttgtcttccttttaggttcacatgatgctcttatagttggc

SEQ ID NO: 210769 - DNA, 42 bp, Artificial Sequence
  Description of Artificial Sequence: Synthetic oligonucleotide
tttgtcttccttttaggttcacatgatgctcttatagttggc

SEQ ID NO: 210770 - DNA, 41 bp, Artificial Sequence
  Description of Artificial Sequence: Synthetic oligonucleotide
ttgtcttccttttaggttcacatgatgctcttatagttggc

SEQ ID NO: 210771 - DNA, 40 bp, Artificial Sequence
  Description of Artificial Sequence: Synthetic oligonucleotide
tgtcttccttttaggttcacatgatgctcttatagttggc

SEQ ID NO: 210772 - DNA, 39 bp, Artificial Sequence
  Description of Artificial Sequence: Synthetic oligonucleotide
gtcttccttttaggttcacatgatgctcttatagttggc

SEQ ID NO: 210773 - DNA, 40 bp, Artificial Sequence
  Description of Artificial Sequence: Synthetic oligonucleotide
tcttccttttaggttcacatgatgctcttatagttggcac

SEQ ID NO: 210774 - DNA, 39 bp, Artificial Sequence
  Description of Artificial Sequence: Synthetic oligonucleotide
cttccttttaggttcacatgatgctcttatagttggcac

SEQ ID NO: 210775 - DNA, 43 bp, Artificial Sequence
  Description of Artificial Sequence: Synthetic oligonucleotide
ttccttttaggttcacatgatgctcttatagttggcactttac

SEQ ID NO: 210776 - DNA, 42 bp, Artificial Sequence
  Description of Artificial Sequence: Synthetic oligonucleotide
tccttttaggttcacatgatgctcttatagttggcactttac

SEQ ID NO: 210777 - DNA, 41 bp, Artificial Sequence
  Description of Artificial Sequence: Synthetic oligonucleotide
ccttttaggttcacatgatgctcttatagttggcactttac

SEQ ID NO: 210778 - DNA, 43 bp, Artificial Sequence
  Description of Artificial Sequence: Synthetic oligonucleotide
cttttaggttcacatgatgctcttatagttggcactttacttg

SEQ ID NO: 210779 - DNA, 43 bp, Artificial Sequence
  Description of Artificial Sequence: Synthetic oligonucleotide
ttttaggttcacatgatgctcttatagttggcactttacttgg

SEQ ID NO: 210780 - DNA, 42 bp, Artificial Sequence
  Description of Artificial Sequence: Synthetic oligonucleotide
tttaggttcacatgatgctcttatagttggcactttacttgg

SEQ ID NO: 210781 - DNA, 41 bp, Artificial Sequence
  Description of Artificial Sequence: Synthetic oligonucleotide
ttaggttcacatgatgctcttatagttggcactttacttgg

SEQ ID NO: 210782 - DNA, 40 bp, Artificial Sequence
  Description of Artificial Sequence: Synthetic oligonucleotide
taggttcacatgatgctcttatagttggcactttacttgg

SEQ ID NO: 210783 - DNA, 39 bp, Artificial Sequence
  Description of Artificial Sequence: Synthetic oligonucleotide
aggttcacatgatgctcttatagttggcactttacttgg

SEQ ID NO: 210784 - DNA, 38 bp, Artificial Sequence
  Description of Artificial Sequence: Synthetic oligonucleotide
ggttcacatgatgctcttatagttggcactttacttgg

SEQ ID NO: 210785 - DNA, 40 bp, Artificial Sequence
  Description of Artificial Sequence: Synthetic oligonucleotide
gttcacatgatgctcttatagttggcactttacttggtac

SEQ ID NO: 210786 - DNA, 40 bp, Artificial Sequence
  Description of Artificial Sequence: Synthetic oligonucleotide
ttcacatgatgctcttatagttggcactttacttggtacg

SEQ ID NO: 210787 - DNA, 39 bp, Artificial Sequence
  Description of Artificial Sequence: Synthetic oligonucleotide
tcacatgatgctcttatagttggcactttacttggtacg

SEQ ID NO: 210788 - DNA, 38 bp, Artificial Sequence
  Description of Artificial Sequence: Synthetic oligonucleotide
cacatgatgctcttatagttggcactttacttggtacg

SEQ ID NO: 210789 - DNA, 40 bp, Artificial Sequence
  Description of Artificial Sequence: Synthetic oligonucleotide
acatgatgctcttatagttggcactttacttggtacgatc

SEQ ID NO: 210790 - DNA, 39 bp, Artificial Sequence
  Description of Artificial Sequence: Synthetic oligonucleotide
catgatgctcttatagttggcactttacttggtacgatc

SEQ ID NO: 210791 - DNA, 41 bp, Artificial Sequence
  Description of Artificial Sequence: Synthetic oligonucleotide
atgatgctcttatagttggcactttacttggtacgatcatc

SEQ ID NO: 210792 - DNA, 40 bp, Artificial Sequence
  Description of Artificial Sequence: Synthetic oligonucleotide
tgatgctcttatagttggcactttacttggtacgatcatc

SEQ ID NO: 210793 - DNA, 39 bp, Artificial Sequence
  Description of Artificial Sequence: Synthetic oligonucleotide
gatgctcttatagttggcactttacttggtacgatcatc

SEQ ID NO: 210794 - DNA, 50 bp, Artificial Sequence
  Description of Artificial Sequence: Synthetic oligonucleotide
atgctcttatagttggcactttacttggtacgatcatctttattttaatc

SEQ ID NO: 210795 - DNA, 49 bp, Artificial Sequence
  Description of Artificial Sequence: Synthetic oligonucleotide
tgctcttatagttggcactttacttggtacgatcatctttattttaatc

SEQ ID NO: 210796 - DNA, 48 bp, Artificial Sequence
  Description of Artificial Sequence: Synthetic oligonucleotide
gctcttatagttggcactttacttggtacgatcatctttattttaatc

SEQ ID NO: 210797 - DNA, 50 bp, Artificial Sequence
  Description of Artificial Sequence: Synthetic oligonucleotide
ctcttatagttggcactttacttggtacgatcatctttattttaatcatc

SEQ ID NO: 210798 - DNA, 55 bp, Artificial Sequence
  Description of Artificial Sequence: Synthetic oligonucleotide
tcttatagttggcactttacttggtacgatcatctttattttaatcatcattttc

SEQ ID NO: 210799 - DNA, 54 bp, Artificial Sequence
  Description of Artificial Sequence: Synthetic oligonucleotide
cttatagttggcactttacttggtacgatcatctttattttaatcatcattttc

SEQ ID NO: 210800 - DNA, 54 bp, Artificial Sequence
  Description of Artificial Sequence: Synthetic oligonucleotide
ttatagttggcactttacttggtacgatcatctttattttaatcatcattttcc

SEQ ID NO: 210801 - DNA, 53 bp, Artificial Sequence
  Description of Artificial Sequence: Synthetic oligonucleotide
tatagttggcactttacttggtacgatcatctttattttaatcatcattttcc

SEQ ID NO: 210802 - DNA, 52 bp, Artificial Sequence
  Description of Artificial Sequence: Synthetic oligonucleotide
atagttggcactttacttggtacgatcatctttattttaatcatcattttcc

SEQ ID NO: 210803 - DNA, 51 bp, Artificial Sequence
  Description of Artificial Sequence: Synthetic oligonucleotide
tagttggcactttacttggtacgatcatctttattttaatcatcattttcc

SEQ ID NO: 210804 - DNA, 50 bp, Artificial Sequence
  Description of Artificial Sequence: Synthetic oligonucleotide
agttggcactttacttggtacgatcatctttattttaatcatcattttcc

SEQ ID NO: 210805 - DNA, 49 bp, Artificial Sequence
  Description of Artificial Sequence: Synthetic oligonucleotide
gttggcactttacttggtacgatcatctttattttaatcatcattttcc

SEQ ID NO: 210806 - DNA, 50 bp, Artificial Sequence
  Description of Artificial Sequence: Synthetic oligonucleotide
ttggcactttacttggtacgatcatctttattttaatcatcattttcctc

SEQ ID NO: 210807 - DNA, 49 bp, Artificial Sequence
  Description of Artificial Sequence: Synthetic oligonucleotide
tggcactttacttggtacgatcatctttattttaatcatcattttcctc

SEQ ID NO: 210808 - DNA, 48 bp, Artificial Sequence
  Description of Artificial Sequence: Synthetic oligonucleotide
ggcactttacttggtacgatcatctttattttaatcatcattttcctc

SEQ ID NO: 210809 - DNA, 52 bp, Artificial Sequence
  Description of Artificial Sequence: Synthetic oligonucleotide
gcactttacttggtacgatcatctttattttaatcatcattttcctctattg

SEQ ID NO: 210810 - DNA, 52 bp, Artificial Sequence
  Description of Artificial Sequence: Synthetic oligonucleotide
cactttacttggtacgatcatctttattttaatcatcattttcctctattgg

SEQ ID NO: 210811 - DNA, 60 bp, Artificial Sequence
  Description of Artificial Sequence: Synthetic oligonucleotide
actttacttggtacgatcatctttattttaatcatcattttcctctattggataattttc

SEQ ID NO: 210812 - DNA, 59 bp, Artificial Sequence
  Description of Artificial Sequence: Synthetic oligonucleotide
ctttacttggtacgatcatctttattttaatcatcattttcctctattggataattttc

SEQ ID NO: 210813 - DNA, 60 bp, Artificial Sequence
  Description of Artificial Sequence: Synthetic oligonucleotide
tttacttggtacgatcatctttattttaatcatcattttcctctattggataattttcaa

SEQ ID NO: 210814 - DNA, 60 bp, Artificial Sequence
  Description of Artificial Sequence: Synthetic oligonucleotide
ttacttggtacgatcatctttattttaatcatcattttcctctattggataattttcaag

SEQ ID NO: 210815 - DNA, 59 bp, Artificial Sequence
  Description of Artificial Sequence: Synthetic oligonucleotide
tacttggtacgatcatctttattttaatcatcattttcctctattggataattttcaag

SEQ ID NO: 210816 - DNA, 58 bp, Artificial Sequence
  Description of Artificial Sequence: Synthetic oligonucleotide
acttggtacgatcatctttattttaatcatcattttcctctattggataattttcaag

SEQ ID NO: 210817 - DNA, 57 bp, Artificial Sequence
  Description of Artificial Sequence: Synthetic oligonucleotide
cttggtacgatcatctttattttaatcatcattttcctctattggataattttcaag

SEQ ID NO: 210818 - DNA, 57 bp, Artificial Sequence
  Description of Artificial Sequence: Synthetic oligonucleotide
ttggtacgatcatctttattttaatcatcattttcctctattggataattttcaagc

SEQ ID NO: 210819 - DNA, 56 bp, Artificial Sequence
  Description of Artificial Sequence: Synthetic oligonucleotide
tggtacgatcatctttattttaatcatcattttcctctattggataattttcaagc

SEQ ID NO: 210820 - DNA, 55 bp, Artificial Sequence
  Description of Artificial Sequence: Synthetic oligonucleotide
ggtacgatcatctttattttaatcatcattttcctctattggataattttcaagc

SEQ ID NO: 210821 - DNA, 56 bp, Artificial Sequence
  Description of Artificial Sequence: Synthetic oligonucleotide
gtacgatcatctttattttaatcatcattttcctctattggataattttcaagcac

SEQ ID NO: 210822 - DNA, 57 bp, Artificial Sequence
  Description of Artificial Sequence: Synthetic oligonucleotide
tacgatcatctttattttaatcatcattttcctctattggataattttcaagcacag

SEQ ID NO: 210823 - DNA, 56 bp, Artificial Sequence
  Description of Artificial Sequence: Synthetic oligonucleotide
acgatcatctttattttaatcatcattttcctctattggataattttcaagcacag

SEQ ID NO: 210824 - DNA, 55 bp, Artificial Sequence
  Description of Artificial Sequence: Synthetic oligonucleotide
cgatcatctttattttaatcatcattttcctctattggataattttcaagcacag

SEQ ID NO: 210825 - DNA, 60 bp, Artificial Sequence
  Description of Artificial Sequence: Synthetic oligonucleotide
gatcatctttattttaatcatcattttcctctattggataattttcaagcacagaaaaag

SEQ ID NO: 210826 - DNA, 42 bp, Artificial Sequence
  Description of Artificial Sequence: Synthetic oligonucleotide
agcttggagcaaaagtggattttgtttgtgatgaaggaaatc

SEQ ID NO: 210827 - DNA, 41 bp, Artificial Sequence
  Description of Artificial Sequence: Synthetic oligonucleotide
gcttggagcaaaagtggattttgtttgtgatgaaggaaatc

SEQ ID NO: 210828 - DNA, 45 bp, Artificial Sequence
  Description of Artificial Sequence: Synthetic oligonucleotide
cttggagcaaaagtggattttgtttgtgatgaaggaaatcttttg

SEQ ID NO: 210829 - DNA, 46 bp, Artificial Sequence
  Description of Artificial Sequence: Synthetic oligonucleotide
ttggagcaaaagtggattttgtttgtgatgaaggaaatcttttgtc

SEQ ID NO: 210830 - DNA, 45 bp, Artificial Sequence
  Description of Artificial Sequence: Synthetic oligonucleotide
tggagcaaaagtggattttgtttgtgatgaaggaaatcttttgtc

SEQ ID NO: 210831 - DNA, 44 bp, Artificial Sequence
  Description of Artificial Sequence: Synthetic oligonucleotide
ggagcaaaagtggattttgtttgtgatgaaggaaatcttttgtc

SEQ ID NO: 210832 - DNA, 44 bp, Artificial Sequence
  Description of Artificial Sequence: Synthetic oligonucleotide
gagcaaaagtggattttgtttgtgatgaaggaaatcttttgtcc

SEQ ID NO: 210833 - DNA, 46 bp, Artificial Sequence
  Description of Artificial Sequence: Synthetic oligonucleotide
agcaaaagtggattttgtttgtgatgaaggaaatcttttgtccaag

SEQ ID NO: 210834 - DNA, 45 bp, Artificial Sequence
  Description of Artificial Sequence: Synthetic oligonucleotide
gcaaaagtggattttgtttgtgatgaaggaaatcttttgtccaag

SEQ ID NO: 210835 - DNA, 46 bp, Artificial Sequence
  Description of Artificial Sequence: Synthetic oligonucleotide
caaaagtggattttgtttgtgatgaaggaaatcttttgtccaagtc

SEQ ID NO: 210836 - DNA, 46 bp, Artificial Sequence
  Description of Artificial Sequence: Synthetic oligonucleotide
aaaagtggattttgtttgtgatgaaggaaatcttttgtccaagtcc

SEQ ID NO: 210837 - DNA, 45 bp, Artificial Sequence
  Description of Artificial Sequence: Synthetic oligonucleotide
aaagtggattttgtttgtgatgaaggaaatcttttgtccaagtcc

SEQ ID NO: 210838 - DNA, 44 bp, Artificial Sequence
  Description of Artificial Sequence: Synthetic oligonucleotide
aagtggattttgtttgtgatgaaggaaatcttttgtccaagtcc

SEQ ID NO: 210839 - DNA, 43 bp, Artificial Sequence
  Description of Artificial Sequence: Synthetic oligonucleotide
agtggattttgtttgtgatgaaggaaatcttttgtccaagtcc

SEQ ID NO: 210840 - DNA, 42 bp, Artificial Sequence
  Description of Artificial Sequence: Synthetic oligonucleotide
gtggattttgtttgtgatgaaggaaatcttttgtccaagtcc

SEQ ID NO: 210841 - DNA, 43 bp, Artificial Sequence
  Description of Artificial Sequence: Synthetic oligonucleotide
tggattttgtttgtgatgaaggaaatcttttgtccaagtcctc

SEQ ID NO: 210842 - DNA, 42 bp, Artificial Sequence
  Description of Artificial Sequence: Synthetic oligonucleotide
ggattttgtttgtgatgaaggaaatcttttgtccaagtcctc

SEQ ID NO: 210843 - DNA, 42 bp, Artificial Sequence
  Description of Artificial Sequence: Synthetic oligonucleotide
gattttgtttgtgatgaaggaaatcttttgtccaagtcctcc

SEQ ID NO: 210844 - DNA, 43 bp, Artificial Sequence
  Description of Artificial Sequence: Synthetic oligonucleotide
attttgtttgtgatgaaggaaatcttttgtccaagtcctccag

SEQ ID NO: 210845 - DNA, 42 bp, Artificial Sequence
  Description of Artificial Sequence: Synthetic oligonucleotide
ttttgtttgtgatgaaggaaatcttttgtccaagtcctccag

SEQ ID NO: 210846 - DNA, 41 bp, Artificial Sequence
  Description of Artificial Sequence: Synthetic oligonucleotide
tttgtttgtgatgaaggaaatcttttgtccaagtcctccag

SEQ ID NO: 210847 - DNA, 40 bp, Artificial Sequence
  Description of Artificial Sequence: Synthetic oligonucleotide
ttgtttgtgatgaaggaaatcttttgtccaagtcctccag

SEQ ID NO: 210848 - DNA, 39 bp, Artificial Sequence
  Description of Artificial Sequence: Synthetic oligonucleotide
tgtttgtgatgaaggaaatcttttgtccaagtcctccag

SEQ ID NO: 210849 - DNA, 38 bp, Artificial Sequence
  Description of Artificial Sequence: Synthetic oligonucleotide
gtttgtgatgaaggaaatcttttgtccaagtcctccag

SEQ ID NO: 210850 - DNA, 43 bp, Artificial Sequence
  Description of Artificial Sequence: Synthetic oligonucleotide
tttgtgatgaaggaaatcttttgtccaagtcctccagttattc

SEQ ID NO: 210851 - DNA, 42 bp, Artificial Sequence
  Description of Artificial Sequence: Synthetic oligonucleotide
ttgtgatgaaggaaatcttttgtccaagtcctccagttattc

SEQ ID NO: 210852 - DNA, 41 bp, Artificial Sequence
  Description of Artificial Sequence: Synthetic oligonucleotide
tgtgatgaaggaaatcttttgtccaagtcctccagttattc

SEQ ID NO: 210853 - DNA, 40 bp, Artificial Sequence
  Description of Artificial Sequence: Synthetic oligonucleotide
gtgatgaaggaaatcttttgtccaagtcctccagttattc

SEQ ID NO: 210854 - DNA, 40 bp, Artificial Sequence
  Description of Artificial Sequence: Synthetic oligonucleotide
tgatgaaggaaatcttttgtccaagtcctccagttattcc

SEQ ID NO: 210855 - DNA, 39 bp, Artificial Sequence
  Description of Artificial Sequence: Synthetic oligonucleotide
gatgaaggaaatcttttgtccaagtcctccagttattcc

SEQ ID NO: 210856 - DNA, 43 bp, Artificial Sequence
  Description of Artificial Sequence: Synthetic oligonucleotide
atgaaggaaatcttttgtccaagtcctccagttattcctaatg

SEQ ID NO: 210857 - DNA, 42 bp, Artificial Sequence
  Description of Artificial Sequence: Synthetic oligonucleotide
tgaaggaaatcttttgtccaagtcctccagttattcctaatg

SEQ ID NO: 210858 - DNA, 41 bp, Artificial Sequence
  Description of Artificial Sequence: Synthetic oligonucleotide
gaaggaaatcttttgtccaagtcctccagttattcctaatg

SEQ ID NO: 210859 - DNA, 41 bp, Artificial Sequence
  Description of Artificial Sequence: Synthetic oligonucleotide
aaggaaatcttttgtccaagtcctccagttattcctaatgg

SEQ ID NO: 210860 - DNA, 40 bp, Artificial Sequence
  Description of Artificial Sequence: Synthetic oligonucleotide
aggaaatcttttgtccaagtcctccagttattcctaatgg

SEQ ID NO: 210861 - DNA, 39 bp, Artificial Sequence
  Description of Artificial Sequence: Synthetic oligonucleotide
ggaaatcttttgtccaagtcctccagttattcctaatgg

SEQ ID NO: 210862 - DNA, 39 bp, Artificial Sequence
  Description of Artificial Sequence: Synthetic oligonucleotide
gaaatcttttgtccaagtcctccagttattcctaatggg

SEQ ID NO: 210863 - DNA, 38 bp, Artificial Sequence
  Description of Artificial Sequence: Synthetic oligonucleotide
acaggaaaacctctggaagtctttccctttggraaarc

SEQ ID NO: 210864 - DNA, 37 bp, Artificial Sequence
  Description of Artificial Sequence: Synthetic oligonucleotide
caggaaaacctctggaagtctttccctttggraaarc

SEQ ID NO: 210865 - DNA, 38 bp, Artificial Sequence
  Description of Artificial Sequence: Synthetic oligonucleotide
aggaaaacctctggaagtctttccctttggraaarcag

SEQ ID NO: 210866 - DNA, 37 bp, Artificial Sequence
  Description of Artificial Sequence: Synthetic oligonucleotide
ggaaaacctctggaagtctttccctttggraaarcag

SEQ ID NO: 210867 - DNA, 44 bp, Artificial Sequence
  Description of Artificial Sequence: Synthetic oligonucleotide
gaaaacctctggaagtctttccctttggraaarcagtaaattac

SEQ ID NO: 210868 - DNA, 45 bp, Artificial Sequence
  Description of Artificial Sequence: Synthetic oligonucleotide
aaaacctctggaagtctttccctttggraaarcagtaaattacac

SEQ ID NO: 210869 - DNA, 44 bp, Artificial Sequence
  Description of Artificial Sequence: Synthetic oligonucleotide
aaacctctggaagtctttccctttggraaarcagtaaattacac

SEQ ID NO: 210870 - DNA, 43 bp, Artificial Sequence
  Description of Artificial Sequence: Synthetic oligonucleotide
aacctctggaagtctttccctttggraaarcagtaaattacac

SEQ ID NO: 210871 - DNA, 42 bp, Artificial Sequence
  Description of Artificial Sequence: Synthetic oligonucleotide
acctctggaagtctttccctttggraaarcagtaaattacac

SEQ ID NO: 210872 - DNA, 41 bp, Artificial Sequence
  Description of Artificial Sequence: Synthetic oligonucleotide
cctctggaagtctttccctttggraaarcagtaaattacac

SEQ ID NO: 210873 - DNA, 43 bp, Artificial Sequence
  Description of Artificial Sequence: Synthetic oligonucleotide
ctctggaagtctttccctttggraaarcagtaaattacacatg

SEQ ID NO: 210874 - DNA, 43 bp, Artificial Sequence
  Description of Artificial Sequence: Synthetic oligonucleotide
tctggaagtctttccctttggraaarcagtaaattacacatgc

SEQ ID NO: 210875 - DNA, 42 bp, Artificial Sequence
  Description of Artificial Sequence: Synthetic oligonucleotide
ctggaagtctttccctttggraaarcagtaaattacacatgc

SEQ ID NO: 210876 - DNA, 42 bp, Artificial Sequence
  Description of Artificial Sequence: Synthetic oligonucleotide
tggaagtctttccctttggraaarcagtaaattacacatgcg

SEQ ID NO: 210877 - DNA, 41 bp, Artificial Sequence
  Description of Artificial Sequence: Synthetic oligonucleotide
ggaagtctttccctttggraaarcagtaaattacacatgcg

SEQ ID NO: 210878 - DNA, 42 bp, Artificial Sequence
  Description of Artificial Sequence: Synthetic oligonucleotide
gaagtctttccctttggraaarcagtaaattacacatgcgac

SEQ ID NO: 210879 - DNA, 42 bp, Artificial Sequence
  Description of Artificial Sequence: Synthetic oligonucleotide
aagtctttccctttggraaarcagtaaattacacatgcgacc

SEQ ID NO: 210880 - DNA, 41 bp, Artificial Sequence
  Description of Artificial Sequence: Synthetic oligonucleotide
agtctttccctttggraaarcagtaaattacacatgcgacc

SEQ ID NO: 210881 - DNA, 40 bp, Artificial Sequence
  Description of Artificial Sequence: Synthetic oligonucleotide
gtctttccctttggraaarcagtaaattacacatgcgacc

SEQ ID NO: 210882 - DNA, 40 bp, Artificial Sequence
  Description of Artificial Sequence: Synthetic oligonucleotide
tctttccctttggraaarcagtaaattacacatgcgaccc

SEQ ID NO: 210883 - DNA, 39 bp, Artificial Sequence
  Description of Artificial Sequence: Synthetic oligonucleotide
ctttccctttggraaarcagtaaattacacatgcgaccc

SEQ ID NO: 210884 - DNA, 39 bp, Artificial Sequence
  Description of Artificial Sequence: Synthetic oligonucleotide
tttccctttggraaarcagtaaattacacatgcgacccc

SEQ ID NO: 210885 - DNA, 38 bp, Artificial Sequence
  Description of Artificial Sequence: Synthetic oligonucleotide
ttccctttggraaarcagtaaattacacatgcgacccc

SEQ ID NO: 210886 - DNA, 37 bp, Artificial Sequence
  Description of Artificial Sequence: Synthetic oligonucleotide
tccctttggraaarcagtaaattacacatgcgacccc

SEQ ID NO: 210887 - DNA, 36 bp, Artificial Sequence
  Description of Artificial Sequence: Synthetic oligonucleotide
ccctttggraaarcagtaaattacacatgcgacccc

SEQ ID NO: 210888 - DNA, 36 bp, Artificial Sequence
  Description of Artificial Sequence: Synthetic oligonucleotide
cctttggraaarcagtaaattacacatgcgaccccc

SEQ ID NO: 210889 - DNA, 37 bp, Artificial Sequence
  Description of Artificial Sequence: Synthetic oligonucleotide
ctttggraaarcagtaaattacacatgcgacccccac

SEQ ID NO: 210890 - DNA, 37 bp, Artificial Sequence
  Description of Artificial Sequence: Synthetic oligonucleotide
tttggraaarcagtaaattacacatgcgacccccacc

SEQ ID NO: 210891 - DNA, 36 bp, Artificial Sequence
  Description of Artificial Sequence: Synthetic oligonucleotide
ttggraaarcagtaaattacacatgcgacccccacc

SEQ ID NO: 210892 - DNA, 35 bp, Artificial Sequence
  Description of Artificial Sequence: Synthetic oligonucleotide
tggraaarcagtaaattacacatgcgacccccacc

SEQ ID NO: 210893 - DNA, 34 bp, Artificial Sequence
  Description of Artificial Sequence: Synthetic oligonucleotide
ggraaarcagtaaattacacatgcgacccccacc

SEQ ID NO: 210894 - DNA, 34 bp, Artificial Sequence
  Description of Artificial Sequence: Synthetic oligonucleotide
graaarcagtaaattacacatgcgacccccaccc

SEQ ID NO: 210895 - DNA, 35 bp, Artificial Sequence
  Description of Artificial Sequence: Synthetic oligonucleotide
raaarcagtaaattacacatgcgacccccacccag

SEQ ID NO: 210896 - DNA, 34 bp, Artificial Sequence
  Description of Artificial Sequence: Synthetic oligonucleotide
aaarcagtaaattacacatgcgacccccacccag

SEQ ID NO: 210897 - DNA, 33 bp, Artificial Sequence
  Description of Artificial Sequence: Synthetic oligonucleotide
aarcagtaaattacacatgcgacccccacccag

SEQ ID NO: 210898 - DNA, 32 bp, Artificial Sequence
  Description of Artificial Sequence: Synthetic oligonucleotide
arcagtaaattacacatgcgacccccacccag

SEQ ID NO: 210899 - DNA, 31 bp, Artificial Sequence
  Description of Artificial Sequence: Synthetic oligonucleotide
rcagtaaattacacatgcgacccccacccag

SEQ ID NO: 210900 - DNA, 35 bp, Artificial Sequence
  Description of Artificial Sequence: Synthetic oligonucleotide
attggagcacgaagccgccaatttgtcaacatttc

SEQ ID NO: 210901 - DNA, 34 bp, Artificial Sequence
  Description of Artificial Sequence: Synthetic oligonucleotide
ttggagcacgaagccgccaatttgtcaacatttc

SEQ ID NO: 210902 - DNA, 33 bp, Artificial Sequence
  Description of Artificial Sequence: Synthetic oligonucleotide
tggagcacgaagccgccaatttgtcaacatttc

SEQ ID NO: 210903 - DNA, 32 bp, Artificial Sequence
  Description of Artificial Sequence: Synthetic oligonucleotide
ggagcacgaagccgccaatttgtcaacatttc

SEQ ID NO: 210904 - DNA, 40 bp, Artificial Sequence
  Description of Artificial Sequence: Synthetic oligonucleotide
gagcacgaagccgccaatttgtcaacatttcaattaaaag

SEQ ID NO: 210905 - DNA, 40 bp, Artificial Sequence
  Description of Artificial Sequence: Synthetic oligonucleotide
agcacgaagccgccaatttgtcaacatttcaattaaaagg

SEQ ID NO: 210906 - DNA, 39 bp, Artificial Sequence
  Description of Artificial Sequence: Synthetic oligonucleotide
gcacgaagccgccaatttgtcaacatttcaattaaaagg

SEQ ID NO: 210907 - DNA, 39 bp, Artificial Sequence
  Description of Artificial Sequence: Synthetic oligonucleotide
cacgaagccgccaatttgtcaacatttcaattaaaaggc

SEQ ID NO: 210908 - DNA, 40 bp, Artificial Sequence
  Description of Artificial Sequence: Synthetic oligonucleotide
acgaagccgccaatttgtcaacatttcaattaaaaggcag

SEQ ID NO: 210909 - DNA, 39 bp, Artificial Sequence
  Description of Artificial Sequence: Synthetic oligonucleotide
cgaagccgccaatttgtcaacatttcaattaaaaggcag

SEQ ID NO: 210910 - DNA, 39 bp, Artificial Sequence
  Description of Artificial Sequence: Synthetic oligonucleotide
gaagccgccaatttgtcaacatttcaattaaaaggcagc

SEQ ID NO: 210911 - DNA, 40 bp, Artificial Sequence
  Description of Artificial Sequence: Synthetic oligonucleotide
aagccgccaatttgtcaacatttcaattaaaaggcagctc

SEQ ID NO: 210912 - DNA, 39 bp, Artificial Sequence
  Description of Artificial Sequence: Synthetic oligonucleotide
agccgccaatttgtcaacatttcaattaaaaggcagctc

SEQ ID NO: 210913 - DNA, 38 bp, Artificial Sequence
  Description of Artificial Sequence: Synthetic oligonucleotide
gccgccaatttgtcaacatttcaattaaaaggcagctc

SEQ ID NO: 210914 - DNA, 39 bp, Artificial Sequence
  Description of Artificial Sequence: Synthetic oligonucleotide
ccgccaatttgtcaacatttcaattaaaaggcagctctg

SEQ ID NO: 210915 - DNA, 39 bp, Artificial Sequence
  Description of Artificial Sequence: Synthetic oligonucleotide
cgccaatttgtcaacatttcaattaaaaggcagctctgc

SEQ ID NO: 210916 - DNA, 41 bp, Artificial Sequence
  Description of Artificial Sequence: Synthetic oligonucleotide
gccaatttgtcaacatttcaattaaaaggcagctctgctag

SEQ ID NO: 210917 - DNA, 44 bp, Artificial Sequence
  Description of Artificial Sequence: Synthetic oligonucleotide
ccaatttgtcaacatttcaattaaaaggcagctctgctagttac

SEQ ID NO: 210918 - DNA, 45 bp, Artificial Sequence
  Description of Artificial Sequence: Synthetic oligonucleotide
caatttgtcaacatttcaattaaaaggcagctctgctagttactg

SEQ ID NO: 210919 - DNA, 46 bp, Artificial Sequence
  Description of Artificial Sequence: Synthetic oligonucleotide
aatttgtcaacatttcaattaaaaggcagctctgctagttactgtg

SEQ ID NO: 210920 - DNA, 45 bp, Artificial Sequence
  Description of Artificial Sequence: Synthetic oligonucleotide
atttgtcaacatttcaattaaaaggcagctctgctagttactgtg

SEQ ID NO: 210921 - DNA, 44 bp, Artificial Sequence
  Description of Artificial Sequence: Synthetic oligonucleotide
tttgtcaacatttcaattaaaaggcagctctgctagttactgtg

SEQ ID NO: 210922 - DNA, 43 bp, Artificial Sequence
  Description of Artificial Sequence: Synthetic oligonucleotide
ttgtcaacatttcaattaaaaggcagctctgctagttactgtg

SEQ ID NO: 210923 - DNA, 42 bp, Artificial Sequence
  Description of Artificial Sequence: Synthetic oligonucleotide
tgtcaacatttcaattaaaaggcagctctgctagttactgtg

SEQ ID NO: 210924 - DNA, 41 bp, Artificial Sequence
  Description of Artificial Sequence: Synthetic oligonucleotide
gtcaacatttcaattaaaaggcagctctgctagttactgtg

SEQ ID NO: 210925 - DNA, 42 bp, Artificial Sequence
  Description of Artificial Sequence: Synthetic oligonucleotide
tcaacatttcaattaaaaggcagctctgctagttactgtgtc

SEQ ID NO: 210926 - DNA, 41 bp, Artificial Sequence
  Description of Artificial Sequence: Synthetic oligonucleotide
caacatttcaattaaaaggcagctctgctagttactgtgtc

SEQ ID NO: 210927 - DNA, 43 bp, Artificial Sequence
  Description of Artificial Sequence: Synthetic oligonucleotide
aacatttcaattaaaaggcagctctgctagttactgtgtcttg

SEQ ID NO: 210928 - DNA, 42 bp, Artificial Sequence
  Description of Artificial Sequence: Synthetic oligonucleotide
acatttcaattaaaaggcagctctgctagttactgtgtcttg

SEQ ID NO: 210929 - DNA, 41 bp, Artificial Sequence
  Description of Artificial Sequence: Synthetic oligonucleotide
catttcaattaaaaggcagctctgctagttactgtgtcttg

SEQ ID NO: 210930 - DNA, 25 bp, Artificial Sequence
  Description of Artificial Sequence: Synthetic oligonucleotide
ctgcccctcgctgtggaattctggg

SEQ ID NO: 210931 - DNA, 26 bp, Artificial Sequence
  Description of Artificial Sequence: Synthetic oligonucleotide
tgcccctcgctgtggaattctgggca

SEQ ID NO: 210932 - DNA, 25 bp, Artificial Sequence
  Description of Artificial Sequence: Synthetic oligonucleotide
gcccctcgctgtggaattctgggca

SEQ ID NO: 210933 - DNA, 25 bp, Artificial Sequence
  Description of Artificial Sequence: Synthetic oligonucleotide
cccctcgctgtggaattctgggcac

SEQ ID NO: 210934 - DNA, 25 bp, Artificial Sequence
  Description of Artificial Sequence: Synthetic oligonucleotide
ccctcgctgtggaattctgggcacc

SEQ ID NO: 210935 - DNA, 26 bp, Artificial Sequence
  Description of Artificial Sequence: Synthetic oligonucleotide
cctcgctgtggaattctgggcaccga

SEQ ID NO: 210936 - DNA, 27 bp, Artificial Sequence
  Description of Artificial Sequence: Synthetic oligonucleotide
ctcgctgtggaattctgggcaccgact

SEQ ID NO: 210937 - DNA, 27 bp, Artificial Sequence
  Description of Artificial Sequence: Synthetic oligonucleotide
tcgctgtggaattctgggcaccgactc

SEQ ID NO: 210938 - DNA, 27 bp, Artificial Sequence
  Description of Artificial Sequence: Synthetic oligonucleotide
cgctgtggaattctgggcaccgactca

SEQ ID NO: 210939 - DNA, 29 bp, Artificial Sequence
  Description of Artificial Sequence: Synthetic oligonucleotide
gctgtggaattctgggcaccgactcattg

SEQ ID NO: 210940 - DNA, 29 bp, Artificial Sequence
  Description of Artificial Sequence: Synthetic oligonucleotide
ctgtggaattctgggcaccgactcattgg

SEQ ID NO: 210941 - DNA, 30 bp, Artificial Sequence
  Description of Artificial Sequence: Synthetic oligonucleotide
tgtggaattctgggcaccgactcattggtc

SEQ ID NO: 210942 - DNA, 29 bp, Artificial Sequence
  Description of Artificial Sequence: Synthetic oligonucleotide
gtggaattctgggcaccgactcattggtc

SEQ ID NO: 210943 - DNA, 30 bp, Artificial Sequence
  Description of Artificial Sequence: Synthetic oligonucleotide
tggaattctgggcaccgactcattggtcac

SEQ ID NO: 210944 - DNA, 29 bp, Artificial Sequence
  Description of Artificial Sequence: Synthetic oligonucleotide
ggaattctgggcaccgactcattggtcac

SEQ ID NO: 210945 - DNA, 30 bp, Artificial Sequence
  Description of Artificial Sequence: Synthetic oligonucleotide
gaattctgggcaccgactcattggtcactc

SEQ ID NO: 210946 - DNA, 32 bp, Artificial Sequence
  Description of Artificial Sequence: Synthetic oligonucleotide
aattctgggcaccgactcattggtcactcatc

SEQ ID NO: 210947 - DNA, 31 bp, Artificial Sequence
  Description of Artificial Sequence: Synthetic oligonucleotide
attctgggcaccgactcattggtcactcatc

SEQ ID NO: 210948 - DNA, 30 bp, Artificial Sequence
  Description of Artificial Sequence: Synthetic oligonucleotide
ttctgggcaccgactcattggtcactcatc

SEQ ID NO: 210949 - DNA, 29 bp, Artificial Sequence
  Description of Artificial Sequence: Synthetic oligonucleotide
tctgggcaccgactcattggtcactcatc

SEQ ID NO: 210950 - DNA, 28 bp, Artificial Sequence
  Description of Artificial Sequence: Synthetic oligonucleotide
ctgggcaccgactcattggtcactcatc

SEQ ID NO: 210951 - DNA, 29 bp, Artificial Sequence
  Description of Artificial Sequence: Synthetic oligonucleotide
tgggcaccgactcattggtcactcatctg

SEQ ID NO: 210952 - DNA, 48 bp, Artificial Sequence
  Description of Artificial Sequence: Synthetic oligonucleotide
tatttctactaatgaatgcacagctccagaagttgaaaatgcaattag

SEQ ID NO: 210953 - DNA, 47 bp, Artificial Sequence
  Description of Artificial Sequence: Synthetic oligonucleotide
atttctactaatgaatgcacagctccagaagttgaaaatgcaattag

SEQ ID NO: 210954 - DNA, 46 bp, Artificial Sequence
  Description of Artificial Sequence: Synthetic oligonucleotide
tttctactaatgaatgcacagctccagaagttgaaaatgcaattag

SEQ ID NO: 210955 - DNA, 45 bp, Artificial Sequence
  Description of Artificial Sequence: Synthetic oligonucleotide
ttctactaatgaatgcacagctccagaagttgaaaatgcaattag

SEQ ID NO: 210956 - DNA, 44 bp, Artificial Sequence
  Description of Artificial Sequence: Synthetic oligonucleotide
tctactaatgaatgcacagctccagaagttgaaaatgcaattag

SEQ ID NO: 210957 - DNA, 43 bp, Artificial Sequence
  Description of Artificial Sequence: Synthetic oligonucleotide
ctactaatgaatgcacagctccagaagttgaaaatgcaattag

SEQ ID NO: 210958 - DNA, 44 bp, Artificial Sequence
  Description of Artificial Sequence: Synthetic oligonucleotide
tactaatgaatgcacagctccagaagttgaaaatgcaattagag

SEQ ID NO: 210959 - DNA, 43 bp, Artificial Sequence
  Description of Artificial Sequence: Synthetic oligonucleotide
actaatgaatgcacagctccagaagttgaaaatgcaattagag

SEQ ID NO: 210960 - DNA, 42 bp, Artificial Sequence
  Description of Artificial Sequence: Synthetic oligonucleotide
ctaatgaatgcacagctccagaagttgaaaatgcaattagag

SEQ ID NO: 210961 - DNA, 44 bp, Artificial Sequence
  Description of Artificial Sequence: Synthetic oligonucleotide
taatgaatgcacagctccagaagttgaaaatgcaattagagtac

SEQ ID NO: 210962 - DNA, 43 bp, Artificial Sequence
  Description of Artificial Sequence: Synthetic oligonucleotide
aatgaatgcacagctccagaagttgaaaatgcaattagagtac

SEQ ID NO: 210963 - DNA, 42 bp, Artificial Sequence
  Description of Artificial Sequence: Synthetic oligonucleotide
atgaatgcacagctccagaagttgaaaatgcaattagagtac

SEQ ID NO: 210964 - DNA, 41 bp, Artificial Sequence
  Description of Artificial Sequence: Synthetic oligonucleotide
tgaatgcacagctccagaagttgaaaatgcaattagagtac

SEQ ID NO: 210965 - DNA, 40 bp, Artificial Sequence
  Description of Artificial Sequence: Synthetic oligonucleotide
gaatgcacagctccagaagttgaaaatgcaattagagtac

SEQ ID NO: 210966 - DNA, 34 bp, Artificial Sequence
  Description of Artificial Sequence: Synthetic oligonucleotide
tggaccagatggagaacagctgtttgagcttatg

SEQ ID NO: 210967 - DNA, 33 bp, Artificial Sequence
  Description of Artificial Sequence: Synthetic oligonucleotide
ggaccagatggagaacagctgtttgagcttatg

SEQ ID NO: 210968 - DNA, 33 bp, Artificial Sequence
  Description of Artificial Sequence: Synthetic oligonucleotide
gaccagatggagaacagctgtttgagcttatgg

SEQ ID NO: 210969 - DNA, 33 bp, Artificial Sequence
  Description of Artificial Sequence: Synthetic oligonucleotide
accagatggagaacagctgtttgagcttatggg

SEQ ID NO: 210970 - DNA, 32 bp, Artificial Sequence
  Description of Artificial Sequence: Synthetic oligonucleotide
ccagatggagaacagctgtttgagcttatggg

SEQ ID NO: 210971 - DNA, 33 bp, Artificial Sequence
  Description of Artificial Sequence: Synthetic oligonucleotide
cagatggagaacagctgtttgagcttatgggag

SEQ ID NO: 210972 - DNA, 35 bp, Artificial Sequence
  Description of Artificial Sequence: Synthetic oligonucleotide
agatggagaacagctgtttgagcttatgggagaac

SEQ ID NO: 210973 - DNA, 34 bp, Artificial Sequence
  Description of Artificial Sequence: Synthetic oligonucleotide
gatggagaacagctgtttgagcttatgggagaac

SEQ ID NO: 210974 - DNA, 34 bp, Artificial Sequence
  Description of Artificial Sequence: Synthetic oligonucleotide
atggagaacagctgtttgagcttatgggagaacg

SEQ ID NO: 210975 - DNA, 33 bp, Artificial Sequence
  Description of Artificial Sequence: Synthetic oligonucleotide
tggagaacagctgtttgagcttatgggagaacg

SEQ ID NO: 210976 - DNA, 32 bp, Artificial Sequence
  Description of Artificial Sequence: Synthetic oligonucleotide
ggagaacagctgtttgagcttatgggagaacg

SEQ ID NO: 210977 - DNA, 32 bp, Artificial Sequence
  Description of Artificial Sequence: Synthetic oligonucleotide
gagaacagctgtttgagcttatgggagaacgg

SEQ ID NO: 210978 - DNA, 33 bp, Artificial Sequence
  Description of Artificial Sequence: Synthetic oligonucleotide
agaacagctgtttgagcttatgggagaacggtc

SEQ ID NO: 210979 - DNA, 32 bp, Artificial Sequence
  Description of Artificial Sequence: Synthetic oligonucleotide
gaacagctgtttgagcttatgggagaacggtc

SEQ ID NO: 210980 - DNA, 40 bp, Artificial Sequence
  Description of Artificial Sequence: Synthetic oligonucleotide
aacagctgtttgagcttatgggagaacggtcaatatattg

SEQ ID NO: 210981 - DNA, 39 bp, Artificial Sequence
  Description of Artificial Sequence: Synthetic oligonucleotide
acagctgtttgagcttatgggagaacggtcaatatattg

SEQ ID NO: 210982 - DNA, 38 bp, Artificial Sequence
  Description of Artificial Sequence: Synthetic oligonucleotide
cagctgtttgagcttatgggagaacggtcaatatattg

SEQ ID NO: 210983 - DNA, 38 bp, Artificial Sequence
  Description of Artificial Sequence: Synthetic oligonucleotide
agctgtttgagcttatgggagaacggtcaatatattgc

SEQ ID NO: 210984 - DNA, 37 bp, Artificial Sequence
  Description of Artificial Sequence: Synthetic oligonucleotide
gctgtttgagcttatgggagaacggtcaatatattgc

SEQ ID NO: 210985 - DNA, 38 bp, Artificial Sequence
  Description of Artificial Sequence: Synthetic oligonucleotide
ctgtttgagcttatgggagaacggtcaatatattgcac

SEQ ID NO: 210986 - DNA, 38 bp, Artificial Sequence
  Description of Artificial Sequence: Synthetic oligonucleotide
tgtttgagcttatgggagaacggtcaatatattgcacc

SEQ ID NO: 210987 - DNA, 37 bp, Artificial Sequence
  Description of Artificial Sequence: Synthetic oligonucleotide
gtttgagcttatgggagaacggtcaatatattgcacc

SEQ ID NO: 210988 - DNA, 38 bp, Artificial Sequence
  Description of Artificial Sequence: Synthetic oligonucleotide
tttgagcttatgggagaacggtcaatatattgcaccag

SEQ ID NO: 210989 - DNA, 37 bp, Artificial Sequence
  Description of Artificial Sequence: Synthetic oligonucleotide
ttgagcttatgggagaacggtcaatatattgcaccag

SEQ ID NO: 210990 - DNA, 36 bp, Artificial Sequence
  Description of Artificial Sequence: Synthetic oligonucleotide
tgagcttatgggagaacggtcaatatattgcaccag

SEQ ID NO: 210991 - DNA, 35 bp, Artificial Sequence
  Description of Artificial Sequence: Synthetic oligonucleotide
gagcttatgggagaacggtcaatatattgcaccag

SEQ ID NO: 210992 - DNA, 35 bp, Artificial Sequence
  Description of Artificial Sequence: Synthetic oligonucleotide
agcttatgggagaacggtcaatatattgcaccagc

SEQ ID NO: 210993 - DNA, 34 bp, Artificial Sequence
  Description of Artificial Sequence: Synthetic oligonucleotide
gcttatgggagaacggtcaatatattgcaccagc

SEQ ID NO: 210994 - DNA, 37 bp, Artificial Sequence
  Description of Artificial Sequence: Synthetic oligonucleotide
cttatgggagaacggtcaatatattgcaccagcaaag

SEQ ID NO: 210995 - DNA, 39 bp, Artificial Sequence
  Description of Artificial Sequence: Synthetic oligonucleotide
ttatgggagaacggtcaatatattgcaccagcaaagatg

SEQ ID NO: 210996 - DNA, 38 bp, Artificial Sequence
  Description of Artificial Sequence: Synthetic oligonucleotide
tatgggagaacggtcaatatattgcaccagcaaagatg

SEQ ID NO: 210997 - DNA, 37 bp, Artificial Sequence
  Description of Artificial Sequence: Synthetic oligonucleotide
atgggagaacggtcaatatattgcaccagcaaagatg

SEQ ID NO: 210998 - DNA, 42 bp, Artificial Sequence
  Description of Artificial Sequence: Synthetic oligonucleotide
caatggagacttctacagcaacaatagaacatcttttcacag

SEQ ID NO: 210999 - DNA, 43 bp, Artificial Sequence
  Description of Artificial Sequence: Synthetic oligonucleotide
aatggagacttctacagcaacaatagaacatcttttcacagtg

SEQ ID NO: 211000 - DNA, 42 bp, Artificial Sequence
  Description of Artificial Sequence: Synthetic oligonucleotide
atggagacttctacagcaacaatagaacatcttttcacagtg

SEQ ID NO: 211001 - DNA, 41 bp, Artificial Sequence
  Description of Artificial Sequence: Synthetic oligonucleotide
tggagacttctacagcaacaatagaacatcttttcacagtg

SEQ ID NO: 211002 - DNA, 40 bp, Artificial Sequence
  Description of Artificial Sequence: Synthetic oligonucleotide
ggagacttctacagcaacaatagaacatcttttcacagtg

SEQ ID NO: 211003 - DNA, 40 bp, Artificial Sequence
  Description of Artificial Sequence: Synthetic oligonucleotide
gagacttctacagcaacaatagaacatcttttcacagtgg

SEQ ID NO: 211004 - DNA, 42 bp, Artificial Sequence
  Description of Artificial Sequence: Synthetic oligonucleotide
agacttctacagcaacaatagaacatcttttcacagtggaac

SEQ ID NO: 211005 - DNA, 41 bp, Artificial Sequence
  Description of Artificial Sequence: Synthetic oligonucleotide
gacttctacagcaacaatagaacatcttttcacagtggaac

SEQ ID NO: 211006 - DNA, 41 bp, Artificial Sequence
  Description of Artificial Sequence: Synthetic oligonucleotide
acttctacagcaacaatagaacatcttttcacagtggaacg

SEQ ID NO: 211007 - DNA, 40 bp, Artificial Sequence
  Description of Artificial Sequence: Synthetic oligonucleotide
cttctacagcaacaatagaacatcttttcacagtggaacg

SEQ ID NO: 211008 - DNA, 40 bp, Artificial Sequence
  Description of Artificial Sequence: Synthetic oligonucleotide
ttctacagcaacaatagaacatcttttcacagtggaacgg

SEQ ID NO: 211009 - DNA, 39 bp, Artificial Sequence
  Description of Artificial Sequence: Synthetic oligonucleotide
tctacagcaacaatagaacatcttttcacagtggaacgg

SEQ ID NO: 211010 - DNA, 38 bp, Artificial Sequence
  Description of Artificial Sequence: Synthetic oligonucleotide
ctacagcaacaatagaacatcttttcacagtggaacgg

SEQ ID NO: 211011 - DNA, 39 bp, Artificial Sequence
  Description of Artificial Sequence: Synthetic oligonucleotide
tacagcaacaatagaacatcttttcacagtggaacggtg

SEQ ID NO: 211012 - DNA, 38 bp, Artificial Sequence
  Description of Artificial Sequence: Synthetic oligonucleotide
acagcaacaatagaacatcttttcacagtggaacggtg

SEQ ID NO: 211013 - DNA, 37 bp, Artificial Sequence
  Description of Artificial Sequence: Synthetic oligonucleotide
cagcaacaatagaacatcttttcacagtggaacggtg

SEQ ID NO: 211014 - DNA, 37 bp, Artificial Sequence
  Description of Artificial Sequence: Synthetic oligonucleotide
agcaacaatagaacatcttttcacagtggaacggtgg

SEQ ID NO: 211015 - DNA, 36 bp, Artificial Sequence
  Description of Artificial Sequence: Synthetic oligonucleotide
gcaacaatagaacatcttttcacagtggaacggtgg

SEQ ID NO: 211016 - DNA, 39 bp, Artificial Sequence
  Description of Artificial Sequence: Synthetic oligonucleotide
caacaatagaacatcttttcacagtggaacggtggtaac

SEQ ID NO: 211017 - DNA, 42 bp, Artificial Sequence
  Description of Artificial Sequence: Synthetic oligonucleotide
aacaatagaacatcttttcacagtggaacggtggtaacttac

SEQ ID NO: 211018 - DNA, 41 bp, Artificial Sequence
  Description of Artificial Sequence: Synthetic oligonucleotide
acaatagaacatcttttcacagtggaacggtggtaacttac

SEQ ID NO: 211019 - DNA, 40 bp, Artificial Sequence
  Description of Artificial Sequence: Synthetic oligonucleotide
caatagaacatcttttcacagtggaacggtggtaacttac

SEQ ID NO: 211020 - DNA, 40 bp, Artificial Sequence
  Description of Artificial Sequence: Synthetic oligonucleotide
aatagaacatcttttcacagtggaacggtggtaacttacc

SEQ ID NO: 211021 - DNA, 39 bp, Artificial Sequence
  Description of Artificial Sequence: Synthetic oligonucleotide
atagaacatcttttcacagtggaacggtggtaacttacc

SEQ ID NO: 211022 - DNA, 38 bp, Artificial Sequence
  Description of Artificial Sequence: Synthetic oligonucleotide
tagaacatcttttcacagtggaacggtggtaacttacc

SEQ ID NO: 211023 - DNA, 37 bp, Artificial Sequence
  Description of Artificial Sequence: Synthetic oligonucleotide
agaacatcttttcacagtggaacggtggtaacttacc

SEQ ID NO: 211024 - DNA, 36 bp, Artificial Sequence
  Description of Artificial Sequence: Synthetic oligonucleotide
gaacatcttttcacagtggaacggtggtaacttacc

SEQ ID NO: 211025 - DNA, 37 bp, Artificial Sequence
  Description of Artificial Sequence: Synthetic oligonucleotide
aacatcttttcacagtggaacggtggtaacttaccag

SEQ ID NO: 211026 - DNA, 36 bp, Artificial Sequence
  Description of Artificial Sequence: Synthetic oligonucleotide
acatcttttcacagtggaacggtggtaacttaccag

SEQ ID NO: 211027 - DNA, 35 bp, Artificial Sequence
  Description of Artificial Sequence: Synthetic oligonucleotide
catcttttcacagtggaacggtggtaacttaccag

SEQ ID NO: 211028 - DNA, 36 bp, Artificial Sequence
  Description of Artificial Sequence: Synthetic oligonucleotide
atcttttcacagtggaacggtggtaacttaccagtg

SEQ ID NO: 211029 - DNA, 35 bp, Artificial Sequence
  Description of Artificial Sequence: Synthetic oligonucleotide
tcttttcacagtggaacggtggtaacttaccagtg

SEQ ID NO: 211030 - DNA, 34 bp, Artificial Sequence
  Description of Artificial Sequence: Synthetic oligonucleotide
cttttcacagtggaacggtggtaacttaccagtg

SEQ ID NO: 211031 - DNA, 34 bp, Artificial Sequence
  Description of Artificial Sequence: Synthetic oligonucleotide
ttttcacagtggaacggtggtaacttaccagtgc

SEQ ID NO: 211032 - DNA, 33 bp, Artificial Sequence
  Description of Artificial Sequence: Synthetic oligonucleotide
tttcacagtggaacggtggtaacttaccagtgc

SEQ ID NO: 211033 - DNA, 32 bp, Artificial Sequence
  Description of Artificial Sequence: Synthetic oligonucleotide
ttcacagtggaacggtggtaacttaccagtgc

SEQ ID NO: 211034 - DNA, 31 bp, Artificial Sequence
  Description of Artificial Sequence: Synthetic oligonucleotide
tcacagtggaacggtggtaacttaccagtgc

SEQ ID NO: 211035 - DNA, 30 bp, Artificial Sequence
  Description of Artificial Sequence: Synthetic oligonucleotide
cacagtggaacggtggtaacttaccagtgc

SEQ ID NO: 211036 - DNA, 30 bp, Artificial Sequence
  Description of Artificial Sequence: Synthetic oligonucleotide
acagtggaacggtggtaacttaccagtgcc

SEQ ID NO: 211037 - DNA, 29 bp, Artificial Sequence
  Description of Artificial Sequence: Synthetic oligonucleotide
cagtggaacggtggtaacttaccagtgcc

SEQ ID NO: 211038 - DNA, 30 bp, Artificial Sequence
  Description of Artificial Sequence: Synthetic oligonucleotide
agtggaacggtggtaacttaccagtgccac

SEQ ID NO: 211039 - DNA, 29 bp, Artificial Sequence
  Description of Artificial Sequence: Synthetic oligonucleotide
gtggaacggtggtaacttaccagtgccac

SEQ ID NO: 211040 - DNA, 35 bp, Artificial Sequence
  Description of Artificial Sequence: Synthetic oligonucleotide
aggaaacaggagtttctttaccctcactgagatcg

SEQ ID NO: 211041 - DNA, 34 bp, Artificial Sequence
  Description of Artificial Sequence: Synthetic oligonucleotide
ggaaacaggagtttctttaccctcactgagatcg

SEQ ID NO: 211042 - DNA, 35 bp, Artificial Sequence
  Description of Artificial Sequence: Synthetic oligonucleotide
gaaacaggagtttctttaccctcactgagatcgtc

SEQ ID NO: 211043 - DNA, 36 bp, Artificial Sequence
  Description of Artificial Sequence: Synthetic oligonucleotide
aaacaggagtttctttaccctcactgagatcgtcag

SEQ ID NO: 211044 - DNA, 35 bp, Artificial Sequence
  Description of Artificial Sequence: Synthetic oligonucleotide
aacaggagtttctttaccctcactgagatcgtcag

SEQ ID NO: 211045 - DNA, 34 bp, Artificial Sequence
  Description of Artificial Sequence: Synthetic oligonucleotide
acaggagtttctttaccctcactgagatcgtcag

SEQ ID NO: 211046 - DNA, 33 bp, Artificial Sequence
  Description of Artificial Sequence: Synthetic oligonucleotide
caggagtttctttaccctcactgagatcgtcag

SEQ ID NO: 211047 - DNA, 38 bp, Artificial Sequence
  Description of Artificial Sequence: Synthetic oligonucleotide
aggagtttctttaccctcactgagatcgtcagatttag

SEQ ID NO: 211048 - DNA, 37 bp, Artificial Sequence
  Description of Artificial Sequence: Synthetic oligonucleotide
ggagtttctttaccctcactgagatcgtcagatttag

SEQ ID NO: 211049 - DNA, 39 bp, Artificial Sequence
  Description of Artificial Sequence: Synthetic oligonucleotide
gagtttctttaccctcactgagatcgtcagatttagatg

SEQ ID NO: 211050 - DNA, 40 bp, Artificial Sequence
  Description of Artificial Sequence: Synthetic oligonucleotide
agtttctttaccctcactgagatcgtcagatttagatgtc

SEQ ID NO: 211051 - DNA, 39 bp, Artificial Sequence
  Description of Artificial Sequence: Synthetic oligonucleotide
gtttctttaccctcactgagatcgtcagatttagatgtc

SEQ ID NO: 211052 - DNA, 40 bp, Artificial Sequence
  Description of Artificial Sequence: Synthetic oligonucleotide
tttctttaccctcactgagatcgtcagatttagatgtcag

SEQ ID NO: 211053 - DNA, 39 bp, Artificial Sequence
  Description of Artificial Sequence: Synthetic oligonucleotide
ttctttaccctcactgagatcgtcagatttagatgtcag

SEQ ID NO: 211054 - DNA, 38 bp, Artificial Sequence
  Description of Artificial Sequence: Synthetic oligonucleotide
tctttaccctcactgagatcgtcagatttagatgtcag

SEQ ID NO: 211055 - DNA, 37 bp, Artificial Sequence
  Description of Artificial Sequence: Synthetic oligonucleotide
ctttaccctcactgagatcgtcagatttagatgtcag

SEQ ID NO: 211056 - DNA, 37 bp, Artificial Sequence
  Description of Artificial Sequence: Synthetic oligonucleotide
tttaccctcactgagatcgtcagatttagatgtcagc

SEQ ID NO: 211057 - DNA, 36 bp, Artificial Sequence
  Description of Artificial Sequence: Synthetic oligonucleotide
ttaccctcactgagatcgtcagatttagatgtcagc

SEQ ID NO: 211058 - DNA, 35 bp, Artificial Sequence
  Description of Artificial Sequence: Synthetic oligonucleotide
taccctcactgagatcgtcagatttagatgtcagc

SEQ ID NO: 211059 - DNA, 34 bp, Artificial Sequence
  Description of Artificial Sequence: Synthetic oligonucleotide
accctcactgagatcgtcagatttagatgtcagc

SEQ ID NO: 211060 - DNA, 46 bp, Artificial Sequence
  Description of Artificial Sequence: Synthetic oligonucleotide
catccagttcggatcccaaattaaatattcttgtactaaaggatac

SEQ ID NO: 211061 - DNA, 46 bp, Artificial Sequence
  Description of Artificial Sequence: Synthetic oligonucleotide
atccagttcggatcccaaattaaatattcttgtactaaaggatacc

SEQ ID NO: 211062 - DNA, 45 bp, Artificial Sequence
  Description of Artificial Sequence: Synthetic oligonucleotide
tccagttcggatcccaaattaaatattcttgtactaaaggatacc

SEQ ID NO: 211063 - DNA, 44 bp, Artificial Sequence
  Description of Artificial Sequence: Synthetic oligonucleotide
ccagttcggatcccaaattaaatattcttgtactaaaggatacc

SEQ ID NO: 211064 - DNA, 44 bp, Artificial Sequence
  Description of Artificial Sequence: Synthetic oligonucleotide
cagttcggatcccaaattaaatattcttgtactaaaggataccg

SEQ ID NO: 211065 - DNA, 45 bp, Artificial Sequence
  Description of Artificial Sequence: Synthetic oligonucleotide
agttcggatcccaaattaaatattcttgtactaaaggataccgac

SEQ ID NO: 211066 - DNA, 44 bp, Artificial Sequence
  Description of Artificial Sequence: Synthetic oligonucleotide
gttcggatcccaaattaaatattcttgtactaaaggataccgac

SEQ ID NO: 211067 - DNA, 45 bp, Artificial Sequence
  Description of Artificial Sequence: Synthetic oligonucleotide
ttcggatcccaaattaaatattcttgtactaaaggataccgactc

SEQ ID NO: 211068 - DNA, 44 bp, Artificial Sequence
  Description of Artificial Sequence: Synthetic oligonucleotide
tcggatcccaaattaaatattcttgtactaaaggataccgactc

SEQ ID NO: 211069 - DNA, 43 bp, Artificial Sequence
  Description of Artificial Sequence: Synthetic oligonucleotide
cggatcccaaattaaatattcttgtactaaaggataccgactc

SEQ ID NO: 211070 - DNA, 46 bp, Artificial Sequence
  Description of Artificial Sequence: Synthetic oligonucleotide
ggatcccaaattaaatattcttgtactaaaggataccgactcattg

SEQ ID NO: 211071 - DNA, 46 bp, Artificial Sequence
  Description of Artificial Sequence: Synthetic oligonucleotide
gatcccaaattaaatattcttgtactaaaggataccgactcattgg

SEQ ID NO: 211072 - DNA, 48 bp, Artificial Sequence
  Description of Artificial Sequence: Synthetic oligonucleotide
atcccaaattaaatattcttgtactaaaggataccgactcattggttc

SEQ ID NO: 211073 - DNA, 47 bp, Artificial Sequence
  Description of Artificial Sequence: Synthetic oligonucleotide
tcccaaattaaatattcttgtactaaaggataccgactcattggttc

SEQ ID NO: 211074 - DNA, 46 bp, Artificial Sequence
  Description of Artificial Sequence: Synthetic oligonucleotide
cccaaattaaatattcttgtactaaaggataccgactcattggttc

SEQ ID NO: 211075 - DNA, 46 bp, Artificial Sequence
  Description of Artificial Sequence: Synthetic oligonucleotide
ccaaattaaatattcttgtactaaaggataccgactcattggttcc

SEQ ID NO: 211076 - DNA, 47 bp, Artificial Sequence
  Description of Artificial Sequence: Synthetic oligonucleotide
caaattaaatattcttgtactaaaggataccgactcattggttcctc

SEQ ID NO: 211077 - DNA, 47 bp, Artificial Sequence
  Description of Artificial Sequence: Synthetic oligonucleotide
aaattaaatattcttgtactaaaggataccgactcattggttcctcg

SEQ ID NO: 211078 - DNA, 46 bp, Artificial Sequence
  Description of Artificial Sequence: Synthetic oligonucleotide
aattaaatattcttgtactaaaggataccgactcattggttcctcg

SEQ ID NO: 211079 - DNA, 45 bp, Artificial Sequence
  Description of Artificial Sequence: Synthetic oligonucleotide
attaaatattcttgtactaaaggataccgactcattggttcctcg

SEQ ID NO: 211080 - DNA, 44 bp, Artificial Sequence
  Description of Artificial Sequence: Synthetic oligonucleotide
ttaaatattcttgtactaaaggataccgactcattggttcctcg

SEQ ID NO: 211081 - DNA, 43 bp, Artificial Sequence
  Description of Artificial Sequence: Synthetic oligonucleotide
taaatattcttgtactaaaggataccgactcattggttcctcg

SEQ ID NO: 211082 - DNA, 42 bp, Artificial Sequence
  Description of Artificial Sequence: Synthetic oligonucleotide
aaatattcttgtactaaaggataccgactcattggttcctcg

SEQ ID NO: 211083 - DNA, 41 bp, Artificial Sequence
  Description of Artificial Sequence: Synthetic oligonucleotide
aatattcttgtactaaaggataccgactcattggttcctcg

SEQ ID NO: 211084 - DNA, 40 bp, Artificial Sequence
  Description of Artificial Sequence: Synthetic oligonucleotide
atattcttgtactaaaggataccgactcattggttcctcg

SEQ ID NO: 211085 - DNA, 39 bp, Artificial Sequence
  Description of Artificial Sequence: Synthetic oligonucleotide
tattcttgtactaaaggataccgactcattggttcctcg

SEQ ID NO: 211086 - DNA, 38 bp, Artificial Sequence
  Description of Artificial Sequence: Synthetic oligonucleotide
attcttgtactaaaggataccgactcattggttcctcg

SEQ ID NO: 211087 - DNA, 37 bp, Artificial Sequence
  Description of Artificial Sequence: Synthetic oligonucleotide
ttcttgtactaaaggataccgactcattggttcctcg

SEQ ID NO: 211088 - DNA, 36 bp, Artificial Sequence
  Description of Artificial Sequence: Synthetic oligonucleotide
tcttgtactaaaggataccgactcattggttcctcg

SEQ ID NO: 211089 - DNA, 35 bp, Artificial Sequence
  Description of Artificial Sequence: Synthetic oligonucleotide
cttgtactaaaggataccgactcattggttcctcg

SEQ ID NO: 211090 - DNA, 36 bp, Artificial Sequence
  Description of Artificial Sequence: Synthetic oligonucleotide
ttgtactaaaggataccgactcattggttcctcgtc

SEQ ID NO: 211091 - DNA, 35 bp, Artificial Sequence
  Description of Artificial Sequence: Synthetic oligonucleotide
tgtactaaaggataccgactcattggttcctcgtc

SEQ ID NO: 211092 - DNA, 34 bp, Artificial Sequence
  Description of Artificial Sequence: Synthetic oligonucleotide
gtactaaaggataccgactcattggttcctcgtc

SEQ ID NO: 211093 - DNA, 35 bp, Artificial Sequence
  Description of Artificial Sequence: Synthetic oligonucleotide
tactaaaggataccgactcattggttcctcgtctg

SEQ ID NO: 211094 - DNA, 34 bp, Artificial Sequence
  Description of Artificial Sequence: Synthetic oligonucleotide
actaaaggataccgactcattggttcctcgtctg

SEQ ID NO: 211095 - DNA, 33 bp, Artificial Sequence
  Description of Artificial Sequence: Synthetic oligonucleotide
ctaaaggataccgactcattggttcctcgtctg

SEQ ID NO: 211096 - DNA, 33 bp, Artificial Sequence
  Description of Artificial Sequence: Synthetic oligonucleotide
taaaggataccgactcattggttcctcgtctgc

SEQ ID NO: 211097 - DNA, 32 bp, Artificial Sequence
  Description of Artificial Sequence: Synthetic oligonucleotide
aaaggataccgactcattggttcctcgtctgc

SEQ ID NO: 211098 - DNA, 31 bp, Artificial Sequence
  Description of Artificial Sequence: Synthetic oligonucleotide
aaggataccgactcattggttcctcgtctgc

SEQ ID NO: 211099 - DNA, 30 bp, Artificial Sequence
  Description of Artificial Sequence: Synthetic oligonucleotide
aggataccgactcattggttcctcgtctgc

SEQ ID NO: 211100 - DNA, 35 bp, Artificial Sequence
  Description of Artificial Sequence: Synthetic oligonucleotide
aggaaaacctctggaagtctttccctttgggaaag

SEQ ID NO: 211101 - DNA, 34 bp, Artificial Sequence
  Description of Artificial Sequence: Synthetic oligonucleotide
ggaaaacctctggaagtctttccctttgggaaag

SEQ ID NO: 211102 - DNA, 34 bp, Artificial Sequence
  Description of Artificial Sequence: Synthetic oligonucleotide
gaaaacctctggaagtctttccctttgggaaagc

SEQ ID NO: 211103 - DNA, 35 bp, Artificial Sequence
  Description of Artificial Sequence: Synthetic oligonucleotide
aaaacctctggaagtctttccctttgggaaagcag

SEQ ID NO: 211104 - DNA, 34 bp, Artificial Sequence
  Description of Artificial Sequence: Synthetic oligonucleotide
aaacctctggaagtctttccctttgggaaagcag

SEQ ID NO: 211105 - DNA, 33 bp, Artificial Sequence
  Description of Artificial Sequence: Synthetic oligonucleotide
aacctctggaagtctttccctttgggaaagcag

SEQ ID NO: 211106 - DNA, 32 bp, Artificial Sequence
  Description of Artificial Sequence: Synthetic oligonucleotide
acctctggaagtctttccctttgggaaagcag

SEQ ID NO: 211107 - DNA, 31 bp, Artificial Sequence
  Description of Artificial Sequence: Synthetic oligonucleotide
cctctggaagtctttccctttgggaaagcag

SEQ ID NO: 211108 - DNA, 38 bp, Artificial Sequence
  Description of Artificial Sequence: Synthetic oligonucleotide
ctctggaagtctttccctttgggaaagcagtaaattac

SEQ ID NO: 211109 - DNA, 39 bp, Artificial Sequence
  Description of Artificial Sequence: Synthetic oligonucleotide
tctggaagtctttccctttgggaaagcagtaaattacac

SEQ ID NO: 211110 - DNA, 38 bp, Artificial Sequence
  Description of Artificial Sequence: Synthetic oligonucleotide
ctggaagtctttccctttgggaaagcagtaaattacac

SEQ ID NO: 211111 - DNA, 40 bp, Artificial Sequence
  Description of Artificial Sequence: Synthetic oligonucleotide
tggaagtctttccctttgggaaagcagtaaattacacatg

SEQ ID NO: 211112 - DNA, 39 bp, Artificial Sequence
  Description of Artificial Sequence: Synthetic oligonucleotide
ggaagtctttccctttgggaaagcagtaaattacacatg

SEQ ID NO: 211113 - DNA, 39 bp, Artificial Sequence
  Description of Artificial Sequence: Synthetic oligonucleotide
gaagtctttccctttgggaaagcagtaaattacacatgc

SEQ ID NO: 211114 - DNA, 39 bp, Artificial Sequence
  Description of Artificial Sequence: Synthetic oligonucleotide
aagtctttccctttgggaaagcagtaaattacacatgcg

SEQ ID NO: 211115 - DNA, 38 bp, Artificial Sequence
  Description of Artificial Sequence: Synthetic oligonucleotide
agtctttccctttgggaaagcagtaaattacacatgcg

SEQ ID NO: 211116 - DNA, 37 bp, Artificial Sequence
  Description of Artificial Sequence: Synthetic oligonucleotide
gtctttccctttgggaaagcagtaaattacacatgcg

SEQ ID NO: 211117 - DNA, 38 bp, Artificial Sequence
  Description of Artificial Sequence: Synthetic oligonucleotide
tctttccctttgggaaagcagtaaattacacatgcgac

SEQ ID NO: 211118 - DNA, 37 bp, Artificial Sequence
  Description of Artificial Sequence: Synthetic oligonucleotide
ctttccctttgggaaagcagtaaattacacatgcgac

SEQ ID NO: 211119 - DNA, 37 bp, Artificial Sequence
  Description of Artificial Sequence: Synthetic oligonucleotide
tttccctttgggaaagcagtaaattacacatgcgacc

SEQ ID NO: 211120 - DNA, 36 bp, Artificial Sequence
  Description of Artificial Sequence: Synthetic oligonucleotide
ttccctttgggaaagcagtaaattacacatgcgacc

SEQ ID NO: 211121 - DNA, 35 bp, Artificial Sequence
  Description of Artificial Sequence: Synthetic oligonucleotide
tccctttgggaaagcagtaaattacacatgcgacc

SEQ ID NO: 211122 - DNA, 34 bp, Artificial Sequence
  Description of Artificial Sequence: Synthetic oligonucleotide
ccctttgggaaagcagtaaattacacatgcgacc

SEQ ID NO: 211123 - DNA, 34 bp, Artificial Sequence
  Description of Artificial Sequence: Synthetic oligonucleotide
cctttgggaaagcagtaaattacacatgcgaccc

SEQ ID NO: 211124 - DNA, 34 bp, Artificial Sequence
  Description of Artificial Sequence: Synthetic oligonucleotide
ctttgggaaagcagtaaattacacatgcgacccc

SEQ ID NO: 211125 - DNA, 34 bp, Artificial Sequence
  Description of Artificial Sequence: Synthetic oligonucleotide
tttgggaaagcagtaaattacacatgcgaccccc

SEQ ID NO: 211126 - DNA, 33 bp, Artificial Sequence
  Description of Artificial Sequence: Synthetic oligonucleotide
ttgggaaagcagtaaattacacatgcgaccccc

SEQ ID NO: 211127 - DNA, 32 bp, Artificial Sequence
  Description of Artificial Sequence: Synthetic oligonucleotide
tgggaaagcagtaaattacacatgcgaccccc

SEQ ID NO: 211128 - DNA, 31 bp, Artificial Sequence
  Description of Artificial Sequence: Synthetic oligonucleotide
gggaaagcagtaaattacacatgcgaccccc

SEQ ID NO: 211129 - DNA, 32 bp, Artificial Sequence
  Description of Artificial Sequence: Synthetic oligonucleotide
ggaaagcagtaaattacacatgcgacccccac

SEQ ID NO: 211130 - DNA, 32 bp, Artificial Sequence
  Description of Artificial Sequence: Synthetic oligonucleotide
gaaagcagtaaattacacatgcgacccccacc

SEQ ID NO: 211131 - DNA, 31 bp, Artificial Sequence
  Description of Artificial Sequence: Synthetic oligonucleotide
cctcgctgtggaattctgggtcactgttaag

SEQ ID NO: 211132 - DNA, 31 bp, Artificial Sequence
  Description of Artificial Sequence: Synthetic oligonucleotide
ctcgctgtggaattctgggtcactgttaagc

SEQ ID NO: 211133 - DNA, 31 bp, Artificial Sequence
  Description of Artificial Sequence: Synthetic oligonucleotide
tcgctgtggaattctgggtcactgttaagcc

SEQ ID NO: 211134 - DNA, 30 bp, Artificial Sequence
  Description of Artificial Sequence: Synthetic oligonucleotide
cgctgtggaattctgggtcactgttaagcc

SEQ ID NO: 211135 - DNA, 30 bp, Artificial Sequence
  Description of Artificial Sequence: Synthetic oligonucleotide
gctgtggaattctgggtcactgttaagccc

SEQ ID NO: 211136 - DNA, 30 bp, Artificial Sequence
  Description of Artificial Sequence: Synthetic oligonucleotide
ctgtggaattctgggtcactgttaagcccc

SEQ ID NO: 211137 - DNA, 31 bp, Artificial Sequence
  Description of Artificial Sequence: Synthetic oligonucleotide
tgtggaattctgggtcactgttaagccccag

SEQ ID NO: 211138 - DNA, 30 bp, Artificial Sequence
  Description of Artificial Sequence: Synthetic oligonucleotide
gtggaattctgggtcactgttaagccccag

SEQ ID NO: 211139 - DNA, 32 bp, Artificial Sequence
  Description of Artificial Sequence: Synthetic oligonucleotide
tggaattctgggtcactgttaagccccagatc

SEQ ID NO: 211140 - DNA, 31 bp, Artificial Sequence
  Description of Artificial Sequence: Synthetic oligonucleotide
ggaattctgggtcactgttaagccccagatc

SEQ ID NO: 211141 - DNA, 36 bp, Artificial Sequence
  Description of Artificial Sequence: Synthetic oligonucleotide
gaattctgggtcactgttaagccccagatcattttc

SEQ ID NO: 211142 - DNA, 37 bp, Artificial Sequence
  Description of Artificial Sequence: Synthetic oligonucleotide
aattctgggtcactgttaagccccagatcattttctg

SEQ ID NO: 211143 - DNA, 36 bp, Artificial Sequence
  Description of Artificial Sequence: Synthetic oligonucleotide
attctgggtcactgttaagccccagatcattttctg

SEQ ID NO: 211144 - DNA, 35 bp, Artificial Sequence
  Description of Artificial Sequence: Synthetic oligonucleotide
ttctgggtcactgttaagccccagatcattttctg

SEQ ID NO: 211145 - DNA, 34 bp, Artificial Sequence
  Description of Artificial Sequence: Synthetic oligonucleotide
tctgggtcactgttaagccccagatcattttctg

SEQ ID NO: 211146 - DNA, 33 bp, Artificial Sequence
  Description of Artificial Sequence: Synthetic oligonucleotide
ctgggtcactgttaagccccagatcattttctg

SEQ ID NO: 211147 - DNA, 36 bp, Artificial Sequence
  Description of Artificial Sequence: Synthetic oligonucleotide
tgggtcactgttaagccccagatcattttctgtttg

SEQ ID NO: 211148 - DNA, 35 bp, Artificial Sequence
  Description of Artificial Sequence: Synthetic oligonucleotide
gggtcactgttaagccccagatcattttctgtttg

SEQ ID NO: 211149 - DNA, 35 bp, Artificial Sequence
  Description of Artificial Sequence: Synthetic oligonucleotide
ggtcactgttaagccccagatcattttctgtttgc

SEQ ID NO: 211150 - DNA, 35 bp, Artificial Sequence
  Description of Artificial Sequence: Synthetic oligonucleotide
gtcactgttaagccccagatcattttctgtttgcc

SEQ ID NO: 211151 - DNA, 37 bp, Artificial Sequence
  Description of Artificial Sequence: Synthetic oligonucleotide
tcactgttaagccccagatcattttctgtttgccaag

SEQ ID NO: 211152 - DNA, 36 bp, Artificial Sequence
  Description of Artificial Sequence: Synthetic oligonucleotide
cactgttaagccccagatcattttctgtttgccaag

SEQ ID NO: 211153 - DNA, 38 bp, Artificial Sequence
  Description of Artificial Sequence: Synthetic oligonucleotide
actgttaagccccagatcattttctgtttgccaagttg

SEQ ID NO: 211154 - DNA, 37 bp, Artificial Sequence
  Description of Artificial Sequence: Synthetic oligonucleotide
ctgttaagccccagatcattttctgtttgccaagttg

SEQ ID NO: 211155 - DNA, 41 bp, Artificial Sequence
  Description of Artificial Sequence: Synthetic oligonucleotide
tgttaagccccagatcattttctgtttgccaagttgaaaac

SEQ ID NO: 211156 - DNA, 40 bp, Artificial Sequence
  Description of Artificial Sequence: Synthetic oligonucleotide
gttaagccccagatcattttctgtttgccaagttgaaaac

SEQ ID NO: 211157 - DNA, 40 bp, Artificial Sequence
  Description of Artificial Sequence: Synthetic oligonucleotide
ttaagccccagatcattttctgtttgccaagttgaaaacc

SEQ ID NO: 211158 - DNA, 39 bp, Artificial Sequence
  Description of Artificial Sequence: Synthetic oligonucleotide
taagccccagatcattttctgtttgccaagttgaaaacc

SEQ ID NO: 211159 - DNA, 27 bp, Artificial Sequence
  Description of Artificial Sequence: Synthetic oligonucleotide
gcctccagaaatcctgcatggtgagcg

SEQ ID NO: 211160 - DNA, 29 bp, Artificial Sequence
  Description of Artificial Sequence: Synthetic oligonucleotide
cctccagaaatcctgcatggtgagcgtac

SEQ ID NO: 211161 - DNA, 29 bp, Artificial Sequence
  Description of Artificial Sequence: Synthetic oligonucleotide
ctccagaaatcctgcatggtgagcgtacc

SEQ ID NO: 211162 - DNA, 29 bp, Artificial Sequence
  Description of Artificial Sequence: Synthetic oligonucleotide
tccagaaatcctgcatggtgagcgtaccc

SEQ ID NO: 211163 - DNA, 28 bp, Artificial Sequence
  Description of Artificial Sequence: Synthetic oligonucleotide
ccagaaatcctgcatggtgagcgtaccc

SEQ ID NO: 211164 - DNA, 28 bp, Artificial Sequence
  Description of Artificial Sequence: Synthetic oligonucleotide
cagaaatcctgcatggtgagcgtacccc

SEQ ID NO: 211165 - DNA, 30 bp, Artificial Sequence
  Description of Artificial Sequence: Synthetic oligonucleotide
agaaatcctgcatggtgagcgtaccccaag

SEQ ID NO: 211166 - DNA, 29 bp, Artificial Sequence
  Description of Artificial Sequence: Synthetic oligonucleotide
gaaatcctgcatggtgagcgtaccccaag

SEQ ID NO: 211167 - DNA, 29 bp, Artificial Sequence
  Description of Artificial Sequence: Synthetic oligonucleotide
aaatcctgcatggtgagcgtaccccaagc

SEQ ID NO: 211168 - DNA, 28 bp, Artificial Sequence
  Description of Artificial Sequence: Synthetic oligonucleotide
aatcctgcatggtgagcgtaccccaagc

SEQ ID NO: 211169 - DNA, 27 bp, Artificial Sequence
  Description of Artificial Sequence: Synthetic oligonucleotide
atcctgcatggtgagcgtaccccaagc

SEQ ID NO: 211170 - DNA, 26 bp, Artificial Sequence
  Description of Artificial Sequence: Synthetic oligonucleotide
tcctgcatggtgagcgtaccccaagc

SEQ ID NO: 211171 - DNA, 25 bp, Artificial Sequence
  Description of Artificial Sequence: Synthetic oligonucleotide
cctgcatggtgagcgtaccccaagc

SEQ ID NO: 211172 - DNA, 27 bp, Artificial Sequence
  Description of Artificial Sequence: Synthetic oligonucleotide
ctgcatggtgagcgtaccccaagccat

SEQ ID NO: 211173 - DNA, 27 bp, Artificial Sequence
  Description of Artificial Sequence: Synthetic oligonucleotide
tgcatggtgagcgtaccccaagccatc

SEQ ID NO: 211174 - DNA, 27 bp, Artificial Sequence
  Description of Artificial Sequence: Synthetic oligonucleotide
gcatggtgagcgtaccccaagccatca

SEQ ID NO: 211175 - DNA, 27 bp, Artificial Sequence
  Description of Artificial Sequence: Synthetic oligonucleotide
catggtgagcgtaccccaagccatcag

SEQ ID NO: 211176 - DNA, 27 bp, Artificial Sequence
  Description of Artificial Sequence: Synthetic oligonucleotide
atggtgagcgtaccccaagccatcagg

SEQ ID NO: 211177 - DNA, 27 bp, Artificial Sequence
  Description of Artificial Sequence: Synthetic oligonucleotide
tggtgagcgtaccccaagccatcagga

SEQ ID NO: 211178 - DNA, 26 bp, Artificial Sequence
  Description of Artificial Sequence: Synthetic oligonucleotide
ggtgagcgtaccccaagccatcagga

SEQ ID NO: 211179 - DNA, 27 bp, Artificial Sequence
  Description of Artificial Sequence: Synthetic oligonucleotide
gtgagcgtaccccaagccatcaggaca

SEQ ID NO: 211180 - DNA, 28 bp, Artificial Sequence
  Description of Artificial Sequence: Synthetic oligonucleotide
tgagcgtaccccaagccatcaggacaac

SEQ ID NO: 211181 - DNA, 27 bp, Artificial Sequence
  Description of Artificial Sequence: Synthetic oligonucleotide
gagcgtaccccaagccatcaggacaac

SEQ ID NO: 211182 - DNA, 31 bp, Artificial Sequence
  Description of Artificial Sequence: Synthetic oligonucleotide
agcgtaccccaagccatcaggacaacttttc

SEQ ID NO: 211183 - DNA, 30 bp, Artificial Sequence
  Description of Artificial Sequence: Synthetic oligonucleotide
gcgtaccccaagccatcaggacaacttttc

SEQ ID NO: 211184 - DNA, 31 bp, Artificial Sequence
  Description of Artificial Sequence: Synthetic oligonucleotide
cgtaccccaagccatcaggacaacttttcac

SEQ ID NO: 211185 - DNA, 31 bp, Artificial Sequence
  Description of Artificial Sequence: Synthetic oligonucleotide
gtaccccaagccatcaggacaacttttcacc

SEQ ID NO: 211186 - DNA, 41 bp, Artificial Sequence
  Description of Artificial Sequence: Synthetic oligonucleotide
gttggatccagaatcaactattcttgtactacagggaattc

SEQ ID NO: 211187 - DNA, 41 bp, Artificial Sequence
  Description of Artificial Sequence: Synthetic oligonucleotide
ttggatccagaatcaactattcttgtactacagggaattcc

SEQ ID NO: 211188 - DNA, 40 bp, Artificial Sequence
  Description of Artificial Sequence: Synthetic oligonucleotide
tggatccagaatcaactattcttgtactacagggaattcc

SEQ ID NO: 211189 - DNA, 39 bp, Artificial Sequence
  Description of Artificial Sequence: Synthetic oligonucleotide
ggatccagaatcaactattcttgtactacagggaattcc

SEQ ID NO: 211190 - DNA, 41 bp, Artificial Sequence
  Description of Artificial Sequence: Synthetic oligonucleotide
gatccagaatcaactattcttgtactacagggaattccttg

SEQ ID NO: 211191 - DNA, 42 bp, Artificial Sequence
  Description of Artificial Sequence: Synthetic oligonucleotide
atccagaatcaactattcttgtactacagggaattccttgtg

SEQ ID NO: 211192 - DNA, 41 bp, Artificial Sequence
  Description of Artificial Sequence: Synthetic oligonucleotide
tccagaatcaactattcttgtactacagggaattccttgtg

SEQ ID NO: 211193 - DNA, 40 bp, Artificial Sequence
  Description of Artificial Sequence: Synthetic oligonucleotide
ccagaatcaactattcttgtactacagggaattccttgtg

SEQ ID NO: 211194 - DNA, 40 bp, Artificial Sequence
  Description of Artificial Sequence: Synthetic oligonucleotide
cagaatcaactattcttgtactacagggaattccttgtgg

SEQ ID NO: 211195 - DNA, 40 bp, Artificial Sequence
  Description of Artificial Sequence: Synthetic oligonucleotide
agaatcaactattcttgtactacagggaattccttgtggg

SEQ ID NO: 211196 - DNA, 39 bp, Artificial Sequence
  Description of Artificial Sequence: Synthetic oligonucleotide
gaatcaactattcttgtactacagggaattccttgtggg

SEQ ID NO: 211197 - DNA, 39 bp, Artificial Sequence
  Description of Artificial Sequence: Synthetic oligonucleotide
aatcaactattcttgtactacagggaattccttgtgggc

SEQ ID NO: 211198 - DNA, 38 bp, Artificial Sequence
  Description of Artificial Sequence: Synthetic oligonucleotide
atcaactattcttgtactacagggaattccttgtgggc

SEQ ID NO: 211199 - DNA, 37 bp, Artificial Sequence
  Description of Artificial Sequence: Synthetic oligonucleotide
tcaactattcttgtactacagggaattccttgtgggc

SEQ ID NO: 211200 - DNA, 36 bp, Artificial Sequence
  Description of Artificial Sequence: Synthetic oligonucleotide
caactattcttgtactacagggaattccttgtgggc

SEQ ID NO: 211201 - DNA, 38 bp, Artificial Sequence
  Description of Artificial Sequence: Synthetic oligonucleotide
aactattcttgtactacagggaattccttgtgggctac

SEQ ID NO: 211202 - DNA, 37 bp, Artificial Sequence
  Description of Artificial Sequence: Synthetic oligonucleotide
actattcttgtactacagggaattccttgtgggctac

SEQ ID NO: 211203 - DNA, 36 bp, Artificial Sequence
  Description of Artificial Sequence: Synthetic oligonucleotide
ctattcttgtactacagggaattccttgtgggctac

SEQ ID NO: 211204 - DNA, 36 bp, Artificial Sequence
  Description of Artificial Sequence: Synthetic oligonucleotide
tattcttgtactacagggaattccttgtgggctacc

SEQ ID NO: 211205 - DNA, 35 bp, Artificial Sequence
  Description of Artificial Sequence: Synthetic oligonucleotide
attcttgtactacagggaattccttgtgggctacc

SEQ ID NO: 211206 - DNA, 34 bp, Artificial Sequence
  Description of Artificial Sequence: Synthetic oligonucleotide
ttcttgtactacagggaattccttgtgggctacc

SEQ ID NO: 211207 - DNA, 33 bp, Artificial Sequence
  Description of Artificial Sequence: Synthetic oligonucleotide
tcttgtactacagggaattccttgtgggctacc

SEQ ID NO: 211208 - DNA, 32 bp, Artificial Sequence
  Description of Artificial Sequence: Synthetic oligonucleotide
cttgtactacagggaattccttgtgggctacc

SEQ ID NO: 211209 - DNA, 32 bp, Artificial Sequence
  Description of Artificial Sequence: Synthetic oligonucleotide
ttgtactacagggaattccttgtgggctaccc

SEQ ID NO: 211210 - DNA, 31 bp, Artificial Sequence
  Description of Artificial Sequence: Synthetic oligonucleotide
tgtactacagggaattccttgtgggctaccc

SEQ ID NO: 211211 - DNA, 30 bp, Artificial Sequence
  Description of Artificial Sequence: Synthetic oligonucleotide
gtactacagggaattccttgtgggctaccc

SEQ ID NO: 211212 - DNA, 30 bp, Artificial Sequence
  Description of Artificial Sequence: Synthetic oligonucleotide
tactacagggaattccttgtgggctacccc

SEQ ID NO: 211213 - DNA, 29 bp, Artificial Sequence
  Description of Artificial Sequence: Synthetic oligonucleotide
actacagggaattccttgtgggctacccc

SEQ ID NO: 211214 - DNA, 28 bp, Artificial Sequence
  Description of Artificial Sequence: Synthetic oligonucleotide
ctacagggaattccttgtgggctacccc

SEQ ID NO: 211215 - DNA, 28 bp, Artificial Sequence
  Description of Artificial Sequence: Synthetic oligonucleotide
tacagggaattccttgtgggctaccccc

SEQ ID NO: 211216 - DNA, 27 bp, Artificial Sequence
  Description of Artificial Sequence: Synthetic oligonucleotide
acagggaattccttgtgggctaccccc

SEQ ID NO: 211217 - DNA, 26 bp, Artificial Sequence
  Description of Artificial Sequence: Synthetic oligonucleotide
cagggaattccttgtgggctaccccc

SEQ ID NO: 211218 - DNA, 27 bp, Artificial Sequence
  Description of Artificial Sequence: Synthetic oligonucleotide
agggaattccttgtgggctacccccca

SEQ ID NO: 211219 - DNA, 26 bp, Artificial Sequence
  Description of Artificial Sequence: Synthetic oligonucleotide
gggaattccttgtgggctacccccca

SEQ ID NO: 211220 - DNA, 26 bp, Artificial Sequence
  Description of Artificial Sequence: Synthetic oligonucleotide
ggaattccttgtgggctaccccccac

SEQ ID NO: 211221 - DNA, 33 bp, Artificial Sequence
  Description of Artificial Sequence: Synthetic oligonucleotide
gtctggtcaagtcccaaagatgtctgtaaacgc

SEQ ID NO: 211222 - DNA, 34 bp, Artificial Sequence
  Description of Artificial Sequence: Synthetic oligonucleotide
tctggtcaagtcccaaagatgtctgtaaacgcac

SEQ ID NO: 211223 - DNA, 33 bp, Artificial Sequence
  Description of Artificial Sequence: Synthetic oligonucleotide
ctggtcaagtcccaaagatgtctgtaaacgcac

SEQ ID NO: 211224 - DNA, 33 bp, Artificial Sequence
  Description of Artificial Sequence: Synthetic oligonucleotide
tggtcaagtcccaaagatgtctgtaaacgcacc

SEQ ID NO: 211225 - DNA, 32 bp, Artificial Sequence
  Description of Artificial Sequence: Synthetic oligonucleotide
ggtcaagtcccaaagatgtctgtaaacgcacc

SEQ ID NO: 211226 - DNA, 32 bp, Artificial Sequence
  Description of Artificial Sequence: Synthetic oligonucleotide
gtcaagtcccaaagatgtctgtaaacgcaccg

SEQ ID NO: 211227 - DNA, 33 bp, Artificial Sequence
  Description of Artificial Sequence: Synthetic oligonucleotide
tcaagtcccaaagatgtctgtaaacgcaccgac

SEQ ID NO: 211228 - DNA, 32 bp, Artificial Sequence
  Description of Artificial Sequence: Synthetic oligonucleotide
caagtcccaaagatgtctgtaaacgcaccgac

SEQ ID NO: 211229 - DNA, 33 bp, Artificial Sequence
  Description of Artificial Sequence: Synthetic oligonucleotide
aagtcccaaagatgtctgtaaacgcaccgactc

SEQ ID NO: 211230 - DNA, 32 bp, Artificial Sequence
  Description of Artificial Sequence: Synthetic oligonucleotide
agtcccaaagatgtctgtaaacgcaccgactc

SEQ ID NO: 211231 - DNA, 31 bp, Artificial Sequence
  Description of Artificial Sequence: Synthetic oligonucleotide
gtcccaaagatgtctgtaaacgcaccgactc

SEQ ID NO: 211232 - DNA, 34 bp, Artificial Sequence
  Description of Artificial Sequence: Synthetic oligonucleotide
tcccaaagatgtctgtaaacgcaccgactcattg

SEQ ID NO: 211233 - DNA, 33 bp, Artificial Sequence
  Description of Artificial Sequence: Synthetic oligonucleotide
cccaaagatgtctgtaaacgcaccgactcattg

SEQ ID NO: 211234 - DNA, 33 bp, Artificial Sequence
  Description of Artificial Sequence: Synthetic oligonucleotide
ccaaagatgtctgtaaacgcaccgactcattgg

SEQ ID NO: 211235 - DNA, 34 bp, Artificial Sequence
  Description of Artificial Sequence: Synthetic oligonucleotide
caaagatgtctgtaaacgcaccgactcattggtc

SEQ ID NO: 211236 - DNA, 35 bp, Artificial Sequence
  Description of Artificial Sequence: Synthetic oligonucleotide
aaagatgtctgtaaacgcaccgactcattggtcac

SEQ ID NO: 211237 - DNA, 34 bp, Artificial Sequence
  Description of Artificial Sequence: Synthetic oligonucleotide
aagatgtctgtaaacgcaccgactcattggtcac

SEQ ID NO: 211238 - DNA, 33 bp, Artificial Sequence
  Description of Artificial Sequence: Synthetic oligonucleotide
agatgtctgtaaacgcaccgactcattggtcac

SEQ ID NO: 211239 - DNA, 32 bp, Artificial Sequence
  Description of Artificial Sequence: Synthetic oligonucleotide
gatgtctgtaaacgcaccgactcattggtcac

SEQ ID NO: 211240 - DNA, 33 bp, Artificial Sequence
  Description of Artificial Sequence: Synthetic oligonucleotide
atgtctgtaaacgcaccgactcattggtcactc

SEQ ID NO: 211241 - DNA, 32 bp, Artificial Sequence
  Description of Artificial Sequence: Synthetic oligonucleotide
tgtctgtaaacgcaccgactcattggtcactc

SEQ ID NO: 211242 - DNA, 31 bp, Artificial Sequence
  Description of Artificial Sequence: Synthetic oligonucleotide
gtctgtaaacgcaccgactcattggtcactc

SEQ ID NO: 211243 - DNA, 33 bp, Artificial Sequence
  Description of Artificial Sequence: Synthetic oligonucleotide
tctgtaaacgcaccgactcattggtcactcatc

SEQ ID NO: 211244 - DNA, 32 bp, Artificial Sequence
  Description of Artificial Sequence: Synthetic oligonucleotide
ctgtaaacgcaccgactcattggtcactcatc

SEQ ID NO: 211245 - DNA, 33 bp, Artificial Sequence
  Description of Artificial Sequence: Synthetic oligonucleotide
tgtaaacgcaccgactcattggtcactcatctg

SEQ ID NO: 211246 - DNA, 32 bp, Artificial Sequence
  Description of Artificial Sequence: Synthetic oligonucleotide
gtaaacgcaccgactcattggtcactcatctg

SEQ ID NO: 211247 - DNA, 32 bp, Artificial Sequence
  Description of Artificial Sequence: Synthetic oligonucleotide
taaacgcaccgactcattggtcactcatctgc

SEQ ID NO: 211248 - DNA, 31 bp, Artificial Sequence
  Description of Artificial Sequence: Synthetic oligonucleotide
aaacgcaccgactcattggtcactcatctgc

SEQ ID NO: 211249 - DNA, 30 bp, Artificial Sequence
  Description of Artificial Sequence: Synthetic oligonucleotide
aacgcaccgactcattggtcactcatctgc

SEQ ID NO: 211250 - DNA, 29 bp, Artificial Sequence
  Description of Artificial Sequence: Synthetic oligonucleotide
acgcaccgactcattggtcactcatctgc

SEQ ID NO: 211251 - DNA, 28 bp, Artificial Sequence
  Description of Artificial Sequence: Synthetic oligonucleotide
cgcaccgactcattggtcactcatctgc

SEQ ID NO: 211252 - DNA, 38 bp, Artificial Sequence
  Description of Artificial Sequence: Synthetic oligonucleotide
gtatctctatatcttcctgggatgacaatcagctacac

SEQ ID NO: 211253 - DNA, 40 bp, Artificial Sequence
  Description of Artificial Sequence: Synthetic oligonucleotide
tatctctatatcttcctgggatgacaatcagctacacttg

SEQ ID NO: 211254 - DNA, 39 bp, Artificial Sequence
  Description of Artificial Sequence: Synthetic oligonucleotide
atctctatatcttcctgggatgacaatcagctacacttg

SEQ ID NO: 211255 - DNA, 38 bp, Artificial Sequence
  Description of Artificial Sequence: Synthetic oligonucleotide
tctctatatcttcctgggatgacaatcagctacacttg

SEQ ID NO: 211256 - DNA, 37 bp, Artificial Sequence
  Description of Artificial Sequence: Synthetic oligonucleotide
ctctatatcttcctgggatgacaatcagctacacttg

SEQ ID NO: 211257 - DNA, 38 bp, Artificial Sequence
  Description of Artificial Sequence: Synthetic oligonucleotide
tctatatcttcctgggatgacaatcagctacacttgtg

SEQ ID NO: 211258 - DNA, 37 bp, Artificial Sequence
  Description of Artificial Sequence: Synthetic oligonucleotide
ctatatcttcctgggatgacaatcagctacacttgtg

SEQ ID NO: 211259 - DNA, 38 bp, Artificial Sequence
  Description of Artificial Sequence: Synthetic oligonucleotide
tatatcttcctgggatgacaatcagctacacttgtgac

SEQ ID NO: 211260 - DNA, 37 bp, Artificial Sequence
  Description of Artificial Sequence: Synthetic oligonucleotide
atatcttcctgggatgacaatcagctacacttgtgac

SEQ ID NO: 211261 - DNA, 36 bp, Artificial Sequence
  Description of Artificial Sequence: Synthetic oligonucleotide
tatcttcctgggatgacaatcagctacacttgtgac

SEQ ID NO: 211262 - DNA, 35 bp, Artificial Sequence
  Description of Artificial Sequence: Synthetic oligonucleotide
atcttcctgggatgacaatcagctacacttgtgac

SEQ ID NO: 211263 - DNA, 34 bp, Artificial Sequence
  Description of Artificial Sequence: Synthetic oligonucleotide
tcttcctgggatgacaatcagctacacttgtgac

SEQ ID NO: 211264 - DNA, 33 bp, Artificial Sequence
  Description of Artificial Sequence: Synthetic oligonucleotide
cttcctgggatgacaatcagctacacttgtgac

SEQ ID NO: 211265 - DNA, 33 bp, Artificial Sequence
  Description of Artificial Sequence: Synthetic oligonucleotide
ttcctgggatgacaatcagctacacttgtgacc

SEQ ID NO: 211266 - DNA, 32 bp, Artificial Sequence
  Description of Artificial Sequence: Synthetic oligonucleotide
tcctgggatgacaatcagctacacttgtgacc

SEQ ID NO: 211267 - DNA, 31 bp, Artificial Sequence
  Description of Artificial Sequence: Synthetic oligonucleotide
cctgggatgacaatcagctacacttgtgacc

SEQ ID NO: 211268 - DNA, 31 bp, Artificial Sequence
  Description of Artificial Sequence: Synthetic oligonucleotide
ctgggatgacaatcagctacacttgtgaccc

SEQ ID NO: 211269 - DNA, 31 bp, Artificial Sequence
  Description of Artificial Sequence: Synthetic oligonucleotide
tgggatgacaatcagctacacttgtgacccc

SEQ ID NO: 211270 - DNA, 30 bp, Artificial Sequence
  Description of Artificial Sequence: Synthetic oligonucleotide
gggatgacaatcagctacacttgtgacccc

SEQ ID NO: 211271 - DNA, 30 bp, Artificial Sequence
  Description of Artificial Sequence: Synthetic oligonucleotide
ggatgacaatcagctacacttgtgaccccg

SEQ ID NO: 211272 - DNA, 30 bp, Artificial Sequence
  Description of Artificial Sequence: Synthetic oligonucleotide
gatgacaatcagctacacttgtgaccccgg

SEQ ID NO: 211273 - DNA, 30 bp, Artificial Sequence
  Description of Artificial Sequence: Synthetic oligonucleotide
atgacaatcagctacacttgtgaccccggc

SEQ ID NO: 211274 - DNA, 29 bp, Artificial Sequence
  Description of Artificial Sequence: Synthetic oligonucleotide
tgacaatcagctacacttgtgaccccggc

SEQ ID NO: 211275 - DNA, 28 bp, Artificial Sequence
  Description of Artificial Sequence: Synthetic oligonucleotide
gacaatcagctacacttgtgaccccggc

SEQ ID NO: 211276 - DNA, 30 bp, Artificial Sequence
  Description of Artificial Sequence: Synthetic oligonucleotide
acaatcagctacacttgtgaccccggctac

SEQ ID NO: 211277 - DNA, 29 bp, Artificial Sequence
  Description of Artificial Sequence: Synthetic oligonucleotide
caatcagctacacttgtgaccccggctac

SEQ ID NO: 211278 - DNA, 29 bp, Artificial Sequence
  Description of Artificial Sequence: Synthetic oligonucleotide
aatcagctacacttgtgaccccggctacc

SEQ ID NO: 211279 - DNA, 28 bp, Artificial Sequence
  Description of Artificial Sequence: Synthetic oligonucleotide
atcagctacacttgtgaccccggctacc

SEQ ID NO: 211280 - DNA, 27 bp, Artificial Sequence
  Description of Artificial Sequence: Synthetic oligonucleotide
tcagctacacttgtgaccccggctacc

SEQ ID NO: 211281 - DNA, 27 bp, Artificial Sequence
  Description of Artificial Sequence: Synthetic oligonucleotide
cagctacacttgtgaccccggctacct

SEQ ID NO: 211282 - DNA, 27 bp, Artificial Sequence
  Description of Artificial Sequence: Synthetic oligonucleotide
agctacacttgtgaccccggctacctg

SEQ ID NO: 211283 - DNA, 27 bp, Artificial Sequence
  Description of Artificial Sequence: Synthetic oligonucleotide
gctacacttgtgaccccggctacctgt

SEQ ID NO: 211284 - DNA, 29 bp, Artificial Sequence
  Description of Artificial Sequence: Synthetic oligonucleotide
ctacacttgtgaccccggctacctgttag

SEQ ID NO: 211285 - DNA, 30 bp, Artificial Sequence
  Description of Artificial Sequence: Synthetic oligonucleotide
tacacttgtgaccccggctacctgttagtg

SEQ ID NO: 211286 - DNA, 29 bp, Artificial Sequence
  Description of Artificial Sequence: Synthetic oligonucleotide
acacttgtgaccccggctacctgttagtg

SEQ ID NO: 211287 - DNA, 28 bp, Artificial Sequence
  Description of Artificial Sequence: Synthetic oligonucleotide
cacttgtgaccccggctacctgttagtg

SEQ ID NO: 211288 - DNA, 28 bp, Artificial Sequence
  Description of Artificial Sequence: Synthetic oligonucleotide
acttgtgaccccggctacctgttagtgg

SEQ ID NO: 211289 - DNA, 27 bp, Artificial Sequence
  Description of Artificial Sequence: Synthetic oligonucleotide
cttgtgaccccggctacctgttagtgg

SEQ ID NO: 211290 - DNA, 28 bp, Artificial Sequence
  Description of Artificial Sequence: Synthetic oligonucleotide
cctcctctggccaaatgtacctctcgtg

SEQ ID NO: 211291 - DNA, 28 bp, Artificial Sequence
  Description of Artificial Sequence: Synthetic oligonucleotide
ctcctctggccaaatgtacctctcgtgc

SEQ ID NO: 211292 - DNA, 29 bp, Artificial Sequence
  Description of Artificial Sequence: Synthetic oligonucleotide
tcctctggccaaatgtacctctcgtgcac

SEQ ID NO: 211293 - DNA, 28 bp, Artificial Sequence
  Description of Artificial Sequence: Synthetic oligonucleotide
cctctggccaaatgtacctctcgtgcac

SEQ ID NO: 211294 - DNA, 30 bp, Artificial Sequence
  Description of Artificial Sequence: Synthetic oligonucleotide
ctctggccaaatgtacctctcgtgcacatg

SEQ ID NO: 211295 - DNA, 32 bp, Artificial Sequence
  Description of Artificial Sequence: Synthetic oligonucleotide
tctggccaaatgtacctctcgtgcacatgatg

SEQ ID NO: 211296 - DNA, 31 bp, Artificial Sequence
  Description of Artificial Sequence: Synthetic oligonucleotide
ctggccaaatgtacctctcgtgcacatgatg

SEQ ID NO: 211297 - DNA, 31 bp, Artificial Sequence
  Description of Artificial Sequence: Synthetic oligonucleotide
tggccaaatgtacctctcgtgcacatgatgc

SEQ ID NO: 211298 - DNA, 30 bp, Artificial Sequence
  Description of Artificial Sequence: Synthetic oligonucleotide
ggccaaatgtacctctcgtgcacatgatgc

SEQ ID NO: 211299 - DNA, 31 bp, Artificial Sequence
  Description of Artificial Sequence: Synthetic oligonucleotide
gccaaatgtacctctcgtgcacatgatgctc

SEQ ID NO: 211300 - DNA, 32 bp, Artificial Sequence
  Description of Artificial Sequence: Synthetic oligonucleotide
ccaaatgtacctctcgtgcacatgatgctctc

SEQ ID NO: 211301 - DNA, 35 bp, Artificial Sequence
  Description of Artificial Sequence: Synthetic oligonucleotide
caaatgtacctctcgtgcacatgatgctctcatag

SEQ ID NO: 211302 - DNA, 37 bp, Artificial Sequence
  Description of Artificial Sequence: Synthetic oligonucleotide
aaatgtacctctcgtgcacatgatgctctcatagttg

SEQ ID NO: 211303 - DNA, 36 bp, Artificial Sequence
  Description of Artificial Sequence: Synthetic oligonucleotide
aatgtacctctcgtgcacatgatgctctcatagttg

SEQ ID NO: 211304 - DNA, 35 bp, Artificial Sequence
  Description of Artificial Sequence: Synthetic oligonucleotide
atgtacctctcgtgcacatgatgctctcatagttg

SEQ ID NO: 211305 - DNA, 34 bp, Artificial Sequence
  Description of Artificial Sequence: Synthetic oligonucleotide
tgtacctctcgtgcacatgatgctctcatagttg

SEQ ID NO: 211306 - DNA, 33 bp, Artificial Sequence
  Description of Artificial Sequence: Synthetic oligonucleotide
gtacctctcgtgcacatgatgctctcatagttg

SEQ ID NO: 211307 - DNA, 33 bp, Artificial Sequence
  Description of Artificial Sequence: Synthetic oligonucleotide
tacctctcgtgcacatgatgctctcatagttgg

SEQ ID NO: 211308 - DNA, 32 bp, Artificial Sequence
  Description of Artificial Sequence: Synthetic oligonucleotide
acctctcgtgcacatgatgctctcatagttgg

SEQ ID NO: 211309 - DNA, 31 bp, Artificial Sequence
  Description of Artificial Sequence: Synthetic oligonucleotide
cctctcgtgcacatgatgctctcatagttgg

SEQ ID NO: 211310 - DNA, 31 bp, Artificial Sequence
  Description of Artificial Sequence: Synthetic oligonucleotide
ctctcgtgcacatgatgctctcatagttggc

SEQ ID NO: 211311 - DNA, 32 bp, Artificial Sequence
  Description of Artificial Sequence: Synthetic oligonucleotide
tctcgtgcacatgatgctctcatagttggcac

SEQ ID NO: 211312 - DNA, 31 bp, Artificial Sequence
  Description of Artificial Sequence: Synthetic oligonucleotide
ctcgtgcacatgatgctctcatagttggcac

SEQ ID NO: 211313 - DNA, 36 bp, Artificial Sequence
  Description of Artificial Sequence: Synthetic oligonucleotide
tcgtgcacatgatgctctcatagttggcactttatc

SEQ ID NO: 211314 - DNA, 35 bp, Artificial Sequence
  Description of Artificial Sequence: Synthetic oligonucleotide
cgtgcacatgatgctctcatagttggcactttatc

SEQ ID NO: 211315 - DNA, 36 bp, Artificial Sequence
  Description of Artificial Sequence: Synthetic oligonucleotide
gtgcacatgatgctctcatagttggcactttatctg

SEQ ID NO: 211316 - DNA, 36 bp, Artificial Sequence
  Description of Artificial Sequence: Synthetic oligonucleotide
tgcacatgatgctctcatagttggcactttatctgg

SEQ ID NO: 211317 - DNA, 35 bp, Artificial Sequence
  Description of Artificial Sequence: Synthetic oligonucleotide
gcacatgatgctctcatagttggcactttatctgg

SEQ ID NO: 211318 - DNA, 34 bp, Artificial Sequence
  Description of Artificial Sequence: Synthetic oligonucleotide
aatggcatggtgcatgtgatcacagacatccatg

SEQ ID NO: 211319 - DNA, 33 bp, Artificial Sequence
  Description of Artificial Sequence: Synthetic oligonucleotide
atggcatggtgcatgtgatcacagacatccatg

SEQ ID NO: 211320 - DNA, 32 bp, Artificial Sequence
  Description of Artificial Sequence: Synthetic oligonucleotide
tggcatggtgcatgtgatcacagacatccatg

SEQ ID NO: 211321 - DNA, 31 bp, Artificial Sequence
  Description of Artificial Sequence: Synthetic oligonucleotide
ggcatggtgcatgtgatcacagacatccatg

SEQ ID NO: 211322 - DNA, 33 bp, Artificial Sequence
  Description of Artificial Sequence: Synthetic oligonucleotide
gcatggtgcatgtgatcacagacatccatgttg

SEQ ID NO: 211323 - DNA, 33 bp, Artificial Sequence
  Description of Artificial Sequence: Synthetic oligonucleotide
catggtgcatgtgatcacagacatccatgttgg

SEQ ID NO: 211324 - DNA, 35 bp, Artificial Sequence
  Description of Artificial Sequence: Synthetic oligonucleotide
atggtgcatgtgatcacagacatccatgttggatc

SEQ ID NO: 211325 - DNA, 34 bp, Artificial Sequence
  Description of Artificial Sequence: Synthetic oligonucleotide
tggtgcatgtgatcacagacatccatgttggatc

SEQ ID NO: 211326 - DNA, 33 bp, Artificial Sequence
  Description of Artificial Sequence: Synthetic oligonucleotide
ggtgcatgtgatcacagacatccatgttggatc

SEQ ID NO: 211327 - DNA, 33 bp, Artificial Sequence
  Description of Artificial Sequence: Synthetic oligonucleotide
gtgcatgtgatcacagacatccatgttggatcc

SEQ ID NO: 211328 - DNA, 34 bp, Artificial Sequence
  Description of Artificial Sequence: Synthetic oligonucleotide
tgcatgtgatcacagacatccatgttggatccag

SEQ ID NO: 211329 - DNA, 33 bp, Artificial Sequence
  Description of Artificial Sequence: Synthetic oligonucleotide
gcatgtgatcacagacatccatgttggatccag

SEQ ID NO: 211330 - DNA, 36 bp, Artificial Sequence
  Description of Artificial Sequence: Synthetic oligonucleotide
catgtgatcacagacatccatgttggatccagaatc

SEQ ID NO: 211331 - DNA, 38 bp, Artificial Sequence
  Description of Artificial Sequence: Synthetic oligonucleotide
atgtgatcacagacatccatgttggatccagaatcaac

SEQ ID NO: 211332 - DNA, 37 bp, Artificial Sequence
  Description of Artificial Sequence: Synthetic oligonucleotide
tgtgatcacagacatccatgttggatccagaatcaac

SEQ ID NO: 211333 - DNA, 36 bp, Artificial Sequence
  Description of Artificial Sequence: Synthetic oligonucleotide
gtgatcacagacatccatgttggatccagaatcaac

SEQ ID NO: 211334 - DNA, 40 bp, Artificial Sequence
  Description of Artificial Sequence: Synthetic oligonucleotide
tgatcacagacatccatgttggatccagaatcaactattc

SEQ ID NO: 211335 - DNA, 39 bp, Artificial Sequence
  Description of Artificial Sequence: Synthetic oligonucleotide
gatcacagacatccatgttggatccagaatcaactattc

SEQ ID NO: 211336 - DNA, 41 bp, Artificial Sequence
  Description of Artificial Sequence: Synthetic oligonucleotide
atcacagacatccatgttggatccagaatcaactattcttg

SEQ ID NO: 211337 - DNA, 40 bp, Artificial Sequence
  Description of Artificial Sequence: Synthetic oligonucleotide
tcacagacatccatgttggatccagaatcaactattcttg

SEQ ID NO: 211338 - DNA, 39 bp, Artificial Sequence
  Description of Artificial Sequence: Synthetic oligonucleotide
cacagacatccatgttggatccagaatcaactattcttg

SEQ ID NO: 211339 - DNA, 41 bp, Artificial Sequence
  Description of Artificial Sequence: Synthetic oligonucleotide
acagacatccatgttggatccagaatcaactattcttgtac

SEQ ID NO: 211340 - DNA, 40 bp, Artificial Sequence
  Description of Artificial Sequence: Synthetic oligonucleotide
cagacatccatgttggatccagaatcaactattcttgtac

SEQ ID NO: 211341 - DNA, 42 bp, Artificial Sequence
  Description of Artificial Sequence: Synthetic oligonucleotide
agacatccatgttggatccagaatcaactattcttgtactac

SEQ ID NO: 211342 - DNA, 41 bp, Artificial Sequence
  Description of Artificial Sequence: Synthetic oligonucleotide
gacatccatgttggatccagaatcaactattcttgtactac

SEQ ID NO: 211343 - DNA, 42 bp, Artificial Sequence
  Description of Artificial Sequence: Synthetic oligonucleotide
acatccatgttggatccagaatcaactattcttgtactacag

SEQ ID NO: 211344 - DNA, 41 bp, Artificial Sequence
  Description of Artificial Sequence: Synthetic oligonucleotide
catccatgttggatccagaatcaactattcttgtactacag

SEQ ID NO: 211345 - DNA, 41 bp, Artificial Sequence
  Description of Artificial Sequence: Synthetic oligonucleotide
atccatgttggatccagaatcaactattcttgtactacagg

SEQ ID NO: 211346 - DNA, 37 bp, Artificial Sequence
  Description of Artificial Sequence: Synthetic oligonucleotide
gtgaatcatgtaaaactcctccagttccagtgaatgg

SEQ ID NO: 211347 - DNA, 37 bp, Artificial Sequence
  Description of Artificial Sequence: Synthetic oligonucleotide
tgaatcatgtaaaactcctccagttccagtgaatggc

SEQ ID NO: 211348 - DNA, 36 bp, Artificial Sequence
  Description of Artificial Sequence: Synthetic oligonucleotide
gaatcatgtaaaactcctccagttccagtgaatggc

SEQ ID NO: 211349 - DNA, 38 bp, Artificial Sequence
  Description of Artificial Sequence: Synthetic oligonucleotide
aatcatgtaaaactcctccagttccagtgaatggcatg

SEQ ID NO: 211350 - DNA, 37 bp, Artificial Sequence
  Description of Artificial Sequence: Synthetic oligonucleotide
atcatgtaaaactcctccagttccagtgaatggcatg

SEQ ID NO: 211351 - DNA, 36 bp, Artificial Sequence
  Description of Artificial Sequence: Synthetic oligonucleotide
tcatgtaaaactcctccagttccagtgaatggcatg

SEQ ID NO: 211352 - DNA, 35 bp, Artificial Sequence
  Description of Artificial Sequence: Synthetic oligonucleotide
catgtaaaactcctccagttccagtgaatggcatg

SEQ ID NO: 211353 - DNA, 35 bp, Artificial Sequence
  Description of Artificial Sequence: Synthetic oligonucleotide
atgtaaaactcctccagttccagtgaatggcatgg

SEQ ID NO: 211354 - DNA, 34 bp, Artificial Sequence
  Description of Artificial Sequence: Synthetic oligonucleotide
tgtaaaactcctccagttccagtgaatggcatgg

SEQ ID NO: 211355 - DNA, 33 bp, Artificial Sequence
  Description of Artificial Sequence: Synthetic oligonucleotide
gtaaaactcctccagttccagtgaatggcatgg

SEQ ID NO: 211356 - DNA, 34 bp, Artificial Sequence
  Description of Artificial Sequence: Synthetic oligonucleotide
taaaactcctccagttccagtgaatggcatggtg

SEQ ID NO: 211357 - DNA, 33 bp, Artificial Sequence
  Description of Artificial Sequence: Synthetic oligonucleotide
aaaactcctccagttccagtgaatggcatggtg

SEQ ID NO: 211358 - DNA, 32 bp, Artificial Sequence
  Description of Artificial Sequence: Synthetic oligonucleotide
aaactcctccagttccagtgaatggcatggtg

SEQ ID NO: 211359 - DNA, 31 bp, Artificial Sequence
  Description of Artificial Sequence: Synthetic oligonucleotide
aactcctccagttccagtgaatggcatggtg

SEQ ID NO: 211360 - DNA, 30 bp, Artificial Sequence
  Description of Artificial Sequence: Synthetic oligonucleotide
actcctccagttccagtgaatggcatggtg

SEQ ID NO: 211361 - DNA, 29 bp, Artificial Sequence
  Description of Artificial Sequence: Synthetic oligonucleotide
ctcctccagttccagtgaatggcatggtg

SEQ ID NO: 211362 - DNA, 29 bp, Artificial Sequence
  Description of Artificial Sequence: Synthetic oligonucleotide
tcctccagttccagtgaatggcatggtgc

SEQ ID NO: 211363 - DNA, 28 bp, Artificial Sequence
  Description of Artificial Sequence: Synthetic oligonucleotide
cctccagttccagtgaatggcatggtgc

SEQ ID NO: 211364 - DNA, 30 bp, Artificial Sequence
  Description of Artificial Sequence: Synthetic oligonucleotide
ctccagttccagtgaatggcatggtgcatg

SEQ ID NO: 211365 - DNA, 31 bp, Artificial Sequence
  Description of Artificial Sequence: Synthetic oligonucleotide
tccagttccagtgaatggcatggtgcatgtg

SEQ ID NO: 211366 - DNA, 30 bp, Artificial Sequence
  Description of Artificial Sequence: Synthetic oligonucleotide
ccagttccagtgaatggcatggtgcatgtg

SEQ ID NO: 211367 - DNA, 32 bp, Artificial Sequence
  Description of Artificial Sequence: Synthetic oligonucleotide
cagttccagtgaatggcatggtgcatgtgatc

SEQ ID NO: 211368 - DNA, 33 bp, Artificial Sequence
  Description of Artificial Sequence: Synthetic oligonucleotide
agttccagtgaatggcatggtgcatgtgatcac

SEQ ID NO: 211369 - DNA, 32 bp, Artificial Sequence
  Description of Artificial Sequence: Synthetic oligonucleotide
gttccagtgaatggcatggtgcatgtgatcac

SEQ ID NO: 211370 - DNA, 33 bp, Artificial Sequence
  Description of Artificial Sequence: Synthetic oligonucleotide
ttccagtgaatggcatggtgcatgtgatcacag

SEQ ID NO: 211371 - DNA, 34 bp, Artificial Sequence
  Description of Artificial Sequence: Synthetic oligonucleotide
actcatctgctgaatgtatcctctcgggcaatac

SEQ ID NO: 211372 - DNA, 33 bp, Artificial Sequence
  Description of Artificial Sequence: Synthetic oligonucleotide
ctcatctgctgaatgtatcctctcgggcaatac

SEQ ID NO: 211373 - DNA, 34 bp, Artificial Sequence
  Description of Artificial Sequence: Synthetic oligonucleotide
tcatctgctgaatgtatcctctcgggcaatactg

SEQ ID NO: 211374 - DNA, 33 bp, Artificial Sequence
  Description of Artificial Sequence: Synthetic oligonucleotide
catctgctgaatgtatcctctcgggcaatactg

SEQ ID NO: 211375 - DNA, 33 bp, Artificial Sequence
  Description of Artificial Sequence: Synthetic oligonucleotide
atctgctgaatgtatcctctcgggcaatactgc

SEQ ID NO: 211376 - DNA, 32 bp, Artificial Sequence
  Description of Artificial Sequence: Synthetic oligonucleotide
tctgctgaatgtatcctctcgggcaatactgc

SEQ ID NO: 211377 - DNA, 31 bp, Artificial Sequence
  Description of Artificial Sequence: Synthetic oligonucleotide
ctgctgaatgtatcctctcgggcaatactgc

SEQ ID NO: 211378 - DNA, 31 bp, Artificial Sequence
  Description of Artificial Sequence: Synthetic oligonucleotide
tgctgaatgtatcctctcgggcaatactgcc

SEQ ID NO: 211379 - DNA, 30 bp, Artificial Sequence
  Description of Artificial Sequence: Synthetic oligonucleotide
gctgaatgtatcctctcgggcaatactgcc

SEQ ID NO: 211380 - DNA, 30 bp, Artificial Sequence
  Description of Artificial Sequence: Synthetic oligonucleotide
ctgaatgtatcctctcgggcaatactgccc

SEQ ID NO: 211381 - DNA, 33 bp, Artificial Sequence
  Description of Artificial Sequence: Synthetic oligonucleotide
tgaatgtatcctctcgggcaatactgcccattg

SEQ ID NO: 211382 - DNA, 32 bp, Artificial Sequence
  Description of Artificial Sequence: Synthetic oligonucleotide
gaatgtatcctctcgggcaatactgcccattg

SEQ ID NO: 211383 - DNA, 32 bp, Artificial Sequence
  Description of Artificial Sequence: Synthetic oligonucleotide
aatgtatcctctcgggcaatactgcccattgg

SEQ ID NO: 211384 - DNA, 31 bp, Artificial Sequence
  Description of Artificial Sequence: Synthetic oligonucleotide
atgtatcctctcgggcaatactgcccattgg

SEQ ID NO: 211385 - DNA, 30 bp, Artificial Sequence
  Description of Artificial Sequence: Synthetic oligonucleotide
tgtatcctctcgggcaatactgcccattgg

SEQ ID NO: 211386 - DNA, 29 bp, Artificial Sequence
  Description of Artificial Sequence: Synthetic oligonucleotide
gtatcctctcgggcaatactgcccattgg

SEQ ID NO: 211387 - DNA, 30 bp, Artificial Sequence
  Description of Artificial Sequence: Synthetic oligonucleotide
tatcctctcgggcaatactgcccattggag

SEQ ID NO: 211388 - DNA, 29 bp, Artificial Sequence
  Description of Artificial Sequence: Synthetic oligonucleotide
atcctctcgggcaatactgcccattggag

SEQ ID NO: 211389 - DNA, 28 bp, Artificial Sequence
  Description of Artificial Sequence: Synthetic oligonucleotide
tcctctcgggcaatactgcccattggag

SEQ ID NO: 211390 - DNA, 27 bp, Artificial Sequence
  Description of Artificial Sequence: Synthetic oligonucleotide
cctctcgggcaatactgcccattggag

SEQ ID NO: 211391 - DNA, 27 bp, Artificial Sequence
  Description of Artificial Sequence: Synthetic oligonucleotide
ctctcgggcaatactgcccattggagc

SEQ ID NO: 211392 - DNA, 29 bp, Artificial Sequence
  Description of Artificial Sequence: Synthetic oligonucleotide
tctcgggcaatactgcccattggagcatg

SEQ ID NO: 211393 - DNA, 28 bp, Artificial Sequence
  Description of Artificial Sequence: Synthetic oligonucleotide
ctcgggcaatactgcccattggagcatg

SEQ ID NO: 211394 - DNA, 30 bp, Artificial Sequence
  Description of Artificial Sequence: Synthetic oligonucleotide
tcgggcaatactgcccattggagcatgaag

SEQ ID NO: 211395 - DNA, 29 bp, Artificial Sequence
  Description of Artificial Sequence: Synthetic oligonucleotide
cgggcaatactgcccattggagcatgaag

SEQ ID NO: 211396 - DNA, 29 bp, Artificial Sequence
  Description of Artificial Sequence: Synthetic oligonucleotide
gggcaatactgcccattggagcatgaagc

SEQ ID NO: 211397 - DNA, 29 bp, Artificial Sequence
  Description of Artificial Sequence: Synthetic oligonucleotide
ggcaatactgcccattggagcatgaagcc

SEQ ID NO: 211398 - DNA, 30 bp, Artificial Sequence
  Description of Artificial Sequence: Synthetic oligonucleotide
gcaatactgcccattggagcatgaagccac

SEQ ID NO: 211399 - DNA, 30 bp, Artificial Sequence
  Description of Artificial Sequence: Synthetic oligonucleotide
caatactgcccattggagcatgaagccacc

SEQ ID NO: 211400 - DNA, 35 bp, Artificial Sequence
  Description of Artificial Sequence: Synthetic oligonucleotide
aatactgcccattggagcatgaagccaccaatttg

SEQ ID NO: 211401 - DNA, 34 bp, Artificial Sequence
  Description of Artificial Sequence: Synthetic oligonucleotide
atactgcccattggagcatgaagccaccaatttg

SEQ ID NO: 211402 - DNA, 33 bp, Artificial Sequence
  Description of Artificial Sequence: Synthetic oligonucleotide
tactgcccattggagcatgaagccaccaatttg

SEQ ID NO: 211403 - DNA, 32 bp, Artificial Sequence
  Description of Artificial Sequence: Synthetic oligonucleotide
actgcccattggagcatgaagccaccaatttg

SEQ ID NO: 211404 - DNA, 31 bp, Artificial Sequence
  Description of Artificial Sequence: Synthetic oligonucleotide
ctgcccattggagcatgaagccaccaatttg

SEQ ID NO: 211405 - DNA, 32 bp, Artificial Sequence
  Description of Artificial Sequence: Synthetic oligonucleotide
tgcccattggagcatgaagccaccaatttgtc

SEQ ID NO: 211406 - DNA, 31 bp, Artificial Sequence
  Description of Artificial Sequence: Synthetic oligonucleotide
gcccattggagcatgaagccaccaatttgtc

SEQ ID NO: 211407 - DNA, 33 bp, Artificial Sequence
  Description of Artificial Sequence: Synthetic oligonucleotide
cccattggagcatgaagccaccaatttgtcaac

SEQ ID NO: 211408 - DNA, 27 bp, Artificial Sequence
  Description of Artificial Sequence: Synthetic oligonucleotide
ctgcccctcgctgtggaattctgggtt

SEQ ID NO: 211409 - DNA, 28 bp, Artificial Sequence
  Description of Artificial Sequence: Synthetic oligonucleotide
tgcccctcgctgtggaattctgggttag

SEQ ID NO: 211410 - DNA, 25 bp, Artificial Sequence
  Description of Artificial Sequence: Synthetic oligonucleotide
atggatcccctgggtgcagccaagc

SEQ ID NO: 211411 - DNA, 24 bp, Artificial Sequence
  Description of Artificial Sequence: Synthetic oligonucleotide
tggatcccctgggtgcagccaagc

SEQ ID NO: 211412 - DNA, 23 bp, Artificial Sequence
  Description of Artificial Sequence: Synthetic oligonucleotide
ggatcccctgggtgcagccaagc

SEQ ID NO: 211413 - DNA, 24 bp, Artificial Sequence
  Description of Artificial Sequence: Synthetic oligonucleotide
gatcccctgggtgcagccaagcca

SEQ ID NO: 211414 - DNA, 27 bp, Artificial Sequence
  Description of Artificial Sequence: Synthetic oligonucleotide
atcccctgggtgcagccaagccacaat

SEQ ID NO: 211415 - DNA, 26 bp, Artificial Sequence
  Description of Artificial Sequence: Synthetic oligonucleotide
tcccctgggtgcagccaagccacaat

SEQ ID NO: 211416 - DNA, 25 bp, Artificial Sequence
  Description of Artificial Sequence: Synthetic oligonucleotide
cccctgggtgcagccaagccacaat

SEQ ID NO: 211417 - DNA, 25 bp, Artificial Sequence
  Description of Artificial Sequence: Synthetic oligonucleotide
ccctgggtgcagccaagccacaatg

SEQ ID NO: 211418 - DNA, 25 bp, Artificial Sequence
  Description of Artificial Sequence: Synthetic oligonucleotide
cctgggtgcagccaagccacaatgg

SEQ ID NO: 211419 - DNA, 25 bp, Artificial Sequence
  Description of Artificial Sequence: Synthetic oligonucleotide
ctgggtgcagccaagccacaatggc

SEQ ID NO: 211420 - DNA, 27 bp, Artificial Sequence
  Description of Artificial Sequence: Synthetic oligonucleotide
tgggtgcagccaagccacaatggccat

SEQ ID NO: 211421 - DNA, 26 bp, Artificial Sequence
  Description of Artificial Sequence: Synthetic oligonucleotide
gggtgcagccaagccacaatggccat

SEQ ID NO: 211422 - DNA, 26 bp, Artificial Sequence
  Description of Artificial Sequence: Synthetic oligonucleotide
ggtgcagccaagccacaatggccatg

SEQ ID NO: 211423 - DNA, 26 bp, Artificial Sequence
  Description of Artificial Sequence: Synthetic oligonucleotide
gtgcagccaagccacaatggccatgg

SEQ ID NO: 211424 - DNA, 26 bp, Artificial Sequence
  Description of Artificial Sequence: Synthetic oligonucleotide
tgcagccaagccacaatggccatggc

SEQ ID NO: 211425 - DNA, 25 bp, Artificial Sequence
  Description of Artificial Sequence: Synthetic oligonucleotide
gcagccaagccacaatggccatggc

SEQ ID NO: 211426 - DNA, 25 bp, Artificial Sequence
  Description of Artificial Sequence: Synthetic oligonucleotide
cagccaagccacaatggccatggcg

SEQ ID NO: 211427 - DNA, 25 bp, Artificial Sequence
  Description of Artificial Sequence: Synthetic oligonucleotide
agccaagccacaatggccatggcgc

SEQ ID NO: 211428 - DNA, 24 bp, Artificial Sequence
  Description of Artificial Sequence: Synthetic oligonucleotide
gccaagccacaatggccatggcgc

SEQ ID NO: 211429 - DNA, 24 bp, Artificial Sequence
  Description of Artificial Sequence: Synthetic oligonucleotide
ccaagccacaatggccatggcgcc

SEQ ID NO: 211430 - DNA, 24 bp, Artificial Sequence
  Description of Artificial Sequence: Synthetic oligonucleotide
caagccacaatggccatggcgccg

SEQ ID NO: 211431 - DNA, 25 bp, Artificial Sequence
  Description of Artificial Sequence: Synthetic oligonucleotide
aagccacaatggccatggcgccgct

SEQ ID NO: 211432 - DNA, 24 bp, Artificial Sequence
  Description of Artificial Sequence: Synthetic oligonucleotide
agccacaatggccatggcgccgct

SEQ ID NO: 211433 - DNA, 23 bp, Artificial Sequence
  Description of Artificial Sequence: Synthetic oligonucleotide
gccacaatggccatggcgccgct

SEQ ID NO: 211434 - DNA, 24 bp, Artificial Sequence
  Description of Artificial Sequence: Synthetic oligonucleotide
ccacaatggccatggcgccgctgt

SEQ ID NO: 211435 - DNA, 25 bp, Artificial Sequence
  Description of Artificial Sequence: Synthetic oligonucleotide
cacaatggccatggcgccgctgtct

SEQ ID NO: 211436 - DNA, 25 bp, Artificial Sequence
  Description of Artificial Sequence: Synthetic oligonucleotide
acaatggccatggcgccgctgtctg

SEQ ID NO: 211437 - DNA, 24 bp, Artificial Sequence
  Description of Artificial Sequence: Synthetic oligonucleotide
caatggccatggcgccgctgtctg

SEQ ID NO: 211438 - DNA, 24 bp, Artificial Sequence
  Description of Artificial Sequence: Synthetic oligonucleotide
aatggccatggcgccgctgtctgg

SEQ ID NO: 211439 - DNA, 23 bp, Artificial Sequence
  Description of Artificial Sequence: Synthetic oligonucleotide
atggccatggcgccgctgtctgg

SEQ ID NO: 211440 - DNA, 22 bp, Artificial Sequence
  Description of Artificial Sequence: Synthetic oligonucleotide
tggccatggcgccgctgtctgg

SEQ ID NO: 211441 - DNA, 21 bp, Artificial Sequence
  Description of Artificial Sequence: Synthetic oligonucleotide
ggccatggcgccgctgtctgg

SEQ ID NO: 211442 - DNA, 21 bp, Artificial Sequence
  Description of Artificial Sequence: Synthetic oligonucleotide
gccatggcgccgctgtctggc

SEQ ID NO: 211443 - DNA, 21 bp, Artificial Sequence
  Description of Artificial Sequence: Synthetic oligonucleotide
ccatggcgccgctgtctggcc

SEQ ID NO: 211444 - DNA, 21 bp, Artificial Sequence
  Description of Artificial Sequence: Synthetic oligonucleotide
catggcgccgctgtctggccg

SEQ ID NO: 211445 - DNA, 22 bp, Artificial Sequence
  Description of Artificial Sequence: Synthetic oligonucleotide
atggcgccgctgtctggccgca

SEQ ID NO: 211446 - DNA, 21 bp, Artificial Sequence
  Description of Artificial Sequence: Synthetic oligonucleotide
tggcgccgctgtctggccgca

SEQ ID NO: 211447 - DNA, 20 bp, Artificial Sequence
  Description of Artificial Sequence: Synthetic oligonucleotide
ggcgccgctgtctggccgca

SEQ ID NO: 211448 - DNA, 21 bp, Artificial Sequence
  Description of Artificial Sequence: Synthetic oligonucleotide
gcgccgctgtctggccgcact

SEQ ID NO: 211449 - DNA, 21 bp, Artificial Sequence
  Description of Artificial Sequence: Synthetic oligonucleotide
cgccgctgtctggccgcactg

SEQ ID NO: 211450 - DNA, 26 bp, Artificial Sequence
  Description of Artificial Sequence: Synthetic oligonucleotide
gccgctgtctggccgcactgctattt

SEQ ID NO: 211451 - DNA, 27 bp, Artificial Sequence
  Description of Artificial Sequence: Synthetic oligonucleotide
ccgctgtctggccgcactgctatttca

SEQ ID NO: 211452 - DNA, 27 bp, Artificial Sequence
  Description of Artificial Sequence: Synthetic oligonucleotide
cgctgtctggccgcactgctatttcag

SEQ ID NO: 211453 - DNA, 27 bp, Artificial Sequence
  Description of Artificial Sequence: Synthetic oligonucleotide
gctgtctggccgcactgctatttcagc

SEQ ID NO: 211454 - DNA, 28 bp, Artificial Sequence
  Description of Artificial Sequence: Synthetic oligonucleotide
ctgtctggccgcactgctatttcagctg

SEQ ID NO: 211455 - DNA, 28 bp, Artificial Sequence
  Description of Artificial Sequence: Synthetic oligonucleotide
tgtctggccgcactgctatttcagctgc

SEQ ID NO: 211456 - DNA, 27 bp, Artificial Sequence
  Description of Artificial Sequence: Synthetic oligonucleotide
gtctggccgcactgctatttcagctgc

SEQ ID NO: 211457 - DNA, 28 bp, Artificial Sequence
  Description of Artificial Sequence: Synthetic oligonucleotide
tctggccgcactgctatttcagctgctg

SEQ ID NO: 211458 - DNA, 27 bp, Artificial Sequence
  Description of Artificial Sequence: Synthetic oligonucleotide
ctggccgcactgctatttcagctgctg

SEQ ID NO: 211459 - DNA, 27 bp, Artificial Sequence
  Description of Artificial Sequence: Synthetic oligonucleotide
tggccgcactgctatttcagctgctgg

SEQ ID NO: 211460 - DNA, 27 bp, Artificial Sequence
  Description of Artificial Sequence: Synthetic oligonucleotide
ggccgcactgctatttcagctgctggt

SEQ ID NO: 211461 - DNA, 27 bp, Artificial Sequence
  Description of Artificial Sequence: Synthetic oligonucleotide
gccgcactgctatttcagctgctggtg

SEQ ID NO: 211462 - DNA, 27 bp, Artificial Sequence
  Description of Artificial Sequence: Synthetic oligonucleotide
ccgcactgctatttcagctgctggtgg

SEQ ID NO: 211463 - DNA, 27 bp, Artificial Sequence
  Description of Artificial Sequence: Synthetic oligonucleotide
cgcactgctatttcagctgctggtggc

SEQ ID NO: 211464 - DNA, 28 bp, Artificial Sequence
  Description of Artificial Sequence: Synthetic oligonucleotide
gcactgctatttcagctgctggtggctg

SEQ ID NO: 211465 - DNA, 29 bp, Artificial Sequence
  Description of Artificial Sequence: Synthetic oligonucleotide
cactgctatttcagctgctggtggctgtg

SEQ ID NO: 211466 - DNA, 30 bp, Artificial Sequence
  Description of Artificial Sequence: Synthetic oligonucleotide
actgctatttcagctgctggtggctgtgtg

SEQ ID NO: 211467 - DNA, 29 bp, Artificial Sequence
  Description of Artificial Sequence: Synthetic oligonucleotide
ctgctatttcagctgctggtggctgtgtg

SEQ ID NO: 211468 - DNA, 32 bp, Artificial Sequence
  Description of Artificial Sequence: Synthetic oligonucleotide
tgctatttcagctgctggtggctgtgtgtttc

SEQ ID NO: 211469 - DNA, 31 bp, Artificial Sequence
  Description of Artificial Sequence: Synthetic oligonucleotide
gctatttcagctgctggtggctgtgtgtttc

SEQ ID NO: 211470 - DNA, 33 bp, Artificial Sequence
  Description of Artificial Sequence: Synthetic oligonucleotide
ctatttcagctgctggtggctgtgtgtttcttc

SEQ ID NO: 211471 - DNA, 34 bp, Artificial Sequence
  Description of Artificial Sequence: Synthetic oligonucleotide
tatttcagctgctggtggctgtgtgtttcttctc

SEQ ID NO: 211472 - DNA, 33 bp, Artificial Sequence
  Description of Artificial Sequence: Synthetic oligonucleotide
atttcagctgctggtggctgtgtgtttcttctc

SEQ ID NO: 211473 - DNA, 32 bp, Artificial Sequence
  Description of Artificial Sequence: Synthetic oligonucleotide
tttcagctgctggtggctgtgtgtttcttctc

SEQ ID NO: 211474 - DNA, 31 bp, Artificial Sequence
  Description of Artificial Sequence: Synthetic oligonucleotide
ttcagctgctggtggctgtgtgtttcttctc

SEQ ID NO: 211475 - DNA, 30 bp, Artificial Sequence
  Description of Artificial Sequence: Synthetic oligonucleotide
tcagctgctggtggctgtgtgtttcttctc

SEQ ID NO: 211476 - DNA, 29 bp, Artificial Sequence
  Description of Artificial Sequence: Synthetic oligonucleotide
cagctgctggtggctgtgtgtttcttctc

SEQ ID NO: 211477 - DNA, 29 bp, Artificial Sequence
  Description of Artificial Sequence: Synthetic oligonucleotide
agctgctggtggctgtgtgtttcttctcc

SEQ ID NO: 211478 - DNA, 28 bp, Artificial Sequence
  Description of Artificial Sequence: Synthetic oligonucleotide
gctgctggtggctgtgtgtttcttctcc

SEQ ID NO: 211479 - DNA, 30 bp, Artificial Sequence
  Description of Artificial Sequence: Synthetic oligonucleotide
ctgctggtggctgtgtgtttcttctcctac

SEQ ID NO: 211480 - DNA, 30 bp, Artificial Sequence
  Description of Artificial Sequence: Synthetic oligonucleotide
tgctggtggctgtgtgtttcttctcctacc

SEQ ID NO: 211481 - DNA, 29 bp, Artificial Sequence
  Description of Artificial Sequence: Synthetic oligonucleotide
gctggtggctgtgtgtttcttctcctacc

SEQ ID NO: 211482 - DNA, 30 bp, Artificial Sequence
  Description of Artificial Sequence: Synthetic oligonucleotide
ctggtggctgtgtgtttcttctcctacctg

SEQ ID NO: 211483 - DNA, 30 bp, Artificial Sequence
  Description of Artificial Sequence: Synthetic oligonucleotide
tggtggctgtgtgtttcttctcctacctgc

SEQ ID NO: 211484 - DNA, 29 bp, Artificial Sequence
  Description of Artificial Sequence: Synthetic oligonucleotide
ggtggctgtgtgtttcttctcctacctgc

SEQ ID NO: 211485 - DNA, 29 bp, Artificial Sequence
  Description of Artificial Sequence: Synthetic oligonucleotide
gtggctgtgtgtttcttctcctacctgcg

SEQ ID NO: 211486 - DNA, 30 bp, Artificial Sequence
  Description of Artificial Sequence: Synthetic oligonucleotide
tggctgtgtgtttcttctcctacctgcgtg

SEQ ID NO: 211487 - DNA, 29 bp, Artificial Sequence
  Description of Artificial Sequence: Synthetic oligonucleotide
ggctgtgtgtttcttctcctacctgcgtg

SEQ ID NO: 211488 - DNA, 30 bp, Artificial Sequence
  Description of Artificial Sequence: Synthetic oligonucleotide
gctgtgtgtttcttctcctacctgcgtgtg

SEQ ID NO: 211489 - DNA, 31 bp, Artificial Sequence
  Description of Artificial Sequence: Synthetic oligonucleotide
ctgtgtgtttcttctcctacctgcgtgtgtc

SEQ ID NO: 211490 - DNA, 31 bp, Artificial Sequence
  Description of Artificial Sequence: Synthetic oligonucleotide
tgtgtgtttcttctcctacctgcgtgtgtcc

SEQ ID NO: 211491 - DNA, 30 bp, Artificial Sequence
  Description of Artificial Sequence: Synthetic oligonucleotide
gtgtgtttcttctcctacctgcgtgtgtcc

SEQ ID NO: 211492 - DNA, 30 bp, Artificial Sequence
  Description of Artificial Sequence: Synthetic oligonucleotide
tgtgtttcttctcctacctgcgtgtgtccc

SEQ ID NO: 211493 - DNA, 29 bp, Artificial Sequence
  Description of Artificial Sequence: Synthetic oligonucleotide
gtgtttcttctcctacctgcgtgtgtccc

SEQ ID NO: 211494 - DNA, 29 bp, Artificial Sequence
  Description of Artificial Sequence: Synthetic oligonucleotide
tgtttcttctcctacctgcgtgtgtcccg

SEQ ID NO: 211495 - DNA, 28 bp, Artificial Sequence
  Description of Artificial Sequence: Synthetic oligonucleotide
gtttcttctcctacctgcgtgtgtcccg

SEQ ID NO: 211496 - DNA, 29 bp, Artificial Sequence
  Description of Artificial Sequence: Synthetic oligonucleotide
tttcttctcctacctgcgtgtgtcccgag

SEQ ID NO: 211497 - DNA, 28 bp, Artificial Sequence
  Description of Artificial Sequence: Synthetic oligonucleotide
ttcttctcctacctgcgtgtgtcccgag

SEQ ID NO: 211498 - DNA, 27 bp, Artificial Sequence
  Description of Artificial Sequence: Synthetic oligonucleotide
tcttctcctacctgcgtgtgtcccgag

SEQ ID NO: 211499 - DNA, 27 bp, Artificial Sequence
  Description of Artificial Sequence: Synthetic oligonucleotide
cttctcctacctgcgtgtgtcccgaga

SEQ ID NO: 211500 - DNA, 27 bp, Artificial Sequence
  Description of Artificial Sequence: Synthetic oligonucleotide
ttctcctacctgcgtgtgtcccgagac

SEQ ID NO: 211501 - DNA, 26 bp, Artificial Sequence
  Description of Artificial Sequence: Synthetic oligonucleotide
tctcctacctgcgtgtgtcccgagac

SEQ ID NO: 211502 - DNA, 25 bp, Artificial Sequence
  Description of Artificial Sequence: Synthetic oligonucleotide
ctcctacctgcgtgtgtcccgagac

SEQ ID NO: 211503 - DNA, 27 bp, Artificial Sequence
  Description of Artificial Sequence: Synthetic oligonucleotide
tcctacctgcgtgtgtcccgagacgat

SEQ ID NO: 211504 - DNA, 26 bp, Artificial Sequence
  Description of Artificial Sequence: Synthetic oligonucleotide
cctacctgcgtgtgtcccgagacgat

SEQ ID NO: 211505 - DNA, 26 bp, Artificial Sequence
  Description of Artificial Sequence: Synthetic oligonucleotide
ctacctgcgtgtgtcccgagacgatg

SEQ ID NO: 211506 - DNA, 26 bp, Artificial Sequence
  Description of Artificial Sequence: Synthetic oligonucleotide
tacctgcgtgtgtcccgagacgatgc

SEQ ID NO: 211507 - DNA, 25 bp, Artificial Sequence
  Description of Artificial Sequence: Synthetic oligonucleotide
acctgcgtgtgtcccgagacgatgc

SEQ ID NO: 211508 - DNA, 24 bp, Artificial Sequence
  Description of Artificial Sequence: Synthetic oligonucleotide
cctgcgtgtgtcccgagacgatgc

SEQ ID NO: 211509 - DNA, 25 bp, Artificial Sequence
  Description of Artificial Sequence: Synthetic oligonucleotide
ctgcgtgtgtcccgagacgatgcca

SEQ ID NO: 211510 - DNA, 26 bp, Artificial Sequence
  Description of Artificial Sequence: Synthetic oligonucleotide
tgcgtgtgtcccgagacgatgccact

SEQ ID NO: 211511 - DNA, 25 bp, Artificial Sequence
  Description of Artificial Sequence: Synthetic oligonucleotide
gcgtgtgtcccgagacgatgccact

SEQ ID NO: 211512 - DNA, 25 bp, Artificial Sequence
  Description of Artificial Sequence: Synthetic oligonucleotide
cgtgtgtcccgagacgatgccactg

SEQ ID NO: 211513 - DNA, 27 bp, Artificial Sequence
  Description of Artificial Sequence: Synthetic oligonucleotide
gtgtgtcccgagacgatgccactggat

SEQ ID NO: 211514 - DNA, 27 bp, Artificial Sequence
  Description of Artificial Sequence: Synthetic oligonucleotide
tgtgtcccgagacgatgccactggatc

SEQ ID NO: 211515 - DNA, 26 bp, Artificial Sequence
  Description of Artificial Sequence: Synthetic oligonucleotide
gtgtcccgagacgatgccactggatc

SEQ ID NO: 211516 - DNA, 26 bp, Artificial Sequence
  Description of Artificial Sequence: Synthetic oligonucleotide
tgtcccgagacgatgccactggatcc

SEQ ID NO: 211517 - DNA, 25 bp, Artificial Sequence
  Description of Artificial Sequence: Synthetic oligonucleotide
gtcccgagacgatgccactggatcc

SEQ ID NO: 211518 - DNA, 25 bp, Artificial Sequence
  Description of Artificial Sequence: Synthetic oligonucleotide
tcccgagacgatgccactggatccc

SEQ ID NO: 211519 - DNA, 24 bp, Artificial Sequence
  Description of Artificial Sequence: Synthetic oligonucleotide
cccgagacgatgccactggatccc

SEQ ID NO: 211520 - DNA, 26 bp, Artificial Sequence
  Description of Artificial Sequence: Synthetic oligonucleotide
ccgagacgatgccactggatccccta

SEQ ID NO: 211521 - DNA, 26 bp, Artificial Sequence
  Description of Artificial Sequence: Synthetic oligonucleotide
cgagacgatgccactggatcccctag

SEQ ID NO: 211522 - DNA, 26 bp, Artificial Sequence
  Description of Artificial Sequence: Synthetic oligonucleotide
gagacgatgccactggatcccctagg

SEQ ID NO: 211523 - DNA, 26 bp, Artificial Sequence
  Description of Artificial Sequence: Synthetic oligonucleotide
agacgatgccactggatcccctaggg

SEQ ID NO: 211524 - DNA, 25 bp, Artificial Sequence
  Description of Artificial Sequence: Synthetic oligonucleotide
gacgatgccactggatcccctaggg

SEQ ID NO: 211525 - DNA, 26 bp, Artificial Sequence
  Description of Artificial Sequence: Synthetic oligonucleotide
acgatgccactggatcccctagggct

SEQ ID NO: 211526 - DNA, 25 bp, Artificial Sequence
  Description of Artificial Sequence: Synthetic oligonucleotide
cgatgccactggatcccctagggct

SEQ ID NO: 211527 - DNA, 25 bp, Artificial Sequence
  Description of Artificial Sequence: Synthetic oligonucleotide
gatgccactggatcccctagggctc

SEQ ID NO: 211528 - DNA, 25 bp, Artificial Sequence
  Description of Artificial Sequence: Synthetic oligonucleotide
atgccactggatcccctagggctcc

SEQ ID NO: 211529 - DNA, 24 bp, Artificial Sequence
  Description of Artificial Sequence: Synthetic oligonucleotide
tgccactggatcccctagggctcc

SEQ ID NO: 211530 - DNA, 23 bp, Artificial Sequence
  Description of Artificial Sequence: Synthetic oligonucleotide
gccactggatcccctagggctcc

SEQ ID NO: 211531 - DNA, 24 bp, Artificial Sequence
  Description of Artificial Sequence: Synthetic oligonucleotide
ccactggatcccctagggctccca

SEQ ID NO: 211532 - DNA, 25 bp, Artificial Sequence
  Description of Artificial Sequence: Synthetic oligonucleotide
cactggatcccctagggctcccagt

SEQ ID NO: 211533 - DNA, 25 bp, Artificial Sequence
  Description of Artificial Sequence: Synthetic oligonucleotide
actggatcccctagggctcccagtg

SEQ ID NO: 211534 - DNA, 24 bp, Artificial Sequence
  Description of Artificial Sequence: Synthetic oligonucleotide
ctggatcccctagggctcccagtg

SEQ ID NO: 211535 - DNA, 24 bp, Artificial Sequence
  Description of Artificial Sequence: Synthetic oligonucleotide
tggatcccctagggctcccagtgg

SEQ ID NO: 211536 - DNA, 23 bp, Artificial Sequence
  Description of Artificial Sequence: Synthetic oligonucleotide
ggatcccctagggctcccagtgg

SEQ ID NO: 211537 - DNA, 24 bp, Artificial Sequence
  Description of Artificial Sequence: Synthetic oligonucleotide
gatcccctagggctcccagtgggt

SEQ ID NO: 211538 - DNA, 24 bp, Artificial Sequence
  Description of Artificial Sequence: Synthetic oligonucleotide
atcccctagggctcccagtgggtc

SEQ ID NO: 211539 - DNA, 23 bp, Artificial Sequence
  Description of Artificial Sequence: Synthetic oligonucleotide
tcccctagggctcccagtgggtc

SEQ ID NO: 211540 - DNA, 22 bp, Artificial Sequence
  Description of Artificial Sequence: Synthetic oligonucleotide
cccctagggctcccagtgggtc

SEQ ID NO: 211541 - DNA, 23 bp, Artificial Sequence
  Description of Artificial Sequence: Synthetic oligonucleotide
ccctagggctcccagtgggtcct

SEQ ID NO: 211542 - DNA, 23 bp, Artificial Sequence
  Description of Artificial Sequence: Synthetic oligonucleotide
cctagggctcccagtgggtcctc

SEQ ID NO: 211543 - DNA, 23 bp, Artificial Sequence
  Description of Artificial Sequence: Synthetic oligonucleotide
ctagggctcccagtgggtcctcc

SEQ ID NO: 211544 - DNA, 23 bp, Artificial Sequence
  Description of Artificial Sequence: Synthetic oligonucleotide
tagggctcccagtgggtcctccc

SEQ ID NO: 211545 - DNA, 22 bp, Artificial Sequence
  Description of Artificial Sequence: Synthetic oligonucleotide
agggctcccagtgggtcctccc

SEQ ID NO: 211546 - DNA, 21 bp, Artificial Sequence
  Description of Artificial Sequence: Synthetic oligonucleotide
gggctcccagtgggtcctccc

SEQ ID NO: 211547 - DNA, 22 bp, Artificial Sequence
  Description of Artificial Sequence: Synthetic oligonucleotide
ggctcccagtgggtcctcccga

SEQ ID NO: 211548 - DNA, 23 bp, Artificial Sequence
  Description of Artificial Sequence: Synthetic oligonucleotide
gctcccagtgggtcctcccgaca

SEQ ID NO: 211549 - DNA, 23 bp, Artificial Sequence
  Description of Artificial Sequence: Synthetic oligonucleotide
ctcccagtgggtcctcccgacag

SEQ ID NO: 211550 - DNA, 24 bp, Artificial Sequence
  Description of Artificial Sequence: Synthetic oligonucleotide
tcccagtgggtcctcccgacagga

SEQ ID NO: 211551 - DNA, 23 bp, Artificial Sequence
  Description of Artificial Sequence: Synthetic oligonucleotide
cccagtgggtcctcccgacagga

SEQ ID NO: 211552 - DNA, 24 bp, Artificial Sequence
  Description of Artificial Sequence: Synthetic oligonucleotide
ccagtgggtcctcccgacaggaca

SEQ ID NO: 211553 - DNA, 24 bp, Artificial Sequence
  Description of Artificial Sequence: Synthetic oligonucleotide
cagtgggtcctcccgacaggacac

SEQ ID NO: 211554 - DNA, 25 bp, Artificial Sequence
  Description of Artificial Sequence: Synthetic oligonucleotide
agtgggtcctcccgacaggacacca

SEQ ID NO: 211555 - DNA, 24 bp, Artificial Sequence
  Description of Artificial Sequence: Synthetic oligonucleotide
gtgggtcctcccgacaggacacca

SEQ ID NO: 211556 - DNA, 25 bp, Artificial Sequence
  Description of Artificial Sequence: Synthetic oligonucleotide
tgggtcctcccgacaggacaccact

SEQ ID NO: 211557 - DNA, 24 bp, Artificial Sequence
  Description of Artificial Sequence: Synthetic oligonucleotide
gggtcctcccgacaggacaccact

SEQ ID NO: 211558 - DNA, 24 bp, Artificial Sequence
  Description of Artificial Sequence: Synthetic oligonucleotide
ggtcctcccgacaggacaccactc

SEQ ID NO: 211559 - DNA, 24 bp, Artificial Sequence
  Description of Artificial Sequence: Synthetic oligonucleotide
gtcctcccgacaggacaccactcc

SEQ ID NO: 211560 - DNA, 25 bp, Artificial Sequence
  Description of Artificial Sequence: Synthetic oligonucleotide
tcctcccgacaggacaccactccca

SEQ ID NO: 211561 - DNA, 24 bp, Artificial Sequence
  Description of Artificial Sequence: Synthetic oligonucleotide
cctcccgacaggacaccactccca

SEQ ID NO: 211562 - DNA, 24 bp, Artificial Sequence
  Description of Artificial Sequence: Synthetic oligonucleotide
ctcccgacaggacaccactcccac

SEQ ID NO: 211563 - DNA, 24 bp, Artificial Sequence
  Description of Artificial Sequence: Synthetic oligonucleotide
tcccgacaggacaccactcccacc

SEQ ID NO: 211564 - DNA, 23 bp, Artificial Sequence
  Description of Artificial Sequence: Synthetic oligonucleotide
cccgacaggacaccactcccacc

SEQ ID NO: 211565 - DNA, 23 bp, Artificial Sequence
  Description of Artificial Sequence: Synthetic oligonucleotide
ccgacaggacaccactcccaccc

SEQ ID NO: 211566 - DNA, 23 bp, Artificial Sequence
  Description of Artificial Sequence: Synthetic oligonucleotide
cgacaggacaccactcccacccg

SEQ ID NO: 211567 - DNA, 23 bp, Artificial Sequence
  Description of Artificial Sequence: Synthetic oligonucleotide
gacaggacaccactcccacccgc

SEQ ID NO: 211568 - DNA, 23 bp, Artificial Sequence
  Description of Artificial Sequence: Synthetic oligonucleotide
acaggacaccactcccacccgcc

SEQ ID NO: 211569 - DNA, 22 bp, Artificial Sequence
  Description of Artificial Sequence: Synthetic oligonucleotide
caggacaccactcccacccgcc

SEQ ID NO: 211570 - DNA, 22 bp, Artificial Sequence
  Description of Artificial Sequence: Synthetic oligonucleotide
aggacaccactcccacccgccc

SEQ ID NO: 211571 - DNA, 21 bp, Artificial Sequence
  Description of Artificial Sequence: Synthetic oligonucleotide
ggacaccactcccacccgccc

SEQ ID NO: 211572 - DNA, 22 bp, Artificial Sequence
  Description of Artificial Sequence: Synthetic oligonucleotide
gacaccactcccacccgcccca

SEQ ID NO: 211573 - DNA, 22 bp, Artificial Sequence
  Description of Artificial Sequence: Synthetic oligonucleotide
acaccactcccacccgccccac

SEQ ID NO: 211574 - DNA, 21 bp, Artificial Sequence
  Description of Artificial Sequence: Synthetic oligonucleotide
caccactcccacccgccccac

SEQ ID NO: 211575 - DNA, 21 bp, Artificial Sequence
  Description of Artificial Sequence: Synthetic oligonucleotide
accactcccacccgccccacc

SEQ ID NO: 211576 - DNA, 20 bp, Artificial Sequence
  Description of Artificial Sequence: Synthetic oligonucleotide
ccactcccacccgccccacc

SEQ ID NO: 211577 - DNA, 21 bp, Artificial Sequence
  Description of Artificial Sequence: Synthetic oligonucleotide
cactcccacccgccccaccct

SEQ ID NO: 211578 - DNA, 21 bp, Artificial Sequence
  Description of Artificial Sequence: Synthetic oligonucleotide
actcccacccgccccaccctc

SEQ ID NO: 211579 - DNA, 20 bp, Artificial Sequence
  Description of Artificial Sequence: Synthetic oligonucleotide
ctcccacccgccccaccctc

SEQ ID NO: 211580 - DNA, 21 bp, Artificial Sequence
  Description of Artificial Sequence: Synthetic oligonucleotide
tcccacccgccccaccctcct

SEQ ID NO: 211581 - DNA, 20 bp, Artificial Sequence
  Description of Artificial Sequence: Synthetic oligonucleotide
cccacccgccccaccctcct

SEQ ID NO: 211582 - DNA, 22 bp, Artificial Sequence
  Description of Artificial Sequence: Synthetic oligonucleotide
ccacccgccccaccctcctgat

SEQ ID NO: 211583 - DNA, 22 bp, Artificial Sequence
  Description of Artificial Sequence: Synthetic oligonucleotide
cacccgccccaccctcctgatc

SEQ ID NO: 211584 - DNA, 23 bp, Artificial Sequence
  Description of Artificial Sequence: Synthetic oligonucleotide
acccgccccaccctcctgatcct

SEQ ID NO: 211585 - DNA, 22 bp, Artificial Sequence
  Description of Artificial Sequence: Synthetic oligonucleotide
cccgccccaccctcctgatcct

SEQ ID NO: 211586 - DNA, 22 bp, Artificial Sequence
  Description of Artificial Sequence: Synthetic oligonucleotide
ccgccccaccctcctgatcctg

SEQ ID NO: 211587 - DNA, 25 bp, Artificial Sequence
  Description of Artificial Sequence: Synthetic oligonucleotide
cgccccaccctcctgatcctgctat

SEQ ID NO: 211588 - DNA, 25 bp, Artificial Sequence
  Description of Artificial Sequence: Synthetic oligonucleotide
gccccaccctcctgatcctgctatg

SEQ ID NO: 211589 - DNA, 26 bp, Artificial Sequence
  Description of Artificial Sequence: Synthetic oligonucleotide
ccccaccctcctgatcctgctatgga

SEQ ID NO: 211590 - DNA, 27 bp, Artificial Sequence
  Description of Artificial Sequence: Synthetic oligonucleotide
cccaccctcctgatcctgctatggaca

SEQ ID NO: 211591 - DNA, 28 bp, Artificial Sequence
  Description of Artificial Sequence: Synthetic oligonucleotide
ccaccctcctgatcctgctatggacatg

SEQ ID NO: 211592 - DNA, 28 bp, Artificial Sequence
  Description of Artificial Sequence: Synthetic oligonucleotide
caccctcctgatcctgctatggacatgg

SEQ ID NO: 211593 - DNA, 28 bp, Artificial Sequence
  Description of Artificial Sequence: Synthetic oligonucleotide
accctcctgatcctgctatggacatggc

SEQ ID NO: 211594 - DNA, 27 bp, Artificial Sequence
  Description of Artificial Sequence: Synthetic oligonucleotide
ccctcctgatcctgctatggacatggc

SEQ ID NO: 211595 - DNA, 27 bp, Artificial Sequence
  Description of Artificial Sequence: Synthetic oligonucleotide
cctcctgatcctgctatggacatggcc

SEQ ID NO: 211596 - DNA, 30 bp, Artificial Sequence
  Description of Artificial Sequence: Synthetic oligonucleotide
ctcctgatcctgctatggacatggcctttc

SEQ ID NO: 211597 - DNA, 30 bp, Artificial Sequence
  Description of Artificial Sequence: Synthetic oligonucleotide
tcctgatcctgctatggacatggcctttcc

SEQ ID NO: 211598 - DNA, 29 bp, Artificial Sequence
  Description of Artificial Sequence: Synthetic oligonucleotide
cctgatcctgctatggacatggcctttcc

SEQ ID NO: 211599 - DNA, 30 bp, Artificial Sequence
  Description of Artificial Sequence: Synthetic oligonucleotide
ctgatcctgctatggacatggcctttccac

SEQ ID NO: 211600 - DNA, 32 bp, Artificial Sequence
  Description of Artificial Sequence: Synthetic oligonucleotide
tgatcctgctatggacatggcctttccacatc

SEQ ID NO: 211601 - DNA, 31 bp, Artificial Sequence
  Description of Artificial Sequence: Synthetic oligonucleotide
gatcctgctatggacatggcctttccacatc

SEQ ID NO: 211602 - DNA, 31 bp, Artificial Sequence
  Description of Artificial Sequence: Synthetic oligonucleotide
atcctgctatggacatggcctttccacatcc

SEQ ID NO: 211603 - DNA, 30 bp, Artificial Sequence
  Description of Artificial Sequence: Synthetic oligonucleotide
tcctgctatggacatggcctttccacatcc

SEQ ID NO: 211604 - DNA, 29 bp, Artificial Sequence
  Description of Artificial Sequence: Synthetic oligonucleotide
cctgctatggacatggcctttccacatcc

SEQ ID NO: 211605 - DNA, 29 bp, Artificial Sequence
  Description of Artificial Sequence: Synthetic oligonucleotide
ctgctatggacatggcctttccacatccc

SEQ ID NO: 211606 - DNA, 30 bp, Artificial Sequence
  Description of Artificial Sequence: Synthetic oligonucleotide
tgctatggacatggcctttccacatccctg

SEQ ID NO: 211607 - DNA, 29 bp, Artificial Sequence
  Description of Artificial Sequence: Synthetic oligonucleotide
gctatggacatggcctttccacatccctg

SEQ ID NO: 211608 - DNA, 30 bp, Artificial Sequence
  Description of Artificial Sequence: Synthetic oligonucleotide
ctatggacatggcctttccacatccctgtg

SEQ ID NO: 211609 - DNA, 30 bp, Artificial Sequence
  Description of Artificial Sequence: Synthetic oligonucleotide
tatggacatggcctttccacatccctgtgg

SEQ ID NO: 211610 - DNA, 29 bp, Artificial Sequence
  Description of Artificial Sequence: Synthetic oligonucleotide
atggacatggcctttccacatccctgtgg

SEQ ID NO: 211611 - DNA, 28 bp, Artificial Sequence
  Description of Artificial Sequence: Synthetic oligonucleotide
tggacatggcctttccacatccctgtgg

SEQ ID NO: 211612 - DNA, 27 bp, Artificial Sequence
  Description of Artificial Sequence: Synthetic oligonucleotide
ggacatggcctttccacatccctgtgg

SEQ ID NO: 211613 - DNA, 27 bp, Artificial Sequence
  Description of Artificial Sequence: Synthetic oligonucleotide
gacatggcctttccacatccctgtggc

SEQ ID NO: 211614 - DNA, 28 bp, Artificial Sequence
  Description of Artificial Sequence: Synthetic oligonucleotide
acatggcctttccacatccctgtggctc

SEQ ID NO: 211615 - DNA, 27 bp, Artificial Sequence
  Description of Artificial Sequence: Synthetic oligonucleotide
catggcctttccacatccctgtggctc

SEQ ID NO: 211616 - DNA, 28 bp, Artificial Sequence
  Description of Artificial Sequence: Synthetic oligonucleotide
atggcctttccacatccctgtggctctg

SEQ ID NO: 211617 - DNA, 27 bp, Artificial Sequence
  Description of Artificial Sequence: Synthetic oligonucleotide
tggcctttccacatccctgtggctctg

SEQ ID NO: 211618 - DNA, 27 bp, Artificial Sequence
  Description of Artificial Sequence: Synthetic oligonucleotide
ggcctttccacatccctgtggctctgt

SEQ ID NO: 211619 - DNA, 27 bp, Artificial Sequence
  Description of Artificial Sequence: Synthetic oligonucleotide
gcctttccacatccctgtggctctgtc

SEQ ID NO: 211620 - DNA, 27 bp, Artificial Sequence
  Description of Artificial Sequence: Synthetic oligonucleotide
cctttccacatccctgtggctctgtcc

SEQ ID NO: 211621 - DNA, 27 bp, Artificial Sequence
  Description of Artificial Sequence: Synthetic oligonucleotide
ctttccacatccctgtggctctgtccc

SEQ ID NO: 211622 - DNA, 27 bp, Artificial Sequence
  Description of Artificial Sequence: Synthetic oligonucleotide
tttccacatccctgtggctctgtcccg

SEQ ID NO: 211623 - DNA, 26 bp, Artificial Sequence
  Description of Artificial Sequence: Synthetic oligonucleotide
ttccacatccctgtggctctgtcccg

SEQ ID NO: 211624 - DNA, 25 bp, Artificial Sequence
  Description of Artificial Sequence: Synthetic oligonucleotide
tccacatccctgtggctctgtcccg

SEQ ID NO: 211625 - DNA, 24 bp, Artificial Sequence
  Description of Artificial Sequence: Synthetic oligonucleotide
ccacatccctgtggctctgtcccg

SEQ ID NO: 211626 - DNA, 25 bp, Artificial Sequence
  Description of Artificial Sequence: Synthetic oligonucleotide
cacatccctgtggctctgtcccgct

SEQ ID NO: 211627 - DNA, 27 bp, Artificial Sequence
  Description of Artificial Sequence: Synthetic oligonucleotide
acatccctgtggctctgtcccgctgtt

SEQ ID NO: 211628 - DNA, 26 bp, Artificial Sequence
  Description of Artificial Sequence: Synthetic oligonucleotide
catccctgtggctctgtcccgctgtt

SEQ ID NO: 211629 - DNA, 27 bp, Artificial Sequence
  Description of Artificial Sequence: Synthetic oligonucleotide
atccctgtggctctgtcccgctgttca

SEQ ID NO: 211630 - DNA, 26 bp, Artificial Sequence
  Description of Artificial Sequence: Synthetic oligonucleotide
tccctgtggctctgtcccgctgttca

SEQ ID NO: 211631 - DNA, 25 bp, Artificial Sequence
  Description of Artificial Sequence: Synthetic oligonucleotide
ccctgtggctctgtcccgctgttca

SEQ ID NO: 211632 - DNA, 26 bp, Artificial Sequence
  Description of Artificial Sequence: Synthetic oligonucleotide
cctgtggctctgtcccgctgttcaga

SEQ ID NO: 211633 - DNA, 27 bp, Artificial Sequence
  Description of Artificial Sequence: Synthetic oligonucleotide
ctgtggctctgtcccgctgttcagaga

SEQ ID NO: 211634 - DNA, 28 bp, Artificial Sequence
  Description of Artificial Sequence: Synthetic oligonucleotide
tgtggctctgtcccgctgttcagagatg

SEQ ID NO: 211635 - DNA, 27 bp, Artificial Sequence
  Description of Artificial Sequence: Synthetic oligonucleotide
gtggctctgtcccgctgttcagagatg

SEQ ID NO: 211636 - DNA, 27 bp, Artificial Sequence
  Description of Artificial Sequence: Synthetic oligonucleotide
tggctctgtcccgctgttcagagatgg

SEQ ID NO: 211637 - DNA, 27 bp, Artificial Sequence
  Description of Artificial Sequence: Synthetic oligonucleotide
ggctctgtcccgctgttcagagatggt

SEQ ID NO: 211638 - DNA, 27 bp, Artificial Sequence
  Description of Artificial Sequence: Synthetic oligonucleotide
gctctgtcccgctgttcagagatggtg

SEQ ID NO: 211639 - DNA, 27 bp, Artificial Sequence
  Description of Artificial Sequence: Synthetic oligonucleotide
ctctgtcccgctgttcagagatggtgc

SEQ ID NO: 211640 - DNA, 27 bp, Artificial Sequence
  Description of Artificial Sequence: Synthetic oligonucleotide
tctgtcccgctgttcagagatggtgcc

SEQ ID NO: 211641 - DNA, 26 bp, Artificial Sequence
  Description of Artificial Sequence: Synthetic oligonucleotide
ctgtcccgctgttcagagatggtgcc

SEQ ID NO: 211642 - DNA, 26 bp, Artificial Sequence
  Description of Artificial Sequence: Synthetic oligonucleotide
tgtcccgctgttcagagatggtgccc

SEQ ID NO: 211643 - DNA, 25 bp, Artificial Sequence
  Description of Artificial Sequence: Synthetic oligonucleotide
gtcccgctgttcagagatggtgccc

SEQ ID NO: 211644 - DNA, 25 bp, Artificial Sequence
  Description of Artificial Sequence: Synthetic oligonucleotide
tcccgctgttcagagatggtgcccg

SEQ ID NO: 211645 - DNA, 24 bp, Artificial Sequence
  Description of Artificial Sequence: Synthetic oligonucleotide
cccgctgttcagagatggtgcccg

SEQ ID NO: 211646 - DNA, 24 bp, Artificial Sequence
  Description of Artificial Sequence: Synthetic oligonucleotide
ccgctgttcagagatggtgcccgg

SEQ ID NO: 211647 - DNA, 25 bp, Artificial Sequence
  Description of Artificial Sequence: Synthetic oligonucleotide
cgctgttcagagatggtgcccggca

SEQ ID NO: 211648 - DNA, 26 bp, Artificial Sequence
  Description of Artificial Sequence: Synthetic oligonucleotide
gctgttcagagatggtgcccggcaca

SEQ ID NO: 211649 - DNA, 26 bp, Artificial Sequence
  Description of Artificial Sequence: Synthetic oligonucleotide
ctgttcagagatggtgcccggcacag

SEQ ID NO: 211650 - DNA, 26 bp, Artificial Sequence
  Description of Artificial Sequence: Synthetic oligonucleotide
tgttcagagatggtgcccggcacagc

SEQ ID NO: 211651 - DNA, 25 bp, Artificial Sequence
  Description of Artificial Sequence: Synthetic oligonucleotide
gttcagagatggtgcccggcacagc

SEQ ID NO: 211652 - DNA, 25 bp, Artificial Sequence
  Description of Artificial Sequence: Synthetic oligonucleotide
ttcagagatggtgcccggcacagcc

SEQ ID NO: 211653 - DNA, 24 bp, Artificial Sequence
  Description of Artificial Sequence: Synthetic oligonucleotide
tcagagatggtgcccggcacagcc

SEQ ID NO: 211654 - DNA, 23 bp, Artificial Sequence
  Description of Artificial Sequence: Synthetic oligonucleotide
cagagatggtgcccggcacagcc

SEQ ID NO: 211655 - DNA, 24 bp, Artificial Sequence
  Description of Artificial Sequence: Synthetic oligonucleotide
agagatggtgcccggcacagccga

SEQ ID NO: 211656 - DNA, 23 bp, Artificial Sequence
  Description of Artificial Sequence: Synthetic oligonucleotide
gagatggtgcccggcacagccga

SEQ ID NO: 211657 - DNA, 24 bp, Artificial Sequence
  Description of Artificial Sequence: Synthetic oligonucleotide
agatggtgcccggcacagccgact

SEQ ID NO: 211658 - DNA, 23 bp, Artificial Sequence
  Description of Artificial Sequence: Synthetic oligonucleotide
gatggtgcccggcacagccgact

SEQ ID NO: 211659 - DNA, 23 bp, Artificial Sequence
  Description of Artificial Sequence: Synthetic oligonucleotide
atggtgcccggcacagccgactg

SEQ ID NO: 211660 - DNA, 22 bp, Artificial Sequence
  Description of Artificial Sequence: Synthetic oligonucleotide
tggtgcccggcacagccgactg

SEQ ID NO: 211661 - DNA, 21 bp, Artificial Sequence
  Description of Artificial Sequence: Synthetic oligonucleotide
ggtgcccggcacagccgactg

SEQ ID NO: 211662 - DNA, 21 bp, Artificial Sequence
  Description of Artificial Sequence: Synthetic oligonucleotide
gtgcccggcacagccgactgc

SEQ ID NO: 211663 - DNA, 22 bp, Artificial Sequence
  Description of Artificial Sequence: Synthetic oligonucleotide
tgcccggcacagccgactgcca

SEQ ID NO: 211664 - DNA, 21 bp, Artificial Sequence
  Description of Artificial Sequence: Synthetic oligonucleotide
gcccggcacagccgactgcca

SEQ ID NO: 211665 - DNA, 23 bp, Artificial Sequence
  Description of Artificial Sequence: Synthetic oligonucleotide
cccggcacagccgactgccacat

SEQ ID NO: 211666 - DNA, 24 bp, Artificial Sequence
  Description of Artificial Sequence: Synthetic oligonucleotide
ccggcacagccgactgccacatca

SEQ ID NO: 211667 - DNA, 25 bp, Artificial Sequence
  Description of Artificial Sequence: Synthetic oligonucleotide
cggcacagccgactgccacatcact

SEQ ID NO: 211668 - DNA, 25 bp, Artificial Sequence
  Description of Artificial Sequence: Synthetic oligonucleotide
ggcacagccgactgccacatcactg

SEQ ID NO: 211669 - DNA, 25 bp, Artificial Sequence
  Description of Artificial Sequence: Synthetic oligonucleotide
gcacagccgactgccacatcactgc

SEQ ID NO: 211670 - DNA, 25 bp, Artificial Sequence
  Description of Artificial Sequence: Synthetic oligonucleotide
cacagccgactgccacatcactgcc

SEQ ID NO: 211671 - DNA, 26 bp, Artificial Sequence
  Description of Artificial Sequence: Synthetic oligonucleotide
acagccgactgccacatcactgccga

SEQ ID NO: 211672 - DNA, 25 bp, Artificial Sequence
  Description of Artificial Sequence: Synthetic oligonucleotide
cagccgactgccacatcactgccga

SEQ ID NO: 211673 - DNA, 25 bp, Artificial Sequence
  Description of Artificial Sequence: Synthetic oligonucleotide
agccgactgccacatcactgccgac

SEQ ID NO: 211674 - DNA, 24 bp, Artificial Sequence
  Description of Artificial Sequence: Synthetic oligonucleotide
gccgactgccacatcactgccgac

SEQ ID NO: 211675 - DNA, 24 bp, Artificial Sequence
  Description of Artificial Sequence: Synthetic oligonucleotide
ccgactgccacatcactgccgacc

SEQ ID NO: 211676 - DNA, 24 bp, Artificial Sequence
  Description of Artificial Sequence: Synthetic oligonucleotide
cgactgccacatcactgccgaccg

SEQ ID NO: 211677 - DNA, 26 bp, Artificial Sequence
  Description of Artificial Sequence: Synthetic oligonucleotide
gactgccacatcactgccgaccgcaa

SEQ ID NO: 211678 - DNA, 26 bp, Artificial Sequence
  Description of Artificial Sequence: Synthetic oligonucleotide
actgccacatcactgccgaccgcaag

SEQ ID NO: 211679 - DNA, 25 bp, Artificial Sequence
  Description of Artificial Sequence: Synthetic oligonucleotide
ctgccacatcactgccgaccgcaag

SEQ ID NO: 211680 - DNA, 26 bp, Artificial Sequence
  Description of Artificial Sequence: Synthetic oligonucleotide
tgccacatcactgccgaccgcaaggt

SEQ ID NO: 211681 - DNA, 25 bp, Artificial Sequence
  Description of Artificial Sequence: Synthetic oligonucleotide
gccacatcactgccgaccgcaaggt

SEQ ID NO: 211682 - DNA, 27 bp, Artificial Sequence
  Description of Artificial Sequence: Synthetic oligonucleotide
ccacatcactgccgaccgcaaggtgta

SEQ ID NO: 211683 - DNA, 27 bp, Artificial Sequence
  Description of Artificial Sequence: Synthetic oligonucleotide
cacatcactgccgaccgcaaggtgtac

SEQ ID NO: 211684 - DNA, 27 bp, Artificial Sequence
  Description of Artificial Sequence: Synthetic oligonucleotide
acatcactgccgaccgcaaggtgtacc

SEQ ID NO: 211685 - DNA, 26 bp, Artificial Sequence
  Description of Artificial Sequence: Synthetic oligonucleotide
catcactgccgaccgcaaggtgtacc

SEQ ID NO: 211686 - DNA, 27 bp, Artificial Sequence
  Description of Artificial Sequence: Synthetic oligonucleotide
atcactgccgaccgcaaggtgtaccca

SEQ ID NO: 211687 - DNA, 26 bp, Artificial Sequence
  Description of Artificial Sequence: Synthetic oligonucleotide
tcactgccgaccgcaaggtgtaccca

SEQ ID NO: 211688 - DNA, 25 bp, Artificial Sequence
  Description of Artificial Sequence: Synthetic oligonucleotide
cactgccgaccgcaaggtgtaccca

SEQ ID NO: 211689 - DNA, 26 bp, Artificial Sequence
  Description of Artificial Sequence: Synthetic oligonucleotide
actgccgaccgcaaggtgtacccaca

SEQ ID NO: 211690 - DNA, 25 bp, Artificial Sequence
  Description of Artificial Sequence: Synthetic oligonucleotide
ctgccgaccgcaaggtgtacccaca

SEQ ID NO: 211691 - DNA, 25 bp, Artificial Sequence
  Description of Artificial Sequence: Synthetic oligonucleotide
tgccgaccgcaaggtgtacccacag

SEQ ID NO: 211692 - DNA, 24 bp, Artificial Sequence
  Description of Artificial Sequence: Synthetic oligonucleotide
gccgaccgcaaggtgtacccacag

SEQ ID NO: 211693 - DNA, 24 bp, Artificial Sequence
  Description of Artificial Sequence: Synthetic oligonucleotide
ccgaccgcaaggtgtacccacagg

SEQ ID NO: 211694 - DNA, 25 bp, Artificial Sequence
  Description of Artificial Sequence: Synthetic oligonucleotide
cgaccgcaaggtgtacccacaggca

SEQ ID NO: 211695 - DNA, 26 bp, Artificial Sequence
  Description of Artificial Sequence: Synthetic oligonucleotide
gaccgcaaggtgtacccacaggcaga

SEQ ID NO: 211696 - DNA, 27 bp, Artificial Sequence
  Description of Artificial Sequence: Synthetic oligonucleotide
accgcaaggtgtacccacaggcagaca

SEQ ID NO: 211697 - DNA, 26 bp, Artificial Sequence
  Description of Artificial Sequence: Synthetic oligonucleotide
ccgcaaggtgtacccacaggcagaca

SEQ ID NO: 211698 - DNA, 26 bp, Artificial Sequence
  Description of Artificial Sequence: Synthetic oligonucleotide
cgcaaggtgtacccacaggcagacac

SEQ ID NO: 211699 - DNA, 26 bp, Artificial Sequence
  Description of Artificial Sequence: Synthetic oligonucleotide
gcaaggtgtacccacaggcagacacg

SEQ ID NO: 211700 - DNA, 27 bp, Artificial Sequence
  Description of Artificial Sequence: Synthetic oligonucleotide
caaggtgtacccacaggcagacacggt

SEQ ID NO: 211701 - DNA, 27 bp, Artificial Sequence
  Description of Artificial Sequence: Synthetic oligonucleotide
aaggtgtacccacaggcagacacggtc

SEQ ID NO: 211702 - DNA, 27 bp, Artificial Sequence
  Description of Artificial Sequence: Synthetic oligonucleotide
aggtgtacccacaggcagacacggtca

SEQ ID NO: 211703 - DNA, 27 bp, Artificial Sequence
  Description of Artificial Sequence: Synthetic oligonucleotide
ggtgtacccacaggcagacacggtcat

SEQ ID NO: 211704 - DNA, 27 bp, Artificial Sequence
  Description of Artificial Sequence: Synthetic oligonucleotide
gtgtacccacaggcagacacggtcatc

SEQ ID NO: 211705 - DNA, 27 bp, Artificial Sequence
  Description of Artificial Sequence: Synthetic oligonucleotide
tgtacccacaggcagacacggtcatcg

SEQ ID NO: 211706 - DNA, 27 bp, Artificial Sequence
  Description of Artificial Sequence: Synthetic oligonucleotide
gtacccacaggcagacacggtcatcgt

SEQ ID NO: 211707 - DNA, 27 bp, Artificial Sequence
  Description of Artificial Sequence: Synthetic oligonucleotide
tacccacaggcagacacggtcatcgtg

SEQ ID NO: 211708 - DNA, 26 bp, Artificial Sequence
  Description of Artificial Sequence: Synthetic oligonucleotide
acccacaggcagacacggtcatcgtg

SEQ ID NO: 211709 - DNA, 25 bp, Artificial Sequence
  Description of Artificial Sequence: Synthetic oligonucleotide
cccacaggcagacacggtcatcgtg

SEQ ID NO: 211710 - DNA, 26 bp, Artificial Sequence
  Description of Artificial Sequence: Synthetic oligonucleotide
ccacaggcagacacggtcatcgtgca

SEQ ID NO: 211711 - DNA, 26 bp, Artificial Sequence
  Description of Artificial Sequence: Synthetic oligonucleotide
cacaggcagacacggtcatcgtgcac

SEQ ID NO: 211712 - DNA, 27 bp, Artificial Sequence
  Description of Artificial Sequence: Synthetic oligonucleotide
acaggcagacacggtcatcgtgcacca

SEQ ID NO: 211713 - DNA, 26 bp, Artificial Sequence
  Description of Artificial Sequence: Synthetic oligonucleotide
caggcagacacggtcatcgtgcacca

SEQ ID NO: 211714 - DNA, 27 bp, Artificial Sequence
  Description of Artificial Sequence: Synthetic oligonucleotide
aggcagacacggtcatcgtgcaccact

SEQ ID NO: 211715 - DNA, 26 bp, Artificial Sequence
  Description of Artificial Sequence: Synthetic oligonucleotide
ggcagacacggtcatcgtgcaccact

SEQ ID NO: 211716 - DNA, 26 bp, Artificial Sequence
  Description of Artificial Sequence: Synthetic oligonucleotide
gcagacacggtcatcgtgcaccactg

SEQ ID NO: 211717 - DNA, 26 bp, Artificial Sequence
  Description of Artificial Sequence: Synthetic oligonucleotide
cagacacggtcatcgtgcaccactgg

SEQ ID NO: 211718 - DNA, 27 bp, Artificial Sequence
  Description of Artificial Sequence: Synthetic oligonucleotide
agacacggtcatcgtgcaccactggga

SEQ ID NO: 211719 - DNA, 27 bp, Artificial Sequence
  Description of Artificial Sequence: Synthetic oligonucleotide
gacacggtcatcgtgcaccactgggat

SEQ ID NO: 211720 - DNA, 29 bp, Artificial Sequence
  Description of Artificial Sequence: Synthetic oligonucleotide
acacggtcatcgtgcaccactgggatatc

SEQ ID NO: 211721 - DNA, 28 bp, Artificial Sequence
  Description of Artificial Sequence: Synthetic oligonucleotide
cacggtcatcgtgcaccactgggatatc

SEQ ID NO: 211722 - DNA, 30 bp, Artificial Sequence
  Description of Artificial Sequence: Synthetic oligonucleotide
acggtcatcgtgcaccactgggatatcatg

SEQ ID NO: 211723 - DNA, 29 bp, Artificial Sequence
  Description of Artificial Sequence: Synthetic oligonucleotide
cggtcatcgtgcaccactgggatatcatg

SEQ ID NO: 211724 - DNA, 30 bp, Artificial Sequence
  Description of Artificial Sequence: Synthetic oligonucleotide
ggtcatcgtgcaccactgggatatcatgtc

SEQ ID NO: 211725 - DNA, 30 bp, Artificial Sequence
  Description of Artificial Sequence: Synthetic oligonucleotide
gtcatcgtgcaccactgggatatcatgtcc

SEQ ID NO: 211726 - DNA, 32 bp, Artificial Sequence
  Description of Artificial Sequence: Synthetic oligonucleotide
tcatcgtgcaccactgggatatcatgtccaac

SEQ ID NO: 211727 - DNA, 31 bp, Artificial Sequence
  Description of Artificial Sequence: Synthetic oligonucleotide
catcgtgcaccactgggatatcatgtccaac

SEQ ID NO: 211728 - DNA, 31 bp, Artificial Sequence
  Description of Artificial Sequence: Synthetic oligonucleotide
atcgtgcaccactgggatatcatgtccaacc

SEQ ID NO: 211729 - DNA, 30 bp, Artificial Sequence
  Description of Artificial Sequence: Synthetic oligonucleotide
tcgtgcaccactgggatatcatgtccaacc

SEQ ID NO: 211730 - DNA, 29 bp, Artificial Sequence
  Description of Artificial Sequence: Synthetic oligonucleotide
cgtgcaccactgggatatcatgtccaacc

SEQ ID NO: 211731 - DNA, 29 bp, Artificial Sequence
  Description of Artificial Sequence: Synthetic oligonucleotide
gtgcaccactgggatatcatgtccaaccc

SEQ ID NO: 211732 - DNA, 32 bp, Artificial Sequence
  Description of Artificial Sequence: Synthetic oligonucleotide
tgcaccactgggatatcatgtccaaccctaag

SEQ ID NO: 211733 - DNA, 31 bp, Artificial Sequence
  Description of Artificial Sequence: Synthetic oligonucleotide
gcaccactgggatatcatgtccaaccctaag

SEQ ID NO: 211734 - DNA, 32 bp, Artificial Sequence
  Description of Artificial Sequence: Synthetic oligonucleotide
caccactgggatatcatgtccaaccctaagtc

SEQ ID NO: 211735 - DNA, 33 bp, Artificial Sequence
  Description of Artificial Sequence: Synthetic oligonucleotide
accactgggatatcatgtccaaccctaagtcac

SEQ ID NO: 211736 - DNA, 32 bp, Artificial Sequence
  Description of Artificial Sequence: Synthetic oligonucleotide
ccactgggatatcatgtccaaccctaagtcac

SEQ ID NO: 211737 - DNA, 32 bp, Artificial Sequence
  Description of Artificial Sequence: Synthetic oligonucleotide
cactgggatatcatgtccaaccctaagtcacg

SEQ ID NO: 211738 - DNA, 32 bp, Artificial Sequence
  Description of Artificial Sequence: Synthetic oligonucleotide
actgggatatcatgtccaaccctaagtcacgc

SEQ ID NO: 211739 - DNA, 31 bp, Artificial Sequence
  Description of Artificial Sequence: Synthetic oligonucleotide
ctgggatatcatgtccaaccctaagtcacgc

SEQ ID NO: 211740 - DNA, 31 bp, Artificial Sequence
  Description of Artificial Sequence: Synthetic oligonucleotide
tgggatatcatgtccaaccctaagtcacgcc

SEQ ID NO: 211741 - DNA, 30 bp, Artificial Sequence
  Description of Artificial Sequence: Synthetic oligonucleotide
gggatatcatgtccaaccctaagtcacgcc

SEQ ID NO: 211742 - DNA, 31 bp, Artificial Sequence
  Description of Artificial Sequence: Synthetic oligonucleotide
ggatatcatgtccaaccctaagtcacgcctc

SEQ ID NO: 211743 - DNA, 31 bp, Artificial Sequence
  Description of Artificial Sequence: Synthetic oligonucleotide
gatatcatgtccaaccctaagtcacgcctcc

SEQ ID NO: 211744 - DNA, 31 bp, Artificial Sequence
  Description of Artificial Sequence: Synthetic oligonucleotide
atatcatgtccaaccctaagtcacgcctccc

SEQ ID NO: 211745 - DNA, 30 bp, Artificial Sequence
  Description of Artificial Sequence: Synthetic oligonucleotide
tatcatgtccaaccctaagtcacgcctccc

SEQ ID NO: 211746 - DNA, 29 bp, Artificial Sequence
  Description of Artificial Sequence: Synthetic oligonucleotide
atcatgtccaaccctaagtcacgcctccc

SEQ ID NO: 211747 - DNA, 28 bp, Artificial Sequence
  Description of Artificial Sequence: Synthetic oligonucleotide
tcatgtccaaccctaagtcacgcctccc

SEQ ID NO: 211748 - DNA, 27 bp, Artificial Sequence
  Description of Artificial Sequence: Synthetic oligonucleotide
catgtccaaccctaagtcacgcctccc

SEQ ID NO: 211749 - DNA, 28 bp, Artificial Sequence
  Description of Artificial Sequence: Synthetic oligonucleotide
atgtccaaccctaagtcacgcctcccac

SEQ ID NO: 211750 - DNA, 27 bp, Artificial Sequence
  Description of Artificial Sequence: Synthetic oligonucleotide
tgtccaaccctaagtcacgcctcccac

SEQ ID NO: 211751 - DNA, 26 bp, Artificial Sequence
  Description of Artificial Sequence: Synthetic oligonucleotide
gtccaaccctaagtcacgcctcccac

SEQ ID NO: 211752 - DNA, 27 bp, Artificial Sequence
  Description of Artificial Sequence: Synthetic oligonucleotide
tccaaccctaagtcacgcctcccacct

SEQ ID NO: 211753 - DNA, 27 bp, Artificial Sequence
  Description of Artificial Sequence: Synthetic oligonucleotide
ccaaccctaagtcacgcctcccacctt

SEQ ID NO: 211754 - DNA, 27 bp, Artificial Sequence
  Description of Artificial Sequence: Synthetic oligonucleotide
caaccctaagtcacgcctcccaccttc

SEQ ID NO: 211755 - DNA, 27 bp, Artificial Sequence
  Description of Artificial Sequence: Synthetic oligonucleotide
aaccctaagtcacgcctcccaccttcc

SEQ ID NO: 211756 - DNA, 26 bp, Artificial Sequence
  Description of Artificial Sequence: Synthetic oligonucleotide
accctaagtcacgcctcccaccttcc

SEQ ID NO: 211757 - DNA, 25 bp, Artificial Sequence
  Description of Artificial Sequence: Synthetic oligonucleotide
ccctaagtcacgcctcccaccttcc

SEQ ID NO: 211758 - DNA, 25 bp, Artificial Sequence
  Description of Artificial Sequence: Synthetic oligonucleotide
cctaagtcacgcctcccaccttccc

SEQ ID NO: 211759 - DNA, 25 bp, Artificial Sequence
  Description of Artificial Sequence: Synthetic oligonucleotide
ctaagtcacgcctcccaccttcccc

SEQ ID NO: 211760 - DNA, 26 bp, Artificial Sequence
  Description of Artificial Sequence: Synthetic oligonucleotide
taagtcacgcctcccaccttccccga

SEQ ID NO: 211761 - DNA, 25 bp, Artificial Sequence
  Description of Artificial Sequence: Synthetic oligonucleotide
aagtcacgcctcccaccttccccga

SEQ ID NO: 211762 - DNA, 24 bp, Artificial Sequence
  Description of Artificial Sequence: Synthetic oligonucleotide
agtcacgcctcccaccttccccga

SEQ ID NO: 211763 - DNA, 23 bp, Artificial Sequence
  Description of Artificial Sequence: Synthetic oligonucleotide
gtcacgcctcccaccttccccga

SEQ ID NO: 211764 - DNA, 23 bp, Artificial Sequence
  Description of Artificial Sequence: Synthetic oligonucleotide
tcacgcctcccaccttccccgag

SEQ ID NO: 211765 - DNA, 22 bp, Artificial Sequence
  Description of Artificial Sequence: Synthetic oligonucleotide
cacgcctcccaccttccccgag

SEQ ID NO: 211766 - DNA, 22 bp, Artificial Sequence
  Description of Artificial Sequence: Synthetic oligonucleotide
acgcctcccaccttccccgagg

SEQ ID NO: 211767 - DNA, 21 bp, Artificial Sequence
  Description of Artificial Sequence: Synthetic oligonucleotide
cgcctcccaccttccccgagg

SEQ ID NO: 211768 - DNA, 21 bp, Artificial Sequence
  Description of Artificial Sequence: Synthetic oligonucleotide
gcctcccaccttccccgaggc

SEQ ID NO: 211769 - DNA, 21 bp, Artificial Sequence
  Description of Artificial Sequence: Synthetic oligonucleotide
cctcccaccttccccgaggcc

SEQ ID NO: 211770 - DNA, 21 bp, Artificial Sequence
  Description of Artificial Sequence: Synthetic oligonucleotide
ctcccaccttccccgaggccg

SEQ ID NO: 211771 - DNA, 22 bp, Artificial Sequence
  Description of Artificial Sequence: Synthetic oligonucleotide
tcccaccttccccgaggccgca

SEQ ID NO: 211772 - DNA, 21 bp, Artificial Sequence
  Description of Artificial Sequence: Synthetic oligonucleotide
cccaccttccccgaggccgca

SEQ ID NO: 211773 - DNA, 21 bp, Artificial Sequence
  Description of Artificial Sequence: Synthetic oligonucleotide
ccaccttccccgaggccgcag

SEQ ID NO: 211774 - DNA, 21 bp, Artificial Sequence
  Description of Artificial Sequence: Synthetic oligonucleotide
caccttccccgaggccgcagg

SEQ ID NO: 211775 - DNA, 21 bp, Artificial Sequence
  Description of Artificial Sequence: Synthetic oligonucleotide
accttccccgaggccgcaggg

SEQ ID NO: 211776 - DNA, 20 bp, Artificial Sequence
  Description of Artificial Sequence: Synthetic oligonucleotide
ccttccccgaggccgcaggg

SEQ ID NO: 211777 - DNA, 20 bp, Artificial Sequence
  Description of Artificial Sequence: Synthetic oligonucleotide
cttccccgaggccgcagggg

SEQ ID NO: 211778 - DNA, 21 bp, Artificial Sequence
  Description of Artificial Sequence: Synthetic oligonucleotide
ttccccgaggccgcaggggca

SEQ ID NO: 211779 - DNA, 20 bp, Artificial Sequence
  Description of Artificial Sequence: Synthetic oligonucleotide
tccccgaggccgcaggggca

SEQ ID NO: 211780 - DNA, 20 bp, Artificial Sequence
  Description of Artificial Sequence: Synthetic oligonucleotide
ccccgaggccgcaggggcat

SEQ ID NO: 211781 - DNA, 20 bp, Artificial Sequence
  Description of Artificial Sequence: Synthetic oligonucleotide
cccgaggccgcaggggcagt

SEQ ID NO: 211782 - DNA, 20 bp, Artificial Sequence
  Description of Artificial Sequence: Synthetic oligonucleotide
ccgaggccgcaggggcagct

SEQ ID NO: 211783 - DNA, 20 bp, Artificial Sequence
  Description of Artificial Sequence: Synthetic oligonucleotide
cgaggccgcaggggcagcgt

SEQ ID NO: 211784 - DNA, 20 bp, Artificial Sequence
  Description of Artificial Sequence: Synthetic oligonucleotide
gaggccgcaggggcagcgct

SEQ ID NO: 211785 - DNA, 20 bp, Artificial Sequence
  Description of Artificial Sequence: Synthetic oligonucleotide
aggccgcaggggcagcgctg

SEQ ID NO: 211786 - DNA, 20 bp, Artificial Sequence
  Description of Artificial Sequence: Synthetic oligonucleotide
ggccgcaggggcagcgctgt

SEQ ID NO: 211787 - DNA, 21 bp, Artificial Sequence
  Description of Artificial Sequence: Synthetic oligonucleotide
gccgcaggggcagcgctggat

SEQ ID NO: 211788 - DNA, 22 bp, Artificial Sequence
  Description of Artificial Sequence: Synthetic oligonucleotide
ccgcaggggcagcgctggatct

SEQ ID NO: 211789 - DNA, 22 bp, Artificial Sequence
  Description of Artificial Sequence: Synthetic oligonucleotide
cgcaggggcagcgctggatctg

SEQ ID NO: 211790 - DNA, 24 bp, Artificial Sequence
  Description of Artificial Sequence: Synthetic oligonucleotide
gcaggggcagcgctggatctggtt

SEQ ID NO: 211791 - DNA, 26 bp, Artificial Sequence
  Description of Artificial Sequence: Synthetic oligonucleotide
caggggcagcgctggatctggttcaa

SEQ ID NO: 211792 - DNA, 27 bp, Artificial Sequence
  Description of Artificial Sequence: Synthetic oligonucleotide
aggggcagcgctggatctggttcaact

SEQ ID NO: 211793 - DNA, 27 bp, Artificial Sequence
  Description of Artificial Sequence: Synthetic oligonucleotide
ggggcagcgctggatctggttcaactt

SEQ ID NO: 211794 - DNA, 27 bp, Artificial Sequence
  Description of Artificial Sequence: Synthetic oligonucleotide
gggcagcgctggatctggttcaacttg

SEQ ID NO: 211795 - DNA, 27 bp, Artificial Sequence
  Description of Artificial Sequence: Synthetic oligonucleotide
ggcagcgctggatctggttcaacttgg

SEQ ID NO: 211796 - DNA, 28 bp, Artificial Sequence
  Description of Artificial Sequence: Synthetic oligonucleotide
gcagcgctggatctggttcaacttggag

SEQ ID NO: 211797 - DNA, 28 bp, Artificial Sequence
  Description of Artificial Sequence: Synthetic oligonucleotide
cagcgctggatctggttcaacttggagc

SEQ ID NO: 211798 - DNA, 28 bp, Artificial Sequence
  Description of Artificial Sequence: Synthetic oligonucleotide
agcgctggatctggttcaacttggagcc

SEQ ID NO: 211799 - DNA, 27 bp, Artificial Sequence
  Description of Artificial Sequence: Synthetic oligonucleotide
gcgctggatctggttcaacttggagcc

SEQ ID NO: 211800 - DNA, 28 bp, Artificial Sequence
  Description of Artificial Sequence: Synthetic oligonucleotide
cgctggatctggttcaacttggagccac

SEQ ID NO: 211801 - DNA, 28 bp, Artificial Sequence
  Description of Artificial Sequence: Synthetic oligonucleotide
gctggatctggttcaacttggagccacc

SEQ ID NO: 211802 - DNA, 28 bp, Artificial Sequence
  Description of Artificial Sequence: Synthetic oligonucleotide
ctggatctggttcaacttggagccaccc

SEQ ID NO: 211803 - DNA, 28 bp, Artificial Sequence
  Description of Artificial Sequence: Synthetic oligonucleotide
tggatctggttcaacttggagccacccc

SEQ ID NO: 211804 - DNA, 27 bp, Artificial Sequence
  Description of Artificial Sequence: Synthetic oligonucleotide
ggatctggttcaacttggagccacccc

SEQ ID NO: 211805 - DNA, 27 bp, Artificial Sequence
  Description of Artificial Sequence: Synthetic oligonucleotide
gatctggttcaacttggagccaccccc

SEQ ID NO: 211806 - DNA, 30 bp, Artificial Sequence
  Description of Artificial Sequence: Synthetic oligonucleotide
atctggttcaacttggagccaccccctaac

SEQ ID NO: 211807 - DNA, 29 bp, Artificial Sequence
  Description of Artificial Sequence: Synthetic oligonucleotide
tctggttcaacttggagccaccccctaac

SEQ ID NO: 211808 - DNA, 28 bp, Artificial Sequence
  Description of Artificial Sequence: Synthetic oligonucleotide
ctggttcaacttggagccaccccctaac

SEQ ID NO: 211809 - DNA, 29 bp, Artificial Sequence
  Description of Artificial Sequence: Synthetic oligonucleotide
tggttcaacttggagccaccccctaactg

SEQ ID NO: 211810 - DNA, 28 bp, Artificial Sequence
  Description of Artificial Sequence: Synthetic oligonucleotide
ggttcaacttggagccaccccctaactg

SEQ ID NO: 211811 - DNA, 28 bp, Artificial Sequence
  Description of Artificial Sequence: Synthetic oligonucleotide
gttcaacttggagccaccccctaactgc

SEQ ID NO: 211812 - DNA, 28 bp, Artificial Sequence
  Description of Artificial Sequence: Synthetic oligonucleotide
ttcaacttggagccaccccctaactgcc

SEQ ID NO: 211813 - DNA, 27 bp, Artificial Sequence
  Description of Artificial Sequence: Synthetic oligonucleotide
tcaacttggagccaccccctaactgcc

SEQ ID NO: 211814 - DNA, 27 bp, Artificial Sequence
  Description of Artificial Sequence: Synthetic oligonucleotide
caacttggagccaccccctaactgcca

SEQ ID NO: 211815 - DNA, 27 bp, Artificial Sequence
  Description of Artificial Sequence: Synthetic oligonucleotide
aacttggagccaccccctaactgccag

SEQ ID NO: 211816 - DNA, 26 bp, Artificial Sequence
  Description of Artificial Sequence: Synthetic oligonucleotide
acttggagccaccccctaactgccag

SEQ ID NO: 211817 - DNA, 25 bp, Artificial Sequence
  Description of Artificial Sequence: Synthetic oligonucleotide
cttggagccaccccctaactgccag

SEQ ID NO: 211818 - DNA, 26 bp, Artificial Sequence
  Description of Artificial Sequence: Synthetic oligonucleotide
ttggagccaccccctaactgccagca

SEQ ID NO: 211819 - DNA, 25 bp, Artificial Sequence
  Description of Artificial Sequence: Synthetic oligonucleotide
tggagccaccccctaactgccagca

SEQ ID NO: 211820 - DNA, 24 bp, Artificial Sequence
  Description of Artificial Sequence: Synthetic oligonucleotide
ggagccaccccctaactgccagca

SEQ ID NO: 211821 - DNA, 24 bp, Artificial Sequence
  Description of Artificial Sequence: Synthetic oligonucleotide
gagccaccccctaactgccagcac

SEQ ID NO: 211822 - DNA, 25 bp, Artificial Sequence
  Description of Artificial Sequence: Synthetic oligonucleotide
agccaccccctaactgccagcacct

SEQ ID NO: 211823 - DNA, 24 bp, Artificial Sequence
  Description of Artificial Sequence: Synthetic oligonucleotide
gccaccccctaactgccagcacct

SEQ ID NO: 211824 - DNA, 24 bp, Artificial Sequence
  Description of Artificial Sequence: Synthetic oligonucleotide
ccaccccctaactgccagcacctg

SEQ ID NO: 211825 - DNA, 26 bp, Artificial Sequence
  Description of Artificial Sequence: Synthetic oligonucleotide
caccccctaactgccagcacctggaa

SEQ ID NO: 211826 - DNA, 26 bp, Artificial Sequence
  Description of Artificial Sequence: Synthetic oligonucleotide
accccctaactgccagcacctggaag

SEQ ID NO: 211827 - DNA, 25 bp, Artificial Sequence
  Description of Artificial Sequence: Synthetic oligonucleotide
ccccctaactgccagcacctggaag

SEQ ID NO: 211828 - DNA, 25 bp, Artificial Sequence
  Description of Artificial Sequence: Synthetic oligonucleotide
cccctaactgccagcacctggaagc

SEQ ID NO: 211829 - DNA, 25 bp, Artificial Sequence
  Description of Artificial Sequence: Synthetic oligonucleotide
ccctaactgccagcacctggaagcc

SEQ ID NO: 211830 - DNA, 26 bp, Artificial Sequence
  Description of Artificial Sequence: Synthetic oligonucleotide
cctaactgccagcacctggaagccct

SEQ ID NO: 211831 - DNA, 26 bp, Artificial Sequence
  Description of Artificial Sequence: Synthetic oligonucleotide
ctaactgccagcacctggaagccctg

SEQ ID NO: 211832 - DNA, 27 bp, Artificial Sequence
  Description of Artificial Sequence: Synthetic oligonucleotide
taactgccagcacctggaagccctgga

SEQ ID NO: 211833 - DNA, 26 bp, Artificial Sequence
  Description of Artificial Sequence: Synthetic oligonucleotide
aactgccagcacctggaagccctgga

SEQ ID NO: 211834 - DNA, 25 bp, Artificial Sequence
  Description of Artificial Sequence: Synthetic oligonucleotide
actgccagcacctggaagccctgga

SEQ ID NO: 211835 - DNA, 24 bp, Artificial Sequence
  Description of Artificial Sequence: Synthetic oligonucleotide
ctgccagcacctggaagccctgga

SEQ ID NO: 211836 - DNA, 25 bp, Artificial Sequence
  Description of Artificial Sequence: Synthetic oligonucleotide
tgccagcacctggaagccctggaca

SEQ ID NO: 211837 - DNA, 24 bp, Artificial Sequence
  Description of Artificial Sequence: Synthetic oligonucleotide
gccagcacctggaagccctggaca

SEQ ID NO: 211838 - DNA, 27 bp, Artificial Sequence
  Description of Artificial Sequence: Synthetic oligonucleotide
ccagcacctggaagccctggacagata

SEQ ID NO: 211839 - DNA, 27 bp, Artificial Sequence
  Description of Artificial Sequence: Synthetic oligonucleotide
cagcacctggaagccctggacagatac

SEQ ID NO: 211840 - DNA, 29 bp, Artificial Sequence
  Description of Artificial Sequence: Synthetic oligonucleotide
agcacctggaagccctggacagatacttc

SEQ ID NO: 211841 - DNA, 28 bp, Artificial Sequence
  Description of Artificial Sequence: Synthetic oligonucleotide
gcacctggaagccctggacagatacttc

SEQ ID NO: 211842 - DNA, 31 bp, Artificial Sequence
  Description of Artificial Sequence: Synthetic oligonucleotide
cacctggaagccctggacagatacttcaatc

SEQ ID NO: 211843 - DNA, 32 bp, Artificial Sequence
  Description of Artificial Sequence: Synthetic oligonucleotide
acctggaagccctggacagatacttcaatctc

SEQ ID NO: 211844 - DNA, 31 bp, Artificial Sequence
  Description of Artificial Sequence: Synthetic oligonucleotide
cctggaagccctggacagatacttcaatctc

SEQ ID NO: 211845 - DNA, 32 bp, Artificial Sequence
  Description of Artificial Sequence: Synthetic oligonucleotide
ctggaagccctggacagatacttcaatctcac

SEQ ID NO: 211846 - DNA, 32 bp, Artificial Sequence
  Description of Artificial Sequence: Synthetic oligonucleotide
tggaagccctggacagatacttcaatctcacc

SEQ ID NO: 211847 - DNA, 31 bp, Artificial Sequence
  Description of Artificial Sequence: Synthetic oligonucleotide
ggaagccctggacagatacttcaatctcacc

SEQ ID NO: 211848 - DNA, 33 bp, Artificial Sequence
  Description of Artificial Sequence: Synthetic oligonucleotide
gaagccctggacagatacttcaatctcaccatg

SEQ ID NO: 211849 - DNA, 34 bp, Artificial Sequence
  Description of Artificial Sequence: Synthetic oligonucleotide
aagccctggacagatacttcaatctcaccatgtc

SEQ ID NO: 211850 - DNA, 33 bp, Artificial Sequence
  Description of Artificial Sequence: Synthetic oligonucleotide
agccctggacagatacttcaatctcaccatgtc

SEQ ID NO: 211851 - DNA, 32 bp, Artificial Sequence
  Description of Artificial Sequence: Synthetic oligonucleotide
gccctggacagatacttcaatctcaccatgtc

SEQ ID NO: 211852 - DNA, 32 bp, Artificial Sequence
  Description of Artificial Sequence: Synthetic oligonucleotide
ccctggacagatacttcaatctcaccatgtcc

SEQ ID NO: 211853 - DNA, 34 bp, Artificial Sequence
  Description of Artificial Sequence: Synthetic oligonucleotide
cctggacagatacttcaatctcaccatgtcctac

SEQ ID NO: 211854 - DNA, 34 bp, Artificial Sequence
  Description of Artificial Sequence: Synthetic oligonucleotide
ctggacagatacttcaatctcaccatgtcctacc

SEQ ID NO: 211855 - DNA, 34 bp, Artificial Sequence
  Description of Artificial Sequence: Synthetic oligonucleotide
tggacagatacttcaatctcaccatgtcctaccg

SEQ ID NO: 211856 - DNA, 33 bp, Artificial Sequence
  Description of Artificial Sequence: Synthetic oligonucleotide
ggacagatacttcaatctcaccatgtcctaccg

SEQ ID NO: 211857 - DNA, 33 bp, Artificial Sequence
  Description of Artificial Sequence: Synthetic oligonucleotide
gacagatacttcaatctcaccatgtcctaccgc

SEQ ID NO: 211858 - DNA, 34 bp, Artificial Sequence
  Description of Artificial Sequence: Synthetic oligonucleotide
acagatacttcaatctcaccatgtcctaccgcag

SEQ ID NO: 211859 - DNA, 33 bp, Artificial Sequence
  Description of Artificial Sequence: Synthetic oligonucleotide
cagatacttcaatctcaccatgtcctaccgcag

SEQ ID NO: 211860 - DNA, 33 bp, Artificial Sequence
  Description of Artificial Sequence: Synthetic oligonucleotide
agatacttcaatctcaccatgtcctaccgcagc

SEQ ID NO: 211861 - DNA, 32 bp, Artificial Sequence
  Description of Artificial Sequence: Synthetic oligonucleotide
gatacttcaatctcaccatgtcctaccgcagc

SEQ ID NO: 211862 - DNA, 32 bp, Artificial Sequence
  Description of Artificial Sequence: Synthetic oligonucleotide
atacttcaatctcaccatgtcctaccgcagcg

SEQ ID NO: 211863 - DNA, 31 bp, Artificial Sequence
  Description of Artificial Sequence: Synthetic oligonucleotide
tacttcaatctcaccatgtcctaccgcagcg

SEQ ID NO: 211864 - DNA, 30 bp, Artificial Sequence
  Description of Artificial Sequence: Synthetic oligonucleotide
acttcaatctcaccatgtcctaccgcagcg

SEQ ID NO: 211865 - DNA, 29 bp, Artificial Sequence
  Description of Artificial Sequence: Synthetic oligonucleotide
cttcaatctcaccatgtcctaccgcagcg

SEQ ID NO: 211866 - DNA, 30 bp, Artificial Sequence
  Description of Artificial Sequence: Synthetic oligonucleotide
ttcaatctcaccatgtcctaccgcagcgac

SEQ ID NO: 211867 - DNA, 29 bp, Artificial Sequence
  Description of Artificial Sequence: Synthetic oligonucleotide
tcaatctcaccatgtcctaccgcagcgac

SEQ ID NO: 211868 - DNA, 28 bp, Artificial Sequence
  Description of Artificial Sequence: Synthetic oligonucleotide
caatctcaccatgtcctaccgcagcgac

SEQ ID NO: 211869 - DNA, 29 bp, Artificial Sequence
  Description of Artificial Sequence: Synthetic oligonucleotide
aatctcaccatgtcctaccgcagcgactc

SEQ ID NO: 211870 - DNA, 28 bp, Artificial Sequence
  Description of Artificial Sequence: Synthetic oligonucleotide
atctcaccatgtcctaccgcagcgactc

SEQ ID NO: 211871 - DNA, 27 bp, Artificial Sequence
  Description of Artificial Sequence: Synthetic oligonucleotide
tctcaccatgtcctaccgcagcgactc

SEQ ID NO: 211872 - DNA, 26 bp, Artificial Sequence
  Description of Artificial Sequence: Synthetic oligonucleotide
ctcaccatgtcctaccgcagcgactc

SEQ ID NO: 211873 - DNA, 26 bp, Artificial Sequence
  Description of Artificial Sequence: Synthetic oligonucleotide
tcaccatgtcctaccgcagcgactcc

SEQ ID NO: 211874 - DNA, 25 bp, Artificial Sequence
  Description of Artificial Sequence: Synthetic oligonucleotide
caccatgtcctaccgcagcgactcc

SEQ ID NO: 211875 - DNA, 26 bp, Artificial Sequence
  Description of Artificial Sequence: Synthetic oligonucleotide
accatgtcctaccgcagcgactccga

SEQ ID NO: 211876 - DNA, 25 bp, Artificial Sequence
  Description of Artificial Sequence: Synthetic oligonucleotide
ccatgtcctaccgcagcgactccga

SEQ ID NO: 211877 - DNA, 27 bp, Artificial Sequence
  Description of Artificial Sequence: Synthetic oligonucleotide
catgtcctaccgcagcgactccgacat

SEQ ID NO: 211878 - DNA, 27 bp, Artificial Sequence
  Description of Artificial Sequence: Synthetic oligonucleotide
atgtcctaccgcagcgactccgacatc

SEQ ID NO: 211879 - DNA, 27 bp, Artificial Sequence
  Description of Artificial Sequence: Synthetic oligonucleotide
tgtcctaccgcagcgactccgacatct

SEQ ID NO: 211880 - DNA, 27 bp, Artificial Sequence
  Description of Artificial Sequence: Synthetic oligonucleotide
gtcctaccgcagcgactccgacatctt

SEQ ID NO: 211881 - DNA, 27 bp, Artificial Sequence
  Description of Artificial Sequence: Synthetic oligonucleotide
tcctaccgcagcgactccgacatcttc

SEQ ID NO: 211882 - DNA, 27 bp, Artificial Sequence
  Description of Artificial Sequence: Synthetic oligonucleotide
cctaccgcagcgactccgacatcttca

SEQ ID NO: 211883 - DNA, 27 bp, Artificial Sequence
  Description of Artificial Sequence: Synthetic oligonucleotide
ctaccgcagcgactccgacatcttcac

SEQ ID NO: 211884 - DNA, 27 bp, Artificial Sequence
  Description of Artificial Sequence: Synthetic oligonucleotide
taccgcagcgactccgacatcttcacg

SEQ ID NO: 211885 - DNA, 26 bp, Artificial Sequence
  Description of Artificial Sequence: Synthetic oligonucleotide
accgcagcgactccgacatcttcacg

SEQ ID NO: 211886 - DNA, 25 bp, Artificial Sequence
  Description of Artificial Sequence: Synthetic oligonucleotide
ccgcagcgactccgacatcttcacg

SEQ ID NO: 211887 - DNA, 25 bp, Artificial Sequence
  Description of Artificial Sequence: Synthetic oligonucleotide
cgcagcgactccgacatcttcacgc

SEQ ID NO: 211888 - DNA, 25 bp, Artificial Sequence
  Description of Artificial Sequence: Synthetic oligonucleotide
gcagcgactccgacatcttcacgcc

SEQ ID NO: 211889 - DNA, 27 bp, Artificial Sequence
  Description of Artificial Sequence: Synthetic oligonucleotide
cagcgactccgacatcttcacgcccta

SEQ ID NO: 211890 - DNA, 27 bp, Artificial Sequence
  Description of Artificial Sequence: Synthetic oligonucleotide
agcgactccgacatcttcacgccctac

SEQ ID NO: 211891 - DNA, 26 bp, Artificial Sequence
  Description of Artificial Sequence: Synthetic oligonucleotide
gcgactccgacatcttcacgccctac

SEQ ID NO: 211892 - DNA, 26 bp, Artificial Sequence
  Description of Artificial Sequence: Synthetic oligonucleotide
cgactccgacatcttcacgccctacg

SEQ ID NO: 211893 - DNA, 26 bp, Artificial Sequence
  Description of Artificial Sequence: Synthetic oligonucleotide
gactccgacatcttcacgccctacgg

SEQ ID NO: 211894 - DNA, 27 bp, Artificial Sequence
  Description of Artificial Sequence: Synthetic oligonucleotide
actccgacatcttcacgccctacggct

SEQ ID NO: 211895 - DNA, 26 bp, Artificial Sequence
  Description of Artificial Sequence: Synthetic oligonucleotide
ctccgacatcttcacgccctacggct

SEQ ID NO: 211896 - DNA, 26 bp, Artificial Sequence
  Description of Artificial Sequence: Synthetic oligonucleotide
tccgacatcttcacgccctacggctg

SEQ ID NO: 211897 - DNA, 25 bp, Artificial Sequence
  Description of Artificial Sequence: Synthetic oligonucleotide
ccgacatcttcacgccctacggctg

SEQ ID NO: 211898 - DNA, 25 bp, Artificial Sequence
  Description of Artificial Sequence: Synthetic oligonucleotide
cgacatcttcacgccctacggctgg

SEQ ID NO: 211899 - DNA, 26 bp, Artificial Sequence
  Description of Artificial Sequence: Synthetic oligonucleotide
gacatcttcacgccctacggctggct

SEQ ID NO: 211900 - DNA, 26 bp, Artificial Sequence
  Description of Artificial Sequence: Synthetic oligonucleotide
acatcttcacgccctacggctggctg

SEQ ID NO: 211901 - DNA, 25 bp, Artificial Sequence
  Description of Artificial Sequence: Synthetic oligonucleotide
catcttcacgccctacggctggctg

SEQ ID NO: 211902 - DNA, 26 bp, Artificial Sequence
  Description of Artificial Sequence: Synthetic oligonucleotide
atcttcacgccctacggctggctgga

SEQ ID NO: 211903 - DNA, 25 bp, Artificial Sequence
  Description of Artificial Sequence: Synthetic oligonucleotide
tcttcacgccctacggctggctgga

SEQ ID NO: 211904 - DNA, 24 bp, Artificial Sequence
  Description of Artificial Sequence: Synthetic oligonucleotide
cttcacgccctacggctggctgga

SEQ ID NO: 211905 - DNA, 24 bp, Artificial Sequence
  Description of Artificial Sequence: Synthetic oligonucleotide
ttcacgccctacggctggctggag

SEQ ID NO: 211906 - DNA, 23 bp, Artificial Sequence
  Description of Artificial Sequence: Synthetic oligonucleotide
tcacgccctacggctggctggag

SEQ ID NO: 211907 - DNA, 22 bp, Artificial Sequence
  Description of Artificial Sequence: Synthetic oligonucleotide
cacgccctacggctggctggag

SEQ ID NO: 211908 - DNA, 22 bp, Artificial Sequence
  Description of Artificial Sequence: Synthetic oligonucleotide
acgccctacggctggctggagc

SEQ ID NO: 211909 - DNA, 21 bp, Artificial Sequence
  Description of Artificial Sequence: Synthetic oligonucleotide
cgccctacggctggctggagc

SEQ ID NO: 211910 - DNA, 21 bp, Artificial Sequence
  Description of Artificial Sequence: Synthetic oligonucleotide
gccctacggctggctggagcc

SEQ ID NO: 211911 - DNA, 22 bp, Artificial Sequence
  Description of Artificial Sequence: Synthetic oligonucleotide
ccctacggctggctggagccgt

SEQ ID NO: 211912 - DNA, 22 bp, Artificial Sequence
  Description of Artificial Sequence: Synthetic oligonucleotide
cctacggctggctggagccgtg

SEQ ID NO: 211913 - DNA, 23 bp, Artificial Sequence
  Description of Artificial Sequence: Synthetic oligonucleotide
ctacggctggctggagccgtggt

SEQ ID NO: 211914 - DNA, 23 bp, Artificial Sequence
  Description of Artificial Sequence: Synthetic oligonucleotide
tacggctggctggagccgtggtc

SEQ ID NO: 211915 - DNA, 22 bp, Artificial Sequence
  Description of Artificial Sequence: Synthetic oligonucleotide
acggctggctggagccgtggtc

SEQ ID NO: 211916 - DNA, 21 bp, Artificial Sequence
  Description of Artificial Sequence: Synthetic oligonucleotide
cggctggctggagccgtggtc

SEQ ID NO: 211917 - DNA, 21 bp, Artificial Sequence
  Description of Artificial Sequence: Synthetic oligonucleotide
ggctggctggagccgtggtcc

SEQ ID NO: 211918 - DNA, 21 bp, Artificial Sequence
  Description of Artificial Sequence: Synthetic oligonucleotide
gctggctggagccgtggtccg

SEQ ID NO: 211919 - DNA, 21 bp, Artificial Sequence
  Description of Artificial Sequence: Synthetic oligonucleotide
ctggctggagccgtggtccgg

SEQ ID NO: 211920 - DNA, 21 bp, Artificial Sequence
  Description of Artificial Sequence: Synthetic oligonucleotide
tggctggagccgtggtccggc

SEQ ID NO: 211921 - DNA, 20 bp, Artificial Sequence
  Description of Artificial Sequence: Synthetic oligonucleotide
ggctggagccgtggtccggc

SEQ ID NO: 211922 - DNA, 21 bp, Artificial Sequence
  Description of Artificial Sequence: Synthetic oligonucleotide
gctggagccgtggtccggcca

SEQ ID NO: 211923 - DNA, 21 bp, Artificial Sequence
  Description of Artificial Sequence: Synthetic oligonucleotide
ctggagccgtggtccggccag

SEQ ID NO: 211924 - DNA, 21 bp, Artificial Sequence
  Description of Artificial Sequence: Synthetic oligonucleotide
tggagccgtggtccggccagc

SEQ ID NO: 211925 - DNA, 20 bp, Artificial Sequence
  Description of Artificial Sequence: Synthetic oligonucleotide
ggagccgtggtccggccagc

SEQ ID NO: 211926 - DNA, 21 bp, Artificial Sequence
  Description of Artificial Sequence: Synthetic oligonucleotide
gagccgtggtccggccagcct

SEQ ID NO: 211927 - DNA, 21 bp, Artificial Sequence
  Description of Artificial Sequence: Synthetic oligonucleotide
agccgtggtccggccagcctg

SEQ ID NO: 211928 - DNA, 20 bp, Artificial Sequence
  Description of Artificial Sequence: Synthetic oligonucleotide
gccgtggtccggccagcctg

SEQ ID NO: 211929 - DNA, 20 bp, Artificial Sequence
  Description of Artificial Sequence: Synthetic oligonucleotide
ccgtggtccggccagcctgc

SEQ ID NO: 211930 - DNA, 20 bp, Artificial Sequence
  Description of Artificial Sequence: Synthetic oligonucleotide
cgtggtccggccagcctgcc

SEQ ID NO: 211931 - DNA, 21 bp, Artificial Sequence
  Description of Artificial Sequence: Synthetic oligonucleotide
gtggtccggccagcctgccca

SEQ ID NO: 211932 - DNA, 21 bp, Artificial Sequence
  Description of Artificial Sequence: Synthetic oligonucleotide
tggtccggccagcctgcccac

SEQ ID NO: 211933 - DNA, 20 bp, Artificial Sequence
  Description of Artificial Sequence: Synthetic oligonucleotide
ggtccggccagcctgcccac

SEQ ID NO: 211934 - DNA, 20 bp, Artificial Sequence
  Description of Artificial Sequence: Synthetic oligonucleotide
gtccggccagcctgcccacc

SEQ ID NO: 211935 - DNA, 21 bp, Artificial Sequence
  Description of Artificial Sequence: Synthetic oligonucleotide
tccggccagcctgcccaccca

SEQ ID NO: 211936 - DNA, 20 bp, Artificial Sequence
  Description of Artificial Sequence: Synthetic oligonucleotide
ccggccagcctgcccaccca

SEQ ID NO: 211937 - DNA, 20 bp, Artificial Sequence
  Description of Artificial Sequence: Synthetic oligonucleotide
cggccagcctgcccacccac

SEQ ID NO: 211938 - DNA, 20 bp, Artificial Sequence
  Description of Artificial Sequence: Synthetic oligonucleotide
ggccagcctgcccacccacc

SEQ ID NO: 211939 - DNA, 20 bp, Artificial Sequence
  Description of Artificial Sequence: Synthetic oligonucleotide
gccagcctgcccacccaccg

SEQ ID NO: 211940 - DNA, 21 bp, Artificial Sequence
  Description of Artificial Sequence: Synthetic oligonucleotide
ccagcctgcccacccaccgct

SEQ ID NO: 211941 - DNA, 23 bp, Artificial Sequence
  Description of Artificial Sequence: Synthetic oligonucleotide
cagcctgcccacccaccgctcaa

SEQ ID NO: 211942 - DNA, 23 bp, Artificial Sequence
  Description of Artificial Sequence: Synthetic oligonucleotide
agcctgcccacccaccgctcaac

SEQ ID NO: 211943 - DNA, 22 bp, Artificial Sequence
  Description of Artificial Sequence: Synthetic oligonucleotide
gcctgcccacccaccgctcaac

SEQ ID NO: 211944 - DNA, 23 bp, Artificial Sequence
  Description of Artificial Sequence: Synthetic oligonucleotide
cctgcccacccaccgctcaacct

SEQ ID NO: 211945 - DNA, 24 bp, Artificial Sequence
  Description of Artificial Sequence: Synthetic oligonucleotide
ctgcccacccaccgctcaacctct

SEQ ID NO: 211946 - DNA, 24 bp, Artificial Sequence
  Description of Artificial Sequence: Synthetic oligonucleotide
tgcccacccaccgctcaacctctc

SEQ ID NO: 211947 - DNA, 23 bp, Artificial Sequence
  Description of Artificial Sequence: Synthetic oligonucleotide
gcccacccaccgctcaacctctc

SEQ ID NO: 211948 - DNA, 23 bp, Artificial Sequence
  Description of Artificial Sequence: Synthetic oligonucleotide
cccacccaccgctcaacctctcg

SEQ ID NO: 211949 - DNA, 23 bp, Artificial Sequence
  Description of Artificial Sequence: Synthetic oligonucleotide
ccacccaccgctcaacctctcgg

SEQ ID NO: 211950 - DNA, 23 bp, Artificial Sequence
  Description of Artificial Sequence: Synthetic oligonucleotide
cacccaccgctcaacctctcggc

SEQ ID NO: 211951 - DNA, 25 bp, Artificial Sequence
  Description of Artificial Sequence: Synthetic oligonucleotide
acccaccgctcaacctctcggccaa

SEQ ID NO: 211952 - DNA, 24 bp, Artificial Sequence
  Description of Artificial Sequence: Synthetic oligonucleotide
cccaccgctcaacctctcggccaa

SEQ ID NO: 211953 - DNA, 25 bp, Artificial Sequence
  Description of Artificial Sequence: Synthetic oligonucleotide
ccaccgctcaacctctcggccaaga

SEQ ID NO: 211954 - DNA, 25 bp, Artificial Sequence
  Description of Artificial Sequence: Synthetic oligonucleotide
caccgctcaacctctcggccaagac

SEQ ID NO: 211955 - DNA, 25 bp, Artificial Sequence
  Description of Artificial Sequence: Synthetic oligonucleotide
accgctcaacctctcggccaagacc

SEQ ID NO: 211956 - DNA, 24 bp, Artificial Sequence
  Description of Artificial Sequence: Synthetic oligonucleotide
ccgctcaacctctcggccaagacc

SEQ ID NO: 211957 - DNA, 25 bp, Artificial Sequence
  Description of Artificial Sequence: Synthetic oligonucleotide
cgctcaacctctcggccaagaccga

SEQ ID NO: 211958 - DNA, 25 bp, Artificial Sequence
  Description of Artificial Sequence: Synthetic oligonucleotide
gctcaacctctcggccaagaccgag

SEQ ID NO: 211959 - DNA, 26 bp, Artificial Sequence
  Description of Artificial Sequence: Synthetic oligonucleotide
ctcaacctctcggccaagaccgagct

SEQ ID NO: 211960 - DNA, 26 bp, Artificial Sequence
  Description of Artificial Sequence: Synthetic oligonucleotide
tcaacctctcggccaagaccgagctg

SEQ ID NO: 211961 - DNA, 25 bp, Artificial Sequence
  Description of Artificial Sequence: Synthetic oligonucleotide
caacctctcggccaagaccgagctg

SEQ ID NO: 211962 - DNA, 26 bp, Artificial Sequence
  Description of Artificial Sequence: Synthetic oligonucleotide
aacctctcggccaagaccgagctggt

SEQ ID NO: 211963 - DNA, 25 bp, Artificial Sequence
  Description of Artificial Sequence: Synthetic oligonucleotide
acctctcggccaagaccgagctggt

SEQ ID NO: 211964 - DNA, 24 bp, Artificial Sequence
  Description of Artificial Sequence: Synthetic oligonucleotide
cctctcggccaagaccgagctggt

SEQ ID NO: 211965 - DNA, 24 bp, Artificial Sequence
  Description of Artificial Sequence: Synthetic oligonucleotide
ctctcggccaagaccgagctggtg

SEQ ID NO: 211966 - DNA, 24 bp, Artificial Sequence
  Description of Artificial Sequence: Synthetic oligonucleotide
tctcggccaagaccgagctggtgg

SEQ ID NO: 211967 - DNA, 23 bp, Artificial Sequence
  Description of Artificial Sequence: Synthetic oligonucleotide
ctcggccaagaccgagctggtgg

SEQ ID NO: 211968 - DNA, 23 bp, Artificial Sequence
  Description of Artificial Sequence: Synthetic oligonucleotide
tcggccaagaccgagctggtggc

SEQ ID NO: 211969 - DNA, 22 bp, Artificial Sequence
  Description of Artificial Sequence: Synthetic oligonucleotide
cggccaagaccgagctggtggc

SEQ ID NO: 211970 - DNA, 23 bp, Artificial Sequence
  Description of Artificial Sequence: Synthetic oligonucleotide
ggccaagaccgagctggtggcct

SEQ ID NO: 211971 - DNA, 23 bp, Artificial Sequence
  Description of Artificial Sequence: Synthetic oligonucleotide
gccaagaccgagctggtggcctg

SEQ ID NO: 211972 - DNA, 23 bp, Artificial Sequence
  Description of Artificial Sequence: Synthetic oligonucleotide
ccaagaccgagctggtggcctgg

SEQ ID NO: 211973 - DNA, 23 bp, Artificial Sequence
  Description of Artificial Sequence: Synthetic oligonucleotide
caagaccgagctggtggcctggg

SEQ ID NO: 211974 - DNA, 23 bp, Artificial Sequence
  Description of Artificial Sequence: Synthetic oligonucleotide
aagaccgagctggtggcctgggc

SEQ ID NO: 211975 - DNA, 22 bp, Artificial Sequence
  Description of Artificial Sequence: Synthetic oligonucleotide
agaccgagctggtggcctgggc

SEQ ID NO: 211976 - DNA, 21 bp, Artificial Sequence
  Description of Artificial Sequence: Synthetic oligonucleotide
gaccgagctggtggcctgggc

SEQ ID NO: 211977 - DNA, 21 bp, Artificial Sequence
  Description of Artificial Sequence: Synthetic oligonucleotide
accgagctggtggcctgggcg

SEQ ID NO: 211978 - DNA, 20 bp, Artificial Sequence
  Description of Artificial Sequence: Synthetic oligonucleotide
ccgagctggtggcctgggcg

SEQ ID NO: 211979 - DNA, 21 bp, Artificial Sequence
  Description of Artificial Sequence: Synthetic oligonucleotide
cgagctggtggcctgggcggt

SEQ ID NO: 211980 - DNA, 22 bp, Artificial Sequence
  Description of Artificial Sequence: Synthetic oligonucleotide
gagctggtggcctgggcggtgt

SEQ ID NO: 211981 - DNA, 22 bp, Artificial Sequence
  Description of Artificial Sequence: Synthetic oligonucleotide
agctggtggcctgggcggtgtc

SEQ ID NO: 211982 - DNA, 21 bp, Artificial Sequence
  Description of Artificial Sequence: Synthetic oligonucleotide
gctggtggcctgggcggtgtc

SEQ ID NO: 211983 - DNA, 23 bp, Artificial Sequence
  Description of Artificial Sequence: Synthetic oligonucleotide
ctggtggcctgggcggtgtccaa

SEQ ID NO: 211984 - DNA, 24 bp, Artificial Sequence
  Description of Artificial Sequence: Synthetic oligonucleotide
tggtggcctgggcggtgtccaact

SEQ ID NO: 211985 - DNA, 23 bp, Artificial Sequence
  Description of Artificial Sequence: Synthetic oligonucleotide
ggtggcctgggcggtgtccaact

SEQ ID NO: 211986 - DNA, 23 bp, Artificial Sequence
  Description of Artificial Sequence: Synthetic oligonucleotide
gtggcctgggcggtgtccaactg

SEQ ID NO: 211987 - DNA, 25 bp, Artificial Sequence
  Description of Artificial Sequence: Synthetic oligonucleotide
tggcctgggcggtgtccaactggaa

SEQ ID NO: 211988 - DNA, 24 bp, Artificial Sequence
  Description of Artificial Sequence: Synthetic oligonucleotide
ggcctgggcggtgtccaactggaa

SEQ ID NO: 211989 - DNA, 24 bp, Artificial Sequence
  Description of Artificial Sequence: Synthetic oligonucleotide
gcctgggcggtgtccaactggaag

SEQ ID NO: 211990 - DNA, 24 bp, Artificial Sequence
  Description of Artificial Sequence: Synthetic oligonucleotide
cctgggcggtgtccaactggaagc

SEQ ID NO: 211991 - DNA, 24 bp, Artificial Sequence
  Description of Artificial Sequence: Synthetic oligonucleotide
ctgggcggtgtccaactggaagcc

SEQ ID NO: 211992 - DNA, 24 bp, Artificial Sequence
  Description of Artificial Sequence: Synthetic oligonucleotide
tgggcggtgtccaactggaagccg

SEQ ID NO: 211993 - DNA, 23 bp, Artificial Sequence
  Description of Artificial Sequence: Synthetic oligonucleotide
gggcggtgtccaactggaagccg

SEQ ID NO: 211994 - DNA, 24 bp, Artificial Sequence
  Description of Artificial Sequence: Synthetic oligonucleotide
ggcggtgtccaactggaagccgga

SEQ ID NO: 211995 - DNA, 25 bp, Artificial Sequence
  Description of Artificial Sequence: Synthetic oligonucleotide
gcggtgtccaactggaagccggact

SEQ ID NO: 211996 - DNA, 26 bp, Artificial Sequence
  Description of Artificial Sequence: Synthetic oligonucleotide
cggtgtccaactggaagccggactca

SEQ ID NO: 211997 - DNA, 26 bp, Artificial Sequence
  Description of Artificial Sequence: Synthetic oligonucleotide
ggtgtccaactggaagccggactcag

SEQ ID NO: 211998 - DNA, 26 bp, Artificial Sequence
  Description of Artificial Sequence: Synthetic oligonucleotide
gtgtccaactggaagccggactcagc

SEQ ID NO: 211999 - DNA, 27 bp, Artificial Sequence
  Description of Artificial Sequence: Synthetic oligonucleotide
tgtccaactggaagccggactcagcca

SEQ ID NO: 212000 - DNA, 26 bp, Artificial Sequence
  Description of Artificial Sequence: Synthetic oligonucleotide
gtccaactggaagccggactcagcca

SEQ ID NO: 212001 - DNA, 26 bp, Artificial Sequence
  Description of Artificial Sequence: Synthetic oligonucleotide
tccaactggaagccggactcagccag

SEQ ID NO: 212002 - DNA, 25 bp, Artificial Sequence
  Description of Artificial Sequence: Synthetic oligonucleotide
ccaactggaagccggactcagccag

SEQ ID NO: 212003 - DNA, 25 bp, Artificial Sequence
  Description of Artificial Sequence: Synthetic oligonucleotide
caactggaagccggactcagccagg

SEQ ID NO: 212004 - DNA, 26 bp, Artificial Sequence
  Description of Artificial Sequence: Synthetic oligonucleotide
aactggaagccggactcagccagggt

SEQ ID NO: 212005 - DNA, 25 bp, Artificial Sequence
  Description of Artificial Sequence: Synthetic oligonucleotide
actggaagccggactcagccagggt

SEQ ID NO: 212006 - DNA, 24 bp, Artificial Sequence
  Description of Artificial Sequence: Synthetic oligonucleotide
ctggaagccggactcagccagggt

SEQ ID NO: 212007 - DNA, 24 bp, Artificial Sequence
  Description of Artificial Sequence: Synthetic oligonucleotide
tggaagccggactcagccagggtg

SEQ ID NO: 212008 - DNA, 23 bp, Artificial Sequence
  Description of Artificial Sequence: Synthetic oligonucleotide
ggaagccggactcagccagggtg

SEQ ID NO: 212009 - DNA, 23 bp, Artificial Sequence
  Description of Artificial Sequence: Synthetic oligonucleotide
gaagccggactcagccagggtgc

SEQ ID NO: 212010 - DNA, 23 bp, Artificial Sequence
  Description of Artificial Sequence: Synthetic oligonucleotide
aagccggactcagccagggtgcg

SEQ ID NO: 212011 - DNA, 22 bp, Artificial Sequence
  Description of Artificial Sequence: Synthetic oligonucleotide
agccggactcagccagggtgcg

SEQ ID NO: 212012 - DNA, 21 bp, Artificial Sequence
  Description of Artificial Sequence: Synthetic oligonucleotide
gccggactcagccagggtgcg

SEQ ID NO: 212013 - DNA, 23 bp, Artificial Sequence
  Description of Artificial Sequence: Synthetic oligonucleotide
ccggactcagccagggtgcgcta

SEQ ID NO: 212014 - DNA, 25 bp, Artificial Sequence
  Description of Artificial Sequence: Synthetic oligonucleotide
cggactcagccagggtgcgctacta

SEQ ID NO: 212015 - DNA, 25 bp, Artificial Sequence
  Description of Artificial Sequence: Synthetic oligonucleotide
ggactcagccagggtgcgctactac

SEQ ID NO: 212016 - DNA, 26 bp, Artificial Sequence
  Description of Artificial Sequence: Synthetic oligonucleotide
gactcagccagggtgcgctactacca

SEQ ID NO: 212017 - DNA, 27 bp, Artificial Sequence
  Description of Artificial Sequence: Synthetic oligonucleotide
actcagccagggtgcgctactaccaga

SEQ ID NO: 212018 - DNA, 26 bp, Artificial Sequence
  Description of Artificial Sequence: Synthetic oligonucleotide
ctcagccagggtgcgctactaccaga

SEQ ID NO: 212019 - DNA, 26 bp, Artificial Sequence
  Description of Artificial Sequence: Synthetic oligonucleotide
tcagccagggtgcgctactaccagag

SEQ ID NO: 212020 - DNA, 25 bp, Artificial Sequence
  Description of Artificial Sequence: Synthetic oligonucleotide
cagccagggtgcgctactaccagag

SEQ ID NO: 212021 - DNA, 25 bp, Artificial Sequence
  Description of Artificial Sequence: Synthetic oligonucleotide
agccagggtgcgctactaccagagc

SEQ ID NO: 212022 - DNA, 24 bp, Artificial Sequence
  Description of Artificial Sequence: Synthetic oligonucleotide
gccagggtgcgctactaccagagc

SEQ ID NO: 212023 - DNA, 25 bp, Artificial Sequence
  Description of Artificial Sequence: Synthetic oligonucleotide
ccagggtgcgctactaccagagcct

SEQ ID NO: 212024 - DNA, 25 bp, Artificial Sequence
  Description of Artificial Sequence: Synthetic oligonucleotide
cagggtgcgctactaccagagcctg

SEQ ID NO: 212025 - DNA, 26 bp, Artificial Sequence
  Description of Artificial Sequence: Synthetic oligonucleotide
agggtgcgctactaccagagcctgca

SEQ ID NO: 212026 - DNA, 25 bp, Artificial Sequence
  Description of Artificial Sequence: Synthetic oligonucleotide
gggtgcgctactaccagagcctgca

SEQ ID NO: 212027 - DNA, 25 bp, Artificial Sequence
  Description of Artificial Sequence: Synthetic oligonucleotide
ggtgcgctactaccagagcctgcag

SEQ ID NO: 212028 - DNA, 25 bp, Artificial Sequence
  Description of Artificial Sequence: Synthetic oligonucleotide
gtgcgctactaccagagcctgcagg

SEQ ID NO: 212029 - DNA, 26 bp, Artificial Sequence
  Description of Artificial Sequence: Synthetic oligonucleotide
tgcgctactaccagagcctgcaggct

SEQ ID NO: 212030 - DNA, 25 bp, Artificial Sequence
  Description of Artificial Sequence: Synthetic oligonucleotide
gcgctactaccagagcctgcaggct

SEQ ID NO: 212031 - DNA, 27 bp, Artificial Sequence
  Description of Artificial Sequence: Synthetic oligonucleotide
cgctactaccagagcctgcaggctcat

SEQ ID NO: 212032 - DNA, 27 bp, Artificial Sequence
  Description of Artificial Sequence: Synthetic oligonucleotide
gctactaccagagcctgcaggctcatc

SEQ ID NO: 212033 - DNA, 28 bp, Artificial Sequence
  Description of Artificial Sequence: Synthetic oligonucleotide
ctactaccagagcctgcaggctcatctc

SEQ ID NO: 212034 - DNA, 30 bp, Artificial Sequence
  Description of Artificial Sequence: Synthetic oligonucleotide
tactaccagagcctgcaggctcatctcaag

SEQ ID NO: 212035 - DNA, 29 bp, Artificial Sequence
  Description of Artificial Sequence: Synthetic oligonucleotide
actaccagagcctgcaggctcatctcaag

SEQ ID NO: 212036 - DNA, 28 bp, Artificial Sequence
  Description of Artificial Sequence: Synthetic oligonucleotide
ctaccagagcctgcaggctcatctcaag

SEQ ID NO: 212037 - DNA, 28 bp, Artificial Sequence
  Description of Artificial Sequence: Synthetic oligonucleotide
taccagagcctgcaggctcatctcaagg

SEQ ID NO: 212038 - DNA, 27 bp, Artificial Sequence
  Description of Artificial Sequence: Synthetic oligonucleotide
accagagcctgcaggctcatctcaagg

SEQ ID NO: 212039 - DNA, 27 bp, Artificial Sequence
  Description of Artificial Sequence: Synthetic oligonucleotide
ccagagcctgcaggctcatctcaaggt

SEQ ID NO: 212040 - DNA, 27 bp, Artificial Sequence
  Description of Artificial Sequence: Synthetic oligonucleotide
cagagcctgcaggctcatctcaaggtg

SEQ ID NO: 212041 - DNA, 27 bp, Artificial Sequence
  Description of Artificial Sequence: Synthetic oligonucleotide
agagcctgcaggctcatctcaaggtgg

SEQ ID NO: 212042 - DNA, 27 bp, Artificial Sequence
  Description of Artificial Sequence: Synthetic oligonucleotide
gagcctgcaggctcatctcaaggtgga

SEQ ID NO: 212043 - DNA, 27 bp, Artificial Sequence
  Description of Artificial Sequence: Synthetic oligonucleotide
agcctgcaggctcatctcaaggtggac

SEQ ID NO: 212044 - DNA, 26 bp, Artificial Sequence
  Description of Artificial Sequence: Synthetic oligonucleotide
gcctgcaggctcatctcaaggtggac

SEQ ID NO: 212045 - DNA, 27 bp, Artificial Sequence
  Description of Artificial Sequence: Synthetic oligonucleotide
cctgcaggctcatctcaaggtggacgt

SEQ ID NO: 212046 - DNA, 27 bp, Artificial Sequence
  Description of Artificial Sequence: Synthetic oligonucleotide
ctgcaggctcatctcaaggtggacgtg

SEQ ID NO: 212047 - DNA, 29 bp, Artificial Sequence
  Description of Artificial Sequence: Synthetic oligonucleotide
tgcaggctcatctcaaggtggacgtgtac

SEQ ID NO: 212048 - DNA, 28 bp, Artificial Sequence
  Description of Artificial Sequence: Synthetic oligonucleotide
gcaggctcatctcaaggtggacgtgtac

SEQ ID NO: 212049 - DNA, 28 bp, Artificial Sequence
  Description of Artificial Sequence: Synthetic oligonucleotide
caggctcatctcaaggtggacgtgtacg

SEQ ID NO: 212050 - DNA, 28 bp, Artificial Sequence
  Description of Artificial Sequence: Synthetic oligonucleotide
aggctcatctcaaggtggacgtgtacgg

SEQ ID NO: 212051 - DNA, 27 bp, Artificial Sequence
  Description of Artificial Sequence: Synthetic oligonucleotide
ggctcatctcaaggtggacgtgtacgg

SEQ ID NO: 212052 - DNA, 28 bp, Artificial Sequence
  Description of Artificial Sequence: Synthetic oligonucleotide
gctcatctcaaggtggacgtgtacggac

SEQ ID NO: 212053 - DNA, 28 bp, Artificial Sequence
  Description of Artificial Sequence: Synthetic oligonucleotide
ctcatctcaaggtggacgtgtacggacg

SEQ ID NO: 212054 - DNA, 28 bp, Artificial Sequence
  Description of Artificial Sequence: Synthetic oligonucleotide
tcatctcaaggtggacgtgtacggacgc

SEQ ID NO: 212055 - DNA, 27 bp, Artificial Sequence
  Description of Artificial Sequence: Synthetic oligonucleotide
catctcaaggtggacgtgtacggacgc

SEQ ID NO: 212056 - DNA, 28 bp, Artificial Sequence
  Description of Artificial Sequence: Synthetic oligonucleotide
atctcaaggtggacgtgtacggacgctc

SEQ ID NO: 212057 - DNA, 27 bp, Artificial Sequence
  Description of Artificial Sequence: Synthetic oligonucleotide
tctcaaggtggacgtgtacggacgctc

SEQ ID NO: 212058 - DNA, 26 bp, Artificial Sequence
  Description of Artificial Sequence: Synthetic oligonucleotide
ctcaaggtggacgtgtacggacgctc

SEQ ID NO: 212059 - DNA, 26 bp, Artificial Sequence
  Description of Artificial Sequence: Synthetic oligonucleotide
tcaaggtggacgtgtacggacgctcc

SEQ ID NO: 212060 - DNA, 25 bp, Artificial Sequence
  Description of Artificial Sequence: Synthetic oligonucleotide
caaggtggacgtgtacggacgctcc

SEQ ID NO: 212061 - DNA, 26 bp, Artificial Sequence
  Description of Artificial Sequence: Synthetic oligonucleotide
aaggtggacgtgtacggacgctccca

SEQ ID NO: 212062 - DNA, 25 bp, Artificial Sequence
  Description of Artificial Sequence: Synthetic oligonucleotide
aggtggacgtgtacggacgctccca

SEQ ID NO: 212063 - DNA, 24 bp, Artificial Sequence
  Description of Artificial Sequence: Synthetic oligonucleotide
ggtggacgtgtacggacgctccca

SEQ ID NO: 212064 - DNA, 26 bp, Artificial Sequence
  Description of Artificial Sequence: Synthetic oligonucleotide
gtggacgtgtacggacgctcccacaa

SEQ ID NO: 212065 - DNA, 26 bp, Artificial Sequence
  Description of Artificial Sequence: Synthetic oligonucleotide
tggacgtgtacggacgctcccacaag

SEQ ID NO: 212066 - DNA, 25 bp, Artificial Sequence
  Description of Artificial Sequence: Synthetic oligonucleotide
ggacgtgtacggacgctcccacaag

SEQ ID NO: 212067 - DNA, 25 bp, Artificial Sequence
  Description of Artificial Sequence: Synthetic oligonucleotide
gacgtgtacggacgctcccacaagc

SEQ ID NO: 212068 - DNA, 25 bp, Artificial Sequence
  Description of Artificial Sequence: Synthetic oligonucleotide
acgtgtacggacgctcccacaagcc

SEQ ID NO: 212069 - DNA, 24 bp, Artificial Sequence
  Description of Artificial Sequence: Synthetic oligonucleotide
cgtgtacggacgctcccacaagcc

SEQ ID NO: 212070 - DNA, 24 bp, Artificial Sequence
  Description of Artificial Sequence: Synthetic oligonucleotide
gtgtacggacgctcccacaagccc

SEQ ID NO: 212071 - DNA, 25 bp, Artificial Sequence
  Description of Artificial Sequence: Synthetic oligonucleotide
tgtacggacgctcccacaagcccct

SEQ ID NO: 212072 - DNA, 24 bp, Artificial Sequence
  Description of Artificial Sequence: Synthetic oligonucleotide
gtacggacgctcccacaagcccct

SEQ ID NO: 212073 - DNA, 24 bp, Artificial Sequence
  Description of Artificial Sequence: Synthetic oligonucleotide
tacggacgctcccacaagcccctg

SEQ ID NO: 212074 - DNA, 23 bp, Artificial Sequence
  Description of Artificial Sequence: Synthetic oligonucleotide
acggacgctcccacaagcccctg

SEQ ID NO: 212075 - DNA, 22 bp, Artificial Sequence
  Description of Artificial Sequence: Synthetic oligonucleotide
cggacgctcccacaagcccctg

SEQ ID NO: 212076 - DNA, 22 bp, Artificial Sequence
  Description of Artificial Sequence: Synthetic oligonucleotide
ggacgctcccacaagcccctgc

SEQ ID NO: 212077 - DNA, 22 bp, Artificial Sequence
  Description of Artificial Sequence: Synthetic oligonucleotide
gacgctcccacaagcccctgcc

SEQ ID NO: 212078 - DNA, 24 bp, Artificial Sequence
  Description of Artificial Sequence: Synthetic oligonucleotide
acgctcccacaagcccctgcccaa

SEQ ID NO: 212079 - DNA, 23 bp, Artificial Sequence
  Description of Artificial Sequence: Synthetic oligonucleotide
cgctcccacaagcccctgcccaa

SEQ ID NO: 212080 - DNA, 23 bp, Artificial Sequence
  Description of Artificial Sequence: Synthetic oligonucleotide
gctcccacaagcccctgcccaag

SEQ ID NO: 212081 - DNA, 23 bp, Artificial Sequence
  Description of Artificial Sequence: Synthetic oligonucleotide
ctcccacaagcccctgcccaagg

SEQ ID NO: 212082 - DNA, 23 bp, Artificial Sequence
  Description of Artificial Sequence: Synthetic oligonucleotide
tcccacaagcccctgcccaaggg

SEQ ID NO: 212083 - DNA, 22 bp, Artificial Sequence
  Description of Artificial Sequence: Synthetic oligonucleotide
cccacaagcccctgcccaaggg

SEQ ID NO: 212084 - DNA, 23 bp, Artificial Sequence
  Description of Artificial Sequence: Synthetic oligonucleotide
ccacaagcccctgcccaagggga

SEQ ID NO: 212085 - DNA, 23 bp, Artificial Sequence
  Description of Artificial Sequence: Synthetic oligonucleotide
cacaagcccctgcccaaggggac

SEQ ID NO: 212086 - DNA, 25 bp, Artificial Sequence
  Description of Artificial Sequence: Synthetic oligonucleotide
acaagcccctgcccaaggggaccat

SEQ ID NO: 212087 - DNA, 24 bp, Artificial Sequence
  Description of Artificial Sequence: Synthetic oligonucleotide
caagcccctgcccaaggggaccat

SEQ ID NO: 212088 - DNA, 26 bp, Artificial Sequence
  Description of Artificial Sequence: Synthetic oligonucleotide
aagcccctgcccaaggggaccatgat

SEQ ID NO: 212089 - DNA, 25 bp, Artificial Sequence
  Description of Artificial Sequence: Synthetic oligonucleotide
agcccctgcccaaggggaccatgat

SEQ ID NO: 212090 - DNA, 24 bp, Artificial Sequence
  Description of Artificial Sequence: Synthetic oligonucleotide
gcccctgcccaaggggaccatgat

SEQ ID NO: 212091 - DNA, 24 bp, Artificial Sequence
  Description of Artificial Sequence: Synthetic oligonucleotide
cccctgcccaaggggaccatgatg

SEQ ID NO: 212092 - DNA, 25 bp, Artificial Sequence
  Description of Artificial Sequence: Synthetic oligonucleotide
ccctgcccaaggggaccatgatgga

SEQ ID NO: 212093 - DNA, 26 bp, Artificial Sequence
  Description of Artificial Sequence: Synthetic oligonucleotide
cctgcccaaggggaccatgatggaga

SEQ ID NO: 212094 - DNA, 26 bp, Artificial Sequence
  Description of Artificial Sequence: Synthetic oligonucleotide
ctgcccaaggggaccatgatggagac

SEQ ID NO: 212095 - DNA, 26 bp, Artificial Sequence
  Description of Artificial Sequence: Synthetic oligonucleotide
tgcccaaggggaccatgatggagacg

SEQ ID NO: 212096 - DNA, 25 bp, Artificial Sequence
  Description of Artificial Sequence: Synthetic oligonucleotide
gcccaaggggaccatgatggagacg

SEQ ID NO: 212097 - DNA, 26 bp, Artificial Sequence
  Description of Artificial Sequence: Synthetic oligonucleotide
cccaaggggaccatgatggagacgct

SEQ ID NO: 212098 - DNA, 27 bp, Artificial Sequence
  Description of Artificial Sequence: Synthetic oligonucleotide
ccaaggggaccatgatggagacgctgt

SEQ ID NO: 212099 - DNA, 27 bp, Artificial Sequence
  Description of Artificial Sequence: Synthetic oligonucleotide
caaggggaccatgatggagacgctgtc

SEQ ID NO: 212100 - DNA, 27 bp, Artificial Sequence
  Description of Artificial Sequence: Synthetic oligonucleotide
aaggggaccatgatggagacgctgtcc

SEQ ID NO: 212101 - DNA, 26 bp, Artificial Sequence
  Description of Artificial Sequence: Synthetic oligonucleotide
aggggaccatgatggagacgctgtcc

SEQ ID NO: 212102 - DNA, 25 bp, Artificial Sequence
  Description of Artificial Sequence: Synthetic oligonucleotide
ggggaccatgatggagacgctgtcc

SEQ ID NO: 212103 - DNA, 25 bp, Artificial Sequence
  Description of Artificial Sequence: Synthetic oligonucleotide
gggaccatgatggagacgctgtccc

SEQ ID NO: 212104 - DNA, 25 bp, Artificial Sequence
  Description of Artificial Sequence: Synthetic oligonucleotide
ggaccatgatggagacgctgtcccg

SEQ ID NO: 212105 - DNA, 27 bp, Artificial Sequence
  Description of Artificial Sequence: Synthetic oligonucleotide
gaccatgatggagacgctgtcccggta

SEQ ID NO: 212106 - DNA, 27 bp, Artificial Sequence
  Description of Artificial Sequence: Synthetic oligonucleotide
accatgatggagacgctgtcccggtac

SEQ ID NO: 212107 - DNA, 27 bp, Artificial Sequence
  Description of Artificial Sequence: Synthetic oligonucleotide
ccatgatggagacgctgtcccggtaca

SEQ ID NO: 212108 - DNA, 28 bp, Artificial Sequence
  Description of Artificial Sequence: Synthetic oligonucleotide
catgatggagacgctgtcccggtacaag

SEQ ID NO: 212109 - DNA, 30 bp, Artificial Sequence
  Description of Artificial Sequence: Synthetic oligonucleotide
atgatggagacgctgtcccggtacaagttc

SEQ ID NO: 212110 - DNA, 29 bp, Artificial Sequence
  Description of Artificial Sequence: Synthetic oligonucleotide
tgatggagacgctgtcccggtacaagttc

SEQ ID NO: 212111 - DNA, 28 bp, Artificial Sequence
  Description of Artificial Sequence: Synthetic oligonucleotide
gatggagacgctgtcccggtacaagttc

SEQ ID NO: 212112 - DNA, 30 bp, Artificial Sequence
  Description of Artificial Sequence: Synthetic oligonucleotide
atggagacgctgtcccggtacaagttctac

SEQ ID NO: 212113 - DNA, 29 bp, Artificial Sequence
  Description of Artificial Sequence: Synthetic oligonucleotide
tggagacgctgtcccggtacaagttctac

SEQ ID NO: 212114 - DNA, 28 bp, Artificial Sequence
  Description of Artificial Sequence: Synthetic oligonucleotide
ggagacgctgtcccggtacaagttctac

SEQ ID NO: 212115 - DNA, 28 bp, Artificial Sequence
  Description of Artificial Sequence: Synthetic oligonucleotide
gagacgctgtcccggtacaagttctacc

SEQ ID NO: 212116 - DNA, 29 bp, Artificial Sequence
  Description of Artificial Sequence: Synthetic oligonucleotide
agacgctgtcccggtacaagttctacctg

SEQ ID NO: 212117 - DNA, 28 bp, Artificial Sequence
  Description of Artificial Sequence: Synthetic oligonucleotide
gacgctgtcccggtacaagttctacctg

SEQ ID NO: 212118 - DNA, 28 bp, Artificial Sequence
  Description of Artificial Sequence: Synthetic oligonucleotide
acgctgtcccggtacaagttctacctgg

SEQ ID NO: 212119 - DNA, 27 bp, Artificial Sequence
  Description of Artificial Sequence: Synthetic oligonucleotide
cgctgtcccggtacaagttctacctgg

SEQ ID NO: 212120 - DNA, 27 bp, Artificial Sequence
  Description of Artificial Sequence: Synthetic oligonucleotide
gctgtcccggtacaagttctacctggc

SEQ ID NO: 212121 - DNA, 27 bp, Artificial Sequence
  Description of Artificial Sequence: Synthetic oligonucleotide
ctgtcccggtacaagttctacctggcc

SEQ ID NO: 212122 - DNA, 29 bp, Artificial Sequence
  Description of Artificial Sequence: Synthetic oligonucleotide
tgtcccggtacaagttctacctggccttc

SEQ ID NO: 212123 - DNA, 28 bp, Artificial Sequence
  Description of Artificial Sequence: Synthetic oligonucleotide
gtcccggtacaagttctacctggccttc

SEQ ID NO: 212124 - DNA, 28 bp, Artificial Sequence
  Description of Artificial Sequence: Synthetic oligonucleotide
tcccggtacaagttctacctggccttcg

SEQ ID NO: 212125 - DNA, 27 bp, Artificial Sequence
  Description of Artificial Sequence: Synthetic oligonucleotide
cccggtacaagttctacctggccttcg

SEQ ID NO: 212126 - DNA, 28 bp, Artificial Sequence
  Description of Artificial Sequence: Synthetic oligonucleotide
ccggtacaagttctacctggccttcgag

SEQ ID NO: 212127 - DNA, 30 bp, Artificial Sequence
  Description of Artificial Sequence: Synthetic oligonucleotide
cggtacaagttctacctggccttcgagaac

SEQ ID NO: 212128 - DNA, 31 bp, Artificial Sequence
  Description of Artificial Sequence: Synthetic oligonucleotide
ggtacaagttctacctggccttcgagaactc

SEQ ID NO: 212129 - DNA, 31 bp, Artificial Sequence
  Description of Artificial Sequence: Synthetic oligonucleotide
gtacaagttctacctggccttcgagaactcc

SEQ ID NO: 212130 - DNA, 33 bp, Artificial Sequence
  Description of Artificial Sequence: Synthetic oligonucleotide
tacaagttctacctggccttcgagaactccttg

SEQ ID NO: 212131 - DNA, 32 bp, Artificial Sequence
  Description of Artificial Sequence: Synthetic oligonucleotide
acaagttctacctggccttcgagaactccttg

SEQ ID NO: 212132 - DNA, 31 bp, Artificial Sequence
  Description of Artificial Sequence: Synthetic oligonucleotide
caagttctacctggccttcgagaactccttg

SEQ ID NO: 212133 - DNA, 31 bp, Artificial Sequence
  Description of Artificial Sequence: Synthetic oligonucleotide
aagttctacctggccttcgagaactccttgc

SEQ ID NO: 212134 - DNA, 30 bp, Artificial Sequence
  Description of Artificial Sequence: Synthetic oligonucleotide
agttctacctggccttcgagaactccttgc

SEQ ID NO: 212135 - DNA, 29 bp, Artificial Sequence
  Description of Artificial Sequence: Synthetic oligonucleotide
gttctacctggccttcgagaactccttgc

SEQ ID NO: 212136 - DNA, 30 bp, Artificial Sequence
  Description of Artificial Sequence: Synthetic oligonucleotide
ttctacctggccttcgagaactccttgcac

SEQ ID NO: 212137 - DNA, 29 bp, Artificial Sequence
  Description of Artificial Sequence: Synthetic oligonucleotide
tctacctggccttcgagaactccttgcac

SEQ ID NO: 212138 - DNA, 28 bp, Artificial Sequence
  Description of Artificial Sequence: Synthetic oligonucleotide
ctacctggccttcgagaactccttgcac

SEQ ID NO: 212139 - DNA, 28 bp, Artificial Sequence
  Description of Artificial Sequence: Synthetic oligonucleotide
tacctggccttcgagaactccttgcacc

SEQ ID NO: 212140 - DNA, 27 bp, Artificial Sequence
  Description of Artificial Sequence: Synthetic oligonucleotide
acctggccttcgagaactccttgcacc

SEQ ID NO: 212141 - DNA, 26 bp, Artificial Sequence
  Description of Artificial Sequence: Synthetic oligonucleotide
cctggccttcgagaactccttgcacc

SEQ ID NO: 212142 - DNA, 26 bp, Artificial Sequence
  Description of Artificial Sequence: Synthetic oligonucleotide
ctggccttcgagaactccttgcaccc

SEQ ID NO: 212143 - DNA, 26 bp, Artificial Sequence
  Description of Artificial Sequence: Synthetic oligonucleotide
tggccttcgagaactccttgcacccc

SEQ ID NO: 212144 - DNA, 25 bp, Artificial Sequence
  Description of Artificial Sequence: Synthetic oligonucleotide
ggccttcgagaactccttgcacccc

SEQ ID NO: 212145 - DNA, 26 bp, Artificial Sequence
  Description of Artificial Sequence: Synthetic oligonucleotide
gccttcgagaactccttgcaccccga

SEQ ID NO: 212146 - DNA, 27 bp, Artificial Sequence
  Description of Artificial Sequence: Synthetic oligonucleotide
ccttcgagaactccttgcaccccgact

SEQ ID NO: 212147 - DNA, 28 bp, Artificial Sequence
  Description of Artificial Sequence: Synthetic oligonucleotide
cttcgagaactccttgcaccccgactac

SEQ ID NO: 212148 - DNA, 30 bp, Artificial Sequence
  Description of Artificial Sequence: Synthetic oligonucleotide
ttcgagaactccttgcaccccgactacatc

SEQ ID NO: 212149 - DNA, 29 bp, Artificial Sequence
  Description of Artificial Sequence: Synthetic oligonucleotide
tcgagaactccttgcaccccgactacatc

SEQ ID NO: 212150 - DNA, 28 bp, Artificial Sequence
  Description of Artificial Sequence: Synthetic oligonucleotide
cgagaactccttgcaccccgactacatc

SEQ ID NO: 212151 - DNA, 29 bp, Artificial Sequence
  Description of Artificial Sequence: Synthetic oligonucleotide
gagaactccttgcaccccgactacatcac

SEQ ID NO: 212152 - DNA, 29 bp, Artificial Sequence
  Description of Artificial Sequence: Synthetic oligonucleotide
agaactccttgcaccccgactacatcacc

SEQ ID NO: 212153 - DNA, 28 bp, Artificial Sequence
  Description of Artificial Sequence: Synthetic oligonucleotide
gaactccttgcaccccgactacatcacc

SEQ ID NO: 212154 - DNA, 28 bp, Artificial Sequence
  Description of Artificial Sequence: Synthetic oligonucleotide
aactccttgcaccccgactacatcaccg

SEQ ID NO: 212155 - DNA, 27 bp, Artificial Sequence
  Description of Artificial Sequence: Synthetic oligonucleotide
actccttgcaccccgactacatcaccg

SEQ ID NO: 212156 - DNA, 27 bp, Artificial Sequence
  Description of Artificial Sequence: Synthetic oligonucleotide
ctccttgcaccccgactacatcaccga

SEQ ID NO: 212157 - DNA, 27 bp, Artificial Sequence
  Description of Artificial Sequence: Synthetic oligonucleotide
tccttgcaccccgactacatcaccgag

SEQ ID NO: 212158 - DNA, 27 bp, Artificial Sequence
  Description of Artificial Sequence: Synthetic oligonucleotide
ccttgcaccccgactacatcaccgaga

SEQ ID NO: 212159 - DNA, 28 bp, Artificial Sequence
  Description of Artificial Sequence: Synthetic oligonucleotide
cttgcaccccgactacatcaccgagaag

SEQ ID NO: 212160 - DNA, 28 bp, Artificial Sequence
  Description of Artificial Sequence: Synthetic oligonucleotide
ttgcaccccgactacatcaccgagaagc

SEQ ID NO: 212161 - DNA, 27 bp, Artificial Sequence
  Description of Artificial Sequence: Synthetic oligonucleotide
tgcaccccgactacatcaccgagaagc

SEQ ID NO: 212162 - DNA, 27 bp, Artificial Sequence
  Description of Artificial Sequence: Synthetic oligonucleotide
gcaccccgactacatcaccgagaagct

SEQ ID NO: 212163 - DNA, 27 bp, Artificial Sequence
  Description of Artificial Sequence: Synthetic oligonucleotide
caccccgactacatcaccgagaagctg

SEQ ID NO: 212164 - DNA, 28 bp, Artificial Sequence
  Description of Artificial Sequence: Synthetic oligonucleotide
accccgactacatcaccgagaagctgtg

SEQ ID NO: 212165 - DNA, 27 bp, Artificial Sequence
  Description of Artificial Sequence: Synthetic oligonucleotide
ccccgactacatcaccgagaagctgtg

SEQ ID NO: 212166 - DNA, 27 bp, Artificial Sequence
  Description of Artificial Sequence: Synthetic oligonucleotide
cccgactacatcaccgagaagctgtgg

SEQ ID NO: 212167 - DNA, 28 bp, Artificial Sequence
  Description of Artificial Sequence: Synthetic oligonucleotide
ccgactacatcaccgagaagctgtggag

SEQ ID NO: 212168 - DNA, 28 bp, Artificial Sequence
  Description of Artificial Sequence: Synthetic oligonucleotide
cgactacatcaccgagaagctgtggagg

SEQ ID NO: 212169 - DNA, 30 bp, Artificial Sequence
  Description of Artificial Sequence: Synthetic oligonucleotide
gactacatcaccgagaagctgtggaggaac

SEQ ID NO: 212170 - DNA, 30 bp, Artificial Sequence
  Description of Artificial Sequence: Synthetic oligonucleotide
actacatcaccgagaagctgtggaggaacg

SEQ ID NO: 212171 - DNA, 29 bp, Artificial Sequence
  Description of Artificial Sequence: Synthetic oligonucleotide
ctacatcaccgagaagctgtggaggaacg

SEQ ID NO: 212172 - DNA, 29 bp, Artificial Sequence
  Description of Artificial Sequence: Synthetic oligonucleotide
tacatcaccgagaagctgtggaggaacgc

SEQ ID NO: 212173 - DNA, 28 bp, Artificial Sequence
  Description of Artificial Sequence: Synthetic oligonucleotide
acatcaccgagaagctgtggaggaacgc

SEQ ID NO: 212174 - DNA, 27 bp, Artificial Sequence
  Description of Artificial Sequence: Synthetic oligonucleotide
catcaccgagaagctgtggaggaacgc

SEQ ID NO: 212175 - DNA, 27 bp, Artificial Sequence
  Description of Artificial Sequence: Synthetic oligonucleotide
atcaccgagaagctgtggaggaacgcc

SEQ ID NO: 212176 - DNA, 26 bp, Artificial Sequence
  Description of Artificial Sequence: Synthetic oligonucleotide
tcaccgagaagctgtggaggaacgcc

SEQ ID NO: 212177 - DNA, 25 bp, Artificial Sequence
  Description of Artificial Sequence: Synthetic oligonucleotide
caccgagaagctgtggaggaacgcc

SEQ ID NO: 212178 - DNA, 26 bp, Artificial Sequence
  Description of Artificial Sequence: Synthetic oligonucleotide
accgagaagctgtggaggaacgccct

SEQ ID NO: 212179 - DNA, 25 bp, Artificial Sequence
  Description of Artificial Sequence: Synthetic oligonucleotide
ccgagaagctgtggaggaacgccct

SEQ ID NO: 212180 - DNA, 25 bp, Artificial Sequence
  Description of Artificial Sequence: Synthetic oligonucleotide
cgagaagctgtggaggaacgccctg

SEQ ID NO: 212181 - DNA, 26 bp, Artificial Sequence
  Description of Artificial Sequence: Synthetic oligonucleotide
gagaagctgtggaggaacgccctgga

SEQ ID NO: 212182 - DNA, 26 bp, Artificial Sequence
  Description of Artificial Sequence: Synthetic oligonucleotide
agaagctgtggaggaacgccctggag

SEQ ID NO: 212183 - DNA, 25 bp, Artificial Sequence
  Description of Artificial Sequence: Synthetic oligonucleotide
gaagctgtggaggaacgccctggag

SEQ ID NO: 212184 - DNA, 25 bp, Artificial Sequence
  Description of Artificial Sequence: Synthetic oligonucleotide
aagctgtggaggaacgccctggagg

SEQ ID NO: 212185 - DNA, 24 bp, Artificial Sequence
  Description of Artificial Sequence: Synthetic oligonucleotide
agctgtggaggaacgccctggagg

SEQ ID NO: 212186 - DNA, 23 bp, Artificial Sequence
  Description of Artificial Sequence: Synthetic oligonucleotide
gctgtggaggaacgccctggagg

SEQ ID NO: 212187 - DNA, 23 bp, Artificial Sequence
  Description of Artificial Sequence: Synthetic oligonucleotide
ctgtggaggaacgccctggaggc

SEQ ID NO: 212188 - DNA, 24 bp, Artificial Sequence
  Description of Artificial Sequence: Synthetic oligonucleotide
tgtggaggaacgccctggaggcct

SEQ ID NO: 212189 - DNA, 23 bp, Artificial Sequence
  Description of Artificial Sequence: Synthetic oligonucleotide
gtggaggaacgccctggaggcct

SEQ ID NO: 212190 - DNA, 23 bp, Artificial Sequence
  Description of Artificial Sequence: Synthetic oligonucleotide
tggaggaacgccctggaggcctg

SEQ ID NO: 212191 - DNA, 22 bp, Artificial Sequence
  Description of Artificial Sequence: Synthetic oligonucleotide
ggaggaacgccctggaggcctg

SEQ ID NO: 212192 - DNA, 22 bp, Artificial Sequence
  Description of Artificial Sequence: Synthetic oligonucleotide
gaggaacgccctggaggcctgg

SEQ ID NO: 212193 - DNA, 22 bp, Artificial Sequence
  Description of Artificial Sequence: Synthetic oligonucleotide
aggaacgccctggaggcctggg

SEQ ID NO: 212194 - DNA, 21 bp, Artificial Sequence
  Description of Artificial Sequence: Synthetic oligonucleotide
ggaacgccctggaggcctggg

SEQ ID NO: 212195 - DNA, 21 bp, Artificial Sequence
  Description of Artificial Sequence: Synthetic oligonucleotide
gaacgccctggaggcctgggc

SEQ ID NO: 212196 - DNA, 21 bp, Artificial Sequence
  Description of Artificial Sequence: Synthetic oligonucleotide
aacgccctggaggcctgggcc

SEQ ID NO: 212197 - DNA, 20 bp, Artificial Sequence
  Description of Artificial Sequence: Synthetic oligonucleotide
acgccctggaggcctgggcc

SEQ ID NO: 212198 - DNA, 20 bp, Artificial Sequence
  Description of Artificial Sequence: Synthetic oligonucleotide
cgccctggaggcctgggcct

SEQ ID NO: 212199 - DNA, 20 bp, Artificial Sequence
  Description of Artificial Sequence: Synthetic oligonucleotide
gccctggaggcctgggccgt

SEQ ID NO: 212200 - DNA, 20 bp, Artificial Sequence
  Description of Artificial Sequence: Synthetic oligonucleotide
ccctggaggcctgggccgtg

SEQ ID NO: 212201 - DNA, 20 bp, Artificial Sequence
  Description of Artificial Sequence: Synthetic oligonucleotide
cctggaggcctgggccgtgc

SEQ ID NO: 212202 - DNA, 20 bp, Artificial Sequence
  Description of Artificial Sequence: Synthetic oligonucleotide
ctggaggcctgggccgtgcc

SEQ ID NO: 212203 - DNA, 20 bp, Artificial Sequence
  Description of Artificial Sequence: Synthetic oligonucleotide
tggaggcctgggccgtgccc

SEQ ID NO: 212204 - DNA, 20 bp, Artificial Sequence
  Description of Artificial Sequence: Synthetic oligonucleotide
ggaggcctgggccgtgccct

SEQ ID NO: 212205 - DNA, 20 bp, Artificial Sequence
  Description of Artificial Sequence: Synthetic oligonucleotide
gaggcctgggccgtgcccgt

SEQ ID NO: 212206 - DNA, 20 bp, Artificial Sequence
  Description of Artificial Sequence: Synthetic oligonucleotide
aggcctgggccgtgcccgtg

SEQ ID NO: 212207 - DNA, 20 bp, Artificial Sequence
  Description of Artificial Sequence: Synthetic oligonucleotide
ggcctgggccgtgcccgtgt

SEQ ID NO: 212208 - DNA, 20 bp, Artificial Sequence
  Description of Artificial Sequence: Synthetic oligonucleotide
gcctgggccgtgcccgtggt

SEQ ID NO: 212209 - DNA, 20 bp, Artificial Sequence
  Description of Artificial Sequence: Synthetic oligonucleotide
cctgggccgtgcccgtggtg

SEQ ID NO: 212210 - DNA, 21 bp, Artificial Sequence
  Description of Artificial Sequence: Synthetic oligonucleotide
ctgggccgtgcccgtggtgct

SEQ ID NO: 212211 - DNA, 21 bp, Artificial Sequence
  Description of Artificial Sequence: Synthetic oligonucleotide
tgggccgtgcccgtggtgctg

SEQ ID NO: 212212 - DNA, 20 bp, Artificial Sequence
  Description of Artificial Sequence: Synthetic oligonucleotide
gggccgtgcccgtggtgctg

SEQ ID NO: 212213 - DNA, 20 bp, Artificial Sequence
  Description of Artificial Sequence: Synthetic oligonucleotide
ggccgtgcccgtggtgctgg

SEQ ID NO: 212214 - DNA, 20 bp, Artificial Sequence
  Description of Artificial Sequence: Synthetic oligonucleotide
gccgtgcccgtggtgctggg

SEQ ID NO: 212215 - DNA, 20 bp, Artificial Sequence
  Description of Artificial Sequence: Synthetic oligonucleotide
ccgtgcccgtggtgctgggc

SEQ ID NO: 212216 - DNA, 20 bp, Artificial Sequence
  Description of Artificial Sequence: Synthetic oligonucleotide
cgtgcccgtggtgctgggcc

SEQ ID NO: 212217 - DNA, 20 bp, Artificial Sequence
  Description of Artificial Sequence: Synthetic oligonucleotide
gtgcccgtggtgctgggccc

SEQ ID NO: 212218 - DNA, 21 bp, Artificial Sequence
  Description of Artificial Sequence: Synthetic oligonucleotide
tgcccgtggtgctgggcccca

SEQ ID NO: 212219 - DNA, 20 bp, Artificial Sequence
  Description of Artificial Sequence: Synthetic oligonucleotide
gcccgtggtgctgggcccca

SEQ ID NO: 212220 - DNA, 20 bp, Artificial Sequence
  Description of Artificial Sequence: Synthetic oligonucleotide
cccgtggtgctgggccccag

SEQ ID NO: 212221 - DNA, 21 bp, Artificial Sequence
  Description of Artificial Sequence: Synthetic oligonucleotide
ccgtggtgctgggccccagca

SEQ ID NO: 212222 - DNA, 23 bp, Artificial Sequence
  Description of Artificial Sequence: Synthetic oligonucleotide
cgtggtgctgggccccagcagaa

SEQ ID NO: 212223 - DNA, 23 bp, Artificial Sequence
  Description of Artificial Sequence: Synthetic oligonucleotide
gtggtgctgggccccagcagaag

SEQ ID NO: 212224 - DNA, 25 bp, Artificial Sequence
  Description of Artificial Sequence: Synthetic oligonucleotide
tggtgctgggccccagcagaagcaa

SEQ ID NO: 212225 - DNA, 24 bp, Artificial Sequence
  Description of Artificial Sequence: Synthetic oligonucleotide
ggtgctgggccccagcagaagcaa

SEQ ID NO: 212226 - DNA, 26 bp, Artificial Sequence
  Description of Artificial Sequence: Synthetic oligonucleotide
gtgctgggccccagcagaagcaacta

SEQ ID NO: 212227 - DNA, 26 bp, Artificial Sequence
  Description of Artificial Sequence: Synthetic oligonucleotide
tgctgggccccagcagaagcaactac

SEQ ID NO: 212228 - DNA, 25 bp, Artificial Sequence
  Description of Artificial Sequence: Synthetic oligonucleotide
gctgggccccagcagaagcaactac

SEQ ID NO: 212229 - DNA, 26 bp, Artificial Sequence
  Description of Artificial Sequence: Synthetic oligonucleotide
ctgggccccagcagaagcaactacga

SEQ ID NO: 212230 - DNA, 27 bp, Artificial Sequence
  Description of Artificial Sequence: Synthetic oligonucleotide
tgggccccagcagaagcaactacgaga

SEQ ID NO: 212231 - DNA, 26 bp, Artificial Sequence
  Description of Artificial Sequence: Synthetic oligonucleotide
gggccccagcagaagcaactacgaga

SEQ ID NO: 212232 - DNA, 26 bp, Artificial Sequence
  Description of Artificial Sequence: Synthetic oligonucleotide
ggccccagcagaagcaactacgagag

SEQ ID NO: 212233 - DNA, 27 bp, Artificial Sequence
  Description of Artificial Sequence: Synthetic oligonucleotide
gccccagcagaagcaactacgagaggt

SEQ ID NO: 212234 - DNA, 28 bp, Artificial Sequence
  Description of Artificial Sequence: Synthetic oligonucleotide
ccccagcagaagcaactacgagaggttc

SEQ ID NO: 212235 - DNA, 28 bp, Artificial Sequence
  Description of Artificial Sequence: Synthetic oligonucleotide
cccagcagaagcaactacgagaggttcc

SEQ ID NO: 212236 - DNA, 29 bp, Artificial Sequence
  Description of Artificial Sequence: Synthetic oligonucleotide
ccagcagaagcaactacgagaggttcctg

SEQ ID NO: 212237 - DNA, 29 bp, Artificial Sequence
  Description of Artificial Sequence: Synthetic oligonucleotide
cagcagaagcaactacgagaggttcctgc

SEQ ID NO: 212238 - DNA, 29 bp, Artificial Sequence
  Description of Artificial Sequence: Synthetic oligonucleotide
agcagaagcaactacgagaggttcctgcc

SEQ ID NO: 212239 - DNA, 28 bp, Artificial Sequence
  Description of Artificial Sequence: Synthetic oligonucleotide
gcagaagcaactacgagaggttcctgcc

SEQ ID NO: 212240 - DNA, 29 bp, Artificial Sequence
  Description of Artificial Sequence: Synthetic oligonucleotide
cagaagcaactacgagaggttcctgccac

SEQ ID NO: 212241 - DNA, 29 bp, Artificial Sequence
  Description of Artificial Sequence: Synthetic oligonucleotide
agaagcaactacgagaggttcctgccacc

SEQ ID NO: 212242 - DNA, 28 bp, Artificial Sequence
  Description of Artificial Sequence: Synthetic oligonucleotide
gaagcaactacgagaggttcctgccacc

SEQ ID NO: 212243 - DNA, 28 bp, Artificial Sequence
  Description of Artificial Sequence: Synthetic oligonucleotide
aagcaactacgagaggttcctgccaccc

SEQ ID NO: 212244 - DNA, 27 bp, Artificial Sequence
  Description of Artificial Sequence: Synthetic oligonucleotide
agcaactacgagaggttcctgccaccc

SEQ ID NO: 212245 - DNA, 26 bp, Artificial Sequence
  Description of Artificial Sequence: Synthetic oligonucleotide
gcaactacgagaggttcctgccaccc

SEQ ID NO: 212246 - DNA, 27 bp, Artificial Sequence
  Description of Artificial Sequence: Synthetic oligonucleotide
caactacgagaggttcctgccacccga

SEQ ID NO: 212247 - DNA, 27 bp, Artificial Sequence
  Description of Artificial Sequence: Synthetic oligonucleotide
aactacgagaggttcctgccacccgac

SEQ ID NO: 212248 - DNA, 26 bp, Artificial Sequence
  Description of Artificial Sequence: Synthetic oligonucleotide
actacgagaggttcctgccacccgac

SEQ ID NO: 212249 - DNA, 25 bp, Artificial Sequence
  Description of Artificial Sequence: Synthetic oligonucleotide
ctacgagaggttcctgccacccgac

SEQ ID NO: 212250 - DNA, 25 bp, Artificial Sequence
  Description of Artificial Sequence: Synthetic oligonucleotide
tacgagaggttcctgccacccgacg

SEQ ID NO: 212251 - DNA, 24 bp, Artificial Sequence
  Description of Artificial Sequence: Synthetic oligonucleotide
acgagaggttcctgccacccgacg

SEQ ID NO: 212252 - DNA, 23 bp, Artificial Sequence
  Description of Artificial Sequence: Synthetic oligonucleotide
cgagaggttcctgccacccgacg

SEQ ID NO: 212253 - DNA, 23 bp, Artificial Sequence
  Description of Artificial Sequence: Synthetic oligonucleotide
gagaggttcctgccacccgacgc

SEQ ID NO: 212254 - DNA, 25 bp, Artificial Sequence
  Description of Artificial Sequence: Synthetic oligonucleotide
agaggttcctgccacccgacgcctt

SEQ ID NO: 212255 - DNA, 24 bp, Artificial Sequence
  Description of Artificial Sequence: Synthetic oligonucleotide
gaggttcctgccacccgacgcctt

SEQ ID NO: 212256 - DNA, 26 bp, Artificial Sequence
  Description of Artificial Sequence: Synthetic oligonucleotide
aggttcctgccacccgacgccttcat

SEQ ID NO: 212257 - DNA, 25 bp, Artificial Sequence
  Description of Artificial Sequence: Synthetic oligonucleotide
ggttcctgccacccgacgccttcat

SEQ ID NO: 212258 - DNA, 25 bp, Artificial Sequence
  Description of Artificial Sequence: Synthetic oligonucleotide
gttcctgccacccgacgccttcatc

SEQ ID NO: 212259 - DNA, 26 bp, Artificial Sequence
  Description of Artificial Sequence: Synthetic oligonucleotide
ttcctgccacccgacgccttcatcca

SEQ ID NO: 212260 - DNA, 25 bp, Artificial Sequence
  Description of Artificial Sequence: Synthetic oligonucleotide
tcctgccacccgacgccttcatcca

SEQ ID NO: 212261 - DNA, 24 bp, Artificial Sequence
  Description of Artificial Sequence: Synthetic oligonucleotide
cctgccacccgacgccttcatcca

SEQ ID NO: 212262 - DNA, 24 bp, Artificial Sequence
  Description of Artificial Sequence: Synthetic oligonucleotide
ctgccacccgacgccttcatccac

SEQ ID NO: 212263 - DNA, 25 bp, Artificial Sequence
  Description of Artificial Sequence: Synthetic oligonucleotide
tgccacccgacgccttcatccacgt

SEQ ID NO: 212264 - DNA, 24 bp, Artificial Sequence
  Description of Artificial Sequence: Synthetic oligonucleotide
gccacccgacgccttcatccacgt

SEQ ID NO: 212265 - DNA, 24 bp, Artificial Sequence
  Description of Artificial Sequence: Synthetic oligonucleotide
ccacccgacgccttcatccacgtg

SEQ ID NO: 212266 - DNA, 25 bp, Artificial Sequence
  Description of Artificial Sequence: Synthetic oligonucleotide
cacccgacgccttcatccacgtgga

SEQ ID NO: 212267 - DNA, 25 bp, Artificial Sequence
  Description of Artificial Sequence: Synthetic oligonucleotide
acccgacgccttcatccacgtggac

SEQ ID NO: 212268 - DNA, 24 bp, Artificial Sequence
  Description of Artificial Sequence: Synthetic oligonucleotide
cccgacgccttcatccacgtggac

SEQ ID NO: 212269 - DNA, 25 bp, Artificial Sequence
  Description of Artificial Sequence: Synthetic oligonucleotide
ccgacgccttcatccacgtggacga

SEQ ID NO: 212270 - DNA, 27 bp, Artificial Sequence
  Description of Artificial Sequence: Synthetic oligonucleotide
cgacgccttcatccacgtggacgactt

SEQ ID NO: 212271 - DNA, 27 bp, Artificial Sequence
  Description of Artificial Sequence: Synthetic oligonucleotide
gacgccttcatccacgtggacgacttc

SEQ ID NO: 212272 - DNA, 27 bp, Artificial Sequence
  Description of Artificial Sequence: Synthetic oligonucleotide
acgccttcatccacgtggacgacttcc

SEQ ID NO: 212273 - DNA, 27 bp, Artificial Sequence
  Description of Artificial Sequence: Synthetic oligonucleotide
cgccttcatccacgtggacgacttcca

SEQ ID NO: 212274 - DNA, 27 bp, Artificial Sequence
  Description of Artificial Sequence: Synthetic oligonucleotide
gccttcatccacgtggacgacttccag

SEQ ID NO: 212275 - DNA, 28 bp, Artificial Sequence
  Description of Artificial Sequence: Synthetic oligonucleotide
ccttcatccacgtggacgacttccagag

SEQ ID NO: 212276 - DNA, 28 bp, Artificial Sequence
  Description of Artificial Sequence: Synthetic oligonucleotide
cttcatccacgtggacgacttccagagc

SEQ ID NO: 212277 - DNA, 28 bp, Artificial Sequence
  Description of Artificial Sequence: Synthetic oligonucleotide
ttcatccacgtggacgacttccagagcc

SEQ ID NO: 212278 - DNA, 27 bp, Artificial Sequence
  Description of Artificial Sequence: Synthetic oligonucleotide
tcatccacgtggacgacttccagagcc

SEQ ID NO: 212279 - DNA, 26 bp, Artificial Sequence
  Description of Artificial Sequence: Synthetic oligonucleotide
catccacgtggacgacttccagagcc

SEQ ID NO: 212280 - DNA, 26 bp, Artificial Sequence
  Description of Artificial Sequence: Synthetic oligonucleotide
atccacgtggacgacttccagagccc

SEQ ID NO: 212281 - DNA, 25 bp, Artificial Sequence
  Description of Artificial Sequence: Synthetic oligonucleotide
tccacgtggacgacttccagagccc

SEQ ID NO: 212282 - DNA, 24 bp, Artificial Sequence
  Description of Artificial Sequence: Synthetic oligonucleotide
ccacgtggacgacttccagagccc

SEQ ID NO: 212283 - DNA, 26 bp, Artificial Sequence
  Description of Artificial Sequence: Synthetic oligonucleotide
cacgtggacgacttccagagccccaa

SEQ ID NO: 212284 - DNA, 26 bp, Artificial Sequence
  Description of Artificial Sequence: Synthetic oligonucleotide
acgtggacgacttccagagccccaag

SEQ ID NO: 212285 - DNA, 25 bp, Artificial Sequence
  Description of Artificial Sequence: Synthetic oligonucleotide
cgtggacgacttccagagccccaag

SEQ ID NO: 212286 - DNA, 26 bp, Artificial Sequence
  Description of Artificial Sequence: Synthetic oligonucleotide
gtggacgacttccagagccccaagga

SEQ ID NO: 212287 - DNA, 26 bp, Artificial Sequence
  Description of Artificial Sequence: Synthetic oligonucleotide
tggacgacttccagagccccaaggac

SEQ ID NO: 212288 - DNA, 25 bp, Artificial Sequence
  Description of Artificial Sequence: Synthetic oligonucleotide
ggacgacttccagagccccaaggac

SEQ ID NO: 212289 - DNA, 26 bp, Artificial Sequence
  Description of Artificial Sequence: Synthetic oligonucleotide
gacgacttccagagccccaaggacct

SEQ ID NO: 212290 - DNA, 26 bp, Artificial Sequence
  Description of Artificial Sequence: Synthetic oligonucleotide
acgacttccagagccccaaggacctg

SEQ ID NO: 212291 - DNA, 25 bp, Artificial Sequence
  Description of Artificial Sequence: Synthetic oligonucleotide
cgacttccagagccccaaggacctg

SEQ ID NO: 212292 - DNA, 25 bp, Artificial Sequence
  Description of Artificial Sequence: Synthetic oligonucleotide
gacttccagagccccaaggacctgg

SEQ ID NO: 212293 - DNA, 25 bp, Artificial Sequence
  Description of Artificial Sequence: Synthetic oligonucleotide
acttccagagccccaaggacctggc

SEQ ID NO: 212294 - DNA, 24 bp, Artificial Sequence
  Description of Artificial Sequence: Synthetic oligonucleotide
cttccagagccccaaggacctggc

SEQ ID NO: 212295 - DNA, 24 bp, Artificial Sequence
  Description of Artificial Sequence: Synthetic oligonucleotide
ttccagagccccaaggacctggcc

SEQ ID NO: 212296 - DNA, 23 bp, Artificial Sequence
  Description of Artificial Sequence: Synthetic oligonucleotide
tccagagccccaaggacctggcc

SEQ ID NO: 212297 - DNA, 22 bp, Artificial Sequence
  Description of Artificial Sequence: Synthetic oligonucleotide
ccagagccccaaggacctggcc

SEQ ID NO: 212298 - DNA, 22 bp, Artificial Sequence
  Description of Artificial Sequence: Synthetic oligonucleotide
cagagccccaaggacctggccc

SEQ ID NO: 212299 - DNA, 22 bp, Artificial Sequence
  Description of Artificial Sequence: Synthetic oligonucleotide
agagccccaaggacctggcccg

SEQ ID NO: 212300 - DNA, 21 bp, Artificial Sequence
  Description of Artificial Sequence: Synthetic oligonucleotide
gagccccaaggacctggcccg

SEQ ID NO: 212301 - DNA, 23 bp, Artificial Sequence
  Description of Artificial Sequence: Synthetic oligonucleotide
agccccaaggacctggcccggta

SEQ ID NO: 212302 - DNA, 22 bp, Artificial Sequence
  Description of Artificial Sequence: Synthetic oligonucleotide
gccccaaggacctggcccggta

SEQ ID NO: 212303 - DNA, 22 bp, Artificial Sequence
  Description of Artificial Sequence: Synthetic oligonucleotide
ccccaaggacctggcccggtac

SEQ ID NO: 212304 - DNA, 23 bp, Artificial Sequence
  Description of Artificial Sequence: Synthetic oligonucleotide
cccaaggacctggcccggtacct

SEQ ID NO: 212305 - DNA, 23 bp, Artificial Sequence
  Description of Artificial Sequence: Synthetic oligonucleotide
ccaaggacctggcccggtacctg

SEQ ID NO: 212306 - DNA, 24 bp, Artificial Sequence
  Description of Artificial Sequence: Synthetic oligonucleotide
caaggacctggcccggtacctgca

SEQ ID NO: 212307 - DNA, 24 bp, Artificial Sequence
  Description of Artificial Sequence: Synthetic oligonucleotide
aaggacctggcccggtacctgcag

SEQ ID NO: 212308 - DNA, 23 bp, Artificial Sequence
  Description of Artificial Sequence: Synthetic oligonucleotide
aggacctggcccggtacctgcag

SEQ ID NO: 212309 - DNA, 22 bp, Artificial Sequence
  Description of Artificial Sequence: Synthetic oligonucleotide
ggacctggcccggtacctgcag

SEQ ID NO: 212310 - DNA, 23 bp, Artificial Sequence
  Description of Artificial Sequence: Synthetic oligonucleotide
gacctggcccggtacctgcagga

SEQ ID NO: 212311 - DNA, 23 bp, Artificial Sequence
  Description of Artificial Sequence: Synthetic oligonucleotide
acctggcccggtacctgcaggag

SEQ ID NO: 212312 - DNA, 22 bp, Artificial Sequence
  Description of Artificial Sequence: Synthetic oligonucleotide
cctggcccggtacctgcaggag

SEQ ID NO: 212313 - DNA, 23 bp, Artificial Sequence
  Description of Artificial Sequence: Synthetic oligonucleotide
ctggcccggtacctgcaggagct

SEQ ID NO: 212314 - DNA, 23 bp, Artificial Sequence
  Description of Artificial Sequence: Synthetic oligonucleotide
tggcccggtacctgcaggagctg

SEQ ID NO: 212315 - DNA, 22 bp, Artificial Sequence
  Description of Artificial Sequence: Synthetic oligonucleotide
ggcccggtacctgcaggagctg

SEQ ID NO: 212316 - DNA, 23 bp, Artificial Sequence
  Description of Artificial Sequence: Synthetic oligonucleotide
gcccggtacctgcaggagctgga

SEQ ID NO: 212317 - DNA, 25 bp, Artificial Sequence
  Description of Artificial Sequence: Synthetic oligonucleotide
cccggtacctgcaggagctggacaa

SEQ ID NO: 212318 - DNA, 25 bp, Artificial Sequence
  Description of Artificial Sequence: Synthetic oligonucleotide
ccggtacctgcaggagctggacaag

SEQ ID NO: 212319 - DNA, 26 bp, Artificial Sequence
  Description of Artificial Sequence: Synthetic oligonucleotide
cggtacctgcaggagctggacaagga

SEQ ID NO: 212320 - DNA, 26 bp, Artificial Sequence
  Description of Artificial Sequence: Synthetic oligonucleotide
ggtacctgcaggagctggacaaggac

SEQ ID NO: 212321 - DNA, 27 bp, Artificial Sequence
  Description of Artificial Sequence: Synthetic oligonucleotide
gtacctgcaggagctggacaaggacca

SEQ ID NO: 212322 - DNA, 27 bp, Artificial Sequence
  Description of Artificial Sequence: Synthetic oligonucleotide
tacctgcaggagctggacaaggaccac

SEQ ID NO: 212323 - DNA, 26 bp, Artificial Sequence
  Description of Artificial Sequence: Synthetic oligonucleotide
acctgcaggagctggacaaggaccac

SEQ ID NO: 212324 - DNA, 25 bp, Artificial Sequence
  Description of Artificial Sequence: Synthetic oligonucleotide
cctgcaggagctggacaaggaccac

SEQ ID NO: 212325 - DNA, 25 bp, Artificial Sequence
  Description of Artificial Sequence: Synthetic oligonucleotide
ctgcaggagctggacaaggaccacg

SEQ ID NO: 212326 - DNA, 25 bp, Artificial Sequence
  Description of Artificial Sequence: Synthetic oligonucleotide
tgcaggagctggacaaggaccacgc

SEQ ID NO: 212327 - DNA, 24 bp, Artificial Sequence
  Description of Artificial Sequence: Synthetic oligonucleotide
gcaggagctggacaaggaccacgc

SEQ ID NO: 212328 - DNA, 24 bp, Artificial Sequence
  Description of Artificial Sequence: Synthetic oligonucleotide
caggagctggacaaggaccacgcc

SEQ ID NO: 212329 - DNA, 24 bp, Artificial Sequence
  Description of Artificial Sequence: Synthetic oligonucleotide
aggagctggacaaggaccacgccc

SEQ ID NO: 212330 - DNA, 23 bp, Artificial Sequence
  Description of Artificial Sequence: Synthetic oligonucleotide
ggagctggacaaggaccacgccc

SEQ ID NO: 212331 - DNA, 23 bp, Artificial Sequence
  Description of Artificial Sequence: Synthetic oligonucleotide
gagctggacaaggaccacgcccg

SEQ ID NO: 212332 - DNA, 25 bp, Artificial Sequence
  Description of Artificial Sequence: Synthetic oligonucleotide
agctggacaaggaccacgcccgcta

SEQ ID NO: 212333 - DNA, 24 bp, Artificial Sequence
  Description of Artificial Sequence: Synthetic oligonucleotide
gctggacaaggaccacgcccgcta

SEQ ID NO: 212334 - DNA, 24 bp, Artificial Sequence
  Description of Artificial Sequence: Synthetic oligonucleotide
ctggacaaggaccacgcccgctac

SEQ ID NO: 212335 - DNA, 25 bp, Artificial Sequence
  Description of Artificial Sequence: Synthetic oligonucleotide
tggacaaggaccacgcccgctacct

SEQ ID NO: 212336 - DNA, 24 bp, Artificial Sequence
  Description of Artificial Sequence: Synthetic oligonucleotide
ggacaaggaccacgcccgctacct

SEQ ID NO: 212337 - DNA, 25 bp, Artificial Sequence
  Description of Artificial Sequence: Synthetic oligonucleotide
gacaaggaccacgcccgctacctga

SEQ ID NO: 212338 - DNA, 25 bp, Artificial Sequence
  Description of Artificial Sequence: Synthetic oligonucleotide
acaaggaccacgcccgctacctgag

SEQ ID NO: 212339 - DNA, 24 bp, Artificial Sequence
  Description of Artificial Sequence: Synthetic oligonucleotide
caaggaccacgcccgctacctgag

SEQ ID NO: 212340 - DNA, 26 bp, Artificial Sequence
  Description of Artificial Sequence: Synthetic oligonucleotide
aaggaccacgcccgctacctgagcta

SEQ ID NO: 212341 - DNA, 25 bp, Artificial Sequence
  Description of Artificial Sequence: Synthetic oligonucleotide
aggaccacgcccgctacctgagcta

SEQ ID NO: 212342 - DNA, 24 bp, Artificial Sequence
  Description of Artificial Sequence: Synthetic oligonucleotide
ggaccacgcccgctacctgagcta

SEQ ID NO: 212343 - DNA, 27 bp, Artificial Sequence
  Description of Artificial Sequence: Synthetic oligonucleotide
gaccacgcccgctacctgagctacttt

SEQ ID NO: 212344 - DNA, 27 bp, Artificial Sequence
  Description of Artificial Sequence: Synthetic oligonucleotide
accacgcccgctacctgagctactttc

SEQ ID NO: 212345 - DNA, 26 bp, Artificial Sequence
  Description of Artificial Sequence: Synthetic oligonucleotide
ccacgcccgctacctgagctactttc

SEQ ID NO: 212346 - DNA, 26 bp, Artificial Sequence
  Description of Artificial Sequence: Synthetic oligonucleotide
cacgcccgctacctgagctactttcg

SEQ ID NO: 212347 - DNA, 27 bp, Artificial Sequence
  Description of Artificial Sequence: Synthetic oligonucleotide
acgcccgctacctgagctactttcgct

SEQ ID NO: 212348 - DNA, 26 bp, Artificial Sequence
  Description of Artificial Sequence: Synthetic oligonucleotide
cgcccgctacctgagctactttcgct

SEQ ID NO: 212349 - DNA, 26 bp, Artificial Sequence
  Description of Artificial Sequence: Synthetic oligonucleotide
gcccgctacctgagctactttcgctg

SEQ ID NO: 212350 - DNA, 26 bp, Artificial Sequence
  Description of Artificial Sequence: Synthetic oligonucleotide
cccgctacctgagctactttcgctgg

SEQ ID NO: 212351 - DNA, 26 bp, Artificial Sequence
  Description of Artificial Sequence: Synthetic oligonucleotide
ccgctacctgagctactttcgctggc

SEQ ID NO: 212352 - DNA, 26 bp, Artificial Sequence
  Description of Artificial Sequence: Synthetic oligonucleotide
cgctacctgagctactttcgctggcg

SEQ ID NO: 212353 - DNA, 26 bp, Artificial Sequence
  Description of Artificial Sequence: Synthetic oligonucleotide
gctacctgagctactttcgctggcgg

SEQ ID NO: 212354 - DNA, 27 bp, Artificial Sequence
  Description of Artificial Sequence: Synthetic oligonucleotide
ctacctgagctactttcgctggcggga

SEQ ID NO: 212355 - DNA, 27 bp, Artificial Sequence
  Description of Artificial Sequence: Synthetic oligonucleotide
tacctgagctactttcgctggcgggag

SEQ ID NO: 212356 - DNA, 27 bp, Artificial Sequence
  Description of Artificial Sequence: Synthetic oligonucleotide
acctgagctactttcgctggcgggaga

SEQ ID NO: 212357 - DNA, 26 bp, Artificial Sequence
  Description of Artificial Sequence: Synthetic oligonucleotide
cctgagctactttcgctggcgggaga

SEQ ID NO: 212358 - DNA, 26 bp, Artificial Sequence
  Description of Artificial Sequence: Synthetic oligonucleotide
ctgagctactttcgctggcgggagac

SEQ ID NO: 212359 - DNA, 26 bp, Artificial Sequence
  Description of Artificial Sequence: Synthetic oligonucleotide
tgagctactttcgctggcgggagacg

SEQ ID NO: 212360 - DNA, 25 bp, Artificial Sequence
  Description of Artificial Sequence: Synthetic oligonucleotide
gagctactttcgctggcgggagacg

SEQ ID NO: 212361 - DNA, 26 bp, Artificial Sequence
  Description of Artificial Sequence: Synthetic oligonucleotide
agctactttcgctggcgggagacgct

SEQ ID NO: 212362 - DNA, 25 bp, Artificial Sequence
  Description of Artificial Sequence: Synthetic oligonucleotide
gctactttcgctggcgggagacgct

SEQ ID NO: 212363 - DNA, 25 bp, Artificial Sequence
  Description of Artificial Sequence: Synthetic oligonucleotide
ctactttcgctggcgggagacgctg

SEQ ID NO: 212364 - DNA, 25 bp, Artificial Sequence
  Description of Artificial Sequence: Synthetic oligonucleotide
tactttcgctggcgggagacgctgc

SEQ ID NO: 212365 - DNA, 24 bp, Artificial Sequence
  Description of Artificial Sequence: Synthetic oligonucleotide
actttcgctggcgggagacgctgc

SEQ ID NO: 212366 - DNA, 23 bp, Artificial Sequence
  Description of Artificial Sequence: Synthetic oligonucleotide
ctttcgctggcgggagacgctgc

SEQ ID NO: 212367 - DNA, 23 bp, Artificial Sequence
  Description of Artificial Sequence: Synthetic oligonucleotide
tttcgctggcgggagacgctgcg

SEQ ID NO: 212368 - DNA, 22 bp, Artificial Sequence
  Description of Artificial Sequence: Synthetic oligonucleotide
ttcgctggcgggagacgctgcg

SEQ ID NO: 212369 - DNA, 21 bp, Artificial Sequence
  Description of Artificial Sequence: Synthetic oligonucleotide
tcgctggcgggagacgctgcg

SEQ ID NO: 212370 - DNA, 20 bp, Artificial Sequence
  Description of Artificial Sequence: Synthetic oligonucleotide
cgctggcgggagacgctgcg

SEQ ID NO: 212371 - DNA, 20 bp, Artificial Sequence
  Description of Artificial Sequence: Synthetic oligonucleotide
gctggcgggagacgctgcgg

SEQ ID NO: 212372 - DNA, 20 bp, Artificial Sequence
  Description of Artificial Sequence: Synthetic oligonucleotide
ctggcgggagacgctgcggc

SEQ ID NO: 212373 - DNA, 21 bp, Artificial Sequence
  Description of Artificial Sequence: Synthetic oligonucleotide
tggcgggagacgctgcggcct

SEQ ID NO: 212374 - DNA, 20 bp, Artificial Sequence
  Description of Artificial Sequence: Synthetic oligonucleotide
ggcgggagacgctgcggcct

SEQ ID NO: 212375 - DNA, 20 bp, Artificial Sequence
  Description of Artificial Sequence: Synthetic oligonucleotide
gcgggagacgctgcggcctc

SEQ ID NO: 212376 - DNA, 20 bp, Artificial Sequence
  Description of Artificial Sequence: Synthetic oligonucleotide
cgggagacgctgcggcctcg

SEQ ID NO: 212377 - DNA, 21 bp, Artificial Sequence
  Description of Artificial Sequence: Synthetic oligonucleotide
gggagacgctgcggcctcgct

SEQ ID NO: 212378 - DNA, 21 bp, Artificial Sequence
  Description of Artificial Sequence: Synthetic oligonucleotide
ggagacgctgcggcctcgctc

SEQ ID NO: 212379 - DNA, 23 bp, Artificial Sequence
  Description of Artificial Sequence: Synthetic oligonucleotide
gagacgctgcggcctcgctcctt

SEQ ID NO: 212380 - DNA, 24 bp, Artificial Sequence
  Description of Artificial Sequence: Synthetic oligonucleotide
agacgctgcggcctcgctccttca

SEQ ID NO: 212381 - DNA, 23 bp, Artificial Sequence
  Description of Artificial Sequence: Synthetic oligonucleotide
gacgctgcggcctcgctccttca

SEQ ID NO: 212382 - DNA, 23 bp, Artificial Sequence
  Description of Artificial Sequence: Synthetic oligonucleotide
acgctgcggcctcgctccttcag

SEQ ID NO: 212383 - DNA, 22 bp, Artificial Sequence
  Description of Artificial Sequence: Synthetic oligonucleotide
cgctgcggcctcgctccttcag

SEQ ID NO: 212384 - DNA, 23 bp, Artificial Sequence
  Description of Artificial Sequence: Synthetic oligonucleotide
gctgcggcctcgctccttcagct

SEQ ID NO: 212385 - DNA, 23 bp, Artificial Sequence
  Description of Artificial Sequence: Synthetic oligonucleotide
ctgcggcctcgctccttcagctg

SEQ ID NO: 212386 - DNA, 23 bp, Artificial Sequence
  Description of Artificial Sequence: Synthetic oligonucleotide
tgcggcctcgctccttcagctgg

SEQ ID NO: 212387 - DNA, 22 bp, Artificial Sequence
  Description of Artificial Sequence: Synthetic oligonucleotide
gcggcctcgctccttcagctgg

SEQ ID NO: 212388 - DNA, 22 bp, Artificial Sequence
  Description of Artificial Sequence: Synthetic oligonucleotide
cggcctcgctccttcagctggg

SEQ ID NO: 212389 - DNA, 23 bp, Artificial Sequence
  Description of Artificial Sequence: Synthetic oligonucleotide
ggcctcgctccttcagctgggca

SEQ ID NO: 212390 - DNA, 24 bp, Artificial Sequence
  Description of Artificial Sequence: Synthetic oligonucleotide
gcctcgctccttcagctgggcact

SEQ ID NO: 212391 - DNA, 24 bp, Artificial Sequence
  Description of Artificial Sequence: Synthetic oligonucleotide
cctcgctccttcagctgggcactg

SEQ ID NO: 212392 - DNA, 27 bp, Artificial Sequence
  Description of Artificial Sequence: Synthetic oligonucleotide
ctcgctccttcagctgggcactggatt

SEQ ID NO: 212393 - DNA, 28 bp, Artificial Sequence
  Description of Artificial Sequence: Synthetic oligonucleotide
tcgctccttcagctgggcactggatttc

SEQ ID NO: 212394 - DNA, 27 bp, Artificial Sequence
  Description of Artificial Sequence: Synthetic oligonucleotide
cgctccttcagctgggcactggatttc

SEQ ID NO: 212395 - DNA, 28 bp, Artificial Sequence
  Description of Artificial Sequence: Synthetic oligonucleotide
gctccttcagctgggcactggatttctg

SEQ ID NO: 212396 - DNA, 28 bp, Artificial Sequence
  Description of Artificial Sequence: Synthetic oligonucleotide
ctccttcagctgggcactggatttctgc

SEQ ID NO: 212397 - DNA, 30 bp, Artificial Sequence
  Description of Artificial Sequence: Synthetic oligonucleotide
tccttcagctgggcactggatttctgcaag

SEQ ID NO: 212398 - DNA, 29 bp, Artificial Sequence
  Description of Artificial Sequence: Synthetic oligonucleotide
ccttcagctgggcactggatttctgcaag

SEQ ID NO: 212399 - DNA, 29 bp, Artificial Sequence
  Description of Artificial Sequence: Synthetic oligonucleotide
cttcagctgggcactggatttctgcaagg

SEQ ID NO: 212400 - DNA, 29 bp, Artificial Sequence
  Description of Artificial Sequence: Synthetic oligonucleotide
ttcagctgggcactggatttctgcaaggc

SEQ ID NO: 212401 - DNA, 28 bp, Artificial Sequence
  Description of Artificial Sequence: Synthetic oligonucleotide
tcagctgggcactggatttctgcaaggc

SEQ ID NO: 212402 - DNA, 27 bp, Artificial Sequence
  Description of Artificial Sequence: Synthetic oligonucleotide
cagctgggcactggatttctgcaaggc

SEQ ID NO: 212403 - DNA, 27 bp, Artificial Sequence
  Description of Artificial Sequence: Synthetic oligonucleotide
agctgggcactggatttctgcaaggcc

SEQ ID NO: 212404 - DNA, 27 bp, Artificial Sequence
  Description of Artificial Sequence: Synthetic oligonucleotide
gctgggcactggatttctgcaaggcct

SEQ ID NO: 212405 - DNA, 27 bp, Artificial Sequence
  Description of Artificial Sequence: Synthetic oligonucleotide
ctgggcactggatttctgcaaggcctg

SEQ ID NO: 212406 - DNA, 27 bp, Artificial Sequence
  Description of Artificial Sequence: Synthetic oligonucleotide
tgggcactggatttctgcaaggcctgc

SEQ ID NO: 212407 - DNA, 27 bp, Artificial Sequence
  Description of Artificial Sequence: Synthetic oligonucleotide
gggcactggatttctgcaaggcctgct

SEQ ID NO: 212408 - DNA, 27 bp, Artificial Sequence
  Description of Artificial Sequence: Synthetic oligonucleotide
ggcactggatttctgcaaggcctgctg

SEQ ID NO: 212409 - DNA, 27 bp, Artificial Sequence
  Description of Artificial Sequence: Synthetic oligonucleotide
gcactggatttctgcaaggcctgctgg

SEQ ID NO: 212410 - DNA, 30 bp, Artificial Sequence
  Description of Artificial Sequence: Synthetic oligonucleotide
cactggatttctgcaaggcctgctggaaac

SEQ ID NO: 212411 - DNA, 31 bp, Artificial Sequence
  Description of Artificial Sequence: Synthetic oligonucleotide
actggatttctgcaaggcctgctggaaactg

SEQ ID NO: 212412 - DNA, 30 bp, Artificial Sequence
  Description of Artificial Sequence: Synthetic oligonucleotide
ctggatttctgcaaggcctgctggaaactg

SEQ ID NO: 212413 - DNA, 30 bp, Artificial Sequence
  Description of Artificial Sequence: Synthetic oligonucleotide
tggatttctgcaaggcctgctggaaactgc

SEQ ID NO: 212414 - DNA, 29 bp, Artificial Sequence
  Description of Artificial Sequence: Synthetic oligonucleotide
ggatttctgcaaggcctgctggaaactgc

SEQ ID NO: 212415 - DNA, 30 bp, Artificial Sequence
  Description of Artificial Sequence: Synthetic oligonucleotide
gatttctgcaaggcctgctggaaactgcag

SEQ ID NO: 212416 - DNA, 30 bp, Artificial Sequence
  Description of Artificial Sequence: Synthetic oligonucleotide
atttctgcaaggcctgctggaaactgcagc

SEQ ID NO: 212417 - DNA, 29 bp, Artificial Sequence
  Description of Artificial Sequence: Synthetic oligonucleotide
tttctgcaaggcctgctggaaactgcagc

SEQ ID NO: 212418 - DNA, 28 bp, Artificial Sequence
  Description of Artificial Sequence: Synthetic oligonucleotide
ttctgcaaggcctgctggaaactgcagc

SEQ ID NO: 212419 - DNA, 27 bp, Artificial Sequence
  Description of Artificial Sequence: Synthetic oligonucleotide
tctgcaaggcctgctggaaactgcagc

SEQ ID NO: 212420 - DNA, 27 bp, Artificial Sequence
  Description of Artificial Sequence: Synthetic oligonucleotide
ctgcaaggcctgctggaaactgcagca

SEQ ID NO: 212421 - DNA, 27 bp, Artificial Sequence
  Description of Artificial Sequence: Synthetic oligonucleotide
tgcaaggcctgctggaaactgcagcag

SEQ ID NO: 212422 - DNA, 26 bp, Artificial Sequence
  Description of Artificial Sequence: Synthetic oligonucleotide
gcaaggcctgctggaaactgcagcag

SEQ ID NO: 212423 - DNA, 27 bp, Artificial Sequence
  Description of Artificial Sequence: Synthetic oligonucleotide
caaggcctgctggaaactgcagcagga

SEQ ID NO: 212424 - DNA, 29 bp, Artificial Sequence
  Description of Artificial Sequence: Synthetic oligonucleotide
aaggcctgctggaaactgcagcaggaatc

SEQ ID NO: 212425 - DNA, 28 bp, Artificial Sequence
  Description of Artificial Sequence: Synthetic oligonucleotide
aggcctgctggaaactgcagcaggaatc

SEQ ID NO: 212426 - DNA, 27 bp, Artificial Sequence
  Description of Artificial Sequence: Synthetic oligonucleotide
ggcctgctggaaactgcagcaggaatc

SEQ ID NO: 212427 - DNA, 27 bp, Artificial Sequence
  Description of Artificial Sequence: Synthetic oligonucleotide
gcctgctggaaactgcagcaggaatcc

SEQ ID NO: 212428 - DNA, 28 bp, Artificial Sequence
  Description of Artificial Sequence: Synthetic oligonucleotide
cctgctggaaactgcagcaggaatccag

SEQ ID NO: 212429 - DNA, 28 bp, Artificial Sequence
  Description of Artificial Sequence: Synthetic oligonucleotide
ctgctggaaactgcagcaggaatccagg

SEQ ID NO: 212430 - DNA, 30 bp, Artificial Sequence
  Description of Artificial Sequence: Synthetic oligonucleotide
tgctggaaactgcagcaggaatccaggtac

SEQ ID NO: 212431 - DNA, 29 bp, Artificial Sequence
  Description of Artificial Sequence: Synthetic oligonucleotide
gctggaaactgcagcaggaatccaggtac

SEQ ID NO: 212432 - DNA, 29 bp, Artificial Sequence
  Description of Artificial Sequence: Synthetic oligonucleotide
ctggaaactgcagcaggaatccaggtacc

SEQ ID NO: 212433 - DNA, 30 bp, Artificial Sequence
  Description of Artificial Sequence: Synthetic oligonucleotide
tggaaactgcagcaggaatccaggtaccag

SEQ ID NO: 212434 - DNA, 29 bp, Artificial Sequence
  Description of Artificial Sequence: Synthetic oligonucleotide
ggaaactgcagcaggaatccaggtaccag

SEQ ID NO: 212435 - DNA, 30 bp, Artificial Sequence
  Description of Artificial Sequence: Synthetic oligonucleotide
gaaactgcagcaggaatccaggtaccagac

SEQ ID NO: 212436 - DNA, 30 bp, Artificial Sequence
  Description of Artificial Sequence: Synthetic oligonucleotide
aaactgcagcaggaatccaggtaccagacg

SEQ ID NO: 212437 - DNA, 29 bp, Artificial Sequence
  Description of Artificial Sequence: Synthetic oligonucleotide
aactgcagcaggaatccaggtaccagacg

SEQ ID NO: 212438 - DNA, 28 bp, Artificial Sequence
  Description of Artificial Sequence: Synthetic oligonucleotide
actgcagcaggaatccaggtaccagacg

SEQ ID NO: 212439 - DNA, 27 bp, Artificial Sequence
  Description of Artificial Sequence: Synthetic oligonucleotide
ctgcagcaggaatccaggtaccagacg

SEQ ID NO: 212440 - DNA, 27 bp, Artificial Sequence
  Description of Artificial Sequence: Synthetic oligonucleotide
tgcagcaggaatccaggtaccagacgg

SEQ ID NO: 212441 - DNA, 27 bp, Artificial Sequence
  Description of Artificial Sequence: Synthetic oligonucleotide
gcagcaggaatccaggtaccagacggt

SEQ ID NO: 212442 - DNA, 27 bp, Artificial Sequence
  Description of Artificial Sequence: Synthetic oligonucleotide
cagcaggaatccaggtaccagacggtg

SEQ ID NO: 212443 - DNA, 27 bp, Artificial Sequence
  Description of Artificial Sequence: Synthetic oligonucleotide
agcaggaatccaggtaccagacggtgc

SEQ ID NO: 212444 - DNA, 26 bp, Artificial Sequence
  Description of Artificial Sequence: Synthetic oligonucleotide
gcaggaatccaggtaccagacggtgc

SEQ ID NO: 212445 - DNA, 26 bp, Artificial Sequence
  Description of Artificial Sequence: Synthetic oligonucleotide
caggaatccaggtaccagacggtgcg

SEQ ID NO: 212446 - DNA, 27 bp, Artificial Sequence
  Description of Artificial Sequence: Synthetic oligonucleotide
aggaatccaggtaccagacggtgcgca

SEQ ID NO: 212447 - DNA, 26 bp, Artificial Sequence
  Description of Artificial Sequence: Synthetic oligonucleotide
ggaatccaggtaccagacggtgcgca

SEQ ID NO: 212448 - DNA, 26 bp, Artificial Sequence
  Description of Artificial Sequence: Synthetic oligonucleotide
gaatccaggtaccagacggtgcgcag

SEQ ID NO: 212449 - DNA, 27 bp, Artificial Sequence
  Description of Artificial Sequence: Synthetic oligonucleotide
aatccaggtaccagacggtgcgcagca

SEQ ID NO: 212450 - DNA, 27 bp, Artificial Sequence
  Description of Artificial Sequence: Synthetic oligonucleotide
atccaggtaccagacggtgcgcagcat

SEQ ID NO: 212451 - DNA, 27 bp, Artificial Sequence
  Description of Artificial Sequence: Synthetic oligonucleotide
tccaggtaccagacggtgcgcagcata

SEQ ID NO: 212452 - DNA, 26 bp, Artificial Sequence
  Description of Artificial Sequence: Synthetic oligonucleotide
ccaggtaccagacggtgcgcagcata

SEQ ID NO: 212453 - DNA, 26 bp, Artificial Sequence
  Description of Artificial Sequence: Synthetic oligonucleotide
caggtaccagacggtgcgcagcatag

SEQ ID NO: 212454 - DNA, 26 bp, Artificial Sequence
  Description of Artificial Sequence: Synthetic oligonucleotide
aggtaccagacggtgcgcagcatagc

SEQ ID NO: 212455 - DNA, 25 bp, Artificial Sequence
  Description of Artificial Sequence: Synthetic oligonucleotide
ggtaccagacggtgcgcagcatagc

SEQ ID NO: 212456 - DNA, 25 bp, Artificial Sequence
  Description of Artificial Sequence: Synthetic oligonucleotide
gtaccagacggtgcgcagcatagcg

SEQ ID NO: 212457 - DNA, 25 bp, Artificial Sequence
  Description of Artificial Sequence: Synthetic oligonucleotide
taccagacggtgcgcagcatagcgg

SEQ ID NO: 212458 - DNA, 24 bp, Artificial Sequence
  Description of Artificial Sequence: Synthetic oligonucleotide
accagacggtgcgcagcatagcgg

SEQ ID NO: 212459 - DNA, 23 bp, Artificial Sequence
  Description of Artificial Sequence: Synthetic oligonucleotide
ccagacggtgcgcagcatagcgg

SEQ ID NO: 212460 - DNA, 25 bp, Artificial Sequence
  Description of Artificial Sequence: Synthetic oligonucleotide
cagacggtgcgcagcatagcggctt

SEQ ID NO: 212461 - DNA, 25 bp, Artificial Sequence
  Description of Artificial Sequence: Synthetic oligonucleotide
agacggtgcgcagcatagcggcttg

SEQ ID NO: 212462 - DNA, 24 bp, Artificial Sequence
  Description of Artificial Sequence: Synthetic oligonucleotide
gacggtgcgcagcatagcggcttg

SEQ ID NO: 212463 - DNA, 26 bp, Artificial Sequence
  Description of Artificial Sequence: Synthetic oligonucleotide
acggtgcgcagcatagcggcttggtt

SEQ ID NO: 212464 - DNA, 25 bp, Artificial Sequence
  Description of Artificial Sequence: Synthetic oligonucleotide
cggtgcgcagcatagcggcttggtt

SEQ ID NO: 212465 - DNA, 26 bp, Artificial Sequence
  Description of Artificial Sequence: Synthetic oligonucleotide
ggtgcgcagcatagcggcttggttca

SEQ ID NO: 212466 - DNA, 26 bp, Artificial Sequence
  Description of Artificial Sequence: Synthetic oligonucleotide
gtgcgcagcatagcggcttggttcac

SEQ ID NO: 212467 - DNA, 27 bp, Artificial Sequence
  Description of Artificial Sequence: Synthetic oligonucleotide
tgcgcagcatagcggcttggttcacct

SEQ ID NO: 212468 - DNA, 26 bp, Artificial Sequence
  Description of Artificial Sequence: Synthetic oligonucleotide
gcgcagcatagcggcttggttcacct

SEQ ID NO: 212469 - DNA, 27 bp, Artificial Sequence
  Description of Artificial Sequence: Synthetic oligonucleotide
cgcagcatagcggcttggttcacctga

SEQ ID NO: 212470 - DNA, 25 bp, Artificial Sequence
  Description of Artificial Sequence: Synthetic oligonucleotide
cggtgtccaactggaagccggactc

SEQ ID NO: 212471 - DNA, 25 bp, Artificial Sequence
  Description of Artificial Sequence: Synthetic oligonucleotide
ggtgtccaactggaagccggactcg

SEQ ID NO: 212472 - DNA, 25 bp, Artificial Sequence
  Description of Artificial Sequence: Synthetic oligonucleotide
gtgtccaactggaagccggactcgg

SEQ ID NO: 212473 - DNA, 25 bp, Artificial Sequence
  Description of Artificial Sequence: Synthetic oligonucleotide
tgtccaactggaagccggactcggc

SEQ ID NO: 212474 - DNA, 24 bp, Artificial Sequence
  Description of Artificial Sequence: Synthetic oligonucleotide
gtccaactggaagccggactcggc

SEQ ID NO: 212475 - DNA, 25 bp, Artificial Sequence
  Description of Artificial Sequence: Synthetic oligonucleotide
tccaactggaagccggactcggcca

SEQ ID NO: 212476 - DNA, 24 bp, Artificial Sequence
  Description of Artificial Sequence: Synthetic oligonucleotide
ccaactggaagccggactcggcca

SEQ ID NO: 212477 - DNA, 24 bp, Artificial Sequence
  Description of Artificial Sequence: Synthetic oligonucleotide
caactggaagccggactcggccag

SEQ ID NO: 212478 - DNA, 24 bp, Artificial Sequence
  Description of Artificial Sequence: Synthetic oligonucleotide
aactggaagccggactcggccagg

SEQ ID NO: 212479 - DNA, 23 bp, Artificial Sequence
  Description of Artificial Sequence: Synthetic oligonucleotide
actggaagccggactcggccagg

SEQ ID NO: 212480 - DNA, 22 bp, Artificial Sequence
  Description of Artificial Sequence: Synthetic oligonucleotide
ctggaagccggactcggccagg

SEQ ID NO: 212481 - DNA, 23 bp, Artificial Sequence
  Description of Artificial Sequence: Synthetic oligonucleotide
tggaagccggactcggccagggt

SEQ ID NO: 212482 - DNA, 22 bp, Artificial Sequence
  Description of Artificial Sequence: Synthetic oligonucleotide
ggaagccggactcggccagggt

SEQ ID NO: 212483 - DNA, 22 bp, Artificial Sequence
  Description of Artificial Sequence: Synthetic oligonucleotide
gaagccggactcggccagggtg

SEQ ID NO: 212484 - DNA, 22 bp, Artificial Sequence
  Description of Artificial Sequence: Synthetic oligonucleotide
aagccggactcggccagggtgc

SEQ ID NO: 212485 - DNA, 21 bp, Artificial Sequence
  Description of Artificial Sequence: Synthetic oligonucleotide
agccggactcggccagggtgc

SEQ ID NO: 212486 - DNA, 20 bp, Artificial Sequence
  Description of Artificial Sequence: Synthetic oligonucleotide
gccggactcggccagggtgc

SEQ ID NO: 212487 - DNA, 20 bp, Artificial Sequence
  Description of Artificial Sequence: Synthetic oligonucleotide
ccggactcggccagggtgcg

SEQ ID NO: 212488 - DNA, 22 bp, Artificial Sequence
  Description of Artificial Sequence: Synthetic oligonucleotide
cggactcggccagggtgcgcta

SEQ ID NO: 212489 - DNA, 24 bp, Artificial Sequence
  Description of Artificial Sequence: Synthetic oligonucleotide
ggactcggccagggtgcgctacta

SEQ ID NO: 212490 - DNA, 24 bp, Artificial Sequence
  Description of Artificial Sequence: Synthetic oligonucleotide
gactcggccagggtgcgctactac

SEQ ID NO: 212491 - DNA, 25 bp, Artificial Sequence
  Description of Artificial Sequence: Synthetic oligonucleotide
actcggccagggtgcgctactacca

SEQ ID NO: 212492 - DNA, 24 bp, Artificial Sequence
  Description of Artificial Sequence: Synthetic oligonucleotide
ctcggccagggtgcgctactacca

SEQ ID NO: 212493 - DNA, 25 bp, Artificial Sequence
  Description of Artificial Sequence: Synthetic oligonucleotide
tcggccagggtgcgctactaccaga

SEQ ID NO: 212494 - DNA, 24 bp, Artificial Sequence
  Description of Artificial Sequence: Synthetic oligonucleotide
cggccagggtgcgctactaccaga

SEQ ID NO: 212495 - DNA, 24 bp, Artificial Sequence
  Description of Artificial Sequence: Synthetic oligonucleotide
ggccagggtgcgctactaccagag

SEQ ID NO: 212496 - DNA, 26 bp, Artificial Sequence
  Description of Artificial Sequence: Synthetic oligonucleotide
cacccgacgccttcatccacgtggat

SEQ ID NO: 212497 - DNA, 27 bp, Artificial Sequence
  Description of Artificial Sequence: Synthetic oligonucleotide
acccgacgccttcatccacgtggatga

SEQ ID NO: 212498 - DNA, 26 bp, Artificial Sequence
  Description of Artificial Sequence: Synthetic oligonucleotide
cccgacgccttcatccacgtggatga

SEQ ID NO: 212499 - DNA, 27 bp, Artificial Sequence
  Description of Artificial Sequence: Synthetic oligonucleotide
ccgacgccttcatccacgtggatgact

SEQ ID NO: 212500 - DNA, 28 bp, Artificial Sequence
  Description of Artificial Sequence: Synthetic oligonucleotide
cgacgccttcatccacgtggatgacttc

SEQ ID NO: 212501 - DNA, 28 bp, Artificial Sequence
  Description of Artificial Sequence: Synthetic oligonucleotide
gacgccttcatccacgtggatgacttcc

SEQ ID NO: 212502 - DNA, 29 bp, Artificial Sequence
  Description of Artificial Sequence: Synthetic oligonucleotide
acgccttcatccacgtggatgacttccag

SEQ ID NO: 212503 - DNA, 28 bp, Artificial Sequence
  Description of Artificial Sequence: Synthetic oligonucleotide
cgccttcatccacgtggatgacttccag

SEQ ID NO: 212504 - DNA, 29 bp, Artificial Sequence
  Description of Artificial Sequence: Synthetic oligonucleotide
gccttcatccacgtggatgacttccagag

SEQ ID NO: 212505 - DNA, 29 bp, Artificial Sequence
  Description of Artificial Sequence: Synthetic oligonucleotide
ccttcatccacgtggatgacttccagagc

SEQ ID NO: 212506 - DNA, 29 bp, Artificial Sequence
  Description of Artificial Sequence: Synthetic oligonucleotide
cttcatccacgtggatgacttccagagcc

SEQ ID NO: 212507 - DNA, 29 bp, Artificial Sequence
  Description of Artificial Sequence: Synthetic oligonucleotide
ttcatccacgtggatgacttccagagccc

SEQ ID NO: 212508 - DNA, 28 bp, Artificial Sequence
  Description of Artificial Sequence: Synthetic oligonucleotide
tcatccacgtggatgacttccagagccc

SEQ ID NO: 212509 - DNA, 27 bp, Artificial Sequence
  Description of Artificial Sequence: Synthetic oligonucleotide
catccacgtggatgacttccagagccc

SEQ ID NO: 212510 - DNA, 27 bp, Artificial Sequence
  Description of Artificial Sequence: Synthetic oligonucleotide
atccacgtggatgacttccagagcccc

SEQ ID NO: 212511 - DNA, 27 bp, Artificial Sequence
  Description of Artificial Sequence: Synthetic oligonucleotide
tccacgtggatgacttccagagcccca

SEQ ID NO: 212512 - DNA, 27 bp, Artificial Sequence
  Description of Artificial Sequence: Synthetic oligonucleotide
ccacgtggatgacttccagagccccaa

SEQ ID NO: 212513 - DNA, 27 bp, Artificial Sequence
  Description of Artificial Sequence: Synthetic oligonucleotide
cacgtggatgacttccagagccccaag

SEQ ID NO: 212514 - DNA, 27 bp, Artificial Sequence
  Description of Artificial Sequence: Synthetic oligonucleotide
acgtggatgacttccagagccccaagg

SEQ ID NO: 212515 - DNA, 27 bp, Artificial Sequence
  Description of Artificial Sequence: Synthetic oligonucleotide
cgtggatgacttccagagccccaagga

SEQ ID NO: 212516 - DNA, 27 bp, Artificial Sequence
  Description of Artificial Sequence: Synthetic oligonucleotide
gtggatgacttccagagccccaaggac

SEQ ID NO: 212517 - DNA, 27 bp, Artificial Sequence
  Description of Artificial Sequence: Synthetic oligonucleotide
tggatgacttccagagccccaaggacc

SEQ ID NO: 212518 - DNA, 27 bp, Artificial Sequence
  Description of Artificial Sequence: Synthetic oligonucleotide
ggatgacttccagagccccaaggacct

SEQ ID NO: 212519 - DNA, 27 bp, Artificial Sequence
  Description of Artificial Sequence: Synthetic oligonucleotide
gatgacttccagagccccaaggacctg

SEQ ID NO: 212520 - DNA, 27 bp, Artificial Sequence
  Description of Artificial Sequence: Synthetic oligonucleotide
atgacttccagagccccaaggacctgg

SEQ ID NO: 212521 - DNA, 26 bp, Artificial Sequence
  Description of Artificial Sequence: Synthetic oligonucleotide
tgacttccagagccccaaggacctgg

SEQ ID NO: 212522 - DNA, 29 bp, Artificial Sequence
  Description of Artificial Sequence: Synthetic oligonucleotide
agacgctgtcccggtacaagttctacctc

SEQ ID NO: 212523 - DNA, 28 bp, Artificial Sequence
  Description of Artificial Sequence: Synthetic oligonucleotide
gacgctgtcccggtacaagttctacctc

SEQ ID NO: 212524 - DNA, 28 bp, Artificial Sequence
  Description of Artificial Sequence: Synthetic oligonucleotide
acgctgtcccggtacaagttctacctcg

SEQ ID NO: 212525 - DNA, 27 bp, Artificial Sequence
  Description of Artificial Sequence: Synthetic oligonucleotide
cgctgtcccggtacaagttctacctcg

SEQ ID NO: 212526 - DNA, 27 bp, Artificial Sequence
  Description of Artificial Sequence: Synthetic oligonucleotide
gctgtcccggtacaagttctacctcgc

SEQ ID NO: 212527 - DNA, 27 bp, Artificial Sequence
  Description of Artificial Sequence: Synthetic oligonucleotide
ctgtcccggtacaagttctacctcgcc

SEQ ID NO: 212528 - DNA, 29 bp, Artificial Sequence
  Description of Artificial Sequence: Synthetic oligonucleotide
tgtcccggtacaagttctacctcgccttc

SEQ ID NO: 212529 - DNA, 28 bp, Artificial Sequence
  Description of Artificial Sequence: Synthetic oligonucleotide
gtcccggtacaagttctacctcgccttc

SEQ ID NO: 212530 - DNA, 28 bp, Artificial Sequence
  Description of Artificial Sequence: Synthetic oligonucleotide
tcccggtacaagttctacctcgccttcg

SEQ ID NO: 212531 - DNA, 27 bp, Artificial Sequence
  Description of Artificial Sequence: Synthetic oligonucleotide
cccggtacaagttctacctcgccttcg

SEQ ID NO: 212532 - DNA, 28 bp, Artificial Sequence
  Description of Artificial Sequence: Synthetic oligonucleotide
ccggtacaagttctacctcgccttcgag

SEQ ID NO: 212533 - DNA, 30 bp, Artificial Sequence
  Description of Artificial Sequence: Synthetic oligonucleotide
cggtacaagttctacctcgccttcgagaac

SEQ ID NO: 212534 - DNA, 31 bp, Artificial Sequence
  Description of Artificial Sequence: Synthetic oligonucleotide
ggtacaagttctacctcgccttcgagaactc

SEQ ID NO: 212535 - DNA, 31 bp, Artificial Sequence
  Description of Artificial Sequence: Synthetic oligonucleotide
gtacaagttctacctcgccttcgagaactcc

SEQ ID NO: 212536 - DNA, 33 bp, Artificial Sequence
  Description of Artificial Sequence: Synthetic oligonucleotide
tacaagttctacctcgccttcgagaactccttg

SEQ ID NO: 212537 - DNA, 32 bp, Artificial Sequence
  Description of Artificial Sequence: Synthetic oligonucleotide
acaagttctacctcgccttcgagaactccttg

SEQ ID NO: 212538 - DNA, 31 bp, Artificial Sequence
  Description of Artificial Sequence: Synthetic oligonucleotide
caagttctacctcgccttcgagaactccttg

SEQ ID NO: 212539 - DNA, 31 bp, Artificial Sequence
  Description of Artificial Sequence: Synthetic oligonucleotide
aagttctacctcgccttcgagaactccttgc

SEQ ID NO: 212540 - DNA, 30 bp, Artificial Sequence
  Description of Artificial Sequence: Synthetic oligonucleotide
agttctacctcgccttcgagaactccttgc

SEQ ID NO: 212541 - DNA, 29 bp, Artificial Sequence
  Description of Artificial Sequence: Synthetic oligonucleotide
gttctacctcgccttcgagaactccttgc

SEQ ID NO: 212542 - DNA, 30 bp, Artificial Sequence
  Description of Artificial Sequence: Synthetic oligonucleotide
ttctacctcgccttcgagaactccttgcac

SEQ ID NO: 212543 - DNA, 29 bp, Artificial Sequence
  Description of Artificial Sequence: Synthetic oligonucleotide
tctacctcgccttcgagaactccttgcac

SEQ ID NO: 212544 - DNA, 28 bp, Artificial Sequence
  Description of Artificial Sequence: Synthetic oligonucleotide
ctacctcgccttcgagaactccttgcac

SEQ ID NO: 212545 - DNA, 28 bp, Artificial Sequence
  Description of Artificial Sequence: Synthetic oligonucleotide
tacctcgccttcgagaactccttgcacc

SEQ ID NO: 212546 - DNA, 27 bp, Artificial Sequence
  Description of Artificial Sequence: Synthetic oligonucleotide
acctcgccttcgagaactccttgcacc

SEQ ID NO: 212547 - DNA, 26 bp, Artificial Sequence
  Description of Artificial Sequence: Synthetic oligonucleotide
cctcgccttcgagaactccttgcacc

SEQ ID NO: 212548 - DNA, 26 bp, Artificial Sequence
  Description of Artificial Sequence: Synthetic oligonucleotide
ctcgccttcgagaactccttgcaccc

SEQ ID NO: 212549 - DNA, 26 bp, Artificial Sequence
  Description of Artificial Sequence: Synthetic oligonucleotide
tcgccttcgagaactccttgcacccc

SEQ ID NO: 212550 - DNA, 25 bp, Artificial Sequence
  Description of Artificial Sequence: Synthetic oligonucleotide
cgccttcgagaactccttgcacccc

SEQ ID NO: 212551 - DNA, 27 bp, Artificial Sequence
  Description of Artificial Sequence: Synthetic oligonucleotide
tggccttcgagaactccttgcacccca

SEQ ID NO: 212552 - DNA, 27 bp, Artificial Sequence
  Description of Artificial Sequence: Synthetic oligonucleotide
ggccttcgagaactccttgcaccccaa

SEQ ID NO: 212553 - DNA, 27 bp, Artificial Sequence
  Description of Artificial Sequence: Synthetic oligonucleotide
gccttcgagaactccttgcaccccaac

SEQ ID NO: 212554 - DNA, 29 bp, Artificial Sequence
  Description of Artificial Sequence: Synthetic oligonucleotide
ccttcgagaactccttgcaccccaactac

SEQ ID NO: 212555 - DNA, 31 bp, Artificial Sequence
  Description of Artificial Sequence: Synthetic oligonucleotide
cttcgagaactccttgcaccccaactacatc

SEQ ID NO: 212556 - DNA, 32 bp, Artificial Sequence
  Description of Artificial Sequence: Synthetic oligonucleotide
ttcgagaactccttgcaccccaactacatcac

SEQ ID NO: 212557 - DNA, 31 bp, Artificial Sequence
  Description of Artificial Sequence: Synthetic oligonucleotide
tcgagaactccttgcaccccaactacatcac

SEQ ID NO: 212558 - DNA, 30 bp, Artificial Sequence
  Description of Artificial Sequence: Synthetic oligonucleotide
cgagaactccttgcaccccaactacatcac

SEQ ID NO: 212559 - DNA, 30 bp, Artificial Sequence
  Description of Artificial Sequence: Synthetic oligonucleotide
gagaactccttgcaccccaactacatcacc

SEQ ID NO: 212560 - DNA, 30 bp, Artificial Sequence
  Description of Artificial Sequence: Synthetic oligonucleotide
agaactccttgcaccccaactacatcaccg

SEQ ID NO: 212561 - DNA, 29 bp, Artificial Sequence
  Description of Artificial Sequence: Synthetic oligonucleotide
gaactccttgcaccccaactacatcaccg

SEQ ID NO: 212562 - DNA, 30 bp, Artificial Sequence
  Description of Artificial Sequence: Synthetic oligonucleotide
aactccttgcaccccaactacatcaccgag

SEQ ID NO: 212563 - DNA, 29 bp, Artificial Sequence
  Description of Artificial Sequence: Synthetic oligonucleotide
actccttgcaccccaactacatcaccgag

SEQ ID NO: 212564 - DNA, 28 bp, Artificial Sequence
  Description of Artificial Sequence: Synthetic oligonucleotide
ctccttgcaccccaactacatcaccgag

SEQ ID NO: 212565 - DNA, 30 bp, Artificial Sequence
  Description of Artificial Sequence: Synthetic oligonucleotide
tccttgcaccccaactacatcaccgagaag

SEQ ID NO: 212566 - DNA, 29 bp, Artificial Sequence
  Description of Artificial Sequence: Synthetic oligonucleotide
ccttgcaccccaactacatcaccgagaag

SEQ ID NO: 212567 - DNA, 29 bp, Artificial Sequence
  Description of Artificial Sequence: Synthetic oligonucleotide
cttgcaccccaactacatcaccgagaagc

SEQ ID NO: 212568 - DNA, 30 bp, Artificial Sequence
  Description of Artificial Sequence: Synthetic oligonucleotide
ttgcaccccaactacatcaccgagaagctg

SEQ ID NO: 212569 - DNA, 29 bp, Artificial Sequence
  Description of Artificial Sequence: Synthetic oligonucleotide
tgcaccccaactacatcaccgagaagctg

SEQ ID NO: 212570 - DNA, 28 bp, Artificial Sequence
  Description of Artificial Sequence: Synthetic oligonucleotide
gcaccccaactacatcaccgagaagctg

SEQ ID NO: 212571 - DNA, 29 bp, Artificial Sequence
  Description of Artificial Sequence: Synthetic oligonucleotide
caccccaactacatcaccgagaagctgtg

SEQ ID NO: 212572 - DNA, 29 bp, Artificial Sequence
  Description of Artificial Sequence: Synthetic oligonucleotide
accccaactacatcaccgagaagctgtgg

SEQ ID NO: 212573 - DNA, 28 bp, Artificial Sequence
  Description of Artificial Sequence: Synthetic oligonucleotide
ccccaactacatcaccgagaagctgtgg

SEQ ID NO: 212574 - DNA, 29 bp, Artificial Sequence
  Description of Artificial Sequence: Synthetic oligonucleotide
cccaactacatcaccgagaagctgtggag

SEQ ID NO: 212575 - DNA, 29 bp, Artificial Sequence
  Description of Artificial Sequence: Synthetic oligonucleotide
ccaactacatcaccgagaagctgtggagg

SEQ ID NO: 212576 - DNA, 31 bp, Artificial Sequence
  Description of Artificial Sequence: Synthetic oligonucleotide
caactacatcaccgagaagctgtggaggaac

SEQ ID NO: 212577 - DNA, 31 bp, Artificial Sequence
  Description of Artificial Sequence: Synthetic oligonucleotide
aactacatcaccgagaagctgtggaggaacg

SEQ ID NO: 212578 - DNA, 20 bp, Artificial Sequence
  Description of Artificial Sequence: Synthetic oligonucleotide
gcgccgctgtctggccgcac

SEQ ID NO: 212579 - DNA, 20 bp, Artificial Sequence
  Description of Artificial Sequence: Synthetic oligonucleotide
cgccgctgtctggccgcacg

SEQ ID NO: 212580 - DNA, 20 bp, Artificial Sequence
  Description of Artificial Sequence: Synthetic oligonucleotide
gccgctgtctggccgcacgg

SEQ ID NO: 212581 - DNA, 25 bp, Artificial Sequence
  Description of Artificial Sequence: Synthetic oligonucleotide
ccgctgtctggccgcacggctattt

SEQ ID NO: 212582 - DNA, 26 bp, Artificial Sequence
  Description of Artificial Sequence: Synthetic oligonucleotide
cgctgtctggccgcacggctatttca

SEQ ID NO: 212583 - DNA, 26 bp, Artificial Sequence
  Description of Artificial Sequence: Synthetic oligonucleotide
gctgtctggccgcacggctatttcag

SEQ ID NO: 212584 - DNA, 27 bp, Artificial Sequence
  Description of Artificial Sequence: Synthetic oligonucleotide
ctgtctggccgcacggctatttcagct

SEQ ID NO: 212585 - DNA, 27 bp, Artificial Sequence
  Description of Artificial Sequence: Synthetic oligonucleotide
tgtctggccgcacggctatttcagctg

SEQ ID NO: 212586 - DNA, 26 bp, Artificial Sequence
  Description of Artificial Sequence: Synthetic oligonucleotide
gtctggccgcacggctatttcagctg

SEQ ID NO: 212587 - DNA, 27 bp, Artificial Sequence
  Description of Artificial Sequence: Synthetic oligonucleotide
tctggccgcacggctatttcagctgct

SEQ ID NO: 212588 - DNA, 26 bp, Artificial Sequence
  Description of Artificial Sequence: Synthetic oligonucleotide
ctggccgcacggctatttcagctgct

SEQ ID NO: 212589 - DNA, 26 bp, Artificial Sequence
  Description of Artificial Sequence: Synthetic oligonucleotide
tggccgcacggctatttcagctgctg

SEQ ID NO: 212590 - DNA, 25 bp, Artificial Sequence
  Description of Artificial Sequence: Synthetic oligonucleotide
ggccgcacggctatttcagctgctg

SEQ ID NO: 212591 - DNA, 26 bp, Artificial Sequence
  Description of Artificial Sequence: Synthetic oligonucleotide
gccgcacggctatttcagctgctggt

SEQ ID NO: 212592 - DNA, 26 bp, Artificial Sequence
  Description of Artificial Sequence: Synthetic oligonucleotide
ccgcacggctatttcagctgctggtg

SEQ ID NO: 212593 - DNA, 26 bp, Artificial Sequence
  Description of Artificial Sequence: Synthetic oligonucleotide
cgcacggctatttcagctgctggtgg

SEQ ID NO: 212594 - DNA, 27 bp, Artificial Sequence
  Description of Artificial Sequence: Synthetic oligonucleotide
gcacggctatttcagctgctggtggct

SEQ ID NO: 212595 - DNA, 27 bp, Artificial Sequence
  Description of Artificial Sequence: Synthetic oligonucleotide
cacggctatttcagctgctggtggctg

SEQ ID NO: 212596 - DNA, 28 bp, Artificial Sequence
  Description of Artificial Sequence: Synthetic oligonucleotide
acggctatttcagctgctggtggctgtg

SEQ ID NO: 212597 - DNA, 27 bp, Artificial Sequence
  Description of Artificial Sequence: Synthetic oligonucleotide
cggctatttcagctgctggtggctgtg

SEQ ID NO: 212598 - DNA, 28 bp, Artificial Sequence
  Description of Artificial Sequence: Synthetic oligonucleotide
ggctatttcagctgctggtggctgtgtg

SEQ ID NO: 212599 - DNA, 24 bp, Artificial Sequence
  Description of Artificial Sequence: Synthetic oligonucleotide
ccacaatggccatggcgccgctct

SEQ ID NO: 212600 - DNA, 25 bp, Artificial Sequence
  Description of Artificial Sequence: Synthetic oligonucleotide
cacaatggccatggcgccgctctct

SEQ ID NO: 212601 - DNA, 25 bp, Artificial Sequence
  Description of Artificial Sequence: Synthetic oligonucleotide
acaatggccatggcgccgctctctg

SEQ ID NO: 212602 - DNA, 24 bp, Artificial Sequence
  Description of Artificial Sequence: Synthetic oligonucleotide
caatggccatggcgccgctctctg

SEQ ID NO: 212603 - DNA, 24 bp, Artificial Sequence
  Description of Artificial Sequence: Synthetic oligonucleotide
aatggccatggcgccgctctctgg

SEQ ID NO: 212604 - DNA, 23 bp, Artificial Sequence
  Description of Artificial Sequence: Synthetic oligonucleotide
atggccatggcgccgctctctgg

SEQ ID NO: 212605 - DNA, 22 bp, Artificial Sequence
  Description of Artificial Sequence: Synthetic oligonucleotide
tggccatggcgccgctctctgg

SEQ ID NO: 212606 - DNA, 21 bp, Artificial Sequence
  Description of Artificial Sequence: Synthetic oligonucleotide
ggccatggcgccgctctctgg

SEQ ID NO: 212607 - DNA, 21 bp, Artificial Sequence
  Description of Artificial Sequence: Synthetic oligonucleotide
gccatggcgccgctctctggc

SEQ ID NO: 212608 - DNA, 21 bp, Artificial Sequence
  Description of Artificial Sequence: Synthetic oligonucleotide
ccatggcgccgctctctggcc

SEQ ID NO: 212609 - DNA, 21 bp, Artificial Sequence
  Description of Artificial Sequence: Synthetic oligonucleotide
catggcgccgctctctggccg

SEQ ID NO: 212610 - DNA, 22 bp, Artificial Sequence
  Description of Artificial Sequence: Synthetic oligonucleotide
atggcgccgctctctggccgca

SEQ ID NO: 212611 - DNA, 21 bp, Artificial Sequence
  Description of Artificial Sequence: Synthetic oligonucleotide
tggcgccgctctctggccgca

SEQ ID NO: 212612 - DNA, 20 bp, Artificial Sequence
  Description of Artificial Sequence: Synthetic oligonucleotide
ggcgccgctctctggccgca

SEQ ID NO: 212613 - DNA, 21 bp, Artificial Sequence
  Description of Artificial Sequence: Synthetic oligonucleotide
gcgccgctctctggccgcact

SEQ ID NO: 212614 - DNA, 21 bp, Artificial Sequence
  Description of Artificial Sequence: Synthetic oligonucleotide
cgccgctctctggccgcactg

SEQ ID NO: 212615 - DNA, 26 bp, Artificial Sequence
  Description of Artificial Sequence: Synthetic oligonucleotide
gccgctctctggccgcactgctattt

SEQ ID NO: 212616 - DNA, 27 bp, Artificial Sequence
  Description of Artificial Sequence: Synthetic oligonucleotide
ccgctctctggccgcactgctatttca

SEQ ID NO: 212617 - DNA, 27 bp, Artificial Sequence
  Description of Artificial Sequence: Synthetic oligonucleotide
cgctctctggccgcactgctatttcag

SEQ ID NO: 212618 - DNA, 27 bp, Artificial Sequence
  Description of Artificial Sequence: Synthetic oligonucleotide
gctctctggccgcactgctatttcagc

SEQ ID NO: 212619 - DNA, 28 bp, Artificial Sequence
  Description of Artificial Sequence: Synthetic oligonucleotide
ctctctggccgcactgctatttcagctg

SEQ ID NO: 212620 - DNA, 28 bp, Artificial Sequence
  Description of Artificial Sequence: Synthetic oligonucleotide
tctctggccgcactgctatttcagctgc

SEQ ID NO: 212621 - DNA, 27 bp, Artificial Sequence
  Description of Artificial Sequence: Synthetic oligonucleotide
ctctggccgcactgctatttcagctgc

SEQ ID NO: 212622 - DNA, 27 bp, Artificial Sequence
  Description of Artificial Sequence: Synthetic oligonucleotide
gcgactccgacatcttcacgccctaca

SEQ ID NO: 212623 - DNA, 27 bp, Artificial Sequence
  Description of Artificial Sequence: Synthetic oligonucleotide
cgactccgacatcttcacgccctacag

SEQ ID NO: 212624 - DNA, 27 bp, Artificial Sequence
  Description of Artificial Sequence: Synthetic oligonucleotide
gactccgacatcttcacgccctacagc

SEQ ID NO: 212625 - DNA, 28 bp, Artificial Sequence
  Description of Artificial Sequence: Synthetic oligonucleotide
actccgacatcttcacgccctacagctg

SEQ ID NO: 212626 - DNA, 27 bp, Artificial Sequence
  Description of Artificial Sequence: Synthetic oligonucleotide
ctccgacatcttcacgccctacagctg

SEQ ID NO: 212627 - DNA, 27 bp, Artificial Sequence
  Description of Artificial Sequence: Synthetic oligonucleotide
tccgacatcttcacgccctacagctgg

SEQ ID NO: 212628 - DNA, 26 bp, Artificial Sequence
  Description of Artificial Sequence: Synthetic oligonucleotide
ccgacatcttcacgccctacagctgg

SEQ ID NO: 212629 - DNA, 27 bp, Artificial Sequence
  Description of Artificial Sequence: Synthetic oligonucleotide
cgacatcttcacgccctacagctggct

SEQ ID NO: 212630 - DNA, 27 bp, Artificial Sequence
  Description of Artificial Sequence: Synthetic oligonucleotide
gacatcttcacgccctacagctggctg

SEQ ID NO: 212631 - DNA, 27 bp, Artificial Sequence
  Description of Artificial Sequence: Synthetic oligonucleotide
acatcttcacgccctacagctggctgg

SEQ ID NO: 212632 - DNA, 27 bp, Artificial Sequence
  Description of Artificial Sequence: Synthetic oligonucleotide
catcttcacgccctacagctggctgga

SEQ ID NO: 212633 - DNA, 27 bp, Artificial Sequence
  Description of Artificial Sequence: Synthetic oligonucleotide
atcttcacgccctacagctggctggag

SEQ ID NO: 212634 - DNA, 26 bp, Artificial Sequence
  Description of Artificial Sequence: Synthetic oligonucleotide
tcttcacgccctacagctggctggag

SEQ ID NO: 212635 - DNA, 25 bp, Artificial Sequence
  Description of Artificial Sequence: Synthetic oligonucleotide
cttcacgccctacagctggctggag

SEQ ID NO: 212636 - DNA, 25 bp, Artificial Sequence
  Description of Artificial Sequence: Synthetic oligonucleotide
ttcacgccctacagctggctggagc

SEQ ID NO: 212637 - DNA, 24 bp, Artificial Sequence
  Description of Artificial Sequence: Synthetic oligonucleotide
tcacgccctacagctggctggagc

SEQ ID NO: 212638 - DNA, 23 bp, Artificial Sequence
  Description of Artificial Sequence: Synthetic oligonucleotide
cacgccctacagctggctggagc

SEQ ID NO: 212639 - DNA, 23 bp, Artificial Sequence
  Description of Artificial Sequence: Synthetic oligonucleotide
acgccctacagctggctggagcc

SEQ ID NO: 212640 - DNA, 22 bp, Artificial Sequence
  Description of Artificial Sequence: Synthetic oligonucleotide
cgccctacagctggctggagcc

SEQ ID NO: 212641 - DNA, 23 bp, Artificial Sequence
  Description of Artificial Sequence: Synthetic oligonucleotide
gccctacagctggctggagccgt

SEQ ID NO: 212642 - DNA, 23 bp, Artificial Sequence
  Description of Artificial Sequence: Synthetic oligonucleotide
ccctacagctggctggagccgtg

SEQ ID NO: 212643 - DNA, 24 bp, Artificial Sequence
  Description of Artificial Sequence: Synthetic oligonucleotide
cctacagctggctggagccgtggt

SEQ ID NO: 212644 - DNA, 24 bp, Artificial Sequence
  Description of Artificial Sequence: Synthetic oligonucleotide
ctacagctggctggagccgtggtc

SEQ ID NO: 212645 - DNA, 24 bp, Artificial Sequence
  Description of Artificial Sequence: Synthetic oligonucleotide
tacagctggctggagccgtggtcc

SEQ ID NO: 212646 - DNA, 23 bp, Artificial Sequence
  Description of Artificial Sequence: Synthetic oligonucleotide
acagctggctggagccgtggtcc

SEQ ID NO: 212647 - DNA, 22 bp, Artificial Sequence
  Description of Artificial Sequence: Synthetic oligonucleotide
cagctggctggagccgtggtcc

SEQ ID NO: 212648 - DNA, 22 bp, Artificial Sequence
  Description of Artificial Sequence: Synthetic oligonucleotide
agctggctggagccgtggtccg

SEQ ID NO: 212649 - DNA, 26 bp, Artificial Sequence
  Description of Artificial Sequence: Synthetic oligonucleotide
ccaaccctaagtcacgcctcccacct

SEQ ID NO: 212650 - DNA, 26 bp, Artificial Sequence
  Description of Artificial Sequence: Synthetic oligonucleotide
caaccctaagtcacgcctcccacctg

SEQ ID NO: 212651 - DNA, 26 bp, Artificial Sequence
  Description of Artificial Sequence: Synthetic oligonucleotide
aaccctaagtcacgcctcccacctgc

SEQ ID NO: 212652 - DNA, 25 bp, Artificial Sequence
  Description of Artificial Sequence: Synthetic oligonucleotide
accctaagtcacgcctcccacctgc

SEQ ID NO: 212653 - DNA, 24 bp, Artificial Sequence
  Description of Artificial Sequence: Synthetic oligonucleotide
ccctaagtcacgcctcccacctgc

SEQ ID NO: 212654 - DNA, 24 bp, Artificial Sequence
  Description of Artificial Sequence: Synthetic oligonucleotide
cctaagtcacgcctcccacctgcc

SEQ ID NO: 212655 - DNA, 24 bp, Artificial Sequence
  Description of Artificial Sequence: Synthetic oligonucleotide
ctaagtcacgcctcccacctgccc

SEQ ID NO: 212656 - DNA, 24 bp, Artificial Sequence
  Description of Artificial Sequence: Synthetic oligonucleotide
taagtcacgcctcccacctgcccc

SEQ ID NO: 212657 - DNA, 23 bp, Artificial Sequence
  Description of Artificial Sequence: Synthetic oligonucleotide
aagtcacgcctcccacctgcccc

SEQ ID NO: 212658 - DNA, 22 bp, Artificial Sequence
  Description of Artificial Sequence: Synthetic oligonucleotide
agtcacgcctcccacctgcccc

SEQ ID NO: 212659 - DNA, 21 bp, Artificial Sequence
  Description of Artificial Sequence: Synthetic oligonucleotide
gtcacgcctcccacctgcccc

SEQ ID NO: 212660 - DNA, 22 bp, Artificial Sequence
  Description of Artificial Sequence: Synthetic oligonucleotide
tcacgcctcccacctgccccga

SEQ ID NO: 212661 - DNA, 21 bp, Artificial Sequence
  Description of Artificial Sequence: Synthetic oligonucleotide
cacgcctcccacctgccccga

SEQ ID NO: 212662 - DNA, 21 bp, Artificial Sequence
  Description of Artificial Sequence: Synthetic oligonucleotide
acgcctcccacctgccccgag

SEQ ID NO: 212663 - DNA, 20 bp, Artificial Sequence
  Description of Artificial Sequence: Synthetic oligonucleotide
cgcctcccacctgccccgag

SEQ ID NO: 212664 - DNA, 20 bp, Artificial Sequence
  Description of Artificial Sequence: Synthetic oligonucleotide
gcctcccacctgccccgagg

SEQ ID NO: 212665 - DNA, 20 bp, Artificial Sequence
  Description of Artificial Sequence: Synthetic oligonucleotide
cctcccacctgccccgaggc

SEQ ID NO: 212666 - DNA, 20 bp, Artificial Sequence
  Description of Artificial Sequence: Synthetic oligonucleotide
ctcccacctgccccgaggcc

SEQ ID NO: 212667 - DNA, 20 bp, Artificial Sequence
  Description of Artificial Sequence: Synthetic oligonucleotide
tcccacctgccccgaggccg

SEQ ID NO: 212668 - DNA, 20 bp, Artificial Sequence
  Description of Artificial Sequence: Synthetic oligonucleotide
cccacctgccccgaggccgt

SEQ ID NO: 212669 - DNA, 20 bp, Artificial Sequence
  Description of Artificial Sequence: Synthetic oligonucleotide
ccacctgccccgaggccgca

SEQ ID NO: 212670 - DNA, 20 bp, Artificial Sequence
  Description of Artificial Sequence: Synthetic oligonucleotide
cacctgccccgaggccgcag

SEQ ID NO: 212671 - DNA, 20 bp, Artificial Sequence
  Description of Artificial Sequence: Synthetic oligonucleotide
acctgccccgaggccgcagg

SEQ ID NO: 212672 - DNA, 20 bp, Artificial Sequence
  Description of Artificial Sequence: Synthetic oligonucleotide
cctgccccgaggccgcaggt

SEQ ID NO: 212673 - DNA, 20 bp, Artificial Sequence
  Description of Artificial Sequence: Synthetic oligonucleotide
ctgccccgaggccgcagggt

SEQ ID NO: 212674 - DNA, 20 bp, Artificial Sequence
  Description of Artificial Sequence: Synthetic oligonucleotide
tgccccgaggccgcaggggt

SEQ ID NO: 212675 - DNA, 20 bp, Artificial Sequence
  Description of Artificial Sequence: Synthetic oligonucleotide
gccccgaggccgcaggggtt

SEQ ID NO: 212676 - DNA, 27 bp, Artificial Sequence
  Description of Artificial Sequence: Synthetic oligonucleotide
tcactgccgaccgcaaggtgtacccaa

SEQ ID NO: 212677 - DNA, 27 bp, Artificial Sequence
  Description of Artificial Sequence: Synthetic oligonucleotide
cactgccgaccgcaaggtgtacccaaa

SEQ ID NO: 212678 - DNA, 27 bp, Artificial Sequence
  Description of Artificial Sequence: Synthetic oligonucleotide
actgccgaccgcaaggtgtacccaaag

SEQ ID NO: 212679 - DNA, 26 bp, Artificial Sequence
  Description of Artificial Sequence: Synthetic oligonucleotide
ctgccgaccgcaaggtgtacccaaag

SEQ ID NO: 212680 - DNA, 26 bp, Artificial Sequence
  Description of Artificial Sequence: Synthetic oligonucleotide
tgccgaccgcaaggtgtacccaaagg

SEQ ID NO: 212681 - DNA, 25 bp, Artificial Sequence
  Description of Artificial Sequence: Synthetic oligonucleotide
gccgaccgcaaggtgtacccaaagg

SEQ ID NO: 212682 - DNA, 26 bp, Artificial Sequence
  Description of Artificial Sequence: Synthetic oligonucleotide
ccgaccgcaaggtgtacccaaaggca

SEQ ID NO: 212683 - DNA, 27 bp, Artificial Sequence
  Description of Artificial Sequence: Synthetic oligonucleotide
cgaccgcaaggtgtacccaaaggcaga

SEQ ID NO: 212684 - DNA, 27 bp, Artificial Sequence
  Description of Artificial Sequence: Synthetic oligonucleotide
gaccgcaaggtgtacccaaaggcagac

SEQ ID NO: 212685 - DNA, 28 bp, Artificial Sequence
  Description of Artificial Sequence: Synthetic oligonucleotide
accgcaaggtgtacccaaaggcagacac

SEQ ID NO: 212686 - DNA, 27 bp, Artificial Sequence
  Description of Artificial Sequence: Synthetic oligonucleotide
ccgcaaggtgtacccaaaggcagacac

SEQ ID NO: 212687 - DNA, 27 bp, Artificial Sequence
  Description of Artificial Sequence: Synthetic oligonucleotide
cgcaaggtgtacccaaaggcagacacg

SEQ ID NO: 212688 - DNA, 27 bp, Artificial Sequence
  Description of Artificial Sequence: Synthetic oligonucleotide
gcaaggtgtacccaaaggcagacacgg

SEQ ID NO: 212689 - DNA, 28 bp, Artificial Sequence
  Description of Artificial Sequence: Synthetic oligonucleotide
caaggtgtacccaaaggcagacacggtc

SEQ ID NO: 212690 - DNA, 30 bp, Artificial Sequence
  Description of Artificial Sequence: Synthetic oligonucleotide
aaggtgtacccaaaggcagacacggtcatc

SEQ ID NO: 212691 - DNA, 29 bp, Artificial Sequence
  Description of Artificial Sequence: Synthetic oligonucleotide
aggtgtacccaaaggcagacacggtcatc

SEQ ID NO: 212692 - DNA, 28 bp, Artificial Sequence
  Description of Artificial Sequence: Synthetic oligonucleotide
ggtgtacccaaaggcagacacggtcatc

SEQ ID NO: 212693 - DNA, 28 bp, Artificial Sequence
  Description of Artificial Sequence: Synthetic oligonucleotide
gtgtacccaaaggcagacacggtcatcg

SEQ ID NO: 212694 - DNA, 29 bp, Artificial Sequence
  Description of Artificial Sequence: Synthetic oligonucleotide
tgtacccaaaggcagacacggtcatcgtg

SEQ ID NO: 212695 - DNA, 28 bp, Artificial Sequence
  Description of Artificial Sequence: Synthetic oligonucleotide
gtacccaaaggcagacacggtcatcgtg

SEQ ID NO: 212696 - DNA, 28 bp, Artificial Sequence
  Description of Artificial Sequence: Synthetic oligonucleotide
tacccaaaggcagacacggtcatcgtgc

SEQ ID NO: 212697 - DNA, 27 bp, Artificial Sequence
  Description of Artificial Sequence: Synthetic oligonucleotide
acccaaaggcagacacggtcatcgtgc

SEQ ID NO: 212698 - DNA, 27 bp, Artificial Sequence
  Description of Artificial Sequence: Synthetic oligonucleotide
cccaaaggcagacacggtcatcgtgca

SEQ ID NO: 212699 - DNA, 27 bp, Artificial Sequence
  Description of Artificial Sequence: Synthetic oligonucleotide
ccaaaggcagacacggtcatcgtgcac

SEQ ID NO: 212700 - DNA, 27 bp, Artificial Sequence
  Description of Artificial Sequence: Synthetic oligonucleotide
caaaggcagacacggtcatcgtgcacc

SEQ ID NO: 212701 - DNA, 28 bp, Artificial Sequence
  Description of Artificial Sequence: Synthetic oligonucleotide
aaaggcagacacggtcatcgtgcaccac

SEQ ID NO: 212702 - DNA, 27 bp, Artificial Sequence
  Description of Artificial Sequence: Synthetic oligonucleotide
aaggcagacacggtcatcgtgcaccac

SEQ ID NO: 212703 - DNA, 24 bp, Artificial Sequence
  Description of Artificial Sequence: Synthetic oligonucleotide
cgccccaccctcctgatcctgcta

SEQ ID NO: 212704 - DNA, 24 bp, Artificial Sequence
  Description of Artificial Sequence: Synthetic oligonucleotide
gccccaccctcctgatcctgctac

SEQ ID NO: 212705 - DNA, 24 bp, Artificial Sequence
  Description of Artificial Sequence: Synthetic oligonucleotide
ccccaccctcctgatcctgctacg

SEQ ID NO: 212706 - DNA, 25 bp, Artificial Sequence
  Description of Artificial Sequence: Synthetic oligonucleotide
cccaccctcctgatcctgctacgga

SEQ ID NO: 212707 - DNA, 27 bp, Artificial Sequence
  Description of Artificial Sequence: Synthetic oligonucleotide
ccaccctcctgatcctgctacggacat

SEQ ID NO: 212708 - DNA, 27 bp, Artificial Sequence
  Description of Artificial Sequence: Synthetic oligonucleotide
caccctcctgatcctgctacggacatg

SEQ ID NO: 212709 - DNA, 27 bp, Artificial Sequence
  Description of Artificial Sequence: Synthetic oligonucleotide
accctcctgatcctgctacggacatgg

SEQ ID NO: 212710 - DNA, 26 bp, Artificial Sequence
  Description of Artificial Sequence: Synthetic oligonucleotide
ccctcctgatcctgctacggacatgg

SEQ ID NO: 212711 - DNA, 26 bp, Artificial Sequence
  Description of Artificial Sequence: Synthetic oligonucleotide
cctcctgatcctgctacggacatggc

SEQ ID NO: 212712 - DNA, 27 bp, Artificial Sequence
  Description of Artificial Sequence: Synthetic oligonucleotide
ctcctgatcctgctacggacatggcct

SEQ ID NO: 212713 - DNA, 29 bp, Artificial Sequence
  Description of Artificial Sequence: Synthetic oligonucleotide
tcctgatcctgctacggacatggcctttc

SEQ ID NO: 212714 - DNA, 28 bp, Artificial Sequence
  Description of Artificial Sequence: Synthetic oligonucleotide
cctgatcctgctacggacatggcctttc

SEQ ID NO: 212715 - DNA, 28 bp, Artificial Sequence
  Description of Artificial Sequence: Synthetic oligonucleotide
ctgatcctgctacggacatggcctttcc

SEQ ID NO: 212716 - DNA, 29 bp, Artificial Sequence
  Description of Artificial Sequence: Synthetic oligonucleotide
tgatcctgctacggacatggcctttccac

SEQ ID NO: 212717 - DNA, 28 bp, Artificial Sequence
  Description of Artificial Sequence: Synthetic oligonucleotide
gatcctgctacggacatggcctttccac

SEQ ID NO: 212718 - DNA, 30 bp, Artificial Sequence
  Description of Artificial Sequence: Synthetic oligonucleotide
atcctgctacggacatggcctttccacatc

SEQ ID NO: 212719 - DNA, 29 bp, Artificial Sequence
  Description of Artificial Sequence: Synthetic oligonucleotide
tcctgctacggacatggcctttccacatc

SEQ ID NO: 212720 - DNA, 28 bp, Artificial Sequence
  Description of Artificial Sequence: Synthetic oligonucleotide
cctgctacggacatggcctttccacatc

SEQ ID NO: 212721 - DNA, 28 bp, Artificial Sequence
  Description of Artificial Sequence: Synthetic oligonucleotide
ctgctacggacatggcctttccacatcc

SEQ ID NO: 212722 - DNA, 28 bp, Artificial Sequence
  Description of Artificial Sequence: Synthetic oligonucleotide
tgctacggacatggcctttccacatccc

SEQ ID NO: 212723 - DNA, 27 bp, Artificial Sequence
  Description of Artificial Sequence: Synthetic oligonucleotide
gctacggacatggcctttccacatccc

SEQ ID NO: 212724 - DNA, 28 bp, Artificial Sequence
  Description of Artificial Sequence: Synthetic oligonucleotide
ctacggacatggcctttccacatccctg

SEQ ID NO: 212725 - DNA, 29 bp, Artificial Sequence
  Description of Artificial Sequence: Synthetic oligonucleotide
tacggacatggcctttccacatccctgtg

SEQ ID NO: 212726 - DNA, 28 bp, Artificial Sequence
  Description of Artificial Sequence: Synthetic oligonucleotide
acggacatggcctttccacatccctgtg

SEQ ID NO: 212727 - DNA, 27 bp, Artificial Sequence
  Description of Artificial Sequence: Synthetic oligonucleotide
cggacatggcctttccacatccctgtg

SEQ ID NO: 212728 - DNA, 27 bp, Artificial Sequence
  Description of Artificial Sequence: Synthetic oligonucleotide
ccgcaaggtgtacccacaggcagacat

SEQ ID NO: 212729 - DNA, 27 bp, Artificial Sequence
  Description of Artificial Sequence: Synthetic oligonucleotide
cgcaaggtgtacccacaggcagacatg

SEQ ID NO: 212730 - DNA, 27 bp, Artificial Sequence
  Description of Artificial Sequence: Synthetic oligonucleotide
gcaaggtgtacccacaggcagacatgg

SEQ ID NO: 212731 - DNA, 28 bp, Artificial Sequence
  Description of Artificial Sequence: Synthetic oligonucleotide
caaggtgtacccacaggcagacatggtc

SEQ ID NO: 212732 - DNA, 30 bp, Artificial Sequence
  Description of Artificial Sequence: Synthetic oligonucleotide
aaggtgtacccacaggcagacatggtcatc

SEQ ID NO: 212733 - DNA, 29 bp, Artificial Sequence
  Description of Artificial Sequence: Synthetic oligonucleotide
aggtgtacccacaggcagacatggtcatc

SEQ ID NO: 212734 - DNA, 28 bp, Artificial Sequence
  Description of Artificial Sequence: Synthetic oligonucleotide
ggtgtacccacaggcagacatggtcatc

SEQ ID NO: 212735 - DNA, 28 bp, Artificial Sequence
  Description of Artificial Sequence: Synthetic oligonucleotide
gtgtacccacaggcagacatggtcatcg

SEQ ID NO: 212736 - DNA, 29 bp, Artificial Sequence
  Description of Artificial Sequence: Synthetic oligonucleotide
tgtacccacaggcagacatggtcatcgtg

SEQ ID NO: 212737 - DNA, 28 bp, Artificial Sequence
  Description of Artificial Sequence: Synthetic oligonucleotide
gtacccacaggcagacatggtcatcgtg

SEQ ID NO: 212738 - DNA, 28 bp, Artificial Sequence
  Description of Artificial Sequence: Synthetic oligonucleotide
tacccacaggcagacatggtcatcgtgc

SEQ ID NO: 212739 - DNA, 27 bp, Artificial Sequence
  Description of Artificial Sequence: Synthetic oligonucleotide
acccacaggcagacatggtcatcgtgc

SEQ ID NO: 212740 - DNA, 27 bp, Artificial Sequence
  Description of Artificial Sequence: Synthetic oligonucleotide
cccacaggcagacatggtcatcgtgca

SEQ ID NO: 212741 - DNA, 27 bp, Artificial Sequence
  Description of Artificial Sequence: Synthetic oligonucleotide
ccacaggcagacatggtcatcgtgcac

SEQ ID NO: 212742 - DNA, 27 bp, Artificial Sequence
  Description of Artificial Sequence: Synthetic oligonucleotide
cacaggcagacatggtcatcgtgcacc

SEQ ID NO: 212743 - DNA, 28 bp, Artificial Sequence
  Description of Artificial Sequence: Synthetic oligonucleotide
acaggcagacatggtcatcgtgcaccac

SEQ ID NO: 212744 - DNA, 27 bp, Artificial Sequence
  Description of Artificial Sequence: Synthetic oligonucleotide
caggcagacatggtcatcgtgcaccac

SEQ ID NO: 212745 - DNA, 28 bp, Artificial Sequence
  Description of Artificial Sequence: Synthetic oligonucleotide
aggcagacatggtcatcgtgcaccactg

SEQ ID NO: 212746 - DNA, 27 bp, Artificial Sequence
  Description of Artificial Sequence: Synthetic oligonucleotide
ggcagacatggtcatcgtgcaccactg

SEQ ID NO: 212747 - DNA, 27 bp, Artificial Sequence
  Description of Artificial Sequence: Synthetic oligonucleotide
gcagacatggtcatcgtgcaccactgg

SEQ ID NO: 212748 - DNA, 27 bp, Artificial Sequence
  Description of Artificial Sequence: Synthetic oligonucleotide
cagacatggtcatcgtgcaccactggg

SEQ ID NO: 212749 - DNA, 31 bp, Artificial Sequence
  Description of Artificial Sequence: Synthetic oligonucleotide
agacatggtcatcgtgcaccactgggatatc

SEQ ID NO: 212750 - DNA, 30 bp, Artificial Sequence
  Description of Artificial Sequence: Synthetic oligonucleotide
gacatggtcatcgtgcaccactgggatatc

SEQ ID NO: 212751 - DNA, 32 bp, Artificial Sequence
  Description of Artificial Sequence: Synthetic oligonucleotide
acatggtcatcgtgcaccactgggatatcatg

SEQ ID NO: 212752 - DNA, 31 bp, Artificial Sequence
  Description of Artificial Sequence: Synthetic oligonucleotide
catggtcatcgtgcaccactgggatatcatg

SEQ ID NO: 212753 - DNA, 32 bp, Artificial Sequence
  Description of Artificial Sequence: Synthetic oligonucleotide
atggtcatcgtgcaccactgggatatcatgtc

SEQ ID NO: 212754 - DNA, 31 bp, Artificial Sequence
  Description of Artificial Sequence: Synthetic oligonucleotide
tggtcatcgtgcaccactgggatatcatgtc

SEQ ID NO: 212755 - DNA, 34 bp, Artificial Sequence
  Description of Artificial Sequence: Synthetic oligonucleotide
atacttcaatctcaccatgtcctaccgcagcaac

SEQ ID NO: 212756 - DNA, 33 bp, Artificial Sequence
  Description of Artificial Sequence: Synthetic oligonucleotide
tacttcaatctcaccatgtcctaccgcagcaac

SEQ ID NO: 212757 - DNA, 32 bp, Artificial Sequence
  Description of Artificial Sequence: Synthetic oligonucleotide
acttcaatctcaccatgtcctaccgcagcaac

SEQ ID NO: 212758 - DNA, 31 bp, Artificial Sequence
  Description of Artificial Sequence: Synthetic oligonucleotide
cttcaatctcaccatgtcctaccgcagcaac

SEQ ID NO: 212759 - DNA, 32 bp, Artificial Sequence
  Description of Artificial Sequence: Synthetic oligonucleotide
ttcaatctcaccatgtcctaccgcagcaactc

SEQ ID NO: 212760 - DNA, 31 bp, Artificial Sequence
  Description of Artificial Sequence: Synthetic oligonucleotide
tcaatctcaccatgtcctaccgcagcaactc

SEQ ID NO: 212761 - DNA, 30 bp, Artificial Sequence
  Description of Artificial Sequence: Synthetic oligonucleotide
caatctcaccatgtcctaccgcagcaactc

SEQ ID NO: 212762 - DNA, 30 bp, Artificial Sequence
  Description of Artificial Sequence: Synthetic oligonucleotide
aatctcaccatgtcctaccgcagcaactcc

SEQ ID NO: 212763 - DNA, 29 bp, Artificial Sequence
  Description of Artificial Sequence: Synthetic oligonucleotide
atctcaccatgtcctaccgcagcaactcc

SEQ ID NO: 212764 - DNA, 28 bp, Artificial Sequence
  Description of Artificial Sequence: Synthetic oligonucleotide
tctcaccatgtcctaccgcagcaactcc

SEQ ID NO: 212765 - DNA, 27 bp, Artificial Sequence
  Description of Artificial Sequence: Synthetic oligonucleotide
ctcaccatgtcctaccgcagcaactcc

SEQ ID NO: 212766 - DNA, 27 bp, Artificial Sequence
  Description of Artificial Sequence: Synthetic oligonucleotide
tcaccatgtcctaccgcagcaactccg

SEQ ID NO: 212767 - DNA, 27 bp, Artificial Sequence
  Description of Artificial Sequence: Synthetic oligonucleotide
caccatgtcctaccgcagcaactccga

SEQ ID NO: 212768 - DNA, 27 bp, Artificial Sequence
  Description of Artificial Sequence: Synthetic oligonucleotide
accatgtcctaccgcagcaactccgac

SEQ ID NO: 212769 - DNA, 27 bp, Artificial Sequence
  Description of Artificial Sequence: Synthetic oligonucleotide
ccatgtcctaccgcagcaactccgaca

SEQ ID NO: 212770 - DNA, 28 bp, Artificial Sequence
  Description of Artificial Sequence: Synthetic oligonucleotide
catgtcctaccgcagcaactccgacatc

SEQ ID NO: 212771 - DNA, 30 bp, Artificial Sequence
  Description of Artificial Sequence: Synthetic oligonucleotide
atgtcctaccgcagcaactccgacatcttc

SEQ ID NO: 212772 - DNA, 29 bp, Artificial Sequence
  Description of Artificial Sequence: Synthetic oligonucleotide
tgtcctaccgcagcaactccgacatcttc

SEQ ID NO: 212773 - DNA, 28 bp, Artificial Sequence
  Description of Artificial Sequence: Synthetic oligonucleotide
gtcctaccgcagcaactccgacatcttc

SEQ ID NO: 212774 - DNA, 29 bp, Artificial Sequence
  Description of Artificial Sequence: Synthetic oligonucleotide
tcctaccgcagcaactccgacatcttcac

SEQ ID NO: 212775 - DNA, 28 bp, Artificial Sequence
  Description of Artificial Sequence: Synthetic oligonucleotide
cctaccgcagcaactccgacatcttcac

SEQ ID NO: 212776 - DNA, 28 bp, Artificial Sequence
  Description of Artificial Sequence: Synthetic oligonucleotide
ctaccgcagcaactccgacatcttcacg

SEQ ID NO: 212777 - DNA, 28 bp, Artificial Sequence
  Description of Artificial Sequence: Synthetic oligonucleotide
taccgcagcaactccgacatcttcacgc

SEQ ID NO: 212778 - DNA, 27 bp, Artificial Sequence
  Description of Artificial Sequence: Synthetic oligonucleotide
accgcagcaactccgacatcttcacgc

SEQ ID NO: 212779 - DNA, 26 bp, Artificial Sequence
  Description of Artificial Sequence: Synthetic oligonucleotide
ccgcagcaactccgacatcttcacgc

SEQ ID NO: 212780 - DNA, 26 bp, Artificial Sequence
  Description of Artificial Sequence: Synthetic oligonucleotide
cgcagcaactccgacatcttcacgcc

SEQ ID NO: 212781 - DNA, 27 bp, Artificial Sequence
  Description of Artificial Sequence: Synthetic oligonucleotide
gcagcaactccgacatcttcacgccct

SEQ ID NO: 212782 - DNA, 28 bp, Artificial Sequence
  Description of Artificial Sequence: Synthetic oligonucleotide
cagcaactccgacatcttcacgccctac

SEQ ID NO: 212783 - DNA, 28 bp, Artificial Sequence
  Description of Artificial Sequence: Synthetic oligonucleotide
agcaactccgacatcttcacgccctacg

SEQ ID NO: 212784 - DNA, 27 bp, Artificial Sequence
  Description of Artificial Sequence: Synthetic oligonucleotide
gcaactccgacatcttcacgccctacg

SEQ ID NO: 212785 - DNA, 27 bp, Artificial Sequence
  Description of Artificial Sequence: Synthetic oligonucleotide
caactccgacatcttcacgccctacgg

SEQ ID NO: 212786 - DNA, 27 bp, Artificial Sequence
  Description of Artificial Sequence: Synthetic oligonucleotide
aactccgacatcttcacgccctacggc

SEQ ID NO: 212787 - DNA, 29 bp, Artificial Sequence
  Description of Artificial Sequence: Synthetic oligonucleotide
caggctcatctcaaggtggacgtgtacag

SEQ ID NO: 212788 - DNA, 30 bp, Artificial Sequence
  Description of Artificial Sequence: Synthetic oligonucleotide
aggctcatctcaaggtggacgtgtacagac

SEQ ID NO: 212789 - DNA, 29 bp, Artificial Sequence
  Description of Artificial Sequence: Synthetic oligonucleotide
ggctcatctcaaggtggacgtgtacagac

SEQ ID NO: 212790 - DNA, 29 bp, Artificial Sequence
  Description of Artificial Sequence: Synthetic oligonucleotide
gctcatctcaaggtggacgtgtacagacg

SEQ ID NO: 212791 - DNA, 29 bp, Artificial Sequence
  Description of Artificial Sequence: Synthetic oligonucleotide
ctcatctcaaggtggacgtgtacagacgc

SEQ ID NO: 212792 - DNA, 30 bp, Artificial Sequence
  Description of Artificial Sequence: Synthetic oligonucleotide
tcatctcaaggtggacgtgtacagacgctc

SEQ ID NO: 212793 - DNA, 29 bp, Artificial Sequence
  Description of Artificial Sequence: Synthetic oligonucleotide
catctcaaggtggacgtgtacagacgctc

SEQ ID NO: 212794 - DNA, 29 bp, Artificial Sequence
  Description of Artificial Sequence: Synthetic oligonucleotide
atctcaaggtggacgtgtacagacgctcc

SEQ ID NO: 212795 - DNA, 28 bp, Artificial Sequence
  Description of Artificial Sequence: Synthetic oligonucleotide
tctcaaggtggacgtgtacagacgctcc

SEQ ID NO: 212796 - DNA, 27 bp, Artificial Sequence
  Description of Artificial Sequence: Synthetic oligonucleotide
ctcaaggtggacgtgtacagacgctcc

SEQ ID NO: 212797 - DNA, 27 bp, Artificial Sequence
  Description of Artificial Sequence: Synthetic oligonucleotide
tcaaggtggacgtgtacagacgctccc

SEQ ID NO: 212798 - DNA, 27 bp, Artificial Sequence
  Description of Artificial Sequence: Synthetic oligonucleotide
caaggtggacgtgtacagacgctccca

SEQ ID NO: 212799 - DNA, 27 bp, Artificial Sequence
  Description of Artificial Sequence: Synthetic oligonucleotide
aaggtggacgtgtacagacgctcccac

SEQ ID NO: 212800 - DNA, 27 bp, Artificial Sequence
  Description of Artificial Sequence: Synthetic oligonucleotide
aggtggacgtgtacagacgctcccaca

SEQ ID NO: 212801 - DNA, 27 bp, Artificial Sequence
  Description of Artificial Sequence: Synthetic oligonucleotide
ggtggacgtgtacagacgctcccacaa

SEQ ID NO: 212802 - DNA, 27 bp, Artificial Sequence
  Description of Artificial Sequence: Synthetic oligonucleotide
gtggacgtgtacagacgctcccacaag

SEQ ID NO: 212803 - DNA, 27 bp, Artificial Sequence
  Description of Artificial Sequence: Synthetic oligonucleotide
tggacgtgtacagacgctcccacaagc

SEQ ID NO: 212804 - DNA, 26 bp, Artificial Sequence
  Description of Artificial Sequence: Synthetic oligonucleotide
ggacgtgtacagacgctcccacaagc

SEQ ID NO: 212805 - DNA, 26 bp, Artificial Sequence
  Description of Artificial Sequence: Synthetic oligonucleotide
gacgtgtacagacgctcccacaagcc

SEQ ID NO: 212806 - DNA, 26 bp, Artificial Sequence
  Description of Artificial Sequence: Synthetic oligonucleotide
acgtgtacagacgctcccacaagccc

SEQ ID NO: 212807 - DNA, 25 bp, Artificial Sequence
  Description of Artificial Sequence: Synthetic oligonucleotide
cgtgtacagacgctcccacaagccc

SEQ ID NO: 212808 - DNA, 26 bp, Artificial Sequence
  Description of Artificial Sequence: Synthetic oligonucleotide
gtgtacagacgctcccacaagcccct

SEQ ID NO: 212809 - DNA, 26 bp, Artificial Sequence
  Description of Artificial Sequence: Synthetic oligonucleotide
tgtacagacgctcccacaagcccctg

SEQ ID NO: 212810 - DNA, 25 bp, Artificial Sequence
  Description of Artificial Sequence: Synthetic oligonucleotide
gtacagacgctcccacaagcccctg

SEQ ID NO: 212811 - DNA, 25 bp, Artificial Sequence
  Description of Artificial Sequence: Synthetic oligonucleotide
tacagacgctcccacaagcccctgc

SEQ ID NO: 212812 - DNA, 24 bp, Artificial Sequence
  Description of Artificial Sequence: Synthetic oligonucleotide
acagacgctcccacaagcccctgc

SEQ ID NO: 212813 - DNA, 23 bp, Artificial Sequence
  Description of Artificial Sequence: Synthetic oligonucleotide
cagacgctcccacaagcccctgc

SEQ ID NO: 212814 - DNA, 23 bp, Artificial Sequence
  Description of Artificial Sequence: Synthetic oligonucleotide
agacgctcccacaagcccctgcc

SEQ ID NO: 212815 - DNA, 27 bp, Artificial Sequence
  Description of Artificial Sequence: Synthetic oligonucleotide
atccaggtaccagacggtgcgcagcaa

SEQ ID NO: 212816 - DNA, 27 bp, Artificial Sequence
  Description of Artificial Sequence: Synthetic oligonucleotide
tccaggtaccagacggtgcgcagcaaa

SEQ ID NO: 212817 - DNA, 26 bp, Artificial Sequence
  Description of Artificial Sequence: Synthetic oligonucleotide
ccaggtaccagacggtgcgcagcaaa

SEQ ID NO: 212818 - DNA, 26 bp, Artificial Sequence
  Description of Artificial Sequence: Synthetic oligonucleotide
caggtaccagacggtgcgcagcaaag

SEQ ID NO: 212819 - DNA, 26 bp, Artificial Sequence
  Description of Artificial Sequence: Synthetic oligonucleotide
aggtaccagacggtgcgcagcaaagc

SEQ ID NO: 212820 - DNA, 25 bp, Artificial Sequence
  Description of Artificial Sequence: Synthetic oligonucleotide
ggtaccagacggtgcgcagcaaagc

SEQ ID NO: 212821 - DNA, 25 bp, Artificial Sequence
  Description of Artificial Sequence: Synthetic oligonucleotide
gtaccagacggtgcgcagcaaagcg

SEQ ID NO: 212822 - DNA, 25 bp, Artificial Sequence
  Description of Artificial Sequence: Synthetic oligonucleotide
taccagacggtgcgcagcaaagcgg

SEQ ID NO: 212823 - DNA, 24 bp, Artificial Sequence
  Description of Artificial Sequence: Synthetic oligonucleotide
accagacggtgcgcagcaaagcgg

SEQ ID NO: 212824 - DNA, 23 bp, Artificial Sequence
  Description of Artificial Sequence: Synthetic oligonucleotide
ccagacggtgcgcagcaaagcgg

SEQ ID NO: 212825 - DNA, 25 bp, Artificial Sequence
  Description of Artificial Sequence: Synthetic oligonucleotide
cagacggtgcgcagcaaagcggctt

SEQ ID NO: 212826 - DNA, 25 bp, Artificial Sequence
  Description of Artificial Sequence: Synthetic oligonucleotide
agacggtgcgcagcaaagcggcttg

SEQ ID NO: 212827 - DNA, 24 bp, Artificial Sequence
  Description of Artificial Sequence: Synthetic oligonucleotide
gacggtgcgcagcaaagcggcttg

SEQ ID NO: 212828 - DNA, 26 bp, Artificial Sequence
  Description of Artificial Sequence: Synthetic oligonucleotide
acggtgcgcagcaaagcggcttggtt

SEQ ID NO: 212829 - DNA, 25 bp, Artificial Sequence
  Description of Artificial Sequence: Synthetic oligonucleotide
cggtgcgcagcaaagcggcttggtt

SEQ ID NO: 212830 - DNA, 26 bp, Artificial Sequence
  Description of Artificial Sequence: Synthetic oligonucleotide
ggtgcgcagcaaagcggcttggttca

SEQ ID NO: 212831 - DNA, 26 bp, Artificial Sequence
  Description of Artificial Sequence: Synthetic oligonucleotide
gtgcgcagcaaagcggcttggttcac

SEQ ID NO: 212832 - DNA, 27 bp, Artificial Sequence
  Description of Artificial Sequence: Synthetic oligonucleotide
tgcgcagcaaagcggcttggttcacct

SEQ ID NO: 212833 - DNA, 26 bp, Artificial Sequence
  Description of Artificial Sequence: Synthetic oligonucleotide
gcgcagcaaagcggcttggttcacct

SEQ ID NO: 212834 - DNA, 27 bp, Artificial Sequence
  Description of Artificial Sequence: Synthetic oligonucleotide
cgcagcaaagcggcttggttcacctga

SEQ ID NO: 212835 - DNA, 23 bp, Artificial Sequence
  Description of Artificial Sequence: Synthetic oligonucleotide
aacgccctggaggcctgggccat

SEQ ID NO: 212836 - DNA, 22 bp, Artificial Sequence
  Description of Artificial Sequence: Synthetic oligonucleotide
acgccctggaggcctgggccat

SEQ ID NO: 212837 - DNA, 21 bp, Artificial Sequence
  Description of Artificial Sequence: Synthetic oligonucleotide
cgccctggaggcctgggccat

SEQ ID NO: 212838 - DNA, 21 bp, Artificial Sequence
  Description of Artificial Sequence: Synthetic oligonucleotide
gccctggaggcctgggccatg

SEQ ID NO: 212839 - DNA, 21 bp, Artificial Sequence
  Description of Artificial Sequence: Synthetic oligonucleotide
ccctggaggcctgggccatgc

SEQ ID NO: 212840 - DNA, 21 bp, Artificial Sequence
  Description of Artificial Sequence: Synthetic oligonucleotide
cctggaggcctgggccatgcc

SEQ ID NO: 212841 - DNA, 21 bp, Artificial Sequence
  Description of Artificial Sequence: Synthetic oligonucleotide
ctggaggcctgggccatgccc

SEQ ID NO: 212842 - DNA, 22 bp, Artificial Sequence
  Description of Artificial Sequence: Synthetic oligonucleotide
tggaggcctgggccatgcccgt

SEQ ID NO: 212843 - DNA, 21 bp, Artificial Sequence
  Description of Artificial Sequence: Synthetic oligonucleotide
ggaggcctgggccatgcccgt

SEQ ID NO: 212844 - DNA, 21 bp, Artificial Sequence
  Description of Artificial Sequence: Synthetic oligonucleotide
gaggcctgggccatgcccgtg

SEQ ID NO: 212845 - DNA, 22 bp, Artificial Sequence
  Description of Artificial Sequence: Synthetic oligonucleotide
aggcctgggccatgcccgtggt

SEQ ID NO: 212846 - DNA, 21 bp, Artificial Sequence
  Description of Artificial Sequence: Synthetic oligonucleotide
ggcctgggccatgcccgtggt

SEQ ID NO: 212847 - DNA, 21 bp, Artificial Sequence
  Description of Artificial Sequence: Synthetic oligonucleotide
gcctgggccatgcccgtggtg

SEQ ID NO: 212848 - DNA, 22 bp, Artificial Sequence
  Description of Artificial Sequence: Synthetic oligonucleotide
cctgggccatgcccgtggtgct

SEQ ID NO: 212849 - DNA, 22 bp, Artificial Sequence
  Description of Artificial Sequence: Synthetic oligonucleotide
ctgggccatgcccgtggtgctg

SEQ ID NO: 212850 - DNA, 22 bp, Artificial Sequence
  Description of Artificial Sequence: Synthetic oligonucleotide
tgggccatgcccgtggtgctgg

SEQ ID NO: 212851 - DNA, 21 bp, Artificial Sequence
  Description of Artificial Sequence: Synthetic oligonucleotide
gggccatgcccgtggtgctgg

SEQ ID NO: 212852 - DNA, 21 bp, Artificial Sequence
  Description of Artificial Sequence: Synthetic oligonucleotide
ggccatgcccgtggtgctggg

SEQ ID NO: 212853 - DNA, 21 bp, Artificial Sequence
  Description of Artificial Sequence: Synthetic oligonucleotide
gccatgcccgtggtgctgggc

SEQ ID NO: 212854 - DNA, 21 bp, Artificial Sequence
  Description of Artificial Sequence: Synthetic oligonucleotide
ccatgcccgtggtgctgggcc

SEQ ID NO: 212855 - DNA, 21 bp, Artificial Sequence
  Description of Artificial Sequence: Synthetic oligonucleotide
catgcccgtggtgctgggccc

SEQ ID NO: 212856 - DNA, 22 bp, Artificial Sequence
  Description of Artificial Sequence: Synthetic oligonucleotide
atgcccgtggtgctgggcccca

SEQ ID NO: 212857 - DNA, 25 bp, Artificial Sequence
  Description of Artificial Sequence: Synthetic oligonucleotide
ggtgtccaactggaagccggactcc

SEQ ID NO: 212858 - DNA, 25 bp, Artificial Sequence
  Description of Artificial Sequence: Synthetic oligonucleotide
gtgtccaactggaagccggactccg

SEQ ID NO: 212859 - DNA, 25 bp, Artificial Sequence
  Description of Artificial Sequence: Synthetic oligonucleotide
tgtccaactggaagccggactccgc

SEQ ID NO: 212860 - DNA, 24 bp, Artificial Sequence
  Description of Artificial Sequence: Synthetic oligonucleotide
gtccaactggaagccggactccgc

SEQ ID NO: 212861 - DNA, 25 bp, Artificial Sequence
  Description of Artificial Sequence: Synthetic oligonucleotide
tccaactggaagccggactccgcca

SEQ ID NO: 212862 - DNA, 24 bp, Artificial Sequence
  Description of Artificial Sequence: Synthetic oligonucleotide
ccaactggaagccggactccgcca

SEQ ID NO: 212863 - DNA, 24 bp, Artificial Sequence
  Description of Artificial Sequence: Synthetic oligonucleotide
caactggaagccggactccgccag

SEQ ID NO: 212864 - DNA, 24 bp, Artificial Sequence
  Description of Artificial Sequence: Synthetic oligonucleotide
aactggaagccggactccgccagg

SEQ ID NO: 212865 - DNA, 23 bp, Artificial Sequence
  Description of Artificial Sequence: Synthetic oligonucleotide
actggaagccggactccgccagg

SEQ ID NO: 212866 - DNA, 22 bp, Artificial Sequence
  Description of Artificial Sequence: Synthetic oligonucleotide
ctggaagccggactccgccagg

SEQ ID NO: 212867 - DNA, 23 bp, Artificial Sequence
  Description of Artificial Sequence: Synthetic oligonucleotide
tggaagccggactccgccagggt

SEQ ID NO: 212868 - DNA, 22 bp, Artificial Sequence
  Description of Artificial Sequence: Synthetic oligonucleotide
ggaagccggactccgccagggt

SEQ ID NO: 212869 - DNA, 22 bp, Artificial Sequence
  Description of Artificial Sequence: Synthetic oligonucleotide
gaagccggactccgccagggtg

SEQ ID NO: 212870 - DNA, 22 bp, Artificial Sequence
  Description of Artificial Sequence: Synthetic oligonucleotide
aagccggactccgccagggtgc

SEQ ID NO: 212871 - DNA, 21 bp, Artificial Sequence
  Description of Artificial Sequence: Synthetic oligonucleotide
agccggactccgccagggtgc

SEQ ID NO: 212872 - DNA, 20 bp, Artificial Sequence
  Description of Artificial Sequence: Synthetic oligonucleotide
gccggactccgccagggtgc

SEQ ID NO: 212873 - DNA, 20 bp, Artificial Sequence
  Description of Artificial Sequence: Synthetic oligonucleotide
ccggactccgccagggtgcg

SEQ ID NO: 212874 - DNA, 22 bp, Artificial Sequence
  Description of Artificial Sequence: Synthetic oligonucleotide
cggactccgccagggtgcgcta

SEQ ID NO: 212875 - DNA, 24 bp, Artificial Sequence
  Description of Artificial Sequence: Synthetic oligonucleotide
ggactccgccagggtgcgctacta

SEQ ID NO: 212876 - DNA, 24 bp, Artificial Sequence
  Description of Artificial Sequence: Synthetic oligonucleotide
gactccgccagggtgcgctactac

SEQ ID NO: 212877 - DNA, 25 bp, Artificial Sequence
  Description of Artificial Sequence: Synthetic oligonucleotide
actccgccagggtgcgctactacca

SEQ ID NO: 212878 - DNA, 24 bp, Artificial Sequence
  Description of Artificial Sequence: Synthetic oligonucleotide
ctccgccagggtgcgctactacca

SEQ ID NO: 212879 - DNA, 25 bp, Artificial Sequence
  Description of Artificial Sequence: Synthetic oligonucleotide
tccgccagggtgcgctactaccaga

SEQ ID NO: 212880 - DNA, 24 bp, Artificial Sequence
  Description of Artificial Sequence: Synthetic oligonucleotide
ccgccagggtgcgctactaccaga

SEQ ID NO: 212881 - DNA, 24 bp, Artificial Sequence
  Description of Artificial Sequence: Synthetic oligonucleotide
cgccagggtgcgctactaccagag

SEQ ID NO: 212882 - DNA, 27 bp, Artificial Sequence
  Description of Artificial Sequence: Synthetic oligonucleotide
ccctaactgccagcacctggaagccat

SEQ ID NO: 212883 - DNA, 27 bp, Artificial Sequence
  Description of Artificial Sequence: Synthetic oligonucleotide
cctaactgccagcacctggaagccatg

SEQ ID NO: 212884 - DNA, 27 bp, Artificial Sequence
  Description of Artificial Sequence: Synthetic oligonucleotide
ctaactgccagcacctggaagccatgg

SEQ ID NO: 212885 - DNA, 28 bp, Artificial Sequence
  Description of Artificial Sequence: Synthetic oligonucleotide
taactgccagcacctggaagccatggac

SEQ ID NO: 212886 - DNA, 27 bp, Artificial Sequence
  Description of Artificial Sequence: Synthetic oligonucleotide
aactgccagcacctggaagccatggac

SEQ ID NO: 212887 - DNA, 27 bp, Artificial Sequence
  Description of Artificial Sequence: Synthetic oligonucleotide
actgccagcacctggaagccatggaca

SEQ ID NO: 212888 - DNA, 26 bp, Artificial Sequence
  Description of Artificial Sequence: Synthetic oligonucleotide
ctgccagcacctggaagccatggaca

SEQ ID NO: 212889 - DNA, 27 bp, Artificial Sequence
  Description of Artificial Sequence: Synthetic oligonucleotide
tgccagcacctggaagccatggacaga

SEQ ID NO: 212890 - DNA, 27 bp, Artificial Sequence
  Description of Artificial Sequence: Synthetic oligonucleotide
gccagcacctggaagccatggacagat

SEQ ID NO: 212891 - DNA, 28 bp, Artificial Sequence
  Description of Artificial Sequence: Synthetic oligonucleotide
ccagcacctggaagccatggacagatac

SEQ ID NO: 212892 - DNA, 30 bp, Artificial Sequence
  Description of Artificial Sequence: Synthetic oligonucleotide
cagcacctggaagccatggacagatacttc

SEQ ID NO: 212893 - DNA, 33 bp, Artificial Sequence
  Description of Artificial Sequence: Synthetic oligonucleotide
agcacctggaagccatggacagatacttcaatc

SEQ ID NO: 212894 - DNA, 32 bp, Artificial Sequence
  Description of Artificial Sequence: Synthetic oligonucleotide
gcacctggaagccatggacagatacttcaatc

SEQ ID NO: 212895 - DNA, 33 bp, Artificial Sequence
  Description of Artificial Sequence: Synthetic oligonucleotide
cacctggaagccatggacagatacttcaatctc

SEQ ID NO: 212896 - DNA, 34 bp, Artificial Sequence
  Description of Artificial Sequence: Synthetic oligonucleotide
acctggaagccatggacagatacttcaatctcac

SEQ ID NO: 212897 - DNA, 33 bp, Artificial Sequence
  Description of Artificial Sequence: Synthetic oligonucleotide
cctggaagccatggacagatacttcaatctcac

SEQ ID NO: 212898 - DNA, 33 bp, Artificial Sequence
  Description of Artificial Sequence: Synthetic oligonucleotide
ctggaagccatggacagatacttcaatctcacc

SEQ ID NO: 212899 - DNA, 35 bp, Artificial Sequence
  Description of Artificial Sequence: Synthetic oligonucleotide
tggaagccatggacagatacttcaatctcaccatg

SEQ ID NO: 212900 - DNA, 34 bp, Artificial Sequence
  Description of Artificial Sequence: Synthetic oligonucleotide
ggaagccatggacagatacttcaatctcaccatg

SEQ ID NO: 212901 - DNA, 35 bp, Artificial Sequence
  Description of Artificial Sequence: Synthetic oligonucleotide
gaagccatggacagatacttcaatctcaccatgtc

SEQ ID NO: 212902 - DNA, 35 bp, Artificial Sequence
  Description of Artificial Sequence: Synthetic oligonucleotide
aagccatggacagatacttcaatctcaccatgtcc

SEQ ID NO: 212903 - DNA, 34 bp, Artificial Sequence
  Description of Artificial Sequence: Synthetic oligonucleotide
agccatggacagatacttcaatctcaccatgtcc

SEQ ID NO: 212904 - DNA, 33 bp, Artificial Sequence
  Description of Artificial Sequence: Synthetic oligonucleotide
gccatggacagatacttcaatctcaccatgtcc

SEQ ID NO: 212905 - DNA, 35 bp, Artificial Sequence
  Description of Artificial Sequence: Synthetic oligonucleotide
ccatggacagatacttcaatctcaccatgtcctac

SEQ ID NO: 212906 - DNA, 35 bp, Artificial Sequence
  Description of Artificial Sequence: Synthetic oligonucleotide
catggacagatacttcaatctcaccatgtcctacc

SEQ ID NO: 212907 - DNA, 35 bp, Artificial Sequence
  Description of Artificial Sequence: Synthetic oligonucleotide
atggacagatacttcaatctcaccatgtcctaccg

SEQ ID NO: 212908 - DNA, 27 bp, Artificial Sequence
  Description of Artificial Sequence: Synthetic oligonucleotide
tgcagccaagccacaatggccatggca

SEQ ID NO: 212909 - DNA, 26 bp, Artificial Sequence
  Description of Artificial Sequence: Synthetic oligonucleotide
gcagccaagccacaatggccatggca

SEQ ID NO: 212910 - DNA, 26 bp, Artificial Sequence
  Description of Artificial Sequence: Synthetic oligonucleotide
cagccaagccacaatggccatggcac

SEQ ID NO: 212911 - DNA, 26 bp, Artificial Sequence
  Description of Artificial Sequence: Synthetic oligonucleotide
agccaagccacaatggccatggcacc

SEQ ID NO: 212912 - DNA, 25 bp, Artificial Sequence
  Description of Artificial Sequence: Synthetic oligonucleotide
gccaagccacaatggccatggcacc

SEQ ID NO: 212913 - DNA, 25 bp, Artificial Sequence
  Description of Artificial Sequence: Synthetic oligonucleotide
ccaagccacaatggccatggcaccg

SEQ ID NO: 212914 - DNA, 26 bp, Artificial Sequence
  Description of Artificial Sequence: Synthetic oligonucleotide
caagccacaatggccatggcaccgct

SEQ ID NO: 212915 - DNA, 27 bp, Artificial Sequence
  Description of Artificial Sequence: Synthetic oligonucleotide
aagccacaatggccatggcaccgctgt

SEQ ID NO: 212916 - DNA, 26 bp, Artificial Sequence
  Description of Artificial Sequence: Synthetic oligonucleotide
agccacaatggccatggcaccgctgt

SEQ ID NO: 212917 - DNA, 25 bp, Artificial Sequence
  Description of Artificial Sequence: Synthetic oligonucleotide
gccacaatggccatggcaccgctgt

SEQ ID NO: 212918 - DNA, 26 bp, Artificial Sequence
  Description of Artificial Sequence: Synthetic oligonucleotide
ccacaatggccatggcaccgctgtct

SEQ ID NO: 212919 - DNA, 26 bp, Artificial Sequence
  Description of Artificial Sequence: Synthetic oligonucleotide
cacaatggccatggcaccgctgtctg

SEQ ID NO: 212920 - DNA, 26 bp, Artificial Sequence
  Description of Artificial Sequence: Synthetic oligonucleotide
acaatggccatggcaccgctgtctgg

SEQ ID NO: 212921 - DNA, 25 bp, Artificial Sequence
  Description of Artificial Sequence: Synthetic oligonucleotide
caatggccatggcaccgctgtctgg

SEQ ID NO: 212922 - DNA, 25 bp, Artificial Sequence
  Description of Artificial Sequence: Synthetic oligonucleotide
aatggccatggcaccgctgtctggc

SEQ ID NO: 212923 - DNA, 24 bp, Artificial Sequence
  Description of Artificial Sequence: Synthetic oligonucleotide
atggccatggcaccgctgtctggc

SEQ ID NO: 212924 - DNA, 23 bp, Artificial Sequence
  Description of Artificial Sequence: Synthetic oligonucleotide
tggccatggcaccgctgtctggc

SEQ ID NO: 212925 - DNA, 22 bp, Artificial Sequence
  Description of Artificial Sequence: Synthetic oligonucleotide
ggccatggcaccgctgtctggc

SEQ ID NO: 212926 - DNA, 22 bp, Artificial Sequence
  Description of Artificial Sequence: Synthetic oligonucleotide
gccatggcaccgctgtctggcc

SEQ ID NO: 212927 - DNA, 22 bp, Artificial Sequence
  Description of Artificial Sequence: Synthetic oligonucleotide
ccatggcaccgctgtctggccg

SEQ ID NO: 212928 - DNA, 23 bp, Artificial Sequence
  Description of Artificial Sequence: Synthetic oligonucleotide
catggcaccgctgtctggccgca

SEQ ID NO: 212929 - DNA, 24 bp, Artificial Sequence
  Description of Artificial Sequence: Synthetic oligonucleotide
atggcaccgctgtctggccgcact

SEQ ID NO: 212930 - DNA, 23 bp, Artificial Sequence
  Description of Artificial Sequence: Synthetic oligonucleotide
tggcaccgctgtctggccgcact

SEQ ID NO: 212931 - DNA, 22 bp, Artificial Sequence
  Description of Artificial Sequence: Synthetic oligonucleotide
ggcaccgctgtctggccgcact

SEQ ID NO: 212932 - DNA, 22 bp, Artificial Sequence
  Description of Artificial Sequence: Synthetic oligonucleotide
gcaccgctgtctggccgcactg

SEQ ID NO: 212933 - DNA, 27 bp, Artificial Sequence
  Description of Artificial Sequence: Synthetic oligonucleotide
caccgctgtctggccgcactgctattt

SEQ ID NO: 212934 - DNA, 27 bp, Artificial Sequence
  Description of Artificial Sequence: Synthetic oligonucleotide
accgctgtctggccgcactgctatttc

SEQ ID NO: 212935 - DNA, 27 bp, Artificial Sequence
  Description of Artificial Sequence: Synthetic oligonucleotide
agcaggaatccaggtaccagacggtgg

SEQ ID NO: 212936 - DNA, 26 bp, Artificial Sequence
  Description of Artificial Sequence: Synthetic oligonucleotide
gcaggaatccaggtaccagacggtgg

SEQ ID NO: 212937 - DNA, 26 bp, Artificial Sequence
  Description of Artificial Sequence: Synthetic oligonucleotide
caggaatccaggtaccagacggtggg

SEQ ID NO: 212938 - DNA, 27 bp, Artificial Sequence
  Description of Artificial Sequence: Synthetic oligonucleotide
aggaatccaggtaccagacggtgggca

SEQ ID NO: 212939 - DNA, 26 bp, Artificial Sequence
  Description of Artificial Sequence: Synthetic oligonucleotide
ggaatccaggtaccagacggtgggca

SEQ ID NO: 212940 - DNA, 26 bp, Artificial Sequence
  Description of Artificial Sequence: Synthetic oligonucleotide
gaatccaggtaccagacggtgggcag

SEQ ID NO: 212941 - DNA, 27 bp, Artificial Sequence
  Description of Artificial Sequence: Synthetic oligonucleotide
aatccaggtaccagacggtgggcagca

SEQ ID NO: 212942 - DNA, 27 bp, Artificial Sequence
  Description of Artificial Sequence: Synthetic oligonucleotide
atccaggtaccagacggtgggcagcat

SEQ ID NO: 212943 - DNA, 27 bp, Artificial Sequence
  Description of Artificial Sequence: Synthetic oligonucleotide
tccaggtaccagacggtgggcagcata

SEQ ID NO: 212944 - DNA, 26 bp, Artificial Sequence
  Description of Artificial Sequence: Synthetic oligonucleotide
ccaggtaccagacggtgggcagcata

SEQ ID NO: 212945 - DNA, 26 bp, Artificial Sequence
  Description of Artificial Sequence: Synthetic oligonucleotide
caggtaccagacggtgggcagcatag

SEQ ID NO: 212946 - DNA, 26 bp, Artificial Sequence
  Description of Artificial Sequence: Synthetic oligonucleotide
aggtaccagacggtgggcagcatagc

SEQ ID NO: 212947 - DNA, 25 bp, Artificial Sequence
  Description of Artificial Sequence: Synthetic oligonucleotide
ggtaccagacggtgggcagcatagc

SEQ ID NO: 212948 - DNA, 25 bp, Artificial Sequence
  Description of Artificial Sequence: Synthetic oligonucleotide
gtaccagacggtgggcagcatagcg

SEQ ID NO: 212949 - DNA, 25 bp, Artificial Sequence
  Description of Artificial Sequence: Synthetic oligonucleotide
taccagacggtgggcagcatagcgg

SEQ ID NO: 212950 - DNA, 24 bp, Artificial Sequence
  Description of Artificial Sequence: Synthetic oligonucleotide
accagacggtgggcagcatagcgg

SEQ ID NO: 212951 - DNA, 23 bp, Artificial Sequence
  Description of Artificial Sequence: Synthetic oligonucleotide
ccagacggtgggcagcatagcgg

SEQ ID NO: 212952 - DNA, 25 bp, Artificial Sequence
  Description of Artificial Sequence: Synthetic oligonucleotide
cagacggtgggcagcatagcggctt

SEQ ID NO: 212953 - DNA, 25 bp, Artificial Sequence
  Description of Artificial Sequence: Synthetic oligonucleotide
agacggtgggcagcatagcggcttg

SEQ ID NO: 212954 - DNA, 24 bp, Artificial Sequence
  Description of Artificial Sequence: Synthetic oligonucleotide
gacggtgggcagcatagcggcttg

SEQ ID NO: 212955 - DNA, 26 bp, Artificial Sequence
  Description of Artificial Sequence: Synthetic oligonucleotide
acggtgggcagcatagcggcttggtt

SEQ ID NO: 212956 - DNA, 25 bp, Artificial Sequence
  Description of Artificial Sequence: Synthetic oligonucleotide
cggtgggcagcatagcggcttggtt

SEQ ID NO: 212957 - DNA, 26 bp, Artificial Sequence
  Description of Artificial Sequence: Synthetic oligonucleotide
ggtgggcagcatagcggcttggttca

SEQ ID NO: 212958 - DNA, 26 bp, Artificial Sequence
  Description of Artificial Sequence: Synthetic oligonucleotide
gtgggcagcatagcggcttggttcac

SEQ ID NO: 212959 - DNA, 27 bp, Artificial Sequence
  Description of Artificial Sequence: Synthetic oligonucleotide
tgggcagcatagcggcttggttcacct

SEQ ID NO: 212960 - DNA, 26 bp, Artificial Sequence
  Description of Artificial Sequence: Synthetic oligonucleotide
gggcagcatagcggcttggttcacct

SEQ ID NO: 212961 - DNA, 27 bp, Artificial Sequence
  Description of Artificial Sequence: Synthetic oligonucleotide
ggcagcatagcggcttggttcacctga

SEQ ID NO: 212962 - DNA, 21 bp, Artificial Sequence
  Description of Artificial Sequence: Synthetic oligonucleotide
atggagcccccggacgcaccg

SEQ ID NO: 212963 - DNA, 20 bp, Artificial Sequence
  Description of Artificial Sequence: Synthetic oligonucleotide
tggagcccccggacgcaccg

SEQ ID NO: 212964 - DNA, 20 bp, Artificial Sequence
  Description of Artificial Sequence: Synthetic oligonucleotide
ggagcccccggacgcaccgt

SEQ ID NO: 212965 - DNA, 20 bp, Artificial Sequence
  Description of Artificial Sequence: Synthetic oligonucleotide
gagcccccggacgcaccggt

SEQ ID NO: 212966 - DNA, 20 bp, Artificial Sequence
  Description of Artificial Sequence: Synthetic oligonucleotide
agcccccggacgcaccggct

SEQ ID NO: 212967 - DNA, 20 bp, Artificial Sequence
  Description of Artificial Sequence: Synthetic oligonucleotide
gcccccggacgcaccggctt

SEQ ID NO: 212968 - DNA, 20 bp, Artificial Sequence
  Description of Artificial Sequence: Synthetic oligonucleotide
cccccggacgcaccggcctt

SEQ ID NO: 212969 - DNA, 20 bp, Artificial Sequence
  Description of Artificial Sequence: Synthetic oligonucleotide
ccccggacgcaccggcccat

SEQ ID NO: 212970 - DNA, 20 bp, Artificial Sequence
  Description of Artificial Sequence: Synthetic oligonucleotide
cccggacgcaccggcccagt

SEQ ID NO: 212971 - DNA, 20 bp, Artificial Sequence
  Description of Artificial Sequence: Synthetic oligonucleotide
ccggacgcaccggcccaggt

SEQ ID NO: 212972 - DNA, 20 bp, Artificial Sequence
  Description of Artificial Sequence: Synthetic oligonucleotide
cggacgcaccggcccaggct

SEQ ID NO: 212973 - DNA, 20 bp, Artificial Sequence
  Description of Artificial Sequence: Synthetic oligonucleotide
ggacgcaccggcccaggcgt

SEQ ID NO: 212974 - DNA, 20 bp, Artificial Sequence
  Description of Artificial Sequence: Synthetic oligonucleotide
gacgcaccggcccaggcgct

SEQ ID NO: 212975 - DNA, 20 bp, Artificial Sequence
  Description of Artificial Sequence: Synthetic oligonucleotide
acgcaccggcccaggcgcgt

SEQ ID NO: 212976 - DNA, 20 bp, Artificial Sequence
  Description of Artificial Sequence: Synthetic oligonucleotide
cgcaccggcccaggcgcgtt

SEQ ID NO: 212977 - DNA, 20 bp, Artificial Sequence
  Description of Artificial Sequence: Synthetic oligonucleotide
gcaccggcccaggcgcgctt

SEQ ID NO: 212978 - DNA, 20 bp, Artificial Sequence
  Description of Artificial Sequence: Synthetic oligonucleotide
caccggcccaggcgcgcgtt

SEQ ID NO: 212979 - DNA, 20 bp, Artificial Sequence
  Description of Artificial Sequence: Synthetic oligonucleotide
accggcccaggcgcgcggtt

SEQ ID NO: 212980 - DNA, 20 bp, Artificial Sequence
  Description of Artificial Sequence: Synthetic oligonucleotide
ccggcccaggcgcgcggttt

SEQ ID NO: 212981 - DNA, 20 bp, Artificial Sequence
  Description of Artificial Sequence: Synthetic oligonucleotide
cggcccaggcgcgcgggttt

SEQ ID NO: 212982 - DNA, 20 bp, Artificial Sequence
  Description of Artificial Sequence: Synthetic oligonucleotide
ggcccaggcgcgcggggttt

SEQ ID NO: 212983 - DNA, 20 bp, Artificial Sequence
  Description of Artificial Sequence: Synthetic oligonucleotide
gcccaggcgcgcggggcttt

SEQ ID NO: 212984 - DNA, 20 bp, Artificial Sequence
  Description of Artificial Sequence: Synthetic oligonucleotide
cccaggcgcgcggggccttt

SEQ ID NO: 212985 - DNA, 20 bp, Artificial Sequence
  Description of Artificial Sequence: Synthetic oligonucleotide
ccaggcgcgcggggcccttt

SEQ ID NO: 212986 - DNA, 20 bp, Artificial Sequence
  Description of Artificial Sequence: Synthetic oligonucleotide
caggcgcgcggggccccttt

SEQ ID NO: 212987 - DNA, 20 bp, Artificial Sequence
  Description of Artificial Sequence: Synthetic oligonucleotide
aggcgcgcggggccccgttt

SEQ ID NO: 212988 - DNA, 20 bp, Artificial Sequence
  Description of Artificial Sequence: Synthetic oligonucleotide
ggcgcgcggggccccgtttt

SEQ ID NO: 212989 - DNA, 20 bp, Artificial Sequence
  Description of Artificial Sequence: Synthetic oligonucleotide
gcgcgcggggccccgctttt

SEQ ID NO: 212990 - DNA, 20 bp, Artificial Sequence
  Description of Artificial Sequence: Synthetic oligonucleotide
cgcgcggggccccgcgtttt

SEQ ID NO: 212991 - DNA, 20 bp, Artificial Sequence
  Description of Artificial Sequence: Synthetic oligonucleotide
gcgcggggccccgcggtttt

SEQ ID NO: 212992 - DNA, 20 bp, Artificial Sequence
  Description of Artificial Sequence: Synthetic oligonucleotide
cgcggggccccgcggctttt

SEQ ID NO: 212993 - DNA, 20 bp, Artificial Sequence
  Description of Artificial Sequence: Synthetic oligonucleotide
gcggggccccgcggctgttt

SEQ ID NO: 212994 - DNA, 20 bp, Artificial Sequence
  Description of Artificial Sequence: Synthetic oligonucleotide
cggggccccgcggctgcttt

SEQ ID NO: 212995 - DNA, 20 bp, Artificial Sequence
  Description of Artificial Sequence: Synthetic oligonucleotide
ggggccccgcggctgctgtt

SEQ ID NO: 212996 - DNA, 20 bp, Artificial Sequence
  Description of Artificial Sequence: Synthetic oligonucleotide
gggccccgcggctgctgttg

SEQ ID NO: 212997 - DNA, 21 bp, Artificial Sequence
  Description of Artificial Sequence: Synthetic oligonucleotide
ggccccgcggctgctgttgct

SEQ ID NO: 212998 - DNA, 21 bp, Artificial Sequence
  Description of Artificial Sequence: Synthetic oligonucleotide
gccccgcggctgctgttgctc

SEQ ID NO: 212999 - DNA, 21 bp, Artificial Sequence
  Description of Artificial Sequence: Synthetic oligonucleotide
ccccgcggctgctgttgctcg

SEQ ID NO: 213000 - DNA, 22 bp, Artificial Sequence
  Description of Artificial Sequence: Synthetic oligonucleotide
cccgcggctgctgttgctcgca

SEQ ID NO: 213001 - DNA, 23 bp, Artificial Sequence
  Description of Artificial Sequence: Synthetic oligonucleotide
ccgcggctgctgttgctcgcagt

SEQ ID NO: 213002 - DNA, 23 bp, Artificial Sequence
  Description of Artificial Sequence: Synthetic oligonucleotide
cgcggctgctgttgctcgcagtc

SEQ ID NO: 213003 - DNA, 24 bp, Artificial Sequence
  Description of Artificial Sequence: Synthetic oligonucleotide
gcggctgctgttgctcgcagtcct

SEQ ID NO: 213004 - DNA, 24 bp, Artificial Sequence
  Description of Artificial Sequence: Synthetic oligonucleotide
cggctgctgttgctcgcagtcctg

SEQ ID NO: 213005 - DNA, 25 bp, Artificial Sequence
  Description of Artificial Sequence: Synthetic oligonucleotide
ggctgctgttgctcgcagtcctgct

SEQ ID NO: 213006 - DNA, 25 bp, Artificial Sequence
  Description of Artificial Sequence: Synthetic oligonucleotide
gctgctgttgctcgcagtcctgctg

SEQ ID NO: 213007 - DNA, 25 bp, Artificial Sequence
  Description of Artificial Sequence: Synthetic oligonucleotide
ctgctgttgctcgcagtcctgctgg

SEQ ID NO: 213008 - DNA, 25 bp, Artificial Sequence
  Description of Artificial Sequence: Synthetic oligonucleotide
tgctgttgctcgcagtcctgctggc

SEQ ID NO: 213009 - DNA, 24 bp, Artificial Sequence
  Description of Artificial Sequence: Synthetic oligonucleotide
gctgttgctcgcagtcctgctggc

SEQ ID NO: 213010 - DNA, 24 bp, Artificial Sequence
  Description of Artificial Sequence: Synthetic oligonucleotide
ctgttgctcgcagtcctgctggcg

SEQ ID NO: 213011 - DNA, 24 bp, Artificial Sequence
  Description of Artificial Sequence: Synthetic oligonucleotide
tgttgctcgcagtcctgctggcgg

SEQ ID NO: 213012 - DNA, 23 bp, Artificial Sequence
  Description of Artificial Sequence: Synthetic oligonucleotide
gttgctcgcagtcctgctggcgg

SEQ ID NO: 213013 - DNA, 23 bp, Artificial Sequence
  Description of Artificial Sequence: Synthetic oligonucleotide
ttgctcgcagtcctgctggcggc

SEQ ID NO: 213014 - DNA, 22 bp, Artificial Sequence
  Description of Artificial Sequence: Synthetic oligonucleotide
tgctcgcagtcctgctggcggc

SEQ ID NO: 213015 - DNA, 21 bp, Artificial Sequence
  Description of Artificial Sequence: Synthetic oligonucleotide
gctcgcagtcctgctggcggc

SEQ ID NO: 213016 - DNA, 21 bp, Artificial Sequence
  Description of Artificial Sequence: Synthetic oligonucleotide
ctcgcagtcctgctggcggcg

SEQ ID NO: 213017 - DNA, 22 bp, Artificial Sequence
  Description of Artificial Sequence: Synthetic oligonucleotide
tcgcagtcctgctggcggcgca

SEQ ID NO: 213018 - DNA, 21 bp, Artificial Sequence
  Description of Artificial Sequence: Synthetic oligonucleotide
cgcagtcctgctggcggcgca

SEQ ID NO: 213019 - DNA, 21 bp, Artificial Sequence
  Description of Artificial Sequence: Synthetic oligonucleotide
gcagtcctgctggcggcgcac

SEQ ID NO: 213020 - DNA, 21 bp, Artificial Sequence
  Description of Artificial Sequence: Synthetic oligonucleotide
cagtcctgctggcggcgcacc

SEQ ID NO: 213021 - DNA, 22 bp, Artificial Sequence
  Description of Artificial Sequence: Synthetic oligonucleotide
agtcctgctggcggcgcaccca

SEQ ID NO: 213022 - DNA, 21 bp, Artificial Sequence
  Description of Artificial Sequence: Synthetic oligonucleotide
gtcctgctggcggcgcaccca

SEQ ID NO: 213023 - DNA, 23 bp, Artificial Sequence
  Description of Artificial Sequence: Synthetic oligonucleotide
tcctgctggcggcgcacccagat

SEQ ID NO: 213024 - DNA, 22 bp, Artificial Sequence
  Description of Artificial Sequence: Synthetic oligonucleotide
cctgctggcggcgcacccagat

SEQ ID NO: 213025 - DNA, 22 bp, Artificial Sequence
  Description of Artificial Sequence: Synthetic oligonucleotide
ctgctggcggcgcacccagatg

SEQ ID NO: 213026 - DNA, 22 bp, Artificial Sequence
  Description of Artificial Sequence: Synthetic oligonucleotide
tgctggcggcgcacccagatgc

SEQ ID NO: 213027 - DNA, 21 bp, Artificial Sequence
  Description of Artificial Sequence: Synthetic oligonucleotide
gctggcggcgcacccagatgc

SEQ ID NO: 213028 - DNA, 21 bp, Artificial Sequence
  Description of Artificial Sequence: Synthetic oligonucleotide
ctggcggcgcacccagatgcc

SEQ ID NO: 213029 - DNA, 22 bp, Artificial Sequence
  Description of Artificial Sequence: Synthetic oligonucleotide
tggcggcgcacccagatgccca

SEQ ID NO: 213030 - DNA, 21 bp, Artificial Sequence
  Description of Artificial Sequence: Synthetic oligonucleotide
ggcggcgcacccagatgccca

SEQ ID NO: 213031 - DNA, 21 bp, Artificial Sequence
  Description of Artificial Sequence: Synthetic oligonucleotide
gcggcgcacccagatgcccag

SEQ ID NO: 213032 - DNA, 21 bp, Artificial Sequence
  Description of Artificial Sequence: Synthetic oligonucleotide
cggcgcacccagatgcccagg

SEQ ID NO: 213033 - DNA, 21 bp, Artificial Sequence
  Description of Artificial Sequence: Synthetic oligonucleotide
ggcgcacccagatgcccaggc

SEQ ID NO: 213034 - DNA, 21 bp, Artificial Sequence
  Description of Artificial Sequence: Synthetic oligonucleotide
gcgcacccagatgcccaggcg

SEQ ID NO: 213035 - DNA, 22 bp, Artificial Sequence
  Description of Artificial Sequence: Synthetic oligonucleotide
cgcacccagatgcccaggcgga

SEQ ID NO: 213036 - DNA, 22 bp, Artificial Sequence
  Description of Artificial Sequence: Synthetic oligonucleotide
gcacccagatgcccaggcggag

SEQ ID NO: 213037 - DNA, 23 bp, Artificial Sequence
  Description of Artificial Sequence: Synthetic oligonucleotide
cacccagatgcccaggcggaggt

SEQ ID NO: 213038 - DNA, 23 bp, Artificial Sequence
  Description of Artificial Sequence: Synthetic oligonucleotide
acccagatgcccaggcggaggtg

SEQ ID NO: 213039 - DNA, 22 bp, Artificial Sequence
  Description of Artificial Sequence: Synthetic oligonucleotide
cccagatgcccaggcggaggtg

SEQ ID NO: 213040 - DNA, 22 bp, Artificial Sequence
  Description of Artificial Sequence: Synthetic oligonucleotide
ccagatgcccaggcggaggtgc

SEQ ID NO: 213041 - DNA, 22 bp, Artificial Sequence
  Description of Artificial Sequence: Synthetic oligonucleotide
cagatgcccaggcggaggtgcg

SEQ ID NO: 213042 - DNA, 24 bp, Artificial Sequence
  Description of Artificial Sequence: Synthetic oligonucleotide
agatgcccaggcggaggtgcgctt

SEQ ID NO: 213043 - DNA, 23 bp, Artificial Sequence
  Description of Artificial Sequence: Synthetic oligonucleotide
gatgcccaggcggaggtgcgctt

SEQ ID NO: 213044 - DNA, 24 bp, Artificial Sequence
  Description of Artificial Sequence: Synthetic oligonucleotide
atgcccaggcggaggtgcgcttgt

SEQ ID NO: 213045 - DNA, 23 bp, Artificial Sequence
  Description of Artificial Sequence: Synthetic oligonucleotide
tgcccaggcggaggtgcgcttgt

SEQ ID NO: 213046 - DNA, 22 bp, Artificial Sequence
  Description of Artificial Sequence: Synthetic oligonucleotide
gcccaggcggaggtgcgcttgt

SEQ ID NO: 213047 - DNA, 23 bp, Artificial Sequence
  Description of Artificial Sequence: Synthetic oligonucleotide
cccaggcggaggtgcgcttgtct

SEQ ID NO: 213048 - DNA, 25 bp, Artificial Sequence
  Description of Artificial Sequence: Synthetic oligonucleotide
ccaggcggaggtgcgcttgtctgta

SEQ ID NO: 213049 - DNA, 25 bp, Artificial Sequence
  Description of Artificial Sequence: Synthetic oligonucleotide
caggcggaggtgcgcttgtctgtac

SEQ ID NO: 213050 - DNA, 25 bp, Artificial Sequence
  Description of Artificial Sequence: Synthetic oligonucleotide
aggcggaggtgcgcttgtctgtacc

SEQ ID NO: 213051 - DNA, 24 bp, Artificial Sequence
  Description of Artificial Sequence: Synthetic oligonucleotide
ggcggaggtgcgcttgtctgtacc

SEQ ID NO: 213052 - DNA, 24 bp, Artificial Sequence
  Description of Artificial Sequence: Synthetic oligonucleotide
gcggaggtgcgcttgtctgtaccc

SEQ ID NO: 213053 - DNA, 24 bp, Artificial Sequence
  Description of Artificial Sequence: Synthetic oligonucleotide
cggaggtgcgcttgtctgtacccc

SEQ ID NO: 213054 - DNA, 24 bp, Artificial Sequence
  Description of Artificial Sequence: Synthetic oligonucleotide
ggaggtgcgcttgtctgtaccccc

SEQ ID NO: 213055 - DNA, 24 bp, Artificial Sequence
  Description of Artificial Sequence: Synthetic oligonucleotide
gaggtgcgcttgtctgtacccccg

SEQ ID NO: 213056 - DNA, 25 bp, Artificial Sequence
  Description of Artificial Sequence: Synthetic oligonucleotide
aggtgcgcttgtctgtacccccgct

SEQ ID NO: 213057 - DNA, 24 bp, Artificial Sequence
  Description of Artificial Sequence: Synthetic oligonucleotide
ggtgcgcttgtctgtacccccgct

SEQ ID NO: 213058 - DNA, 24 bp, Artificial Sequence
  Description of Artificial Sequence: Synthetic oligonucleotide
gtgcgcttgtctgtacccccgctg

SEQ ID NO: 213059 - DNA, 25 bp, Artificial Sequence
  Description of Artificial Sequence: Synthetic oligonucleotide
tgcgcttgtctgtacccccgctggt

SEQ ID NO: 213060 - DNA, 24 bp, Artificial Sequence
  Description of Artificial Sequence: Synthetic oligonucleotide
gcgcttgtctgtacccccgctggt

SEQ ID NO: 213061 - DNA, 24 bp, Artificial Sequence
  Description of Artificial Sequence: Synthetic oligonucleotide
cgcttgtctgtacccccgctggtg

SEQ ID NO: 213062 - DNA, 25 bp, Artificial Sequence
  Description of Artificial Sequence: Synthetic oligonucleotide
gcttgtctgtacccccgctggtgga

SEQ ID NO: 213063 - DNA, 25 bp, Artificial Sequence
  Description of Artificial Sequence: Synthetic oligonucleotide
cttgtctgtacccccgctggtggag

SEQ ID NO: 213064 - DNA, 26 bp, Artificial Sequence
  Description of Artificial Sequence: Synthetic oligonucleotide
ttgtctgtacccccgctggtggaggt

SEQ ID NO: 213065 - DNA, 25 bp, Artificial Sequence
  Description of Artificial Sequence: Synthetic oligonucleotide
tgtctgtacccccgctggtggaggt

SEQ ID NO: 213066 - DNA, 24 bp, Artificial Sequence
  Description of Artificial Sequence: Synthetic oligonucleotide
gtctgtacccccgctggtggaggt

SEQ ID NO: 213067 - DNA, 26 bp, Artificial Sequence
  Description of Artificial Sequence: Synthetic oligonucleotide
tctgtacccccgctggtggaggtgat

SEQ ID NO: 213068 - DNA, 25 bp, Artificial Sequence
  Description of Artificial Sequence: Synthetic oligonucleotide
ctgtacccccgctggtggaggtgat

SEQ ID NO: 213069 - DNA, 25 bp, Artificial Sequence
  Description of Artificial Sequence: Synthetic oligonucleotide
tgtacccccgctggtggaggtgatg

SEQ ID NO: 213070 - DNA, 24 bp, Artificial Sequence
  Description of Artificial Sequence: Synthetic oligonucleotide
gtacccccgctggtggaggtgatg

SEQ ID NO: 213071 - DNA, 24 bp, Artificial Sequence
  Description of Artificial Sequence: Synthetic oligonucleotide
tacccccgctggtggaggtgatgc

SEQ ID NO: 213072 - DNA, 23 bp, Artificial Sequence
  Description of Artificial Sequence: Synthetic oligonucleotide
acccccgctggtggaggtgatgc

SEQ ID NO: 213073 - DNA, 22 bp, Artificial Sequence
  Description of Artificial Sequence: Synthetic oligonucleotide
cccccgctggtggaggtgatgc

SEQ ID NO: 213074 - DNA, 23 bp, Artificial Sequence
  Description of Artificial Sequence: Synthetic oligonucleotide
ccccgctggtggaggtgatgcga

SEQ ID NO: 213075 - DNA, 23 bp, Artificial Sequence
  Description of Artificial Sequence: Synthetic oligonucleotide
cccgctggtggaggtgatgcgag

SEQ ID NO: 213076 - DNA, 26 bp, Artificial Sequence
  Description of Artificial Sequence: Synthetic oligonucleotide
ccgctggtggaggtgatgcgaggaaa

SEQ ID NO: 213077 - DNA, 27 bp, Artificial Sequence
  Description of Artificial Sequence: Synthetic oligonucleotide
cgctggtggaggtgatgcgaggaaagt

SEQ ID NO: 213078 - DNA, 27 bp, Artificial Sequence
  Description of Artificial Sequence: Synthetic oligonucleotide
gctggtggaggtgatgcgaggaaagtc

SEQ ID NO: 213079 - DNA, 28 bp, Artificial Sequence
  Description of Artificial Sequence: Synthetic oligonucleotide
ctggtggaggtgatgcgaggaaagtctg

SEQ ID NO: 213080 - DNA, 29 bp, Artificial Sequence
  Description of Artificial Sequence: Synthetic oligonucleotide
tggtggaggtgatgcgaggaaagtctgtc

SEQ ID NO: 213081 - DNA, 28 bp, Artificial Sequence
  Description of Artificial Sequence: Synthetic oligonucleotide
ggtggaggtgatgcgaggaaagtctgtc

SEQ ID NO: 213082 - DNA, 31 bp, Artificial Sequence
  Description of Artificial Sequence: Synthetic oligonucleotide
gtggaggtgatgcgaggaaagtctgtcattc

SEQ ID NO: 213083 - DNA, 32 bp, Artificial Sequence
  Description of Artificial Sequence: Synthetic oligonucleotide
tggaggtgatgcgaggaaagtctgtcattctg

SEQ ID NO: 213084 - DNA, 31 bp, Artificial Sequence
  Description of Artificial Sequence: Synthetic oligonucleotide
ggaggtgatgcgaggaaagtctgtcattctg

SEQ ID NO: 213085 - DNA, 31 bp, Artificial Sequence
  Description of Artificial Sequence: Synthetic oligonucleotide
gaggtgatgcgaggaaagtctgtcattctgg

SEQ ID NO: 213086 - DNA, 32 bp, Artificial Sequence
  Description of Artificial Sequence: Synthetic oligonucleotide
aggtgatgcgaggaaagtctgtcattctggac

SEQ ID NO: 213087 - DNA, 31 bp, Artificial Sequence
  Description of Artificial Sequence: Synthetic oligonucleotide
ggtgatgcgaggaaagtctgtcattctggac

SEQ ID NO: 213088 - DNA, 32 bp, Artificial Sequence
  Description of Artificial Sequence: Synthetic oligonucleotide
gtgatgcgaggaaagtctgtcattctggactg

SEQ ID NO: 213089 - DNA, 32 bp, Artificial Sequence
  Description of Artificial Sequence: Synthetic oligonucleotide
tgatgcgaggaaagtctgtcattctggactgc

SEQ ID NO: 213090 - DNA, 31 bp, Artificial Sequence
  Description of Artificial Sequence: Synthetic oligonucleotide
gatgcgaggaaagtctgtcattctggactgc

SEQ ID NO: 213091 - DNA, 32 bp, Artificial Sequence
  Description of Artificial Sequence: Synthetic oligonucleotide
atgcgaggaaagtctgtcattctggactgcac

SEQ ID NO: 213092 - DNA, 31 bp, Artificial Sequence
  Description of Artificial Sequence: Synthetic oligonucleotide
tgcgaggaaagtctgtcattctggactgcac

SEQ ID NO: 213093 - DNA, 30 bp, Artificial Sequence
  Description of Artificial Sequence: Synthetic oligonucleotide
gcgaggaaagtctgtcattctggactgcac

SEQ ID NO: 213094 - DNA, 30 bp, Artificial Sequence
  Description of Artificial Sequence: Synthetic oligonucleotide
cgaggaaagtctgtcattctggactgcacc

SEQ ID NO: 213095 - DNA, 30 bp, Artificial Sequence
  Description of Artificial Sequence: Synthetic oligonucleotide
gaggaaagtctgtcattctggactgcaccc

SEQ ID NO: 213096 - DNA, 30 bp, Artificial Sequence
  Description of Artificial Sequence: Synthetic oligonucleotide
aggaaagtctgtcattctggactgcacccc

SEQ ID NO: 213097 - DNA, 29 bp, Artificial Sequence
  Description of Artificial Sequence: Synthetic oligonucleotide
ggaaagtctgtcattctggactgcacccc

SEQ ID NO: 213098 - DNA, 31 bp, Artificial Sequence
  Description of Artificial Sequence: Synthetic oligonucleotide
gaaagtctgtcattctggactgcacccctac

SEQ ID NO: 213099 - DNA, 31 bp, Artificial Sequence
  Description of Artificial Sequence: Synthetic oligonucleotide
aaagtctgtcattctggactgcacccctacg

SEQ ID NO: 213100 - DNA, 30 bp, Artificial Sequence
  Description of Artificial Sequence: Synthetic oligonucleotide
aagtctgtcattctggactgcacccctacg

SEQ ID NO: 213101 - DNA, 29 bp, Artificial Sequence
  Description of Artificial Sequence: Synthetic oligonucleotide
agtctgtcattctggactgcacccctacg

SEQ ID NO: 213102 - DNA, 28 bp, Artificial Sequence
  Description of Artificial Sequence: Synthetic oligonucleotide
gtctgtcattctggactgcacccctacg

SEQ ID NO: 213103 - DNA, 28 bp, Artificial Sequence
  Description of Artificial Sequence: Synthetic oligonucleotide
tctgtcattctggactgcacccctacgg

SEQ ID NO: 213104 - DNA, 27 bp, Artificial Sequence
  Description of Artificial Sequence: Synthetic oligonucleotide
ctgtcattctggactgcacccctacgg

SEQ ID NO: 213105 - DNA, 27 bp, Artificial Sequence
  Description of Artificial Sequence: Synthetic oligonucleotide
tgtcattctggactgcacccctacggg

SEQ ID NO: 213106 - DNA, 27 bp, Artificial Sequence
  Description of Artificial Sequence: Synthetic oligonucleotide
gtcattctggactgcacccctacggga

SEQ ID NO: 213107 - DNA, 28 bp, Artificial Sequence
  Description of Artificial Sequence: Synthetic oligonucleotide
tcattctggactgcacccctacgggaac

SEQ ID NO: 213108 - DNA, 27 bp, Artificial Sequence
  Description of Artificial Sequence: Synthetic oligonucleotide
cattctggactgcacccctacgggaac

SEQ ID NO: 213109 - DNA, 27 bp, Artificial Sequence
  Description of Artificial Sequence: Synthetic oligonucleotide
attctggactgcacccctacgggaacc

SEQ ID NO: 213110 - DNA, 26 bp, Artificial Sequence
  Description of Artificial Sequence: Synthetic oligonucleotide
ttctggactgcacccctacgggaacc

SEQ ID NO: 213111 - DNA, 25 bp, Artificial Sequence
  Description of Artificial Sequence: Synthetic oligonucleotide
tctggactgcacccctacgggaacc

SEQ ID NO: 213112 - DNA, 24 bp, Artificial Sequence
  Description of Artificial Sequence: Synthetic oligonucleotide
ctggactgcacccctacgggaacc

SEQ ID NO: 213113 - DNA, 25 bp, Artificial Sequence
  Description of Artificial Sequence: Synthetic oligonucleotide
tggactgcacccctacgggaaccca

SEQ ID NO: 213114 - DNA, 24 bp, Artificial Sequence
  Description of Artificial Sequence: Synthetic oligonucleotide
ggactgcacccctacgggaaccca

SEQ ID NO: 213115 - DNA, 24 bp, Artificial Sequence
  Description of Artificial Sequence: Synthetic oligonucleotide
gactgcacccctacgggaacccac

SEQ ID NO: 213116 - DNA, 25 bp, Artificial Sequence
  Description of Artificial Sequence: Synthetic oligonucleotide
actgcacccctacgggaacccacga

SEQ ID NO: 213117 - DNA, 24 bp, Artificial Sequence
  Description of Artificial Sequence: Synthetic oligonucleotide
ctgcacccctacgggaacccacga

SEQ ID NO: 213118 - DNA, 24 bp, Artificial Sequence
  Description of Artificial Sequence: Synthetic oligonucleotide
tgcacccctacgggaacccacgac

SEQ ID NO: 213119 - DNA, 23 bp, Artificial Sequence
  Description of Artificial Sequence: Synthetic oligonucleotide
gcacccctacgggaacccacgac

SEQ ID NO: 213120 - DNA, 27 bp, Artificial Sequence
  Description of Artificial Sequence: Synthetic oligonucleotide
cacccctacgggaacccacgaccatta

SEQ ID NO: 213121 - DNA, 30 bp, Artificial Sequence
  Description of Artificial Sequence: Synthetic oligonucleotide
acccctacgggaacccacgaccattatatg

SEQ ID NO: 213122 - DNA, 29 bp, Artificial Sequence
  Description of Artificial Sequence: Synthetic oligonucleotide
cccctacgggaacccacgaccattatatg

SEQ ID NO: 213123 - DNA, 29 bp, Artificial Sequence
  Description of Artificial Sequence: Synthetic oligonucleotide
ccctacgggaacccacgaccattatatgc

SEQ ID NO: 213124 - DNA, 30 bp, Artificial Sequence
  Description of Artificial Sequence: Synthetic oligonucleotide
cctacgggaacccacgaccattatatgctg

SEQ ID NO: 213125 - DNA, 30 bp, Artificial Sequence
  Description of Artificial Sequence: Synthetic oligonucleotide
ctacgggaacccacgaccattatatgctgg

SEQ ID NO: 213126 - DNA, 33 bp, Artificial Sequence
  Description of Artificial Sequence: Synthetic oligonucleotide
tacgggaacccacgaccattatatgctggaatg

SEQ ID NO: 213127 - DNA, 32 bp, Artificial Sequence
  Description of Artificial Sequence: Synthetic oligonucleotide
acgggaacccacgaccattatatgctggaatg

SEQ ID NO: 213128 - DNA, 31 bp, Artificial Sequence
  Description of Artificial Sequence: Synthetic oligonucleotide
cgggaacccacgaccattatatgctggaatg

SEQ ID NO: 213129 - DNA, 31 bp, Artificial Sequence
  Description of Artificial Sequence: Synthetic oligonucleotide
gggaacccacgaccattatatgctggaatgg

SEQ ID NO: 213130 - DNA, 33 bp, Artificial Sequence
  Description of Artificial Sequence: Synthetic oligonucleotide
ggaacccacgaccattatatgctggaatggttc

SEQ ID NO: 213131 - DNA, 33 bp, Artificial Sequence
  Description of Artificial Sequence: Synthetic oligonucleotide
gaacccacgaccattatatgctggaatggttcc

SEQ ID NO: 213132 - DNA, 36 bp, Artificial Sequence
  Description of Artificial Sequence: Synthetic oligonucleotide
aacccacgaccattatatgctggaatggttccttac

SEQ ID NO: 213133 - DNA, 35 bp, Artificial Sequence
  Description of Artificial Sequence: Synthetic oligonucleotide
acccacgaccattatatgctggaatggttccttac

SEQ ID NO: 213134 - DNA, 34 bp, Artificial Sequence
  Description of Artificial Sequence: Synthetic oligonucleotide
cccacgaccattatatgctggaatggttccttac

SEQ ID NO: 213135 - DNA, 34 bp, Artificial Sequence
  Description of Artificial Sequence: Synthetic oligonucleotide
ccacgaccattatatgctggaatggttccttacc

SEQ ID NO: 213136 - DNA, 34 bp, Artificial Sequence
  Description of Artificial Sequence: Synthetic oligonucleotide
cacgaccattatatgctggaatggttccttaccg

SEQ ID NO: 213137 - DNA, 35 bp, Artificial Sequence
  Description of Artificial Sequence: Synthetic oligonucleotide
acgaccattatatgctggaatggttccttaccgac

SEQ ID NO: 213138 - DNA, 34 bp, Artificial Sequence
  Description of Artificial Sequence: Synthetic oligonucleotide
cgaccattatatgctggaatggttccttaccgac

SEQ ID NO: 213139 - DNA, 34 bp, Artificial Sequence
  Description of Artificial Sequence: Synthetic oligonucleotide
gaccattatatgctggaatggttccttaccgacc

SEQ ID NO: 213140 - DNA, 34 bp, Artificial Sequence
  Description of Artificial Sequence: Synthetic oligonucleotide
accattatatgctggaatggttccttaccgaccg

SEQ ID NO: 213141 - DNA, 33 bp, Artificial Sequence
  Description of Artificial Sequence: Synthetic oligonucleotide
ccattatatgctggaatggttccttaccgaccg

SEQ ID NO: 213142 - DNA, 33 bp, Artificial Sequence
  Description of Artificial Sequence: Synthetic oligonucleotide
cattatatgctggaatggttccttaccgaccgc

SEQ ID NO: 213143 - DNA, 34 bp, Artificial Sequence
  Description of Artificial Sequence: Synthetic oligonucleotide
attatatgctggaatggttccttaccgaccgctc

SEQ ID NO: 213144 - DNA, 33 bp, Artificial Sequence
  Description of Artificial Sequence: Synthetic oligonucleotide
ttatatgctggaatggttccttaccgaccgctc

SEQ ID NO: 213145 - DNA, 32 bp, Artificial Sequence
  Description of Artificial Sequence: Synthetic oligonucleotide
tatatgctggaatggttccttaccgaccgctc

SEQ ID NO: 213146 - DNA, 31 bp, Artificial Sequence
  Description of Artificial Sequence: Synthetic oligonucleotide
atatgctggaatggttccttaccgaccgctc

SEQ ID NO: 213147 - DNA, 30 bp, Artificial Sequence
  Description of Artificial Sequence: Synthetic oligonucleotide
tatgctggaatggttccttaccgaccgctc

SEQ ID NO: 213148 - DNA, 29 bp, Artificial Sequence
  Description of Artificial Sequence: Synthetic oligonucleotide
atgctggaatggttccttaccgaccgctc

SEQ ID NO: 213149 - DNA, 28 bp, Artificial Sequence
  Description of Artificial Sequence: Synthetic oligonucleotide
tgctggaatggttccttaccgaccgctc

SEQ ID NO: 213150 - DNA, 27 bp, Artificial Sequence
  Description of Artificial Sequence: Synthetic oligonucleotide
gctggaatggttccttaccgaccgctc

SEQ ID NO: 213151 - DNA, 27 bp, Artificial Sequence
  Description of Artificial Sequence: Synthetic oligonucleotide
ctggaatggttccttaccgaccgctcg

SEQ ID NO: 213152 - DNA, 27 bp, Artificial Sequence
  Description of Artificial Sequence: Synthetic oligonucleotide
tggaatggttccttaccgaccgctcgg

SEQ ID NO: 213153 - DNA, 26 bp, Artificial Sequence
  Description of Artificial Sequence: Synthetic oligonucleotide
ggaatggttccttaccgaccgctcgg

SEQ ID NO: 213154 - DNA, 27 bp, Artificial Sequence
  Description of Artificial Sequence: Synthetic oligonucleotide
gaatggttccttaccgaccgctcggga

SEQ ID NO: 213155 - DNA, 27 bp, Artificial Sequence
  Description of Artificial Sequence: Synthetic oligonucleotide
aatggttccttaccgaccgctcgggag

SEQ ID NO: 213156 - DNA, 26 bp, Artificial Sequence
  Description of Artificial Sequence: Synthetic oligonucleotide
atggttccttaccgaccgctcgggag

SEQ ID NO: 213157 - DNA, 25 bp, Artificial Sequence
  Description of Artificial Sequence: Synthetic oligonucleotide
tggttccttaccgaccgctcgggag

SEQ ID NO: 213158 - DNA, 24 bp, Artificial Sequence
  Description of Artificial Sequence: Synthetic oligonucleotide
ggttccttaccgaccgctcgggag

SEQ ID NO: 213159 - DNA, 25 bp, Artificial Sequence
  Description of Artificial Sequence: Synthetic oligonucleotide
gttccttaccgaccgctcgggagct

SEQ ID NO: 213160 - DNA, 25 bp, Artificial Sequence
  Description of Artificial Sequence: Synthetic oligonucleotide
ttccttaccgaccgctcgggagctc

SEQ ID NO: 213161 - DNA, 24 bp, Artificial Sequence
  Description of Artificial Sequence: Synthetic oligonucleotide
tccttaccgaccgctcgggagctc

SEQ ID NO: 213162 - DNA, 23 bp, Artificial Sequence
  Description of Artificial Sequence: Synthetic oligonucleotide
ccttaccgaccgctcgggagctc

SEQ ID NO: 213163 - DNA, 23 bp, Artificial Sequence
  Description of Artificial Sequence: Synthetic oligonucleotide
cttaccgaccgctcgggagctcg

SEQ ID NO: 213164 - DNA, 23 bp, Artificial Sequence
  Description of Artificial Sequence: Synthetic oligonucleotide
ttaccgaccgctcgggagctcgc

SEQ ID NO: 213165 - DNA, 22 bp, Artificial Sequence
  Description of Artificial Sequence: Synthetic oligonucleotide
taccgaccgctcgggagctcgc

SEQ ID NO: 213166 - DNA, 21 bp, Artificial Sequence
  Description of Artificial Sequence: Synthetic oligonucleotide
accgaccgctcgggagctcgc

SEQ ID NO: 213167 - DNA, 20 bp, Artificial Sequence
  Description of Artificial Sequence: Synthetic oligonucleotide
ccgaccgctcgggagctcgc

SEQ ID NO: 213168 - DNA, 20 bp, Artificial Sequence
  Description of Artificial Sequence: Synthetic oligonucleotide
cgaccgctcgggagctcgcc

SEQ ID NO: 213169 - DNA, 20 bp, Artificial Sequence
  Description of Artificial Sequence: Synthetic oligonucleotide
gaccgctcgggagctcgccc

SEQ ID NO: 213170 - DNA, 20 bp, Artificial Sequence
  Description of Artificial Sequence: Synthetic oligonucleotide
accgctcgggagctcgcccc

SEQ ID NO: 213171 - DNA, 20 bp, Artificial Sequence
  Description of Artificial Sequence: Synthetic oligonucleotide
ccgctcgggagctcgcccct

SEQ ID NO: 213172 - DNA, 20 bp, Artificial Sequence
  Description of Artificial Sequence: Synthetic oligonucleotide
cgctcgggagctcgccccct

SEQ ID NO: 213173 - DNA, 20 bp, Artificial Sequence
  Description of Artificial Sequence: Synthetic oligonucleotide
gctcgggagctcgcccccgt

SEQ ID NO: 213174 - DNA, 20 bp, Artificial Sequence
  Description of Artificial Sequence: Synthetic oligonucleotide
ctcgggagctcgcccccgct

SEQ ID NO: 213175 - DNA, 21 bp, Artificial Sequence
  Description of Artificial Sequence: Synthetic oligonucleotide
tcgggagctcgcccccgccta

SEQ ID NO: 213176 - DNA, 20 bp, Artificial Sequence
  Description of Artificial Sequence: Synthetic oligonucleotide
cgggagctcgcccccgccta

SEQ ID NO: 213177 - DNA, 20 bp, Artificial Sequence
  Description of Artificial Sequence: Synthetic oligonucleotide
gggagctcgcccccgcctag

SEQ ID NO: 213178 - DNA, 20 bp, Artificial Sequence
  Description of Artificial Sequence: Synthetic oligonucleotide
ggagctcgcccccgcctagc

SEQ ID NO: 213179 - DNA, 21 bp, Artificial Sequence
  Description of Artificial Sequence: Synthetic oligonucleotide
gagctcgcccccgcctagcct

SEQ ID NO: 213180 - DNA, 21 bp, Artificial Sequence
  Description of Artificial Sequence: Synthetic oligonucleotide
agctcgcccccgcctagcctc

SEQ ID NO: 213181 - DNA, 20 bp, Artificial Sequence
  Description of Artificial Sequence: Synthetic oligonucleotide
gctcgcccccgcctagcctc

SEQ ID NO: 213182 - DNA, 20 bp, Artificial Sequence
  Description of Artificial Sequence: Synthetic oligonucleotide
ctcgcccccgcctagcctcg

SEQ ID NO: 213183 - DNA, 20 bp, Artificial Sequence
  Description of Artificial Sequence: Synthetic oligonucleotide
tcgcccccgcctagcctcgg

SEQ ID NO: 213184 - DNA, 20 bp, Artificial Sequence
  Description of Artificial Sequence: Synthetic oligonucleotide
cgcccccgcctagcctcggt

SEQ ID NO: 213185 - DNA, 20 bp, Artificial Sequence
  Description of Artificial Sequence: Synthetic oligonucleotide
gcccccgcctagcctcggct

SEQ ID NO: 213186 - DNA, 21 bp, Artificial Sequence
  Description of Artificial Sequence: Synthetic oligonucleotide
cccccgcctagcctcggctga

SEQ ID NO: 213187 - DNA, 23 bp, Artificial Sequence
  Description of Artificial Sequence: Synthetic oligonucleotide
ccccgcctagcctcggctgagat

SEQ ID NO: 213188 - DNA, 23 bp, Artificial Sequence
  Description of Artificial Sequence: Synthetic oligonucleotide
cccgcctagcctcggctgagatg

SEQ ID NO: 213189 - DNA, 24 bp, Artificial Sequence
  Description of Artificial Sequence: Synthetic oligonucleotide
ccgcctagcctcggctgagatgca

SEQ ID NO: 213190 - DNA, 24 bp, Artificial Sequence
  Description of Artificial Sequence: Synthetic oligonucleotide
cgcctagcctcggctgagatgcag

SEQ ID NO: 213191 - DNA, 24 bp, Artificial Sequence
  Description of Artificial Sequence: Synthetic oligonucleotide
gcctagcctcggctgagatgcagg

SEQ ID NO: 213192 - DNA, 24 bp, Artificial Sequence
  Description of Artificial Sequence: Synthetic oligonucleotide
cctagcctcggctgagatgcaggg

SEQ ID NO: 213193 - DNA, 25 bp, Artificial Sequence
  Description of Artificial Sequence: Synthetic oligonucleotide
ctagcctcggctgagatgcagggct

SEQ ID NO: 213194 - DNA, 26 bp, Artificial Sequence
  Description of Artificial Sequence: Synthetic oligonucleotide
tagcctcggctgagatgcagggctct

SEQ ID NO: 213195 - DNA, 25 bp, Artificial Sequence
  Description of Artificial Sequence: Synthetic oligonucleotide
agcctcggctgagatgcagggctct

SEQ ID NO: 213196 - DNA, 24 bp, Artificial Sequence
  Description of Artificial Sequence: Synthetic oligonucleotide
gcctcggctgagatgcagggctct

SEQ ID NO: 213197 - DNA, 25 bp, Artificial Sequence
  Description of Artificial Sequence: Synthetic oligonucleotide
cctcggctgagatgcagggctctga

SEQ ID NO: 213198 - DNA, 25 bp, Artificial Sequence
  Description of Artificial Sequence: Synthetic oligonucleotide
ctcggctgagatgcagggctctgag

SEQ ID NO: 213199 - DNA, 26 bp, Artificial Sequence
  Description of Artificial Sequence: Synthetic oligonucleotide
tcggctgagatgcagggctctgagct

SEQ ID NO: 213200 - DNA, 25 bp, Artificial Sequence
  Description of Artificial Sequence: Synthetic oligonucleotide
cggctgagatgcagggctctgagct

SEQ ID NO: 213201 - DNA, 25 bp, Artificial Sequence
  Description of Artificial Sequence: Synthetic oligonucleotide
ggctgagatgcagggctctgagctc

SEQ ID NO: 213202 - DNA, 26 bp, Artificial Sequence
  Description of Artificial Sequence: Synthetic oligonucleotide
gctgagatgcagggctctgagctcca

SEQ ID NO: 213203 - DNA, 26 bp, Artificial Sequence
  Description of Artificial Sequence: Synthetic oligonucleotide
ctgagatgcagggctctgagctccag

SEQ ID NO: 213204 - DNA, 27 bp, Artificial Sequence
  Description of Artificial Sequence: Synthetic oligonucleotide
tgagatgcagggctctgagctccaggt

SEQ ID NO: 213205 - DNA, 26 bp, Artificial Sequence
  Description of Artificial Sequence: Synthetic oligonucleotide
gagatgcagggctctgagctccaggt

SEQ ID NO: 213206 - DNA, 27 bp, Artificial Sequence
  Description of Artificial Sequence: Synthetic oligonucleotide
agatgcagggctctgagctccaggtca

SEQ ID NO: 213207 - DNA, 26 bp, Artificial Sequence
  Description of Artificial Sequence: Synthetic oligonucleotide
gatgcagggctctgagctccaggtca

SEQ ID NO: 213208 - DNA, 27 bp, Artificial Sequence
  Description of Artificial Sequence: Synthetic oligonucleotide
atgcagggctctgagctccaggtcaca

SEQ ID NO: 213209 - DNA, 27 bp, Artificial Sequence
  Description of Artificial Sequence: Synthetic oligonucleotide
tgcagggctctgagctccaggtcacaa

SEQ ID NO: 213210 - DNA, 27 bp, Artificial Sequence
  Description of Artificial Sequence: Synthetic oligonucleotide
gcagggctctgagctccaggtcacaat

SEQ ID NO: 213211 - DNA, 27 bp, Artificial Sequence
  Description of Artificial Sequence: Synthetic oligonucleotide
cagggctctgagctccaggtcacaatg

SEQ ID NO: 213212 - DNA, 27 bp, Artificial Sequence
  Description of Artificial Sequence: Synthetic oligonucleotide
agggctctgagctccaggtcacaatgc

SEQ ID NO: 213213 - DNA, 27 bp, Artificial Sequence
  Description of Artificial Sequence: Synthetic oligonucleotide
gggctctgagctccaggtcacaatgca

SEQ ID NO: 213214 - DNA, 27 bp, Artificial Sequence
  Description of Artificial Sequence: Synthetic oligonucleotide
ggctctgagctccaggtcacaatgcac

SEQ ID NO: 213215 - DNA, 27 bp, Artificial Sequence
  Description of Artificial Sequence: Synthetic oligonucleotide
gctctgagctccaggtcacaatgcacg

SEQ ID NO: 213216 - DNA, 28 bp, Artificial Sequence
  Description of Artificial Sequence: Synthetic oligonucleotide
ctctgagctccaggtcacaatgcacgac

SEQ ID NO: 213217 - DNA, 29 bp, Artificial Sequence
  Description of Artificial Sequence: Synthetic oligonucleotide
tctgagctccaggtcacaatgcacgacac

SEQ ID NO: 213218 - DNA, 28 bp, Artificial Sequence
  Description of Artificial Sequence: Synthetic oligonucleotide
ctgagctccaggtcacaatgcacgacac

SEQ ID NO: 213219 - DNA, 28 bp, Artificial Sequence
  Description of Artificial Sequence: Synthetic oligonucleotide
tgagctccaggtcacaatgcacgacacc

SEQ ID NO: 213220 - DNA, 27 bp, Artificial Sequence
  Description of Artificial Sequence: Synthetic oligonucleotide
gagctccaggtcacaatgcacgacacc

SEQ ID NO: 213221 - DNA, 27 bp, Artificial Sequence
  Description of Artificial Sequence: Synthetic oligonucleotide
agctccaggtcacaatgcacgacaccc

SEQ ID NO: 213222 - DNA, 26 bp, Artificial Sequence
  Description of Artificial Sequence: Synthetic oligonucleotide
gctccaggtcacaatgcacgacaccc

SEQ ID NO: 213223 - DNA, 26 bp, Artificial Sequence
  Description of Artificial Sequence: Synthetic oligonucleotide
ctccaggtcacaatgcacgacacccg

SEQ ID NO: 213224 - DNA, 26 bp, Artificial Sequence
  Description of Artificial Sequence: Synthetic oligonucleotide
tccaggtcacaatgcacgacacccgg

SEQ ID NO: 213225 - DNA, 25 bp, Artificial Sequence
  Description of Artificial Sequence: Synthetic oligonucleotide
ccaggtcacaatgcacgacacccgg

SEQ ID NO: 213226 - DNA, 25 bp, Artificial Sequence
  Description of Artificial Sequence: Synthetic oligonucleotide
caggtcacaatgcacgacacccggg

SEQ ID NO: 213227 - DNA, 25 bp, Artificial Sequence
  Description of Artificial Sequence: Synthetic oligonucleotide
aggtcacaatgcacgacacccgggg

SEQ ID NO: 213228 - DNA, 24 bp, Artificial Sequence
  Description of Artificial Sequence: Synthetic oligonucleotide
ggtcacaatgcacgacacccgggg

SEQ ID NO: 213229 - DNA, 24 bp, Artificial Sequence
  Description of Artificial Sequence: Synthetic oligonucleotide
gtcacaatgcacgacacccggggc

SEQ ID NO: 213230 - DNA, 24 bp, Artificial Sequence
  Description of Artificial Sequence: Synthetic oligonucleotide
tcacaatgcacgacacccggggcc

SEQ ID NO: 213231 - DNA, 23 bp, Artificial Sequence
  Description of Artificial Sequence: Synthetic oligonucleotide
cacaatgcacgacacccggggcc

SEQ ID NO: 213232 - DNA, 23 bp, Artificial Sequence
  Description of Artificial Sequence: Synthetic oligonucleotide
acaatgcacgacacccggggccg

SEQ ID NO: 213233 - DNA, 22 bp, Artificial Sequence
  Description of Artificial Sequence: Synthetic oligonucleotide
caatgcacgacacccggggccg

SEQ ID NO: 213234 - DNA, 23 bp, Artificial Sequence
  Description of Artificial Sequence: Synthetic oligonucleotide
aatgcacgacacccggggccgca

SEQ ID NO: 213235 - DNA, 22 bp, Artificial Sequence
  Description of Artificial Sequence: Synthetic oligonucleotide
atgcacgacacccggggccgca

SEQ ID NO: 213236 - DNA, 21 bp, Artificial Sequence
  Description of Artificial Sequence: Synthetic oligonucleotide
tgcacgacacccggggccgca

SEQ ID NO: 213237 - DNA, 20 bp, Artificial Sequence
  Description of Artificial Sequence: Synthetic oligonucleotide
gcacgacacccggggccgca

SEQ ID NO: 213238 - DNA, 21 bp, Artificial Sequence
  Description of Artificial Sequence: Synthetic oligonucleotide
cacgacacccggggccgcagt

SEQ ID NO: 213239 - DNA, 21 bp, Artificial Sequence
  Description of Artificial Sequence: Synthetic oligonucleotide
acgacacccggggccgcagtc

SEQ ID NO: 213240 - DNA, 20 bp, Artificial Sequence
  Description of Artificial Sequence: Synthetic oligonucleotide
cgacacccggggccgcagtc

SEQ ID NO: 213241 - DNA, 20 bp, Artificial Sequence
  Description of Artificial Sequence: Synthetic oligonucleotide
gacacccggggccgcagtcc

SEQ ID NO: 213242 - DNA, 20 bp, Artificial Sequence
  Description of Artificial Sequence: Synthetic oligonucleotide
acacccggggccgcagtccc

SEQ ID NO: 213243 - DNA, 20 bp, Artificial Sequence
  Description of Artificial Sequence: Synthetic oligonucleotide
cacccggggccgcagtccct

SEQ ID NO: 213244 - DNA, 20 bp, Artificial Sequence
  Description of Artificial Sequence: Synthetic oligonucleotide
acccggggccgcagtcccct

SEQ ID NO: 213245 - DNA, 20 bp, Artificial Sequence
  Description of Artificial Sequence: Synthetic oligonucleotide
cccggggccgcagtcccctt

SEQ ID NO: 213246 - DNA, 21 bp, Artificial Sequence
  Description of Artificial Sequence: Synthetic oligonucleotide
ccggggccgcagtcccccata

SEQ ID NO: 213247 - DNA, 21 bp, Artificial Sequence
  Description of Artificial Sequence: Synthetic oligonucleotide
cggggccgcagtcccccatac

SEQ ID NO: 213248 - DNA, 22 bp, Artificial Sequence
  Description of Artificial Sequence: Synthetic oligonucleotide
ggggccgcagtcccccatacca

SEQ ID NO: 213249 - DNA, 22 bp, Artificial Sequence
  Description of Artificial Sequence: Synthetic oligonucleotide
gggccgcagtcccccataccag

SEQ ID NO: 213250 - DNA, 23 bp, Artificial Sequence
  Description of Artificial Sequence: Synthetic oligonucleotide
ggccgcagtcccccataccagct

SEQ ID NO: 213251 - DNA, 23 bp, Artificial Sequence
  Description of Artificial Sequence: Synthetic oligonucleotide
gccgcagtcccccataccagctg

SEQ ID NO: 213252 - DNA, 24 bp, Artificial Sequence
  Description of Artificial Sequence: Synthetic oligonucleotide
ccgcagtcccccataccagctgga

SEQ ID NO: 213253 - DNA, 25 bp, Artificial Sequence
  Description of Artificial Sequence: Synthetic oligonucleotide
cgcagtcccccataccagctggact

SEQ ID NO: 213254 - DNA, 25 bp, Artificial Sequence
  Description of Artificial Sequence: Synthetic oligonucleotide
gcagtcccccataccagctggactc

SEQ ID NO: 213255 - DNA, 25 bp, Artificial Sequence
  Description of Artificial Sequence: Synthetic oligonucleotide
cagtcccccataccagctggactcc

SEQ ID NO: 213256 - DNA, 26 bp, Artificial Sequence
  Description of Artificial Sequence: Synthetic oligonucleotide
agtcccccataccagctggactccca

SEQ ID NO: 213257 - DNA, 25 bp, Artificial Sequence
  Description of Artificial Sequence: Synthetic oligonucleotide
gtcccccataccagctggactccca

SEQ ID NO: 213258 - DNA, 25 bp, Artificial Sequence
  Description of Artificial Sequence: Synthetic oligonucleotide
tcccccataccagctggactcccag

SEQ ID NO: 213259 - DNA, 24 bp, Artificial Sequence
  Description of Artificial Sequence: Synthetic oligonucleotide
cccccataccagctggactcccag

SEQ ID NO: 213260 - DNA, 24 bp, Artificial Sequence
  Description of Artificial Sequence: Synthetic oligonucleotide
ccccataccagctggactcccagg

SEQ ID NO: 213261 - DNA, 24 bp, Artificial Sequence
  Description of Artificial Sequence: Synthetic oligonucleotide
cccataccagctggactcccaggg

SEQ ID NO: 213262 - DNA, 24 bp, Artificial Sequence
  Description of Artificial Sequence: Synthetic oligonucleotide
ccataccagctggactcccagggg

SEQ ID NO: 213263 - DNA, 24 bp, Artificial Sequence
  Description of Artificial Sequence: Synthetic oligonucleotide
cataccagctggactcccaggggc

SEQ ID NO: 213264 - DNA, 24 bp, Artificial Sequence
  Description of Artificial Sequence: Synthetic oligonucleotide
ataccagctggactcccaggggcg

SEQ ID NO: 213265 - DNA, 23 bp, Artificial Sequence
  Description of Artificial Sequence: Synthetic oligonucleotide
taccagctggactcccaggggcg

SEQ ID NO: 213266 - DNA, 22 bp, Artificial Sequence
  Description of Artificial Sequence: Synthetic oligonucleotide
accagctggactcccaggggcg

SEQ ID NO: 213267 - DNA, 21 bp, Artificial Sequence
  Description of Artificial Sequence: Synthetic oligonucleotide
ccagctggactcccaggggcg

SEQ ID NO: 213268 - DNA, 21 bp, Artificial Sequence
  Description of Artificial Sequence: Synthetic oligonucleotide
cagctggactcccaggggcgc

SEQ ID NO: 213269 - DNA, 22 bp, Artificial Sequence
  Description of Artificial Sequence: Synthetic oligonucleotide
agctggactcccaggggcgcct

SEQ ID NO: 213270 - DNA, 21 bp, Artificial Sequence
  Description of Artificial Sequence: Synthetic oligonucleotide
gctggactcccaggggcgcct

SEQ ID NO: 213271 - DNA, 21 bp, Artificial Sequence
  Description of Artificial Sequence: Synthetic oligonucleotide
ctggactcccaggggcgcctg

SEQ ID NO: 213272 - DNA, 22 bp, Artificial Sequence
  Description of Artificial Sequence: Synthetic oligonucleotide
tggactcccaggggcgcctggt

SEQ ID NO: 213273 - DNA, 21 bp, Artificial Sequence
  Description of Artificial Sequence: Synthetic oligonucleotide
ggactcccaggggcgcctggt

SEQ ID NO: 213274 - DNA, 21 bp, Artificial Sequence
  Description of Artificial Sequence: Synthetic oligonucleotide
gactcccaggggcgcctggtg

SEQ ID NO: 213275 - DNA, 22 bp, Artificial Sequence
  Description of Artificial Sequence: Synthetic oligonucleotide
actcccaggggcgcctggtgct

SEQ ID NO: 213276 - DNA, 21 bp, Artificial Sequence
  Description of Artificial Sequence: Synthetic oligonucleotide
ctcccaggggcgcctggtgct

SEQ ID NO: 213277 - DNA, 21 bp, Artificial Sequence
  Description of Artificial Sequence: Synthetic oligonucleotide
tcccaggggcgcctggtgctg

SEQ ID NO: 213278 - DNA, 20 bp, Artificial Sequence
  Description of Artificial Sequence: Synthetic oligonucleotide
cccaggggcgcctggtgctg

SEQ ID NO: 213279 - DNA, 20 bp, Artificial Sequence
  Description of Artificial Sequence: Synthetic oligonucleotide
ccaggggcgcctggtgctgg

SEQ ID NO: 213280 - DNA, 21 bp, Artificial Sequence
  Description of Artificial Sequence: Synthetic oligonucleotide
caggggcgcctggtgctggct

SEQ ID NO: 213281 - DNA, 22 bp, Artificial Sequence
  Description of Artificial Sequence: Synthetic oligonucleotide
aggggcgcctggtgctggctga

SEQ ID NO: 213282 - DNA, 21 bp, Artificial Sequence
  Description of Artificial Sequence: Synthetic oligonucleotide
ggggcgcctggtgctggctga

SEQ ID NO: 213283 - DNA, 21 bp, Artificial Sequence
  Description of Artificial Sequence: Synthetic oligonucleotide
gggcgcctggtgctggctgag

SEQ ID NO: 213284 - DNA, 21 bp, Artificial Sequence
  Description of Artificial Sequence: Synthetic oligonucleotide
ggcgcctggtgctggctgagg

SEQ ID NO: 213285 - DNA, 21 bp, Artificial Sequence
  Description of Artificial Sequence: Synthetic oligonucleotide
gcgcctggtgctggctgaggc

SEQ ID NO: 213286 - DNA, 21 bp, Artificial Sequence
  Description of Artificial Sequence: Synthetic oligonucleotide
cgcctggtgctggctgaggcc

SEQ ID NO: 213287 - DNA, 22 bp, Artificial Sequence
  Description of Artificial Sequence: Synthetic oligonucleotide
gcctggtgctggctgaggccca

SEQ ID NO: 213288 - DNA, 22 bp, Artificial Sequence
  Description of Artificial Sequence: Synthetic oligonucleotide
cctggtgctggctgaggcccag

SEQ ID NO: 213289 - DNA, 23 bp, Artificial Sequence
  Description of Artificial Sequence: Synthetic oligonucleotide
ctggtgctggctgaggcccaggt

SEQ ID NO: 213290 - DNA, 23 bp, Artificial Sequence
  Description of Artificial Sequence: Synthetic oligonucleotide
tggtgctggctgaggcccaggtg

SEQ ID NO: 213291 - DNA, 22 bp, Artificial Sequence
  Description of Artificial Sequence: Synthetic oligonucleotide
ggtgctggctgaggcccaggtg

SEQ ID NO: 213292 - DNA, 22 bp, Artificial Sequence
  Description of Artificial Sequence: Synthetic oligonucleotide
gtgctggctgaggcccaggtgg

SEQ ID NO: 213293 - DNA, 22 bp, Artificial Sequence
  Description of Artificial Sequence: Synthetic oligonucleotide
tgctggctgaggcccaggtggg

SEQ ID NO: 213294 - DNA, 21 bp, Artificial Sequence
  Description of Artificial Sequence: Synthetic oligonucleotide
gctggctgaggcccaggtggg

SEQ ID NO: 213295 - DNA, 21 bp, Artificial Sequence
  Description of Artificial Sequence: Synthetic oligonucleotide
ctggctgaggcccaggtgggc

SEQ ID NO: 213296 - DNA, 22 bp, Artificial Sequence
  Description of Artificial Sequence: Synthetic oligonucleotide
tggctgaggcccaggtgggcga

SEQ ID NO: 213297 - DNA, 21 bp, Artificial Sequence
  Description of Artificial Sequence: Synthetic oligonucleotide
ggctgaggcccaggtgggcga

SEQ ID NO: 213298 - DNA, 21 bp, Artificial Sequence
  Description of Artificial Sequence: Synthetic oligonucleotide
gctgaggcccaggtgggcgac

SEQ ID NO: 213299 - DNA, 22 bp, Artificial Sequence
  Description of Artificial Sequence: Synthetic oligonucleotide
ctgaggcccaggtgggcgacga

SEQ ID NO: 213300 - DNA, 22 bp, Artificial Sequence
  Description of Artificial Sequence: Synthetic oligonucleotide
tgaggcccaggtgggcgacgag

SEQ ID NO: 213301 - DNA, 21 bp, Artificial Sequence
  Description of Artificial Sequence: Synthetic oligonucleotide
gaggcccaggtgggcgacgag

SEQ ID NO: 213302 - DNA, 21 bp, Artificial Sequence
  Description of Artificial Sequence: Synthetic oligonucleotide
aggcccaggtgggcgacgagc

SEQ ID NO: 213303 - DNA, 20 bp, Artificial Sequence
  Description of Artificial Sequence: Synthetic oligonucleotide
ggcccaggtgggcgacgagc

SEQ ID NO: 213304 - DNA, 21 bp, Artificial Sequence
  Description of Artificial Sequence: Synthetic oligonucleotide
gcccaggtgggcgacgagcga

SEQ ID NO: 213305 - DNA, 22 bp, Artificial Sequence
  Description of Artificial Sequence: Synthetic oligonucleotide
cccaggtgggcgacgagcgaga

SEQ ID NO: 213306 - DNA, 24 bp, Artificial Sequence
  Description of Artificial Sequence: Synthetic oligonucleotide
ccaggtgggcgacgagcgagacta

SEQ ID NO: 213307 - DNA, 24 bp, Artificial Sequence
  Description of Artificial Sequence: Synthetic oligonucleotide
caggtgggcgacgagcgagactac

SEQ ID NO: 213308 - DNA, 25 bp, Artificial Sequence
  Description of Artificial Sequence: Synthetic oligonucleotide
aggtgggcgacgagcgagactacgt

SEQ ID NO: 213309 - DNA, 24 bp, Artificial Sequence
  Description of Artificial Sequence: Synthetic oligonucleotide
ggtgggcgacgagcgagactacgt

SEQ ID NO: 213310 - DNA, 25 bp, Artificial Sequence
  Description of Artificial Sequence: Synthetic oligonucleotide
gtgggcgacgagcgagactacgtgt

SEQ ID NO: 213311 - DNA, 25 bp, Artificial Sequence
  Description of Artificial Sequence: Synthetic oligonucleotide
tgggcgacgagcgagactacgtgtg

SEQ ID NO: 213312 - DNA, 24 bp, Artificial Sequence
  Description of Artificial Sequence: Synthetic oligonucleotide
gggcgacgagcgagactacgtgtg

SEQ ID NO: 213313 - DNA, 24 bp, Artificial Sequence
  Description of Artificial Sequence: Synthetic oligonucleotide
ggcgacgagcgagactacgtgtgc

SEQ ID NO: 213314 - DNA, 25 bp, Artificial Sequence
  Description of Artificial Sequence: Synthetic oligonucleotide
gcgacgagcgagactacgtgtgcgt

SEQ ID NO: 213315 - DNA, 25 bp, Artificial Sequence
  Description of Artificial Sequence: Synthetic oligonucleotide
cgacgagcgagactacgtgtgcgtg

SEQ ID NO: 213316 - DNA, 26 bp, Artificial Sequence
  Description of Artificial Sequence: Synthetic oligonucleotide
gacgagcgagactacgtgtgcgtggt

SEQ ID NO: 213317 - DNA, 27 bp, Artificial Sequence
  Description of Artificial Sequence: Synthetic oligonucleotide
acgagcgagactacgtgtgcgtggtga

SEQ ID NO: 213318 - DNA, 26 bp, Artificial Sequence
  Description of Artificial Sequence: Synthetic oligonucleotide
cgagcgagactacgtgtgcgtggtga

SEQ ID NO: 213319 - DNA, 26 bp, Artificial Sequence
  Description of Artificial Sequence: Synthetic oligonucleotide
gagcgagactacgtgtgcgtggtgag

SEQ ID NO: 213320 - DNA, 26 bp, Artificial Sequence
  Description of Artificial Sequence: Synthetic oligonucleotide
agcgagactacgtgtgcgtggtgagg

SEQ ID NO: 213321 - DNA, 25 bp, Artificial Sequence
  Description of Artificial Sequence: Synthetic oligonucleotide
gcgagactacgtgtgcgtggtgagg

SEQ ID NO: 213322 - DNA, 25 bp, Artificial Sequence
  Description of Artificial Sequence: Synthetic oligonucleotide
cgagactacgtgtgcgtggtgaggg

SEQ ID NO: 213323 - DNA, 26 bp, Artificial Sequence
  Description of Artificial Sequence: Synthetic oligonucleotide
gagactacgtgtgcgtggtgagggca

SEQ ID NO: 213324 - DNA, 26 bp, Artificial Sequence
  Description of Artificial Sequence: Synthetic oligonucleotide
agactacgtgtgcgtggtgagggcag

SEQ ID NO: 213325 - DNA, 25 bp, Artificial Sequence
  Description of Artificial Sequence: Synthetic oligonucleotide
gactacgtgtgcgtggtgagggcag

SEQ ID NO: 213326 - DNA, 25 bp, Artificial Sequence
  Description of Artificial Sequence: Synthetic oligonucleotide
actacgtgtgcgtggtgagggcagg

SEQ ID NO: 213327 - DNA, 24 bp, Artificial Sequence
  Description of Artificial Sequence: Synthetic oligonucleotide
ctacgtgtgcgtggtgagggcagg

SEQ ID NO: 213328 - DNA, 24 bp, Artificial Sequence
  Description of Artificial Sequence: Synthetic oligonucleotide
tacgtgtgcgtggtgagggcaggg

SEQ ID NO: 213329 - DNA, 23 bp, Artificial Sequence
  Description of Artificial Sequence: Synthetic oligonucleotide
acgtgtgcgtggtgagggcaggg

SEQ ID NO: 213330 - DNA, 22 bp, Artificial Sequence
  Description of Artificial Sequence: Synthetic oligonucleotide
cgtgtgcgtggtgagggcaggg

SEQ ID NO: 213331 - DNA, 22 bp, Artificial Sequence
  Description of Artificial Sequence: Synthetic oligonucleotide
gtgtgcgtggtgagggcagggg

SEQ ID NO: 213332 - DNA, 22 bp, Artificial Sequence
  Description of Artificial Sequence: Synthetic oligonucleotide
tgtgcgtggtgagggcaggggc

SEQ ID NO: 213333 - DNA, 21 bp, Artificial Sequence
  Description of Artificial Sequence: Synthetic oligonucleotide
gtgcgtggtgagggcaggggc

SEQ ID NO: 213334 - DNA, 21 bp, Artificial Sequence
  Description of Artificial Sequence: Synthetic oligonucleotide
tgcgtggtgagggcaggggcg

SEQ ID NO: 213335 - DNA, 20 bp, Artificial Sequence
  Description of Artificial Sequence: Synthetic oligonucleotide
gcgtggtgagggcaggggcg

SEQ ID NO: 213336 - DNA, 20 bp, Artificial Sequence
  Description of Artificial Sequence: Synthetic oligonucleotide
cgtggtgagggcaggggcgg

SEQ ID NO: 213337 - DNA, 21 bp, Artificial Sequence
  Description of Artificial Sequence: Synthetic oligonucleotide
gtggtgagggcaggggcggca

SEQ ID NO: 213338 - DNA, 21 bp, Artificial Sequence
  Description of Artificial Sequence: Synthetic oligonucleotide
tggtgagggcaggggcggcag

SEQ ID NO: 213339 - DNA, 20 bp, Artificial Sequence
  Description of Artificial Sequence: Synthetic oligonucleotide
ggtgagggcaggggcggcag

SEQ ID NO: 213340 - DNA, 20 bp, Artificial Sequence
  Description of Artificial Sequence: Synthetic oligonucleotide
gtgagggcaggggcggcagg

SEQ ID NO: 213341 - DNA, 21 bp, Artificial Sequence
  Description of Artificial Sequence: Synthetic oligonucleotide
tgagggcaggggcggcaggca

SEQ ID NO: 213342 - DNA, 20 bp, Artificial Sequence
  Description of Artificial Sequence: Synthetic oligonucleotide
gagggcaggggcggcaggca

SEQ ID NO: 213343 - DNA, 21 bp, Artificial Sequence
  Description of Artificial Sequence: Synthetic oligonucleotide
agggcaggggcggcaggcact

SEQ ID NO: 213344 - DNA, 20 bp, Artificial Sequence
  Description of Artificial Sequence: Synthetic oligonucleotide
gggcaggggcggcaggcact

SEQ ID NO: 213345 - DNA, 20 bp, Artificial Sequence
  Description of Artificial Sequence: Synthetic oligonucleotide
ggcaggggcggcaggcactg

SEQ ID NO: 213346 - DNA, 21 bp, Artificial Sequence
  Description of Artificial Sequence: Synthetic oligonucleotide
gcaggggcggcaggcactgct

SEQ ID NO: 213347 - DNA, 22 bp, Artificial Sequence
  Description of Artificial Sequence: Synthetic oligonucleotide
caggggcggcaggcactgctga

SEQ ID NO: 213348 - DNA, 22 bp, Artificial Sequence
  Description of Artificial Sequence: Synthetic oligonucleotide
aggggcggcaggcactgctgag

SEQ ID NO: 213349 - DNA, 21 bp, Artificial Sequence
  Description of Artificial Sequence: Synthetic oligonucleotide
ggggcggcaggcactgctgag

SEQ ID NO: 213350 - DNA, 21 bp, Artificial Sequence
  Description of Artificial Sequence: Synthetic oligonucleotide
gggcggcaggcactgctgagg

SEQ ID NO: 213351 - DNA, 21 bp, Artificial Sequence
  Description of Artificial Sequence: Synthetic oligonucleotide
ggcggcaggcactgctgaggc

SEQ ID NO: 213352 - DNA, 22 bp, Artificial Sequence
  Description of Artificial Sequence: Synthetic oligonucleotide
gcggcaggcactgctgaggcca

SEQ ID NO: 213353 - DNA, 23 bp, Artificial Sequence
  Description of Artificial Sequence: Synthetic oligonucleotide
cggcaggcactgctgaggccact

SEQ ID NO: 213354 - DNA, 23 bp, Artificial Sequence
  Description of Artificial Sequence: Synthetic oligonucleotide
ggcaggcactgctgaggccactg

SEQ ID NO: 213355 - DNA, 23 bp, Artificial Sequence
  Description of Artificial Sequence: Synthetic oligonucleotide
gcaggcactgctgaggccactgc

SEQ ID NO: 213356 - DNA, 23 bp, Artificial Sequence
  Description of Artificial Sequence: Synthetic oligonucleotide
caggcactgctgaggccactgcg

SEQ ID NO: 213357 - DNA, 23 bp, Artificial Sequence
  Description of Artificial Sequence: Synthetic oligonucleotide
aggcactgctgaggccactgcgc

SEQ ID NO: 213358 - DNA, 22 bp, Artificial Sequence
  Description of Artificial Sequence: Synthetic oligonucleotide
ggcactgctgaggccactgcgc

SEQ ID NO: 213359 - DNA, 22 bp, Artificial Sequence
  Description of Artificial Sequence: Synthetic oligonucleotide
gcactgctgaggccactgcgcg

SEQ ID NO: 213360 - DNA, 22 bp, Artificial Sequence
  Description of Artificial Sequence: Synthetic oligonucleotide
cactgctgaggccactgcgcgg

SEQ ID NO: 213361 - DNA, 23 bp, Artificial Sequence
  Description of Artificial Sequence: Synthetic oligonucleotide
actgctgaggccactgcgcggct

SEQ ID NO: 213362 - DNA, 22 bp, Artificial Sequence
  Description of Artificial Sequence: Synthetic oligonucleotide
ctgctgaggccactgcgcggct

SEQ ID NO: 213363 - DNA, 24 bp, Artificial Sequence
  Description of Artificial Sequence: Synthetic oligonucleotide
tgctgaggccactgcgcggctcaa

SEQ ID NO: 213364 - DNA, 23 bp, Artificial Sequence
  Description of Artificial Sequence: Synthetic oligonucleotide
gctgaggccactgcgcggctcaa

SEQ ID NO: 213365 - DNA, 23 bp, Artificial Sequence
  Description of Artificial Sequence: Synthetic oligonucleotide
ctgaggccactgcgcggctcaac

SEQ ID NO: 213366 - DNA, 24 bp, Artificial Sequence
  Description of Artificial Sequence: Synthetic oligonucleotide
tgaggccactgcgcggctcaacgt

SEQ ID NO: 213367 - DNA, 23 bp, Artificial Sequence
  Description of Artificial Sequence: Synthetic oligonucleotide
gaggccactgcgcggctcaacgt

SEQ ID NO: 213368 - DNA, 26 bp, Artificial Sequence
  Description of Artificial Sequence: Synthetic oligonucleotide
aggccactgcgcggctcaacgtgttt

SEQ ID NO: 213369 - DNA, 25 bp, Artificial Sequence
  Description of Artificial Sequence: Synthetic oligonucleotide
ggccactgcgcggctcaacgtgttt

SEQ ID NO: 213370 - DNA, 25 bp, Artificial Sequence
  Description of Artificial Sequence: Synthetic oligonucleotide
gccactgcgcggctcaacgtgtttg

SEQ ID NO: 213371 - DNA, 27 bp, Artificial Sequence
  Description of Artificial Sequence: Synthetic oligonucleotide
ccactgcgcggctcaacgtgtttgcaa

SEQ ID NO: 213372 - DNA, 28 bp, Artificial Sequence
  Description of Artificial Sequence: Synthetic oligonucleotide
cactgcgcggctcaacgtgtttgcaaag

SEQ ID NO: 213373 - DNA, 28 bp, Artificial Sequence
  Description of Artificial Sequence: Synthetic oligonucleotide
actgcgcggctcaacgtgtttgcaaagc

SEQ ID NO: 213374 - DNA, 27 bp, Artificial Sequence
  Description of Artificial Sequence: Synthetic oligonucleotide
ctgcgcggctcaacgtgtttgcaaagc

SEQ ID NO: 213375 - DNA, 27 bp, Artificial Sequence
  Description of Artificial Sequence: Synthetic oligonucleotide
tgcgcggctcaacgtgtttgcaaagcc

SEQ ID NO: 213376 - DNA, 27 bp, Artificial Sequence
  Description of Artificial Sequence: Synthetic oligonucleotide
gcgcggctcaacgtgtttgcaaagcca

SEQ ID NO: 213377 - DNA, 27 bp, Artificial Sequence
  Description of Artificial Sequence: Synthetic oligonucleotide
cgcggctcaacgtgtttgcaaagccag

SEQ ID NO: 213378 - DNA, 28 bp, Artificial Sequence
  Description of Artificial Sequence: Synthetic oligonucleotide
gcggctcaacgtgtttgcaaagccagag

SEQ ID NO: 213379 - DNA, 28 bp, Artificial Sequence
  Description of Artificial Sequence: Synthetic oligonucleotide
cggctcaacgtgtttgcaaagccagagg

SEQ ID NO: 213380 - DNA, 28 bp, Artificial Sequence
  Description of Artificial Sequence: Synthetic oligonucleotide
ggctcaacgtgtttgcaaagccagaggc

SEQ ID NO: 213381 - DNA, 28 bp, Artificial Sequence
  Description of Artificial Sequence: Synthetic oligonucleotide
gctcaacgtgtttgcaaagccagaggcc

SEQ ID NO: 213382 - DNA, 29 bp, Artificial Sequence
  Description of Artificial Sequence: Synthetic oligonucleotide
ctcaacgtgtttgcaaagccagaggccac

SEQ ID NO: 213383 - DNA, 30 bp, Artificial Sequence
  Description of Artificial Sequence: Synthetic oligonucleotide
tcaacgtgtttgcaaagccagaggccactg

SEQ ID NO: 213384 - DNA, 29 bp, Artificial Sequence
  Description of Artificial Sequence: Synthetic oligonucleotide
caacgtgtttgcaaagccagaggccactg

SEQ ID NO: 213385 - DNA, 30 bp, Artificial Sequence
  Description of Artificial Sequence: Synthetic oligonucleotide
aacgtgtttgcaaagccagaggccactgag

SEQ ID NO: 213386 - DNA, 29 bp, Artificial Sequence
  Description of Artificial Sequence: Synthetic oligonucleotide
acgtgtttgcaaagccagaggccactgag

SEQ ID NO: 213387 - DNA, 28 bp, Artificial Sequence
  Description of Artificial Sequence: Synthetic oligonucleotide
cgtgtttgcaaagccagaggccactgag

SEQ ID NO: 213388 - DNA, 28 bp, Artificial Sequence
  Description of Artificial Sequence: Synthetic oligonucleotide
gtgtttgcaaagccagaggccactgagg

SEQ ID NO: 213389 - DNA, 29 bp, Artificial Sequence
  Description of Artificial Sequence: Synthetic oligonucleotide
tgtttgcaaagccagaggccactgaggtc

SEQ ID NO: 213390 - DNA, 28 bp, Artificial Sequence
  Description of Artificial Sequence: Synthetic oligonucleotide
gtttgcaaagccagaggccactgaggtc

SEQ ID NO: 213391 - DNA, 29 bp, Artificial Sequence
  Description of Artificial Sequence: Synthetic oligonucleotide
tttgcaaagccagaggccactgaggtctc

SEQ ID NO: 213392 - DNA, 28 bp, Artificial Sequence
  Description of Artificial Sequence: Synthetic oligonucleotide
ttgcaaagccagaggccactgaggtctc

SEQ ID NO: 213393 - DNA, 27 bp, Artificial Sequence
  Description of Artificial Sequence: Synthetic oligonucleotide
tgcaaagccagaggccactgaggtctc

SEQ ID NO: 213394 - DNA, 26 bp, Artificial Sequence
  Description of Artificial Sequence: Synthetic oligonucleotide
gcaaagccagaggccactgaggtctc

SEQ ID NO: 213395 - DNA, 26 bp, Artificial Sequence
  Description of Artificial Sequence: Synthetic oligonucleotide
caaagccagaggccactgaggtctcc

SEQ ID NO: 213396 - DNA, 26 bp, Artificial Sequence
  Description of Artificial Sequence: Synthetic oligonucleotide
aaagccagaggccactgaggtctccc

SEQ ID NO: 213397 - DNA, 25 bp, Artificial Sequence
  Description of Artificial Sequence: Synthetic oligonucleotide
aagccagaggccactgaggtctccc

SEQ ID NO: 213398 - DNA, 24 bp, Artificial Sequence
  Description of Artificial Sequence: Synthetic oligonucleotide
agccagaggccactgaggtctccc

SEQ ID NO: 213399 - DNA, 23 bp, Artificial Sequence
  Description of Artificial Sequence: Synthetic oligonucleotide
gccagaggccactgaggtctccc

SEQ ID NO: 213400 - DNA, 23 bp, Artificial Sequence
  Description of Artificial Sequence: Synthetic oligonucleotide
ccagaggccactgaggtctcccc

SEQ ID NO: 213401 - DNA, 25 bp, Artificial Sequence
  Description of Artificial Sequence: Synthetic oligonucleotide
cagaggccactgaggtctcccccaa

SEQ ID NO: 213402 - DNA, 27 bp, Artificial Sequence
  Description of Artificial Sequence: Synthetic oligonucleotide
agaggccactgaggtctcccccaacaa

SEQ ID NO: 213403 - DNA, 27 bp, Artificial Sequence
  Description of Artificial Sequence: Synthetic oligonucleotide
gaggccactgaggtctcccccaacaaa

SEQ ID NO: 213404 - DNA, 27 bp, Artificial Sequence
  Description of Artificial Sequence: Synthetic oligonucleotide
aggccactgaggtctcccccaacaaag

SEQ ID NO: 213405 - DNA, 26 bp, Artificial Sequence
  Description of Artificial Sequence: Synthetic oligonucleotide
ggccactgaggtctcccccaacaaag

SEQ ID NO: 213406 - DNA, 26 bp, Artificial Sequence
  Description of Artificial Sequence: Synthetic oligonucleotide
gccactgaggtctcccccaacaaagg

SEQ ID NO: 213407 - DNA, 27 bp, Artificial Sequence
  Description of Artificial Sequence: Synthetic oligonucleotide
ccactgaggtctcccccaacaaaggga

SEQ ID NO: 213408 - DNA, 27 bp, Artificial Sequence
  Description of Artificial Sequence: Synthetic oligonucleotide
cactgaggtctcccccaacaaagggac

SEQ ID NO: 213409 - DNA, 28 bp, Artificial Sequence
  Description of Artificial Sequence: Synthetic oligonucleotide
actgaggtctcccccaacaaagggacac

SEQ ID NO: 213410 - DNA, 27 bp, Artificial Sequence
  Description of Artificial Sequence: Synthetic oligonucleotide
ctgaggtctcccccaacaaagggacac

SEQ ID NO: 213411 - DNA, 28 bp, Artificial Sequence
  Description of Artificial Sequence: Synthetic oligonucleotide
tgaggtctcccccaacaaagggacactg

SEQ ID NO: 213412 - DNA, 27 bp, Artificial Sequence
  Description of Artificial Sequence: Synthetic oligonucleotide
gaggtctcccccaacaaagggacactg

SEQ ID NO: 213413 - DNA, 28 bp, Artificial Sequence
  Description of Artificial Sequence: Synthetic oligonucleotide
aggtctcccccaacaaagggacactgtc

SEQ ID NO: 213414 - DNA, 27 bp, Artificial Sequence
  Description of Artificial Sequence: Synthetic oligonucleotide
ggtctcccccaacaaagggacactgtc

SEQ ID NO: 213415 - DNA, 28 bp, Artificial Sequence
  Description of Artificial Sequence: Synthetic oligonucleotide
gtctcccccaacaaagggacactgtctg

SEQ ID NO: 213416 - DNA, 29 bp, Artificial Sequence
  Description of Artificial Sequence: Synthetic oligonucleotide
tctcccccaacaaagggacactgtctgtg

SEQ ID NO: 213417 - DNA, 28 bp, Artificial Sequence
  Description of Artificial Sequence: Synthetic oligonucleotide
ctcccccaacaaagggacactgtctgtg

SEQ ID NO: 213418 - DNA, 30 bp, Artificial Sequence
  Description of Artificial Sequence: Synthetic oligonucleotide
tcccccaacaaagggacactgtctgtgatg

SEQ ID NO: 213419 - DNA, 29 bp, Artificial Sequence
  Description of Artificial Sequence: Synthetic oligonucleotide
cccccaacaaagggacactgtctgtgatg

SEQ ID NO: 213420 - DNA, 29 bp, Artificial Sequence
  Description of Artificial Sequence: Synthetic oligonucleotide
ccccaacaaagggacactgtctgtgatgg

SEQ ID NO: 213421 - DNA, 30 bp, Artificial Sequence
  Description of Artificial Sequence: Synthetic oligonucleotide
cccaacaaagggacactgtctgtgatggag

SEQ ID NO: 213422 - DNA, 30 bp, Artificial Sequence
  Description of Artificial Sequence: Synthetic oligonucleotide
ccaacaaagggacactgtctgtgatggagg

SEQ ID NO: 213423 - DNA, 31 bp, Artificial Sequence
  Description of Artificial Sequence: Synthetic oligonucleotide
caacaaagggacactgtctgtgatggaggac

SEQ ID NO: 213424 - DNA, 32 bp, Artificial Sequence
  Description of Artificial Sequence: Synthetic oligonucleotide
aacaaagggacactgtctgtgatggaggactc

SEQ ID NO: 213425 - DNA, 31 bp, Artificial Sequence
  Description of Artificial Sequence: Synthetic oligonucleotide
acaaagggacactgtctgtgatggaggactc

SEQ ID NO: 213426 - DNA, 30 bp, Artificial Sequence
  Description of Artificial Sequence: Synthetic oligonucleotide
caaagggacactgtctgtgatggaggactc

SEQ ID NO: 213427 - DNA, 31 bp, Artificial Sequence
  Description of Artificial Sequence: Synthetic oligonucleotide
aaagggacactgtctgtgatggaggactctg

SEQ ID NO: 213428 - DNA, 30 bp, Artificial Sequence
  Description of Artificial Sequence: Synthetic oligonucleotide
aagggacactgtctgtgatggaggactctg

SEQ ID NO: 213429 - DNA, 29 bp, Artificial Sequence
  Description of Artificial Sequence: Synthetic oligonucleotide
agggacactgtctgtgatggaggactctg

SEQ ID NO: 213430 - DNA, 28 bp, Artificial Sequence
  Description of Artificial Sequence: Synthetic oligonucleotide
gggacactgtctgtgatggaggactctg

SEQ ID NO: 213431 - DNA, 28 bp, Artificial Sequence
  Description of Artificial Sequence: Synthetic oligonucleotide
ggacactgtctgtgatggaggactctgc

SEQ ID NO: 213432 - DNA, 28 bp, Artificial Sequence
  Description of Artificial Sequence: Synthetic oligonucleotide
gacactgtctgtgatggaggactctgcc

SEQ ID NO: 213433 - DNA, 28 bp, Artificial Sequence
  Description of Artificial Sequence: Synthetic oligonucleotide
acactgtctgtgatggaggactctgccc

SEQ ID NO: 213434 - DNA, 27 bp, Artificial Sequence
  Description of Artificial Sequence: Synthetic oligonucleotide
cactgtctgtgatggaggactctgccc

SEQ ID NO: 213435 - DNA, 28 bp, Artificial Sequence
  Description of Artificial Sequence: Synthetic oligonucleotide
actgtctgtgatggaggactctgcccag

SEQ ID NO: 213436 - DNA, 27 bp, Artificial Sequence
  Description of Artificial Sequence: Synthetic oligonucleotide
ctgtctgtgatggaggactctgcccag

SEQ ID NO: 213437 - DNA, 27 bp, Artificial Sequence
  Description of Artificial Sequence: Synthetic oligonucleotide
tgtctgtgatggaggactctgcccagg

SEQ ID NO: 213438 - DNA, 27 bp, Artificial Sequence
  Description of Artificial Sequence: Synthetic oligonucleotide
gtctgtgatggaggactctgcccagga

SEQ ID NO: 213439 - DNA, 27 bp, Artificial Sequence
  Description of Artificial Sequence: Synthetic oligonucleotide
tctgtgatggaggactctgcccaggag

SEQ ID NO: 213440 - DNA, 27 bp, Artificial Sequence
  Description of Artificial Sequence: Synthetic oligonucleotide
ctgtgatggaggactctgcccaggaga

SEQ ID NO: 213441 - DNA, 28 bp, Artificial Sequence
  Description of Artificial Sequence: Synthetic oligonucleotide
tgtgatggaggactctgcccaggagatc

SEQ ID NO: 213442 - DNA, 27 bp, Artificial Sequence
  Description of Artificial Sequence: Synthetic oligonucleotide
gtgatggaggactctgcccaggagatc

SEQ ID NO: 213443 - DNA, 27 bp, Artificial Sequence
  Description of Artificial Sequence: Synthetic oligonucleotide
tgatggaggactctgcccaggagatcg

SEQ ID NO: 213444 - DNA, 26 bp, Artificial Sequence
  Description of Artificial Sequence: Synthetic oligonucleotide
gatggaggactctgcccaggagatcg

SEQ ID NO: 213445 - DNA, 26 bp, Artificial Sequence
  Description of Artificial Sequence: Synthetic oligonucleotide
atggaggactctgcccaggagatcgc

SEQ ID NO: 213446 - DNA, 25 bp, Artificial Sequence
  Description of Artificial Sequence: Synthetic oligonucleotide
tggaggactctgcccaggagatcgc

SEQ ID NO: 213447 - DNA, 24 bp, Artificial Sequence
  Description of Artificial Sequence: Synthetic oligonucleotide
ggaggactctgcccaggagatcgc

SEQ ID NO: 213448 - DNA, 25 bp, Artificial Sequence
  Description of Artificial Sequence: Synthetic oligonucleotide
gaggactctgcccaggagatcgcca

SEQ ID NO: 213449 - DNA, 25 bp, Artificial Sequence
  Description of Artificial Sequence: Synthetic oligonucleotide
aggactctgcccaggagatcgccac

SEQ ID NO: 213450 - DNA, 24 bp, Artificial Sequence
  Description of Artificial Sequence: Synthetic oligonucleotide
ggactctgcccaggagatcgccac

SEQ ID NO: 213451 - DNA, 25 bp, Artificial Sequence
  Description of Artificial Sequence: Synthetic oligonucleotide
gactctgcccaggagatcgccacct

SEQ ID NO: 213452 - DNA, 25 bp, Artificial Sequence
  Description of Artificial Sequence: Synthetic oligonucleotide
actctgcccaggagatcgccacctg

SEQ ID NO: 213453 - DNA, 24 bp, Artificial Sequence
  Description of Artificial Sequence: Synthetic oligonucleotide
ctctgcccaggagatcgccacctg

SEQ ID NO: 213454 - DNA, 26 bp, Artificial Sequence
  Description of Artificial Sequence: Synthetic oligonucleotide
tctgcccaggagatcgccacctgcaa

SEQ ID NO: 213455 - DNA, 25 bp, Artificial Sequence
  Description of Artificial Sequence: Synthetic oligonucleotide
ctgcccaggagatcgccacctgcaa

SEQ ID NO: 213456 - DNA, 26 bp, Artificial Sequence
  Description of Artificial Sequence: Synthetic oligonucleotide
tgcccaggagatcgccacctgcaaca

SEQ ID NO: 213457 - DNA, 25 bp, Artificial Sequence
  Description of Artificial Sequence: Synthetic oligonucleotide
gcccaggagatcgccacctgcaaca

SEQ ID NO: 213458 - DNA, 25 bp, Artificial Sequence
  Description of Artificial Sequence: Synthetic oligonucleotide
cccaggagatcgccacctgcaacag

SEQ ID NO: 213459 - DNA, 25 bp, Artificial Sequence
  Description of Artificial Sequence: Synthetic oligonucleotide
ccaggagatcgccacctgcaacagc

SEQ ID NO: 213460 - DNA, 25 bp, Artificial Sequence
  Description of Artificial Sequence: Synthetic oligonucleotide
caggagatcgccacctgcaacagcc

SEQ ID NO: 213461 - DNA, 25 bp, Artificial Sequence
  Description of Artificial Sequence: Synthetic oligonucleotide
aggagatcgccacctgcaacagccg

SEQ ID NO: 213462 - DNA, 24 bp, Artificial Sequence
  Description of Artificial Sequence: Synthetic oligonucleotide
ggagatcgccacctgcaacagccg

SEQ ID NO: 213463 - DNA, 26 bp, Artificial Sequence
  Description of Artificial Sequence: Synthetic oligonucleotide
gagatcgccacctgcaacagccggaa

SEQ ID NO: 213464 - DNA, 26 bp, Artificial Sequence
  Description of Artificial Sequence: Synthetic oligonucleotide
agatcgccacctgcaacagccggaac

SEQ ID NO: 213465 - DNA, 25 bp, Artificial Sequence
  Description of Artificial Sequence: Synthetic oligonucleotide
gatcgccacctgcaacagccggaac

SEQ ID NO: 213466 - DNA, 25 bp, Artificial Sequence
  Description of Artificial Sequence: Synthetic oligonucleotide
atcgccacctgcaacagccggaacg

SEQ ID NO: 213467 - DNA, 24 bp, Artificial Sequence
  Description of Artificial Sequence: Synthetic oligonucleotide
tcgccacctgcaacagccggaacg

SEQ ID NO: 213468 - DNA, 23 bp, Artificial Sequence
  Description of Artificial Sequence: Synthetic oligonucleotide
cgccacctgcaacagccggaacg

SEQ ID NO: 213469 - DNA, 23 bp, Artificial Sequence
  Description of Artificial Sequence: Synthetic oligonucleotide
gccacctgcaacagccggaacgg

SEQ ID NO: 213470 - DNA, 25 bp, Artificial Sequence
  Description of Artificial Sequence: Synthetic oligonucleotide
ccacctgcaacagccggaacgggaa

SEQ ID NO: 213471 - DNA, 25 bp, Artificial Sequence
  Description of Artificial Sequence: Synthetic oligonucleotide
cacctgcaacagccggaacgggaac

SEQ ID NO: 213472 - DNA, 25 bp, Artificial Sequence
  Description of Artificial Sequence: Synthetic oligonucleotide
acctgcaacagccggaacgggaacc

SEQ ID NO: 213473 - DNA, 24 bp, Artificial Sequence
  Description of Artificial Sequence: Synthetic oligonucleotide
cctgcaacagccggaacgggaacc

SEQ ID NO: 213474 - DNA, 24 bp, Artificial Sequence
  Description of Artificial Sequence: Synthetic oligonucleotide
ctgcaacagccggaacgggaaccc

SEQ ID NO: 213475 - DNA, 24 bp, Artificial Sequence
  Description of Artificial Sequence: Synthetic oligonucleotide
tgcaacagccggaacgggaacccg

SEQ ID NO: 213476 - DNA, 23 bp, Artificial Sequence
  Description of Artificial Sequence: Synthetic oligonucleotide
gcaacagccggaacgggaacccg

SEQ ID NO: 213477 - DNA, 23 bp, Artificial Sequence
  Description of Artificial Sequence: Synthetic oligonucleotide
caacagccggaacgggaacccgg

SEQ ID NO: 213478 - DNA, 23 bp, Artificial Sequence
  Description of Artificial Sequence: Synthetic oligonucleotide
aacagccggaacgggaacccggc

SEQ ID NO: 213479 - DNA, 22 bp, Artificial Sequence
  Description of Artificial Sequence: Synthetic oligonucleotide
acagccggaacgggaacccggc

SEQ ID NO: 213480 - DNA, 21 bp, Artificial Sequence
  Description of Artificial Sequence: Synthetic oligonucleotide
cagccggaacgggaacccggc

SEQ ID NO: 213481 - DNA, 21 bp, Artificial Sequence
  Description of Artificial Sequence: Synthetic oligonucleotide
agccggaacgggaacccggcc

SEQ ID NO: 213482 - DNA, 20 bp, Artificial Sequence
  Description of Artificial Sequence: Synthetic oligonucleotide
gccggaacgggaacccggcc

SEQ ID NO: 213483 - DNA, 20 bp, Artificial Sequence
  Description of Artificial Sequence: Synthetic oligonucleotide
ccggaacgggaacccggccc

SEQ ID NO: 213484 - DNA, 20 bp, Artificial Sequence
  Description of Artificial Sequence: Synthetic oligonucleotide
cggaacgggaacccggcccc

SEQ ID NO: 213485 - DNA, 22 bp, Artificial Sequence
  Description of Artificial Sequence: Synthetic oligonucleotide
ggaacgggaacccggcccccaa

SEQ ID NO: 213486 - DNA, 24 bp, Artificial Sequence
  Description of Artificial Sequence: Synthetic oligonucleotide
gaacgggaacccggcccccaagat

SEQ ID NO: 213487 - DNA, 25 bp, Artificial Sequence
  Description of Artificial Sequence: Synthetic oligonucleotide
aacgggaacccggcccccaagatca

SEQ ID NO: 213488 - DNA, 24 bp, Artificial Sequence
  Description of Artificial Sequence: Synthetic oligonucleotide
acgggaacccggcccccaagatca

SEQ ID NO: 213489 - DNA, 23 bp, Artificial Sequence
  Description of Artificial Sequence: Synthetic oligonucleotide
cgggaacccggcccccaagatca

SEQ ID NO: 213490 - DNA, 23 bp, Artificial Sequence
  Description of Artificial Sequence: Synthetic oligonucleotide
gggaacccggcccccaagatcac

SEQ ID NO: 213491 - DNA, 24 bp, Artificial Sequence
  Description of Artificial Sequence: Synthetic oligonucleotide
ggaacccggcccccaagatcacgt

SEQ ID NO: 213492 - DNA, 24 bp, Artificial Sequence
  Description of Artificial Sequence: Synthetic oligonucleotide
gaacccggcccccaagatcacgtg

SEQ ID NO: 213493 - DNA, 27 bp, Artificial Sequence
  Description of Artificial Sequence: Synthetic oligonucleotide
aacccggcccccaagatcacgtggtat

SEQ ID NO: 213494 - DNA, 26 bp, Artificial Sequence
  Description of Artificial Sequence: Synthetic oligonucleotide
acccggcccccaagatcacgtggtat

SEQ ID NO: 213495 - DNA, 25 bp, Artificial Sequence
  Description of Artificial Sequence: Synthetic oligonucleotide
cccggcccccaagatcacgtggtat

SEQ ID NO: 213496 - DNA, 25 bp, Artificial Sequence
  Description of Artificial Sequence: Synthetic oligonucleotide
ccggcccccaagatcacgtggtatc

SEQ ID NO: 213497 - DNA, 25 bp, Artificial Sequence
  Description of Artificial Sequence: Synthetic oligonucleotide
cggcccccaagatcacgtggtatcg

SEQ ID NO: 213498 - DNA, 27 bp, Artificial Sequence
  Description of Artificial Sequence: Synthetic oligonucleotide
ggcccccaagatcacgtggtatcgcaa

SEQ ID NO: 213499 - DNA, 27 bp, Artificial Sequence
  Description of Artificial Sequence: Synthetic oligonucleotide
gcccccaagatcacgtggtatcgcaac

SEQ ID NO: 213500 - DNA, 27 bp, Artificial Sequence
  Description of Artificial Sequence: Synthetic oligonucleotide
cccccaagatcacgtggtatcgcaacg

SEQ ID NO: 213501 - DNA, 27 bp, Artificial Sequence
  Description of Artificial Sequence: Synthetic oligonucleotide
ccccaagatcacgtggtatcgcaacgg

SEQ ID NO: 213502 - DNA, 27 bp, Artificial Sequence
  Description of Artificial Sequence: Synthetic oligonucleotide
cccaagatcacgtggtatcgcaacggg

SEQ ID NO: 213503 - DNA, 27 bp, Artificial Sequence
  Description of Artificial Sequence: Synthetic oligonucleotide
ccaagatcacgtggtatcgcaacgggc

SEQ ID NO: 213504 - DNA, 28 bp, Artificial Sequence
  Description of Artificial Sequence: Synthetic oligonucleotide
caagatcacgtggtatcgcaacgggcag

SEQ ID NO: 213505 - DNA, 28 bp, Artificial Sequence
  Description of Artificial Sequence: Synthetic oligonucleotide
aagatcacgtggtatcgcaacgggcagc

SEQ ID NO: 213506 - DNA, 27 bp, Artificial Sequence
  Description of Artificial Sequence: Synthetic oligonucleotide
agatcacgtggtatcgcaacgggcagc

SEQ ID NO: 213507 - DNA, 26 bp, Artificial Sequence
  Description of Artificial Sequence: Synthetic oligonucleotide
gatcacgtggtatcgcaacgggcagc

SEQ ID NO: 213508 - DNA, 26 bp, Artificial Sequence
  Description of Artificial Sequence: Synthetic oligonucleotide
atcacgtggtatcgcaacgggcagcg

SEQ ID NO: 213509 - DNA, 25 bp, Artificial Sequence
  Description of Artificial Sequence: Synthetic oligonucleotide
tcacgtggtatcgcaacgggcagcg

SEQ ID NO: 213510 - DNA, 24 bp, Artificial Sequence
  Description of Artificial Sequence: Synthetic oligonucleotide
cacgtggtatcgcaacgggcagcg

SEQ ID NO: 213511 - DNA, 24 bp, Artificial Sequence
  Description of Artificial Sequence: Synthetic oligonucleotide
acgtggtatcgcaacgggcagcgc

SEQ ID NO: 213512 - DNA, 23 bp, Artificial Sequence
  Description of Artificial Sequence: Synthetic oligonucleotide
cgtggtatcgcaacgggcagcgc

SEQ ID NO: 213513 - DNA, 24 bp, Artificial Sequence
  Description of Artificial Sequence: Synthetic oligonucleotide
gtggtatcgcaacgggcagcgcct

SEQ ID NO: 213514 - DNA, 24 bp, Artificial Sequence
  Description of Artificial Sequence: Synthetic oligonucleotide
tggtatcgcaacgggcagcgcctg

SEQ ID NO: 213515 - DNA, 23 bp, Artificial Sequence
  Description of Artificial Sequence: Synthetic oligonucleotide
ggtatcgcaacgggcagcgcctg

SEQ ID NO: 213516 - DNA, 24 bp, Artificial Sequence
  Description of Artificial Sequence: Synthetic oligonucleotide
gtatcgcaacgggcagcgcctgga

SEQ ID NO: 213517 - DNA, 24 bp, Artificial Sequence
  Description of Artificial Sequence: Synthetic oligonucleotide
tatcgcaacgggcagcgcctggag

SEQ ID NO: 213518 - DNA, 23 bp, Artificial Sequence
  Description of Artificial Sequence: Synthetic oligonucleotide
atcgcaacgggcagcgcctggag

SEQ ID NO: 213519 - DNA, 22 bp, Artificial Sequence
  Description of Artificial Sequence: Synthetic oligonucleotide
tcgcaacgggcagcgcctggag

SEQ ID NO: 213520 - DNA, 21 bp, Artificial Sequence
  Description of Artificial Sequence: Synthetic oligonucleotide
cgcaacgggcagcgcctggag

SEQ ID NO: 213521 - DNA, 22 bp, Artificial Sequence
  Description of Artificial Sequence: Synthetic oligonucleotide
gcaacgggcagcgcctggaggt

SEQ ID NO: 213522 - DNA, 22 bp, Artificial Sequence
  Description of Artificial Sequence: Synthetic oligonucleotide
caacgggcagcgcctggaggtg

SEQ ID NO: 213523 - DNA, 22 bp, Artificial Sequence
  Description of Artificial Sequence: Synthetic oligonucleotide
aacgggcagcgcctggaggtgc

SEQ ID NO: 213524 - DNA, 21 bp, Artificial Sequence
  Description of Artificial Sequence: Synthetic oligonucleotide
acgggcagcgcctggaggtgc

SEQ ID NO: 213525 - DNA, 20 bp, Artificial Sequence
  Description of Artificial Sequence: Synthetic oligonucleotide
cgggcagcgcctggaggtgc

SEQ ID NO: 213526 - DNA, 20 bp, Artificial Sequence
  Description of Artificial Sequence: Synthetic oligonucleotide
gggcagcgcctggaggtgcc

SEQ ID NO: 213527 - DNA, 20 bp, Artificial Sequence
  Description of Artificial Sequence: Synthetic oligonucleotide
ggcagcgcctggaggtgccc

SEQ ID NO: 213528 - DNA, 22 bp, Artificial Sequence
  Description of Artificial Sequence: Synthetic oligonucleotide
gcagcgcctggaggtgcccgta

SEQ ID NO: 213529 - DNA, 23 bp, Artificial Sequence
  Description of Artificial Sequence: Synthetic oligonucleotide
cagcgcctggaggtgcccgtaga

SEQ ID NO: 213530 - DNA, 25 bp, Artificial Sequence
  Description of Artificial Sequence: Synthetic oligonucleotide
agcgcctggaggtgcccgtagagat

SEQ ID NO: 213531 - DNA, 24 bp, Artificial Sequence
  Description of Artificial Sequence: Synthetic oligonucleotide
gcgcctggaggtgcccgtagagat

SEQ ID NO: 213532 - DNA, 26 bp, Artificial Sequence
  Description of Artificial Sequence: Synthetic oligonucleotide
cgcctggaggtgcccgtagagatgaa

SEQ ID NO: 213533 - DNA, 26 bp, Artificial Sequence
  Description of Artificial Sequence: Synthetic oligonucleotide
gcctggaggtgcccgtagagatgaac

SEQ ID NO: 213534 - DNA, 26 bp, Artificial Sequence
  Description of Artificial Sequence: Synthetic oligonucleotide
cctggaggtgcccgtagagatgaacc

SEQ ID NO: 213535 - DNA, 27 bp, Artificial Sequence
  Description of Artificial Sequence: Synthetic oligonucleotide
ctggaggtgcccgtagagatgaaccca

SEQ ID NO: 213536 - DNA, 27 bp, Artificial Sequence
  Description of Artificial Sequence: Synthetic oligonucleotide
tggaggtgcccgtagagatgaacccag

SEQ ID NO: 213537 - DNA, 27 bp, Artificial Sequence
  Description of Artificial Sequence: Synthetic oligonucleotide
ggaggtgcccgtagagatgaacccaga

SEQ ID NO: 213538 - DNA, 27 bp, Artificial Sequence
  Description of Artificial Sequence: Synthetic oligonucleotide
gaggtgcccgtagagatgaacccagag

SEQ ID NO: 213539 - DNA, 27 bp, Artificial Sequence
  Description of Artificial Sequence: Synthetic oligonucleotide
aggtgcccgtagagatgaacccagagg

SEQ ID NO: 213540 - DNA, 26 bp, Artificial Sequence
  Description of Artificial Sequence: Synthetic oligonucleotide
ggtgcccgtagagatgaacccagagg

SEQ ID NO: 213541 - DNA, 26 bp, Artificial Sequence
  Description of Artificial Sequence: Synthetic oligonucleotide
gtgcccgtagagatgaacccagaggg

SEQ ID NO: 213542 - DNA, 27 bp, Artificial Sequence
  Description of Artificial Sequence: Synthetic oligonucleotide
tgcccgtagagatgaacccagagggct

SEQ ID NO: 213543 - DNA, 27 bp, Artificial Sequence
  Description of Artificial Sequence: Synthetic oligonucleotide
gcccgtagagatgaacccagagggcta

SEQ ID NO: 213544 - DNA, 27 bp, Artificial Sequence
  Description of Artificial Sequence: Synthetic oligonucleotide
cccgtagagatgaacccagagggctac

SEQ ID NO: 213545 - DNA, 29 bp, Artificial Sequence
  Description of Artificial Sequence: Synthetic oligonucleotide
ccgtagagatgaacccagagggctacatg

SEQ ID NO: 213546 - DNA, 30 bp, Artificial Sequence
  Description of Artificial Sequence: Synthetic oligonucleotide
cgtagagatgaacccagagggctacatgac

SEQ ID NO: 213547 - DNA, 30 bp, Artificial Sequence
  Description of Artificial Sequence: Synthetic oligonucleotide
gtagagatgaacccagagggctacatgacc

SEQ ID NO: 213548 - DNA, 31 bp, Artificial Sequence
  Description of Artificial Sequence: Synthetic oligonucleotide
tagagatgaacccagagggctacatgaccag

SEQ ID NO: 213549 - DNA, 30 bp, Artificial Sequence
  Description of Artificial Sequence: Synthetic oligonucleotide
agagatgaacccagagggctacatgaccag

SEQ ID NO: 213550 - DNA, 29 bp, Artificial Sequence
  Description of Artificial Sequence: Synthetic oligonucleotide
gagatgaacccagagggctacatgaccag

SEQ ID NO: 213551 - DNA, 29 bp, Artificial Sequence
  Description of Artificial Sequence: Synthetic oligonucleotide
agatgaacccagagggctacatgaccagc

SEQ ID NO: 213552 - DNA, 28 bp, Artificial Sequence
  Description of Artificial Sequence: Synthetic oligonucleotide
gatgaacccagagggctacatgaccagc

SEQ ID NO: 213553 - DNA, 28 bp, Artificial Sequence
  Description of Artificial Sequence: Synthetic oligonucleotide
atgaacccagagggctacatgaccagcc

SEQ ID NO: 213554 - DNA, 27 bp, Artificial Sequence
  Description of Artificial Sequence: Synthetic oligonucleotide
tgaacccagagggctacatgaccagcc

SEQ ID NO: 213555 - DNA, 26 bp, Artificial Sequence
  Description of Artificial Sequence: Synthetic oligonucleotide
gaacccagagggctacatgaccagcc

SEQ ID NO: 213556 - DNA, 26 bp, Artificial Sequence
  Description of Artificial Sequence: Synthetic oligonucleotide
aacccagagggctacatgaccagccg

SEQ ID NO: 213557 - DNA, 25 bp, Artificial Sequence
  Description of Artificial Sequence: Synthetic oligonucleotide
acccagagggctacatgaccagccg

SEQ ID NO: 213558 - DNA, 24 bp, Artificial Sequence
  Description of Artificial Sequence: Synthetic oligonucleotide
cccagagggctacatgaccagccg

SEQ ID NO: 213559 - DNA, 25 bp, Artificial Sequence
  Description of Artificial Sequence: Synthetic oligonucleotide
ccagagggctacatgaccagccgca

SEQ ID NO: 213560 - DNA, 25 bp, Artificial Sequence
  Description of Artificial Sequence: Synthetic oligonucleotide
cagagggctacatgaccagccgcac

SEQ ID NO: 213561 - DNA, 25 bp, Artificial Sequence
  Description of Artificial Sequence: Synthetic oligonucleotide
agagggctacatgaccagccgcacg

SEQ ID NO: 213562 - DNA, 24 bp, Artificial Sequence
  Description of Artificial Sequence: Synthetic oligonucleotide
gagggctacatgaccagccgcacg

SEQ ID NO: 213563 - DNA, 25 bp, Artificial Sequence
  Description of Artificial Sequence: Synthetic oligonucleotide
agggctacatgaccagccgcacggt

SEQ ID NO: 213564 - DNA, 24 bp, Artificial Sequence
  Description of Artificial Sequence: Synthetic oligonucleotide
gggctacatgaccagccgcacggt

SEQ ID NO: 213565 - DNA, 24 bp, Artificial Sequence
  Description of Artificial Sequence: Synthetic oligonucleotide
ggctacatgaccagccgcacggtc

SEQ ID NO: 213566 - DNA, 24 bp, Artificial Sequence
  Description of Artificial Sequence: Synthetic oligonucleotide
gctacatgaccagccgcacggtcc

SEQ ID NO: 213567 - DNA, 24 bp, Artificial Sequence
  Description of Artificial Sequence: Synthetic oligonucleotide
ctacatgaccagccgcacggtccg

SEQ ID NO: 213568 - DNA, 24 bp, Artificial Sequence
  Description of Artificial Sequence: Synthetic oligonucleotide
tacatgaccagccgcacggtccgg

SEQ ID NO: 213569 - DNA, 23 bp, Artificial Sequence
  Description of Artificial Sequence: Synthetic oligonucleotide
acatgaccagccgcacggtccgg

SEQ ID NO: 213570 - DNA, 22 bp, Artificial Sequence
  Description of Artificial Sequence: Synthetic oligonucleotide
catgaccagccgcacggtccgg

SEQ ID NO: 213571 - DNA, 23 bp, Artificial Sequence
  Description of Artificial Sequence: Synthetic oligonucleotide
atgaccagccgcacggtccggga

SEQ ID NO: 213572 - DNA, 22 bp, Artificial Sequence
  Description of Artificial Sequence: Synthetic oligonucleotide
tgaccagccgcacggtccggga

SEQ ID NO: 213573 - DNA, 21 bp, Artificial Sequence
  Description of Artificial Sequence: Synthetic oligonucleotide
gaccagccgcacggtccggga

SEQ ID NO: 213574 - DNA, 21 bp, Artificial Sequence
  Description of Artificial Sequence: Synthetic oligonucleotide
accagccgcacggtccgggag

SEQ ID NO: 213575 - DNA, 20 bp, Artificial Sequence
  Description of Artificial Sequence: Synthetic oligonucleotide
ccagccgcacggtccgggag

SEQ ID NO: 213576 - DNA, 20 bp, Artificial Sequence
  Description of Artificial Sequence: Synthetic oligonucleotide
cagccgcacggtccgggagg

SEQ ID NO: 213577 - DNA, 20 bp, Artificial Sequence
  Description of Artificial Sequence: Synthetic oligonucleotide
agccgcacggtccgggaggc

SEQ ID NO: 213578 - DNA, 20 bp, Artificial Sequence
  Description of Artificial Sequence: Synthetic oligonucleotide
gccgcacggtccgggaggct

SEQ ID NO: 213579 - DNA, 20 bp, Artificial Sequence
  Description of Artificial Sequence: Synthetic oligonucleotide
ccgcacggtccgggaggcct

SEQ ID NO: 213580 - DNA, 20 bp, Artificial Sequence
  Description of Artificial Sequence: Synthetic oligonucleotide
cgcacggtccgggaggcctc

SEQ ID NO: 213581 - DNA, 20 bp, Artificial Sequence
  Description of Artificial Sequence: Synthetic oligonucleotide
gcacggtccgggaggcctcg

SEQ ID NO: 213582 - DNA, 20 bp, Artificial Sequence
  Description of Artificial Sequence: Synthetic oligonucleotide
cacggtccgggaggcctcgg

SEQ ID NO: 213583 - DNA, 20 bp, Artificial Sequence
  Description of Artificial Sequence: Synthetic oligonucleotide
acggtccgggaggcctcggg

SEQ ID NO: 213584 - DNA, 20 bp, Artificial Sequence
  Description of Artificial Sequence: Synthetic oligonucleotide
cggtccgggaggcctcgggt

SEQ ID NO: 213585 - DNA, 20 bp, Artificial Sequence
  Description of Artificial Sequence: Synthetic oligonucleotide
ggtccgggaggcctcgggct

SEQ ID NO: 213586 - DNA, 20 bp, Artificial Sequence
  Description of Artificial Sequence: Synthetic oligonucleotide
gtccgggaggcctcgggcct

SEQ ID NO: 213587 - DNA, 20 bp, Artificial Sequence
  Description of Artificial Sequence: Synthetic oligonucleotide
tccgggaggcctcgggcctg

SEQ ID NO: 213588 - DNA, 20 bp, Artificial Sequence
  Description of Artificial Sequence: Synthetic oligonucleotide
ccgggaggcctcgggcctgt

SEQ ID NO: 213589 - DNA, 20 bp, Artificial Sequence
  Description of Artificial Sequence: Synthetic oligonucleotide
cgggaggcctcgggcctgct

SEQ ID NO: 213590 - DNA, 21 bp, Artificial Sequence
  Description of Artificial Sequence: Synthetic oligonucleotide
gggaggcctcgggcctgctct

SEQ ID NO: 213591 - DNA, 21 bp, Artificial Sequence
  Description of Artificial Sequence: Synthetic oligonucleotide
ggaggcctcgggcctgctctc

SEQ ID NO: 213592 - DNA, 21 bp, Artificial Sequence
  Description of Artificial Sequence: Synthetic oligonucleotide
gaggcctcgggcctgctctcc

SEQ ID NO: 213593 - DNA, 22 bp, Artificial Sequence
  Description of Artificial Sequence: Synthetic oligonucleotide
aggcctcgggcctgctctccct

SEQ ID NO: 213594 - DNA, 21 bp, Artificial Sequence
  Description of Artificial Sequence: Synthetic oligonucleotide
ggcctcgggcctgctctccct

SEQ ID NO: 213595 - DNA, 22 bp, Artificial Sequence
  Description of Artificial Sequence: Synthetic oligonucleotide
gcctcgggcctgctctccctca

SEQ ID NO: 213596 - DNA, 22 bp, Artificial Sequence
  Description of Artificial Sequence: Synthetic oligonucleotide
cctcgggcctgctctccctcac

SEQ ID NO: 213597 - DNA, 23 bp, Artificial Sequence
  Description of Artificial Sequence: Synthetic oligonucleotide
ctcgggcctgctctccctcacca

SEQ ID NO: 213598 - DNA, 23 bp, Artificial Sequence
  Description of Artificial Sequence: Synthetic oligonucleotide
tcgggcctgctctccctcaccag

SEQ ID NO: 213599 - DNA, 22 bp, Artificial Sequence
  Description of Artificial Sequence: Synthetic oligonucleotide
cgggcctgctctccctcaccag

SEQ ID NO: 213600 - DNA, 23 bp, Artificial Sequence
  Description of Artificial Sequence: Synthetic oligonucleotide
gggcctgctctccctcaccagca

SEQ ID NO: 213601 - DNA, 23 bp, Artificial Sequence
  Description of Artificial Sequence: Synthetic oligonucleotide
ggcctgctctccctcaccagcac

SEQ ID NO: 213602 - DNA, 23 bp, Artificial Sequence
  Description of Artificial Sequence: Synthetic oligonucleotide
gcctgctctccctcaccagcacc

SEQ ID NO: 213603 - DNA, 24 bp, Artificial Sequence
  Description of Artificial Sequence: Synthetic oligonucleotide
cctgctctccctcaccagcaccct

SEQ ID NO: 213604 - DNA, 26 bp, Artificial Sequence
  Description of Artificial Sequence: Synthetic oligonucleotide
ctgctctccctcaccagcaccctcta

SEQ ID NO: 213605 - DNA, 26 bp, Artificial Sequence
  Description of Artificial Sequence: Synthetic oligonucleotide
tgctctccctcaccagcaccctctac

SEQ ID NO: 213606 - DNA, 25 bp, Artificial Sequence
  Description of Artificial Sequence: Synthetic oligonucleotide
gctctccctcaccagcaccctctac

SEQ ID NO: 213607 - DNA, 26 bp, Artificial Sequence
  Description of Artificial Sequence: Synthetic oligonucleotide
ctctccctcaccagcaccctctacct

SEQ ID NO: 213608 - DNA, 26 bp, Artificial Sequence
  Description of Artificial Sequence: Synthetic oligonucleotide
tctccctcaccagcaccctctacctg

SEQ ID NO: 213609 - DNA, 25 bp, Artificial Sequence
  Description of Artificial Sequence: Synthetic oligonucleotide
ctccctcaccagcaccctctacctg

SEQ ID NO: 213610 - DNA, 25 bp, Artificial Sequence
  Description of Artificial Sequence: Synthetic oligonucleotide
tccctcaccagcaccctctacctgc

SEQ ID NO: 213611 - DNA, 24 bp, Artificial Sequence
  Description of Artificial Sequence: Synthetic oligonucleotide
ccctcaccagcaccctctacctgc

SEQ ID NO: 213612 - DNA, 24 bp, Artificial Sequence
  Description of Artificial Sequence: Synthetic oligonucleotide
cctcaccagcaccctctacctgcg

SEQ ID NO: 213613 - DNA, 24 bp, Artificial Sequence
  Description of Artificial Sequence: Synthetic oligonucleotide
ctcaccagcaccctctacctgcgg

SEQ ID NO: 213614 - DNA, 25 bp, Artificial Sequence
  Description of Artificial Sequence: Synthetic oligonucleotide
tcaccagcaccctctacctgcggct

SEQ ID NO: 213615 - DNA, 24 bp, Artificial Sequence
  Description of Artificial Sequence: Synthetic oligonucleotide
caccagcaccctctacctgcggct

SEQ ID NO: 213616 - DNA, 24 bp, Artificial Sequence
  Description of Artificial Sequence: Synthetic oligonucleotide
accagcaccctctacctgcggctc

SEQ ID NO: 213617 - DNA, 23 bp, Artificial Sequence
  Description of Artificial Sequence: Synthetic oligonucleotide
ccagcaccctctacctgcggctc

SEQ ID NO: 213618 - DNA, 23 bp, Artificial Sequence
  Description of Artificial Sequence: Synthetic oligonucleotide
cagcaccctctacctgcggctcc

SEQ ID NO: 213619 - DNA, 23 bp, Artificial Sequence
  Description of Artificial Sequence: Synthetic oligonucleotide
agcaccctctacctgcggctccg

SEQ ID NO: 213620 - DNA, 22 bp, Artificial Sequence
  Description of Artificial Sequence: Synthetic oligonucleotide
gcaccctctacctgcggctccg

SEQ ID NO: 213621 - DNA, 24 bp, Artificial Sequence
  Description of Artificial Sequence: Synthetic oligonucleotide
caccctctacctgcggctccgcaa

SEQ ID NO: 213622 - DNA, 24 bp, Artificial Sequence
  Description of Artificial Sequence: Synthetic oligonucleotide
accctctacctgcggctccgcaag

SEQ ID NO: 213623 - DNA, 23 bp, Artificial Sequence
  Description of Artificial Sequence: Synthetic oligonucleotide
ccctctacctgcggctccgcaag

SEQ ID NO: 213624 - DNA, 25 bp, Artificial Sequence
  Description of Artificial Sequence: Synthetic oligonucleotide
cctctacctgcggctccgcaaggat

SEQ ID NO: 213625 - DNA, 26 bp, Artificial Sequence
  Description of Artificial Sequence: Synthetic oligonucleotide
ctctacctgcggctccgcaaggatga

SEQ ID NO: 213626 - DNA, 26 bp, Artificial Sequence
  Description of Artificial Sequence: Synthetic oligonucleotide
tctacctgcggctccgcaaggatgac

SEQ ID NO: 213627 - DNA, 25 bp, Artificial Sequence
  Description of Artificial Sequence: Synthetic oligonucleotide
ctacctgcggctccgcaaggatgac

SEQ ID NO: 213628 - DNA, 25 bp, Artificial Sequence
  Description of Artificial Sequence: Synthetic oligonucleotide
tacctgcggctccgcaaggatgacc

SEQ ID NO: 213629 - DNA, 24 bp, Artificial Sequence
  Description of Artificial Sequence: Synthetic oligonucleotide
acctgcggctccgcaaggatgacc

SEQ ID NO: 213630 - DNA, 23 bp, Artificial Sequence
  Description of Artificial Sequence: Synthetic oligonucleotide
cctgcggctccgcaaggatgacc

SEQ ID NO: 213631 - DNA, 24 bp, Artificial Sequence
  Description of Artificial Sequence: Synthetic oligonucleotide
ctgcggctccgcaaggatgaccga

SEQ ID NO: 213632 - DNA, 25 bp, Artificial Sequence
  Description of Artificial Sequence: Synthetic oligonucleotide
tgcggctccgcaaggatgaccgaga

SEQ ID NO: 213633 - DNA, 24 bp, Artificial Sequence
  Description of Artificial Sequence: Synthetic oligonucleotide
gcggctccgcaaggatgaccgaga

SEQ ID NO: 213634 - DNA, 24 bp, Artificial Sequence
  Description of Artificial Sequence: Synthetic oligonucleotide
cggctccgcaaggatgaccgagac

SEQ ID NO: 213635 - DNA, 24 bp, Artificial Sequence
  Description of Artificial Sequence: Synthetic oligonucleotide
ggctccgcaaggatgaccgagacg

SEQ ID NO: 213636 - DNA, 24 bp, Artificial Sequence
  Description of Artificial Sequence: Synthetic oligonucleotide
gctccgcaaggatgaccgagacgc

SEQ ID NO: 213637 - DNA, 25 bp, Artificial Sequence
  Description of Artificial Sequence: Synthetic oligonucleotide
ctccgcaaggatgaccgagacgcca

SEQ ID NO: 213638 - DNA, 25 bp, Artificial Sequence
  Description of Artificial Sequence: Synthetic oligonucleotide
tccgcaaggatgaccgagacgccag

SEQ ID NO: 213639 - DNA, 24 bp, Artificial Sequence
  Description of Artificial Sequence: Synthetic oligonucleotide
ccgcaaggatgaccgagacgccag

SEQ ID NO: 213640 - DNA, 26 bp, Artificial Sequence
  Description of Artificial Sequence: Synthetic oligonucleotide
cgcaaggatgaccgagacgccagctt

SEQ ID NO: 213641 - DNA, 26 bp, Artificial Sequence
  Description of Artificial Sequence: Synthetic oligonucleotide
gcaaggatgaccgagacgccagcttc

SEQ ID NO: 213642 - DNA, 27 bp, Artificial Sequence
  Description of Artificial Sequence: Synthetic oligonucleotide
caaggatgaccgagacgccagcttcca

SEQ ID NO: 213643 - DNA, 27 bp, Artificial Sequence
  Description of Artificial Sequence: Synthetic oligonucleotide
aaggatgaccgagacgccagcttccac

SEQ ID NO: 213644 - DNA, 27 bp, Artificial Sequence
  Description of Artificial Sequence: Synthetic oligonucleotide
aggatgaccgagacgccagcttccact

SEQ ID NO: 213645 - DNA, 26 bp, Artificial Sequence
  Description of Artificial Sequence: Synthetic oligonucleotide
ggatgaccgagacgccagcttccact

SEQ ID NO: 213646 - DNA, 26 bp, Artificial Sequence
  Description of Artificial Sequence: Synthetic oligonucleotide
gatgaccgagacgccagcttccactg

SEQ ID NO: 213647 - DNA, 26 bp, Artificial Sequence
  Description of Artificial Sequence: Synthetic oligonucleotide
atgaccgagacgccagcttccactgc

SEQ ID NO: 213648 - DNA, 25 bp, Artificial Sequence
  Description of Artificial Sequence: Synthetic oligonucleotide
tgaccgagacgccagcttccactgc

SEQ ID NO: 213649 - DNA, 24 bp, Artificial Sequence
  Description of Artificial Sequence: Synthetic oligonucleotide
gaccgagacgccagcttccactgc

SEQ ID NO: 213650 - DNA, 24 bp, Artificial Sequence
  Description of Artificial Sequence: Synthetic oligonucleotide
accgagacgccagcttccactgcg

SEQ ID NO: 213651 - DNA, 23 bp, Artificial Sequence
  Description of Artificial Sequence: Synthetic oligonucleotide
ccgagacgccagcttccactgcg

SEQ ID NO: 213652 - DNA, 23 bp, Artificial Sequence
  Description of Artificial Sequence: Synthetic oligonucleotide
cgagacgccagcttccactgcgc

SEQ ID NO: 213653 - DNA, 23 bp, Artificial Sequence
  Description of Artificial Sequence: Synthetic oligonucleotide
gagacgccagcttccactgcgcc

SEQ ID NO: 213654 - DNA, 23 bp, Artificial Sequence
  Description of Artificial Sequence: Synthetic oligonucleotide
agacgccagcttccactgcgccg

SEQ ID NO: 213655 - DNA, 22 bp, Artificial Sequence
  Description of Artificial Sequence: Synthetic oligonucleotide
gacgccagcttccactgcgccg

SEQ ID NO: 213656 - DNA, 22 bp, Artificial Sequence
  Description of Artificial Sequence: Synthetic oligonucleotide
acgccagcttccactgcgccgc

SEQ ID NO: 213657 - DNA, 21 bp, Artificial Sequence
  Description of Artificial Sequence: Synthetic oligonucleotide
cgccagcttccactgcgccgc

SEQ ID NO: 213658 - DNA, 21 bp, Artificial Sequence
  Description of Artificial Sequence: Synthetic oligonucleotide
gccagcttccactgcgccgcc

SEQ ID NO: 213659 - DNA, 22 bp, Artificial Sequence
  Description of Artificial Sequence: Synthetic oligonucleotide
ccagcttccactgcgccgccca

SEQ ID NO: 213660 - DNA, 24 bp, Artificial Sequence
  Description of Artificial Sequence: Synthetic oligonucleotide
cagcttccactgcgccgcccacta

SEQ ID NO: 213661 - DNA, 25 bp, Artificial Sequence
  Description of Artificial Sequence: Synthetic oligonucleotide
agcttccactgcgccgcccactaca

SEQ ID NO: 213662 - DNA, 24 bp, Artificial Sequence
  Description of Artificial Sequence: Synthetic oligonucleotide
gcttccactgcgccgcccactaca

SEQ ID NO: 213663 - DNA, 24 bp, Artificial Sequence
  Description of Artificial Sequence: Synthetic oligonucleotide
cttccactgcgccgcccactacag

SEQ ID NO: 213664 - DNA, 24 bp, Artificial Sequence
  Description of Artificial Sequence: Synthetic oligonucleotide
ttccactgcgccgcccactacagc

SEQ ID NO: 213665 - DNA, 23 bp, Artificial Sequence
  Description of Artificial Sequence: Synthetic oligonucleotide
tccactgcgccgcccactacagc

SEQ ID NO: 213666 - DNA, 22 bp, Artificial Sequence
  Description of Artificial Sequence: Synthetic oligonucleotide
ccactgcgccgcccactacagc

SEQ ID NO: 213667 - DNA, 23 bp, Artificial Sequence
  Description of Artificial Sequence: Synthetic oligonucleotide
cactgcgccgcccactacagcct

SEQ ID NO: 213668 - DNA, 23 bp, Artificial Sequence
  Description of Artificial Sequence: Synthetic oligonucleotide
actgcgccgcccactacagcctg

SEQ ID NO: 213669 - DNA, 22 bp, Artificial Sequence
  Description of Artificial Sequence: Synthetic oligonucleotide
ctgcgccgcccactacagcctg

SEQ ID NO: 213670 - DNA, 22 bp, Artificial Sequence
  Description of Artificial Sequence: Synthetic oligonucleotide
tgcgccgcccactacagcctgc

SEQ ID NO: 213671 - DNA, 21 bp, Artificial Sequence
  Description of Artificial Sequence: Synthetic oligonucleotide
gcgccgcccactacagcctgc

SEQ ID NO: 213672 - DNA, 21 bp, Artificial Sequence
  Description of Artificial Sequence: Synthetic oligonucleotide
cgccgcccactacagcctgcc

SEQ ID NO: 213673 - DNA, 21 bp, Artificial Sequence
  Description of Artificial Sequence: Synthetic oligonucleotide
gccgcccactacagcctgccc

SEQ ID NO: 213674 - DNA, 22 bp, Artificial Sequence
  Description of Artificial Sequence: Synthetic oligonucleotide
ccgcccactacagcctgcccga

SEQ ID NO: 213675 - DNA, 22 bp, Artificial Sequence
  Description of Artificial Sequence: Synthetic oligonucleotide
cgcccactacagcctgcccgag

SEQ ID NO: 213676 - DNA, 22 bp, Artificial Sequence
  Description of Artificial Sequence: Synthetic oligonucleotide
gcccactacagcctgcccgagg

SEQ ID NO: 213677 - DNA, 22 bp, Artificial Sequence
  Description of Artificial Sequence: Synthetic oligonucleotide
cccactacagcctgcccgaggg

SEQ ID NO: 213678 - DNA, 22 bp, Artificial Sequence
  Description of Artificial Sequence: Synthetic oligonucleotide
ccactacagcctgcccgagggc

SEQ ID NO: 213679 - DNA, 22 bp, Artificial Sequence
  Description of Artificial Sequence: Synthetic oligonucleotide
cactacagcctgcccgagggcc

SEQ ID NO: 213680 - DNA, 22 bp, Artificial Sequence
  Description of Artificial Sequence: Synthetic oligonucleotide
actacagcctgcccgagggccg

SEQ ID NO: 213681 - DNA, 21 bp, Artificial Sequence
  Description of Artificial Sequence: Synthetic oligonucleotide
ctacagcctgcccgagggccg

SEQ ID NO: 213682 - DNA, 21 bp, Artificial Sequence
  Description of Artificial Sequence: Synthetic oligonucleotide
tacagcctgcccgagggccgc

SEQ ID NO: 213683 - DNA, 20 bp, Artificial Sequence
  Description of Artificial Sequence: Synthetic oligonucleotide
acagcctgcccgagggccgc

SEQ ID NO: 213684 - DNA, 20 bp, Artificial Sequence
  Description of Artificial Sequence: Synthetic oligonucleotide
cagcctgcccgagggccgct

SEQ ID NO: 213685 - DNA, 20 bp, Artificial Sequence
  Description of Artificial Sequence: Synthetic oligonucleotide
agcctgcccgagggccgcca

SEQ ID NO: 213686 - DNA, 20 bp, Artificial Sequence
  Description of Artificial Sequence: Synthetic oligonucleotide
gcctgcccgagggccgccat

SEQ ID NO: 213687 - DNA, 20 bp, Artificial Sequence
  Description of Artificial Sequence: Synthetic oligonucleotide
cctgcccgagggccgccact

SEQ ID NO: 213688 - DNA, 20 bp, Artificial Sequence
  Description of Artificial Sequence: Synthetic oligonucleotide
ctgcccgagggccgccacgt

SEQ ID NO: 213689 - DNA, 20 bp, Artificial Sequence
  Description of Artificial Sequence: Synthetic oligonucleotide
tgcccgagggccgccacggt

SEQ ID NO: 213690 - DNA, 20 bp, Artificial Sequence
  Description of Artificial Sequence: Synthetic oligonucleotide
gcccgagggccgccacggtt

SEQ ID NO: 213691 - DNA, 20 bp, Artificial Sequence
  Description of Artificial Sequence: Synthetic oligonucleotide
cccgagggccgccacggctt

SEQ ID NO: 213692 - DNA, 20 bp, Artificial Sequence
  Description of Artificial Sequence: Synthetic oligonucleotide
ccgagggccgccacggcctt

SEQ ID NO: 213693 - DNA, 20 bp, Artificial Sequence
  Description of Artificial Sequence: Synthetic oligonucleotide
cgagggccgccacggccgtt

SEQ ID NO: 213694 - DNA, 20 bp, Artificial Sequence
  Description of Artificial Sequence: Synthetic oligonucleotide
gagggccgccacggccgctt

SEQ ID NO: 213695 - DNA, 20 bp, Artificial Sequence
  Description of Artificial Sequence: Synthetic oligonucleotide
agggccgccacggccgcctt

SEQ ID NO: 213696 - DNA, 20 bp, Artificial Sequence
  Description of Artificial Sequence: Synthetic oligonucleotide
gggccgccacggccgccttt

SEQ ID NO: 213697 - DNA, 20 bp, Artificial Sequence
  Description of Artificial Sequence: Synthetic oligonucleotide
ggccgccacggccgcctgtt

SEQ ID NO: 213698 - DNA, 20 bp, Artificial Sequence
  Description of Artificial Sequence: Synthetic oligonucleotide
gccgccacggccgcctggat

SEQ ID NO: 213699 - DNA, 20 bp, Artificial Sequence
  Description of Artificial Sequence: Synthetic oligonucleotide
ccgccacggccgcctggaca

SEQ ID NO: 213700 - DNA, 20 bp, Artificial Sequence
  Description of Artificial Sequence: Synthetic oligonucleotide
cgccacggccgcctggacag

SEQ ID NO: 213701 - DNA, 20 bp, Artificial Sequence
  Description of Artificial Sequence: Synthetic oligonucleotide
gccacggccgcctggacagc

SEQ ID NO: 213702 - DNA, 20 bp, Artificial Sequence
  Description of Artificial Sequence: Synthetic oligonucleotide
ccacggccgcctggacagcc

SEQ ID NO: 213703 - DNA, 20 bp, Artificial Sequence
  Description of Artificial Sequence: Synthetic oligonucleotide
cacggccgcctggacagccc

SEQ ID NO: 213704 - DNA, 21 bp, Artificial Sequence
  Description of Artificial Sequence: Synthetic oligonucleotide
acggccgcctggacagcccca

SEQ ID NO: 213705 - DNA, 20 bp, Artificial Sequence
  Description of Artificial Sequence: Synthetic oligonucleotide
cggccgcctggacagcccca

SEQ ID NO: 213706 - DNA, 20 bp, Artificial Sequence
  Description of Artificial Sequence: Synthetic oligonucleotide
ggccgcctggacagccccac

SEQ ID NO: 213707 - DNA, 22 bp, Artificial Sequence
  Description of Artificial Sequence: Synthetic oligonucleotide
gccgcctggacagccccacctt

SEQ ID NO: 213708 - DNA, 22 bp, Artificial Sequence
  Description of Artificial Sequence: Synthetic oligonucleotide
ccgcctggacagccccaccttc

SEQ ID NO: 213709 - DNA, 23 bp, Artificial Sequence
  Description of Artificial Sequence: Synthetic oligonucleotide
cgcctggacagccccaccttcca

SEQ ID NO: 213710 - DNA, 23 bp, Artificial Sequence
  Description of Artificial Sequence: Synthetic oligonucleotide
gcctggacagccccaccttccac

SEQ ID NO: 213711 - DNA, 24 bp, Artificial Sequence
  Description of Artificial Sequence: Synthetic oligonucleotide
cctggacagccccaccttccacct

SEQ ID NO: 213712 - DNA, 25 bp, Artificial Sequence
  Description of Artificial Sequence: Synthetic oligonucleotide
ctggacagccccaccttccacctca

SEQ ID NO: 213713 - DNA, 25 bp, Artificial Sequence
  Description of Artificial Sequence: Synthetic oligonucleotide
tggacagccccaccttccacctcac

SEQ ID NO: 213714 - DNA, 24 bp, Artificial Sequence
  Description of Artificial Sequence: Synthetic oligonucleotide
ggacagccccaccttccacctcac

SEQ ID NO: 213715 - DNA, 24 bp, Artificial Sequence
  Description of Artificial Sequence: Synthetic oligonucleotide
gacagccccaccttccacctcacc

SEQ ID NO: 213716 - DNA, 25 bp, Artificial Sequence
  Description of Artificial Sequence: Synthetic oligonucleotide
acagccccaccttccacctcaccct

SEQ ID NO: 213717 - DNA, 24 bp, Artificial Sequence
  Description of Artificial Sequence: Synthetic oligonucleotide
cagccccaccttccacctcaccct

SEQ ID NO: 213718 - DNA, 24 bp, Artificial Sequence
  Description of Artificial Sequence: Synthetic oligonucleotide
agccccaccttccacctcaccctg

SEQ ID NO: 213719 - DNA, 23 bp, Artificial Sequence
  Description of Artificial Sequence: Synthetic oligonucleotide
gccccaccttccacctcaccctg

SEQ ID NO: 213720 - DNA, 24 bp, Artificial Sequence
  Description of Artificial Sequence: Synthetic oligonucleotide
ccccaccttccacctcaccctgca

SEQ ID NO: 213721 - DNA, 27 bp, Artificial Sequence
  Description of Artificial Sequence: Synthetic oligonucleotide
cccaccttccacctcaccctgcactat

SEQ ID NO: 213722 - DNA, 27 bp, Artificial Sequence
  Description of Artificial Sequence: Synthetic oligonucleotide
ccaccttccacctcaccctgcactatc

SEQ ID NO: 213723 - DNA, 27 bp, Artificial Sequence
  Description of Artificial Sequence: Synthetic oligonucleotide
caccttccacctcaccctgcactatcc

SEQ ID NO: 213724 - DNA, 27 bp, Artificial Sequence
  Description of Artificial Sequence: Synthetic oligonucleotide
accttccacctcaccctgcactatccc

SEQ ID NO: 213725 - DNA, 27 bp, Artificial Sequence
  Description of Artificial Sequence: Synthetic oligonucleotide
ccttccacctcaccctgcactatccca

SEQ ID NO: 213726 - DNA, 27 bp, Artificial Sequence
  Description of Artificial Sequence: Synthetic oligonucleotide
cttccacctcaccctgcactatcccac

SEQ ID NO: 213727 - DNA, 27 bp, Artificial Sequence
  Description of Artificial Sequence: Synthetic oligonucleotide
ttccacctcaccctgcactatcccacg

SEQ ID NO: 213728 - DNA, 26 bp, Artificial Sequence
  Description of Artificial Sequence: Synthetic oligonucleotide
tccacctcaccctgcactatcccacg

SEQ ID NO: 213729 - DNA, 25 bp, Artificial Sequence
  Description of Artificial Sequence: Synthetic oligonucleotide
ccacctcaccctgcactatcccacg

SEQ ID NO: 213730 - DNA, 26 bp, Artificial Sequence
  Description of Artificial Sequence: Synthetic oligonucleotide
cacctcaccctgcactatcccacgga

SEQ ID NO: 213731 - DNA, 26 bp, Artificial Sequence
  Description of Artificial Sequence: Synthetic oligonucleotide
acctcaccctgcactatcccacggag

SEQ ID NO: 213732 - DNA, 25 bp, Artificial Sequence
  Description of Artificial Sequence: Synthetic oligonucleotide
cctcaccctgcactatcccacggag

SEQ ID NO: 213733 - DNA, 26 bp, Artificial Sequence
  Description of Artificial Sequence: Synthetic oligonucleotide
ctcaccctgcactatcccacggagca

SEQ ID NO: 213734 - DNA, 26 bp, Artificial Sequence
  Description of Artificial Sequence: Synthetic oligonucleotide
tcaccctgcactatcccacggagcac

SEQ ID NO: 213735 - DNA, 25 bp, Artificial Sequence
  Description of Artificial Sequence: Synthetic oligonucleotide
caccctgcactatcccacggagcac

SEQ ID NO: 213736 - DNA, 26 bp, Artificial Sequence
  Description of Artificial Sequence: Synthetic oligonucleotide
accctgcactatcccacggagcacgt

SEQ ID NO: 213737 - DNA, 25 bp, Artificial Sequence
  Description of Artificial Sequence: Synthetic oligonucleotide
ccctgcactatcccacggagcacgt

SEQ ID NO: 213738 - DNA, 25 bp, Artificial Sequence
  Description of Artificial Sequence: Synthetic oligonucleotide
cctgcactatcccacggagcacgtg

SEQ ID NO: 213739 - DNA, 26 bp, Artificial Sequence
  Description of Artificial Sequence: Synthetic oligonucleotide
ctgcactatcccacggagcacgtgca

SEQ ID NO: 213740 - DNA, 27 bp, Artificial Sequence
  Description of Artificial Sequence: Synthetic oligonucleotide
tgcactatcccacggagcacgtgcagt

SEQ ID NO: 213741 - DNA, 27 bp, Artificial Sequence
  Description of Artificial Sequence: Synthetic oligonucleotide
gcactatcccacggagcacgtgcagtt

SEQ ID NO: 213742 - DNA, 27 bp, Artificial Sequence
  Description of Artificial Sequence: Synthetic oligonucleotide
cactatcccacggagcacgtgcagttc

SEQ ID NO: 213743 - DNA, 28 bp, Artificial Sequence
  Description of Artificial Sequence: Synthetic oligonucleotide
actatcccacggagcacgtgcagttctg

SEQ ID NO: 213744 - DNA, 27 bp, Artificial Sequence
  Description of Artificial Sequence: Synthetic oligonucleotide
ctatcccacggagcacgtgcagttctg

SEQ ID NO: 213745 - DNA, 27 bp, Artificial Sequence
  Description of Artificial Sequence: Synthetic oligonucleotide
tatcccacggagcacgtgcagttctgg

SEQ ID NO: 213746 - DNA, 26 bp, Artificial Sequence
  Description of Artificial Sequence: Synthetic oligonucleotide
atcccacggagcacgtgcagttctgg

SEQ ID NO: 213747 - DNA, 25 bp, Artificial Sequence
  Description of Artificial Sequence: Synthetic oligonucleotide
tcccacggagcacgtgcagttctgg

SEQ ID NO: 213748 - DNA, 24 bp, Artificial Sequence
  Description of Artificial Sequence: Synthetic oligonucleotide
cccacggagcacgtgcagttctgg

SEQ ID NO: 213749 - DNA, 25 bp, Artificial Sequence
  Description of Artificial Sequence: Synthetic oligonucleotide
ccacggagcacgtgcagttctgggt

SEQ ID NO: 213750 - DNA, 25 bp, Artificial Sequence
  Description of Artificial Sequence: Synthetic oligonucleotide
cacggagcacgtgcagttctgggtg

SEQ ID NO: 213751 - DNA, 25 bp, Artificial Sequence
  Description of Artificial Sequence: Synthetic oligonucleotide
acggagcacgtgcagttctgggtgg

SEQ ID NO: 213752 - DNA, 24 bp, Artificial Sequence
  Description of Artificial Sequence: Synthetic oligonucleotide
cggagcacgtgcagttctgggtgg

SEQ ID NO: 213753 - DNA, 24 bp, Artificial Sequence
  Description of Artificial Sequence: Synthetic oligonucleotide
ggagcacgtgcagttctgggtggg

SEQ ID NO: 213754 - DNA, 25 bp, Artificial Sequence
  Description of Artificial Sequence: Synthetic oligonucleotide
gagcacgtgcagttctgggtgggca

SEQ ID NO: 213755 - DNA, 25 bp, Artificial Sequence
  Description of Artificial Sequence: Synthetic oligonucleotide
agcacgtgcagttctgggtgggcag

SEQ ID NO: 213756 - DNA, 24 bp, Artificial Sequence
  Description of Artificial Sequence: Synthetic oligonucleotide
gcacgtgcagttctgggtgggcag

SEQ ID NO: 213757 - DNA, 24 bp, Artificial Sequence
  Description of Artificial Sequence: Synthetic oligonucleotide
cacgtgcagttctgggtgggcagc

SEQ ID NO: 213758 - DNA, 24 bp, Artificial Sequence
  Description of Artificial Sequence: Synthetic oligonucleotide
acgtgcagttctgggtgggcagcc

SEQ ID NO: 213759 - DNA, 23 bp, Artificial Sequence
  Description of Artificial Sequence: Synthetic oligonucleotide
cgtgcagttctgggtgggcagcc

SEQ ID NO: 213760 - DNA, 23 bp, Artificial Sequence
  Description of Artificial Sequence: Synthetic oligonucleotide
gtgcagttctgggtgggcagccc

SEQ ID NO: 213761 - DNA, 24 bp, Artificial Sequence
  Description of Artificial Sequence: Synthetic oligonucleotide
tgcagttctgggtgggcagcccgt

SEQ ID NO: 213762 - DNA, 23 bp, Artificial Sequence
  Description of Artificial Sequence: Synthetic oligonucleotide
gcagttctgggtgggcagcccgt

SEQ ID NO: 213763 - DNA, 23 bp, Artificial Sequence
  Description of Artificial Sequence: Synthetic oligonucleotide
cagttctgggtgggcagcccgtc

SEQ ID NO: 213764 - DNA, 24 bp, Artificial Sequence
  Description of Artificial Sequence: Synthetic oligonucleotide
agttctgggtgggcagcccgtcca

SEQ ID NO: 213765 - DNA, 23 bp, Artificial Sequence
  Description of Artificial Sequence: Synthetic oligonucleotide
gttctgggtgggcagcccgtcca

SEQ ID NO: 213766 - DNA, 23 bp, Artificial Sequence
  Description of Artificial Sequence: Synthetic oligonucleotide
ttctgggtgggcagcccgtccac

SEQ ID NO: 213767 - DNA, 22 bp, Artificial Sequence
  Description of Artificial Sequence: Synthetic oligonucleotide
tctgggtgggcagcccgtccac

SEQ ID NO: 213768 - DNA, 21 bp, Artificial Sequence
  Description of Artificial Sequence: Synthetic oligonucleotide
ctgggtgggcagcccgtccac

SEQ ID NO: 213769 - DNA, 21 bp, Artificial Sequence
  Description of Artificial Sequence: Synthetic oligonucleotide
tgggtgggcagcccgtccacc

SEQ ID NO: 213770 - DNA, 20 bp, Artificial Sequence
  Description of Artificial Sequence: Synthetic oligonucleotide
gggtgggcagcccgtccacc

SEQ ID NO: 213771 - DNA, 20 bp, Artificial Sequence
  Description of Artificial Sequence: Synthetic oligonucleotide
ggtgggcagcccgtccaccc

SEQ ID NO: 213772 - DNA, 21 bp, Artificial Sequence
  Description of Artificial Sequence: Synthetic oligonucleotide
gtgggcagcccgtccacccca

SEQ ID NO: 213773 - DNA, 21 bp, Artificial Sequence
  Description of Artificial Sequence: Synthetic oligonucleotide
tgggcagcccgtccaccccag

SEQ ID NO: 213774 - DNA, 20 bp, Artificial Sequence
  Description of Artificial Sequence: Synthetic oligonucleotide
gggcagcccgtccaccccag

SEQ ID NO: 213775 - DNA, 21 bp, Artificial Sequence
  Description of Artificial Sequence: Synthetic oligonucleotide
ggcagcccgtccaccccagca

SEQ ID NO: 213776 - DNA, 21 bp, Artificial Sequence
  Description of Artificial Sequence: Synthetic oligonucleotide
gcagcccgtccaccccagcag

SEQ ID NO: 213777 - DNA, 21 bp, Artificial Sequence
  Description of Artificial Sequence: Synthetic oligonucleotide
cagcccgtccaccccagcagg

SEQ ID NO: 213778 - DNA, 22 bp, Artificial Sequence
  Description of Artificial Sequence: Synthetic oligonucleotide
agcccgtccaccccagcaggct

SEQ ID NO: 213779 - DNA, 21 bp, Artificial Sequence
  Description of Artificial Sequence: Synthetic oligonucleotide
gcccgtccaccccagcaggct

SEQ ID NO: 213780 - DNA, 21 bp, Artificial Sequence
  Description of Artificial Sequence: Synthetic oligonucleotide
cccgtccaccccagcaggctg

SEQ ID NO: 213781 - DNA, 21 bp, Artificial Sequence
  Description of Artificial Sequence: Synthetic oligonucleotide
ccgtccaccccagcaggctgg

SEQ ID NO: 213782 - DNA, 23 bp, Artificial Sequence
  Description of Artificial Sequence: Synthetic oligonucleotide
cgtccaccccagcaggctgggta

SEQ ID NO: 213783 - DNA, 23 bp, Artificial Sequence
  Description of Artificial Sequence: Synthetic oligonucleotide
gtccaccccagcaggctgggtac

SEQ ID NO: 213784 - DNA, 23 bp, Artificial Sequence
  Description of Artificial Sequence: Synthetic oligonucleotide
tccaccccagcaggctgggtacg

SEQ ID NO: 213785 - DNA, 22 bp, Artificial Sequence
  Description of Artificial Sequence: Synthetic oligonucleotide
ccaccccagcaggctgggtacg

SEQ ID NO: 213786 - DNA, 22 bp, Artificial Sequence
  Description of Artificial Sequence: Synthetic oligonucleotide
caccccagcaggctgggtacgc

SEQ ID NO: 213787 - DNA, 23 bp, Artificial Sequence
  Description of Artificial Sequence: Synthetic oligonucleotide
accccagcaggctgggtacgcga

SEQ ID NO: 213788 - DNA, 22 bp, Artificial Sequence
  Description of Artificial Sequence: Synthetic oligonucleotide
ccccagcaggctgggtacgcga

SEQ ID NO: 213789 - DNA, 22 bp, Artificial Sequence
  Description of Artificial Sequence: Synthetic oligonucleotide
cccagcaggctgggtacgcgag

SEQ ID NO: 213790 - DNA, 22 bp, Artificial Sequence
  Description of Artificial Sequence: Synthetic oligonucleotide
ccagcaggctgggtacgcgagg

SEQ ID NO: 213791 - DNA, 23 bp, Artificial Sequence
  Description of Artificial Sequence: Synthetic oligonucleotide
cagcaggctgggtacgcgagggt

SEQ ID NO: 213792 - DNA, 24 bp, Artificial Sequence
  Description of Artificial Sequence: Synthetic oligonucleotide
agcaggctgggtacgcgagggtga

SEQ ID NO: 213793 - DNA, 23 bp, Artificial Sequence
  Description of Artificial Sequence: Synthetic oligonucleotide
gcaggctgggtacgcgagggtga

SEQ ID NO: 213794 - DNA, 24 bp, Artificial Sequence
  Description of Artificial Sequence: Synthetic oligonucleotide
caggctgggtacgcgagggtgaca

SEQ ID NO: 213795 - DNA, 25 bp, Artificial Sequence
  Description of Artificial Sequence: Synthetic oligonucleotide
aggctgggtacgcgagggtgacact

SEQ ID NO: 213796 - DNA, 24 bp, Artificial Sequence
  Description of Artificial Sequence: Synthetic oligonucleotide
ggctgggtacgcgagggtgacact

SEQ ID NO: 213797 - DNA, 25 bp, Artificial Sequence
  Description of Artificial Sequence: Synthetic oligonucleotide
gctgggtacgcgagggtgacactgt

SEQ ID NO: 213798 - DNA, 25 bp, Artificial Sequence
  Description of Artificial Sequence: Synthetic oligonucleotide
ctgggtacgcgagggtgacactgtc

SEQ ID NO: 213799 - DNA, 26 bp, Artificial Sequence
  Description of Artificial Sequence: Synthetic oligonucleotide
tgggtacgcgagggtgacactgtcca

SEQ ID NO: 213800 - DNA, 25 bp, Artificial Sequence
  Description of Artificial Sequence: Synthetic oligonucleotide
gggtacgcgagggtgacactgtcca

SEQ ID NO: 213801 - DNA, 25 bp, Artificial Sequence
  Description of Artificial Sequence: Synthetic oligonucleotide
ggtacgcgagggtgacactgtccag

SEQ ID NO: 213802 - DNA, 26 bp, Artificial Sequence
  Description of Artificial Sequence: Synthetic oligonucleotide
gtacgcgagggtgacactgtccagct

SEQ ID NO: 213803 - DNA, 26 bp, Artificial Sequence
  Description of Artificial Sequence: Synthetic oligonucleotide
tacgcgagggtgacactgtccagctg

SEQ ID NO: 213804 - DNA, 25 bp, Artificial Sequence
  Description of Artificial Sequence: Synthetic oligonucleotide
acgcgagggtgacactgtccagctg

SEQ ID NO: 213805 - DNA, 24 bp, Artificial Sequence
  Description of Artificial Sequence: Synthetic oligonucleotide
cgcgagggtgacactgtccagctg

SEQ ID NO: 213806 - DNA, 25 bp, Artificial Sequence
  Description of Artificial Sequence: Synthetic oligonucleotide
gcgagggtgacactgtccagctgct

SEQ ID NO: 213807 - DNA, 26 bp, Artificial Sequence
  Description of Artificial Sequence: Synthetic oligonucleotide
cgagggtgacactgtccagctgctct

SEQ ID NO: 213808 - DNA, 26 bp, Artificial Sequence
  Description of Artificial Sequence: Synthetic oligonucleotide
gagggtgacactgtccagctgctctg

SEQ ID NO: 213809 - DNA, 26 bp, Artificial Sequence
  Description of Artificial Sequence: Synthetic oligonucleotide
agggtgacactgtccagctgctctgc

SEQ ID NO: 213810 - DNA, 25 bp, Artificial Sequence
  Description of Artificial Sequence: Synthetic oligonucleotide
gggtgacactgtccagctgctctgc

SEQ ID NO: 213811 - DNA, 25 bp, Artificial Sequence
  Description of Artificial Sequence: Synthetic oligonucleotide
ggtgacactgtccagctgctctgcc

SEQ ID NO: 213812 - DNA, 25 bp, Artificial Sequence
  Description of Artificial Sequence: Synthetic oligonucleotide
gtgacactgtccagctgctctgccg

SEQ ID NO: 213813 - DNA, 25 bp, Artificial Sequence
  Description of Artificial Sequence: Synthetic oligonucleotide
tgacactgtccagctgctctgccgg

SEQ ID NO: 213814 - DNA, 24 bp, Artificial Sequence
  Description of Artificial Sequence: Synthetic oligonucleotide
gacactgtccagctgctctgccgg

SEQ ID NO: 213815 - DNA, 24 bp, Artificial Sequence
  Description of Artificial Sequence: Synthetic oligonucleotide
acactgtccagctgctctgccggg

SEQ ID NO: 213816 - DNA, 23 bp, Artificial Sequence
  Description of Artificial Sequence: Synthetic oligonucleotide
cactgtccagctgctctgccggg

SEQ ID NO: 213817 - DNA, 23 bp, Artificial Sequence
  Description of Artificial Sequence: Synthetic oligonucleotide
actgtccagctgctctgccgggg

SEQ ID NO: 213818 - DNA, 22 bp, Artificial Sequence
  Description of Artificial Sequence: Synthetic oligonucleotide
ctgtccagctgctctgccgggg

SEQ ID NO: 213819 - DNA, 22 bp, Artificial Sequence
  Description of Artificial Sequence: Synthetic oligonucleotide
tgtccagctgctctgccggggg

SEQ ID NO: 213820 - DNA, 21 bp, Artificial Sequence
  Description of Artificial Sequence: Synthetic oligonucleotide
gtccagctgctctgccggggg

SEQ ID NO: 213821 - DNA, 22 bp, Artificial Sequence
  Description of Artificial Sequence: Synthetic oligonucleotide
tccagctgctctgccgggggga

SEQ ID NO: 213822 - DNA, 21 bp, Artificial Sequence
  Description of Artificial Sequence: Synthetic oligonucleotide
ccagctgctctgccgggggga

SEQ ID NO: 213823 - DNA, 21 bp, Artificial Sequence
  Description of Artificial Sequence: Synthetic oligonucleotide
cagctgctctgccggggggac

SEQ ID NO: 213824 - DNA, 21 bp, Artificial Sequence
  Description of Artificial Sequence: Synthetic oligonucleotide
agctgctctgccggggggacg

SEQ ID NO: 213825 - DNA, 20 bp, Artificial Sequence
  Description of Artificial Sequence: Synthetic oligonucleotide
gctgctctgccggggggacg

SEQ ID NO: 213826 - DNA, 20 bp, Artificial Sequence
  Description of Artificial Sequence: Synthetic oligonucleotide
ctgctctgccggggggacgg

SEQ ID NO: 213827 - DNA, 21 bp, Artificial Sequence
  Description of Artificial Sequence: Synthetic oligonucleotide
tgctctgccggggggacggca

SEQ ID NO: 213828 - DNA, 20 bp, Artificial Sequence
  Description of Artificial Sequence: Synthetic oligonucleotide
gctctgccggggggacggca

SEQ ID NO: 213829 - DNA, 20 bp, Artificial Sequence
  Description of Artificial Sequence: Synthetic oligonucleotide
ctctgccggggggacggcag

SEQ ID NO: 213830 - DNA, 20 bp, Artificial Sequence
  Description of Artificial Sequence: Synthetic oligonucleotide
tctgccggggggacggcagc

SEQ ID NO: 213831 - DNA, 20 bp, Artificial Sequence
  Description of Artificial Sequence: Synthetic oligonucleotide
ctgccggggggacggcagct

SEQ ID NO: 213832 - DNA, 20 bp, Artificial Sequence
  Description of Artificial Sequence: Synthetic oligonucleotide
tgccggggggacggcagcct

SEQ ID NO: 213833 - DNA, 20 bp, Artificial Sequence
  Description of Artificial Sequence: Synthetic oligonucleotide
gccggggggacggcagcctt

SEQ ID NO: 213834 - DNA, 20 bp, Artificial Sequence
  Description of Artificial Sequence: Synthetic oligonucleotide
ccggggggacggcagccctt

SEQ ID NO: 213835 - DNA, 20 bp, Artificial Sequence
  Description of Artificial Sequence: Synthetic oligonucleotide
cggggggacggcagccccat

SEQ ID NO: 213836 - DNA, 20 bp, Artificial Sequence
  Description of Artificial Sequence: Synthetic oligonucleotide
ggggggacggcagccccagt

SEQ ID NO: 213837 - DNA, 20 bp, Artificial Sequence
  Description of Artificial Sequence: Synthetic oligonucleotide
gggggacggcagccccagct

SEQ ID NO: 213838 - DNA, 20 bp, Artificial Sequence
  Description of Artificial Sequence: Synthetic oligonucleotide
ggggacggcagccccagcct

SEQ ID NO: 213839 - DNA, 20 bp, Artificial Sequence
  Description of Artificial Sequence: Synthetic oligonucleotide
gggacggcagccccagccct

SEQ ID NO: 213840 - DNA, 20 bp, Artificial Sequence
  Description of Artificial Sequence: Synthetic oligonucleotide
ggacggcagccccagcccgt

SEQ ID NO: 213841 - DNA, 20 bp, Artificial Sequence
  Description of Artificial Sequence: Synthetic oligonucleotide
gacggcagccccagcccgga

SEQ ID NO: 213842 - DNA, 24 bp, Artificial Sequence
  Description of Artificial Sequence: Synthetic oligonucleotide
acggcagccccagcccggagtata

SEQ ID NO: 213843 - DNA, 23 bp, Artificial Sequence
  Description of Artificial Sequence: Synthetic oligonucleotide
cggcagccccagcccggagtata

SEQ ID NO: 213844 - DNA, 23 bp, Artificial Sequence
  Description of Artificial Sequence: Synthetic oligonucleotide
ggcagccccagcccggagtatac

SEQ ID NO: 213845 - DNA, 23 bp, Artificial Sequence
  Description of Artificial Sequence: Synthetic oligonucleotide
gcagccccagcccggagtatacg

SEQ ID NO: 213846 - DNA, 27 bp, Artificial Sequence
  Description of Artificial Sequence: Synthetic oligonucleotide
cagccccagcccggagtatacgctttt

SEQ ID NO: 213847 - DNA, 27 bp, Artificial Sequence
  Description of Artificial Sequence: Synthetic oligonucleotide
agccccagcccggagtatacgcttttc

SEQ ID NO: 213848 - DNA, 26 bp, Artificial Sequence
  Description of Artificial Sequence: Synthetic oligonucleotide
gccccagcccggagtatacgcttttc

SEQ ID NO: 213849 - DNA, 26 bp, Artificial Sequence
  Description of Artificial Sequence: Synthetic oligonucleotide
ccccagcccggagtatacgcttttcc

SEQ ID NO: 213850 - DNA, 26 bp, Artificial Sequence
  Description of Artificial Sequence: Synthetic oligonucleotide
cccagcccggagtatacgcttttccg

SEQ ID NO: 213851 - DNA, 26 bp, Artificial Sequence
  Description of Artificial Sequence: Synthetic oligonucleotide
ccagcccggagtatacgcttttccgc

SEQ ID NO: 213852 - DNA, 27 bp, Artificial Sequence
  Description of Artificial Sequence: Synthetic oligonucleotide
cagcccggagtatacgcttttccgcct

SEQ ID NO: 213853 - DNA, 28 bp, Artificial Sequence
  Description of Artificial Sequence: Synthetic oligonucleotide
agcccggagtatacgcttttccgccttc

SEQ ID NO: 213854 - DNA, 27 bp, Artificial Sequence
  Description of Artificial Sequence: Synthetic oligonucleotide
gcccggagtatacgcttttccgccttc

SEQ ID NO: 213855 - DNA, 28 bp, Artificial Sequence
  Description of Artificial Sequence: Synthetic oligonucleotide
cccggagtatacgcttttccgccttcag

SEQ ID NO: 213856 - DNA, 28 bp, Artificial Sequence
  Description of Artificial Sequence: Synthetic oligonucleotide
ccggagtatacgcttttccgccttcagg

SEQ ID NO: 213857 - DNA, 30 bp, Artificial Sequence
  Description of Artificial Sequence: Synthetic oligonucleotide
cggagtatacgcttttccgccttcaggatg

SEQ ID NO: 213858 - DNA, 31 bp, Artificial Sequence
  Description of Artificial Sequence: Synthetic oligonucleotide
ggagtatacgcttttccgccttcaggatgag

SEQ ID NO: 213859 - DNA, 31 bp, Artificial Sequence
  Description of Artificial Sequence: Synthetic oligonucleotide
gagtatacgcttttccgccttcaggatgagc

SEQ ID NO: 213860 - DNA, 32 bp, Artificial Sequence
  Description of Artificial Sequence: Synthetic oligonucleotide
agtatacgcttttccgccttcaggatgagcag

SEQ ID NO: 213861 - DNA, 31 bp, Artificial Sequence
  Description of Artificial Sequence: Synthetic oligonucleotide
gtatacgcttttccgccttcaggatgagcag

SEQ ID NO: 213862 - DNA, 31 bp, Artificial Sequence
  Description of Artificial Sequence: Synthetic oligonucleotide
tatacgcttttccgccttcaggatgagcagg

SEQ ID NO: 213863 - DNA, 30 bp, Artificial Sequence
  Description of Artificial Sequence: Synthetic oligonucleotide
atacgcttttccgccttcaggatgagcagg

SEQ ID NO: 213864 - DNA, 29 bp, Artificial Sequence
  Description of Artificial Sequence: Synthetic oligonucleotide
tacgcttttccgccttcaggatgagcagg

SEQ ID NO: 213865 - DNA, 28 bp, Artificial Sequence
  Description of Artificial Sequence: Synthetic oligonucleotide
acgcttttccgccttcaggatgagcagg

SEQ ID NO: 213866 - DNA, 27 bp, Artificial Sequence
  Description of Artificial Sequence: Synthetic oligonucleotide
cgcttttccgccttcaggatgagcagg

SEQ ID NO: 213867 - DNA, 28 bp, Artificial Sequence
  Description of Artificial Sequence: Synthetic oligonucleotide
gcttttccgccttcaggatgagcaggag

SEQ ID NO: 213868 - DNA, 28 bp, Artificial Sequence
  Description of Artificial Sequence: Synthetic oligonucleotide
cttttccgccttcaggatgagcaggagg

SEQ ID NO: 213869 - DNA, 30 bp, Artificial Sequence
  Description of Artificial Sequence: Synthetic oligonucleotide
ttttccgccttcaggatgagcaggaggaag

SEQ ID NO: 213870 - DNA, 29 bp, Artificial Sequence
  Description of Artificial Sequence: Synthetic oligonucleotide
tttccgccttcaggatgagcaggaggaag

SEQ ID NO: 213871 - DNA, 28 bp, Artificial Sequence
  Description of Artificial Sequence: Synthetic oligonucleotide
ttccgccttcaggatgagcaggaggaag

SEQ ID NO: 213872 - DNA, 27 bp, Artificial Sequence
  Description of Artificial Sequence: Synthetic oligonucleotide
tccgccttcaggatgagcaggaggaag

SEQ ID NO: 213873 - DNA, 27 bp, Artificial Sequence
  Description of Artificial Sequence: Synthetic oligonucleotide
ccgccttcaggatgagcaggaggaagt

SEQ ID NO: 213874 - DNA, 27 bp, Artificial Sequence
  Description of Artificial Sequence: Synthetic oligonucleotide
cgccttcaggatgagcaggaggaagtg

SEQ ID NO: 213875 - DNA, 27 bp, Artificial Sequence
  Description of Artificial Sequence: Synthetic oligonucleotide
gccttcaggatgagcaggaggaagtgc

SEQ ID NO: 213876 - DNA, 28 bp, Artificial Sequence
  Description of Artificial Sequence: Synthetic oligonucleotide
ccttcaggatgagcaggaggaagtgctg

SEQ ID NO: 213877 - DNA, 31 bp, Artificial Sequence
  Description of Artificial Sequence: Synthetic oligonucleotide
cttcaggatgagcaggaggaagtgctgaatg

SEQ ID NO: 213878 - DNA, 32 bp, Artificial Sequence
  Description of Artificial Sequence: Synthetic oligonucleotide
ttcaggatgagcaggaggaagtgctgaatgtg

SEQ ID NO: 213879 - DNA, 31 bp, Artificial Sequence
  Description of Artificial Sequence: Synthetic oligonucleotide
tcaggatgagcaggaggaagtgctgaatgtg

SEQ ID NO: 213880 - DNA, 30 bp, Artificial Sequence
  Description of Artificial Sequence: Synthetic oligonucleotide
caggatgagcaggaggaagtgctgaatgtg

SEQ ID NO: 213881 - DNA, 33 bp, Artificial Sequence
  Description of Artificial Sequence: Synthetic oligonucleotide
aggatgagcaggaggaagtgctgaatgtgaatc

SEQ ID NO: 213882 - DNA, 32 bp, Artificial Sequence
  Description of Artificial Sequence: Synthetic oligonucleotide
ggatgagcaggaggaagtgctgaatgtgaatc

SEQ ID NO: 213883 - DNA, 33 bp, Artificial Sequence
  Description of Artificial Sequence: Synthetic oligonucleotide
gatgagcaggaggaagtgctgaatgtgaatctc

SEQ ID NO: 213884 - DNA, 33 bp, Artificial Sequence
  Description of Artificial Sequence: Synthetic oligonucleotide
atgagcaggaggaagtgctgaatgtgaatctcg

SEQ ID NO: 213885 - DNA, 32 bp, Artificial Sequence
  Description of Artificial Sequence: Synthetic oligonucleotide
tgagcaggaggaagtgctgaatgtgaatctcg

SEQ ID NO: 213886 - DNA, 31 bp, Artificial Sequence
  Description of Artificial Sequence: Synthetic oligonucleotide
gagcaggaggaagtgctgaatgtgaatctcg

SEQ ID NO: 213887 - DNA, 32 bp, Artificial Sequence
  Description of Artificial Sequence: Synthetic oligonucleotide
agcaggaggaagtgctgaatgtgaatctcgag

SEQ ID NO: 213888 - DNA, 31 bp, Artificial Sequence
  Description of Artificial Sequence: Synthetic oligonucleotide
gcaggaggaagtgctgaatgtgaatctcgag

SEQ ID NO: 213889 - DNA, 31 bp, Artificial Sequence
  Description of Artificial Sequence: Synthetic oligonucleotide
caggaggaagtgctgaatgtgaatctcgagg

SEQ ID NO: 213890 - DNA, 31 bp, Artificial Sequence
  Description of Artificial Sequence: Synthetic oligonucleotide
aggaggaagtgctgaatgtgaatctcgaggg

SEQ ID NO: 213891 - DNA, 30 bp, Artificial Sequence
  Description of Artificial Sequence: Synthetic oligonucleotide
ggaggaagtgctgaatgtgaatctcgaggg

SEQ ID NO: 213892 - DNA, 30 bp, Artificial Sequence
  Description of Artificial Sequence: Synthetic oligonucleotide
gaggaagtgctgaatgtgaatctcgagggg

SEQ ID NO: 213893 - DNA, 32 bp, Artificial Sequence
  Description of Artificial Sequence: Synthetic oligonucleotide
aggaagtgctgaatgtgaatctcgaggggaac

SEQ ID NO: 213894 - DNA, 31 bp, Artificial Sequence
  Description of Artificial Sequence: Synthetic oligonucleotide
ggaagtgctgaatgtgaatctcgaggggaac

SEQ ID NO: 213895 - DNA, 33 bp, Artificial Sequence
  Description of Artificial Sequence: Synthetic oligonucleotide
gaagtgctgaatgtgaatctcgaggggaacttg

SEQ ID NO: 213896 - DNA, 34 bp, Artificial Sequence
  Description of Artificial Sequence: Synthetic oligonucleotide
aagtgctgaatgtgaatctcgaggggaacttgac

SEQ ID NO: 213897 - DNA, 33 bp, Artificial Sequence
  Description of Artificial Sequence: Synthetic oligonucleotide
agtgctgaatgtgaatctcgaggggaacttgac

SEQ ID NO: 213898 - DNA, 32 bp, Artificial Sequence
  Description of Artificial Sequence: Synthetic oligonucleotide
gtgctgaatgtgaatctcgaggggaacttgac

SEQ ID NO: 213899 - DNA, 32 bp, Artificial Sequence
  Description of Artificial Sequence: Synthetic oligonucleotide
tgctgaatgtgaatctcgaggggaacttgacc

SEQ ID NO: 213900 - DNA, 31 bp, Artificial Sequence
  Description of Artificial Sequence: Synthetic oligonucleotide
gctgaatgtgaatctcgaggggaacttgacc

SEQ ID NO: 213901 - DNA, 31 bp, Artificial Sequence
  Description of Artificial Sequence: Synthetic oligonucleotide
ctgaatgtgaatctcgaggggaacttgaccc

SEQ ID NO: 213902 - DNA, 32 bp, Artificial Sequence
  Description of Artificial Sequence: Synthetic oligonucleotide
tgaatgtgaatctcgaggggaacttgaccctg

SEQ ID NO: 213903 - DNA, 31 bp, Artificial Sequence
  Description of Artificial Sequence: Synthetic oligonucleotide
gaatgtgaatctcgaggggaacttgaccctg

SEQ ID NO: 213904 - DNA, 31 bp, Artificial Sequence
  Description of Artificial Sequence: Synthetic oligonucleotide
aatgtgaatctcgaggggaacttgaccctgg

SEQ ID NO: 213905 - DNA, 30 bp, Artificial Sequence
  Description of Artificial Sequence: Synthetic oligonucleotide
atgtgaatctcgaggggaacttgaccctgg

SEQ ID NO: 213906 - DNA, 29 bp, Artificial Sequence
  Description of Artificial Sequence: Synthetic oligonucleotide
tgtgaatctcgaggggaacttgaccctgg

SEQ ID NO: 213907 - DNA, 28 bp, Artificial Sequence
  Description of Artificial Sequence: Synthetic oligonucleotide
gtgaatctcgaggggaacttgaccctgg

SEQ ID NO: 213908 - DNA, 29 bp, Artificial Sequence
  Description of Artificial Sequence: Synthetic oligonucleotide
tgaatctcgaggggaacttgaccctggag

SEQ ID NO: 213909 - DNA, 28 bp, Artificial Sequence
  Description of Artificial Sequence: Synthetic oligonucleotide
gaatctcgaggggaacttgaccctggag

SEQ ID NO: 213910 - DNA, 28 bp, Artificial Sequence
  Description of Artificial Sequence: Synthetic oligonucleotide
aatctcgaggggaacttgaccctggagg

SEQ ID NO: 213911 - DNA, 27 bp, Artificial Sequence
  Description of Artificial Sequence: Synthetic oligonucleotide
atctcgaggggaacttgaccctggagg

SEQ ID NO: 213912 - DNA, 26 bp, Artificial Sequence
  Description of Artificial Sequence: Synthetic oligonucleotide
tctcgaggggaacttgaccctggagg

SEQ ID NO: 213913 - DNA, 25 bp, Artificial Sequence
  Description of Artificial Sequence: Synthetic oligonucleotide
ctcgaggggaacttgaccctggagg

SEQ ID NO: 213914 - DNA, 26 bp, Artificial Sequence
  Description of Artificial Sequence: Synthetic oligonucleotide
tcgaggggaacttgaccctggaggga

SEQ ID NO: 213915 - DNA, 25 bp, Artificial Sequence
  Description of Artificial Sequence: Synthetic oligonucleotide
cgaggggaacttgaccctggaggga

SEQ ID NO: 213916 - DNA, 26 bp, Artificial Sequence
  Description of Artificial Sequence: Synthetic oligonucleotide
gaggggaacttgaccctggagggagt

SEQ ID NO: 213917 - DNA, 27 bp, Artificial Sequence
  Description of Artificial Sequence: Synthetic oligonucleotide
aggggaacttgaccctggagggagtga

SEQ ID NO: 213918 - DNA, 26 bp, Artificial Sequence
  Description of Artificial Sequence: Synthetic oligonucleotide
ggggaacttgaccctggagggagtga

SEQ ID NO: 213919 - DNA, 26 bp, Artificial Sequence
  Description of Artificial Sequence: Synthetic oligonucleotide
gggaacttgaccctggagggagtgac

SEQ ID NO: 213920 - DNA, 26 bp, Artificial Sequence
  Description of Artificial Sequence: Synthetic oligonucleotide
ggaacttgaccctggagggagtgacc

SEQ ID NO: 213921 - DNA, 26 bp, Artificial Sequence
  Description of Artificial Sequence: Synthetic oligonucleotide
gaacttgaccctggagggagtgaccc

SEQ ID NO: 213922 - DNA, 26 bp, Artificial Sequence
  Description of Artificial Sequence: Synthetic oligonucleotide
aacttgaccctggagggagtgacccg

SEQ ID NO: 213923 - DNA, 25 bp, Artificial Sequence
  Description of Artificial Sequence: Synthetic oligonucleotide
acttgaccctggagggagtgacccg

SEQ ID NO: 213924 - DNA, 24 bp, Artificial Sequence
  Description of Artificial Sequence: Synthetic oligonucleotide
cttgaccctggagggagtgacccg

SEQ ID NO: 213925 - DNA, 24 bp, Artificial Sequence
  Description of Artificial Sequence: Synthetic oligonucleotide
ttgaccctggagggagtgacccgg

SEQ ID NO: 213926 - DNA, 23 bp, Artificial Sequence
  Description of Artificial Sequence: Synthetic oligonucleotide
tgaccctggagggagtgacccgg

SEQ ID NO: 213927 - DNA, 22 bp, Artificial Sequence
  Description of Artificial Sequence: Synthetic oligonucleotide
gaccctggagggagtgacccgg

SEQ ID NO: 213928 - DNA, 22 bp, Artificial Sequence
  Description of Artificial Sequence: Synthetic oligonucleotide
accctggagggagtgacccggg

SEQ ID NO: 213929 - DNA, 21 bp, Artificial Sequence
  Description of Artificial Sequence: Synthetic oligonucleotide
ccctggagggagtgacccggg

SEQ ID NO: 213930 - DNA, 21 bp, Artificial Sequence
  Description of Artificial Sequence: Synthetic oligonucleotide
cctggagggagtgacccgggg

SEQ ID NO: 213931 - DNA, 21 bp, Artificial Sequence
  Description of Artificial Sequence: Synthetic oligonucleotide
ctggagggagtgacccggggc

SEQ ID NO: 213932 - DNA, 22 bp, Artificial Sequence
  Description of Artificial Sequence: Synthetic oligonucleotide
tggagggagtgacccggggcca

SEQ ID NO: 213933 - DNA, 21 bp, Artificial Sequence
  Description of Artificial Sequence: Synthetic oligonucleotide
ggagggagtgacccggggcca

SEQ ID NO: 213934 - DNA, 22 bp, Artificial Sequence
  Description of Artificial Sequence: Synthetic oligonucleotide
gagggagtgacccggggccaga

SEQ ID NO: 213935 - DNA, 22 bp, Artificial Sequence
  Description of Artificial Sequence: Synthetic oligonucleotide
agggagtgacccggggccagag

SEQ ID NO: 213936 - DNA, 21 bp, Artificial Sequence
  Description of Artificial Sequence: Synthetic oligonucleotide
gggagtgacccggggccagag

SEQ ID NO: 213937 - DNA, 21 bp, Artificial Sequence
  Description of Artificial Sequence: Synthetic oligonucleotide
ggagtgacccggggccagagc

SEQ ID NO: 213938 - DNA, 21 bp, Artificial Sequence
  Description of Artificial Sequence: Synthetic oligonucleotide
gagtgacccggggccagagcg

SEQ ID NO: 213939 - DNA, 21 bp, Artificial Sequence
  Description of Artificial Sequence: Synthetic oligonucleotide
agtgacccggggccagagcgg

SEQ ID NO: 213940 - DNA, 20 bp, Artificial Sequence
  Description of Artificial Sequence: Synthetic oligonucleotide
gtgacccggggccagagcgg

SEQ ID NO: 213941 - DNA, 21 bp, Artificial Sequence
  Description of Artificial Sequence: Synthetic oligonucleotide
tgacccggggccagagcggga

SEQ ID NO: 213942 - DNA, 20 bp, Artificial Sequence
  Description of Artificial Sequence: Synthetic oligonucleotide
gacccggggccagagcggga

SEQ ID NO: 213943 - DNA, 20 bp, Artificial Sequence
  Description of Artificial Sequence: Synthetic oligonucleotide
acccggggccagagcgggac

SEQ ID NO: 213944 - DNA, 20 bp, Artificial Sequence
  Description of Artificial Sequence: Synthetic oligonucleotide
cccggggccagagcgggact

SEQ ID NO: 213945 - DNA, 22 bp, Artificial Sequence
  Description of Artificial Sequence: Synthetic oligonucleotide
ccggggccagagcgggacctat

SEQ ID NO: 213946 - DNA, 22 bp, Artificial Sequence
  Description of Artificial Sequence: Synthetic oligonucleotide
cggggccagagcgggacctatg

SEQ ID NO: 213947 - DNA, 22 bp, Artificial Sequence
  Description of Artificial Sequence: Synthetic oligonucleotide
ggggccagagcgggacctatgg

SEQ ID NO: 213948 - DNA, 23 bp, Artificial Sequence
  Description of Artificial Sequence: Synthetic oligonucleotide
gggccagagcgggacctatggct

SEQ ID NO: 213949 - DNA, 23 bp, Artificial Sequence
  Description of Artificial Sequence: Synthetic oligonucleotide
ggccagagcgggacctatggctg

SEQ ID NO: 213950 - DNA, 24 bp, Artificial Sequence
  Description of Artificial Sequence: Synthetic oligonucleotide
gccagagcgggacctatggctgca

SEQ ID NO: 213951 - DNA, 25 bp, Artificial Sequence
  Description of Artificial Sequence: Synthetic oligonucleotide
ccagagcgggacctatggctgcaga

SEQ ID NO: 213952 - DNA, 26 bp, Artificial Sequence
  Description of Artificial Sequence: Synthetic oligonucleotide
cagagcgggacctatggctgcagagt

SEQ ID NO: 213953 - DNA, 26 bp, Artificial Sequence
  Description of Artificial Sequence: Synthetic oligonucleotide
agagcgggacctatggctgcagagtg

SEQ ID NO: 213954 - DNA, 25 bp, Artificial Sequence
  Description of Artificial Sequence: Synthetic oligonucleotide
gagcgggacctatggctgcagagtg

SEQ ID NO: 213955 - DNA, 26 bp, Artificial Sequence
  Description of Artificial Sequence: Synthetic oligonucleotide
agcgggacctatggctgcagagtgga

SEQ ID NO: 213956 - DNA, 25 bp, Artificial Sequence
  Description of Artificial Sequence: Synthetic oligonucleotide
gcgggacctatggctgcagagtgga

SEQ ID NO: 213957 - DNA, 25 bp, Artificial Sequence
  Description of Artificial Sequence: Synthetic oligonucleotide
cgggacctatggctgcagagtggag

SEQ ID NO: 213958 - DNA, 27 bp, Artificial Sequence
  Description of Artificial Sequence: Synthetic oligonucleotide
gggacctatggctgcagagtggaggat

SEQ ID NO: 213959 - DNA, 29 bp, Artificial Sequence
  Description of Artificial Sequence: Synthetic oligonucleotide
ggacctatggctgcagagtggaggattac

SEQ ID NO: 213960 - DNA, 29 bp, Artificial Sequence
  Description of Artificial Sequence: Synthetic oligonucleotide
gacctatggctgcagagtggaggattacg

SEQ ID NO: 213961 - DNA, 30 bp, Artificial Sequence
  Description of Artificial Sequence: Synthetic oligonucleotide
acctatggctgcagagtggaggattacgac

SEQ ID NO: 213962 - DNA, 29 bp, Artificial Sequence
  Description of Artificial Sequence: Synthetic oligonucleotide
cctatggctgcagagtggaggattacgac

SEQ ID NO: 213963 - DNA, 29 bp, Artificial Sequence
  Description of Artificial Sequence: Synthetic oligonucleotide
ctatggctgcagagtggaggattacgacg

SEQ ID NO: 213964 - DNA, 29 bp, Artificial Sequence
  Description of Artificial Sequence: Synthetic oligonucleotide
tatggctgcagagtggaggattacgacgc

SEQ ID NO: 213965 - DNA, 28 bp, Artificial Sequence
  Description of Artificial Sequence: Synthetic oligonucleotide
atggctgcagagtggaggattacgacgc

SEQ ID NO: 213966 - DNA, 27 bp, Artificial Sequence
  Description of Artificial Sequence: Synthetic oligonucleotide
tggctgcagagtggaggattacgacgc

SEQ ID NO: 213967 - DNA, 26 bp, Artificial Sequence
  Description of Artificial Sequence: Synthetic oligonucleotide
ggctgcagagtggaggattacgacgc

SEQ ID NO: 213968 - DNA, 26 bp, Artificial Sequence
  Description of Artificial Sequence: Synthetic oligonucleotide
gctgcagagtggaggattacgacgcg

SEQ ID NO: 213969 - DNA, 26 bp, Artificial Sequence
  Description of Artificial Sequence: Synthetic oligonucleotide
ctgcagagtggaggattacgacgcgg

SEQ ID NO: 213970 - DNA, 27 bp, Artificial Sequence
  Description of Artificial Sequence: Synthetic oligonucleotide
tgcagagtggaggattacgacgcggca

SEQ ID NO: 213971 - DNA, 26 bp, Artificial Sequence
  Description of Artificial Sequence: Synthetic oligonucleotide
gcagagtggaggattacgacgcggca

SEQ ID NO: 213972 - DNA, 27 bp, Artificial Sequence
  Description of Artificial Sequence: Synthetic oligonucleotide
cagagtggaggattacgacgcggcaga

SEQ ID NO: 213973 - DNA, 28 bp, Artificial Sequence
  Description of Artificial Sequence: Synthetic oligonucleotide
agagtggaggattacgacgcggcagatg

SEQ ID NO: 213974 - DNA, 27 bp, Artificial Sequence
  Description of Artificial Sequence: Synthetic oligonucleotide
gagtggaggattacgacgcggcagatg

SEQ ID NO: 213975 - DNA, 28 bp, Artificial Sequence
  Description of Artificial Sequence: Synthetic oligonucleotide
agtggaggattacgacgcggcagatgac

SEQ ID NO: 213976 - DNA, 27 bp, Artificial Sequence
  Description of Artificial Sequence: Synthetic oligonucleotide
gtggaggattacgacgcggcagatgac

SEQ ID NO: 213977 - DNA, 27 bp, Artificial Sequence
  Description of Artificial Sequence: Synthetic oligonucleotide
tggaggattacgacgcggcagatgacg

SEQ ID NO: 213978 - DNA, 27 bp, Artificial Sequence
  Description of Artificial Sequence: Synthetic oligonucleotide
ggaggattacgacgcggcagatgacgt

SEQ ID NO: 213979 - DNA, 27 bp, Artificial Sequence
  Description of Artificial Sequence: Synthetic oligonucleotide
gaggattacgacgcggcagatgacgtg

SEQ ID NO: 213980 - DNA, 27 bp, Artificial Sequence
  Description of Artificial Sequence: Synthetic oligonucleotide
aggattacgacgcggcagatgacgtgc

SEQ ID NO: 213981 - DNA, 27 bp, Artificial Sequence
  Description of Artificial Sequence: Synthetic oligonucleotide
ggattacgacgcggcagatgacgtgca

SEQ ID NO: 213982 - DNA, 27 bp, Artificial Sequence
  Description of Artificial Sequence: Synthetic oligonucleotide
gattacgacgcggcagatgacgtgcag

SEQ ID NO: 213983 - DNA, 27 bp, Artificial Sequence
  Description of Artificial Sequence: Synthetic oligonucleotide
attacgacgcggcagatgacgtgcagc

SEQ ID NO: 213984 - DNA, 27 bp, Artificial Sequence
  Description of Artificial Sequence: Synthetic oligonucleotide
ttacgacgcggcagatgacgtgcagct

SEQ ID NO: 213985 - DNA, 26 bp, Artificial Sequence
  Description of Artificial Sequence: Synthetic oligonucleotide
tacgacgcggcagatgacgtgcagct

SEQ ID NO: 213986 - DNA, 25 bp, Artificial Sequence
  Description of Artificial Sequence: Synthetic oligonucleotide
acgacgcggcagatgacgtgcagct

SEQ ID NO: 213987 - DNA, 24 bp, Artificial Sequence
  Description of Artificial Sequence: Synthetic oligonucleotide
cgacgcggcagatgacgtgcagct

SEQ ID NO: 213988 - DNA, 25 bp, Artificial Sequence
  Description of Artificial Sequence: Synthetic oligonucleotide
gacgcggcagatgacgtgcagctct

SEQ ID NO: 213989 - DNA, 25 bp, Artificial Sequence
  Description of Artificial Sequence: Synthetic oligonucleotide
acgcggcagatgacgtgcagctctc

SEQ ID NO: 213990 - DNA, 24 bp, Artificial Sequence
  Description of Artificial Sequence: Synthetic oligonucleotide
cgcggcagatgacgtgcagctctc

SEQ ID NO: 213991 - DNA, 26 bp, Artificial Sequence
  Description of Artificial Sequence: Synthetic oligonucleotide
gcggcagatgacgtgcagctctccaa

SEQ ID NO: 213992 - DNA, 27 bp, Artificial Sequence
  Description of Artificial Sequence: Synthetic oligonucleotide
cggcagatgacgtgcagctctccaaga

SEQ ID NO: 213993 - DNA, 27 bp, Artificial Sequence
  Description of Artificial Sequence: Synthetic oligonucleotide
ggcagatgacgtgcagctctccaagac

SEQ ID NO: 213994 - DNA, 27 bp, Artificial Sequence
  Description of Artificial Sequence: Synthetic oligonucleotide
gcagatgacgtgcagctctccaagacg

SEQ ID NO: 213995 - DNA, 27 bp, Artificial Sequence
  Description of Artificial Sequence: Synthetic oligonucleotide
cagatgacgtgcagctctccaagacgc

SEQ ID NO: 213996 - DNA, 28 bp, Artificial Sequence
  Description of Artificial Sequence: Synthetic oligonucleotide
agatgacgtgcagctctccaagacgctg

SEQ ID NO: 213997 - DNA, 27 bp, Artificial Sequence
  Description of Artificial Sequence: Synthetic oligonucleotide
gatgacgtgcagctctccaagacgctg

SEQ ID NO: 213998 - DNA, 27 bp, Artificial Sequence
  Description of Artificial Sequence: Synthetic oligonucleotide
atgacgtgcagctctccaagacgctgg

SEQ ID NO: 213999 - DNA, 27 bp, Artificial Sequence
  Description of Artificial Sequence: Synthetic oligonucleotide
tgacgtgcagctctccaagacgctgga

SEQ ID NO: 214000 - DNA, 26 bp, Artificial Sequence
  Description of Artificial Sequence: Synthetic oligonucleotide
gacgtgcagctctccaagacgctgga

SEQ ID NO: 214001 - DNA, 26 bp, Artificial Sequence
  Description of Artificial Sequence: Synthetic oligonucleotide
acgtgcagctctccaagacgctggag

SEQ ID NO: 214002 - DNA, 25 bp, Artificial Sequence
  Description of Artificial Sequence: Synthetic oligonucleotide
cgtgcagctctccaagacgctggag

SEQ ID NO: 214003 - DNA, 26 bp, Artificial Sequence
  Description of Artificial Sequence: Synthetic oligonucleotide
gtgcagctctccaagacgctggagct

SEQ ID NO: 214004 - DNA, 26 bp, Artificial Sequence
  Description of Artificial Sequence: Synthetic oligonucleotide
tgcagctctccaagacgctggagctg

SEQ ID NO: 214005 - DNA, 25 bp, Artificial Sequence
  Description of Artificial Sequence: Synthetic oligonucleotide
gcagctctccaagacgctggagctg

SEQ ID NO: 214006 - DNA, 25 bp, Artificial Sequence
  Description of Artificial Sequence: Synthetic oligonucleotide
cagctctccaagacgctggagctgc

SEQ ID NO: 214007 - DNA, 25 bp, Artificial Sequence
  Description of Artificial Sequence: Synthetic oligonucleotide
agctctccaagacgctggagctgcg

SEQ ID NO: 214008 - DNA, 24 bp, Artificial Sequence
  Description of Artificial Sequence: Synthetic oligonucleotide
gctctccaagacgctggagctgcg

SEQ ID NO: 214009 - DNA, 24 bp, Artificial Sequence
  Description of Artificial Sequence: Synthetic oligonucleotide
ctctccaagacgctggagctgcgc

SEQ ID NO: 214010 - DNA, 25 bp, Artificial Sequence
  Description of Artificial Sequence: Synthetic oligonucleotide
tctccaagacgctggagctgcgcgt

SEQ ID NO: 214011 - DNA, 24 bp, Artificial Sequence
  Description of Artificial Sequence: Synthetic oligonucleotide
ctccaagacgctggagctgcgcgt

SEQ ID NO: 214012 - DNA, 24 bp, Artificial Sequence
  Description of Artificial Sequence: Synthetic oligonucleotide
tccaagacgctggagctgcgcgtg

SEQ ID NO: 214013 - DNA, 23 bp, Artificial Sequence
  Description of Artificial Sequence: Synthetic oligonucleotide
ccaagacgctggagctgcgcgtg

SEQ ID NO: 214014 - DNA, 23 bp, Artificial Sequence
  Description of Artificial Sequence: Synthetic oligonucleotide
caagacgctggagctgcgcgtgg

SEQ ID NO: 214015 - DNA, 23 bp, Artificial Sequence
  Description of Artificial Sequence: Synthetic oligonucleotide
aagacgctggagctgcgcgtggc

SEQ ID NO: 214016 - DNA, 22 bp, Artificial Sequence
  Description of Artificial Sequence: Synthetic oligonucleotide
agacgctggagctgcgcgtggc

SEQ ID NO: 214017 - DNA, 21 bp, Artificial Sequence
  Description of Artificial Sequence: Synthetic oligonucleotide
gacgctggagctgcgcgtggc

SEQ ID NO: 214018 - DNA, 24 bp, Artificial Sequence
  Description of Artificial Sequence: Synthetic oligonucleotide
acgctggagctgcgcgtggcctat

SEQ ID NO: 214019 - DNA, 23 bp, Artificial Sequence
  Description of Artificial Sequence: Synthetic oligonucleotide
cgctggagctgcgcgtggcctat

SEQ ID NO: 214020 - DNA, 24 bp, Artificial Sequence
  Description of Artificial Sequence: Synthetic oligonucleotide
gctggagctgcgcgtggcctatct

SEQ ID NO: 214021 - DNA, 24 bp, Artificial Sequence
  Description of Artificial Sequence: Synthetic oligonucleotide
ctggagctgcgcgtggcctatctg

SEQ ID NO: 214022 - DNA, 25 bp, Artificial Sequence
  Description of Artificial Sequence: Synthetic oligonucleotide
tggagctgcgcgtggcctatctgga

SEQ ID NO: 214023 - DNA, 24 bp, Artificial Sequence
  Description of Artificial Sequence: Synthetic oligonucleotide
ggagctgcgcgtggcctatctgga

SEQ ID NO: 214024 - DNA, 24 bp, Artificial Sequence
  Description of Artificial Sequence: Synthetic oligonucleotide
gagctgcgcgtggcctatctggac

SEQ ID NO: 214025 - DNA, 24 bp, Artificial Sequence
  Description of Artificial Sequence: Synthetic oligonucleotide
agctgcgcgtggcctatctggacc

SEQ ID NO: 214026 - DNA, 23 bp, Artificial Sequence
  Description of Artificial Sequence: Synthetic oligonucleotide
gctgcgcgtggcctatctggacc

SEQ ID NO: 214027 - DNA, 23 bp, Artificial Sequence
  Description of Artificial Sequence: Synthetic oligonucleotide
ctgcgcgtggcctatctggaccc

SEQ ID NO: 214028 - DNA, 23 bp, Artificial Sequence
  Description of Artificial Sequence: Synthetic oligonucleotide
tgcgcgtggcctatctggacccc

SEQ ID NO: 214029 - DNA, 22 bp, Artificial Sequence
  Description of Artificial Sequence: Synthetic oligonucleotide
gcgcgtggcctatctggacccc

SEQ ID NO: 214030 - DNA, 23 bp, Artificial Sequence
  Description of Artificial Sequence: Synthetic oligonucleotide
cgcgtggcctatctggaccccct

SEQ ID NO: 214031 - DNA, 23 bp, Artificial Sequence
  Description of Artificial Sequence: Synthetic oligonucleotide
gcgtggcctatctggaccccctg

SEQ ID NO: 214032 - DNA, 24 bp, Artificial Sequence
  Description of Artificial Sequence: Synthetic oligonucleotide
cgtggcctatctggaccccctgga

SEQ ID NO: 214033 - DNA, 24 bp, Artificial Sequence
  Description of Artificial Sequence: Synthetic oligonucleotide
gtggcctatctggaccccctggag

SEQ ID NO: 214034 - DNA, 25 bp, Artificial Sequence
  Description of Artificial Sequence: Synthetic oligonucleotide
tggcctatctggaccccctggagct

SEQ ID NO: 214035 - DNA, 24 bp, Artificial Sequence
  Description of Artificial Sequence: Synthetic oligonucleotide
ggcctatctggaccccctggagct

SEQ ID NO: 214036 - DNA, 25 bp, Artificial Sequence
  Description of Artificial Sequence: Synthetic oligonucleotide
gcctatctggaccccctggagctca

SEQ ID NO: 214037 - DNA, 25 bp, Artificial Sequence
  Description of Artificial Sequence: Synthetic oligonucleotide
cctatctggaccccctggagctcag

SEQ ID NO: 214038 - DNA, 25 bp, Artificial Sequence
  Description of Artificial Sequence: Synthetic oligonucleotide
ctatctggaccccctggagctcagc

SEQ ID NO: 214039 - DNA, 26 bp, Artificial Sequence
  Description of Artificial Sequence: Synthetic oligonucleotide
tatctggaccccctggagctcagcga

SEQ ID NO: 214040 - DNA, 25 bp, Artificial Sequence
  Description of Artificial Sequence: Synthetic oligonucleotide
atctggaccccctggagctcagcga

SEQ ID NO: 214041 - DNA, 24 bp, Artificial Sequence
  Description of Artificial Sequence: Synthetic oligonucleotide
tctggaccccctggagctcagcga

SEQ ID NO: 214042 - DNA, 23 bp, Artificial Sequence
  Description of Artificial Sequence: Synthetic oligonucleotide
ctggaccccctggagctcagcga

SEQ ID NO: 214043 - DNA, 23 bp, Artificial Sequence
  Description of Artificial Sequence: Synthetic oligonucleotide
tggaccccctggagctcagcgag

SEQ ID NO: 214044 - DNA, 22 bp, Artificial Sequence
  Description of Artificial Sequence: Synthetic oligonucleotide
ggaccccctggagctcagcgag

SEQ ID NO: 214045 - DNA, 22 bp, Artificial Sequence
  Description of Artificial Sequence: Synthetic oligonucleotide
gaccccctggagctcagcgagg

SEQ ID NO: 214046 - DNA, 22 bp, Artificial Sequence
  Description of Artificial Sequence: Synthetic oligonucleotide
accccctggagctcagcgaggg

SEQ ID NO: 214047 - DNA, 21 bp, Artificial Sequence
  Description of Artificial Sequence: Synthetic oligonucleotide
ccccctggagctcagcgaggg

SEQ ID NO: 214048 - DNA, 23 bp, Artificial Sequence
  Description of Artificial Sequence: Synthetic oligonucleotide
cccctggagctcagcgaggggaa

SEQ ID NO: 214049 - DNA, 23 bp, Artificial Sequence
  Description of Artificial Sequence: Synthetic oligonucleotide
ccctggagctcagcgaggggaag

SEQ ID NO: 214050 - DNA, 24 bp, Artificial Sequence
  Description of Artificial Sequence: Synthetic oligonucleotide
cctggagctcagcgaggggaaggt

SEQ ID NO: 214051 - DNA, 24 bp, Artificial Sequence
  Description of Artificial Sequence: Synthetic oligonucleotide
ctggagctcagcgaggggaaggtg

SEQ ID NO: 214052 - DNA, 27 bp, Artificial Sequence
  Description of Artificial Sequence: Synthetic oligonucleotide
tggagctcagcgaggggaaggtgcttt

SEQ ID NO: 214053 - DNA, 26 bp, Artificial Sequence
  Description of Artificial Sequence: Synthetic oligonucleotide
ggagctcagcgaggggaaggtgcttt

SEQ ID NO: 214054 - DNA, 26 bp, Artificial Sequence
  Description of Artificial Sequence: Synthetic oligonucleotide
gagctcagcgaggggaaggtgctttc

SEQ ID NO: 214055 - DNA, 27 bp, Artificial Sequence
  Description of Artificial Sequence: Synthetic oligonucleotide
agctcagcgaggggaaggtgctttcct

SEQ ID NO: 214056 - DNA, 27 bp, Artificial Sequence
  Description of Artificial Sequence: Synthetic oligonucleotide
gctcagcgaggggaaggtgctttcctt

SEQ ID NO: 214057 - DNA, 28 bp, Artificial Sequence
  Description of Artificial Sequence: Synthetic oligonucleotide
ctcagcgaggggaaggtgctttccttac

SEQ ID NO: 214058 - DNA, 28 bp, Artificial Sequence
  Description of Artificial Sequence: Synthetic oligonucleotide
tcagcgaggggaaggtgctttccttacc

SEQ ID NO: 214059 - DNA, 27 bp, Artificial Sequence
  Description of Artificial Sequence: Synthetic oligonucleotide
cagcgaggggaaggtgctttccttacc

SEQ ID NO: 214060 - DNA, 28 bp, Artificial Sequence
  Description of Artificial Sequence: Synthetic oligonucleotide
agcgaggggaaggtgctttccttacctc

SEQ ID NO: 214061 - DNA, 27 bp, Artificial Sequence
  Description of Artificial Sequence: Synthetic oligonucleotide
gcgaggggaaggtgctttccttacctc

SEQ ID NO: 214062 - DNA, 31 bp, Artificial Sequence
  Description of Artificial Sequence: Synthetic oligonucleotide
cgaggggaaggtgctttccttacctctaaac

SEQ ID NO: 214063 - DNA, 32 bp, Artificial Sequence
  Description of Artificial Sequence: Synthetic oligonucleotide
gaggggaaggtgctttccttacctctaaacag

SEQ ID NO: 214064 - DNA, 32 bp, Artificial Sequence
  Description of Artificial Sequence: Synthetic oligonucleotide
aggggaaggtgctttccttacctctaaacagc

SEQ ID NO: 214065 - DNA, 31 bp, Artificial Sequence
  Description of Artificial Sequence: Synthetic oligonucleotide
ggggaaggtgctttccttacctctaaacagc

SEQ ID NO: 214066 - DNA, 32 bp, Artificial Sequence
  Description of Artificial Sequence: Synthetic oligonucleotide
gggaaggtgctttccttacctctaaacagcag

SEQ ID NO: 214067 - DNA, 33 bp, Artificial Sequence
  Description of Artificial Sequence: Synthetic oligonucleotide
ggaaggtgctttccttacctctaaacagcagtg

SEQ ID NO: 214068 - DNA, 33 bp, Artificial Sequence
  Description of Artificial Sequence: Synthetic oligonucleotide
gaaggtgctttccttacctctaaacagcagtgc

SEQ ID NO: 214069 - DNA, 34 bp, Artificial Sequence
  Description of Artificial Sequence: Synthetic oligonucleotide
aaggtgctttccttacctctaaacagcagtgcag

SEQ ID NO: 214070 - DNA, 33 bp, Artificial Sequence
  Description of Artificial Sequence: Synthetic oligonucleotide
aggtgctttccttacctctaaacagcagtgcag

SEQ ID NO: 214071 - DNA, 32 bp, Artificial Sequence
  Description of Artificial Sequence: Synthetic oligonucleotide
ggtgctttccttacctctaaacagcagtgcag

SEQ ID NO: 214072 - DNA, 33 bp, Artificial Sequence
  Description of Artificial Sequence: Synthetic oligonucleotide
gtgctttccttacctctaaacagcagtgcagtc

SEQ ID NO: 214073 - DNA, 33 bp, Artificial Sequence
  Description of Artificial Sequence: Synthetic oligonucleotide
tgctttccttacctctaaacagcagtgcagtcg

SEQ ID NO: 214074 - DNA, 32 bp, Artificial Sequence
  Description of Artificial Sequence: Synthetic oligonucleotide
gctttccttacctctaaacagcagtgcagtcg

SEQ ID NO: 214075 - DNA, 33 bp, Artificial Sequence
  Description of Artificial Sequence: Synthetic oligonucleotide
ctttccttacctctaaacagcagtgcagtcgtg

SEQ ID NO: 214076 - DNA, 35 bp, Artificial Sequence
  Description of Artificial Sequence: Synthetic oligonucleotide
tttccttacctctaaacagcagtgcagtcgtgaac

SEQ ID NO: 214077 - DNA, 34 bp, Artificial Sequence
  Description of Artificial Sequence: Synthetic oligonucleotide
ttccttacctctaaacagcagtgcagtcgtgaac

SEQ ID NO: 214078 - DNA, 33 bp, Artificial Sequence
  Description of Artificial Sequence: Synthetic oligonucleotide
tccttacctctaaacagcagtgcagtcgtgaac

SEQ ID NO: 214079 - DNA, 32 bp, Artificial Sequence
  Description of Artificial Sequence: Synthetic oligonucleotide
ccttacctctaaacagcagtgcagtcgtgaac

SEQ ID NO: 214080 - DNA, 33 bp, Artificial Sequence
  Description of Artificial Sequence: Synthetic oligonucleotide
cttacctctaaacagcagtgcagtcgtgaactg

SEQ ID NO: 214081 - DNA, 33 bp, Artificial Sequence
  Description of Artificial Sequence: Synthetic oligonucleotide
ttacctctaaacagcagtgcagtcgtgaactgc

SEQ ID NO: 214082 - DNA, 32 bp, Artificial Sequence
  Description of Artificial Sequence: Synthetic oligonucleotide
tacctctaaacagcagtgcagtcgtgaactgc

SEQ ID NO: 214083 - DNA, 31 bp, Artificial Sequence
  Description of Artificial Sequence: Synthetic oligonucleotide
acctctaaacagcagtgcagtcgtgaactgc

SEQ ID NO: 214084 - DNA, 30 bp, Artificial Sequence
  Description of Artificial Sequence: Synthetic oligonucleotide
cctctaaacagcagtgcagtcgtgaactgc

SEQ ID NO: 214085 - DNA, 31 bp, Artificial Sequence
  Description of Artificial Sequence: Synthetic oligonucleotide
ctctaaacagcagtgcagtcgtgaactgctc

SEQ ID NO: 214086 - DNA, 31 bp, Artificial Sequence
  Description of Artificial Sequence: Synthetic oligonucleotide
tctaaacagcagtgcagtcgtgaactgctcc

SEQ ID NO: 214087 - DNA, 30 bp, Artificial Sequence
  Description of Artificial Sequence: Synthetic oligonucleotide
ctaaacagcagtgcagtcgtgaactgctcc

SEQ ID NO: 214088 - DNA, 30 bp, Artificial Sequence
  Description of Artificial Sequence: Synthetic oligonucleotide
taaacagcagtgcagtcgtgaactgctccg

SEQ ID NO: 214089 - DNA, 29 bp, Artificial Sequence
  Description of Artificial Sequence: Synthetic oligonucleotide
aaacagcagtgcagtcgtgaactgctccg

SEQ ID NO: 214090 - DNA, 28 bp, Artificial Sequence
  Description of Artificial Sequence: Synthetic oligonucleotide
aacagcagtgcagtcgtgaactgctccg

SEQ ID NO: 214091 - DNA, 27 bp, Artificial Sequence
  Description of Artificial Sequence: Synthetic oligonucleotide
acagcagtgcagtcgtgaactgctccg

SEQ ID NO: 214092 - DNA, 27 bp, Artificial Sequence
  Description of Artificial Sequence: Synthetic oligonucleotide
cagcagtgcagtcgtgaactgctccgt

SEQ ID NO: 214093 - DNA, 27 bp, Artificial Sequence
  Description of Artificial Sequence: Synthetic oligonucleotide
agcagtgcagtcgtgaactgctccgtg

SEQ ID NO: 214094 - DNA, 26 bp, Artificial Sequence
  Description of Artificial Sequence: Synthetic oligonucleotide
gcagtgcagtcgtgaactgctccgtg

SEQ ID NO: 214095 - DNA, 27 bp, Artificial Sequence
  Description of Artificial Sequence: Synthetic oligonucleotide
cagtgcagtcgtgaactgctccgtgca

SEQ ID NO: 214096 - DNA, 27 bp, Artificial Sequence
  Description of Artificial Sequence: Synthetic oligonucleotide
agtgcagtcgtgaactgctccgtgcac

SEQ ID NO: 214097 - DNA, 26 bp, Artificial Sequence
  Description of Artificial Sequence: Synthetic oligonucleotide
gtgcagtcgtgaactgctccgtgcac

SEQ ID NO: 214098 - DNA, 26 bp, Artificial Sequence
  Description of Artificial Sequence: Synthetic oligonucleotide
tgcagtcgtgaactgctccgtgcacg

SEQ ID NO: 214099 - DNA, 25 bp, Artificial Sequence
  Description of Artificial Sequence: Synthetic oligonucleotide
gcagtcgtgaactgctccgtgcacg

SEQ ID NO: 214100 - DNA, 25 bp, Artificial Sequence
  Description of Artificial Sequence: Synthetic oligonucleotide
cagtcgtgaactgctccgtgcacgg

SEQ ID NO: 214101 - DNA, 25 bp, Artificial Sequence
  Description of Artificial Sequence: Synthetic oligonucleotide
agtcgtgaactgctccgtgcacggc

SEQ ID NO: 214102 - DNA, 24 bp, Artificial Sequence
  Description of Artificial Sequence: Synthetic oligonucleotide
gtcgtgaactgctccgtgcacggc

SEQ ID NO: 214103 - DNA, 25 bp, Artificial Sequence
  Description of Artificial Sequence: Synthetic oligonucleotide
tcgtgaactgctccgtgcacggcct

SEQ ID NO: 214104 - DNA, 24 bp, Artificial Sequence
  Description of Artificial Sequence: Synthetic oligonucleotide
cgtgaactgctccgtgcacggcct

SEQ ID NO: 214105 - DNA, 24 bp, Artificial Sequence
  Description of Artificial Sequence: Synthetic oligonucleotide
gtgaactgctccgtgcacggcctg

SEQ ID NO: 214106 - DNA, 24 bp, Artificial Sequence
  Description of Artificial Sequence: Synthetic oligonucleotide
tgaactgctccgtgcacggcctgc

SEQ ID NO: 214107 - DNA, 23 bp, Artificial Sequence
  Description of Artificial Sequence: Synthetic oligonucleotide
gaactgctccgtgcacggcctgc

SEQ ID NO: 214108 - DNA, 23 bp, Artificial Sequence
  Description of Artificial Sequence: Synthetic oligonucleotide
aactgctccgtgcacggcctgcc

SEQ ID NO: 214109 - DNA, 22 bp, Artificial Sequence
  Description of Artificial Sequence: Synthetic oligonucleotide
actgctccgtgcacggcctgcc

SEQ ID NO: 214110 - DNA, 21 bp, Artificial Sequence
  Description of Artificial Sequence: Synthetic oligonucleotide
ctgctccgtgcacggcctgcc

SEQ ID NO: 214111 - DNA, 22 bp, Artificial Sequence
  Description of Artificial Sequence: Synthetic oligonucleotide
tgctccgtgcacggcctgccca

SEQ ID NO: 214112 - DNA, 21 bp, Artificial Sequence
  Description of Artificial Sequence: Synthetic oligonucleotide
gctccgtgcacggcctgccca

SEQ ID NO: 214113 - DNA, 21 bp, Artificial Sequence
  Description of Artificial Sequence: Synthetic oligonucleotide
ctccgtgcacggcctgcccac

SEQ ID NO: 214114 - DNA, 21 bp, Artificial Sequence
  Description of Artificial Sequence: Synthetic oligonucleotide
tccgtgcacggcctgcccacc

SEQ ID NO: 214115 - DNA, 20 bp, Artificial Sequence
  Description of Artificial Sequence: Synthetic oligonucleotide
ccgtgcacggcctgcccacc

SEQ ID NO: 214116 - DNA, 20 bp, Artificial Sequence
  Description of Artificial Sequence: Synthetic oligonucleotide
cgtgcacggcctgcccaccc

SEQ ID NO: 214117 - DNA, 21 bp, Artificial Sequence
  Description of Artificial Sequence: Synthetic oligonucleotide
gtgcacggcctgcccacccct

SEQ ID NO: 214118 - DNA, 21 bp, Artificial Sequence
  Description of Artificial Sequence: Synthetic oligonucleotide
tgcacggcctgcccacccctg

SEQ ID NO: 214119 - DNA, 20 bp, Artificial Sequence
  Description of Artificial Sequence: Synthetic oligonucleotide
gcacggcctgcccacccctg

SEQ ID NO: 214120 - DNA, 20 bp, Artificial Sequence
  Description of Artificial Sequence: Synthetic oligonucleotide
cacggcctgcccacccctgc

SEQ ID NO: 214121 - DNA, 20 bp, Artificial Sequence
  Description of Artificial Sequence: Synthetic oligonucleotide
acggcctgcccacccctgcc

SEQ ID NO: 214122 - DNA, 20 bp, Artificial Sequence
  Description of Artificial Sequence: Synthetic oligonucleotide
cggcctgcccacccctgcct

SEQ ID NO: 214123 - DNA, 21 bp, Artificial Sequence
  Description of Artificial Sequence: Synthetic oligonucleotide
ggcctgcccacccctgcccta

SEQ ID NO: 214124 - DNA, 21 bp, Artificial Sequence
  Description of Artificial Sequence: Synthetic oligonucleotide
gcctgcccacccctgccctac

SEQ ID NO: 214125 - DNA, 21 bp, Artificial Sequence
  Description of Artificial Sequence: Synthetic oligonucleotide
cctgcccacccctgccctacg

SEQ ID NO: 214126 - DNA, 22 bp, Artificial Sequence
  Description of Artificial Sequence: Synthetic oligonucleotide
ctgcccacccctgccctacgct

SEQ ID NO: 214127 - DNA, 22 bp, Artificial Sequence
  Description of Artificial Sequence: Synthetic oligonucleotide
tgcccacccctgccctacgctg

SEQ ID NO: 214128 - DNA, 21 bp, Artificial Sequence
  Description of Artificial Sequence: Synthetic oligonucleotide
gcccacccctgccctacgctg

SEQ ID NO: 214129 - DNA, 22 bp, Artificial Sequence
  Description of Artificial Sequence: Synthetic oligonucleotide
cccacccctgccctacgctgga

SEQ ID NO: 214130 - DNA, 22 bp, Artificial Sequence
  Description of Artificial Sequence: Synthetic oligonucleotide
ccacccctgccctacgctggac

SEQ ID NO: 214131 - DNA, 24 bp, Artificial Sequence
  Description of Artificial Sequence: Synthetic oligonucleotide
cacccctgccctacgctggaccaa

SEQ ID NO: 214132 - DNA, 24 bp, Artificial Sequence
  Description of Artificial Sequence: Synthetic oligonucleotide
acccctgccctacgctggaccaag

SEQ ID NO: 214133 - DNA, 23 bp, Artificial Sequence
  Description of Artificial Sequence: Synthetic oligonucleotide
cccctgccctacgctggaccaag

SEQ ID NO: 214134 - DNA, 24 bp, Artificial Sequence
  Description of Artificial Sequence: Synthetic oligonucleotide
ccctgccctacgctggaccaagga

SEQ ID NO: 214135 - DNA, 25 bp, Artificial Sequence
  Description of Artificial Sequence: Synthetic oligonucleotide
cctgccctacgctggaccaaggact

SEQ ID NO: 214136 - DNA, 25 bp, Artificial Sequence
  Description of Artificial Sequence: Synthetic oligonucleotide
ctgccctacgctggaccaaggactc

SEQ ID NO: 214137 - DNA, 26 bp, Artificial Sequence
  Description of Artificial Sequence: Synthetic oligonucleotide
tgccctacgctggaccaaggactcca

SEQ ID NO: 214138 - DNA, 25 bp, Artificial Sequence
  Description of Artificial Sequence: Synthetic oligonucleotide
gccctacgctggaccaaggactcca

SEQ ID NO: 214139 - DNA, 26 bp, Artificial Sequence
  Description of Artificial Sequence: Synthetic oligonucleotide
ccctacgctggaccaaggactccact

SEQ ID NO: 214140 - DNA, 26 bp, Artificial Sequence
  Description of Artificial Sequence: Synthetic oligonucleotide
cctacgctggaccaaggactccactc

SEQ ID NO: 214141 - DNA, 26 bp, Artificial Sequence
  Description of Artificial Sequence: Synthetic oligonucleotide
ctacgctggaccaaggactccactcc

SEQ ID NO: 214142 - DNA, 26 bp, Artificial Sequence
  Description of Artificial Sequence: Synthetic oligonucleotide
tacgctggaccaaggactccactccc

SEQ ID NO: 214143 - DNA, 25 bp, Artificial Sequence
  Description of Artificial Sequence: Synthetic oligonucleotide
acgctggaccaaggactccactccc

SEQ ID NO: 214144 - DNA, 24 bp, Artificial Sequence
  Description of Artificial Sequence: Synthetic oligonucleotide
cgctggaccaaggactccactccc

SEQ ID NO: 214145 - DNA, 25 bp, Artificial Sequence
  Description of Artificial Sequence: Synthetic oligonucleotide
gctggaccaaggactccactcccct

SEQ ID NO: 214146 - DNA, 25 bp, Artificial Sequence
  Description of Artificial Sequence: Synthetic oligonucleotide
ctggaccaaggactccactcccctg

SEQ ID NO: 214147 - DNA, 25 bp, Artificial Sequence
  Description of Artificial Sequence: Synthetic oligonucleotide
tggaccaaggactccactcccctgg

SEQ ID NO: 214148 - DNA, 24 bp, Artificial Sequence
  Description of Artificial Sequence: Synthetic oligonucleotide
ggaccaaggactccactcccctgg

SEQ ID NO: 214149 - DNA, 24 bp, Artificial Sequence
  Description of Artificial Sequence: Synthetic oligonucleotide
gaccaaggactccactcccctggg

SEQ ID NO: 214150 - DNA, 24 bp, Artificial Sequence
  Description of Artificial Sequence: Synthetic oligonucleotide
accaaggactccactcccctgggc

SEQ ID NO: 214151 - DNA, 23 bp, Artificial Sequence
  Description of Artificial Sequence: Synthetic oligonucleotide
ccaaggactccactcccctgggc

SEQ ID NO: 214152 - DNA, 25 bp, Artificial Sequence
  Description of Artificial Sequence: Synthetic oligonucleotide
caaggactccactcccctgggcgat

SEQ ID NO: 214153 - DNA, 25 bp, Artificial Sequence
  Description of Artificial Sequence: Synthetic oligonucleotide
aaggactccactcccctgggcgatg

SEQ ID NO: 214154 - DNA, 24 bp, Artificial Sequence
  Description of Artificial Sequence: Synthetic oligonucleotide
aggactccactcccctgggcgatg

SEQ ID NO: 214155 - DNA, 23 bp, Artificial Sequence
  Description of Artificial Sequence: Synthetic oligonucleotide
ggactccactcccctgggcgatg

SEQ ID NO: 214156 - DNA, 23 bp, Artificial Sequence
  Description of Artificial Sequence: Synthetic oligonucleotide
gactccactcccctgggcgatgg

SEQ ID NO: 214157 - DNA, 23 bp, Artificial Sequence
  Description of Artificial Sequence: Synthetic oligonucleotide
actccactcccctgggcgatggc

SEQ ID NO: 214158 - DNA, 22 bp, Artificial Sequence
  Description of Artificial Sequence: Synthetic oligonucleotide
ctccactcccctgggcgatggc

SEQ ID NO: 214159 - DNA, 22 bp, Artificial Sequence
  Description of Artificial Sequence: Synthetic oligonucleotide
tccactcccctgggcgatggcc

SEQ ID NO: 214160 - DNA, 21 bp, Artificial Sequence
  Description of Artificial Sequence: Synthetic oligonucleotide
ccactcccctgggcgatggcc

SEQ ID NO: 214161 - DNA, 21 bp, Artificial Sequence
  Description of Artificial Sequence: Synthetic oligonucleotide
cactcccctgggcgatggccc

SEQ ID NO: 214162 - DNA, 23 bp, Artificial Sequence
  Description of Artificial Sequence: Synthetic oligonucleotide
actcccctgggcgatggccccat

SEQ ID NO: 214163 - DNA, 22 bp, Artificial Sequence
  Description of Artificial Sequence: Synthetic oligonucleotide
ctcccctgggcgatggccccat

SEQ ID NO: 214164 - DNA, 22 bp, Artificial Sequence
  Description of Artificial Sequence: Synthetic oligonucleotide
tcccctgggcgatggccccatg

SEQ ID NO: 214165 - DNA, 21 bp, Artificial Sequence
  Description of Artificial Sequence: Synthetic oligonucleotide
cccctgggcgatggccccatg

SEQ ID NO: 214166 - DNA, 22 bp, Artificial Sequence
  Description of Artificial Sequence: Synthetic oligonucleotide
ccctgggcgatggccccatgct

SEQ ID NO: 214167 - DNA, 23 bp, Artificial Sequence
  Description of Artificial Sequence: Synthetic oligonucleotide
cctgggcgatggccccatgctgt

SEQ ID NO: 214168 - DNA, 23 bp, Artificial Sequence
  Description of Artificial Sequence: Synthetic oligonucleotide
ctgggcgatggccccatgctgtc

SEQ ID NO: 214169 - DNA, 23 bp, Artificial Sequence
  Description of Artificial Sequence: Synthetic oligonucleotide
tgggcgatggccccatgctgtcg

SEQ ID NO: 214170 - DNA, 22 bp, Artificial Sequence
  Description of Artificial Sequence: Synthetic oligonucleotide
gggcgatggccccatgctgtcg

SEQ ID NO: 214171 - DNA, 23 bp, Artificial Sequence
  Description of Artificial Sequence: Synthetic oligonucleotide
ggcgatggccccatgctgtcgct

SEQ ID NO: 214172 - DNA, 24 bp, Artificial Sequence
  Description of Artificial Sequence: Synthetic oligonucleotide
gcgatggccccatgctgtcgctca

SEQ ID NO: 214173 - DNA, 26 bp, Artificial Sequence
  Description of Artificial Sequence: Synthetic oligonucleotide
cgatggccccatgctgtcgctcagtt

SEQ ID NO: 214174 - DNA, 27 bp, Artificial Sequence
  Description of Artificial Sequence: Synthetic oligonucleotide
gatggccccatgctgtcgctcagttct

SEQ ID NO: 214175 - DNA, 29 bp, Artificial Sequence
  Description of Artificial Sequence: Synthetic oligonucleotide
atggccccatgctgtcgctcagttctatc

SEQ ID NO: 214176 - DNA, 28 bp, Artificial Sequence
  Description of Artificial Sequence: Synthetic oligonucleotide
tggccccatgctgtcgctcagttctatc

SEQ ID NO: 214177 - DNA, 27 bp, Artificial Sequence
  Description of Artificial Sequence: Synthetic oligonucleotide
ggccccatgctgtcgctcagttctatc

SEQ ID NO: 214178 - DNA, 28 bp, Artificial Sequence
  Description of Artificial Sequence: Synthetic oligonucleotide
gccccatgctgtcgctcagttctatcac

SEQ ID NO: 214179 - DNA, 28 bp, Artificial Sequence
  Description of Artificial Sequence: Synthetic oligonucleotide
ccccatgctgtcgctcagttctatcacc

SEQ ID NO: 214180 - DNA, 30 bp, Artificial Sequence
  Description of Artificial Sequence: Synthetic oligonucleotide
cccatgctgtcgctcagttctatcaccttc

SEQ ID NO: 214181 - DNA, 30 bp, Artificial Sequence
  Description of Artificial Sequence: Synthetic oligonucleotide
ccatgctgtcgctcagttctatcaccttcg

SEQ ID NO: 214182 - DNA, 33 bp, Artificial Sequence
  Description of Artificial Sequence: Synthetic oligonucleotide
catgctgtcgctcagttctatcaccttcgattc

SEQ ID NO: 214183 - DNA, 33 bp, Artificial Sequence
  Description of Artificial Sequence: Synthetic oligonucleotide
atgctgtcgctcagttctatcaccttcgattcc

SEQ ID NO: 214184 - DNA, 32 bp, Artificial Sequence
  Description of Artificial Sequence: Synthetic oligonucleotide
tgctgtcgctcagttctatcaccttcgattcc

SEQ ID NO: 214185 - DNA, 31 bp, Artificial Sequence
  Description of Artificial Sequence: Synthetic oligonucleotide
gctgtcgctcagttctatcaccttcgattcc

SEQ ID NO: 214186 - DNA, 34 bp, Artificial Sequence
  Description of Artificial Sequence: Synthetic oligonucleotide
ctgtcgctcagttctatcaccttcgattccaatg

SEQ ID NO: 214187 - DNA, 34 bp, Artificial Sequence
  Description of Artificial Sequence: Synthetic oligonucleotide
tgtcgctcagttctatcaccttcgattccaatgg

SEQ ID NO: 214188 - DNA, 33 bp, Artificial Sequence
  Description of Artificial Sequence: Synthetic oligonucleotide
gtcgctcagttctatcaccttcgattccaatgg

SEQ ID NO: 214189 - DNA, 33 bp, Artificial Sequence
  Description of Artificial Sequence: Synthetic oligonucleotide
tcgctcagttctatcaccttcgattccaatggc

SEQ ID NO: 214190 - DNA, 32 bp, Artificial Sequence
  Description of Artificial Sequence: Synthetic oligonucleotide
cgctcagttctatcaccttcgattccaatggc

SEQ ID NO: 214191 - DNA, 33 bp, Artificial Sequence
  Description of Artificial Sequence: Synthetic oligonucleotide
gctcagttctatcaccttcgattccaatggcac

SEQ ID NO: 214192 - DNA, 33 bp, Artificial Sequence
  Description of Artificial Sequence: Synthetic oligonucleotide
ctcagttctatcaccttcgattccaatggcacc

SEQ ID NO: 214193 - DNA, 35 bp, Artificial Sequence
  Description of Artificial Sequence: Synthetic oligonucleotide
tcagttctatcaccttcgattccaatggcacctac

SEQ ID NO: 214194 - DNA, 34 bp, Artificial Sequence
  Description of Artificial Sequence: Synthetic oligonucleotide
cagttctatcaccttcgattccaatggcacctac

SEQ ID NO: 214195 - DNA, 34 bp, Artificial Sequence
  Description of Artificial Sequence: Synthetic oligonucleotide
agttctatcaccttcgattccaatggcacctacg

SEQ ID NO: 214196 - DNA, 33 bp, Artificial Sequence
  Description of Artificial Sequence: Synthetic oligonucleotide
gttctatcaccttcgattccaatggcacctacg

SEQ ID NO: 214197 - DNA, 36 bp, Artificial Sequence
  Description of Artificial Sequence: Synthetic oligonucleotide
ttctatcaccttcgattccaatggcacctacgtatg

SEQ ID NO: 214198 - DNA, 35 bp, Artificial Sequence
  Description of Artificial Sequence: Synthetic oligonucleotide
tctatcaccttcgattccaatggcacctacgtatg

SEQ ID NO: 214199 - DNA, 34 bp, Artificial Sequence
  Description of Artificial Sequence: Synthetic oligonucleotide
ctatcaccttcgattccaatggcacctacgtatg

SEQ ID NO: 214200 - DNA, 35 bp, Artificial Sequence
  Description of Artificial Sequence: Synthetic oligonucleotide
tatcaccttcgattccaatggcacctacgtatgtg

SEQ ID NO: 214201 - DNA, 34 bp, Artificial Sequence
  Description of Artificial Sequence: Synthetic oligonucleotide
atcaccttcgattccaatggcacctacgtatgtg

SEQ ID NO: 214202 - DNA, 33 bp, Artificial Sequence
  Description of Artificial Sequence: Synthetic oligonucleotide
tcaccttcgattccaatggcacctacgtatgtg

SEQ ID NO: 214203 - DNA, 32 bp, Artificial Sequence
  Description of Artificial Sequence: Synthetic oligonucleotide
caccttcgattccaatggcacctacgtatgtg

SEQ ID NO: 214204 - DNA, 33 bp, Artificial Sequence
  Description of Artificial Sequence: Synthetic oligonucleotide
accttcgattccaatggcacctacgtatgtgag

SEQ ID NO: 214205 - DNA, 32 bp, Artificial Sequence
  Description of Artificial Sequence: Synthetic oligonucleotide
ccttcgattccaatggcacctacgtatgtgag

SEQ ID NO: 214206 - DNA, 32 bp, Artificial Sequence
  Description of Artificial Sequence: Synthetic oligonucleotide
cttcgattccaatggcacctacgtatgtgagg

SEQ ID NO: 214207 - DNA, 32 bp, Artificial Sequence
  Description of Artificial Sequence: Synthetic oligonucleotide
ttcgattccaatggcacctacgtatgtgaggc

SEQ ID NO: 214208 - DNA, 31 bp, Artificial Sequence
  Description of Artificial Sequence: Synthetic oligonucleotide
tcgattccaatggcacctacgtatgtgaggc

SEQ ID NO: 214209 - DNA, 30 bp, Artificial Sequence
  Description of Artificial Sequence: Synthetic oligonucleotide
cgattccaatggcacctacgtatgtgaggc

SEQ ID NO: 214210 - DNA, 30 bp, Artificial Sequence
  Description of Artificial Sequence: Synthetic oligonucleotide
gattccaatggcacctacgtatgtgaggcc

SEQ ID NO: 214211 - DNA, 31 bp, Artificial Sequence
  Description of Artificial Sequence: Synthetic oligonucleotide
attccaatggcacctacgtatgtgaggcctc

SEQ ID NO: 214212 - DNA, 30 bp, Artificial Sequence
  Description of Artificial Sequence: Synthetic oligonucleotide
ttccaatggcacctacgtatgtgaggcctc

SEQ ID NO: 214213 - DNA, 29 bp, Artificial Sequence
  Description of Artificial Sequence: Synthetic oligonucleotide
tccaatggcacctacgtatgtgaggcctc

SEQ ID NO: 214214 - DNA, 28 bp, Artificial Sequence
  Description of Artificial Sequence: Synthetic oligonucleotide
ccaatggcacctacgtatgtgaggcctc

SEQ ID NO: 214215 - DNA, 28 bp, Artificial Sequence
  Description of Artificial Sequence: Synthetic oligonucleotide
caatggcacctacgtatgtgaggcctcc

SEQ ID NO: 214216 - DNA, 28 bp, Artificial Sequence
  Description of Artificial Sequence: Synthetic oligonucleotide
aatggcacctacgtatgtgaggcctccc

SEQ ID NO: 214217 - DNA, 27 bp, Artificial Sequence
  Description of Artificial Sequence: Synthetic oligonucleotide
atggcacctacgtatgtgaggcctccc

SEQ ID NO: 214218 - DNA, 27 bp, Artificial Sequence
  Description of Artificial Sequence: Synthetic oligonucleotide
tggcacctacgtatgtgaggcctccct

SEQ ID NO: 214219 - DNA, 26 bp, Artificial Sequence
  Description of Artificial Sequence: Synthetic oligonucleotide
ggcacctacgtatgtgaggcctccct

SEQ ID NO: 214220 - DNA, 26 bp, Artificial Sequence
  Description of Artificial Sequence: Synthetic oligonucleotide
gcacctacgtatgtgaggcctccctg

SEQ ID NO: 214221 - DNA, 26 bp, Artificial Sequence
  Description of Artificial Sequence: Synthetic oligonucleotide
cacctacgtatgtgaggcctccctgc

SEQ ID NO: 214222 - DNA, 26 bp, Artificial Sequence
  Description of Artificial Sequence: Synthetic oligonucleotide
acctacgtatgtgaggcctccctgcc

SEQ ID NO: 214223 - DNA, 25 bp, Artificial Sequence
  Description of Artificial Sequence: Synthetic oligonucleotide
cctacgtatgtgaggcctccctgcc

SEQ ID NO: 214224 - DNA, 26 bp, Artificial Sequence
  Description of Artificial Sequence: Synthetic oligonucleotide
ctacgtatgtgaggcctccctgccca

SEQ ID NO: 214225 - DNA, 27 bp, Artificial Sequence
  Description of Artificial Sequence: Synthetic oligonucleotide
tacgtatgtgaggcctccctgcccaca

SEQ ID NO: 214226 - DNA, 26 bp, Artificial Sequence
  Description of Artificial Sequence: Synthetic oligonucleotide
acgtatgtgaggcctccctgcccaca

SEQ ID NO: 214227 - DNA, 25 bp, Artificial Sequence
  Description of Artificial Sequence: Synthetic oligonucleotide
cgtatgtgaggcctccctgcccaca

SEQ ID NO: 214228 - DNA, 26 bp, Artificial Sequence
  Description of Artificial Sequence: Synthetic oligonucleotide
gtatgtgaggcctccctgcccacagt

SEQ ID NO: 214229 - DNA, 26 bp, Artificial Sequence
  Description of Artificial Sequence: Synthetic oligonucleotide
tatgtgaggcctccctgcccacagtc

SEQ ID NO: 214230 - DNA, 25 bp, Artificial Sequence
  Description of Artificial Sequence: Synthetic oligonucleotide
atgtgaggcctccctgcccacagtc

SEQ ID NO: 214231 - DNA, 24 bp, Artificial Sequence
  Description of Artificial Sequence: Synthetic oligonucleotide
tgtgaggcctccctgcccacagtc

SEQ ID NO: 214232 - DNA, 23 bp, Artificial Sequence
  Description of Artificial Sequence: Synthetic oligonucleotide
gtgaggcctccctgcccacagtc

SEQ ID NO: 214233 - DNA, 23 bp, Artificial Sequence
  Description of Artificial Sequence: Synthetic oligonucleotide
tgaggcctccctgcccacagtcc

SEQ ID NO: 214234 - DNA, 22 bp, Artificial Sequence
  Description of Artificial Sequence: Synthetic oligonucleotide
gaggcctccctgcccacagtcc

SEQ ID NO: 214235 - DNA, 22 bp, Artificial Sequence
  Description of Artificial Sequence: Synthetic oligonucleotide
aggcctccctgcccacagtccc

SEQ ID NO: 214236 - DNA, 21 bp, Artificial Sequence
  Description of Artificial Sequence: Synthetic oligonucleotide
ggcctccctgcccacagtccc

SEQ ID NO: 214237 - DNA, 21 bp, Artificial Sequence
  Description of Artificial Sequence: Synthetic oligonucleotide
gcctccctgcccacagtcccg

SEQ ID NO: 214238 - DNA, 22 bp, Artificial Sequence
  Description of Artificial Sequence: Synthetic oligonucleotide
cctccctgcccacagtcccggt

SEQ ID NO: 214239 - DNA, 22 bp, Artificial Sequence
  Description of Artificial Sequence: Synthetic oligonucleotide
ctccctgcccacagtcccggtc

SEQ ID NO: 214240 - DNA, 23 bp, Artificial Sequence
  Description of Artificial Sequence: Synthetic oligonucleotide
tccctgcccacagtcccggtcct

SEQ ID NO: 214241 - DNA, 22 bp, Artificial Sequence
  Description of Artificial Sequence: Synthetic oligonucleotide
ccctgcccacagtcccggtcct

SEQ ID NO: 214242 - DNA, 23 bp, Artificial Sequence
  Description of Artificial Sequence: Synthetic oligonucleotide
cctgcccacagtcccggtcctca

SEQ ID NO: 214243 - DNA, 23 bp, Artificial Sequence
  Description of Artificial Sequence: Synthetic oligonucleotide
ctgcccacagtcccggtcctcag

SEQ ID NO: 214244 - DNA, 23 bp, Artificial Sequence
  Description of Artificial Sequence: Synthetic oligonucleotide
tgcccacagtcccggtcctcagc

SEQ ID NO: 214245 - DNA, 22 bp, Artificial Sequence
  Description of Artificial Sequence: Synthetic oligonucleotide
gcccacagtcccggtcctcagc

SEQ ID NO: 214246 - DNA, 22 bp, Artificial Sequence
  Description of Artificial Sequence: Synthetic oligonucleotide
cccacagtcccggtcctcagcc

SEQ ID NO: 214247 - DNA, 22 bp, Artificial Sequence
  Description of Artificial Sequence: Synthetic oligonucleotide
ccacagtcccggtcctcagccg

SEQ ID NO: 214248 - DNA, 23 bp, Artificial Sequence
  Description of Artificial Sequence: Synthetic oligonucleotide
cacagtcccggtcctcagccgca

SEQ ID NO: 214249 - DNA, 23 bp, Artificial Sequence
  Description of Artificial Sequence: Synthetic oligonucleotide
acagtcccggtcctcagccgcac

SEQ ID NO: 214250 - DNA, 22 bp, Artificial Sequence
  Description of Artificial Sequence: Synthetic oligonucleotide
cagtcccggtcctcagccgcac

SEQ ID NO: 214251 - DNA, 22 bp, Artificial Sequence
  Description of Artificial Sequence: Synthetic oligonucleotide
agtcccggtcctcagccgcacc

SEQ ID NO: 214252 - DNA, 21 bp, Artificial Sequence
  Description of Artificial Sequence: Synthetic oligonucleotide
gtcccggtcctcagccgcacc

SEQ ID NO: 214253 - DNA, 22 bp, Artificial Sequence
  Description of Artificial Sequence: Synthetic oligonucleotide
tcccggtcctcagccgcaccca

SEQ ID NO: 214254 - DNA, 21 bp, Artificial Sequence
  Description of Artificial Sequence: Synthetic oligonucleotide
cccggtcctcagccgcaccca

SEQ ID NO: 214255 - DNA, 23 bp, Artificial Sequence
  Description of Artificial Sequence: Synthetic oligonucleotide
ccggtcctcagccgcacccagaa

SEQ ID NO: 214256 - DNA, 25 bp, Artificial Sequence
  Description of Artificial Sequence: Synthetic oligonucleotide
cggtcctcagccgcacccagaactt

SEQ ID NO: 214257 - DNA, 26 bp, Artificial Sequence
  Description of Artificial Sequence: Synthetic oligonucleotide
ggtcctcagccgcacccagaacttca

SEQ ID NO: 214258 - DNA, 26 bp, Artificial Sequence
  Description of Artificial Sequence: Synthetic oligonucleotide
gtcctcagccgcacccagaacttcac

SEQ ID NO: 214259 - DNA, 26 bp, Artificial Sequence
  Description of Artificial Sequence: Synthetic oligonucleotide
tcctcagccgcacccagaacttcacg

SEQ ID NO: 214260 - DNA, 25 bp, Artificial Sequence
  Description of Artificial Sequence: Synthetic oligonucleotide
cctcagccgcacccagaacttcacg

SEQ ID NO: 214261 - DNA, 26 bp, Artificial Sequence
  Description of Artificial Sequence: Synthetic oligonucleotide
ctcagccgcacccagaacttcacgct

SEQ ID NO: 214262 - DNA, 26 bp, Artificial Sequence
  Description of Artificial Sequence: Synthetic oligonucleotide
tcagccgcacccagaacttcacgctg

SEQ ID NO: 214263 - DNA, 25 bp, Artificial Sequence
  Description of Artificial Sequence: Synthetic oligonucleotide
cagccgcacccagaacttcacgctg

SEQ ID NO: 214264 - DNA, 26 bp, Artificial Sequence
  Description of Artificial Sequence: Synthetic oligonucleotide
agccgcacccagaacttcacgctgct

SEQ ID NO: 214265 - DNA, 25 bp, Artificial Sequence
  Description of Artificial Sequence: Synthetic oligonucleotide
gccgcacccagaacttcacgctgct

SEQ ID NO: 214266 - DNA, 25 bp, Artificial Sequence
  Description of Artificial Sequence: Synthetic oligonucleotide
ccgcacccagaacttcacgctgctg

SEQ ID NO: 214267 - DNA, 26 bp, Artificial Sequence
  Description of Artificial Sequence: Synthetic oligonucleotide
cgcacccagaacttcacgctgctggt

SEQ ID NO: 214268 - DNA, 26 bp, Artificial Sequence
  Description of Artificial Sequence: Synthetic oligonucleotide
gcacccagaacttcacgctgctggtc

SEQ ID NO: 214269 - DNA, 27 bp, Artificial Sequence
  Description of Artificial Sequence: Synthetic oligonucleotide
cacccagaacttcacgctgctggtcca

SEQ ID NO: 214270 - DNA, 28 bp, Artificial Sequence
  Description of Artificial Sequence: Synthetic oligonucleotide
acccagaacttcacgctgctggtccaag

SEQ ID NO: 214271 - DNA, 27 bp, Artificial Sequence
  Description of Artificial Sequence: Synthetic oligonucleotide
cccagaacttcacgctgctggtccaag

SEQ ID NO: 214272 - DNA, 27 bp, Artificial Sequence
  Description of Artificial Sequence: Synthetic oligonucleotide
ccagaacttcacgctgctggtccaagg

SEQ ID NO: 214273 - DNA, 27 bp, Artificial Sequence
  Description of Artificial Sequence: Synthetic oligonucleotide
cagaacttcacgctgctggtccaaggc

SEQ ID NO: 214274 - DNA, 28 bp, Artificial Sequence
  Description of Artificial Sequence: Synthetic oligonucleotide
agaacttcacgctgctggtccaaggctc

SEQ ID NO: 214275 - DNA, 27 bp, Artificial Sequence
  Description of Artificial Sequence: Synthetic oligonucleotide
gaacttcacgctgctggtccaaggctc

SEQ ID NO: 214276 - DNA, 27 bp, Artificial Sequence
  Description of Artificial Sequence: Synthetic oligonucleotide
aacttcacgctgctggtccaaggctcg

SEQ ID NO: 214277 - DNA, 26 bp, Artificial Sequence
  Description of Artificial Sequence: Synthetic oligonucleotide
acttcacgctgctggtccaaggctcg

SEQ ID NO: 214278 - DNA, 25 bp, Artificial Sequence
  Description of Artificial Sequence: Synthetic oligonucleotide
cttcacgctgctggtccaaggctcg

SEQ ID NO: 214279 - DNA, 25 bp, Artificial Sequence
  Description of Artificial Sequence: Synthetic oligonucleotide
ttcacgctgctggtccaaggctcgc

SEQ ID NO: 214280 - DNA, 24 bp, Artificial Sequence
  Description of Artificial Sequence: Synthetic oligonucleotide
tcacgctgctggtccaaggctcgc

SEQ ID NO: 214281 - DNA, 23 bp, Artificial Sequence
  Description of Artificial Sequence: Synthetic oligonucleotide
cacgctgctggtccaaggctcgc

SEQ ID NO: 214282 - DNA, 24 bp, Artificial Sequence
  Description of Artificial Sequence: Synthetic oligonucleotide
acgctgctggtccaaggctcgcca

SEQ ID NO: 214283 - DNA, 23 bp, Artificial Sequence
  Description of Artificial Sequence: Synthetic oligonucleotide
cgctgctggtccaaggctcgcca

SEQ ID NO: 214284 - DNA, 24 bp, Artificial Sequence
  Description of Artificial Sequence: Synthetic oligonucleotide
gctgctggtccaaggctcgccaga

SEQ ID NO: 214285 - DNA, 24 bp, Artificial Sequence
  Description of Artificial Sequence: Synthetic oligonucleotide
ctgctggtccaaggctcgccagag

SEQ ID NO: 214286 - DNA, 27 bp, Artificial Sequence
  Description of Artificial Sequence: Synthetic oligonucleotide
tgctggtccaaggctcgccagagctaa

SEQ ID NO: 214287 - DNA, 27 bp, Artificial Sequence
  Description of Artificial Sequence: Synthetic oligonucleotide
gctggtccaaggctcgccagagctaaa

SEQ ID NO: 214288 - DNA, 27 bp, Artificial Sequence
  Description of Artificial Sequence: Synthetic oligonucleotide
ctggtccaaggctcgccagagctaaag

SEQ ID NO: 214289 - DNA, 28 bp, Artificial Sequence
  Description of Artificial Sequence: Synthetic oligonucleotide
tggtccaaggctcgccagagctaaagac

SEQ ID NO: 214290 - DNA, 27 bp, Artificial Sequence
  Description of Artificial Sequence: Synthetic oligonucleotide
ggtccaaggctcgccagagctaaagac

SEQ ID NO: 214291 - DNA, 28 bp, Artificial Sequence
  Description of Artificial Sequence: Synthetic oligonucleotide
gtccaaggctcgccagagctaaagacag

SEQ ID NO: 214292 - DNA, 28 bp, Artificial Sequence
  Description of Artificial Sequence: Synthetic oligonucleotide
tccaaggctcgccagagctaaagacagc

SEQ ID NO: 214293 - DNA, 27 bp, Artificial Sequence
  Description of Artificial Sequence: Synthetic oligonucleotide
ccaaggctcgccagagctaaagacagc

SEQ ID NO: 214294 - DNA, 27 bp, Artificial Sequence
  Description of Artificial Sequence: Synthetic oligonucleotide
caaggctcgccagagctaaagacagcg

SEQ ID NO: 214295 - DNA, 27 bp, Artificial Sequence
  Description of Artificial Sequence: Synthetic oligonucleotide
aaggctcgccagagctaaagacagcgg

SEQ ID NO: 214296 - DNA, 27 bp, Artificial Sequence
  Description of Artificial Sequence: Synthetic oligonucleotide
aggctcgccagagctaaagacagcgga

SEQ ID NO: 214297 - DNA, 27 bp, Artificial Sequence
  Description of Artificial Sequence: Synthetic oligonucleotide
ggctcgccagagctaaagacagcggaa

SEQ ID NO: 214298 - DNA, 30 bp, Artificial Sequence
  Description of Artificial Sequence: Synthetic oligonucleotide
gctcgccagagctaaagacagcggaaatag

SEQ ID NO: 214299 - DNA, 31 bp, Artificial Sequence
  Description of Artificial Sequence: Synthetic oligonucleotide
ctcgccagagctaaagacagcggaaatagag

SEQ ID NO: 214300 - DNA, 31 bp, Artificial Sequence
  Description of Artificial Sequence: Synthetic oligonucleotide
tcgccagagctaaagacagcggaaatagagc

SEQ ID NO: 214301 - DNA, 30 bp, Artificial Sequence
  Description of Artificial Sequence: Synthetic oligonucleotide
cgccagagctaaagacagcggaaatagagc

SEQ ID NO: 214302 - DNA, 30 bp, Artificial Sequence
  Description of Artificial Sequence: Synthetic oligonucleotide
gccagagctaaagacagcggaaatagagcc

SEQ ID NO: 214303 - DNA, 30 bp, Artificial Sequence
  Description of Artificial Sequence: Synthetic oligonucleotide
ccagagctaaagacagcggaaatagagccc

SEQ ID NO: 214304 - DNA, 32 bp, Artificial Sequence
  Description of Artificial Sequence: Synthetic oligonucleotide
cagagctaaagacagcggaaatagagcccaag

SEQ ID NO: 214305 - DNA, 32 bp, Artificial Sequence
  Description of Artificial Sequence: Synthetic oligonucleotide
agagctaaagacagcggaaatagagcccaagg

SEQ ID NO: 214306 - DNA, 31 bp, Artificial Sequence
  Description of Artificial Sequence: Synthetic oligonucleotide
gagctaaagacagcggaaatagagcccaagg

SEQ ID NO: 214307 - DNA, 31 bp, Artificial Sequence
  Description of Artificial Sequence: Synthetic oligonucleotide
agctaaagacagcggaaatagagcccaaggc

SEQ ID NO: 214308 - DNA, 30 bp, Artificial Sequence
  Description of Artificial Sequence: Synthetic oligonucleotide
gctaaagacagcggaaatagagcccaaggc

SEQ ID NO: 214309 - DNA, 31 bp, Artificial Sequence
  Description of Artificial Sequence: Synthetic oligonucleotide
ctaaagacagcggaaatagagcccaaggcag

SEQ ID NO: 214310 - DNA, 33 bp, Artificial Sequence
  Description of Artificial Sequence: Synthetic oligonucleotide
taaagacagcggaaatagagcccaaggcagatg

SEQ ID NO: 214311 - DNA, 32 bp, Artificial Sequence
  Description of Artificial Sequence: Synthetic oligonucleotide
aaagacagcggaaatagagcccaaggcagatg

SEQ ID NO: 214312 - DNA, 31 bp, Artificial Sequence
  Description of Artificial Sequence: Synthetic oligonucleotide
aagacagcggaaatagagcccaaggcagatg

SEQ ID NO: 214313 - DNA, 30 bp, Artificial Sequence
  Description of Artificial Sequence: Synthetic oligonucleotide
agacagcggaaatagagcccaaggcagatg

SEQ ID NO: 214314 - DNA, 29 bp, Artificial Sequence
  Description of Artificial Sequence: Synthetic oligonucleotide
gacagcggaaatagagcccaaggcagatg

SEQ ID NO: 214315 - DNA, 29 bp, Artificial Sequence
  Description of Artificial Sequence: Synthetic oligonucleotide
acagcggaaatagagcccaaggcagatgg

SEQ ID NO: 214316 - DNA, 28 bp, Artificial Sequence
  Description of Artificial Sequence: Synthetic oligonucleotide
cagcggaaatagagcccaaggcagatgg

SEQ ID NO: 214317 - DNA, 28 bp, Artificial Sequence
  Description of Artificial Sequence: Synthetic oligonucleotide
agcggaaatagagcccaaggcagatggc

SEQ ID NO: 214318 - DNA, 27 bp, Artificial Sequence
  Description of Artificial Sequence: Synthetic oligonucleotide
gcggaaatagagcccaaggcagatggc

SEQ ID NO: 214319 - DNA, 28 bp, Artificial Sequence
  Description of Artificial Sequence: Synthetic oligonucleotide
cggaaatagagcccaaggcagatggcag

SEQ ID NO: 214320 - DNA, 28 bp, Artificial Sequence
  Description of Artificial Sequence: Synthetic oligonucleotide
ggaaatagagcccaaggcagatggcagc

SEQ ID NO: 214321 - DNA, 29 bp, Artificial Sequence
  Description of Artificial Sequence: Synthetic oligonucleotide
gaaatagagcccaaggcagatggcagctg

SEQ ID NO: 214322 - DNA, 29 bp, Artificial Sequence
  Description of Artificial Sequence: Synthetic oligonucleotide
aaatagagcccaaggcagatggcagctgg

SEQ ID NO: 214323 - DNA, 28 bp, Artificial Sequence
  Description of Artificial Sequence: Synthetic oligonucleotide
aatagagcccaaggcagatggcagctgg

SEQ ID NO: 214324 - DNA, 27 bp, Artificial Sequence
  Description of Artificial Sequence: Synthetic oligonucleotide
atagagcccaaggcagatggcagctgg

SEQ ID NO: 214325 - DNA, 27 bp, Artificial Sequence
  Description of Artificial Sequence: Synthetic oligonucleotide
tagagcccaaggcagatggcagctgga

SEQ ID NO: 214326 - DNA, 26 bp, Artificial Sequence
  Description of Artificial Sequence: Synthetic oligonucleotide
agagcccaaggcagatggcagctgga

SEQ ID NO: 214327 - DNA, 25 bp, Artificial Sequence
  Description of Artificial Sequence: Synthetic oligonucleotide
gagcccaaggcagatggcagctgga

SEQ ID NO: 214328 - DNA, 25 bp, Artificial Sequence
  Description of Artificial Sequence: Synthetic oligonucleotide
agcccaaggcagatggcagctggag

SEQ ID NO: 214329 - DNA, 24 bp, Artificial Sequence
  Description of Artificial Sequence: Synthetic oligonucleotide
gcccaaggcagatggcagctggag

SEQ ID NO: 214330 - DNA, 24 bp, Artificial Sequence
  Description of Artificial Sequence: Synthetic oligonucleotide
cccaaggcagatggcagctggagg

SEQ ID NO: 214331 - DNA, 26 bp, Artificial Sequence
  Description of Artificial Sequence: Synthetic oligonucleotide
ccaaggcagatggcagctggagggaa

SEQ ID NO: 214332 - DNA, 26 bp, Artificial Sequence
  Description of Artificial Sequence: Synthetic oligonucleotide
caaggcagatggcagctggagggaag

SEQ ID NO: 214333 - DNA, 27 bp, Artificial Sequence
  Description of Artificial Sequence: Synthetic oligonucleotide
aaggcagatggcagctggagggaagga

SEQ ID NO: 214334 - DNA, 26 bp, Artificial Sequence
  Description of Artificial Sequence: Synthetic oligonucleotide
aggcagatggcagctggagggaagga

SEQ ID NO: 214335 - DNA, 25 bp, Artificial Sequence
  Description of Artificial Sequence: Synthetic oligonucleotide
ggcagatggcagctggagggaagga

SEQ ID NO: 214336 - DNA, 26 bp, Artificial Sequence
  Description of Artificial Sequence: Synthetic oligonucleotide
gcagatggcagctggagggaaggaga

SEQ ID NO: 214337 - DNA, 26 bp, Artificial Sequence
  Description of Artificial Sequence: Synthetic oligonucleotide
cagatggcagctggagggaaggagac

SEQ ID NO: 214338 - DNA, 27 bp, Artificial Sequence
  Description of Artificial Sequence: Synthetic oligonucleotide
agatggcagctggagggaaggagacga

SEQ ID NO: 214339 - DNA, 27 bp, Artificial Sequence
  Description of Artificial Sequence: Synthetic oligonucleotide
gatggcagctggagggaaggagacgaa

SEQ ID NO: 214340 - DNA, 27 bp, Artificial Sequence
  Description of Artificial Sequence: Synthetic oligonucleotide
atggcagctggagggaaggagacgaag

SEQ ID NO: 214341 - DNA, 27 bp, Artificial Sequence
  Description of Artificial Sequence: Synthetic oligonucleotide
tggcagctggagggaaggagacgaagt

SEQ ID NO: 214342 - DNA, 26 bp, Artificial Sequence
  Description of Artificial Sequence: Synthetic oligonucleotide
ggcagctggagggaaggagacgaagt

SEQ ID NO: 214343 - DNA, 27 bp, Artificial Sequence
  Description of Artificial Sequence: Synthetic oligonucleotide
gcagctggagggaaggagacgaagtca

SEQ ID NO: 214344 - DNA, 27 bp, Artificial Sequence
  Description of Artificial Sequence: Synthetic oligonucleotide
cagctggagggaaggagacgaagtcac

SEQ ID NO: 214345 - DNA, 28 bp, Artificial Sequence
  Description of Artificial Sequence: Synthetic oligonucleotide
agctggagggaaggagacgaagtcacac

SEQ ID NO: 214346 - DNA, 27 bp, Artificial Sequence
  Description of Artificial Sequence: Synthetic oligonucleotide
gctggagggaaggagacgaagtcacac

SEQ ID NO: 214347 - DNA, 28 bp, Artificial Sequence
  Description of Artificial Sequence: Synthetic oligonucleotide
ctggagggaaggagacgaagtcacactc

SEQ ID NO: 214348 - DNA, 30 bp, Artificial Sequence
  Description of Artificial Sequence: Synthetic oligonucleotide
tggagggaaggagacgaagtcacactcatc

SEQ ID NO: 214349 - DNA, 29 bp, Artificial Sequence
  Description of Artificial Sequence: Synthetic oligonucleotide
ggagggaaggagacgaagtcacactcatc

SEQ ID NO: 214350 - DNA, 30 bp, Artificial Sequence
  Description of Artificial Sequence: Synthetic oligonucleotide
gagggaaggagacgaagtcacactcatctg

SEQ ID NO: 214351 - DNA, 30 bp, Artificial Sequence
  Description of Artificial Sequence: Synthetic oligonucleotide
agggaaggagacgaagtcacactcatctgc

SEQ ID NO: 214352 - DNA, 29 bp, Artificial Sequence
  Description of Artificial Sequence: Synthetic oligonucleotide
gggaaggagacgaagtcacactcatctgc

SEQ ID NO: 214353 - DNA, 30 bp, Artificial Sequence
  Description of Artificial Sequence: Synthetic oligonucleotide
ggaaggagacgaagtcacactcatctgctc

SEQ ID NO: 214354 - DNA, 31 bp, Artificial Sequence
  Description of Artificial Sequence: Synthetic oligonucleotide
gaaggagacgaagtcacactcatctgctctg

SEQ ID NO: 214355 - DNA, 31 bp, Artificial Sequence
  Description of Artificial Sequence: Synthetic oligonucleotide
aaggagacgaagtcacactcatctgctctgc

SEQ ID NO: 214356 - DNA, 30 bp, Artificial Sequence
  Description of Artificial Sequence: Synthetic oligonucleotide
aggagacgaagtcacactcatctgctctgc

SEQ ID NO: 214357 - DNA, 29 bp, Artificial Sequence
  Description of Artificial Sequence: Synthetic oligonucleotide
ggagacgaagtcacactcatctgctctgc

SEQ ID NO: 214358 - DNA, 29 bp, Artificial Sequence
  Description of Artificial Sequence: Synthetic oligonucleotide
gagacgaagtcacactcatctgctctgcc

SEQ ID NO: 214359 - DNA, 29 bp, Artificial Sequence
  Description of Artificial Sequence: Synthetic oligonucleotide
agacgaagtcacactcatctgctctgccc

SEQ ID NO: 214360 - DNA, 28 bp, Artificial Sequence
  Description of Artificial Sequence: Synthetic oligonucleotide
gacgaagtcacactcatctgctctgccc

SEQ ID NO: 214361 - DNA, 28 bp, Artificial Sequence
  Description of Artificial Sequence: Synthetic oligonucleotide
acgaagtcacactcatctgctctgcccg

SEQ ID NO: 214362 - DNA, 27 bp, Artificial Sequence
  Description of Artificial Sequence: Synthetic oligonucleotide
cgaagtcacactcatctgctctgcccg

SEQ ID NO: 214363 - DNA, 27 bp, Artificial Sequence
  Description of Artificial Sequence: Synthetic oligonucleotide
gaagtcacactcatctgctctgcccgc

SEQ ID NO: 214364 - DNA, 27 bp, Artificial Sequence
  Description of Artificial Sequence: Synthetic oligonucleotide
aagtcacactcatctgctctgcccgcg

SEQ ID NO: 214365 - DNA, 26 bp, Artificial Sequence
  Description of Artificial Sequence: Synthetic oligonucleotide
agtcacactcatctgctctgcccgcg

SEQ ID NO: 214366 - DNA, 25 bp, Artificial Sequence
  Description of Artificial Sequence: Synthetic oligonucleotide
gtcacactcatctgctctgcccgcg

SEQ ID NO: 214367 - DNA, 25 bp, Artificial Sequence
  Description of Artificial Sequence: Synthetic oligonucleotide
tcacactcatctgctctgcccgcgg

SEQ ID NO: 214368 - DNA, 24 bp, Artificial Sequence
  Description of Artificial Sequence: Synthetic oligonucleotide
cacactcatctgctctgcccgcgg

SEQ ID NO: 214369 - DNA, 24 bp, Artificial Sequence
  Description of Artificial Sequence: Synthetic oligonucleotide
acactcatctgctctgcccgcggc

SEQ ID NO: 214370 - DNA, 23 bp, Artificial Sequence
  Description of Artificial Sequence: Synthetic oligonucleotide
cactcatctgctctgcccgcggc

SEQ ID NO: 214371 - DNA, 25 bp, Artificial Sequence
  Description of Artificial Sequence: Synthetic oligonucleotide
actcatctgctctgcccgcggccat

SEQ ID NO: 214372 - DNA, 24 bp, Artificial Sequence
  Description of Artificial Sequence: Synthetic oligonucleotide
ctcatctgctctgcccgcggccat

SEQ ID NO: 214373 - DNA, 24 bp, Artificial Sequence
  Description of Artificial Sequence: Synthetic oligonucleotide
tcatctgctctgcccgcggccatc

SEQ ID NO: 214374 - DNA, 23 bp, Artificial Sequence
  Description of Artificial Sequence: Synthetic oligonucleotide
catctgctctgcccgcggccatc

SEQ ID NO: 214375 - DNA, 24 bp, Artificial Sequence
  Description of Artificial Sequence: Synthetic oligonucleotide
atctgctctgcccgcggccatcca

SEQ ID NO: 214376 - DNA, 23 bp, Artificial Sequence
  Description of Artificial Sequence: Synthetic oligonucleotide
tctgctctgcccgcggccatcca

SEQ ID NO: 214377 - DNA, 22 bp, Artificial Sequence
  Description of Artificial Sequence: Synthetic oligonucleotide
ctgctctgcccgcggccatcca

SEQ ID NO: 214378 - DNA, 23 bp, Artificial Sequence
  Description of Artificial Sequence: Synthetic oligonucleotide
tgctctgcccgcggccatccaga

SEQ ID NO: 214379 - DNA, 22 bp, Artificial Sequence
  Description of Artificial Sequence: Synthetic oligonucleotide
gctctgcccgcggccatccaga

SEQ ID NO: 214380 - DNA, 22 bp, Artificial Sequence
  Description of Artificial Sequence: Synthetic oligonucleotide
ctctgcccgcggccatccagac

SEQ ID NO: 214381 - DNA, 22 bp, Artificial Sequence
  Description of Artificial Sequence: Synthetic oligonucleotide
tctgcccgcggccatccagacc

SEQ ID NO: 214382 - DNA, 21 bp, Artificial Sequence
  Description of Artificial Sequence: Synthetic oligonucleotide
ctgcccgcggccatccagacc

SEQ ID NO: 214383 - DNA, 21 bp, Artificial Sequence
  Description of Artificial Sequence: Synthetic oligonucleotide
tgcccgcggccatccagaccc

SEQ ID NO: 214384 - DNA, 20 bp, Artificial Sequence
  Description of Artificial Sequence: Synthetic oligonucleotide
gcccgcggccatccagaccc

SEQ ID NO: 214385 - DNA, 23 bp, Artificial Sequence
  Description of Artificial Sequence: Synthetic oligonucleotide
cccgcggccatccagaccccaaa

SEQ ID NO: 214386 - DNA, 24 bp, Artificial Sequence
  Description of Artificial Sequence: Synthetic oligonucleotide
ccgcggccatccagaccccaaact

SEQ ID NO: 214387 - DNA, 25 bp, Artificial Sequence
  Description of Artificial Sequence: Synthetic oligonucleotide
cgcggccatccagaccccaaactca

SEQ ID NO: 214388 - DNA, 25 bp, Artificial Sequence
  Description of Artificial Sequence: Synthetic oligonucleotide
gcggccatccagaccccaaactcag

SEQ ID NO: 214389 - DNA, 26 bp, Artificial Sequence
  Description of Artificial Sequence: Synthetic oligonucleotide
cggccatccagaccccaaactcagct

SEQ ID NO: 214390 - DNA, 26 bp, Artificial Sequence
  Description of Artificial Sequence: Synthetic oligonucleotide
ggccatccagaccccaaactcagctg

SEQ ID NO: 214391 - DNA, 27 bp, Artificial Sequence
  Description of Artificial Sequence: Synthetic oligonucleotide
gccatccagaccccaaactcagctgga

SEQ ID NO: 214392 - DNA, 27 bp, Artificial Sequence
  Description of Artificial Sequence: Synthetic oligonucleotide
ccatccagaccccaaactcagctggag

SEQ ID NO: 214393 - DNA, 27 bp, Artificial Sequence
  Description of Artificial Sequence: Synthetic oligonucleotide
catccagaccccaaactcagctggagc

SEQ ID NO: 214394 - DNA, 27 bp, Artificial Sequence
  Description of Artificial Sequence: Synthetic oligonucleotide
atccagaccccaaactcagctggagcc

SEQ ID NO: 214395 - DNA, 27 bp, Artificial Sequence
  Description of Artificial Sequence: Synthetic oligonucleotide
tccagaccccaaactcagctggagcca

SEQ ID NO: 214396 - DNA, 27 bp, Artificial Sequence
  Description of Artificial Sequence: Synthetic oligonucleotide
ccagaccccaaactcagctggagccaa

SEQ ID NO: 214397 - DNA, 29 bp, Artificial Sequence
  Description of Artificial Sequence: Synthetic oligonucleotide
cagaccccaaactcagctggagccaattg

SEQ ID NO: 214398 - DNA, 29 bp, Artificial Sequence
  Description of Artificial Sequence: Synthetic oligonucleotide
agaccccaaactcagctggagccaattgg

SEQ ID NO: 214399 - DNA, 28 bp, Artificial Sequence
  Description of Artificial Sequence: Synthetic oligonucleotide
gaccccaaactcagctggagccaattgg

SEQ ID NO: 214400 - DNA, 28 bp, Artificial Sequence
  Description of Artificial Sequence: Synthetic oligonucleotide
accccaaactcagctggagccaattggg

SEQ ID NO: 214401 - DNA, 27 bp, Artificial Sequence
  Description of Artificial Sequence: Synthetic oligonucleotide
ccccaaactcagctggagccaattggg

SEQ ID NO: 214402 - DNA, 27 bp, Artificial Sequence
  Description of Artificial Sequence: Synthetic oligonucleotide
cccaaactcagctggagccaattgggg

SEQ ID NO: 214403 - DNA, 27 bp, Artificial Sequence
  Description of Artificial Sequence: Synthetic oligonucleotide
ccaaactcagctggagccaattggggg

SEQ ID NO: 214404 - DNA, 27 bp, Artificial Sequence
  Description of Artificial Sequence: Synthetic oligonucleotide
caaactcagctggagccaattgggggg

SEQ ID NO: 214405 - DNA, 27 bp, Artificial Sequence
  Description of Artificial Sequence: Synthetic oligonucleotide
aaactcagctggagccaattggggggc

SEQ ID NO: 214406 - DNA, 27 bp, Artificial Sequence
  Description of Artificial Sequence: Synthetic oligonucleotide
aactcagctggagccaattggggggca

SEQ ID NO: 214407 - DNA, 26 bp, Artificial Sequence
  Description of Artificial Sequence: Synthetic oligonucleotide
actcagctggagccaattggggggca

SEQ ID NO: 214408 - DNA, 25 bp, Artificial Sequence
  Description of Artificial Sequence: Synthetic oligonucleotide
ctcagctggagccaattggggggca

SEQ ID NO: 214409 - DNA, 25 bp, Artificial Sequence
  Description of Artificial Sequence: Synthetic oligonucleotide
tcagctggagccaattggggggcag

SEQ ID NO: 214410 - DNA, 24 bp, Artificial Sequence
  Description of Artificial Sequence: Synthetic oligonucleotide
cagctggagccaattggggggcag

SEQ ID NO: 214411 - DNA, 24 bp, Artificial Sequence
  Description of Artificial Sequence: Synthetic oligonucleotide
agctggagccaattggggggcagc

SEQ ID NO: 214412 - DNA, 23 bp, Artificial Sequence
  Description of Artificial Sequence: Synthetic oligonucleotide
gctggagccaattggggggcagc

SEQ ID NO: 214413 - DNA, 23 bp, Artificial Sequence
  Description of Artificial Sequence: Synthetic oligonucleotide
ctggagccaattggggggcagcc

SEQ ID NO: 214414 - DNA, 23 bp, Artificial Sequence
  Description of Artificial Sequence: Synthetic oligonucleotide
tggagccaattggggggcagccc

SEQ ID NO: 214415 - DNA, 22 bp, Artificial Sequence
  Description of Artificial Sequence: Synthetic oligonucleotide
ggagccaattggggggcagccc

SEQ ID NO: 214416 - DNA, 22 bp, Artificial Sequence
  Description of Artificial Sequence: Synthetic oligonucleotide
gagccaattggggggcagcccc

SEQ ID NO: 214417 - DNA, 22 bp, Artificial Sequence
  Description of Artificial Sequence: Synthetic oligonucleotide
agccaattggggggcagccccg

SEQ ID NO: 214418 - DNA, 21 bp, Artificial Sequence
  Description of Artificial Sequence: Synthetic oligonucleotide
gccaattggggggcagccccg

SEQ ID NO: 214419 - DNA, 22 bp, Artificial Sequence
  Description of Artificial Sequence: Synthetic oligonucleotide
ccaattggggggcagccccgca

SEQ ID NO: 214420 - DNA, 23 bp, Artificial Sequence
  Description of Artificial Sequence: Synthetic oligonucleotide
caattggggggcagccccgcaga

SEQ ID NO: 214421 - DNA, 23 bp, Artificial Sequence
  Description of Artificial Sequence: Synthetic oligonucleotide
aattggggggcagccccgcagag

SEQ ID NO: 214422 - DNA, 22 bp, Artificial Sequence
  Description of Artificial Sequence: Synthetic oligonucleotide
attggggggcagccccgcagag

SEQ ID NO: 214423 - DNA, 21 bp, Artificial Sequence
  Description of Artificial Sequence: Synthetic oligonucleotide
ttggggggcagccccgcagag

SEQ ID NO: 214424 - DNA, 20 bp, Artificial Sequence
  Description of Artificial Sequence: Synthetic oligonucleotide
tggggggcagccccgcagag

SEQ ID NO: 214425 - DNA, 20 bp, Artificial Sequence
  Description of Artificial Sequence: Synthetic oligonucleotide
ggggggcagccccgcagagt

SEQ ID NO: 214426 - DNA, 20 bp, Artificial Sequence
  Description of Artificial Sequence: Synthetic oligonucleotide
gggggcagccccgcagagct

SEQ ID NO: 214427 - DNA, 22 bp, Artificial Sequence
  Description of Artificial Sequence: Synthetic oligonucleotide
ggggcagccccgcagagccaat

SEQ ID NO: 214428 - DNA, 22 bp, Artificial Sequence
  Description of Artificial Sequence: Synthetic oligonucleotide
gggcagccccgcagagccaatc

SEQ ID NO: 214429 - DNA, 22 bp, Artificial Sequence
  Description of Artificial Sequence: Synthetic oligonucleotide
ggcagccccgcagagccaatcc

SEQ ID NO: 214430 - DNA, 22 bp, Artificial Sequence
  Description of Artificial Sequence: Synthetic oligonucleotide
gcagccccgcagagccaatccc

SEQ ID NO: 214431 - DNA, 22 bp, Artificial Sequence
  Description of Artificial Sequence: Synthetic oligonucleotide
cagccccgcagagccaatcccc

SEQ ID NO: 214432 - DNA, 22 bp, Artificial Sequence
  Description of Artificial Sequence: Synthetic oligonucleotide
agccccgcagagccaatccccg

SEQ ID NO: 214433 - DNA, 21 bp, Artificial Sequence
  Description of Artificial Sequence: Synthetic oligonucleotide
gccccgcagagccaatccccg

SEQ ID NO: 214434 - DNA, 22 bp, Artificial Sequence
  Description of Artificial Sequence: Synthetic oligonucleotide
ccccgcagagccaatccccgga

SEQ ID NO: 214435 - DNA, 22 bp, Artificial Sequence
  Description of Artificial Sequence: Synthetic oligonucleotide
cccgcagagccaatccccggac

SEQ ID NO: 214436 - DNA, 22 bp, Artificial Sequence
  Description of Artificial Sequence: Synthetic oligonucleotide
ccgcagagccaatccccggacg

SEQ ID NO: 214437 - DNA, 22 bp, Artificial Sequence
  Description of Artificial Sequence: Synthetic oligonucleotide
cgcagagccaatccccggacgg

SEQ ID NO: 214438 - DNA, 23 bp, Artificial Sequence
  Description of Artificial Sequence: Synthetic oligonucleotide
gcagagccaatccccggacggca

SEQ ID NO: 214439 - DNA, 23 bp, Artificial Sequence
  Description of Artificial Sequence: Synthetic oligonucleotide
cagagccaatccccggacggcag

SEQ ID NO: 214440 - DNA, 23 bp, Artificial Sequence
  Description of Artificial Sequence: Synthetic oligonucleotide
agagccaatccccggacggcagg

SEQ ID NO: 214441 - DNA, 22 bp, Artificial Sequence
  Description of Artificial Sequence: Synthetic oligonucleotide
gagccaatccccggacggcagg

SEQ ID NO: 214442 - DNA, 24 bp, Artificial Sequence
  Description of Artificial Sequence: Synthetic oligonucleotide
agccaatccccggacggcagggtt

SEQ ID NO: 214443 - DNA, 23 bp, Artificial Sequence
  Description of Artificial Sequence: Synthetic oligonucleotide
gccaatccccggacggcagggtt

SEQ ID NO: 214444 - DNA, 23 bp, Artificial Sequence
  Description of Artificial Sequence: Synthetic oligonucleotide
ccaatccccggacggcagggttg

SEQ ID NO: 214445 - DNA, 23 bp, Artificial Sequence
  Description of Artificial Sequence: Synthetic oligonucleotide
caatccccggacggcagggttgg

SEQ ID NO: 214446 - DNA, 24 bp, Artificial Sequence
  Description of Artificial Sequence: Synthetic oligonucleotide
aatccccggacggcagggttgggt

SEQ ID NO: 214447 - DNA, 23 bp, Artificial Sequence
  Description of Artificial Sequence: Synthetic oligonucleotide
atccccggacggcagggttgggt

SEQ ID NO: 214448 - DNA, 22 bp, Artificial Sequence
  Description of Artificial Sequence: Synthetic oligonucleotide
tccccggacggcagggttgggt

SEQ ID NO: 214449 - DNA, 21 bp, Artificial Sequence
  Description of Artificial Sequence: Synthetic oligonucleotide
ccccggacggcagggttgggt

SEQ ID NO: 214450 - DNA, 22 bp, Artificial Sequence
  Description of Artificial Sequence: Synthetic oligonucleotide
cccggacggcagggttgggtga

SEQ ID NO: 214451 - DNA, 22 bp, Artificial Sequence
  Description of Artificial Sequence: Synthetic oligonucleotide
ccggacggcagggttgggtgag

SEQ ID NO: 214452 - DNA, 23 bp, Artificial Sequence
  Description of Artificial Sequence: Synthetic oligonucleotide
cggacggcagggttgggtgagca

SEQ ID NO: 214453 - DNA, 23 bp, Artificial Sequence
  Description of Artificial Sequence: Synthetic oligonucleotide
ggacggcagggttgggtgagcag

SEQ ID NO: 214454 - DNA, 24 bp, Artificial Sequence
  Description of Artificial Sequence: Synthetic oligonucleotide
gacggcagggttgggtgagcagct

SEQ ID NO: 214455 - DNA, 25 bp, Artificial Sequence
  Description of Artificial Sequence: Synthetic oligonucleotide
acggcagggttgggtgagcagctct

SEQ ID NO: 214456 - DNA, 24 bp, Artificial Sequence
  Description of Artificial Sequence: Synthetic oligonucleotide
cggcagggttgggtgagcagctct

SEQ ID NO: 214457 - DNA, 25 bp, Artificial Sequence
  Description of Artificial Sequence: Synthetic oligonucleotide
ggcagggttgggtgagcagctctct

SEQ ID NO: 214458 - DNA, 26 bp, Artificial Sequence
  Description of Artificial Sequence: Synthetic oligonucleotide
gcagggttgggtgagcagctctctga

SEQ ID NO: 214459 - DNA, 26 bp, Artificial Sequence
  Description of Artificial Sequence: Synthetic oligonucleotide
cagggttgggtgagcagctctctgac

SEQ ID NO: 214460 - DNA, 26 bp, Artificial Sequence
  Description of Artificial Sequence: Synthetic oligonucleotide
agggttgggtgagcagctctctgacc

SEQ ID NO: 214461 - DNA, 25 bp, Artificial Sequence
  Description of Artificial Sequence: Synthetic oligonucleotide
gggttgggtgagcagctctctgacc

SEQ ID NO: 214462 - DNA, 26 bp, Artificial Sequence
  Description of Artificial Sequence: Synthetic oligonucleotide
ggttgggtgagcagctctctgaccct

SEQ ID NO: 214463 - DNA, 27 bp, Artificial Sequence
  Description of Artificial Sequence: Synthetic oligonucleotide
gttgggtgagcagctctctgaccctga

SEQ ID NO: 214464 - DNA, 29 bp, Artificial Sequence
  Description of Artificial Sequence: Synthetic oligonucleotide
ttgggtgagcagctctctgaccctgaaag

SEQ ID NO: 214465 - DNA, 28 bp, Artificial Sequence
  Description of Artificial Sequence: Synthetic oligonucleotide
tgggtgagcagctctctgaccctgaaag

SEQ ID NO: 214466 - DNA, 27 bp, Artificial Sequence
  Description of Artificial Sequence: Synthetic oligonucleotide
gggtgagcagctctctgaccctgaaag

SEQ ID NO: 214467 - DNA, 28 bp, Artificial Sequence
  Description of Artificial Sequence: Synthetic oligonucleotide
ggtgagcagctctctgaccctgaaagtg

SEQ ID NO: 214468 - DNA, 29 bp, Artificial Sequence
  Description of Artificial Sequence: Synthetic oligonucleotide
gtgagcagctctctgaccctgaaagtgac

SEQ ID NO: 214469 - DNA, 29 bp, Artificial Sequence
  Description of Artificial Sequence: Synthetic oligonucleotide
tgagcagctctctgaccctgaaagtgacc

SEQ ID NO: 214470 - DNA, 28 bp, Artificial Sequence
  Description of Artificial Sequence: Synthetic oligonucleotide
gagcagctctctgaccctgaaagtgacc

SEQ ID NO: 214471 - DNA, 29 bp, Artificial Sequence
  Description of Artificial Sequence: Synthetic oligonucleotide
agcagctctctgaccctgaaagtgaccag

SEQ ID NO: 214472 - DNA, 28 bp, Artificial Sequence
  Description of Artificial Sequence: Synthetic oligonucleotide
gcagctctctgaccctgaaagtgaccag

SEQ ID NO: 214473 - DNA, 28 bp, Artificial Sequence
  Description of Artificial Sequence: Synthetic oligonucleotide
cagctctctgaccctgaaagtgaccagc

SEQ ID NO: 214474 - DNA, 28 bp, Artificial Sequence
  Description of Artificial Sequence: Synthetic oligonucleotide
agctctctgaccctgaaagtgaccagcg

SEQ ID NO: 214475 - DNA, 27 bp, Artificial Sequence
  Description of Artificial Sequence: Synthetic oligonucleotide
gctctctgaccctgaaagtgaccagcg

SEQ ID NO: 214476 - DNA, 27 bp, Artificial Sequence
  Description of Artificial Sequence: Synthetic oligonucleotide
ctctctgaccctgaaagtgaccagcgc

SEQ ID NO: 214477 - DNA, 27 bp, Artificial Sequence
  Description of Artificial Sequence: Synthetic oligonucleotide
tctctgaccctgaaagtgaccagcgcc

SEQ ID NO: 214478 - DNA, 26 bp, Artificial Sequence
  Description of Artificial Sequence: Synthetic oligonucleotide
ctctgaccctgaaagtgaccagcgcc

SEQ ID NO: 214479 - DNA, 27 bp, Artificial Sequence
  Description of Artificial Sequence: Synthetic oligonucleotide
tctgaccctgaaagtgaccagcgccct

SEQ ID NO: 214480 - DNA, 26 bp, Artificial Sequence
  Description of Artificial Sequence: Synthetic oligonucleotide
ctgaccctgaaagtgaccagcgccct

SEQ ID NO: 214481 - DNA, 27 bp, Artificial Sequence
  Description of Artificial Sequence: Synthetic oligonucleotide
tgaccctgaaagtgaccagcgccctga

SEQ ID NO: 214482 - DNA, 26 bp, Artificial Sequence
  Description of Artificial Sequence: Synthetic oligonucleotide
gaccctgaaagtgaccagcgccctga

SEQ ID NO: 214483 - DNA, 26 bp, Artificial Sequence
  Description of Artificial Sequence: Synthetic oligonucleotide
accctgaaagtgaccagcgccctgag

SEQ ID NO: 214484 - DNA, 25 bp, Artificial Sequence
  Description of Artificial Sequence: Synthetic oligonucleotide
ccctgaaagtgaccagcgccctgag

SEQ ID NO: 214485 - DNA, 25 bp, Artificial Sequence
  Description of Artificial Sequence: Synthetic oligonucleotide
cctgaaagtgaccagcgccctgagc

SEQ ID NO: 214486 - DNA, 25 bp, Artificial Sequence
  Description of Artificial Sequence: Synthetic oligonucleotide
ctgaaagtgaccagcgccctgagcc

SEQ ID NO: 214487 - DNA, 25 bp, Artificial Sequence
  Description of Artificial Sequence: Synthetic oligonucleotide
tgaaagtgaccagcgccctgagccg

SEQ ID NO: 214488 - DNA, 24 bp, Artificial Sequence
  Description of Artificial Sequence: Synthetic oligonucleotide
gaaagtgaccagcgccctgagccg

SEQ ID NO: 214489 - DNA, 24 bp, Artificial Sequence
  Description of Artificial Sequence: Synthetic oligonucleotide
aaagtgaccagcgccctgagccgc

SEQ ID NO: 214490 - DNA, 23 bp, Artificial Sequence
  Description of Artificial Sequence: Synthetic oligonucleotide
aagtgaccagcgccctgagccgc

SEQ ID NO: 214491 - DNA, 22 bp, Artificial Sequence
  Description of Artificial Sequence: Synthetic oligonucleotide
agtgaccagcgccctgagccgc

SEQ ID NO: 214492 - DNA, 21 bp, Artificial Sequence
  Description of Artificial Sequence: Synthetic oligonucleotide
gtgaccagcgccctgagccgc

SEQ ID NO: 214493 - DNA, 23 bp, Artificial Sequence
  Description of Artificial Sequence: Synthetic oligonucleotide
tgaccagcgccctgagccgcgat

SEQ ID NO: 214494 - DNA, 22 bp, Artificial Sequence
  Description of Artificial Sequence: Synthetic oligonucleotide
gaccagcgccctgagccgcgat

SEQ ID NO: 214495 - DNA, 22 bp, Artificial Sequence
  Description of Artificial Sequence: Synthetic oligonucleotide
accagcgccctgagccgcgatg

SEQ ID NO: 214496 - DNA, 21 bp, Artificial Sequence
  Description of Artificial Sequence: Synthetic oligonucleotide
ccagcgccctgagccgcgatg

SEQ ID NO: 214497 - DNA, 21 bp, Artificial Sequence
  Description of Artificial Sequence: Synthetic oligonucleotide
cagcgccctgagccgcgatgg

SEQ ID NO: 214498 - DNA, 23 bp, Artificial Sequence
  Description of Artificial Sequence: Synthetic oligonucleotide
agcgccctgagccgcgatggcat

SEQ ID NO: 214499 - DNA, 22 bp, Artificial Sequence
  Description of Artificial Sequence: Synthetic oligonucleotide
gcgccctgagccgcgatggcat

SEQ ID NO: 214500 - DNA, 23 bp, Artificial Sequence
  Description of Artificial Sequence: Synthetic oligonucleotide
cgccctgagccgcgatggcatct

SEQ ID NO: 214501 - DNA, 23 bp, Artificial Sequence
  Description of Artificial Sequence: Synthetic oligonucleotide
gccctgagccgcgatggcatctc

SEQ ID NO: 214502 - DNA, 24 bp, Artificial Sequence
  Description of Artificial Sequence: Synthetic oligonucleotide
ccctgagccgcgatggcatctcct

SEQ ID NO: 214503 - DNA, 25 bp, Artificial Sequence
  Description of Artificial Sequence: Synthetic oligonucleotide
cctgagccgcgatggcatctcctgt

SEQ ID NO: 214504 - DNA, 27 bp, Artificial Sequence
  Description of Artificial Sequence: Synthetic oligonucleotide
ctgagccgcgatggcatctcctgtgaa

SEQ ID NO: 214505 - DNA, 27 bp, Artificial Sequence
  Description of Artificial Sequence: Synthetic oligonucleotide
tgagccgcgatggcatctcctgtgaag

SEQ ID NO: 214506 - DNA, 26 bp, Artificial Sequence
  Description of Artificial Sequence: Synthetic oligonucleotide
gagccgcgatggcatctcctgtgaag

SEQ ID NO: 214507 - DNA, 26 bp, Artificial Sequence
  Description of Artificial Sequence: Synthetic oligonucleotide
agccgcgatggcatctcctgtgaagc

SEQ ID NO: 214508 - DNA, 25 bp, Artificial Sequence
  Description of Artificial Sequence: Synthetic oligonucleotide
gccgcgatggcatctcctgtgaagc

SEQ ID NO: 214509 - DNA, 26 bp, Artificial Sequence
  Description of Artificial Sequence: Synthetic oligonucleotide
ccgcgatggcatctcctgtgaagcct

SEQ ID NO: 214510 - DNA, 26 bp, Artificial Sequence
  Description of Artificial Sequence: Synthetic oligonucleotide
cgcgatggcatctcctgtgaagcctc

SEQ ID NO: 214511 - DNA, 27 bp, Artificial Sequence
  Description of Artificial Sequence: Synthetic oligonucleotide
gcgatggcatctcctgtgaagcctcca

SEQ ID NO: 214512 - DNA, 28 bp, Artificial Sequence
  Description of Artificial Sequence: Synthetic oligonucleotide
cgatggcatctcctgtgaagcctccaac

SEQ ID NO: 214513 - DNA, 28 bp, Artificial Sequence
  Description of Artificial Sequence: Synthetic oligonucleotide
gatggcatctcctgtgaagcctccaacc

SEQ ID NO: 214514 - DNA, 28 bp, Artificial Sequence
  Description of Artificial Sequence: Synthetic oligonucleotide
atggcatctcctgtgaagcctccaaccc

SEQ ID NO: 214515 - DNA, 27 bp, Artificial Sequence
  Description of Artificial Sequence: Synthetic oligonucleotide
tggcatctcctgtgaagcctccaaccc

SEQ ID NO: 214516 - DNA, 26 bp, Artificial Sequence
  Description of Artificial Sequence: Synthetic oligonucleotide
ggcatctcctgtgaagcctccaaccc

SEQ ID NO: 214517 - DNA, 26 bp, Artificial Sequence
  Description of Artificial Sequence: Synthetic oligonucleotide
gcatctcctgtgaagcctccaacccc

SEQ ID NO: 214518 - DNA, 27 bp, Artificial Sequence
  Description of Artificial Sequence: Synthetic oligonucleotide
catctcctgtgaagcctccaaccccca

SEQ ID NO: 214519 - DNA, 27 bp, Artificial Sequence
  Description of Artificial Sequence: Synthetic oligonucleotide
atctcctgtgaagcctccaacccccac

SEQ ID NO: 214520 - DNA, 26 bp, Artificial Sequence
  Description of Artificial Sequence: Synthetic oligonucleotide
tctcctgtgaagcctccaacccccac

SEQ ID NO: 214521 - DNA, 25 bp, Artificial Sequence
  Description of Artificial Sequence: Synthetic oligonucleotide
ctcctgtgaagcctccaacccccac

SEQ ID NO: 214522 - DNA, 25 bp, Artificial Sequence
  Description of Artificial Sequence: Synthetic oligonucleotide
tcctgtgaagcctccaacccccacg

SEQ ID NO: 214523 - DNA, 24 bp, Artificial Sequence
  Description of Artificial Sequence: Synthetic oligonucleotide
cctgtgaagcctccaacccccacg

SEQ ID NO: 214524 - DNA, 24 bp, Artificial Sequence
  Description of Artificial Sequence: Synthetic oligonucleotide
ctgtgaagcctccaacccccacgg

SEQ ID NO: 214525 - DNA, 26 bp, Artificial Sequence
  Description of Artificial Sequence: Synthetic oligonucleotide
tgtgaagcctccaacccccacgggaa

SEQ ID NO: 214526 - DNA, 25 bp, Artificial Sequence
  Description of Artificial Sequence: Synthetic oligonucleotide
gtgaagcctccaacccccacgggaa

SEQ ID NO: 214527 - DNA, 27 bp, Artificial Sequence
  Description of Artificial Sequence: Synthetic oligonucleotide
tgaagcctccaacccccacgggaacaa

SEQ ID NO: 214528 - DNA, 26 bp, Artificial Sequence
  Description of Artificial Sequence: Synthetic oligonucleotide
gaagcctccaacccccacgggaacaa

SEQ ID NO: 214529 - DNA, 26 bp, Artificial Sequence
  Description of Artificial Sequence: Synthetic oligonucleotide
aagcctccaacccccacgggaacaag

SEQ ID NO: 214530 - DNA, 25 bp, Artificial Sequence
  Description of Artificial Sequence: Synthetic oligonucleotide
agcctccaacccccacgggaacaag

SEQ ID NO: 214531 - DNA, 24 bp, Artificial Sequence
  Description of Artificial Sequence: Synthetic oligonucleotide
gcctccaacccccacgggaacaag

SEQ ID NO: 214532 - DNA, 24 bp, Artificial Sequence
  Description of Artificial Sequence: Synthetic oligonucleotide
cctccaacccccacgggaacaagc

SEQ ID NO: 214533 - DNA, 24 bp, Artificial Sequence
  Description of Artificial Sequence: Synthetic oligonucleotide
ctccaacccccacgggaacaagcg

SEQ ID NO: 214534 - DNA, 24 bp, Artificial Sequence
  Description of Artificial Sequence: Synthetic oligonucleotide
tccaacccccacgggaacaagcgc

SEQ ID NO: 214535 - DNA, 23 bp, Artificial Sequence
  Description of Artificial Sequence: Synthetic oligonucleotide
ccaacccccacgggaacaagcgc

SEQ ID NO: 214536 - DNA, 25 bp, Artificial Sequence
  Description of Artificial Sequence: Synthetic oligonucleotide
caacccccacgggaacaagcgccat

SEQ ID NO: 214537 - DNA, 26 bp, Artificial Sequence
  Description of Artificial Sequence: Synthetic oligonucleotide
aacccccacgggaacaagcgccatgt

SEQ ID NO: 214538 - DNA, 25 bp, Artificial Sequence
  Description of Artificial Sequence: Synthetic oligonucleotide
acccccacgggaacaagcgccatgt

SEQ ID NO: 214539 - DNA, 24 bp, Artificial Sequence
  Description of Artificial Sequence: Synthetic oligonucleotide
cccccacgggaacaagcgccatgt

SEQ ID NO: 214540 - DNA, 26 bp, Artificial Sequence
  Description of Artificial Sequence: Synthetic oligonucleotide
ccccacgggaacaagcgccatgtctt

SEQ ID NO: 214541 - DNA, 26 bp, Artificial Sequence
  Description of Artificial Sequence: Synthetic oligonucleotide
cccacgggaacaagcgccatgtcttc

SEQ ID NO: 214542 - DNA, 27 bp, Artificial Sequence
  Description of Artificial Sequence: Synthetic oligonucleotide
ccacgggaacaagcgccatgtcttcca

SEQ ID NO: 214543 - DNA, 27 bp, Artificial Sequence
  Description of Artificial Sequence: Synthetic oligonucleotide
cacgggaacaagcgccatgtcttccac

SEQ ID NO: 214544 - DNA, 29 bp, Artificial Sequence
  Description of Artificial Sequence: Synthetic oligonucleotide
acgggaacaagcgccatgtcttccacttc

SEQ ID NO: 214545 - DNA, 28 bp, Artificial Sequence
  Description of Artificial Sequence: Synthetic oligonucleotide
cgggaacaagcgccatgtcttccacttc

SEQ ID NO: 214546 - DNA, 28 bp, Artificial Sequence
  Description of Artificial Sequence: Synthetic oligonucleotide
gggaacaagcgccatgtcttccacttcg

SEQ ID NO: 214547 - DNA, 28 bp, Artificial Sequence
  Description of Artificial Sequence: Synthetic oligonucleotide
ggaacaagcgccatgtcttccacttcgg

SEQ ID NO: 214548 - DNA, 28 bp, Artificial Sequence
  Description of Artificial Sequence: Synthetic oligonucleotide
gaacaagcgccatgtcttccacttcggc

SEQ ID NO: 214549 - DNA, 29 bp, Artificial Sequence
  Description of Artificial Sequence: Synthetic oligonucleotide
aacaagcgccatgtcttccacttcggcac

SEQ ID NO: 214550 - DNA, 28 bp, Artificial Sequence
  Description of Artificial Sequence: Synthetic oligonucleotide
acaagcgccatgtcttccacttcggcac

SEQ ID NO: 214551 - DNA, 27 bp, Artificial Sequence
  Description of Artificial Sequence: Synthetic oligonucleotide
caagcgccatgtcttccacttcggcac

SEQ ID NO: 214552 - DNA, 27 bp, Artificial Sequence
  Description of Artificial Sequence: Synthetic oligonucleotide
aagcgccatgtcttccacttcggcacc

SEQ ID NO: 214553 - DNA, 26 bp, Artificial Sequence
  Description of Artificial Sequence: Synthetic oligonucleotide
agcgccatgtcttccacttcggcacc

SEQ ID NO: 214554 - DNA, 25 bp, Artificial Sequence
  Description of Artificial Sequence: Synthetic oligonucleotide
gcgccatgtcttccacttcggcacc

SEQ ID NO: 214555 - DNA, 26 bp, Artificial Sequence
  Description of Artificial Sequence: Synthetic oligonucleotide
cgccatgtcttccacttcggcaccgt

SEQ ID NO: 214556 - DNA, 27 bp, Artificial Sequence
  Description of Artificial Sequence: Synthetic oligonucleotide
gccatgtcttccacttcggcaccgtga

SEQ ID NO: 214557 - DNA, 27 bp, Artificial Sequence
  Description of Artificial Sequence: Synthetic oligonucleotide
ccatgtcttccacttcggcaccgtgag

SEQ ID NO: 214558 - DNA, 27 bp, Artificial Sequence
  Description of Artificial Sequence: Synthetic oligonucleotide
catgtcttccacttcggcaccgtgagc

SEQ ID NO: 214559 - DNA, 27 bp, Artificial Sequence
  Description of Artificial Sequence: Synthetic oligonucleotide
atgtcttccacttcggcaccgtgagcc

SEQ ID NO: 214560 - DNA, 26 bp, Artificial Sequence
  Description of Artificial Sequence: Synthetic oligonucleotide
tgtcttccacttcggcaccgtgagcc

SEQ ID NO: 214561 - DNA, 25 bp, Artificial Sequence
  Description of Artificial Sequence: Synthetic oligonucleotide
gtcttccacttcggcaccgtgagcc

SEQ ID NO: 214562 - DNA, 25 bp, Artificial Sequence
  Description of Artificial Sequence: Synthetic oligonucleotide
tcttccacttcggcaccgtgagccc

SEQ ID NO: 214563 - DNA, 24 bp, Artificial Sequence
  Description of Artificial Sequence: Synthetic oligonucleotide
cttccacttcggcaccgtgagccc

SEQ ID NO: 214564 - DNA, 24 bp, Artificial Sequence
  Description of Artificial Sequence: Synthetic oligonucleotide
ttccacttcggcaccgtgagcccc

SEQ ID NO: 214565 - DNA, 23 bp, Artificial Sequence
  Description of Artificial Sequence: Synthetic oligonucleotide
tccacttcggcaccgtgagcccc

SEQ ID NO: 214566 - DNA, 22 bp, Artificial Sequence
  Description of Artificial Sequence: Synthetic oligonucleotide
ccacttcggcaccgtgagcccc

SEQ ID NO: 214567 - DNA, 23 bp, Artificial Sequence
  Description of Artificial Sequence: Synthetic oligonucleotide
cacttcggcaccgtgagccccca

SEQ ID NO: 214568 - DNA, 24 bp, Artificial Sequence
  Description of Artificial Sequence: Synthetic oligonucleotide
acttcggcaccgtgagcccccaga

SEQ ID NO: 214569 - DNA, 23 bp, Artificial Sequence
  Description of Artificial Sequence: Synthetic oligonucleotide
cttcggcaccgtgagcccccaga

SEQ ID NO: 214570 - DNA, 23 bp, Artificial Sequence
  Description of Artificial Sequence: Synthetic oligonucleotide
ttcggcaccgtgagcccccagac

SEQ ID NO: 214571 - DNA, 22 bp, Artificial Sequence
  Description of Artificial Sequence: Synthetic oligonucleotide
tcggcaccgtgagcccccagac

SEQ ID NO: 214572 - DNA, 21 bp, Artificial Sequence
  Description of Artificial Sequence: Synthetic oligonucleotide
cggcaccgtgagcccccagac

SEQ ID NO: 214573 - DNA, 22 bp, Artificial Sequence
  Description of Artificial Sequence: Synthetic oligonucleotide
ggcaccgtgagcccccagacct

SEQ ID NO: 214574 - DNA, 22 bp, Artificial Sequence
  Description of Artificial Sequence: Synthetic oligonucleotide
gcaccgtgagcccccagacctc

SEQ ID NO: 214575 - DNA, 22 bp, Artificial Sequence
  Description of Artificial Sequence: Synthetic oligonucleotide
caccgtgagcccccagacctcc

SEQ ID NO: 214576 - DNA, 23 bp, Artificial Sequence
  Description of Artificial Sequence: Synthetic oligonucleotide
accgtgagcccccagacctccca

SEQ ID NO: 214577 - DNA, 22 bp, Artificial Sequence
  Description of Artificial Sequence: Synthetic oligonucleotide
ccgtgagcccccagacctccca

SEQ ID NO: 214578 - DNA, 22 bp, Artificial Sequence
  Description of Artificial Sequence: Synthetic oligonucleotide
cgtgagcccccagacctcccag

SEQ ID NO: 214579 - DNA, 22 bp, Artificial Sequence
  Description of Artificial Sequence: Synthetic oligonucleotide
gtgagcccccagacctcccagg

SEQ ID NO: 214580 - DNA, 23 bp, Artificial Sequence
  Description of Artificial Sequence: Synthetic oligonucleotide
tgagcccccagacctcccaggct

SEQ ID NO: 214581 - DNA, 22 bp, Artificial Sequence
  Description of Artificial Sequence: Synthetic oligonucleotide
gagcccccagacctcccaggct

SEQ ID NO: 214582 - DNA, 22 bp, Artificial Sequence
  Description of Artificial Sequence: Synthetic oligonucleotide
agcccccagacctcccaggctg

SEQ ID NO: 214583 - DNA, 21 bp, Artificial Sequence
  Description of Artificial Sequence: Synthetic oligonucleotide
gcccccagacctcccaggctg

SEQ ID NO: 214584 - DNA, 22 bp, Artificial Sequence
  Description of Artificial Sequence: Synthetic oligonucleotide
cccccagacctcccaggctgga

SEQ ID NO: 214585 - DNA, 23 bp, Artificial Sequence
  Description of Artificial Sequence: Synthetic oligonucleotide
ccccagacctcccaggctggagt

SEQ ID NO: 214586 - DNA, 23 bp, Artificial Sequence
  Description of Artificial Sequence: Synthetic oligonucleotide
cccagacctcccaggctggagtg

SEQ ID NO: 214587 - DNA, 23 bp, Artificial Sequence
  Description of Artificial Sequence: Synthetic oligonucleotide
ccagacctcccaggctggagtgg

SEQ ID NO: 214588 - DNA, 23 bp, Artificial Sequence
  Description of Artificial Sequence: Synthetic oligonucleotide
cagacctcccaggctggagtggc

SEQ ID NO: 214589 - DNA, 23 bp, Artificial Sequence
  Description of Artificial Sequence: Synthetic oligonucleotide
agacctcccaggctggagtggcc

SEQ ID NO: 214590 - DNA, 22 bp, Artificial Sequence
  Description of Artificial Sequence: Synthetic oligonucleotide
gacctcccaggctggagtggcc

SEQ ID NO: 214591 - DNA, 23 bp, Artificial Sequence
  Description of Artificial Sequence: Synthetic oligonucleotide
acctcccaggctggagtggccgt

SEQ ID NO: 214592 - DNA, 22 bp, Artificial Sequence
  Description of Artificial Sequence: Synthetic oligonucleotide
cctcccaggctggagtggccgt

SEQ ID NO: 214593 - DNA, 24 bp, Artificial Sequence
  Description of Artificial Sequence: Synthetic oligonucleotide
ctcccaggctggagtggccgtcat

SEQ ID NO: 214594 - DNA, 24 bp, Artificial Sequence
  Description of Artificial Sequence: Synthetic oligonucleotide
tcccaggctggagtggccgtcatg

SEQ ID NO: 214595 - DNA, 23 bp, Artificial Sequence
  Description of Artificial Sequence: Synthetic oligonucleotide
cccaggctggagtggccgtcatg

SEQ ID NO: 214596 - DNA, 23 bp, Artificial Sequence
  Description of Artificial Sequence: Synthetic oligonucleotide
ccaggctggagtggccgtcatgg

SEQ ID NO: 214597 - DNA, 23 bp, Artificial Sequence
  Description of Artificial Sequence: Synthetic oligonucleotide
caggctggagtggccgtcatggc

SEQ ID NO: 214598 - DNA, 23 bp, Artificial Sequence
  Description of Artificial Sequence: Synthetic oligonucleotide
aggctggagtggccgtcatggcc

SEQ ID NO: 214599 - DNA, 22 bp, Artificial Sequence
  Description of Artificial Sequence: Synthetic oligonucleotide
ggctggagtggccgtcatggcc

SEQ ID NO: 214600 - DNA, 23 bp, Artificial Sequence
  Description of Artificial Sequence: Synthetic oligonucleotide
gctggagtggccgtcatggccgt

SEQ ID NO: 214601 - DNA, 23 bp, Artificial Sequence
  Description of Artificial Sequence: Synthetic oligonucleotide
ctggagtggccgtcatggccgtg

SEQ ID NO: 214602 - DNA, 23 bp, Artificial Sequence
  Description of Artificial Sequence: Synthetic oligonucleotide
tggagtggccgtcatggccgtgg

SEQ ID NO: 214603 - DNA, 22 bp, Artificial Sequence
  Description of Artificial Sequence: Synthetic oligonucleotide
ggagtggccgtcatggccgtgg

SEQ ID NO: 214604 - DNA, 22 bp, Artificial Sequence
  Description of Artificial Sequence: Synthetic oligonucleotide
gagtggccgtcatggccgtggc

SEQ ID NO: 214605 - DNA, 22 bp, Artificial Sequence
  Description of Artificial Sequence: Synthetic oligonucleotide
agtggccgtcatggccgtggcc

SEQ ID NO: 214606 - DNA, 21 bp, Artificial Sequence
  Description of Artificial Sequence: Synthetic oligonucleotide
gtggccgtcatggccgtggcc

SEQ ID NO: 214607 - DNA, 22 bp, Artificial Sequence
  Description of Artificial Sequence: Synthetic oligonucleotide
tggccgtcatggccgtggccgt

SEQ ID NO: 214608 - DNA, 21 bp, Artificial Sequence
  Description of Artificial Sequence: Synthetic oligonucleotide
ggccgtcatggccgtggccgt

SEQ ID NO: 214609 - DNA, 22 bp, Artificial Sequence
  Description of Artificial Sequence: Synthetic oligonucleotide
gccgtcatggccgtggccgtca

SEQ ID NO: 214610 - DNA, 22 bp, Artificial Sequence
  Description of Artificial Sequence: Synthetic oligonucleotide
ccgtcatggccgtggccgtcag

SEQ ID NO: 214611 - DNA, 22 bp, Artificial Sequence
  Description of Artificial Sequence: Synthetic oligonucleotide
cgtcatggccgtggccgtcagc

SEQ ID NO: 214612 - DNA, 23 bp, Artificial Sequence
  Description of Artificial Sequence: Synthetic oligonucleotide
gtcatggccgtggccgtcagcgt

SEQ ID NO: 214613 - DNA, 23 bp, Artificial Sequence
  Description of Artificial Sequence: Synthetic oligonucleotide
tcatggccgtggccgtcagcgtg

SEQ ID NO: 214614 - DNA, 22 bp, Artificial Sequence
  Description of Artificial Sequence: Synthetic oligonucleotide
catggccgtggccgtcagcgtg

SEQ ID NO: 214615 - DNA, 22 bp, Artificial Sequence
  Description of Artificial Sequence: Synthetic oligonucleotide
atggccgtggccgtcagcgtgg

SEQ ID NO: 214616 - DNA, 21 bp, Artificial Sequence
  Description of Artificial Sequence: Synthetic oligonucleotide
tggccgtggccgtcagcgtgg

SEQ ID NO: 214617 - DNA, 20 bp, Artificial Sequence
  Description of Artificial Sequence: Synthetic oligonucleotide
ggccgtggccgtcagcgtgg

SEQ ID NO: 214618 - DNA, 20 bp, Artificial Sequence
  Description of Artificial Sequence: Synthetic oligonucleotide
gccgtggccgtcagcgtggg

SEQ ID NO: 214619 - DNA, 20 bp, Artificial Sequence
  Description of Artificial Sequence: Synthetic oligonucleotide
ccgtggccgtcagcgtgggc

SEQ ID NO: 214620 - DNA, 21 bp, Artificial Sequence
  Description of Artificial Sequence: Synthetic oligonucleotide
cgtggccgtcagcgtgggcct

SEQ ID NO: 214621 - DNA, 21 bp, Artificial Sequence
  Description of Artificial Sequence: Synthetic oligonucleotide
gtggccgtcagcgtgggcctc

SEQ ID NO: 214622 - DNA, 22 bp, Artificial Sequence
  Description of Artificial Sequence: Synthetic oligonucleotide
tggccgtcagcgtgggcctcct

SEQ ID NO: 214623 - DNA, 21 bp, Artificial Sequence
  Description of Artificial Sequence: Synthetic oligonucleotide
ggccgtcagcgtgggcctcct

SEQ ID NO: 214624 - DNA, 21 bp, Artificial Sequence
  Description of Artificial Sequence: Synthetic oligonucleotide
gccgtcagcgtgggcctcctg

SEQ ID NO: 214625 - DNA, 22 bp, Artificial Sequence
  Description of Artificial Sequence: Synthetic oligonucleotide
ccgtcagcgtgggcctcctgct

SEQ ID NO: 214626 - DNA, 22 bp, Artificial Sequence
  Description of Artificial Sequence: Synthetic oligonucleotide
cgtcagcgtgggcctcctgctc

SEQ ID NO: 214627 - DNA, 23 bp, Artificial Sequence
  Description of Artificial Sequence: Synthetic oligonucleotide
gtcagcgtgggcctcctgctcct

SEQ ID NO: 214628 - DNA, 23 bp, Artificial Sequence
  Description of Artificial Sequence: Synthetic oligonucleotide
tcagcgtgggcctcctgctcctc

SEQ ID NO: 214629 - DNA, 22 bp, Artificial Sequence
  Description of Artificial Sequence: Synthetic oligonucleotide
cagcgtgggcctcctgctcctc

SEQ ID NO: 214630 - DNA, 23 bp, Artificial Sequence
  Description of Artificial Sequence: Synthetic oligonucleotide
agcgtgggcctcctgctcctcgt

SEQ ID NO: 214631 - DNA, 22 bp, Artificial Sequence
  Description of Artificial Sequence: Synthetic oligonucleotide
gcgtgggcctcctgctcctcgt

SEQ ID NO: 214632 - DNA, 22 bp, Artificial Sequence
  Description of Artificial Sequence: Synthetic oligonucleotide
cgtgggcctcctgctcctcgtc

SEQ ID NO: 214633 - DNA, 24 bp, Artificial Sequence
  Description of Artificial Sequence: Synthetic oligonucleotide
gtgggcctcctgctcctcgtcgtt

SEQ ID NO: 214634 - DNA, 24 bp, Artificial Sequence
  Description of Artificial Sequence: Synthetic oligonucleotide
tgggcctcctgctcctcgtcgttg

SEQ ID NO: 214635 - DNA, 23 bp, Artificial Sequence
  Description of Artificial Sequence: Synthetic oligonucleotide
gggcctcctgctcctcgtcgttg

SEQ ID NO: 214636 - DNA, 24 bp, Artificial Sequence
  Description of Artificial Sequence: Synthetic oligonucleotide
ggcctcctgctcctcgtcgttgct

SEQ ID NO: 214637 - DNA, 25 bp, Artificial Sequence
  Description of Artificial Sequence: Synthetic oligonucleotide
gcctcctgctcctcgtcgttgctgt

SEQ ID NO: 214638 - DNA, 27 bp, Artificial Sequence
  Description of Artificial Sequence: Synthetic oligonucleotide
cctcctgctcctcgtcgttgctgtctt

SEQ ID NO: 214639 - DNA, 27 bp, Artificial Sequence
  Description of Artificial Sequence: Synthetic oligonucleotide
ctcctgctcctcgtcgttgctgtcttc

SEQ ID NO: 214640 - DNA, 29 bp, Artificial Sequence
  Description of Artificial Sequence: Synthetic oligonucleotide
tcctgctcctcgtcgttgctgtcttctac

SEQ ID NO: 214641 - DNA, 28 bp, Artificial Sequence
  Description of Artificial Sequence: Synthetic oligonucleotide
cctgctcctcgtcgttgctgtcttctac

SEQ ID NO: 214642 - DNA, 29 bp, Artificial Sequence
  Description of Artificial Sequence: Synthetic oligonucleotide
ctgctcctcgtcgttgctgtcttctactg

SEQ ID NO: 214643 - DNA, 29 bp, Artificial Sequence
  Description of Artificial Sequence: Synthetic oligonucleotide
tgctcctcgtcgttgctgtcttctactgc

SEQ ID NO: 214644 - DNA, 28 bp, Artificial Sequence
  Description of Artificial Sequence: Synthetic oligonucleotide
gctcctcgtcgttgctgtcttctactgc

SEQ ID NO: 214645 - DNA, 28 bp, Artificial Sequence
  Description of Artificial Sequence: Synthetic oligonucleotide
ctcctcgtcgttgctgtcttctactgcg

SEQ ID NO: 214646 - DNA, 29 bp, Artificial Sequence
  Description of Artificial Sequence: Synthetic oligonucleotide
tcctcgtcgttgctgtcttctactgcgtg

SEQ ID NO: 214647 - DNA, 28 bp, Artificial Sequence
  Description of Artificial Sequence: Synthetic oligonucleotide
cctcgtcgttgctgtcttctactgcgtg

SEQ ID NO: 214648 - DNA, 29 bp, Artificial Sequence
  Description of Artificial Sequence: Synthetic oligonucleotide
ctcgtcgttgctgtcttctactgcgtgag

SEQ ID NO: 214649 - DNA, 30 bp, Artificial Sequence
  Description of Artificial Sequence: Synthetic oligonucleotide
tcgtcgttgctgtcttctactgcgtgagac

SEQ ID NO: 214650 - DNA, 29 bp, Artificial Sequence
  Description of Artificial Sequence: Synthetic oligonucleotide
cgtcgttgctgtcttctactgcgtgagac

SEQ ID NO: 214651 - DNA, 29 bp, Artificial Sequence
  Description of Artificial Sequence: Synthetic oligonucleotide
gtcgttgctgtcttctactgcgtgagacg

SEQ ID NO: 214652 - DNA, 29 bp, Artificial Sequence
  Description of Artificial Sequence: Synthetic oligonucleotide
tcgttgctgtcttctactgcgtgagacgc

SEQ ID NO: 214653 - DNA, 28 bp, Artificial Sequence
  Description of Artificial Sequence: Synthetic oligonucleotide
cgttgctgtcttctactgcgtgagacgc

SEQ ID NO: 214654 - DNA, 31 bp, Artificial Sequence
  Description of Artificial Sequence: Synthetic oligonucleotide
gttgctgtcttctactgcgtgagacgcaaag

SEQ ID NO: 214655 - DNA, 31 bp, Artificial Sequence
  Description of Artificial Sequence: Synthetic oligonucleotide
ttgctgtcttctactgcgtgagacgcaaagg

SEQ ID NO: 214656 - DNA, 30 bp, Artificial Sequence
  Description of Artificial Sequence: Synthetic oligonucleotide
tgctgtcttctactgcgtgagacgcaaagg

SEQ ID NO: 214657 - DNA, 29 bp, Artificial Sequence
  Description of Artificial Sequence: Synthetic oligonucleotide
gctgtcttctactgcgtgagacgcaaagg

SEQ ID NO: 214658 - DNA, 29 bp, Artificial Sequence
  Description of Artificial Sequence: Synthetic oligonucleotide
ctgtcttctactgcgtgagacgcaaaggg

SEQ ID NO: 214659 - DNA, 29 bp, Artificial Sequence
  Description of Artificial Sequence: Synthetic oligonucleotide
tgtcttctactgcgtgagacgcaaagggg

SEQ ID NO: 214660 - DNA, 28 bp, Artificial Sequence
  Description of Artificial Sequence: Synthetic oligonucleotide
gtcttctactgcgtgagacgcaaagggg

SEQ ID NO: 214661 - DNA, 28 bp, Artificial Sequence
  Description of Artificial Sequence: Synthetic oligonucleotide
tcttctactgcgtgagacgcaaaggggg

SEQ ID NO: 214662 - DNA, 27 bp, Artificial Sequence
  Description of Artificial Sequence: Synthetic oligonucleotide
cttctactgcgtgagacgcaaaggggg

SEQ ID NO: 214663 - DNA, 27 bp, Artificial Sequence
  Description of Artificial Sequence: Synthetic oligonucleotide
ttctactgcgtgagacgcaaagggggc

SEQ ID NO: 214664 - DNA, 26 bp, Artificial Sequence
  Description of Artificial Sequence: Synthetic oligonucleotide
tctactgcgtgagacgcaaagggggc

SEQ ID NO: 214665 - DNA, 25 bp, Artificial Sequence
  Description of Artificial Sequence: Synthetic oligonucleotide
ctactgcgtgagacgcaaagggggc

SEQ ID NO: 214666 - DNA, 25 bp, Artificial Sequence
  Description of Artificial Sequence: Synthetic oligonucleotide
tactgcgtgagacgcaaagggggcc

SEQ ID NO: 214667 - DNA, 24 bp, Artificial Sequence
  Description of Artificial Sequence: Synthetic oligonucleotide
actgcgtgagacgcaaagggggcc

SEQ ID NO: 214668 - DNA, 23 bp, Artificial Sequence
  Description of Artificial Sequence: Synthetic oligonucleotide
ctgcgtgagacgcaaagggggcc

SEQ ID NO: 214669 - DNA, 23 bp, Artificial Sequence
  Description of Artificial Sequence: Synthetic oligonucleotide
tgcgtgagacgcaaagggggccc

SEQ ID NO: 214670 - DNA, 22 bp, Artificial Sequence
  Description of Artificial Sequence: Synthetic oligonucleotide
gcgtgagacgcaaagggggccc

SEQ ID NO: 214671 - DNA, 23 bp, Artificial Sequence
  Description of Artificial Sequence: Synthetic oligonucleotide
cgtgagacgcaaagggggcccct

SEQ ID NO: 214672 - DNA, 23 bp, Artificial Sequence
  Description of Artificial Sequence: Synthetic oligonucleotide
gtgagacgcaaagggggcccctg

SEQ ID NO: 214673 - DNA, 24 bp, Artificial Sequence
  Description of Artificial Sequence: Synthetic oligonucleotide
tgagacgcaaagggggcccctgct

SEQ ID NO: 214674 - DNA, 23 bp, Artificial Sequence
  Description of Artificial Sequence: Synthetic oligonucleotide
gagacgcaaagggggcccctgct

SEQ ID NO: 214675 - DNA, 23 bp, Artificial Sequence
  Description of Artificial Sequence: Synthetic oligonucleotide
agacgcaaagggggcccctgctg

SEQ ID NO: 214676 - DNA, 22 bp, Artificial Sequence
  Description of Artificial Sequence: Synthetic oligonucleotide
gacgcaaagggggcccctgctg

SEQ ID NO: 214677 - DNA, 22 bp, Artificial Sequence
  Description of Artificial Sequence: Synthetic oligonucleotide
acgcaaagggggcccctgctgc

SEQ ID NO: 214678 - DNA, 21 bp, Artificial Sequence
  Description of Artificial Sequence: Synthetic oligonucleotide
cgcaaagggggcccctgctgc

SEQ ID NO: 214679 - DNA, 21 bp, Artificial Sequence
  Description of Artificial Sequence: Synthetic oligonucleotide
gcaaagggggcccctgctgcc

SEQ ID NO: 214680 - DNA, 21 bp, Artificial Sequence
  Description of Artificial Sequence: Synthetic oligonucleotide
caaagggggcccctgctgccg

SEQ ID NO: 214681 - DNA, 21 bp, Artificial Sequence
  Description of Artificial Sequence: Synthetic oligonucleotide
aaagggggcccctgctgccgc

SEQ ID NO: 214682 - DNA, 20 bp, Artificial Sequence
  Description of Artificial Sequence: Synthetic oligonucleotide
aagggggcccctgctgccgc

SEQ ID NO: 214683 - DNA, 20 bp, Artificial Sequence
  Description of Artificial Sequence: Synthetic oligonucleotide
agggggcccctgctgccgct

SEQ ID NO: 214684 - DNA, 20 bp, Artificial Sequence
  Description of Artificial Sequence: Synthetic oligonucleotide
gggggcccctgctgccgctt

SEQ ID NO: 214685 - DNA, 20 bp, Artificial Sequence
  Description of Artificial Sequence: Synthetic oligonucleotide
ggggcccctgctgccgccat

SEQ ID NO: 214686 - DNA, 20 bp, Artificial Sequence
  Description of Artificial Sequence: Synthetic oligonucleotide
gggcccctgctgccgccagt

SEQ ID NO: 214687 - DNA, 20 bp, Artificial Sequence
  Description of Artificial Sequence: Synthetic oligonucleotide
ggcccctgctgccgccagct

SEQ ID NO: 214688 - DNA, 20 bp, Artificial Sequence
  Description of Artificial Sequence: Synthetic oligonucleotide
gcccctgctgccgccagcgt

SEQ ID NO: 214689 - DNA, 20 bp, Artificial Sequence
  Description of Artificial Sequence: Synthetic oligonucleotide
cccctgctgccgccagcggt

SEQ ID NO: 214690 - DNA, 20 bp, Artificial Sequence
  Description of Artificial Sequence: Synthetic oligonucleotide
ccctgctgccgccagcggct

SEQ ID NO: 214691 - DNA, 20 bp, Artificial Sequence
  Description of Artificial Sequence: Synthetic oligonucleotide
cctgctgccgccagcggcgt

SEQ ID NO: 214692 - DNA, 20 bp, Artificial Sequence
  Description of Artificial Sequence: Synthetic oligonucleotide
ctgctgccgccagcggcggt

SEQ ID NO: 214693 - DNA, 20 bp, Artificial Sequence
  Description of Artificial Sequence: Synthetic oligonucleotide
tgctgccgccagcggcggga

SEQ ID NO: 214694 - DNA, 20 bp, Artificial Sequence
  Description of Artificial Sequence: Synthetic oligonucleotide
gctgccgccagcggcgggat

SEQ ID NO: 214695 - DNA, 21 bp, Artificial Sequence
  Description of Artificial Sequence: Synthetic oligonucleotide
ctgccgccagcggcgggagaa

SEQ ID NO: 214696 - DNA, 21 bp, Artificial Sequence
  Description of Artificial Sequence: Synthetic oligonucleotide
tgccgccagcggcgggagaag

SEQ ID NO: 214697 - DNA, 20 bp, Artificial Sequence
  Description of Artificial Sequence: Synthetic oligonucleotide
gccgccagcggcgggagaag

SEQ ID NO: 214698 - DNA, 20 bp, Artificial Sequence
  Description of Artificial Sequence: Synthetic oligonucleotide
ccgccagcggcgggagaagg

SEQ ID NO: 214699 - DNA, 20 bp, Artificial Sequence
  Description of Artificial Sequence: Synthetic oligonucleotide
cgccagcggcgggagaaggg

SEQ ID NO: 214700 - DNA, 20 bp, Artificial Sequence
  Description of Artificial Sequence: Synthetic oligonucleotide
gccagcggcgggagaagggg

SEQ ID NO: 214701 - DNA, 20 bp, Artificial Sequence
  Description of Artificial Sequence: Synthetic oligonucleotide
ccagcggcgggagaaggggg

SEQ ID NO: 214702 - DNA, 21 bp, Artificial Sequence
  Description of Artificial Sequence: Synthetic oligonucleotide
cagcggcgggagaagggggct

SEQ ID NO: 214703 - DNA, 21 bp, Artificial Sequence
  Description of Artificial Sequence: Synthetic oligonucleotide
agcggcgggagaagggggctc

SEQ ID NO: 214704 - DNA, 20 bp, Artificial Sequence
  Description of Artificial Sequence: Synthetic oligonucleotide
gcggcgggagaagggggctc

SEQ ID NO: 214705 - DNA, 20 bp, Artificial Sequence
  Description of Artificial Sequence: Synthetic oligonucleotide
cggcgggagaagggggctcc

SEQ ID NO: 214706 - DNA, 20 bp, Artificial Sequence
  Description of Artificial Sequence: Synthetic oligonucleotide
ggcgggagaagggggctccg

SEQ ID NO: 214707 - DNA, 20 bp, Artificial Sequence
  Description of Artificial Sequence: Synthetic oligonucleotide
gcgggagaagggggctccgc

SEQ ID NO: 214708 - DNA, 20 bp, Artificial Sequence
  Description of Artificial Sequence: Synthetic oligonucleotide
cgggagaagggggctccgcc

SEQ ID NO: 214709 - DNA, 20 bp, Artificial Sequence
  Description of Artificial Sequence: Synthetic oligonucleotide
gggagaagggggctccgccg

SEQ ID NO: 214710 - DNA, 20 bp, Artificial Sequence
  Description of Artificial Sequence: Synthetic oligonucleotide
ggagaagggggctccgccgc

SEQ ID NO: 214711 - DNA, 21 bp, Artificial Sequence
  Description of Artificial Sequence: Synthetic oligonucleotide
gagaagggggctccgccgcca

SEQ ID NO: 214712 - DNA, 21 bp, Artificial Sequence
  Description of Artificial Sequence: Synthetic oligonucleotide
agaagggggctccgccgccag

SEQ ID NO: 214713 - DNA, 20 bp, Artificial Sequence
  Description of Artificial Sequence: Synthetic oligonucleotide
gaagggggctccgccgccag

SEQ ID NO: 214714 - DNA, 20 bp, Artificial Sequence
  Description of Artificial Sequence: Synthetic oligonucleotide
aagggggctccgccgccagg

SEQ ID NO: 214715 - DNA, 20 bp, Artificial Sequence
  Description of Artificial Sequence: Synthetic oligonucleotide
agggggctccgccgccaggt

SEQ ID NO: 214716 - DNA, 20 bp, Artificial Sequence
  Description of Artificial Sequence: Synthetic oligonucleotide
gggggctccgccgccaggtt

SEQ ID NO: 214717 - DNA, 20 bp, Artificial Sequence
  Description of Artificial Sequence: Synthetic oligonucleotide
ggggctccgccgccagggtt

SEQ ID NO: 214718 - DNA, 20 bp, Artificial Sequence
  Description of Artificial Sequence: Synthetic oligonucleotide
gggctccgccgccaggggat

SEQ ID NO: 214719 - DNA, 20 bp, Artificial Sequence
  Description of Artificial Sequence: Synthetic oligonucleotide
ggctccgccgccaggggagt

SEQ ID NO: 214720 - DNA, 20 bp, Artificial Sequence
  Description of Artificial Sequence: Synthetic oligonucleotide
gctccgccgccaggggagct

SEQ ID NO: 214721 - DNA, 20 bp, Artificial Sequence
  Description of Artificial Sequence: Synthetic oligonucleotide
ctccgccgccaggggagcca

SEQ ID NO: 214722 - DNA, 20 bp, Artificial Sequence
  Description of Artificial Sequence: Synthetic oligonucleotide
tccgccgccaggggagccag

SEQ ID NO: 214723 - DNA, 20 bp, Artificial Sequence
  Description of Artificial Sequence: Synthetic oligonucleotide
ccgccgccaggggagccagt

SEQ ID NO: 214724 - DNA, 20 bp, Artificial Sequence
  Description of Artificial Sequence: Synthetic oligonucleotide
cgccgccaggggagccaggt

SEQ ID NO: 214725 - DNA, 20 bp, Artificial Sequence
  Description of Artificial Sequence: Synthetic oligonucleotide
gccgccaggggagccagggt

SEQ ID NO: 214726 - DNA, 20 bp, Artificial Sequence
  Description of Artificial Sequence: Synthetic oligonucleotide
ccgccaggggagccagggct

SEQ ID NO: 214727 - DNA, 21 bp, Artificial Sequence
  Description of Artificial Sequence: Synthetic oligonucleotide
cgccaggggagccagggctga

SEQ ID NO: 214728 - DNA, 21 bp, Artificial Sequence
  Description of Artificial Sequence: Synthetic oligonucleotide
gccaggggagccagggctgag

SEQ ID NO: 214729 - DNA, 21 bp, Artificial Sequence
  Description of Artificial Sequence: Synthetic oligonucleotide
ccaggggagccagggctgagc

SEQ ID NO: 214730 - DNA, 22 bp, Artificial Sequence
  Description of Artificial Sequence: Synthetic oligonucleotide
caggggagccagggctgagcca

SEQ ID NO: 214731 - DNA, 23 bp, Artificial Sequence
  Description of Artificial Sequence: Synthetic oligonucleotide
aggggagccagggctgagccact

SEQ ID NO: 214732 - DNA, 22 bp, Artificial Sequence
  Description of Artificial Sequence: Synthetic oligonucleotide
ggggagccagggctgagccact

SEQ ID NO: 214733 - DNA, 22 bp, Artificial Sequence
  Description of Artificial Sequence: Synthetic oligonucleotide
gggagccagggctgagccactc

SEQ ID NO: 214734 - DNA, 22 bp, Artificial Sequence
  Description of Artificial Sequence: Synthetic oligonucleotide
ggagccagggctgagccactcg

SEQ ID NO: 214735 - DNA, 22 bp, Artificial Sequence
  Description of Artificial Sequence: Synthetic oligonucleotide
gagccagggctgagccactcgg

SEQ ID NO: 214736 - DNA, 22 bp, Artificial Sequence
  Description of Artificial Sequence: Synthetic oligonucleotide
agccagggctgagccactcggg

SEQ ID NO: 214737 - DNA, 21 bp, Artificial Sequence
  Description of Artificial Sequence: Synthetic oligonucleotide
gccagggctgagccactcggg

SEQ ID NO: 214738 - DNA, 22 bp, Artificial Sequence
  Description of Artificial Sequence: Synthetic oligonucleotide
ccagggctgagccactcggggt

SEQ ID NO: 214739 - DNA, 22 bp, Artificial Sequence
  Description of Artificial Sequence: Synthetic oligonucleotide
cagggctgagccactcggggtc

SEQ ID NO: 214740 - DNA, 22 bp, Artificial Sequence
  Description of Artificial Sequence: Synthetic oligonucleotide
agggctgagccactcggggtcg

SEQ ID NO: 214741 - DNA, 21 bp, Artificial Sequence
  Description of Artificial Sequence: Synthetic oligonucleotide
gggctgagccactcggggtcg

SEQ ID NO: 214742 - DNA, 22 bp, Artificial Sequence
  Description of Artificial Sequence: Synthetic oligonucleotide
ggctgagccactcggggtcgga

SEQ ID NO: 214743 - DNA, 22 bp, Artificial Sequence
  Description of Artificial Sequence: Synthetic oligonucleotide
gctgagccactcggggtcggag

SEQ ID NO: 214744 - DNA, 24 bp, Artificial Sequence
  Description of Artificial Sequence: Synthetic oligonucleotide
ctgagccactcggggtcggagcaa

SEQ ID NO: 214745 - DNA, 24 bp, Artificial Sequence
  Description of Artificial Sequence: Synthetic oligonucleotide
tgagccactcggggtcggagcaac

SEQ ID NO: 214746 - DNA, 23 bp, Artificial Sequence
  Description of Artificial Sequence: Synthetic oligonucleotide
gagccactcggggtcggagcaac

SEQ ID NO: 214747 - DNA, 24 bp, Artificial Sequence
  Description of Artificial Sequence: Synthetic oligonucleotide
agccactcggggtcggagcaacca

SEQ ID NO: 214748 - DNA, 23 bp, Artificial Sequence
  Description of Artificial Sequence: Synthetic oligonucleotide
gccactcggggtcggagcaacca

SEQ ID NO: 214749 - DNA, 24 bp, Artificial Sequence
  Description of Artificial Sequence: Synthetic oligonucleotide
ccactcggggtcggagcaaccaga

SEQ ID NO: 214750 - DNA, 24 bp, Artificial Sequence
  Description of Artificial Sequence: Synthetic oligonucleotide
cactcggggtcggagcaaccagag

SEQ ID NO: 214751 - DNA, 25 bp, Artificial Sequence
  Description of Artificial Sequence: Synthetic oligonucleotide
actcggggtcggagcaaccagagca

SEQ ID NO: 214752 - DNA, 24 bp, Artificial Sequence
  Description of Artificial Sequence: Synthetic oligonucleotide
ctcggggtcggagcaaccagagca

SEQ ID NO: 214753 - DNA, 25 bp, Artificial Sequence
  Description of Artificial Sequence: Synthetic oligonucleotide
tcggggtcggagcaaccagagcaga

SEQ ID NO: 214754 - DNA, 24 bp, Artificial Sequence
  Description of Artificial Sequence: Synthetic oligonucleotide
cggggtcggagcaaccagagcaga

SEQ ID NO: 214755 - DNA, 24 bp, Artificial Sequence
  Description of Artificial Sequence: Synthetic oligonucleotide
ggggtcggagcaaccagagcagac

SEQ ID NO: 214756 - DNA, 24 bp, Artificial Sequence
  Description of Artificial Sequence: Synthetic oligonucleotide
gggtcggagcaaccagagcagacc

SEQ ID NO: 214757 - DNA, 24 bp, Artificial Sequence
  Description of Artificial Sequence: Synthetic oligonucleotide
ggtcggagcaaccagagcagaccg

SEQ ID NO: 214758 - DNA, 24 bp, Artificial Sequence
  Description of Artificial Sequence: Synthetic oligonucleotide
gtcggagcaaccagagcagaccgg

SEQ ID NO: 214759 - DNA, 24 bp, Artificial Sequence
  Description of Artificial Sequence: Synthetic oligonucleotide
tcggagcaaccagagcagaccggc

SEQ ID NO: 214760 - DNA, 23 bp, Artificial Sequence
  Description of Artificial Sequence: Synthetic oligonucleotide
cggagcaaccagagcagaccggc

SEQ ID NO: 214761 - DNA, 25 bp, Artificial Sequence
  Description of Artificial Sequence: Synthetic oligonucleotide
ggagcaaccagagcagaccggcctt

SEQ ID NO: 214762 - DNA, 26 bp, Artificial Sequence
  Description of Artificial Sequence: Synthetic oligonucleotide
gagcaaccagagcagaccggccttct

SEQ ID NO: 214763 - DNA, 27 bp, Artificial Sequence
  Description of Artificial Sequence: Synthetic oligonucleotide
agcaaccagagcagaccggccttctca

SEQ ID NO: 214764 - DNA, 27 bp, Artificial Sequence
  Description of Artificial Sequence: Synthetic oligonucleotide
gcaaccagagcagaccggccttctcat

SEQ ID NO: 214765 - DNA, 27 bp, Artificial Sequence
  Description of Artificial Sequence: Synthetic oligonucleotide
caaccagagcagaccggccttctcatg

SEQ ID NO: 214766 - DNA, 27 bp, Artificial Sequence
  Description of Artificial Sequence: Synthetic oligonucleotide
aaccagagcagaccggccttctcatgg

SEQ ID NO: 214767 - DNA, 26 bp, Artificial Sequence
  Description of Artificial Sequence: Synthetic oligonucleotide
accagagcagaccggccttctcatgg

SEQ ID NO: 214768 - DNA, 25 bp, Artificial Sequence
  Description of Artificial Sequence: Synthetic oligonucleotide
ccagagcagaccggccttctcatgg

SEQ ID NO: 214769 - DNA, 26 bp, Artificial Sequence
  Description of Artificial Sequence: Synthetic oligonucleotide
cagagcagaccggccttctcatggga

SEQ ID NO: 214770 - DNA, 26 bp, Artificial Sequence
  Description of Artificial Sequence: Synthetic oligonucleotide
agagcagaccggccttctcatgggag

SEQ ID NO: 214771 - DNA, 25 bp, Artificial Sequence
  Description of Artificial Sequence: Synthetic oligonucleotide
gagcagaccggccttctcatgggag

SEQ ID NO: 214772 - DNA, 26 bp, Artificial Sequence
  Description of Artificial Sequence: Synthetic oligonucleotide
agcagaccggccttctcatgggaggt

SEQ ID NO: 214773 - DNA, 25 bp, Artificial Sequence
  Description of Artificial Sequence: Synthetic oligonucleotide
gcagaccggccttctcatgggaggt

SEQ ID NO: 214774 - DNA, 25 bp, Artificial Sequence
  Description of Artificial Sequence: Synthetic oligonucleotide
cagaccggccttctcatgggaggtg

SEQ ID NO: 214775 - DNA, 25 bp, Artificial Sequence
  Description of Artificial Sequence: Synthetic oligonucleotide
agaccggccttctcatgggaggtgc

SEQ ID NO: 214776 - DNA, 24 bp, Artificial Sequence
  Description of Artificial Sequence: Synthetic oligonucleotide
gaccggccttctcatgggaggtgc

SEQ ID NO: 214777 - DNA, 25 bp, Artificial Sequence
  Description of Artificial Sequence: Synthetic oligonucleotide
accggccttctcatgggaggtgcct

SEQ ID NO: 214778 - DNA, 24 bp, Artificial Sequence
  Description of Artificial Sequence: Synthetic oligonucleotide
ccggccttctcatgggaggtgcct

SEQ ID NO: 214779 - DNA, 24 bp, Artificial Sequence
  Description of Artificial Sequence: Synthetic oligonucleotide
cggccttctcatgggaggtgcctc

SEQ ID NO: 214780 - DNA, 24 bp, Artificial Sequence
  Description of Artificial Sequence: Synthetic oligonucleotide
ggccttctcatgggaggtgcctcc

SEQ ID NO: 214781 - DNA, 24 bp, Artificial Sequence
  Description of Artificial Sequence: Synthetic oligonucleotide
gccttctcatgggaggtgcctccg

SEQ ID NO: 214782 - DNA, 25 bp, Artificial Sequence
  Description of Artificial Sequence: Synthetic oligonucleotide
ccttctcatgggaggtgcctccgga

SEQ ID NO: 214783 - DNA, 25 bp, Artificial Sequence
  Description of Artificial Sequence: Synthetic oligonucleotide
cttctcatgggaggtgcctccggag

SEQ ID NO: 214784 - DNA, 26 bp, Artificial Sequence
  Description of Artificial Sequence: Synthetic oligonucleotide
ttctcatgggaggtgcctccggagga

SEQ ID NO: 214785 - DNA, 25 bp, Artificial Sequence
  Description of Artificial Sequence: Synthetic oligonucleotide
tctcatgggaggtgcctccggagga

SEQ ID NO: 214786 - DNA, 24 bp, Artificial Sequence
  Description of Artificial Sequence: Synthetic oligonucleotide
ctcatgggaggtgcctccggagga

SEQ ID NO: 214787 - DNA, 24 bp, Artificial Sequence
  Description of Artificial Sequence: Synthetic oligonucleotide
tcatgggaggtgcctccggaggag

SEQ ID NO: 214788 - DNA, 23 bp, Artificial Sequence
  Description of Artificial Sequence: Synthetic oligonucleotide
catgggaggtgcctccggaggag

SEQ ID NO: 214789 - DNA, 23 bp, Artificial Sequence
  Description of Artificial Sequence: Synthetic oligonucleotide
atgggaggtgcctccggaggagc

SEQ ID NO: 214790 - DNA, 22 bp, Artificial Sequence
  Description of Artificial Sequence: Synthetic oligonucleotide
tgggaggtgcctccggaggagc

SEQ ID NO: 214791 - DNA, 21 bp, Artificial Sequence
  Description of Artificial Sequence: Synthetic oligonucleotide
gggaggtgcctccggaggagc

SEQ ID NO: 214792 - DNA, 22 bp, Artificial Sequence
  Description of Artificial Sequence: Synthetic oligonucleotide
ggaggtgcctccggaggagcca

SEQ ID NO: 214793 - DNA, 22 bp, Artificial Sequence
  Description of Artificial Sequence: Synthetic oligonucleotide
gaggtgcctccggaggagccag

SEQ ID NO: 214794 - DNA, 22 bp, Artificial Sequence
  Description of Artificial Sequence: Synthetic oligonucleotide
aggtgcctccggaggagccagg

SEQ ID NO: 214795 - DNA, 21 bp, Artificial Sequence
  Description of Artificial Sequence: Synthetic oligonucleotide
ggtgcctccggaggagccagg

SEQ ID NO: 214796 - DNA, 21 bp, Artificial Sequence
  Description of Artificial Sequence: Synthetic oligonucleotide
gtgcctccggaggagccaggg

SEQ ID NO: 214797 - DNA, 22 bp, Artificial Sequence
  Description of Artificial Sequence: Synthetic oligonucleotide
tgcctccggaggagccaggggt

SEQ ID NO: 214798 - DNA, 21 bp, Artificial Sequence
  Description of Artificial Sequence: Synthetic oligonucleotide
gcctccggaggagccaggggt

SEQ ID NO: 214799 - DNA, 21 bp, Artificial Sequence
  Description of Artificial Sequence: Synthetic oligonucleotide
cctccggaggagccaggggtg

SEQ ID NO: 214800 - DNA, 21 bp, Artificial Sequence
  Description of Artificial Sequence: Synthetic oligonucleotide
ctccggaggagccaggggtgg

SEQ ID NO: 214801 - DNA, 22 bp, Artificial Sequence
  Description of Artificial Sequence: Synthetic oligonucleotide
tccggaggagccaggggtggca

SEQ ID NO: 214802 - DNA, 21 bp, Artificial Sequence
  Description of Artificial Sequence: Synthetic oligonucleotide
ccggaggagccaggggtggca

SEQ ID NO: 214803 - DNA, 21 bp, Artificial Sequence
  Description of Artificial Sequence: Synthetic oligonucleotide
cggaggagccaggggtggcag

SEQ ID NO: 214804 - DNA, 21 bp, Artificial Sequence
  Description of Artificial Sequence: Synthetic oligonucleotide
ggaggagccaggggtggcagc

SEQ ID NO: 214805 - DNA, 21 bp, Artificial Sequence
  Description of Artificial Sequence: Synthetic oligonucleotide
gaggagccaggggtggcagcg

SEQ ID NO: 214806 - DNA, 21 bp, Artificial Sequence
  Description of Artificial Sequence: Synthetic oligonucleotide
aggagccaggggtggcagcgg

SEQ ID NO: 214807 - DNA, 20 bp, Artificial Sequence
  Description of Artificial Sequence: Synthetic oligonucleotide
ggagccaggggtggcagcgg

SEQ ID NO: 214808 - DNA, 20 bp, Artificial Sequence
  Description of Artificial Sequence: Synthetic oligonucleotide
gagccaggggtggcagcggg

SEQ ID NO: 214809 - DNA, 20 bp, Artificial Sequence
  Description of Artificial Sequence: Synthetic oligonucleotide
agccaggggtggcagcgggg

SEQ ID NO: 214810 - DNA, 20 bp, Artificial Sequence
  Description of Artificial Sequence: Synthetic oligonucleotide
gccaggggtggcagcggggt

SEQ ID NO: 214811 - DNA, 20 bp, Artificial Sequence
  Description of Artificial Sequence: Synthetic oligonucleotide
ccaggggtggcagcgggggt

SEQ ID NO: 214812 - DNA, 21 bp, Artificial Sequence
  Description of Artificial Sequence: Synthetic oligonucleotide
caggggtggcagcgggggctt

SEQ ID NO: 214813 - DNA, 21 bp, Artificial Sequence
  Description of Artificial Sequence: Synthetic oligonucleotide
aggggtggcagcgggggcttc

SEQ ID NO: 214814 - DNA, 20 bp, Artificial Sequence
  Description of Artificial Sequence: Synthetic oligonucleotide
ggggtggcagcgggggcttc

SEQ ID NO: 214815 - DNA, 20 bp, Artificial Sequence
  Description of Artificial Sequence: Synthetic oligonucleotide
gggtggcagcgggggcttcg

SEQ ID NO: 214816 - DNA, 21 bp, Artificial Sequence
  Description of Artificial Sequence: Synthetic oligonucleotide
ggtggcagcgggggcttcgga

SEQ ID NO: 214817 - DNA, 22 bp, Artificial Sequence
  Description of Artificial Sequence: Synthetic oligonucleotide
gtggcagcgggggcttcggaga

SEQ ID NO: 214818 - DNA, 22 bp, Artificial Sequence
  Description of Artificial Sequence: Synthetic oligonucleotide
tggcagcgggggcttcggagac

SEQ ID NO: 214819 - DNA, 21 bp, Artificial Sequence
  Description of Artificial Sequence: Synthetic oligonucleotide
ggcagcgggggcttcggagac

SEQ ID NO: 214820 - DNA, 22 bp, Artificial Sequence
  Description of Artificial Sequence: Synthetic oligonucleotide
gcagcgggggcttcggagacga

SEQ ID NO: 214821 - DNA, 23 bp, Artificial Sequence
  Description of Artificial Sequence: Synthetic oligonucleotide
cagcgggggcttcggagacgagt

SEQ ID NO: 214822 - DNA, 23 bp, Artificial Sequence
  Description of Artificial Sequence: Synthetic oligonucleotide
agcgggggcttcggagacgagtg

SEQ ID NO: 214823 - DNA, 22 bp, Artificial Sequence
  Description of Artificial Sequence: Synthetic oligonucleotide
gcgggggcttcggagacgagtg

SEQ ID NO: 214824 - DNA, 23 bp, Artificial Sequence
  Description of Artificial Sequence: Synthetic oligonucleotide
cgggggcttcggagacgagtgct

SEQ ID NO: 214825 - DNA, 24 bp, Artificial Sequence
  Description of Artificial Sequence: Synthetic oligonucleotide
gggggcttcggagacgagtgctga

SEQ ID NO: 214826 - DNA, 27 bp, Artificial Sequence
  Description of Artificial Sequence: Synthetic oligonucleotide
tcaaggatgaccgagacgccagcttcc

SEQ ID NO: 214827 - DNA, 25 bp, Artificial Sequence
  Description of Artificial Sequence: Synthetic oligonucleotide
cccaccttccacctcaccctgcact

SEQ ID NO: 214828 - DNA, 25 bp, Artificial Sequence
  Description of Artificial Sequence: Synthetic oligonucleotide
cccataccagctggactcccaggga

SEQ ID NO: 214829 - DNA, 25 bp, Artificial Sequence
  Description of Artificial Sequence: Synthetic oligonucleotide
ccataccagctggactcccagggac

SEQ ID NO: 214830 - DNA, 25 bp, Artificial Sequence
  Description of Artificial Sequence: Synthetic oligonucleotide
cataccagctggactcccagggacg

SEQ ID NO: 214831 - DNA, 25 bp, Artificial Sequence
  Description of Artificial Sequence: Synthetic oligonucleotide
ataccagctggactcccagggacgc

SEQ ID NO: 214832 - DNA, 24 bp, Artificial Sequence
  Description of Artificial Sequence: Synthetic oligonucleotide
taccagctggactcccagggacgc

SEQ ID NO: 214833 - DNA, 23 bp, Artificial Sequence
  Description of Artificial Sequence: Synthetic oligonucleotide
accagctggactcccagggacgc

SEQ ID NO: 214834 - DNA, 22 bp, Artificial Sequence
  Description of Artificial Sequence: Synthetic oligonucleotide
ccagctggactcccagggacgc

SEQ ID NO: 214835 - DNA, 23 bp, Artificial Sequence
  Description of Artificial Sequence: Synthetic oligonucleotide
cagctggactcccagggacgcct

SEQ ID NO: 214836 - DNA, 23 bp, Artificial Sequence
  Description of Artificial Sequence: Synthetic oligonucleotide
agctggactcccagggacgcctg

SEQ ID NO: 214837 - DNA, 22 bp, Artificial Sequence
  Description of Artificial Sequence: Synthetic oligonucleotide
gctggactcccagggacgcctg

SEQ ID NO: 214838 - DNA, 23 bp, Artificial Sequence
  Description of Artificial Sequence: Synthetic oligonucleotide
ctggactcccagggacgcctggt

SEQ ID NO: 214839 - DNA, 23 bp, Artificial Sequence
  Description of Artificial Sequence: Synthetic oligonucleotide
tggactcccagggacgcctggtg

SEQ ID NO: 214840 - DNA, 22 bp, Artificial Sequence
  Description of Artificial Sequence: Synthetic oligonucleotide
ggactcccagggacgcctggtg

SEQ ID NO: 214841 - DNA, 23 bp, Artificial Sequence
  Description of Artificial Sequence: Synthetic oligonucleotide
gactcccagggacgcctggtgct

SEQ ID NO: 214842 - DNA, 23 bp, Artificial Sequence
  Description of Artificial Sequence: Synthetic oligonucleotide
actcccagggacgcctggtgctg

SEQ ID NO: 214843 - DNA, 22 bp, Artificial Sequence
  Description of Artificial Sequence: Synthetic oligonucleotide
ctcccagggacgcctggtgctg

SEQ ID NO: 214844 - DNA, 22 bp, Artificial Sequence
  Description of Artificial Sequence: Synthetic oligonucleotide
tcccagggacgcctggtgctgg

SEQ ID NO: 214845 - DNA, 21 bp, Artificial Sequence
  Description of Artificial Sequence: Synthetic oligonucleotide
cccagggacgcctggtgctgg

SEQ ID NO: 214846 - DNA, 22 bp, Artificial Sequence
  Description of Artificial Sequence: Synthetic oligonucleotide
ccagggacgcctggtgctggct

SEQ ID NO: 214847 - DNA, 23 bp, Artificial Sequence
  Description of Artificial Sequence: Synthetic oligonucleotide
cagggacgcctggtgctggctga

SEQ ID NO: 214848 - DNA, 23 bp, Artificial Sequence
  Description of Artificial Sequence: Synthetic oligonucleotide
agggacgcctggtgctggctgag

SEQ ID NO: 214849 - DNA, 22 bp, Artificial Sequence
  Description of Artificial Sequence: Synthetic oligonucleotide
gggacgcctggtgctggctgag

SEQ ID NO: 214850 - DNA, 22 bp, Artificial Sequence
  Description of Artificial Sequence: Synthetic oligonucleotide
ggacgcctggtgctggctgagg

SEQ ID NO: 214851 - DNA, 22 bp, Artificial Sequence
  Description of Artificial Sequence: Synthetic oligonucleotide
gacgcctggtgctggctgaggc

SEQ ID NO: 214852 - DNA, 22 bp, Artificial Sequence
  Description of Artificial Sequence: Synthetic oligonucleotide
acgcctggtgctggctgaggcc

SEQ ID NO: 214853 - DNA, 24 bp, Artificial Sequence
  Description of Artificial Sequence: Synthetic oligonucleotide
tgctctgcccgcggccatccagaa

SEQ ID NO: 214854 - DNA, 24 bp, Artificial Sequence
  Description of Artificial Sequence: Synthetic oligonucleotide
cctcaccagcaccctctacctgcc

SEQ ID NO: 214855 - DNA, 25 bp, Artificial Sequence
  Description of Artificial Sequence: Synthetic oligonucleotide
ctcaccagcaccctctacctgccgt

SEQ ID NO: 214856 - DNA, 25 bp, Artificial Sequence
  Description of Artificial Sequence: Synthetic oligonucleotide
tcaccagcaccctctacctgccgtg

SEQ ID NO: 214857 - DNA, 24 bp, Artificial Sequence
  Description of Artificial Sequence: Synthetic oligonucleotide
caccagcaccctctacctgccgtg

SEQ ID NO: 214858 - DNA, 24 bp, Artificial Sequence
  Description of Artificial Sequence: Synthetic oligonucleotide
accagcaccctctacctgccgtgc

SEQ ID NO: 214859 - DNA, 23 bp, Artificial Sequence
  Description of Artificial Sequence: Synthetic oligonucleotide
ccagcaccctctacctgccgtgc

SEQ ID NO: 214860 - DNA, 23 bp, Artificial Sequence
  Description of Artificial Sequence: Synthetic oligonucleotide
cagcaccctctacctgccgtgcc

SEQ ID NO: 214861 - DNA, 23 bp, Artificial Sequence
  Description of Artificial Sequence: Synthetic oligonucleotide
agcaccctctacctgccgtgccg

SEQ ID NO: 214862 - DNA, 22 bp, Artificial Sequence
  Description of Artificial Sequence: Synthetic oligonucleotide
gcaccctctacctgccgtgccg

SEQ ID NO: 214863 - DNA, 24 bp, Artificial Sequence
  Description of Artificial Sequence: Synthetic oligonucleotide
caccctctacctgccgtgccgcaa

SEQ ID NO: 214864 - DNA, 24 bp, Artificial Sequence
  Description of Artificial Sequence: Synthetic oligonucleotide
accctctacctgccgtgccgcaag

SEQ ID NO: 214865 - DNA, 23 bp, Artificial Sequence
  Description of Artificial Sequence: Synthetic oligonucleotide
ccctctacctgccgtgccgcaag

SEQ ID NO: 214866 - DNA, 25 bp, Artificial Sequence
  Description of Artificial Sequence: Synthetic oligonucleotide
cctctacctgccgtgccgcaaggat

SEQ ID NO: 214867 - DNA, 26 bp, Artificial Sequence
  Description of Artificial Sequence: Synthetic oligonucleotide
ctctacctgccgtgccgcaaggatga

SEQ ID NO: 214868 - DNA, 26 bp, Artificial Sequence
  Description of Artificial Sequence: Synthetic oligonucleotide
tctacctgccgtgccgcaaggatgac

SEQ ID NO: 214869 - DNA, 25 bp, Artificial Sequence
  Description of Artificial Sequence: Synthetic oligonucleotide
ctacctgccgtgccgcaaggatgac

SEQ ID NO: 214870 - DNA, 25 bp, Artificial Sequence
  Description of Artificial Sequence: Synthetic oligonucleotide
tacctgccgtgccgcaaggatgacc

SEQ ID NO: 214871 - DNA, 24 bp, Artificial Sequence
  Description of Artificial Sequence: Synthetic oligonucleotide
acctgccgtgccgcaaggatgacc

SEQ ID NO: 214872 - DNA, 23 bp, Artificial Sequence
  Description of Artificial Sequence: Synthetic oligonucleotide
cctgccgtgccgcaaggatgacc

SEQ ID NO: 214873 - DNA, 24 bp, Artificial Sequence
  Description of Artificial Sequence: Synthetic oligonucleotide
ctgccgtgccgcaaggatgaccga

SEQ ID NO: 214874 - DNA, 25 bp, Artificial Sequence
  Description of Artificial Sequence: Synthetic oligonucleotide
tgccgtgccgcaaggatgaccgaga

SEQ ID NO: 214875 - DNA, 24 bp, Artificial Sequence
  Description of Artificial Sequence: Synthetic oligonucleotide
gccgtgccgcaaggatgaccgaga

SEQ ID NO: 214876 - DNA, 24 bp, Artificial Sequence
  Description of Artificial Sequence: Synthetic oligonucleotide
ccgtgccgcaaggatgaccgagac

SEQ ID NO: 214877 - DNA, 24 bp, Artificial Sequence
  Description of Artificial Sequence: Synthetic oligonucleotide
cgtgccgcaaggatgaccgagacg

SEQ ID NO: 214878 - DNA, 24 bp, Artificial Sequence
  Description of Artificial Sequence: Synthetic oligonucleotide
gtgccgcaaggatgaccgagacgc

SEQ ID NO: 214879 - DNA, 25 bp, Artificial Sequence
  Description of Artificial Sequence: Synthetic oligonucleotide
tgccgcaaggatgaccgagacgcca

SEQ ID NO: 214880 - DNA, 24 bp, Artificial Sequence
  Description of Artificial Sequence: Synthetic oligonucleotide
gccgcaaggatgaccgagacgcca

SEQ ID NO: 214881 - DNA, 26 bp, Artificial Sequence
  Description of Artificial Sequence: Synthetic oligonucleotide
acgtgcagctctccaagacgctggac

SEQ ID NO: 214882 - DNA, 25 bp, Artificial Sequence
  Description of Artificial Sequence: Synthetic oligonucleotide
cgtgcagctctccaagacgctggac

SEQ ID NO: 214883 - DNA, 26 bp, Artificial Sequence
  Description of Artificial Sequence: Synthetic oligonucleotide
gtgcagctctccaagacgctggacgt

SEQ ID NO: 214884 - DNA, 26 bp, Artificial Sequence
  Description of Artificial Sequence: Synthetic oligonucleotide
tgcagctctccaagacgctggacgtg

SEQ ID NO: 214885 - DNA, 25 bp, Artificial Sequence
  Description of Artificial Sequence: Synthetic oligonucleotide
gcagctctccaagacgctggacgtg

SEQ ID NO: 214886 - DNA, 25 bp, Artificial Sequence
  Description of Artificial Sequence: Synthetic oligonucleotide
cagctctccaagacgctggacgtgc

SEQ ID NO: 214887 - DNA, 25 bp, Artificial Sequence
  Description of Artificial Sequence: Synthetic oligonucleotide
agctctccaagacgctggacgtgcg

SEQ ID NO: 214888 - DNA, 24 bp, Artificial Sequence
  Description of Artificial Sequence: Synthetic oligonucleotide
gctctccaagacgctggacgtgcg

SEQ ID NO: 214889 - DNA, 24 bp, Artificial Sequence
  Description of Artificial Sequence: Synthetic oligonucleotide
ctctccaagacgctggacgtgcgc

SEQ ID NO: 214890 - DNA, 25 bp, Artificial Sequence
  Description of Artificial Sequence: Synthetic oligonucleotide
tctccaagacgctggacgtgcgcgt

SEQ ID NO: 214891 - DNA, 24 bp, Artificial Sequence
  Description of Artificial Sequence: Synthetic oligonucleotide
ctccaagacgctggacgtgcgcgt

SEQ ID NO: 214892 - DNA, 24 bp, Artificial Sequence
  Description of Artificial Sequence: Synthetic oligonucleotide
tccaagacgctggacgtgcgcgtg

SEQ ID NO: 214893 - DNA, 23 bp, Artificial Sequence
  Description of Artificial Sequence: Synthetic oligonucleotide
ccaagacgctggacgtgcgcgtg

SEQ ID NO: 214894 - DNA, 23 bp, Artificial Sequence
  Description of Artificial Sequence: Synthetic oligonucleotide
caagacgctggacgtgcgcgtgg

SEQ ID NO: 214895 - DNA, 23 bp, Artificial Sequence
  Description of Artificial Sequence: Synthetic oligonucleotide
aagacgctggacgtgcgcgtggc

SEQ ID NO: 214896 - DNA, 22 bp, Artificial Sequence
  Description of Artificial Sequence: Synthetic oligonucleotide
agacgctggacgtgcgcgtggc

SEQ ID NO: 214897 - DNA, 21 bp, Artificial Sequence
  Description of Artificial Sequence: Synthetic oligonucleotide
gacgctggacgtgcgcgtggc

SEQ ID NO: 214898 - DNA, 24 bp, Artificial Sequence
  Description of Artificial Sequence: Synthetic oligonucleotide
acgctggacgtgcgcgtggcctat

SEQ ID NO: 214899 - DNA, 23 bp, Artificial Sequence
  Description of Artificial Sequence: Synthetic oligonucleotide
cgctggacgtgcgcgtggcctat

SEQ ID NO: 214900 - DNA, 24 bp, Artificial Sequence
  Description of Artificial Sequence: Synthetic oligonucleotide
gctggacgtgcgcgtggcctatct

SEQ ID NO: 214901 - DNA, 24 bp, Artificial Sequence
  Description of Artificial Sequence: Synthetic oligonucleotide
ctggacgtgcgcgtggcctatctg

SEQ ID NO: 214902 - DNA, 25 bp, Artificial Sequence
  Description of Artificial Sequence: Synthetic oligonucleotide
tggacgtgcgcgtggcctatctgga

SEQ ID NO: 214903 - DNA, 24 bp, Artificial Sequence
  Description of Artificial Sequence: Synthetic oligonucleotide
ggacgtgcgcgtggcctatctgga

SEQ ID NO: 214904 - DNA, 24 bp, Artificial Sequence
  Description of Artificial Sequence: Synthetic oligonucleotide
gacgtgcgcgtggcctatctggac

SEQ ID NO: 214905 - DNA, 24 bp, Artificial Sequence
  Description of Artificial Sequence: Synthetic oligonucleotide
acgtgcgcgtggcctatctggacc

SEQ ID NO: 214906 - DNA, 23 bp, Artificial Sequence
  Description of Artificial Sequence: Synthetic oligonucleotide
cgtgcgcgtggcctatctggacc

SEQ ID NO: 214907 - DNA, 23 bp, Artificial Sequence
  Description of Artificial Sequence: Synthetic oligonucleotide
gtgcgcgtggcctatctggaccc

SEQ ID NO: 214908 - DNA, 28 bp, Artificial Sequence
  Description of Artificial Sequence: Synthetic oligonucleotide
aacaagcgccatgtcttccacttcggcg

SEQ ID NO: 214909 - DNA, 27 bp, Artificial Sequence
  Description of Artificial Sequence: Synthetic oligonucleotide
acaagcgccatgtcttccacttcggcg

SEQ ID NO: 214910 - DNA, 26 bp, Artificial Sequence
  Description of Artificial Sequence: Synthetic oligonucleotide
caagcgccatgtcttccacttcggcg

SEQ ID NO: 214911 - DNA, 26 bp, Artificial Sequence
  Description of Artificial Sequence: Synthetic oligonucleotide
aagcgccatgtcttccacttcggcgc

SEQ ID NO: 214912 - DNA, 25 bp, Artificial Sequence
  Description of Artificial Sequence: Synthetic oligonucleotide
agcgccatgtcttccacttcggcgc

SEQ ID NO: 214913 - DNA, 24 bp, Artificial Sequence
  Description of Artificial Sequence: Synthetic oligonucleotide
gcgccatgtcttccacttcggcgc

SEQ ID NO: 214914 - DNA, 24 bp, Artificial Sequence
  Description of Artificial Sequence: Synthetic oligonucleotide
cgccatgtcttccacttcggcgcc

SEQ ID NO: 214915 - DNA, 25 bp, Artificial Sequence
  Description of Artificial Sequence: Synthetic oligonucleotide
gccatgtcttccacttcggcgccgt

SEQ ID NO: 214916 - DNA, 26 bp, Artificial Sequence
  Description of Artificial Sequence: Synthetic oligonucleotide
ccatgtcttccacttcggcgccgtga

SEQ ID NO: 214917 - DNA, 26 bp, Artificial Sequence
  Description of Artificial Sequence: Synthetic oligonucleotide
catgtcttccacttcggcgccgtgag

SEQ ID NO: 214918 - DNA, 26 bp, Artificial Sequence
  Description of Artificial Sequence: Synthetic oligonucleotide
atgtcttccacttcggcgccgtgagc

SEQ ID NO: 214919 - DNA, 25 bp, Artificial Sequence
  Description of Artificial Sequence: Synthetic oligonucleotide
tgtcttccacttcggcgccgtgagc

SEQ ID NO: 214920 - DNA, 24 bp, Artificial Sequence
  Description of Artificial Sequence: Synthetic oligonucleotide
gtcttccacttcggcgccgtgagc

SEQ ID NO: 214921 - DNA, 24 bp, Artificial Sequence
  Description of Artificial Sequence: Synthetic oligonucleotide
tcttccacttcggcgccgtgagcc

SEQ ID NO: 214922 - DNA, 23 bp, Artificial Sequence
  Description of Artificial Sequence: Synthetic oligonucleotide
cttccacttcggcgccgtgagcc

SEQ ID NO: 214923 - DNA, 23 bp, Artificial Sequence
  Description of Artificial Sequence: Synthetic oligonucleotide
ttccacttcggcgccgtgagccc

SEQ ID NO: 214924 - DNA, 22 bp, Artificial Sequence
  Description of Artificial Sequence: Synthetic oligonucleotide
tccacttcggcgccgtgagccc

SEQ ID NO: 214925 - DNA, 21 bp, Artificial Sequence
  Description of Artificial Sequence: Synthetic oligonucleotide
ccacttcggcgccgtgagccc

SEQ ID NO: 214926 - DNA, 21 bp, Artificial Sequence
  Description of Artificial Sequence: Synthetic oligonucleotide
cacttcggcgccgtgagcccc

SEQ ID NO: 214927 - DNA, 22 bp, Artificial Sequence
  Description of Artificial Sequence: Synthetic oligonucleotide
acttcggcgccgtgagccccca

SEQ ID NO: 214928 - DNA, 21 bp, Artificial Sequence
  Description of Artificial Sequence: Synthetic oligonucleotide
cttcggcgccgtgagccccca

SEQ ID NO: 214929 - DNA, 22 bp, Artificial Sequence
  Description of Artificial Sequence: Synthetic oligonucleotide
ttcggcgccgtgagcccccaga

SEQ ID NO: 214930 - DNA, 21 bp, Artificial Sequence
  Description of Artificial Sequence: Synthetic oligonucleotide
tcggcgccgtgagcccccaga

SEQ ID NO: 214931 - DNA, 20 bp, Artificial Sequence
  Description of Artificial Sequence: Synthetic oligonucleotide
cggcgccgtgagcccccaga

SEQ ID NO: 214932 - DNA, 20 bp, Artificial Sequence
  Description of Artificial Sequence: Synthetic oligonucleotide
ggcgccgtgagcccccagac

SEQ ID NO: 214933 - DNA, 21 bp, Artificial Sequence
  Description of Artificial Sequence: Synthetic oligonucleotide
gcgccgtgagcccccagacct

SEQ ID NO: 214934 - DNA, 21 bp, Artificial Sequence
  Description of Artificial Sequence: Synthetic oligonucleotide
cgccgtgagcccccagacctc

SEQ ID NO: 214935 - DNA, 21 bp, Artificial Sequence
  Description of Artificial Sequence: Synthetic oligonucleotide
gccgtgagcccccagacctcc

SEQ ID NO: 214936 - DNA, 27 bp, Artificial Sequence
  Description of Artificial Sequence: Synthetic oligonucleotide
atggggtctctgttccctctgtcgctg

SEQ ID NO: 214937 - DNA, 26 bp, Artificial Sequence
  Description of Artificial Sequence: Synthetic oligonucleotide
tggggtctctgttccctctgtcgctg

SEQ ID NO: 214938 - DNA, 25 bp, Artificial Sequence
  Description of Artificial Sequence: Synthetic oligonucleotide
ggggtctctgttccctctgtcgctg

SEQ ID NO: 214939 - DNA, 26 bp, Artificial Sequence
  Description of Artificial Sequence: Synthetic oligonucleotide
gggtctctgttccctctgtcgctgct

SEQ ID NO: 214940 - DNA, 27 bp, Artificial Sequence
  Description of Artificial Sequence: Synthetic oligonucleotide
ggtctctgttccctctgtcgctgctgt

SEQ ID NO: 214941 - DNA, 34 bp, Artificial Sequence
  Description of Artificial Sequence: Synthetic oligonucleotide
gtctctgttccctctgtcgctgctgttttttttg

SEQ ID NO: 214942 - DNA, 34 bp, Artificial Sequence
  Description of Artificial Sequence: Synthetic oligonucleotide
tctctgttccctctgtcgctgctgttttttttgg

SEQ ID NO: 214943 - DNA, 33 bp, Artificial Sequence
  Description of Artificial Sequence: Synthetic oligonucleotide
ctctgttccctctgtcgctgctgttttttttgg

SEQ ID NO: 214944 - DNA, 33 bp, Artificial Sequence
  Description of Artificial Sequence: Synthetic oligonucleotide
tctgttccctctgtcgctgctgttttttttggc

SEQ ID NO: 214945 - DNA, 32 bp, Artificial Sequence
  Description of Artificial Sequence: Synthetic oligonucleotide
ctgttccctctgtcgctgctgttttttttggc

SEQ ID NO: 214946 - DNA, 32 bp, Artificial Sequence
  Description of Artificial Sequence: Synthetic oligonucleotide
tgttccctctgtcgctgctgttttttttggcg

SEQ ID NO: 214947 - DNA, 31 bp, Artificial Sequence
  Description of Artificial Sequence: Synthetic oligonucleotide
gttccctctgtcgctgctgttttttttggcg

SEQ ID NO: 214948 - DNA, 31 bp, Artificial Sequence
  Description of Artificial Sequence: Synthetic oligonucleotide
ttccctctgtcgctgctgttttttttggcgg

SEQ ID NO: 214949 - DNA, 30 bp, Artificial Sequence
  Description of Artificial Sequence: Synthetic oligonucleotide
tccctctgtcgctgctgttttttttggcgg

SEQ ID NO: 214950 - DNA, 29 bp, Artificial Sequence
  Description of Artificial Sequence: Synthetic oligonucleotide
ccctctgtcgctgctgttttttttggcgg

SEQ ID NO: 214951 - DNA, 29 bp, Artificial Sequence
  Description of Artificial Sequence: Synthetic oligonucleotide
cctctgtcgctgctgttttttttggcggc

SEQ ID NO: 214952 - DNA, 29 bp, Artificial Sequence
  Description of Artificial Sequence: Synthetic oligonucleotide
ctctgtcgctgctgttttttttggcggcc

SEQ ID NO: 214953 - DNA, 29 bp, Artificial Sequence
  Description of Artificial Sequence: Synthetic oligonucleotide
tctgtcgctgctgttttttttggcggccg

SEQ ID NO: 214954 - DNA, 28 bp, Artificial Sequence
  Description of Artificial Sequence: Synthetic oligonucleotide
ctgtcgctgctgttttttttggcggccg

SEQ ID NO: 214955 - DNA, 28 bp, Artificial Sequence
  Description of Artificial Sequence: Synthetic oligonucleotide
tgtcgctgctgttttttttggcggccgc

SEQ ID NO: 214956 - DNA, 27 bp, Artificial Sequence
  Description of Artificial Sequence: Synthetic oligonucleotide
gtcgctgctgttttttttggcggccgc

SEQ ID NO: 214957 - DNA, 27 bp, Artificial Sequence
  Description of Artificial Sequence: Synthetic oligonucleotide
tcgctgctgttttttttggcggccgcc

SEQ ID NO: 214958 - DNA, 27 bp, Artificial Sequence
  Description of Artificial Sequence: Synthetic oligonucleotide
cgctgctgttttttttggcggccgcct

SEQ ID NO: 214959 - DNA, 28 bp, Artificial Sequence
  Description of Artificial Sequence: Synthetic oligonucleotide
gctgctgttttttttggcggccgcctac

SEQ ID NO: 214960 - DNA, 28 bp, Artificial Sequence
  Description of Artificial Sequence: Synthetic oligonucleotide
ctgctgttttttttggcggccgcctacc

SEQ ID NO: 214961 - DNA, 28 bp, Artificial Sequence
  Description of Artificial Sequence: Synthetic oligonucleotide
tgctgttttttttggcggccgcctaccc

SEQ ID NO: 214962 - DNA, 27 bp, Artificial Sequence
  Description of Artificial Sequence: Synthetic oligonucleotide
gctgttttttttggcggccgcctaccc

SEQ ID NO: 214963 - DNA, 27 bp, Artificial Sequence
  Description of Artificial Sequence: Synthetic oligonucleotide
ctgttttttttggcggccgcctacccg

SEQ ID NO: 214964 - DNA, 27 bp, Artificial Sequence
  Description of Artificial Sequence: Synthetic oligonucleotide
tgttttttttggcggccgcctacccgg

SEQ ID NO: 214965 - DNA, 26 bp, Artificial Sequence
  Description of Artificial Sequence: Synthetic oligonucleotide
gttttttttggcggccgcctacccgg

SEQ ID NO: 214966 - DNA, 27 bp, Artificial Sequence
  Description of Artificial Sequence: Synthetic oligonucleotide
ttttttttggcggccgcctacccggga

SEQ ID NO: 214967 - DNA, 26 bp, Artificial Sequence
  Description of Artificial Sequence: Synthetic oligonucleotide
tttttttggcggccgcctacccggga

SEQ ID NO: 214968 - DNA, 25 bp, Artificial Sequence
  Description of Artificial Sequence: Synthetic oligonucleotide
ttttttggcggccgcctacccggga

SEQ ID NO: 214969 - DNA, 24 bp, Artificial Sequence
  Description of Artificial Sequence: Synthetic oligonucleotide
tttttggcggccgcctacccggga

SEQ ID NO: 214970 - DNA, 23 bp, Artificial Sequence
  Description of Artificial Sequence: Synthetic oligonucleotide
ttttggcggccgcctacccggga

SEQ ID NO: 214971 - DNA, 22 bp, Artificial Sequence
  Description of Artificial Sequence: Synthetic oligonucleotide
tttggcggccgcctacccggga

SEQ ID NO: 214972 - DNA, 21 bp, Artificial Sequence
  Description of Artificial Sequence: Synthetic oligonucleotide
ttggcggccgcctacccggga

SEQ ID NO: 214973 - DNA, 20 bp, Artificial Sequence
  Description of Artificial Sequence: Synthetic oligonucleotide
tggcggccgcctacccggga

SEQ ID NO: 214974 - DNA, 20 bp, Artificial Sequence
  Description of Artificial Sequence: Synthetic oligonucleotide
ggcggccgcctacccgggat

SEQ ID NO: 214975 - DNA, 21 bp, Artificial Sequence
  Description of Artificial Sequence: Synthetic oligonucleotide
gcggccgcctacccgggagtt

SEQ ID NO: 214976 - DNA, 21 bp, Artificial Sequence
  Description of Artificial Sequence: Synthetic oligonucleotide
cggccgcctacccgggagttg

SEQ ID NO: 214977 - DNA, 21 bp, Artificial Sequence
  Description of Artificial Sequence: Synthetic oligonucleotide
ggccgcctacccgggagttgg

SEQ ID NO: 214978 - DNA, 22 bp, Artificial Sequence
  Description of Artificial Sequence: Synthetic oligonucleotide
gccgcctacccgggagttggga

SEQ ID NO: 214979 - DNA, 22 bp, Artificial Sequence
  Description of Artificial Sequence: Synthetic oligonucleotide
ccgcctacccgggagttgggag

SEQ ID NO: 214980 - DNA, 22 bp, Artificial Sequence
  Description of Artificial Sequence: Synthetic oligonucleotide
cgcctacccgggagttgggagc

SEQ ID NO: 214981 - DNA, 22 bp, Artificial Sequence
  Description of Artificial Sequence: Synthetic oligonucleotide
gcctacccgggagttgggagcg

SEQ ID NO: 214982 - DNA, 22 bp, Artificial Sequence
  Description of Artificial Sequence: Synthetic oligonucleotide
cctacccgggagttgggagcgc

SEQ ID NO: 214983 - DNA, 22 bp, Artificial Sequence
  Description of Artificial Sequence: Synthetic oligonucleotide
ctacccgggagttgggagcgcg

SEQ ID NO: 214984 - DNA, 23 bp, Artificial Sequence
  Description of Artificial Sequence: Synthetic oligonucleotide
tacccgggagttgggagcgcgct

SEQ ID NO: 214985 - DNA, 22 bp, Artificial Sequence
  Description of Artificial Sequence: Synthetic oligonucleotide
acccgggagttgggagcgcgct

SEQ ID NO: 214986 - DNA, 21 bp, Artificial Sequence
  Description of Artificial Sequence: Synthetic oligonucleotide
cccgggagttgggagcgcgct

SEQ ID NO: 214987 - DNA, 21 bp, Artificial Sequence
  Description of Artificial Sequence: Synthetic oligonucleotide
ccgggagttgggagcgcgctg

SEQ ID NO: 214988 - DNA, 21 bp, Artificial Sequence
  Description of Artificial Sequence: Synthetic oligonucleotide
cgggagttgggagcgcgctgg

SEQ ID NO: 214989 - DNA, 22 bp, Artificial Sequence
  Description of Artificial Sequence: Synthetic oligonucleotide
gggagttgggagcgcgctggga

SEQ ID NO: 214990 - DNA, 22 bp, Artificial Sequence
  Description of Artificial Sequence: Synthetic oligonucleotide
ggagttgggagcgcgctgggac

SEQ ID NO: 214991 - DNA, 22 bp, Artificial Sequence
  Description of Artificial Sequence: Synthetic oligonucleotide
gagttgggagcgcgctgggacg

SEQ ID NO: 214992 - DNA, 22 bp, Artificial Sequence
  Description of Artificial Sequence: Synthetic oligonucleotide
agttgggagcgcgctgggacgc

SEQ ID NO: 214993 - DNA, 21 bp, Artificial Sequence
  Description of Artificial Sequence: Synthetic oligonucleotide
gttgggagcgcgctgggacgc

SEQ ID NO: 214994 - DNA, 21 bp, Artificial Sequence
  Description of Artificial Sequence: Synthetic oligonucleotide
ttgggagcgcgctgggacgcc

SEQ ID NO: 214995 - DNA, 20 bp, Artificial Sequence
  Description of Artificial Sequence: Synthetic oligonucleotide
tgggagcgcgctgggacgcc

SEQ ID NO: 214996 - DNA, 20 bp, Artificial Sequence
  Description of Artificial Sequence: Synthetic oligonucleotide
gggagcgcgctgggacgcct

SEQ ID NO: 214997 - DNA, 20 bp, Artificial Sequence
  Description of Artificial Sequence: Synthetic oligonucleotide
ggagcgcgctgggacgccgt

SEQ ID NO: 214998 - DNA, 20 bp, Artificial Sequence
  Description of Artificial Sequence: Synthetic oligonucleotide
gagcgcgctgggacgccgga

SEQ ID NO: 214999 - DNA, 23 bp, Artificial Sequence
  Description of Artificial Sequence: Synthetic oligonucleotide
agcgcgctgggacgccggactaa

SEQ ID NO: 215000 - DNA, 22 bp, Artificial Sequence
  Description of Artificial Sequence: Synthetic oligonucleotide
gcgcgctgggacgccggactaa

SEQ ID NO: 215001 - DNA, 22 bp, Artificial Sequence
  Description of Artificial Sequence: Synthetic oligonucleotide
cgcgctgggacgccggactaag

SEQ ID NO: 215002 - DNA, 22 bp, Artificial Sequence
  Description of Artificial Sequence: Synthetic oligonucleotide
gcgctgggacgccggactaagc

SEQ ID NO: 215003 - DNA, 22 bp, Artificial Sequence
  Description of Artificial Sequence: Synthetic oligonucleotide
cgctgggacgccggactaagcg

SEQ ID NO: 215004 - DNA, 22 bp, Artificial Sequence
  Description of Artificial Sequence: Synthetic oligonucleotide
gctgggacgccggactaagcgg

SEQ ID NO: 215005 - DNA, 22 bp, Artificial Sequence
  Description of Artificial Sequence: Synthetic oligonucleotide
ctgggacgccggactaagcggg

SEQ ID NO: 215006 - DNA, 22 bp, Artificial Sequence
  Description of Artificial Sequence: Synthetic oligonucleotide
tgggacgccggactaagcgggc

SEQ ID NO: 215007 - DNA, 21 bp, Artificial Sequence
  Description of Artificial Sequence: Synthetic oligonucleotide
gggacgccggactaagcgggc

SEQ ID NO: 215008 - DNA, 21 bp, Artificial Sequence
  Description of Artificial Sequence: Synthetic oligonucleotide
ggacgccggactaagcgggcg

SEQ ID NO: 215009 - DNA, 24 bp, Artificial Sequence
  Description of Artificial Sequence: Synthetic oligonucleotide
gacgccggactaagcgggcgcaaa

SEQ ID NO: 215010 - DNA, 24 bp, Artificial Sequence
  Description of Artificial Sequence: Synthetic oligonucleotide
acgccggactaagcgggcgcaaag

SEQ ID NO: 215011 - DNA, 23 bp, Artificial Sequence
  Description of Artificial Sequence: Synthetic oligonucleotide
cgccggactaagcgggcgcaaag

SEQ ID NO: 215012 - DNA, 23 bp, Artificial Sequence
  Description of Artificial Sequence: Synthetic oligonucleotide
gccggactaagcgggcgcaaagc

SEQ ID NO: 215013 - DNA, 23 bp, Artificial Sequence
  Description of Artificial Sequence: Synthetic oligonucleotide
ccggactaagcgggcgcaaagcc

SEQ ID NO: 215014 - DNA, 23 bp, Artificial Sequence
  Description of Artificial Sequence: Synthetic oligonucleotide
cggactaagcgggcgcaaagccc

SEQ ID NO: 215015 - DNA, 25 bp, Artificial Sequence
  Description of Artificial Sequence: Synthetic oligonucleotide
ggactaagcgggcgcaaagccccaa

SEQ ID NO: 215016 - DNA, 25 bp, Artificial Sequence
  Description of Artificial Sequence: Synthetic oligonucleotide
gactaagcgggcgcaaagccccaag

SEQ ID NO: 215017 - DNA, 25 bp, Artificial Sequence
  Description of Artificial Sequence: Synthetic oligonucleotide
actaagcgggcgcaaagccccaagg

SEQ ID NO: 215018 - DNA, 24 bp, Artificial Sequence
  Description of Artificial Sequence: Synthetic oligonucleotide
ctaagcgggcgcaaagccccaagg

SEQ ID NO: 215019 - DNA, 26 bp, Artificial Sequence
  Description of Artificial Sequence: Synthetic oligonucleotide
taagcgggcgcaaagccccaagggta

SEQ ID NO: 215020 - DNA, 25 bp, Artificial Sequence
  Description of Artificial Sequence: Synthetic oligonucleotide
aagcgggcgcaaagccccaagggta

SEQ ID NO: 215021 - DNA, 24 bp, Artificial Sequence
  Description of Artificial Sequence: Synthetic oligonucleotide
agcgggcgcaaagccccaagggta

SEQ ID NO: 215022 - DNA, 23 bp, Artificial Sequence
  Description of Artificial Sequence: Synthetic oligonucleotide
gcgggcgcaaagccccaagggta

SEQ ID NO: 215023 - DNA, 23 bp, Artificial Sequence
  Description of Artificial Sequence: Synthetic oligonucleotide
cgggcgcaaagccccaagggtag

SEQ ID NO: 215024 - DNA, 23 bp, Artificial Sequence
  Description of Artificial Sequence: Synthetic oligonucleotide
gggcgcaaagccccaagggtagc

SEQ ID NO: 215025 - DNA, 23 bp, Artificial Sequence
  Description of Artificial Sequence: Synthetic oligonucleotide
ggcgcaaagccccaagggtagcc

SEQ ID NO: 215026 - DNA, 24 bp, Artificial Sequence
  Description of Artificial Sequence: Synthetic oligonucleotide
gcgcaaagccccaagggtagccct

SEQ ID NO: 215027 - DNA, 25 bp, Artificial Sequence
  Description of Artificial Sequence: Synthetic oligonucleotide
cgcaaagccccaagggtagccctct

SEQ ID NO: 215028 - DNA, 25 bp, Artificial Sequence
  Description of Artificial Sequence: Synthetic oligonucleotide
gcaaagccccaagggtagccctctc

SEQ ID NO: 215029 - DNA, 25 bp, Artificial Sequence
  Description of Artificial Sequence: Synthetic oligonucleotide
caaagccccaagggtagccctctcg

SEQ ID NO: 215030 - DNA, 25 bp, Artificial Sequence
  Description of Artificial Sequence: Synthetic oligonucleotide
aaagccccaagggtagccctctcgc

SEQ ID NO: 215031 - DNA, 24 bp, Artificial Sequence
  Description of Artificial Sequence: Synthetic oligonucleotide
aagccccaagggtagccctctcgc

SEQ ID NO: 215032 - DNA, 23 bp, Artificial Sequence
  Description of Artificial Sequence: Synthetic oligonucleotide
agccccaagggtagccctctcgc

SEQ ID NO: 215033 - DNA, 22 bp, Artificial Sequence
  Description of Artificial Sequence: Synthetic oligonucleotide
gccccaagggtagccctctcgc

SEQ ID NO: 215034 - DNA, 22 bp, Artificial Sequence
  Description of Artificial Sequence: Synthetic oligonucleotide
ccccaagggtagccctctcgcg

SEQ ID NO: 215035 - DNA, 22 bp, Artificial Sequence
  Description of Artificial Sequence: Synthetic oligonucleotide
cccaagggtagccctctcgcgc

SEQ ID NO: 215036 - DNA, 22 bp, Artificial Sequence
  Description of Artificial Sequence: Synthetic oligonucleotide
ccaagggtagccctctcgcgcc

SEQ ID NO: 215037 - DNA, 23 bp, Artificial Sequence
  Description of Artificial Sequence: Synthetic oligonucleotide
caagggtagccctctcgcgccct

SEQ ID NO: 215038 - DNA, 23 bp, Artificial Sequence
  Description of Artificial Sequence: Synthetic oligonucleotide
aagggtagccctctcgcgccctc

SEQ ID NO: 215039 - DNA, 22 bp, Artificial Sequence
  Description of Artificial Sequence: Synthetic oligonucleotide
agggtagccctctcgcgccctc

SEQ ID NO: 215040 - DNA, 21 bp, Artificial Sequence
  Description of Artificial Sequence: Synthetic oligonucleotide
gggtagccctctcgcgccctc

SEQ ID NO: 215041 - DNA, 21 bp, Artificial Sequence
  Description of Artificial Sequence: Synthetic oligonucleotide
ggtagccctctcgcgccctcc

SEQ ID NO: 215042 - DNA, 21 bp, Artificial Sequence
  Description of Artificial Sequence: Synthetic oligonucleotide
gtagccctctcgcgccctccg

SEQ ID NO: 215043 - DNA, 21 bp, Artificial Sequence
  Description of Artificial Sequence: Synthetic oligonucleotide
tagccctctcgcgccctccgg

SEQ ID NO: 215044 - DNA, 20 bp, Artificial Sequence
  Description of Artificial Sequence: Synthetic oligonucleotide
agccctctcgcgccctccgg

SEQ ID NO: 215045 - DNA, 20 bp, Artificial Sequence
  Description of Artificial Sequence: Synthetic oligonucleotide
gccctctcgcgccctccggt

SEQ ID NO: 215046 - DNA, 20 bp, Artificial Sequence
  Description of Artificial Sequence: Synthetic oligonucleotide
ccctctcgcgccctccggga

SEQ ID NO: 215047 - DNA, 20 bp, Artificial Sequence
  Description of Artificial Sequence: Synthetic oligonucleotide
cctctcgcgccctccgggac

SEQ ID NO: 215048 - DNA, 21 bp, Artificial Sequence
  Description of Artificial Sequence: Synthetic oligonucleotide
ctctcgcgccctccgggacct

SEQ ID NO: 215049 - DNA, 22 bp, Artificial Sequence
  Description of Artificial Sequence: Synthetic oligonucleotide
tctcgcgccctccgggacctca

SEQ ID NO: 215050 - DNA, 21 bp, Artificial Sequence
  Description of Artificial Sequence: Synthetic oligonucleotide
ctcgcgccctccgggacctca

SEQ ID NO: 215051 - DNA, 22 bp, Artificial Sequence
  Description of Artificial Sequence: Synthetic oligonucleotide
tcgcgccctccgggacctcagt

SEQ ID NO: 215052 - DNA, 21 bp, Artificial Sequence
  Description of Artificial Sequence: Synthetic oligonucleotide
cgcgccctccgggacctcagt

SEQ ID NO: 215053 - DNA, 21 bp, Artificial Sequence
  Description of Artificial Sequence: Synthetic oligonucleotide
gcgccctccgggacctcagtg

SEQ ID NO: 215054 - DNA, 21 bp, Artificial Sequence
  Description of Artificial Sequence: Synthetic oligonucleotide
cgccctccgggacctcagtgc

SEQ ID NO: 215055 - DNA, 21 bp, Artificial Sequence
  Description of Artificial Sequence: Synthetic oligonucleotide
gccctccgggacctcagtgcc

SEQ ID NO: 215056 - DNA, 23 bp, Artificial Sequence
  Description of Artificial Sequence: Synthetic oligonucleotide
ccctccgggacctcagtgccctt

SEQ ID NO: 215057 - DNA, 24 bp, Artificial Sequence
  Description of Artificial Sequence: Synthetic oligonucleotide
cctccgggacctcagtgcccttct

SEQ ID NO: 215058 - DNA, 24 bp, Artificial Sequence
  Description of Artificial Sequence: Synthetic oligonucleotide
ctccgggacctcagtgcccttctg

SEQ ID NO: 215059 - DNA, 24 bp, Artificial Sequence
  Description of Artificial Sequence: Synthetic oligonucleotide
tccgggacctcagtgcccttctgg

SEQ ID NO: 215060 - DNA, 23 bp, Artificial Sequence
  Description of Artificial Sequence: Synthetic oligonucleotide
ccgggacctcagtgcccttctgg

SEQ ID NO: 215061 - DNA, 24 bp, Artificial Sequence
  Description of Artificial Sequence: Synthetic oligonucleotide
cgggacctcagtgcccttctgggt

SEQ ID NO: 215062 - DNA, 24 bp, Artificial Sequence
  Description of Artificial Sequence: Synthetic oligonucleotide
gggacctcagtgcccttctgggtg

SEQ ID NO: 215063 - DNA, 24 bp, Artificial Sequence
  Description of Artificial Sequence: Synthetic oligonucleotide
ggacctcagtgcccttctgggtgc

SEQ ID NO: 215064 - DNA, 24 bp, Artificial Sequence
  Description of Artificial Sequence: Synthetic oligonucleotide
gacctcagtgcccttctgggtgcg

SEQ ID NO: 215065 - DNA, 26 bp, Artificial Sequence
  Description of Artificial Sequence: Synthetic oligonucleotide
acctcagtgcccttctgggtgcgcat

SEQ ID NO: 215066 - DNA, 25 bp, Artificial Sequence
  Description of Artificial Sequence: Synthetic oligonucleotide
cctcagtgcccttctgggtgcgcat

SEQ ID NO: 215067 - DNA, 26 bp, Artificial Sequence
  Description of Artificial Sequence: Synthetic oligonucleotide
ctcagtgcccttctgggtgcgcatga

SEQ ID NO: 215068 - DNA, 26 bp, Artificial Sequence
  Description of Artificial Sequence: Synthetic oligonucleotide
tcagtgcccttctgggtgcgcatgag

SEQ ID NO: 215069 - DNA, 25 bp, Artificial Sequence
  Description of Artificial Sequence: Synthetic oligonucleotide
cagtgcccttctgggtgcgcatgag

SEQ ID NO: 215070 - DNA, 25 bp, Artificial Sequence
  Description of Artificial Sequence: Synthetic oligonucleotide
agtgcccttctgggtgcgcatgagc

SEQ ID NO: 215071 - DNA, 24 bp, Artificial Sequence
  Description of Artificial Sequence: Synthetic oligonucleotide
gtgcccttctgggtgcgcatgagc

SEQ ID NO: 215072 - DNA, 24 bp, Artificial Sequence
  Description of Artificial Sequence: Synthetic oligonucleotide
tgcccttctgggtgcgcatgagcc

SEQ ID NO: 215073 - DNA, 23 bp, Artificial Sequence
  Description of Artificial Sequence: Synthetic oligonucleotide
gcccttctgggtgcgcatgagcc

SEQ ID NO: 215074 - DNA, 23 bp, Artificial Sequence
  Description of Artificial Sequence: Synthetic oligonucleotide
cccttctgggtgcgcatgagccc

SEQ ID NO: 215075 - DNA, 23 bp, Artificial Sequence
  Description of Artificial Sequence: Synthetic oligonucleotide
ccttctgggtgcgcatgagcccg

SEQ ID NO: 215076 - DNA, 24 bp, Artificial Sequence
  Description of Artificial Sequence: Synthetic oligonucleotide
cttctgggtgcgcatgagcccgga

SEQ ID NO: 215077 - DNA, 26 bp, Artificial Sequence
  Description of Artificial Sequence: Synthetic oligonucleotide
ttctgggtgcgcatgagcccggagtt

SEQ ID NO: 215078 - DNA, 25 bp, Artificial Sequence
  Description of Artificial Sequence: Synthetic oligonucleotide
tctgggtgcgcatgagcccggagtt

SEQ ID NO: 215079 - DNA, 24 bp, Artificial Sequence
  Description of Artificial Sequence: Synthetic oligonucleotide
ctgggtgcgcatgagcccggagtt

SEQ ID NO: 215080 - DNA, 24 bp, Artificial Sequence
  Description of Artificial Sequence: Synthetic oligonucleotide
tgggtgcgcatgagcccggagttc

SEQ ID NO: 215081 - DNA, 23 bp, Artificial Sequence
  Description of Artificial Sequence: Synthetic oligonucleotide
gggtgcgcatgagcccggagttc

SEQ ID NO: 215082 - DNA, 24 bp, Artificial Sequence
  Description of Artificial Sequence: Synthetic oligonucleotide
ggtgcgcatgagcccggagttcgt

SEQ ID NO: 215083 - DNA, 24 bp, Artificial Sequence
  Description of Artificial Sequence: Synthetic oligonucleotide
gtgcgcatgagcccggagttcgtg

SEQ ID NO: 215084 - DNA, 24 bp, Artificial Sequence
  Description of Artificial Sequence: Synthetic oligonucleotide
tgcgcatgagcccggagttcgtgg

SEQ ID NO: 215085 - DNA, 23 bp, Artificial Sequence
  Description of Artificial Sequence: Synthetic oligonucleotide
gcgcatgagcccggagttcgtgg

SEQ ID NO: 215086 - DNA, 24 bp, Artificial Sequence
  Description of Artificial Sequence: Synthetic oligonucleotide
cgcatgagcccggagttcgtggct

SEQ ID NO: 215087 - DNA, 25 bp, Artificial Sequence
  Description of Artificial Sequence: Synthetic oligonucleotide
gcatgagcccggagttcgtggctgt

SEQ ID NO: 215088 - DNA, 25 bp, Artificial Sequence
  Description of Artificial Sequence: Synthetic oligonucleotide
catgagcccggagttcgtggctgtg

SEQ ID NO: 215089 - DNA, 26 bp, Artificial Sequence
  Description of Artificial Sequence: Synthetic oligonucleotide
atgagcccggagttcgtggctgtgca

SEQ ID NO: 215090 - DNA, 25 bp, Artificial Sequence
  Description of Artificial Sequence: Synthetic oligonucleotide
tgagcccggagttcgtggctgtgca

SEQ ID NO: 215091 - DNA, 24 bp, Artificial Sequence
  Description of Artificial Sequence: Synthetic oligonucleotide
gagcccggagttcgtggctgtgca

SEQ ID NO: 215092 - DNA, 24 bp, Artificial Sequence
  Description of Artificial Sequence: Synthetic oligonucleotide
agcccggagttcgtggctgtgcag

SEQ ID NO: 215093 - DNA, 23 bp, Artificial Sequence
  Description of Artificial Sequence: Synthetic oligonucleotide
gcccggagttcgtggctgtgcag

SEQ ID NO: 215094 - DNA, 23 bp, Artificial Sequence
  Description of Artificial Sequence: Synthetic oligonucleotide
cccggagttcgtggctgtgcagc

SEQ ID NO: 215095 - DNA, 23 bp, Artificial Sequence
  Description of Artificial Sequence: Synthetic oligonucleotide
ccggagttcgtggctgtgcagcc

SEQ ID NO: 215096 - DNA, 23 bp, Artificial Sequence
  Description of Artificial Sequence: Synthetic oligonucleotide
cggagttcgtggctgtgcagccg

SEQ ID NO: 215097 - DNA, 23 bp, Artificial Sequence
  Description of Artificial Sequence: Synthetic oligonucleotide
ggagttcgtggctgtgcagccgg

SEQ ID NO: 215098 - DNA, 23 bp, Artificial Sequence
  Description of Artificial Sequence: Synthetic oligonucleotide
gagttcgtggctgtgcagccggg

SEQ ID NO: 215099 - DNA, 25 bp, Artificial Sequence
  Description of Artificial Sequence: Synthetic oligonucleotide
agttcgtggctgtgcagccggggaa

SEQ ID NO: 215100 - DNA, 24 bp, Artificial Sequence
  Description of Artificial Sequence: Synthetic oligonucleotide
gttcgtggctgtgcagccggggaa

SEQ ID NO: 215101 - DNA, 25 bp, Artificial Sequence
  Description of Artificial Sequence: Synthetic oligonucleotide
ttcgtggctgtgcagccggggaagt

SEQ ID NO: 215102 - DNA, 24 bp, Artificial Sequence
  Description of Artificial Sequence: Synthetic oligonucleotide
tcgtggctgtgcagccggggaagt

SEQ ID NO: 215103 - DNA, 23 bp, Artificial Sequence
  Description of Artificial Sequence: Synthetic oligonucleotide
cgtggctgtgcagccggggaagt

SEQ ID NO: 215104 - DNA, 24 bp, Artificial Sequence
  Description of Artificial Sequence: Synthetic oligonucleotide
gtggctgtgcagccggggaagtca

SEQ ID NO: 215105 - DNA, 25 bp, Artificial Sequence
  Description of Artificial Sequence: Synthetic oligonucleotide
tggctgtgcagccggggaagtcagt

SEQ ID NO: 215106 - DNA, 24 bp, Artificial Sequence
  Description of Artificial Sequence: Synthetic oligonucleotide
ggctgtgcagccggggaagtcagt

SEQ ID NO: 215107 - DNA, 24 bp, Artificial Sequence
  Description of Artificial Sequence: Synthetic oligonucleotide
gctgtgcagccggggaagtcagtg

SEQ ID NO: 215108 - DNA, 25 bp, Artificial Sequence
  Description of Artificial Sequence: Synthetic oligonucleotide
ctgtgcagccggggaagtcagtgca

SEQ ID NO: 215109 - DNA, 25 bp, Artificial Sequence
  Description of Artificial Sequence: Synthetic oligonucleotide
tgtgcagccggggaagtcagtgcag

SEQ ID NO: 215110 - DNA, 24 bp, Artificial Sequence
  Description of Artificial Sequence: Synthetic oligonucleotide
gtgcagccggggaagtcagtgcag

SEQ ID NO: 215111 - DNA, 25 bp, Artificial Sequence
  Description of Artificial Sequence: Synthetic oligonucleotide
tgcagccggggaagtcagtgcagct

SEQ ID NO: 215112 - DNA, 24 bp, Artificial Sequence
  Description of Artificial Sequence: Synthetic oligonucleotide
gcagccggggaagtcagtgcagct

SEQ ID NO: 215113 - DNA, 27 bp, Artificial Sequence
  Description of Artificial Sequence: Synthetic oligonucleotide
cagccggggaagtcagtgcagctcaat

SEQ ID NO: 215114 - DNA, 28 bp, Artificial Sequence
  Description of Artificial Sequence: Synthetic oligonucleotide
agccggggaagtcagtgcagctcaattg

SEQ ID NO: 215115 - DNA, 27 bp, Artificial Sequence
  Description of Artificial Sequence: Synthetic oligonucleotide
gccggggaagtcagtgcagctcaattg

SEQ ID NO: 215116 - DNA, 27 bp, Artificial Sequence
  Description of Artificial Sequence: Synthetic oligonucleotide
ccggggaagtcagtgcagctcaattgc

SEQ ID NO: 215117 - DNA, 28 bp, Artificial Sequence
  Description of Artificial Sequence: Synthetic oligonucleotide
cggggaagtcagtgcagctcaattgcag

SEQ ID NO: 215118 - DNA, 28 bp, Artificial Sequence
  Description of Artificial Sequence: Synthetic oligonucleotide
ggggaagtcagtgcagctcaattgcagc

SEQ ID NO: 215119 - DNA, 30 bp, Artificial Sequence
  Description of Artificial Sequence: Synthetic oligonucleotide
gggaagtcagtgcagctcaattgcagcaac

SEQ ID NO: 215120 - DNA, 31 bp, Artificial Sequence
  Description of Artificial Sequence: Synthetic oligonucleotide
ggaagtcagtgcagctcaattgcagcaacag

SEQ ID NO: 215121 - DNA, 31 bp, Artificial Sequence
  Description of Artificial Sequence: Synthetic oligonucleotide
gaagtcagtgcagctcaattgcagcaacagc

SEQ ID NO: 215122 - DNA, 32 bp, Artificial Sequence
  Description of Artificial Sequence: Synthetic oligonucleotide
aagtcagtgcagctcaattgcagcaacagctg

SEQ ID NO: 215123 - DNA, 31 bp, Artificial Sequence
  Description of Artificial Sequence: Synthetic oligonucleotide
agtcagtgcagctcaattgcagcaacagctg

SEQ ID NO: 215124 - DNA, 30 bp, Artificial Sequence
  Description of Artificial Sequence: Synthetic oligonucleotide
gtcagtgcagctcaattgcagcaacagctg

SEQ ID NO: 215125 - DNA, 31 bp, Artificial Sequence
  Description of Artificial Sequence: Synthetic oligonucleotide
tcagtgcagctcaattgcagcaacagctgtc

SEQ ID NO: 215126 - DNA, 30 bp, Artificial Sequence
  Description of Artificial Sequence: Synthetic oligonucleotide
cagtgcagctcaattgcagcaacagctgtc

SEQ ID NO: 215127 - DNA, 30 bp, Artificial Sequence
  Description of Artificial Sequence: Synthetic oligonucleotide
agtgcagctcaattgcagcaacagctgtcc

SEQ ID NO: 215128 - DNA, 29 bp, Artificial Sequence
  Description of Artificial Sequence: Synthetic oligonucleotide
gtgcagctcaattgcagcaacagctgtcc

SEQ ID NO: 215129 - DNA, 29 bp, Artificial Sequence
  Description of Artificial Sequence: Synthetic oligonucleotide
tgcagctcaattgcagcaacagctgtccc

SEQ ID NO: 215130 - DNA, 28 bp, Artificial Sequence
  Description of Artificial Sequence: Synthetic oligonucleotide
gcagctcaattgcagcaacagctgtccc

SEQ ID NO: 215131 - DNA, 28 bp, Artificial Sequence
  Description of Artificial Sequence: Synthetic oligonucleotide
cagctcaattgcagcaacagctgtcccc

SEQ ID NO: 215132 - DNA, 29 bp, Artificial Sequence
  Description of Artificial Sequence: Synthetic oligonucleotide
agctcaattgcagcaacagctgtccccag

SEQ ID NO: 215133 - DNA, 28 bp, Artificial Sequence
  Description of Artificial Sequence: Synthetic oligonucleotide
gctcaattgcagcaacagctgtccccag

SEQ ID NO: 215134 - DNA, 28 bp, Artificial Sequence
  Description of Artificial Sequence: Synthetic oligonucleotide
ctcaattgcagcaacagctgtccccagc

SEQ ID NO: 215135 - DNA, 28 bp, Artificial Sequence
  Description of Artificial Sequence: Synthetic oligonucleotide
tcaattgcagcaacagctgtccccagcc

SEQ ID NO: 215136 - DNA, 27 bp, Artificial Sequence
  Description of Artificial Sequence: Synthetic oligonucleotide
caattgcagcaacagctgtccccagcc

SEQ ID NO: 215137 - DNA, 27 bp, Artificial Sequence
  Description of Artificial Sequence: Synthetic oligonucleotide
aattgcagcaacagctgtccccagccg

SEQ ID NO: 215138 - DNA, 26 bp, Artificial Sequence
  Description of Artificial Sequence: Synthetic oligonucleotide
attgcagcaacagctgtccccagccg

SEQ ID NO: 215139 - DNA, 25 bp, Artificial Sequence
  Description of Artificial Sequence: Synthetic oligonucleotide
ttgcagcaacagctgtccccagccg

SEQ ID NO: 215140 - DNA, 24 bp, Artificial Sequence
  Description of Artificial Sequence: Synthetic oligonucleotide
tgcagcaacagctgtccccagccg

SEQ ID NO: 215141 - DNA, 23 bp, Artificial Sequence
  Description of Artificial Sequence: Synthetic oligonucleotide
gcagcaacagctgtccccagccg

SEQ ID NO: 215142 - DNA, 24 bp, Artificial Sequence
  Description of Artificial Sequence: Synthetic oligonucleotide
cagcaacagctgtccccagccgca

SEQ ID NO: 215143 - DNA, 27 bp, Artificial Sequence
  Description of Artificial Sequence: Synthetic oligonucleotide
agcaacagctgtccccagccgcagaat

SEQ ID NO: 215144 - DNA, 27 bp, Artificial Sequence
  Description of Artificial Sequence: Synthetic oligonucleotide
gcaacagctgtccccagccgcagaatt

SEQ ID NO: 215145 - DNA, 27 bp, Artificial Sequence
  Description of Artificial Sequence: Synthetic oligonucleotide
caacagctgtccccagccgcagaattc

SEQ ID NO: 215146 - DNA, 27 bp, Artificial Sequence
  Description of Artificial Sequence: Synthetic oligonucleotide
aacagctgtccccagccgcagaattcc

SEQ ID NO: 215147 - DNA, 27 bp, Artificial Sequence
  Description of Artificial Sequence: Synthetic oligonucleotide
acagctgtccccagccgcagaattcca

SEQ ID NO: 215148 - DNA, 26 bp, Artificial Sequence
  Description of Artificial Sequence: Synthetic oligonucleotide
cagctgtccccagccgcagaattcca

SEQ ID NO: 215149 - DNA, 26 bp, Artificial Sequence
  Description of Artificial Sequence: Synthetic oligonucleotide
agctgtccccagccgcagaattccag

SEQ ID NO: 215150 - DNA, 25 bp, Artificial Sequence
  Description of Artificial Sequence: Synthetic oligonucleotide
gctgtccccagccgcagaattccag

SEQ ID NO: 215151 - DNA, 25 bp, Artificial Sequence
  Description of Artificial Sequence: Synthetic oligonucleotide
ctgtccccagccgcagaattccagc

SEQ ID NO: 215152 - DNA, 26 bp, Artificial Sequence
  Description of Artificial Sequence: Synthetic oligonucleotide
tgtccccagccgcagaattccagcct

SEQ ID NO: 215153 - DNA, 25 bp, Artificial Sequence
  Description of Artificial Sequence: Synthetic oligonucleotide
gtccccagccgcagaattccagcct

SEQ ID NO: 215154 - DNA, 25 bp, Artificial Sequence
  Description of Artificial Sequence: Synthetic oligonucleotide
tccccagccgcagaattccagcctc

SEQ ID NO: 215155 - DNA, 24 bp, Artificial Sequence
  Description of Artificial Sequence: Synthetic oligonucleotide
ccccagccgcagaattccagcctc

SEQ ID NO: 215156 - DNA, 24 bp, Artificial Sequence
  Description of Artificial Sequence: Synthetic oligonucleotide
cccagccgcagaattccagcctcc

SEQ ID NO: 215157 - DNA, 24 bp, Artificial Sequence
  Description of Artificial Sequence: Synthetic oligonucleotide
ccagccgcagaattccagcctccg

SEQ ID NO: 215158 - DNA, 25 bp, Artificial Sequence
  Description of Artificial Sequence: Synthetic oligonucleotide
cagccgcagaattccagcctccgca

SEQ ID NO: 215159 - DNA, 25 bp, Artificial Sequence
  Description of Artificial Sequence: Synthetic oligonucleotide
agccgcagaattccagcctccgcac

SEQ ID NO: 215160 - DNA, 24 bp, Artificial Sequence
  Description of Artificial Sequence: Synthetic oligonucleotide
gccgcagaattccagcctccgcac

SEQ ID NO: 215161 - DNA, 24 bp, Artificial Sequence
  Description of Artificial Sequence: Synthetic oligonucleotide
ccgcagaattccagcctccgcacc

SEQ ID NO: 215162 - DNA, 24 bp, Artificial Sequence
  Description of Artificial Sequence: Synthetic oligonucleotide
cgcagaattccagcctccgcaccc

SEQ ID NO: 215163 - DNA, 24 bp, Artificial Sequence
  Description of Artificial Sequence: Synthetic oligonucleotide
gcagaattccagcctccgcacccc

SEQ ID NO: 215164 - DNA, 24 bp, Artificial Sequence
  Description of Artificial Sequence: Synthetic oligonucleotide
cagaattccagcctccgcaccccg

SEQ ID NO: 215165 - DNA, 25 bp, Artificial Sequence
  Description of Artificial Sequence: Synthetic oligonucleotide
agaattccagcctccgcaccccgct

SEQ ID NO: 215166 - DNA, 24 bp, Artificial Sequence
  Description of Artificial Sequence: Synthetic oligonucleotide
gaattccagcctccgcaccccgct

SEQ ID NO: 215167 - DNA, 24 bp, Artificial Sequence
  Description of Artificial Sequence: Synthetic oligonucleotide
aattccagcctccgcaccccgctg

SEQ ID NO: 215168 - DNA, 23 bp, Artificial Sequence
  Description of Artificial Sequence: Synthetic oligonucleotide
attccagcctccgcaccccgctg

SEQ ID NO: 215169 - DNA, 22 bp, Artificial Sequence
  Description of Artificial Sequence: Synthetic oligonucleotide
ttccagcctccgcaccccgctg

SEQ ID NO: 215170 - DNA, 21 bp, Artificial Sequence
  Description of Artificial Sequence: Synthetic oligonucleotide
tccagcctccgcaccccgctg

SEQ ID NO: 215171 - DNA, 20 bp, Artificial Sequence
  Description of Artificial Sequence: Synthetic oligonucleotide
ccagcctccgcaccccgctg

SEQ ID NO: 215172 - DNA, 20 bp, Artificial Sequence
  Description of Artificial Sequence: Synthetic oligonucleotide
cagcctccgcaccccgctgc

SEQ ID NO: 215173 - DNA, 20 bp, Artificial Sequence
  Description of Artificial Sequence: Synthetic oligonucleotide
agcctccgcaccccgctgcg

SEQ ID NO: 215174 - DNA, 20 bp, Artificial Sequence
  Description of Artificial Sequence: Synthetic oligonucleotide
gcctccgcaccccgctgcgt

SEQ ID NO: 215175 - DNA, 20 bp, Artificial Sequence
  Description of Artificial Sequence: Synthetic oligonucleotide
cctccgcaccccgctgcggt

SEQ ID NO: 215176 - DNA, 21 bp, Artificial Sequence
  Description of Artificial Sequence: Synthetic oligonucleotide
ctccgcaccccgctgcggcaa

SEQ ID NO: 215177 - DNA, 21 bp, Artificial Sequence
  Description of Artificial Sequence: Synthetic oligonucleotide
tccgcaccccgctgcggcaag

SEQ ID NO: 215178 - DNA, 20 bp, Artificial Sequence
  Description of Artificial Sequence: Synthetic oligonucleotide
ccgcaccccgctgcggcaag

SEQ ID NO: 215179 - DNA, 20 bp, Artificial Sequence
  Description of Artificial Sequence: Synthetic oligonucleotide
cgcaccccgctgcggcaagg

SEQ ID NO: 215180 - DNA, 22 bp, Artificial Sequence
  Description of Artificial Sequence: Synthetic oligonucleotide
gcaccccgctgcggcaaggcaa

SEQ ID NO: 215181 - DNA, 23 bp, Artificial Sequence
  Description of Artificial Sequence: Synthetic oligonucleotide
caccccgctgcggcaaggcaaga

SEQ ID NO: 215182 - DNA, 23 bp, Artificial Sequence
  Description of Artificial Sequence: Synthetic oligonucleotide
accccgctgcggcaaggcaagac

SEQ ID NO: 215183 - DNA, 22 bp, Artificial Sequence
  Description of Artificial Sequence: Synthetic oligonucleotide
ccccgctgcggcaaggcaagac

SEQ ID NO: 215184 - DNA, 22 bp, Artificial Sequence
  Description of Artificial Sequence: Synthetic oligonucleotide
cccgctgcggcaaggcaagacg

SEQ ID NO: 215185 - DNA, 23 bp, Artificial Sequence
  Description of Artificial Sequence: Synthetic oligonucleotide
ccgctgcggcaaggcaagacgct

SEQ ID NO: 215186 - DNA, 24 bp, Artificial Sequence
  Description of Artificial Sequence: Synthetic oligonucleotide
cgctgcggcaaggcaagacgctca

SEQ ID NO: 215187 - DNA, 25 bp, Artificial Sequence
  Description of Artificial Sequence: Synthetic oligonucleotide
gctgcggcaaggcaagacgctcaga

SEQ ID NO: 215188 - DNA, 25 bp, Artificial Sequence
  Description of Artificial Sequence: Synthetic oligonucleotide
ctgcggcaaggcaagacgctcagag

SEQ ID NO: 215189 - DNA, 25 bp, Artificial Sequence
  Description of Artificial Sequence: Synthetic oligonucleotide
tgcggcaaggcaagacgctcagagg

SEQ ID NO: 215190 - DNA, 24 bp, Artificial Sequence
  Description of Artificial Sequence: Synthetic oligonucleotide
gcggcaaggcaagacgctcagagg

SEQ ID NO: 215191 - DNA, 24 bp, Artificial Sequence
  Description of Artificial Sequence: Synthetic oligonucleotide
cggcaaggcaagacgctcagaggg

SEQ ID NO: 215192 - DNA, 24 bp, Artificial Sequence
  Description of Artificial Sequence: Synthetic oligonucleotide
ggcaaggcaagacgctcagagggc

SEQ ID NO: 215193 - DNA, 24 bp, Artificial Sequence
  Description of Artificial Sequence: Synthetic oligonucleotide
gcaaggcaagacgctcagagggcc

SEQ ID NO: 215194 - DNA, 24 bp, Artificial Sequence
  Description of Artificial Sequence: Synthetic oligonucleotide
caaggcaagacgctcagagggccg

SEQ ID NO: 215195 - DNA, 24 bp, Artificial Sequence
  Description of Artificial Sequence: Synthetic oligonucleotide
aaggcaagacgctcagagggccgg

SEQ ID NO: 215196 - DNA, 23 bp, Artificial Sequence
  Description of Artificial Sequence: Synthetic oligonucleotide
aggcaagacgctcagagggccgg

SEQ ID NO: 215197 - DNA, 22 bp, Artificial Sequence
  Description of Artificial Sequence: Synthetic oligonucleotide
ggcaagacgctcagagggccgg

SEQ ID NO: 215198 - DNA, 24 bp, Artificial Sequence
  Description of Artificial Sequence: Synthetic oligonucleotide
gcaagacgctcagagggccgggtt

SEQ ID NO: 215199 - DNA, 24 bp, Artificial Sequence
  Description of Artificial Sequence: Synthetic oligonucleotide
caagacgctcagagggccgggttg

SEQ ID NO: 215200 - DNA, 24 bp, Artificial Sequence
  Description of Artificial Sequence: Synthetic oligonucleotide
aagacgctcagagggccgggttgg

SEQ ID NO: 215201 - DNA, 23 bp, Artificial Sequence
  Description of Artificial Sequence: Synthetic oligonucleotide
agacgctcagagggccgggttgg

SEQ ID NO: 215202 - DNA, 22 bp, Artificial Sequence
  Description of Artificial Sequence: Synthetic oligonucleotide
gacgctcagagggccgggttgg

SEQ ID NO: 215203 - DNA, 23 bp, Artificial Sequence
  Description of Artificial Sequence: Synthetic oligonucleotide
acgctcagagggccgggttgggt

SEQ ID NO: 215204 - DNA, 22 bp, Artificial Sequence
  Description of Artificial Sequence: Synthetic oligonucleotide
cgctcagagggccgggttgggt

SEQ ID NO: 215205 - DNA, 23 bp, Artificial Sequence
  Description of Artificial Sequence: Synthetic oligonucleotide
gctcagagggccgggttgggtgt

SEQ ID NO: 215206 - DNA, 26 bp, Artificial Sequence
  Description of Artificial Sequence: Synthetic oligonucleotide
ctcagagggccgggttgggtgtctta

SEQ ID NO: 215207 - DNA, 26 bp, Artificial Sequence
  Description of Artificial Sequence: Synthetic oligonucleotide
tcagagggccgggttgggtgtcttac

SEQ ID NO: 215208 - DNA, 25 bp, Artificial Sequence
  Description of Artificial Sequence: Synthetic oligonucleotide
cagagggccgggttgggtgtcttac

SEQ ID NO: 215209 - DNA, 26 bp, Artificial Sequence
  Description of Artificial Sequence: Synthetic oligonucleotide
agagggccgggttgggtgtcttacca

SEQ ID NO: 215210 - DNA, 25 bp, Artificial Sequence
  Description of Artificial Sequence: Synthetic oligonucleotide
gagggccgggttgggtgtcttacca

SEQ ID NO: 215211 - DNA, 25 bp, Artificial Sequence
  Description of Artificial Sequence: Synthetic oligonucleotide
agggccgggttgggtgtcttaccag

SEQ ID NO: 215212 - DNA, 24 bp, Artificial Sequence
  Description of Artificial Sequence: Synthetic oligonucleotide
gggccgggttgggtgtcttaccag

SEQ ID NO: 215213 - DNA, 25 bp, Artificial Sequence
  Description of Artificial Sequence: Synthetic oligonucleotide
ggccgggttgggtgtcttaccagct

SEQ ID NO: 215214 - DNA, 25 bp, Artificial Sequence
  Description of Artificial Sequence: Synthetic oligonucleotide
gccgggttgggtgtcttaccagctg

SEQ ID NO: 215215 - DNA, 26 bp, Artificial Sequence
  Description of Artificial Sequence: Synthetic oligonucleotide
ccgggttgggtgtcttaccagctgct

SEQ ID NO: 215216 - DNA, 26 bp, Artificial Sequence
  Description of Artificial Sequence: Synthetic oligonucleotide
cgggttgggtgtcttaccagctgctc

SEQ ID NO: 215217 - DNA, 27 bp, Artificial Sequence
  Description of Artificial Sequence: Synthetic oligonucleotide
gggttgggtgtcttaccagctgctcga

SEQ ID NO: 215218 - DNA, 27 bp, Artificial Sequence
  Description of Artificial Sequence: Synthetic oligonucleotide
ggttgggtgtcttaccagctgctcgac

SEQ ID NO: 215219 - DNA, 27 bp, Artificial Sequence
  Description of Artificial Sequence: Synthetic oligonucleotide
gttgggtgtcttaccagctgctcgacg

SEQ ID NO: 215220 - DNA, 28 bp, Artificial Sequence
  Description of Artificial Sequence: Synthetic oligonucleotide
ttgggtgtcttaccagctgctcgacgtg

SEQ ID NO: 215221 - DNA, 27 bp, Artificial Sequence
  Description of Artificial Sequence: Synthetic oligonucleotide
tgggtgtcttaccagctgctcgacgtg

SEQ ID NO: 215222 - DNA, 27 bp, Artificial Sequence
  Description of Artificial Sequence: Synthetic oligonucleotide
gggtgtcttaccagctgctcgacgtga

SEQ ID NO: 215223 - DNA, 27 bp, Artificial Sequence
  Description of Artificial Sequence: Synthetic oligonucleotide
ggtgtcttaccagctgctcgacgtgag

SEQ ID NO: 215224 - DNA, 27 bp, Artificial Sequence
  Description of Artificial Sequence: Synthetic oligonucleotide
gtgtcttaccagctgctcgacgtgagg

SEQ ID NO: 215225 - DNA, 27 bp, Artificial Sequence
  Description of Artificial Sequence: Synthetic oligonucleotide
tgtcttaccagctgctcgacgtgaggg

SEQ ID NO: 215226 - DNA, 26 bp, Artificial Sequence
  Description of Artificial Sequence: Synthetic oligonucleotide
gtcttaccagctgctcgacgtgaggg

SEQ ID NO: 215227 - DNA, 26 bp, Artificial Sequence
  Description of Artificial Sequence: Synthetic oligonucleotide
tcttaccagctgctcgacgtgagggc

SEQ ID NO: 215228 - DNA, 25 bp, Artificial Sequence
  Description of Artificial Sequence: Synthetic oligonucleotide
cttaccagctgctcgacgtgagggc

SEQ ID NO: 215229 - DNA, 26 bp, Artificial Sequence
  Description of Artificial Sequence: Synthetic oligonucleotide
ttaccagctgctcgacgtgagggcct

SEQ ID NO: 215230 - DNA, 25 bp, Artificial Sequence
  Description of Artificial Sequence: Synthetic oligonucleotide
taccagctgctcgacgtgagggcct

SEQ ID NO: 215231 - DNA, 24 bp, Artificial Sequence
  Description of Artificial Sequence: Synthetic oligonucleotide
accagctgctcgacgtgagggcct

SEQ ID NO: 215232 - DNA, 23 bp, Artificial Sequence
  Description of Artificial Sequence: Synthetic oligonucleotide
ccagctgctcgacgtgagggcct

SEQ ID NO: 215233 - DNA, 23 bp, Artificial Sequence
  Description of Artificial Sequence: Synthetic oligonucleotide
cagctgctcgacgtgagggcctg

SEQ ID NO: 215234 - DNA, 24 bp, Artificial Sequence
  Description of Artificial Sequence: Synthetic oligonucleotide
agctgctcgacgtgagggcctgga

SEQ ID NO: 215235 - DNA, 23 bp, Artificial Sequence
  Description of Artificial Sequence: Synthetic oligonucleotide
gctgctcgacgtgagggcctgga

SEQ ID NO: 215236 - DNA, 23 bp, Artificial Sequence
  Description of Artificial Sequence: Synthetic oligonucleotide
ctgctcgacgtgagggcctggag

SEQ ID NO: 215237 - DNA, 24 bp, Artificial Sequence
  Description of Artificial Sequence: Synthetic oligonucleotide
tgctcgacgtgagggcctggagct

SEQ ID NO: 215238 - DNA, 23 bp, Artificial Sequence
  Description of Artificial Sequence: Synthetic oligonucleotide
gctcgacgtgagggcctggagct

SEQ ID NO: 215239 - DNA, 23 bp, Artificial Sequence
  Description of Artificial Sequence: Synthetic oligonucleotide
ctcgacgtgagggcctggagctc

SEQ ID NO: 215240 - DNA, 23 bp, Artificial Sequence
  Description of Artificial Sequence: Synthetic oligonucleotide
tcgacgtgagggcctggagctcc

SEQ ID NO: 215241 - DNA, 22 bp, Artificial Sequence
  Description of Artificial Sequence: Synthetic oligonucleotide
cgacgtgagggcctggagctcc

SEQ ID NO: 215242 - DNA, 23 bp, Artificial Sequence
  Description of Artificial Sequence: Synthetic oligonucleotide
gacgtgagggcctggagctccct

SEQ ID NO: 215243 - DNA, 23 bp, Artificial Sequence
  Description of Artificial Sequence: Synthetic oligonucleotide
acgtgagggcctggagctccctc

SEQ ID NO: 215244 - DNA, 22 bp, Artificial Sequence
  Description of Artificial Sequence: Synthetic oligonucleotide
cgtgagggcctggagctccctc

SEQ ID NO: 215245 - DNA, 22 bp, Artificial Sequence
  Description of Artificial Sequence: Synthetic oligonucleotide
gtgagggcctggagctccctcg

SEQ ID NO: 215246 - DNA, 22 bp, Artificial Sequence
  Description of Artificial Sequence: Synthetic oligonucleotide
tgagggcctggagctccctcgc

SEQ ID NO: 215247 - DNA, 21 bp, Artificial Sequence
  Description of Artificial Sequence: Synthetic oligonucleotide
gagggcctggagctccctcgc

SEQ ID NO: 215248 - DNA, 21 bp, Artificial Sequence
  Description of Artificial Sequence: Synthetic oligonucleotide
agggcctggagctccctcgcg

SEQ ID NO: 215249 - DNA, 20 bp, Artificial Sequence
  Description of Artificial Sequence: Synthetic oligonucleotide
gggcctggagctccctcgcg

SEQ ID NO: 215250 - DNA, 21 bp, Artificial Sequence
  Description of Artificial Sequence: Synthetic oligonucleotide
ggcctggagctccctcgcgca

SEQ ID NO: 215251 - DNA, 22 bp, Artificial Sequence
  Description of Artificial Sequence: Synthetic oligonucleotide
gcctggagctccctcgcgcact

SEQ ID NO: 215252 - DNA, 22 bp, Artificial Sequence
  Description of Artificial Sequence: Synthetic oligonucleotide
cctggagctccctcgcgcactg

SEQ ID NO: 215253 - DNA, 22 bp, Artificial Sequence
  Description of Artificial Sequence: Synthetic oligonucleotide
ctggagctccctcgcgcactgc

SEQ ID NO: 215254 - DNA, 23 bp, Artificial Sequence
  Description of Artificial Sequence: Synthetic oligonucleotide
tggagctccctcgcgcactgcct

SEQ ID NO: 215255 - DNA, 22 bp, Artificial Sequence
  Description of Artificial Sequence: Synthetic oligonucleotide
ggagctccctcgcgcactgcct

SEQ ID NO: 215256 - DNA, 22 bp, Artificial Sequence
  Description of Artificial Sequence: Synthetic oligonucleotide
gagctccctcgcgcactgcctc

SEQ ID NO: 215257 - DNA, 23 bp, Artificial Sequence
  Description of Artificial Sequence: Synthetic oligonucleotide
agctccctcgcgcactgcctcgt

SEQ ID NO: 215258 - DNA, 22 bp, Artificial Sequence
  Description of Artificial Sequence: Synthetic oligonucleotide
gctccctcgcgcactgcctcgt

SEQ ID NO: 215259 - DNA, 23 bp, Artificial Sequence
  Description of Artificial Sequence: Synthetic oligonucleotide
ctccctcgcgcactgcctcgtga

SEQ ID NO: 215260 - DNA, 23 bp, Artificial Sequence
  Description of Artificial Sequence: Synthetic oligonucleotide
tccctcgcgcactgcctcgtgac

SEQ ID NO: 215261 - DNA, 22 bp, Artificial Sequence
  Description of Artificial Sequence: Synthetic oligonucleotide
ccctcgcgcactgcctcgtgac

SEQ ID NO: 215262 - DNA, 23 bp, Artificial Sequence
  Description of Artificial Sequence: Synthetic oligonucleotide
cctcgcgcactgcctcgtgacct

SEQ ID NO: 215263 - DNA, 23 bp, Artificial Sequence
  Description of Artificial Sequence: Synthetic oligonucleotide
ctcgcgcactgcctcgtgacctg

SEQ ID NO: 215264 - DNA, 23 bp, Artificial Sequence
  Description of Artificial Sequence: Synthetic oligonucleotide
tcgcgcactgcctcgtgacctgc

SEQ ID NO: 215265 - DNA, 22 bp, Artificial Sequence
  Description of Artificial Sequence: Synthetic oligonucleotide
cgcgcactgcctcgtgacctgc

SEQ ID NO: 215266 - DNA, 22 bp, Artificial Sequence
  Description of Artificial Sequence: Synthetic oligonucleotide
gcgcactgcctcgtgacctgcg

SEQ ID NO: 215267 - DNA, 23 bp, Artificial Sequence
  Description of Artificial Sequence: Synthetic oligonucleotide
cgcactgcctcgtgacctgcgca

SEQ ID NO: 215268 - DNA, 23 bp, Artificial Sequence
  Description of Artificial Sequence: Synthetic oligonucleotide
gcactgcctcgtgacctgcgcag

SEQ ID NO: 215269 - DNA, 27 bp, Artificial Sequence
  Description of Artificial Sequence: Synthetic oligonucleotide
cactgcctcgtgacctgcgcaggaaaa

SEQ ID NO: 215270 - DNA, 28 bp, Artificial Sequence
  Description of Artificial Sequence: Synthetic oligonucleotide
actgcctcgtgacctgcgcaggaaaaac

SEQ ID NO: 215271 - DNA, 27 bp, Artificial Sequence
  Description of Artificial Sequence: Synthetic oligonucleotide
ctgcctcgtgacctgcgcaggaaaaac

SEQ ID NO: 215272 - DNA, 28 bp, Artificial Sequence
  Description of Artificial Sequence: Synthetic oligonucleotide
tgcctcgtgacctgcgcaggaaaaacac

SEQ ID NO: 215273 - DNA, 27 bp, Artificial Sequence
  Description of Artificial Sequence: Synthetic oligonucleotide
gcctcgtgacctgcgcaggaaaaacac

SEQ ID NO: 215274 - DNA, 27 bp, Artificial Sequence
  Description of Artificial Sequence: Synthetic oligonucleotide
cctcgtgacctgcgcaggaaaaacacg

SEQ ID NO: 215275 - DNA, 27 bp, Artificial Sequence
  Description of Artificial Sequence: Synthetic oligonucleotide
ctcgtgacctgcgcaggaaaaacacgc

SEQ ID NO: 215276 - DNA, 28 bp, Artificial Sequence
  Description of Artificial Sequence: Synthetic oligonucleotide
tcgtgacctgcgcaggaaaaacacgctg

SEQ ID NO: 215277 - DNA, 27 bp, Artificial Sequence
  Description of Artificial Sequence: Synthetic oligonucleotide
cgtgacctgcgcaggaaaaacacgctg

SEQ ID NO: 215278 - DNA, 27 bp, Artificial Sequence
  Description of Artificial Sequence: Synthetic oligonucleotide
gtgacctgcgcaggaaaaacacgctgg

SEQ ID NO: 215279 - DNA, 27 bp, Artificial Sequence
  Description of Artificial Sequence: Synthetic oligonucleotide
tgacctgcgcaggaaaaacacgctggg

SEQ ID NO: 215280 - DNA, 26 bp, Artificial Sequence
  Description of Artificial Sequence: Synthetic oligonucleotide
gacctgcgcaggaaaaacacgctggg

SEQ ID NO: 215281 - DNA, 26 bp, Artificial Sequence
  Description of Artificial Sequence: Synthetic oligonucleotide
acctgcgcaggaaaaacacgctgggc

SEQ ID NO: 215282 - DNA, 25 bp, Artificial Sequence
  Description of Artificial Sequence: Synthetic oligonucleotide
cctgcgcaggaaaaacacgctgggc

SEQ ID NO: 215283 - DNA, 26 bp, Artificial Sequence
  Description of Artificial Sequence: Synthetic oligonucleotide
ctgcgcaggaaaaacacgctgggcca

SEQ ID NO: 215284 - DNA, 26 bp, Artificial Sequence
  Description of Artificial Sequence: Synthetic oligonucleotide
tgcgcaggaaaaacacgctgggccac

SEQ ID NO: 215285 - DNA, 25 bp, Artificial Sequence
  Description of Artificial Sequence: Synthetic oligonucleotide
gcgcaggaaaaacacgctgggccac

SEQ ID NO: 215286 - DNA, 26 bp, Artificial Sequence
  Description of Artificial Sequence: Synthetic oligonucleotide
cgcaggaaaaacacgctgggccacct

SEQ ID NO: 215287 - DNA, 26 bp, Artificial Sequence
  Description of Artificial Sequence: Synthetic oligonucleotide
gcaggaaaaacacgctgggccacctc

SEQ ID NO: 215288 - DNA, 27 bp, Artificial Sequence
  Description of Artificial Sequence: Synthetic oligonucleotide
caggaaaaacacgctgggccacctcca

SEQ ID NO: 215289 - DNA, 27 bp, Artificial Sequence
  Description of Artificial Sequence: Synthetic oligonucleotide
aggaaaaacacgctgggccacctccag

SEQ ID NO: 215290 - DNA, 26 bp, Artificial Sequence
  Description of Artificial Sequence: Synthetic oligonucleotide
ggaaaaacacgctgggccacctccag

SEQ ID NO: 215291 - DNA, 27 bp, Artificial Sequence
  Description of Artificial Sequence: Synthetic oligonucleotide
gaaaaacacgctgggccacctccagga

SEQ ID NO: 215292 - DNA, 28 bp, Artificial Sequence
  Description of Artificial Sequence: Synthetic oligonucleotide
aaaaacacgctgggccacctccaggatc

SEQ ID NO: 215293 - DNA, 27 bp, Artificial Sequence
  Description of Artificial Sequence: Synthetic oligonucleotide
aaaacacgctgggccacctccaggatc

SEQ ID NO: 215294 - DNA, 27 bp, Artificial Sequence
  Description of Artificial Sequence: Synthetic oligonucleotide
aaacacgctgggccacctccaggatca

SEQ ID NO: 215295 - DNA, 26 bp, Artificial Sequence
  Description of Artificial Sequence: Synthetic oligonucleotide
aacacgctgggccacctccaggatca

SEQ ID NO: 215296 - DNA, 25 bp, Artificial Sequence
  Description of Artificial Sequence: Synthetic oligonucleotide
acacgctgggccacctccaggatca

SEQ ID NO: 215297 - DNA, 24 bp, Artificial Sequence
  Description of Artificial Sequence: Synthetic oligonucleotide
cacgctgggccacctccaggatca

SEQ ID NO: 215298 - DNA, 24 bp, Artificial Sequence
  Description of Artificial Sequence: Synthetic oligonucleotide
acgctgggccacctccaggatcac

SEQ ID NO: 215299 - DNA, 23 bp, Artificial Sequence
  Description of Artificial Sequence: Synthetic oligonucleotide
cgctgggccacctccaggatcac

SEQ ID NO: 215300 - DNA, 23 bp, Artificial Sequence
  Description of Artificial Sequence: Synthetic oligonucleotide
gctgggccacctccaggatcacc

SEQ ID NO: 215301 - DNA, 23 bp, Artificial Sequence
  Description of Artificial Sequence: Synthetic oligonucleotide
ctgggccacctccaggatcaccg

SEQ ID NO: 215302 - DNA, 23 bp, Artificial Sequence
  Description of Artificial Sequence: Synthetic oligonucleotide
tgggccacctccaggatcaccgc

SEQ ID NO: 215303 - DNA, 22 bp, Artificial Sequence
  Description of Artificial Sequence: Synthetic oligonucleotide
gggccacctccaggatcaccgc

SEQ ID NO: 215304 - DNA, 24 bp, Artificial Sequence
  Description of Artificial Sequence: Synthetic oligonucleotide
ggccacctccaggatcaccgccta

SEQ ID NO: 215305 - DNA, 27 bp, Artificial Sequence
  Description of Artificial Sequence: Synthetic oligonucleotide
gccacctccaggatcaccgcctacaaa

SEQ ID NO: 215306 - DNA, 27 bp, Artificial Sequence
  Description of Artificial Sequence: Synthetic oligonucleotide
ccacctccaggatcaccgcctacaaac

SEQ ID NO: 215307 - DNA, 27 bp, Artificial Sequence
  Description of Artificial Sequence: Synthetic oligonucleotide
cacctccaggatcaccgcctacaaacc

SEQ ID NO: 215308 - DNA, 27 bp, Artificial Sequence
  Description of Artificial Sequence: Synthetic oligonucleotide
acctccaggatcaccgcctacaaaccg

SEQ ID NO: 215309 - DNA, 26 bp, Artificial Sequence
  Description of Artificial Sequence: Synthetic oligonucleotide
cctccaggatcaccgcctacaaaccg

SEQ ID NO: 215310 - DNA, 26 bp, Artificial Sequence
  Description of Artificial Sequence: Synthetic oligonucleotide
ctccaggatcaccgcctacaaaccgc

SEQ ID NO: 215311 - DNA, 26 bp, Artificial Sequence
  Description of Artificial Sequence: Synthetic oligonucleotide
tccaggatcaccgcctacaaaccgcc

SEQ ID NO: 215312 - DNA, 25 bp, Artificial Sequence
  Description of Artificial Sequence: Synthetic oligonucleotide
ccaggatcaccgcctacaaaccgcc

SEQ ID NO: 215313 - DNA, 25 bp, Artificial Sequence
  Description of Artificial Sequence: Synthetic oligonucleotide
caggatcaccgcctacaaaccgccc

SEQ ID NO: 215314 - DNA, 26 bp, Artificial Sequence
  Description of Artificial Sequence: Synthetic oligonucleotide
aggatcaccgcctacaaaccgcccca

SEQ ID NO: 215315 - DNA, 25 bp, Artificial Sequence
  Description of Artificial Sequence: Synthetic oligonucleotide
ggatcaccgcctacaaaccgcccca

SEQ ID NO: 215316 - DNA, 26 bp, Artificial Sequence
  Description of Artificial Sequence: Synthetic oligonucleotide
gatcaccgcctacaaaccgccccaca

SEQ ID NO: 215317 - DNA, 26 bp, Artificial Sequence
  Description of Artificial Sequence: Synthetic oligonucleotide
atcaccgcctacaaaccgccccacag

SEQ ID NO: 215318 - DNA, 25 bp, Artificial Sequence
  Description of Artificial Sequence: Synthetic oligonucleotide
tcaccgcctacaaaccgccccacag

SEQ ID NO: 215319 - DNA, 24 bp, Artificial Sequence
  Description of Artificial Sequence: Synthetic oligonucleotide
caccgcctacaaaccgccccacag

SEQ ID NO: 215320 - DNA, 24 bp, Artificial Sequence
  Description of Artificial Sequence: Synthetic oligonucleotide
accgcctacaaaccgccccacagc

SEQ ID NO: 215321 - DNA, 23 bp, Artificial Sequence
  Description of Artificial Sequence: Synthetic oligonucleotide
ccgcctacaaaccgccccacagc

SEQ ID NO: 215322 - DNA, 24 bp, Artificial Sequence
  Description of Artificial Sequence: Synthetic oligonucleotide
cgcctacaaaccgccccacagcgt

SEQ ID NO: 215323 - DNA, 27 bp, Artificial Sequence
  Description of Artificial Sequence: Synthetic oligonucleotide
gcctacaaaccgccccacagcgtgatt

SEQ ID NO: 215324 - DNA, 29 bp, Artificial Sequence
  Description of Artificial Sequence: Synthetic oligonucleotide
cctacaaaccgccccacagcgtgattttg

SEQ ID NO: 215325 - DNA, 29 bp, Artificial Sequence
  Description of Artificial Sequence: Synthetic oligonucleotide
ctacaaaccgccccacagcgtgattttgg

SEQ ID NO: 215326 - DNA, 30 bp, Artificial Sequence
  Description of Artificial Sequence: Synthetic oligonucleotide
tacaaaccgccccacagcgtgattttggag

SEQ ID NO: 215327 - DNA, 29 bp, Artificial Sequence
  Description of Artificial Sequence: Synthetic oligonucleotide
acaaaccgccccacagcgtgattttggag

SEQ ID NO: 215328 - DNA, 28 bp, Artificial Sequence
  Description of Artificial Sequence: Synthetic oligonucleotide
caaaccgccccacagcgtgattttggag

SEQ ID NO: 215329 - DNA, 28 bp, Artificial Sequence
  Description of Artificial Sequence: Synthetic oligonucleotide
aaaccgccccacagcgtgattttggagc

SEQ ID NO: 215330 - DNA, 27 bp, Artificial Sequence
  Description of Artificial Sequence: Synthetic oligonucleotide
aaccgccccacagcgtgattttggagc

SEQ ID NO: 215331 - DNA, 26 bp, Artificial Sequence
  Description of Artificial Sequence: Synthetic oligonucleotide
accgccccacagcgtgattttggagc

SEQ ID NO: 215332 - DNA, 25 bp, Artificial Sequence
  Description of Artificial Sequence: Synthetic oligonucleotide
ccgccccacagcgtgattttggagc

SEQ ID NO: 215333 - DNA, 26 bp, Artificial Sequence
  Description of Artificial Sequence: Synthetic oligonucleotide
cgccccacagcgtgattttggagcct

SEQ ID NO: 215334 - DNA, 26 bp, Artificial Sequence
  Description of Artificial Sequence: Synthetic oligonucleotide
gccccacagcgtgattttggagcctc

SEQ ID NO: 215335 - DNA, 26 bp, Artificial Sequence
  Description of Artificial Sequence: Synthetic oligonucleotide
ccccacagcgtgattttggagcctcc

SEQ ID NO: 215336 - DNA, 26 bp, Artificial Sequence
  Description of Artificial Sequence: Synthetic oligonucleotide
cccacagcgtgattttggagcctccg

SEQ ID NO: 215337 - DNA, 27 bp, Artificial Sequence
  Description of Artificial Sequence: Synthetic oligonucleotide
ccacagcgtgattttggagcctccggt

SEQ ID NO: 215338 - DNA, 27 bp, Artificial Sequence
  Description of Artificial Sequence: Synthetic oligonucleotide
cacagcgtgattttggagcctccggtc

SEQ ID NO: 215339 - DNA, 32 bp, Artificial Sequence
  Description of Artificial Sequence: Synthetic oligonucleotide
acagcgtgattttggagcctccggtcttaaag

SEQ ID NO: 215340 - DNA, 31 bp, Artificial Sequence
  Description of Artificial Sequence: Synthetic oligonucleotide
cagcgtgattttggagcctccggtcttaaag

SEQ ID NO: 215341 - DNA, 31 bp, Artificial Sequence
  Description of Artificial Sequence: Synthetic oligonucleotide
agcgtgattttggagcctccggtcttaaagg

SEQ ID NO: 215342 - DNA, 30 bp, Artificial Sequence
  Description of Artificial Sequence: Synthetic oligonucleotide
gcgtgattttggagcctccggtcttaaagg

SEQ ID NO: 215343 - DNA, 30 bp, Artificial Sequence
  Description of Artificial Sequence: Synthetic oligonucleotide
cgtgattttggagcctccggtcttaaaggg

SEQ ID NO: 215344 - DNA, 30 bp, Artificial Sequence
  Description of Artificial Sequence: Synthetic oligonucleotide
gtgattttggagcctccggtcttaaagggc

SEQ ID NO: 215345 - DNA, 31 bp, Artificial Sequence
  Description of Artificial Sequence: Synthetic oligonucleotide
tgattttggagcctccggtcttaaagggcag

SEQ ID NO: 215346 - DNA, 30 bp, Artificial Sequence
  Description of Artificial Sequence: Synthetic oligonucleotide
gattttggagcctccggtcttaaagggcag

SEQ ID NO: 215347 - DNA, 30 bp, Artificial Sequence
  Description of Artificial Sequence: Synthetic oligonucleotide
attttggagcctccggtcttaaagggcagg

SEQ ID NO: 215348 - DNA, 29 bp, Artificial Sequence
  Description of Artificial Sequence: Synthetic oligonucleotide
ttttggagcctccggtcttaaagggcagg

SEQ ID NO: 215349 - DNA, 28 bp, Artificial Sequence
  Description of Artificial Sequence: Synthetic oligonucleotide
tttggagcctccggtcttaaagggcagg

SEQ ID NO: 215350 - DNA, 27 bp, Artificial Sequence
  Description of Artificial Sequence: Synthetic oligonucleotide
ttggagcctccggtcttaaagggcagg

SEQ ID NO: 215351 - DNA, 27 bp, Artificial Sequence
  Description of Artificial Sequence: Synthetic oligonucleotide
tggagcctccggtcttaaagggcagga

SEQ ID NO: 215352 - DNA, 27 bp, Artificial Sequence
  Description of Artificial Sequence: Synthetic oligonucleotide
ggagcctccggtcttaaagggcaggaa

SEQ ID NO: 215353 - DNA, 30 bp, Artificial Sequence
  Description of Artificial Sequence: Synthetic oligonucleotide
gagcctccggtcttaaagggcaggaaatac

SEQ ID NO: 215354 - DNA, 31 bp, Artificial Sequence
  Description of Artificial Sequence: Synthetic oligonucleotide
agcctccggtcttaaagggcaggaaatacac

SEQ ID NO: 215355 - DNA, 30 bp, Artificial Sequence
  Description of Artificial Sequence: Synthetic oligonucleotide
gcctccggtcttaaagggcaggaaatacac

SEQ ID NO: 215356 - DNA, 33 bp, Artificial Sequence
  Description of Artificial Sequence: Synthetic oligonucleotide
cctccggtcttaaagggcaggaaatacactttg

SEQ ID NO: 215357 - DNA, 33 bp, Artificial Sequence
  Description of Artificial Sequence: Synthetic oligonucleotide
ctccggtcttaaagggcaggaaatacactttgc

SEQ ID NO: 215358 - DNA, 33 bp, Artificial Sequence
  Description of Artificial Sequence: Synthetic oligonucleotide
tccggtcttaaagggcaggaaatacactttgcg

SEQ ID NO: 215359 - DNA, 32 bp, Artificial Sequence
  Description of Artificial Sequence: Synthetic oligonucleotide
ccggtcttaaagggcaggaaatacactttgcg

SEQ ID NO: 215360 - DNA, 32 bp, Artificial Sequence
  Description of Artificial Sequence: Synthetic oligonucleotide
cggtcttaaagggcaggaaatacactttgcgc

SEQ ID NO: 215361 - DNA, 33 bp, Artificial Sequence
  Description of Artificial Sequence: Synthetic oligonucleotide
ggtcttaaagggcaggaaatacactttgcgctg

SEQ ID NO: 215362 - DNA, 33 bp, Artificial Sequence
  Description of Artificial Sequence: Synthetic oligonucleotide
gtcttaaagggcaggaaatacactttgcgctgc

SEQ ID NO: 215363 - DNA, 33 bp, Artificial Sequence
  Description of Artificial Sequence: Synthetic oligonucleotide
tcttaaagggcaggaaatacactttgcgctgcc

SEQ ID NO: 215364 - DNA, 32 bp, Artificial Sequence
  Description of Artificial Sequence: Synthetic oligonucleotide
cttaaagggcaggaaatacactttgcgctgcc

SEQ ID NO: 215365 - DNA, 33 bp, Artificial Sequence
  Description of Artificial Sequence: Synthetic oligonucleotide
ttaaagggcaggaaatacactttgcgctgccac

SEQ ID NO: 215366 - DNA, 32 bp, Artificial Sequence
  Description of Artificial Sequence: Synthetic oligonucleotide
taaagggcaggaaatacactttgcgctgccac

SEQ ID NO: 215367 - DNA, 31 bp, Artificial Sequence
  Description of Artificial Sequence: Synthetic oligonucleotide
aaagggcaggaaatacactttgcgctgccac

SEQ ID NO: 215368 - DNA, 30 bp, Artificial Sequence
  Description of Artificial Sequence: Synthetic oligonucleotide
aagggcaggaaatacactttgcgctgccac

SEQ ID NO: 215369 - DNA, 29 bp, Artificial Sequence
  Description of Artificial Sequence: Synthetic oligonucleotide
agggcaggaaatacactttgcgctgccac

SEQ ID NO: 215370 - DNA, 28 bp, Artificial Sequence
  Description of Artificial Sequence: Synthetic oligonucleotide
gggcaggaaatacactttgcgctgccac

SEQ ID NO: 215371 - DNA, 28 bp, Artificial Sequence
  Description of Artificial Sequence: Synthetic oligonucleotide
ggcaggaaatacactttgcgctgccacg

SEQ ID NO: 215372 - DNA, 29 bp, Artificial Sequence
  Description of Artificial Sequence: Synthetic oligonucleotide
gcaggaaatacactttgcgctgccacgtg

SEQ ID NO: 215373 - DNA, 30 bp, Artificial Sequence
  Description of Artificial Sequence: Synthetic oligonucleotide
caggaaatacactttgcgctgccacgtgac

SEQ ID NO: 215374 - DNA, 30 bp, Artificial Sequence
  Description of Artificial Sequence: Synthetic oligonucleotide
aggaaatacactttgcgctgccacgtgacg

SEQ ID NO: 215375 - DNA, 29 bp, Artificial Sequence
  Description of Artificial Sequence: Synthetic oligonucleotide
ggaaatacactttgcgctgccacgtgacg

SEQ ID NO: 215376 - DNA, 29 bp, Artificial Sequence
  Description of Artificial Sequence: Synthetic oligonucleotide
gaaatacactttgcgctgccacgtgacgc

SEQ ID NO: 215377 - DNA, 30 bp, Artificial Sequence
  Description of Artificial Sequence: Synthetic oligonucleotide
aaatacactttgcgctgccacgtgacgcag

SEQ ID NO: 215378 - DNA, 29 bp, Artificial Sequence
  Description of Artificial Sequence: Synthetic oligonucleotide
aatacactttgcgctgccacgtgacgcag

SEQ ID NO: 215379 - DNA, 28 bp, Artificial Sequence
  Description of Artificial Sequence: Synthetic oligonucleotide
atacactttgcgctgccacgtgacgcag

SEQ ID NO: 215380 - DNA, 27 bp, Artificial Sequence
  Description of Artificial Sequence: Synthetic oligonucleotide
tacactttgcgctgccacgtgacgcag

SEQ ID NO: 215381 - DNA, 26 bp, Artificial Sequence
  Description of Artificial Sequence: Synthetic oligonucleotide
acactttgcgctgccacgtgacgcag

SEQ ID NO: 215382 - DNA, 25 bp, Artificial Sequence
  Description of Artificial Sequence: Synthetic oligonucleotide
cactttgcgctgccacgtgacgcag

SEQ ID NO: 215383 - DNA, 26 bp, Artificial Sequence
  Description of Artificial Sequence: Synthetic oligonucleotide
actttgcgctgccacgtgacgcaggt

SEQ ID NO: 215384 - DNA, 25 bp, Artificial Sequence
  Description of Artificial Sequence: Synthetic oligonucleotide
ctttgcgctgccacgtgacgcaggt

SEQ ID NO: 215385 - DNA, 27 bp, Artificial Sequence
  Description of Artificial Sequence: Synthetic oligonucleotide
tttgcgctgccacgtgacgcaggtgtt

SEQ ID NO: 215386 - DNA, 26 bp, Artificial Sequence
  Description of Artificial Sequence: Synthetic oligonucleotide
ttgcgctgccacgtgacgcaggtgtt

SEQ ID NO: 215387 - DNA, 25 bp, Artificial Sequence
  Description of Artificial Sequence: Synthetic oligonucleotide
tgcgctgccacgtgacgcaggtgtt

SEQ ID NO: 215388 - DNA, 24 bp, Artificial Sequence
  Description of Artificial Sequence: Synthetic oligonucleotide
gcgctgccacgtgacgcaggtgtt

SEQ ID NO: 215389 - DNA, 24 bp, Artificial Sequence
  Description of Artificial Sequence: Synthetic oligonucleotide
cgctgccacgtgacgcaggtgttc

SEQ ID NO: 215390 - DNA, 24 bp, Artificial Sequence
  Description of Artificial Sequence: Synthetic oligonucleotide
gctgccacgtgacgcaggtgttcc

SEQ ID NO: 215391 - DNA, 24 bp, Artificial Sequence
  Description of Artificial Sequence: Synthetic oligonucleotide
ctgccacgtgacgcaggtgttccc

SEQ ID NO: 215392 - DNA, 24 bp, Artificial Sequence
  Description of Artificial Sequence: Synthetic oligonucleotide
tgccacgtgacgcaggtgttcccg

SEQ ID NO: 215393 - DNA, 23 bp, Artificial Sequence
  Description of Artificial Sequence: Synthetic oligonucleotide
gccacgtgacgcaggtgttcccg

SEQ ID NO: 215394 - DNA, 24 bp, Artificial Sequence
  Description of Artificial Sequence: Synthetic oligonucleotide
ccacgtgacgcaggtgttcccggt

SEQ ID NO: 215395 - DNA, 24 bp, Artificial Sequence
  Description of Artificial Sequence: Synthetic oligonucleotide
cacgtgacgcaggtgttcccggtg

SEQ ID NO: 215396 - DNA, 24 bp, Artificial Sequence
  Description of Artificial Sequence: Synthetic oligonucleotide
acgtgacgcaggtgttcccggtgg

SEQ ID NO: 215397 - DNA, 23 bp, Artificial Sequence
  Description of Artificial Sequence: Synthetic oligonucleotide
cgtgacgcaggtgttcccggtgg

SEQ ID NO: 215398 - DNA, 23 bp, Artificial Sequence
  Description of Artificial Sequence: Synthetic oligonucleotide
gtgacgcaggtgttcccggtggg

SEQ ID NO: 215399 - DNA, 25 bp, Artificial Sequence
  Description of Artificial Sequence: Synthetic oligonucleotide
tgacgcaggtgttcccggtgggcta

SEQ ID NO: 215400 - DNA, 24 bp, Artificial Sequence
  Description of Artificial Sequence: Synthetic oligonucleotide
gacgcaggtgttcccggtgggcta

SEQ ID NO: 215401 - DNA, 26 bp, Artificial Sequence
  Description of Artificial Sequence: Synthetic oligonucleotide
acgcaggtgttcccggtgggctactt

SEQ ID NO: 215402 - DNA, 25 bp, Artificial Sequence
  Description of Artificial Sequence: Synthetic oligonucleotide
cgcaggtgttcccggtgggctactt

SEQ ID NO: 215403 - DNA, 25 bp, Artificial Sequence
  Description of Artificial Sequence: Synthetic oligonucleotide
gcaggtgttcccggtgggctacttg

SEQ ID NO: 215404 - DNA, 26 bp, Artificial Sequence
  Description of Artificial Sequence: Synthetic oligonucleotide
caggtgttcccggtgggctacttggt

SEQ ID NO: 215405 - DNA, 26 bp, Artificial Sequence
  Description of Artificial Sequence: Synthetic oligonucleotide
aggtgttcccggtgggctacttggtg

SEQ ID NO: 215406 - DNA, 25 bp, Artificial Sequence
  Description of Artificial Sequence: Synthetic oligonucleotide
ggtgttcccggtgggctacttggtg

SEQ ID NO: 215407 - DNA, 26 bp, Artificial Sequence
  Description of Artificial Sequence: Synthetic oligonucleotide
gtgttcccggtgggctacttggtggt

SEQ ID NO: 215408 - DNA, 27 bp, Artificial Sequence
  Description of Artificial Sequence: Synthetic oligonucleotide
tgttcccggtgggctacttggtggtga

SEQ ID NO: 215409 - DNA, 26 bp, Artificial Sequence
  Description of Artificial Sequence: Synthetic oligonucleotide
gttcccggtgggctacttggtggtga

SEQ ID NO: 215410 - DNA, 26 bp, Artificial Sequence
  Description of Artificial Sequence: Synthetic oligonucleotide
ttcccggtgggctacttggtggtgac

SEQ ID NO: 215411 - DNA, 25 bp, Artificial Sequence
  Description of Artificial Sequence: Synthetic oligonucleotide
tcccggtgggctacttggtggtgac

SEQ ID NO: 215412 - DNA, 24 bp, Artificial Sequence
  Description of Artificial Sequence: Synthetic oligonucleotide
cccggtgggctacttggtggtgac

SEQ ID NO: 215413 - DNA, 24 bp, Artificial Sequence
  Description of Artificial Sequence: Synthetic oligonucleotide
ccggtgggctacttggtggtgacc

SEQ ID NO: 215414 - DNA, 25 bp, Artificial Sequence
  Description of Artificial Sequence: Synthetic oligonucleotide
cggtgggctacttggtggtgaccct

SEQ ID NO: 215415 - DNA, 26 bp, Artificial Sequence
  Description of Artificial Sequence: Synthetic oligonucleotide
ggtgggctacttggtggtgaccctga

SEQ ID NO: 215416 - DNA, 26 bp, Artificial Sequence
  Description of Artificial Sequence: Synthetic oligonucleotide
gtgggctacttggtggtgaccctgag

SEQ ID NO: 215417 - DNA, 26 bp, Artificial Sequence
  Description of Artificial Sequence: Synthetic oligonucleotide
tgggctacttggtggtgaccctgagg

SEQ ID NO: 215418 - DNA, 25 bp, Artificial Sequence
  Description of Artificial Sequence: Synthetic oligonucleotide
gggctacttggtggtgaccctgagg

SEQ ID NO: 215419 - DNA, 27 bp, Artificial Sequence
  Description of Artificial Sequence: Synthetic oligonucleotide
ggctacttggtggtgaccctgaggcat

SEQ ID NO: 215420 - DNA, 27 bp, Artificial Sequence
  Description of Artificial Sequence: Synthetic oligonucleotide
gctacttggtggtgaccctgaggcatg

SEQ ID NO: 215421 - DNA, 27 bp, Artificial Sequence
  Description of Artificial Sequence: Synthetic oligonucleotide
ctacttggtggtgaccctgaggcatgg

SEQ ID NO: 215422 - DNA, 29 bp, Artificial Sequence
  Description of Artificial Sequence: Synthetic oligonucleotide
tacttggtggtgaccctgaggcatggaag

SEQ ID NO: 215423 - DNA, 28 bp, Artificial Sequence
  Description of Artificial Sequence: Synthetic oligonucleotide
acttggtggtgaccctgaggcatggaag

SEQ ID NO: 215424 - DNA, 27 bp, Artificial Sequence
  Description of Artificial Sequence: Synthetic oligonucleotide
cttggtggtgaccctgaggcatggaag

SEQ ID NO: 215425 - DNA, 27 bp, Artificial Sequence
  Description of Artificial Sequence: Synthetic oligonucleotide
ttggtggtgaccctgaggcatggaagc

SEQ ID NO: 215426 - DNA, 26 bp, Artificial Sequence
  Description of Artificial Sequence: Synthetic oligonucleotide
tggtggtgaccctgaggcatggaagc

SEQ ID NO: 215427 - DNA, 25 bp, Artificial Sequence
  Description of Artificial Sequence: Synthetic oligonucleotide
ggtggtgaccctgaggcatggaagc

SEQ ID NO: 215428 - DNA, 25 bp, Artificial Sequence
  Description of Artificial Sequence: Synthetic oligonucleotide
gtggtgaccctgaggcatggaagcc

SEQ ID NO: 215429 - DNA, 25 bp, Artificial Sequence
  Description of Artificial Sequence: Synthetic oligonucleotide
tggtgaccctgaggcatggaagccg

SEQ ID NO: 215430 - DNA, 24 bp, Artificial Sequence
  Description of Artificial Sequence: Synthetic oligonucleotide
ggtgaccctgaggcatggaagccg

SEQ ID NO: 215431 - DNA, 24 bp, Artificial Sequence
  Description of Artificial Sequence: Synthetic oligonucleotide
gtgaccctgaggcatggaagccgg

SEQ ID NO: 215432 - DNA, 25 bp, Artificial Sequence
  Description of Artificial Sequence: Synthetic oligonucleotide
tgaccctgaggcatggaagccgggt

SEQ ID NO: 215433 - DNA, 24 bp, Artificial Sequence
  Description of Artificial Sequence: Synthetic oligonucleotide
gaccctgaggcatggaagccgggt

SEQ ID NO: 215434 - DNA, 26 bp, Artificial Sequence
  Description of Artificial Sequence: Synthetic oligonucleotide
accctgaggcatggaagccgggtcat

SEQ ID NO: 215435 - DNA, 25 bp, Artificial Sequence
  Description of Artificial Sequence: Synthetic oligonucleotide
ccctgaggcatggaagccgggtcat

SEQ ID NO: 215436 - DNA, 27 bp, Artificial Sequence
  Description of Artificial Sequence: Synthetic oligonucleotide
cctgaggcatggaagccgggtcatcta

SEQ ID NO: 215437 - DNA, 29 bp, Artificial Sequence
  Description of Artificial Sequence: Synthetic oligonucleotide
ctgaggcatggaagccgggtcatctattc

SEQ ID NO: 215438 - DNA, 29 bp, Artificial Sequence
  Description of Artificial Sequence: Synthetic oligonucleotide
tgaggcatggaagccgggtcatctattcc

SEQ ID NO: 215439 - DNA, 28 bp, Artificial Sequence
  Description of Artificial Sequence: Synthetic oligonucleotide
gaggcatggaagccgggtcatctattcc

SEQ ID NO: 215440 - DNA, 28 bp, Artificial Sequence
  Description of Artificial Sequence: Synthetic oligonucleotide
aggcatggaagccgggtcatctattccg

SEQ ID NO: 215441 - DNA, 27 bp, Artificial Sequence
  Description of Artificial Sequence: Synthetic oligonucleotide
ggcatggaagccgggtcatctattccg

SEQ ID NO: 215442 - DNA, 30 bp, Artificial Sequence
  Description of Artificial Sequence: Synthetic oligonucleotide
gcatggaagccgggtcatctattccgaaag

SEQ ID NO: 215443 - DNA, 30 bp, Artificial Sequence
  Description of Artificial Sequence: Synthetic oligonucleotide
catggaagccgggtcatctattccgaaagc

SEQ ID NO: 215444 - DNA, 30 bp, Artificial Sequence
  Description of Artificial Sequence: Synthetic oligonucleotide
atggaagccgggtcatctattccgaaagcc

SEQ ID NO: 215445 - DNA, 29 bp, Artificial Sequence
  Description of Artificial Sequence: Synthetic oligonucleotide
tggaagccgggtcatctattccgaaagcc

SEQ ID NO: 215446 - DNA, 28 bp, Artificial Sequence
  Description of Artificial Sequence: Synthetic oligonucleotide
ggaagccgggtcatctattccgaaagcc

SEQ ID NO: 215447 - DNA, 29 bp, Artificial Sequence
  Description of Artificial Sequence: Synthetic oligonucleotide
gaagccgggtcatctattccgaaagcctg

SEQ ID NO: 215448 - DNA, 29 bp, Artificial Sequence
  Description of Artificial Sequence: Synthetic oligonucleotide
aagccgggtcatctattccgaaagcctgg

SEQ ID NO: 215449 - DNA, 28 bp, Artificial Sequence
  Description of Artificial Sequence: Synthetic oligonucleotide
agccgggtcatctattccgaaagcctgg

SEQ ID NO: 215450 - DNA, 27 bp, Artificial Sequence
  Description of Artificial Sequence: Synthetic oligonucleotide
gccgggtcatctattccgaaagcctgg

SEQ ID NO: 215451 - DNA, 28 bp, Artificial Sequence
  Description of Artificial Sequence: Synthetic oligonucleotide
ccgggtcatctattccgaaagcctggag

SEQ ID NO: 215452 - DNA, 28 bp, Artificial Sequence
  Description of Artificial Sequence: Synthetic oligonucleotide
cgggtcatctattccgaaagcctggagc

SEQ ID NO: 215453 - DNA, 28 bp, Artificial Sequence
  Description of Artificial Sequence: Synthetic oligonucleotide
gggtcatctattccgaaagcctggagcg

SEQ ID NO: 215454 - DNA, 28 bp, Artificial Sequence
  Description of Artificial Sequence: Synthetic oligonucleotide
ggtcatctattccgaaagcctggagcgc

SEQ ID NO: 215455 - DNA, 30 bp, Artificial Sequence
  Description of Artificial Sequence: Synthetic oligonucleotide
gtcatctattccgaaagcctggagcgcttc

SEQ ID NO: 215456 - DNA, 31 bp, Artificial Sequence
  Description of Artificial Sequence: Synthetic oligonucleotide
tcatctattccgaaagcctggagcgcttcac

SEQ ID NO: 215457 - DNA, 30 bp, Artificial Sequence
  Description of Artificial Sequence: Synthetic oligonucleotide
catctattccgaaagcctggagcgcttcac

SEQ ID NO: 215458 - DNA, 30 bp, Artificial Sequence
  Description of Artificial Sequence: Synthetic oligonucleotide
atctattccgaaagcctggagcgcttcacc

SEQ ID NO: 215459 - DNA, 29 bp, Artificial Sequence
  Description of Artificial Sequence: Synthetic oligonucleotide
tctattccgaaagcctggagcgcttcacc

SEQ ID NO: 215460 - DNA, 28 bp, Artificial Sequence
  Description of Artificial Sequence: Synthetic oligonucleotide
ctattccgaaagcctggagcgcttcacc

SEQ ID NO: 215461 - DNA, 28 bp, Artificial Sequence
  Description of Artificial Sequence: Synthetic oligonucleotide
tattccgaaagcctggagcgcttcaccg

SEQ ID NO: 215462 - DNA, 27 bp, Artificial Sequence
  Description of Artificial Sequence: Synthetic oligonucleotide
attccgaaagcctggagcgcttcaccg

SEQ ID NO: 215463 - DNA, 26 bp, Artificial Sequence
  Description of Artificial Sequence: Synthetic oligonucleotide
ttccgaaagcctggagcgcttcaccg

SEQ ID NO: 215464 - DNA, 25 bp, Artificial Sequence
  Description of Artificial Sequence: Synthetic oligonucleotide
tccgaaagcctggagcgcttcaccg

SEQ ID NO: 215465 - DNA, 24 bp, Artificial Sequence
  Description of Artificial Sequence: Synthetic oligonucleotide
ccgaaagcctggagcgcttcaccg

SEQ ID NO: 215466 - DNA, 24 bp, Artificial Sequence
  Description of Artificial Sequence: Synthetic oligonucleotide
cgaaagcctggagcgcttcaccgg

SEQ ID NO: 215467 - DNA, 24 bp, Artificial Sequence
  Description of Artificial Sequence: Synthetic oligonucleotide
gaaagcctggagcgcttcaccggc

SEQ ID NO: 215468 - DNA, 25 bp, Artificial Sequence
  Description of Artificial Sequence: Synthetic oligonucleotide
aaagcctggagcgcttcaccggcct

SEQ ID NO: 215469 - DNA, 24 bp, Artificial Sequence
  Description of Artificial Sequence: Synthetic oligonucleotide
aagcctggagcgcttcaccggcct

SEQ ID NO: 215470 - DNA, 23 bp, Artificial Sequence
  Description of Artificial Sequence: Synthetic oligonucleotide
agcctggagcgcttcaccggcct

SEQ ID NO: 215471 - DNA, 22 bp, Artificial Sequence
  Description of Artificial Sequence: Synthetic oligonucleotide
gcctggagcgcttcaccggcct

SEQ ID NO: 215472 - DNA, 22 bp, Artificial Sequence
  Description of Artificial Sequence: Synthetic oligonucleotide
cctggagcgcttcaccggcctg

SEQ ID NO: 215473 - DNA, 24 bp, Artificial Sequence
  Description of Artificial Sequence: Synthetic oligonucleotide
ctggagcgcttcaccggcctggat

SEQ ID NO: 215474 - DNA, 25 bp, Artificial Sequence
  Description of Artificial Sequence: Synthetic oligonucleotide
tggagcgcttcaccggcctggatct

SEQ ID NO: 215475 - DNA, 24 bp, Artificial Sequence
  Description of Artificial Sequence: Synthetic oligonucleotide
ggagcgcttcaccggcctggatct

SEQ ID NO: 215476 - DNA, 24 bp, Artificial Sequence
  Description of Artificial Sequence: Synthetic oligonucleotide
gagcgcttcaccggcctggatctg

SEQ ID NO: 215477 - DNA, 24 bp, Artificial Sequence
  Description of Artificial Sequence: Synthetic oligonucleotide
agcgcttcaccggcctggatctgg

SEQ ID NO: 215478 - DNA, 23 bp, Artificial Sequence
  Description of Artificial Sequence: Synthetic oligonucleotide
gcgcttcaccggcctggatctgg

SEQ ID NO: 215479 - DNA, 23 bp, Artificial Sequence
  Description of Artificial Sequence: Synthetic oligonucleotide
cgcttcaccggcctggatctggc

SEQ ID NO: 215480 - DNA, 25 bp, Artificial Sequence
  Description of Artificial Sequence: Synthetic oligonucleotide
gcttcaccggcctggatctggccaa

SEQ ID NO: 215481 - DNA, 25 bp, Artificial Sequence
  Description of Artificial Sequence: Synthetic oligonucleotide
cttcaccggcctggatctggccaac

SEQ ID NO: 215482 - DNA, 26 bp, Artificial Sequence
  Description of Artificial Sequence: Synthetic oligonucleotide
ttcaccggcctggatctggccaacgt

SEQ ID NO: 215483 - DNA, 25 bp, Artificial Sequence
  Description of Artificial Sequence: Synthetic oligonucleotide
tcaccggcctggatctggccaacgt

SEQ ID NO: 215484 - DNA, 24 bp, Artificial Sequence
  Description of Artificial Sequence: Synthetic oligonucleotide
caccggcctggatctggccaacgt

SEQ ID NO: 215485 - DNA, 25 bp, Artificial Sequence
  Description of Artificial Sequence: Synthetic oligonucleotide
accggcctggatctggccaacgtga

SEQ ID NO: 215486 - DNA, 24 bp, Artificial Sequence
  Description of Artificial Sequence: Synthetic oligonucleotide
ccggcctggatctggccaacgtga

SEQ ID NO: 215487 - DNA, 24 bp, Artificial Sequence
  Description of Artificial Sequence: Synthetic oligonucleotide
cggcctggatctggccaacgtgac

SEQ ID NO: 215488 - DNA, 26 bp, Artificial Sequence
  Description of Artificial Sequence: Synthetic oligonucleotide
ggcctggatctggccaacgtgacctt

SEQ ID NO: 215489 - DNA, 27 bp, Artificial Sequence
  Description of Artificial Sequence: Synthetic oligonucleotide
gcctggatctggccaacgtgaccttga

SEQ ID NO: 215490 - DNA, 27 bp, Artificial Sequence
  Description of Artificial Sequence: Synthetic oligonucleotide
cctggatctggccaacgtgaccttgac

SEQ ID NO: 215491 - DNA, 27 bp, Artificial Sequence
  Description of Artificial Sequence: Synthetic oligonucleotide
ctggatctggccaacgtgaccttgacc

SEQ ID NO: 215492 - DNA, 29 bp, Artificial Sequence
  Description of Artificial Sequence: Synthetic oligonucleotide
tggatctggccaacgtgaccttgacctac

SEQ ID NO: 215493 - DNA, 28 bp, Artificial Sequence
  Description of Artificial Sequence: Synthetic oligonucleotide
ggatctggccaacgtgaccttgacctac

SEQ ID NO: 215494 - DNA, 28 bp, Artificial Sequence
  Description of Artificial Sequence: Synthetic oligonucleotide
gatctggccaacgtgaccttgacctacg

SEQ ID NO: 215495 - DNA, 29 bp, Artificial Sequence
  Description of Artificial Sequence: Synthetic oligonucleotide
atctggccaacgtgaccttgacctacgag

SEQ ID NO: 215496 - DNA, 28 bp, Artificial Sequence
  Description of Artificial Sequence: Synthetic oligonucleotide
tctggccaacgtgaccttgacctacgag

SEQ ID NO: 215497 - DNA, 27 bp, Artificial Sequence
  Description of Artificial Sequence: Synthetic oligonucleotide
ctggccaacgtgaccttgacctacgag

SEQ ID NO: 215498 - DNA, 30 bp, Artificial Sequence
  Description of Artificial Sequence: Synthetic oligonucleotide
tggccaacgtgaccttgacctacgagtttg

SEQ ID NO: 215499 - DNA, 29 bp, Artificial Sequence
  Description of Artificial Sequence: Synthetic oligonucleotide
ggccaacgtgaccttgacctacgagtttg

SEQ ID NO: 215500 - DNA, 29 bp, Artificial Sequence
  Description of Artificial Sequence: Synthetic oligonucleotide
gccaacgtgaccttgacctacgagtttgc

SEQ ID NO: 215501 - DNA, 30 bp, Artificial Sequence
  Description of Artificial Sequence: Synthetic oligonucleotide
ccaacgtgaccttgacctacgagtttgctg

SEQ ID NO: 215502 - DNA, 30 bp, Artificial Sequence
  Description of Artificial Sequence: Synthetic oligonucleotide
caacgtgaccttgacctacgagtttgctgc

SEQ ID NO: 215503 - DNA, 31 bp, Artificial Sequence
  Description of Artificial Sequence: Synthetic oligonucleotide
aacgtgaccttgacctacgagtttgctgctg

SEQ ID NO: 215504 - DNA, 30 bp, Artificial Sequence
  Description of Artificial Sequence: Synthetic oligonucleotide
acgtgaccttgacctacgagtttgctgctg

SEQ ID NO: 215505 - DNA, 29 bp, Artificial Sequence
  Description of Artificial Sequence: Synthetic oligonucleotide
cgtgaccttgacctacgagtttgctgctg

SEQ ID NO: 215506 - DNA, 29 bp, Artificial Sequence
  Description of Artificial Sequence: Synthetic oligonucleotide
gtgaccttgacctacgagtttgctgctgg

SEQ ID NO: 215507 - DNA, 30 bp, Artificial Sequence
  Description of Artificial Sequence: Synthetic oligonucleotide
tgaccttgacctacgagtttgctgctggac

SEQ ID NO: 215508 - DNA, 29 bp, Artificial Sequence
  Description of Artificial Sequence: Synthetic oligonucleotide
gaccttgacctacgagtttgctgctggac

SEQ ID NO: 215509 - DNA, 29 bp, Artificial Sequence
  Description of Artificial Sequence: Synthetic oligonucleotide
accttgacctacgagtttgctgctggacc

SEQ ID NO: 215510 - DNA, 28 bp, Artificial Sequence
  Description of Artificial Sequence: Synthetic oligonucleotide
ccttgacctacgagtttgctgctggacc

SEQ ID NO: 215511 - DNA, 28 bp, Artificial Sequence
  Description of Artificial Sequence: Synthetic oligonucleotide
cttgacctacgagtttgctgctggaccc

SEQ ID NO: 215512 - DNA, 28 bp, Artificial Sequence
  Description of Artificial Sequence: Synthetic oligonucleotide
ttgacctacgagtttgctgctggacccc

SEQ ID NO: 215513 - DNA, 27 bp, Artificial Sequence
  Description of Artificial Sequence: Synthetic oligonucleotide
tgacctacgagtttgctgctggacccc

SEQ ID NO: 215514 - DNA, 26 bp, Artificial Sequence
  Description of Artificial Sequence: Synthetic oligonucleotide
gacctacgagtttgctgctggacccc

SEQ ID NO: 215515 - DNA, 26 bp, Artificial Sequence
  Description of Artificial Sequence: Synthetic oligonucleotide
acctacgagtttgctgctggaccccg

SEQ ID NO: 215516 - DNA, 25 bp, Artificial Sequence
  Description of Artificial Sequence: Synthetic oligonucleotide
cctacgagtttgctgctggaccccg

SEQ ID NO: 215517 - DNA, 25 bp, Artificial Sequence
  Description of Artificial Sequence: Synthetic oligonucleotide
ctacgagtttgctgctggaccccgc

SEQ ID NO: 215518 - DNA, 26 bp, Artificial Sequence
  Description of Artificial Sequence: Synthetic oligonucleotide
tacgagtttgctgctggaccccgcga

SEQ ID NO: 215519 - DNA, 25 bp, Artificial Sequence
  Description of Artificial Sequence: Synthetic oligonucleotide
acgagtttgctgctggaccccgcga

SEQ ID NO: 215520 - DNA, 24 bp, Artificial Sequence
  Description of Artificial Sequence: Synthetic oligonucleotide
cgagtttgctgctggaccccgcga

SEQ ID NO: 215521 - DNA, 26 bp, Artificial Sequence
  Description of Artificial Sequence: Synthetic oligonucleotide
gagtttgctgctggaccccgcgactt

SEQ ID NO: 215522 - DNA, 27 bp, Artificial Sequence
  Description of Artificial Sequence: Synthetic oligonucleotide
agtttgctgctggaccccgcgacttct

SEQ ID NO: 215523 - DNA, 26 bp, Artificial Sequence
  Description of Artificial Sequence: Synthetic oligonucleotide
gtttgctgctggaccccgcgacttct

SEQ ID NO: 215524 - DNA, 26 bp, Artificial Sequence
  Description of Artificial Sequence: Synthetic oligonucleotide
tttgctgctggaccccgcgacttctg

SEQ ID NO: 215525 - DNA, 25 bp, Artificial Sequence
  Description of Artificial Sequence: Synthetic oligonucleotide
ttgctgctggaccccgcgacttctg

SEQ ID NO: 215526 - DNA, 24 bp, Artificial Sequence
  Description of Artificial Sequence: Synthetic oligonucleotide
tgctgctggaccccgcgacttctg

SEQ ID NO: 215527 - DNA, 23 bp, Artificial Sequence
  Description of Artificial Sequence: Synthetic oligonucleotide
gctgctggaccccgcgacttctg

SEQ ID NO: 215528 - DNA, 23 bp, Artificial Sequence
  Description of Artificial Sequence: Synthetic oligonucleotide
ctgctggaccccgcgacttctgg

SEQ ID NO: 215529 - DNA, 24 bp, Artificial Sequence
  Description of Artificial Sequence: Synthetic oligonucleotide
tgctggaccccgcgacttctggca

SEQ ID NO: 215530 - DNA, 23 bp, Artificial Sequence
  Description of Artificial Sequence: Synthetic oligonucleotide
gctggaccccgcgacttctggca

SEQ ID NO: 215531 - DNA, 23 bp, Artificial Sequence
  Description of Artificial Sequence: Synthetic oligonucleotide
ctggaccccgcgacttctggcag

SEQ ID NO: 215532 - DNA, 23 bp, Artificial Sequence
  Description of Artificial Sequence: Synthetic oligonucleotide
tggaccccgcgacttctggcagc

SEQ ID NO: 215533 - DNA, 22 bp, Artificial Sequence
  Description of Artificial Sequence: Synthetic oligonucleotide
ggaccccgcgacttctggcagc

SEQ ID NO: 215534 - DNA, 22 bp, Artificial Sequence
  Description of Artificial Sequence: Synthetic oligonucleotide
gaccccgcgacttctggcagcc

SEQ ID NO: 215535 - DNA, 22 bp, Artificial Sequence
  Description of Artificial Sequence: Synthetic oligonucleotide
accccgcgacttctggcagccc

SEQ ID NO: 215536 - DNA, 21 bp, Artificial Sequence
  Description of Artificial Sequence: Synthetic oligonucleotide
ccccgcgacttctggcagccc

SEQ ID NO: 215537 - DNA, 22 bp, Artificial Sequence
  Description of Artificial Sequence: Synthetic oligonucleotide
cccgcgacttctggcagcccgt

SEQ ID NO: 215538 - DNA, 24 bp, Artificial Sequence
  Description of Artificial Sequence: Synthetic oligonucleotide
ccgcgacttctggcagcccgtgat

SEQ ID NO: 215539 - DNA, 25 bp, Artificial Sequence
  Description of Artificial Sequence: Synthetic oligonucleotide
cgcgacttctggcagcccgtgatct

SEQ ID NO: 215540 - DNA, 25 bp, Artificial Sequence
  Description of Artificial Sequence: Synthetic oligonucleotide
gcgacttctggcagcccgtgatctg

SEQ ID NO: 215541 - DNA, 25 bp, Artificial Sequence
  Description of Artificial Sequence: Synthetic oligonucleotide
cgacttctggcagcccgtgatctgc

SEQ ID NO: 215542 - DNA, 26 bp, Artificial Sequence
  Description of Artificial Sequence: Synthetic oligonucleotide
gacttctggcagcccgtgatctgcca

SEQ ID NO: 215543 - DNA, 26 bp, Artificial Sequence
  Description of Artificial Sequence: Synthetic oligonucleotide
acttctggcagcccgtgatctgccac

SEQ ID NO: 215544 - DNA, 25 bp, Artificial Sequence
  Description of Artificial Sequence: Synthetic oligonucleotide
cttctggcagcccgtgatctgccac

SEQ ID NO: 215545 - DNA, 25 bp, Artificial Sequence
  Description of Artificial Sequence: Synthetic oligonucleotide
ttctggcagcccgtgatctgccacg

SEQ ID NO: 215546 - DNA, 24 bp, Artificial Sequence
  Description of Artificial Sequence: Synthetic oligonucleotide
tctggcagcccgtgatctgccacg

SEQ ID NO: 215547 - DNA, 23 bp, Artificial Sequence
  Description of Artificial Sequence: Synthetic oligonucleotide
ctggcagcccgtgatctgccacg

SEQ ID NO: 215548 - DNA, 23 bp, Artificial Sequence
  Description of Artificial Sequence: Synthetic oligonucleotide
tggcagcccgtgatctgccacgc

SEQ ID NO: 215549 - DNA, 22 bp, Artificial Sequence
  Description of Artificial Sequence: Synthetic oligonucleotide
ggcagcccgtgatctgccacgc

SEQ ID NO: 215550 - DNA, 22 bp, Artificial Sequence
  Description of Artificial Sequence: Synthetic oligonucleotide
gcagcccgtgatctgccacgcg

SEQ ID NO: 215551 - DNA, 22 bp, Artificial Sequence
  Description of Artificial Sequence: Synthetic oligonucleotide
cagcccgtgatctgccacgcgc

SEQ ID NO: 215552 - DNA, 22 bp, Artificial Sequence
  Description of Artificial Sequence: Synthetic oligonucleotide
agcccgtgatctgccacgcgcg

SEQ ID NO: 215553 - DNA, 21 bp, Artificial Sequence
  Description of Artificial Sequence: Synthetic oligonucleotide
gcccgtgatctgccacgcgcg

SEQ ID NO: 215554 - DNA, 21 bp, Artificial Sequence
  Description of Artificial Sequence: Synthetic oligonucleotide
cccgtgatctgccacgcgcgc

SEQ ID NO: 215555 - DNA, 22 bp, Artificial Sequence
  Description of Artificial Sequence: Synthetic oligonucleotide
ccgtgatctgccacgcgcgcct

SEQ ID NO: 215556 - DNA, 25 bp, Artificial Sequence
  Description of Artificial Sequence: Synthetic oligonucleotide
cgtgatctgccacgcgcgcctcaat

SEQ ID NO: 215557 - DNA, 26 bp, Artificial Sequence
  Description of Artificial Sequence: Synthetic oligonucleotide
gtgatctgccacgcgcgcctcaatct

SEQ ID NO: 215558 - DNA, 26 bp, Artificial Sequence
  Description of Artificial Sequence: Synthetic oligonucleotide
tgatctgccacgcgcgcctcaatctc

SEQ ID NO: 215559 - DNA, 25 bp, Artificial Sequence
  Description of Artificial Sequence: Synthetic oligonucleotide
gatctgccacgcgcgcctcaatctc

SEQ ID NO: 215560 - DNA, 26 bp, Artificial Sequence
  Description of Artificial Sequence: Synthetic oligonucleotide
atctgccacgcgcgcctcaatctcga

SEQ ID NO: 215561 - DNA, 25 bp, Artificial Sequence
  Description of Artificial Sequence: Synthetic oligonucleotide
tctgccacgcgcgcctcaatctcga

SEQ ID NO: 215562 - DNA, 24 bp, Artificial Sequence
  Description of Artificial Sequence: Synthetic oligonucleotide
ctgccacgcgcgcctcaatctcga

SEQ ID NO: 215563 - DNA, 24 bp, Artificial Sequence
  Description of Artificial Sequence: Synthetic oligonucleotide
tgccacgcgcgcctcaatctcgac

SEQ ID NO: 215564 - DNA, 23 bp, Artificial Sequence
  Description of Artificial Sequence: Synthetic oligonucleotide
gccacgcgcgcctcaatctcgac

SEQ ID NO: 215565 - DNA, 23 bp, Artificial Sequence
  Description of Artificial Sequence: Synthetic oligonucleotide
ccacgcgcgcctcaatctcgacg

SEQ ID NO: 215566 - DNA, 23 bp, Artificial Sequence
  Description of Artificial Sequence: Synthetic oligonucleotide
cacgcgcgcctcaatctcgacgg

SEQ ID NO: 215567 - DNA, 23 bp, Artificial Sequence
  Description of Artificial Sequence: Synthetic oligonucleotide
acgcgcgcctcaatctcgacggc

SEQ ID NO: 215568 - DNA, 22 bp, Artificial Sequence
  Description of Artificial Sequence: Synthetic oligonucleotide
cgcgcgcctcaatctcgacggc

SEQ ID NO: 215569 - DNA, 23 bp, Artificial Sequence
  Description of Artificial Sequence: Synthetic oligonucleotide
gcgcgcctcaatctcgacggcct

SEQ ID NO: 215570 - DNA, 23 bp, Artificial Sequence
  Description of Artificial Sequence: Synthetic oligonucleotide
cgcgcctcaatctcgacggcctg

SEQ ID NO: 215571 - DNA, 24 bp, Artificial Sequence
  Description of Artificial Sequence: Synthetic oligonucleotide
gcgcctcaatctcgacggcctggt

SEQ ID NO: 215572 - DNA, 24 bp, Artificial Sequence
  Description of Artificial Sequence: Synthetic oligonucleotide
cgcctcaatctcgacggcctggtg

SEQ ID NO: 215573 - DNA, 25 bp, Artificial Sequence
  Description of Artificial Sequence: Synthetic oligonucleotide
gcctcaatctcgacggcctggtggt

SEQ ID NO: 215574 - DNA, 25 bp, Artificial Sequence
  Description of Artificial Sequence: Synthetic oligonucleotide
cctcaatctcgacggcctggtggtc

SEQ ID NO: 215575 - DNA, 25 bp, Artificial Sequence
  Description of Artificial Sequence: Synthetic oligonucleotide
ctcaatctcgacggcctggtggtcc

SEQ ID NO: 215576 - DNA, 25 bp, Artificial Sequence
  Description of Artificial Sequence: Synthetic oligonucleotide
tcaatctcgacggcctggtggtccg

SEQ ID NO: 215577 - DNA, 24 bp, Artificial Sequence
  Description of Artificial Sequence: Synthetic oligonucleotide
caatctcgacggcctggtggtccg

SEQ ID NO: 215578 - DNA, 26 bp, Artificial Sequence
  Description of Artificial Sequence: Synthetic oligonucleotide
aatctcgacggcctggtggtccgcaa

SEQ ID NO: 215579 - DNA, 25 bp, Artificial Sequence
  Description of Artificial Sequence: Synthetic oligonucleotide
atctcgacggcctggtggtccgcaa

SEQ ID NO: 215580 - DNA, 24 bp, Artificial Sequence
  Description of Artificial Sequence: Synthetic oligonucleotide
tctcgacggcctggtggtccgcaa

SEQ ID NO: 215581 - DNA, 23 bp, Artificial Sequence
  Description of Artificial Sequence: Synthetic oligonucleotide
ctcgacggcctggtggtccgcaa

SEQ ID NO: 215582 - DNA, 24 bp, Artificial Sequence
  Description of Artificial Sequence: Synthetic oligonucleotide
tcgacggcctggtggtccgcaaca

SEQ ID NO: 215583 - DNA, 23 bp, Artificial Sequence
  Description of Artificial Sequence: Synthetic oligonucleotide
cgacggcctggtggtccgcaaca

SEQ ID NO: 215584 - DNA, 23 bp, Artificial Sequence
  Description of Artificial Sequence: Synthetic oligonucleotide
gacggcctggtggtccgcaacag

SEQ ID NO: 215585 - DNA, 24 bp, Artificial Sequence
  Description of Artificial Sequence: Synthetic oligonucleotide
acggcctggtggtccgcaacagct

SEQ ID NO: 215586 - DNA, 23 bp, Artificial Sequence
  Description of Artificial Sequence: Synthetic oligonucleotide
cggcctggtggtccgcaacagct

SEQ ID NO: 215587 - DNA, 23 bp, Artificial Sequence
  Description of Artificial Sequence: Synthetic oligonucleotide
ggcctggtggtccgcaacagctc

SEQ ID NO: 215588 - DNA, 23 bp, Artificial Sequence
  Description of Artificial Sequence: Synthetic oligonucleotide
gcctggtggtccgcaacagctcg

SEQ ID NO: 215589 - DNA, 23 bp, Artificial Sequence
  Description of Artificial Sequence: Synthetic oligonucleotide
cctggtggtccgcaacagctcgg

SEQ ID NO: 215590 - DNA, 24 bp, Artificial Sequence
  Description of Artificial Sequence: Synthetic oligonucleotide
ctggtggtccgcaacagctcggca

SEQ ID NO: 215591 - DNA, 24 bp, Artificial Sequence
  Description of Artificial Sequence: Synthetic oligonucleotide
tggtggtccgcaacagctcggcac

SEQ ID NO: 215592 - DNA, 23 bp, Artificial Sequence
  Description of Artificial Sequence: Synthetic oligonucleotide
ggtggtccgcaacagctcggcac

SEQ ID NO: 215593 - DNA, 23 bp, Artificial Sequence
  Description of Artificial Sequence: Synthetic oligonucleotide
gtggtccgcaacagctcggcacc

SEQ ID NO: 215594 - DNA, 27 bp, Artificial Sequence
  Description of Artificial Sequence: Synthetic oligonucleotide
tggtccgcaacagctcggcacccatta

SEQ ID NO: 215595 - DNA, 26 bp, Artificial Sequence
  Description of Artificial Sequence: Synthetic oligonucleotide
ggtccgcaacagctcggcacccatta

SEQ ID NO: 215596 - DNA, 27 bp, Artificial Sequence
  Description of Artificial Sequence: Synthetic oligonucleotide
gtccgcaacagctcggcacccattaca

SEQ ID NO: 215597 - DNA, 27 bp, Artificial Sequence
  Description of Artificial Sequence: Synthetic oligonucleotide
tccgcaacagctcggcacccattacac

SEQ ID NO: 215598 - DNA, 27 bp, Artificial Sequence
  Description of Artificial Sequence: Synthetic oligonucleotide
ccgcaacagctcggcacccattacact

SEQ ID NO: 215599 - DNA, 27 bp, Artificial Sequence
  Description of Artificial Sequence: Synthetic oligonucleotide
cgcaacagctcggcacccattacactg

SEQ ID NO: 215600 - DNA, 29 bp, Artificial Sequence
  Description of Artificial Sequence: Synthetic oligonucleotide
gcaacagctcggcacccattacactgatg

SEQ ID NO: 215601 - DNA, 29 bp, Artificial Sequence
  Description of Artificial Sequence: Synthetic oligonucleotide
caacagctcggcacccattacactgatgc

SEQ ID NO: 215602 - DNA, 30 bp, Artificial Sequence
  Description of Artificial Sequence: Synthetic oligonucleotide
aacagctcggcacccattacactgatgctc

SEQ ID NO: 215603 - DNA, 29 bp, Artificial Sequence
  Description of Artificial Sequence: Synthetic oligonucleotide
acagctcggcacccattacactgatgctc

SEQ ID NO: 215604 - DNA, 28 bp, Artificial Sequence
  Description of Artificial Sequence: Synthetic oligonucleotide
cagctcggcacccattacactgatgctc

SEQ ID NO: 215605 - DNA, 28 bp, Artificial Sequence
  Description of Artificial Sequence: Synthetic oligonucleotide
agctcggcacccattacactgatgctcg

SEQ ID NO: 215606 - DNA, 27 bp, Artificial Sequence
  Description of Artificial Sequence: Synthetic oligonucleotide
gctcggcacccattacactgatgctcg

SEQ ID NO: 215607 - DNA, 27 bp, Artificial Sequence
  Description of Artificial Sequence: Synthetic oligonucleotide
ctcggcacccattacactgatgctcgc

SEQ ID NO: 215608 - DNA, 29 bp, Artificial Sequence
  Description of Artificial Sequence: Synthetic oligonucleotide
tcggcacccattacactgatgctcgcttg

SEQ ID NO: 215609 - DNA, 28 bp, Artificial Sequence
  Description of Artificial Sequence: Synthetic oligonucleotide
cggcacccattacactgatgctcgcttg

SEQ ID NO: 215610 - DNA, 28 bp, Artificial Sequence
  Description of Artificial Sequence: Synthetic oligonucleotide
ggcacccattacactgatgctcgcttgg

SEQ ID NO: 215611 - DNA, 29 bp, Artificial Sequence
  Description of Artificial Sequence: Synthetic oligonucleotide
gcacccattacactgatgctcgcttggag

SEQ ID NO: 215612 - DNA, 29 bp, Artificial Sequence
  Description of Artificial Sequence: Synthetic oligonucleotide
cacccattacactgatgctcgcttggagc

SEQ ID NO: 215613 - DNA, 29 bp, Artificial Sequence
  Description of Artificial Sequence: Synthetic oligonucleotide
acccattacactgatgctcgcttggagcc

SEQ ID NO: 215614 - DNA, 28 bp, Artificial Sequence
  Description of Artificial Sequence: Synthetic oligonucleotide
cccattacactgatgctcgcttggagcc

SEQ ID NO: 215615 - DNA, 28 bp, Artificial Sequence
  Description of Artificial Sequence: Synthetic oligonucleotide
ccattacactgatgctcgcttggagccc

SEQ ID NO: 215616 - DNA, 28 bp, Artificial Sequence
  Description of Artificial Sequence: Synthetic oligonucleotide
cattacactgatgctcgcttggagcccc

SEQ ID NO: 215617 - DNA, 28 bp, Artificial Sequence
  Description of Artificial Sequence: Synthetic oligonucleotide
attacactgatgctcgcttggagccccg

SEQ ID NO: 215618 - DNA, 27 bp, Artificial Sequence
  Description of Artificial Sequence: Synthetic oligonucleotide
ttacactgatgctcgcttggagccccg

SEQ ID NO: 215619 - DNA, 26 bp, Artificial Sequence
  Description of Artificial Sequence: Synthetic oligonucleotide
tacactgatgctcgcttggagccccg

SEQ ID NO: 215620 - DNA, 25 bp, Artificial Sequence
  Description of Artificial Sequence: Synthetic oligonucleotide
acactgatgctcgcttggagccccg

SEQ ID NO: 215621 - DNA, 24 bp, Artificial Sequence
  Description of Artificial Sequence: Synthetic oligonucleotide
cactgatgctcgcttggagccccg

SEQ ID NO: 215622 - DNA, 24 bp, Artificial Sequence
  Description of Artificial Sequence: Synthetic oligonucleotide
actgatgctcgcttggagccccgc

SEQ ID NO: 215623 - DNA, 23 bp, Artificial Sequence
  Description of Artificial Sequence: Synthetic oligonucleotide
ctgatgctcgcttggagccccgc

SEQ ID NO: 215624 - DNA, 23 bp, Artificial Sequence
  Description of Artificial Sequence: Synthetic oligonucleotide
tgatgctcgcttggagccccgcg

SEQ ID NO: 215625 - DNA, 22 bp, Artificial Sequence
  Description of Artificial Sequence: Synthetic oligonucleotide
gatgctcgcttggagccccgcg

SEQ ID NO: 215626 - DNA, 22 bp, Artificial Sequence
  Description of Artificial Sequence: Synthetic oligonucleotide
atgctcgcttggagccccgcgc

SEQ ID NO: 215627 - DNA, 21 bp, Artificial Sequence
  Description of Artificial Sequence: Synthetic oligonucleotide
tgctcgcttggagccccgcgc

SEQ ID NO: 215628 - DNA, 20 bp, Artificial Sequence
  Description of Artificial Sequence: Synthetic oligonucleotide
gctcgcttggagccccgcgc

SEQ ID NO: 215629 - DNA, 20 bp, Artificial Sequence
  Description of Artificial Sequence: Synthetic oligonucleotide
ctcgcttggagccccgcgcc

SEQ ID NO: 215630 - DNA, 21 bp, Artificial Sequence
  Description of Artificial Sequence: Synthetic oligonucleotide
tcgcttggagccccgcgccca

SEQ ID NO: 215631 - DNA, 20 bp, Artificial Sequence
  Description of Artificial Sequence: Synthetic oligonucleotide
cgcttggagccccgcgccca

SEQ ID NO: 215632 - DNA, 21 bp, Artificial Sequence
  Description of Artificial Sequence: Synthetic oligonucleotide
gcttggagccccgcgcccaca

SEQ ID NO: 215633 - DNA, 21 bp, Artificial Sequence
  Description of Artificial Sequence: Synthetic oligonucleotide
cttggagccccgcgcccacag

SEQ ID NO: 215634 - DNA, 24 bp, Artificial Sequence
  Description of Artificial Sequence: Synthetic oligonucleotide
ttggagccccgcgcccacagcttt

SEQ ID NO: 215635 - DNA, 23 bp, Artificial Sequence
  Description of Artificial Sequence: Synthetic oligonucleotide
tggagccccgcgcccacagcttt

SEQ ID NO: 215636 - DNA, 22 bp, Artificial Sequence
  Description of Artificial Sequence: Synthetic oligonucleotide
ggagccccgcgcccacagcttt

SEQ ID NO: 215637 - DNA, 22 bp, Artificial Sequence
  Description of Artificial Sequence: Synthetic oligonucleotide
gagccccgcgcccacagctttg

SEQ ID NO: 215638 - DNA, 22 bp, Artificial Sequence
  Description of Artificial Sequence: Synthetic oligonucleotide
agccccgcgcccacagctttgg

SEQ ID NO: 215639 - DNA, 21 bp, Artificial Sequence
  Description of Artificial Sequence: Synthetic oligonucleotide
gccccgcgcccacagctttgg

SEQ ID NO: 215640 - DNA, 21 bp, Artificial Sequence
  Description of Artificial Sequence: Synthetic oligonucleotide
ccccgcgcccacagctttggc

SEQ ID NO: 215641 - DNA, 22 bp, Artificial Sequence
  Description of Artificial Sequence: Synthetic oligonucleotide
cccgcgcccacagctttggcct

SEQ ID NO: 215642 - DNA, 22 bp, Artificial Sequence
  Description of Artificial Sequence: Synthetic oligonucleotide
ccgcgcccacagctttggcctc

SEQ ID NO: 215643 - DNA, 22 bp, Artificial Sequence
  Description of Artificial Sequence: Synthetic oligonucleotide
cgcgcccacagctttggcctcc

SEQ ID NO: 215644 - DNA, 22 bp, Artificial Sequence
  Description of Artificial Sequence: Synthetic oligonucleotide
gcgcccacagctttggcctccg

SEQ ID NO: 215645 - DNA, 24 bp, Artificial Sequence
  Description of Artificial Sequence: Synthetic oligonucleotide
cgcccacagctttggcctccggtt

SEQ ID NO: 215646 - DNA, 24 bp, Artificial Sequence
  Description of Artificial Sequence: Synthetic oligonucleotide
gcccacagctttggcctccggttc

SEQ ID NO: 215647 - DNA, 26 bp, Artificial Sequence
  Description of Artificial Sequence: Synthetic oligonucleotide
cccacagctttggcctccggttccat

SEQ ID NO: 215648 - DNA, 26 bp, Artificial Sequence
  Description of Artificial Sequence: Synthetic oligonucleotide
ccacagctttggcctccggttccatc

SEQ ID NO: 215649 - DNA, 26 bp, Artificial Sequence
  Description of Artificial Sequence: Synthetic oligonucleotide
cacagctttggcctccggttccatcg

SEQ ID NO: 215650 - DNA, 27 bp, Artificial Sequence
  Description of Artificial Sequence: Synthetic oligonucleotide
acagctttggcctccggttccatcgct

SEQ ID NO: 215651 - DNA, 26 bp, Artificial Sequence
  Description of Artificial Sequence: Synthetic oligonucleotide
cagctttggcctccggttccatcgct

SEQ ID NO: 215652 - DNA, 26 bp, Artificial Sequence
  Description of Artificial Sequence: Synthetic oligonucleotide
agctttggcctccggttccatcgctg

SEQ ID NO: 215653 - DNA, 25 bp, Artificial Sequence
  Description of Artificial Sequence: Synthetic oligonucleotide
gctttggcctccggttccatcgctg

SEQ ID NO: 215654 - DNA, 25 bp, Artificial Sequence
  Description of Artificial Sequence: Synthetic oligonucleotide
ctttggcctccggttccatcgctgc

SEQ ID NO: 215655 - DNA, 25 bp, Artificial Sequence
  Description of Artificial Sequence: Synthetic oligonucleotide
tttggcctccggttccatcgctgcc

SEQ ID NO: 215656 - DNA, 24 bp, Artificial Sequence
  Description of Artificial Sequence: Synthetic oligonucleotide
ttggcctccggttccatcgctgcc

SEQ ID NO: 215657 - DNA, 23 bp, Artificial Sequence
  Description of Artificial Sequence: Synthetic oligonucleotide
tggcctccggttccatcgctgcc

SEQ ID NO: 215658 - DNA, 22 bp, Artificial Sequence
  Description of Artificial Sequence: Synthetic oligonucleotide
ggcctccggttccatcgctgcc

SEQ ID NO: 215659 - DNA, 24 bp, Artificial Sequence
  Description of Artificial Sequence: Synthetic oligonucleotide
gcctccggttccatcgctgccctt

SEQ ID NO: 215660 - DNA, 26 bp, Artificial Sequence
  Description of Artificial Sequence: Synthetic oligonucleotide
cctccggttccatcgctgcccttgta

SEQ ID NO: 215661 - DNA, 26 bp, Artificial Sequence
  Description of Artificial Sequence: Synthetic oligonucleotide
ctccggttccatcgctgcccttgtag

SEQ ID NO: 215662 - DNA, 26 bp, Artificial Sequence
  Description of Artificial Sequence: Synthetic oligonucleotide
tccggttccatcgctgcccttgtagg

SEQ ID NO: 215663 - DNA, 25 bp, Artificial Sequence
  Description of Artificial Sequence: Synthetic oligonucleotide
ccggttccatcgctgcccttgtagg

SEQ ID NO: 215664 - DNA, 27 bp, Artificial Sequence
  Description of Artificial Sequence: Synthetic oligonucleotide
cggttccatcgctgcccttgtagggat

SEQ ID NO: 215665 - DNA, 27 bp, Artificial Sequence
  Description of Artificial Sequence: Synthetic oligonucleotide
ggttccatcgctgcccttgtagggatc

SEQ ID NO: 215666 - DNA, 27 bp, Artificial Sequence
  Description of Artificial Sequence: Synthetic oligonucleotide
gttccatcgctgcccttgtagggatcc

SEQ ID NO: 215667 - DNA, 28 bp, Artificial Sequence
  Description of Artificial Sequence: Synthetic oligonucleotide
ttccatcgctgcccttgtagggatcctc

SEQ ID NO: 215668 - DNA, 27 bp, Artificial Sequence
  Description of Artificial Sequence: Synthetic oligonucleotide
tccatcgctgcccttgtagggatcctc

SEQ ID NO: 215669 - DNA, 26 bp, Artificial Sequence
  Description of Artificial Sequence: Synthetic oligonucleotide
ccatcgctgcccttgtagggatcctc

SEQ ID NO: 215670 - DNA, 27 bp, Artificial Sequence
  Description of Artificial Sequence: Synthetic oligonucleotide
catcgctgcccttgtagggatcctcct

SEQ ID NO: 215671 - DNA, 27 bp, Artificial Sequence
  Description of Artificial Sequence: Synthetic oligonucleotide
atcgctgcccttgtagggatcctcctc

SEQ ID NO: 215672 - DNA, 27 bp, Artificial Sequence
  Description of Artificial Sequence: Synthetic oligonucleotide
tcgctgcccttgtagggatcctcctca

SEQ ID NO: 215673 - DNA, 26 bp, Artificial Sequence
  Description of Artificial Sequence: Synthetic oligonucleotide
cgctgcccttgtagggatcctcctca

SEQ ID NO: 215674 - DNA, 27 bp, Artificial Sequence
  Description of Artificial Sequence: Synthetic oligonucleotide
gctgcccttgtagggatcctcctcact

SEQ ID NO: 215675 - DNA, 27 bp, Artificial Sequence
  Description of Artificial Sequence: Synthetic oligonucleotide
ctgcccttgtagggatcctcctcactg

SEQ ID NO: 215676 - DNA, 28 bp, Artificial Sequence
  Description of Artificial Sequence: Synthetic oligonucleotide
tgcccttgtagggatcctcctcactgtg

SEQ ID NO: 215677 - DNA, 27 bp, Artificial Sequence
  Description of Artificial Sequence: Synthetic oligonucleotide
gcccttgtagggatcctcctcactgtg

SEQ ID NO: 215678 - DNA, 27 bp, Artificial Sequence
  Description of Artificial Sequence: Synthetic oligonucleotide
cccttgtagggatcctcctcactgtgg

SEQ ID NO: 215679 - DNA, 27 bp, Artificial Sequence
  Description of Artificial Sequence: Synthetic oligonucleotide
ccttgtagggatcctcctcactgtggg

SEQ ID NO: 215680 - DNA, 27 bp, Artificial Sequence
  Description of Artificial Sequence: Synthetic oligonucleotide
cttgtagggatcctcctcactgtgggc

SEQ ID NO: 215681 - DNA, 27 bp, Artificial Sequence
  Description of Artificial Sequence: Synthetic oligonucleotide
ttgtagggatcctcctcactgtgggcg

SEQ ID NO: 215682 - DNA, 26 bp, Artificial Sequence
  Description of Artificial Sequence: Synthetic oligonucleotide
tgtagggatcctcctcactgtgggcg

SEQ ID NO: 215683 - DNA, 25 bp, Artificial Sequence
  Description of Artificial Sequence: Synthetic oligonucleotide
gtagggatcctcctcactgtgggcg

SEQ ID NO: 215684 - DNA, 26 bp, Artificial Sequence
  Description of Artificial Sequence: Synthetic oligonucleotide
tagggatcctcctcactgtgggcgct

SEQ ID NO: 215685 - DNA, 25 bp, Artificial Sequence
  Description of Artificial Sequence: Synthetic oligonucleotide
agggatcctcctcactgtgggcgct

SEQ ID NO: 215686 - DNA, 24 bp, Artificial Sequence
  Description of Artificial Sequence: Synthetic oligonucleotide
gggatcctcctcactgtgggcgct

SEQ ID NO: 215687 - DNA, 24 bp, Artificial Sequence
  Description of Artificial Sequence: Synthetic oligonucleotide
ggatcctcctcactgtgggcgctg

SEQ ID NO: 215688 - DNA, 24 bp, Artificial Sequence
  Description of Artificial Sequence: Synthetic oligonucleotide
gatcctcctcactgtgggcgctgc

SEQ ID NO: 215689 - DNA, 26 bp, Artificial Sequence
  Description of Artificial Sequence: Synthetic oligonucleotide
atcctcctcactgtgggcgctgcgta

SEQ ID NO: 215690 - DNA, 25 bp, Artificial Sequence
  Description of Artificial Sequence: Synthetic oligonucleotide
tcctcctcactgtgggcgctgcgta

SEQ ID NO: 215691 - DNA, 24 bp, Artificial Sequence
  Description of Artificial Sequence: Synthetic oligonucleotide
cctcctcactgtgggcgctgcgta

SEQ ID NO: 215692 - DNA, 24 bp, Artificial Sequence
  Description of Artificial Sequence: Synthetic oligonucleotide
ctcctcactgtgggcgctgcgtac

SEQ ID NO: 215693 - DNA, 27 bp, Artificial Sequence
  Description of Artificial Sequence: Synthetic oligonucleotide
tcctcactgtgggcgctgcgtacctat

SEQ ID NO: 215694 - DNA, 26 bp, Artificial Sequence
  Description of Artificial Sequence: Synthetic oligonucleotide
cctcactgtgggcgctgcgtacctat

SEQ ID NO: 215695 - DNA, 26 bp, Artificial Sequence
  Description of Artificial Sequence: Synthetic oligonucleotide
ctcactgtgggcgctgcgtacctatg

SEQ ID NO: 215696 - DNA, 27 bp, Artificial Sequence
  Description of Artificial Sequence: Synthetic oligonucleotide
tcactgtgggcgctgcgtacctatgca

SEQ ID NO: 215697 - DNA, 27 bp, Artificial Sequence
  Description of Artificial Sequence: Synthetic oligonucleotide
cactgtgggcgctgcgtacctatgcaa

SEQ ID NO: 215698 - DNA, 27 bp, Artificial Sequence
  Description of Artificial Sequence: Synthetic oligonucleotide
actgtgggcgctgcgtacctatgcaag

SEQ ID NO: 215699 - DNA, 27 bp, Artificial Sequence
  Description of Artificial Sequence: Synthetic oligonucleotide
ctgtgggcgctgcgtacctatgcaagt

SEQ ID NO: 215700 - DNA, 27 bp, Artificial Sequence
  Description of Artificial Sequence: Synthetic oligonucleotide
tgtgggcgctgcgtacctatgcaagtg

SEQ ID NO: 215701 - DNA, 26 bp, Artificial Sequence
  Description of Artificial Sequence: Synthetic oligonucleotide
gtgggcgctgcgtacctatgcaagtg

SEQ ID NO: 215702 - DNA, 26 bp, Artificial Sequence
  Description of Artificial Sequence: Synthetic oligonucleotide
tgggcgctgcgtacctatgcaagtgc

SEQ ID NO: 215703 - DNA, 25 bp, Artificial Sequence
  Description of Artificial Sequence: Synthetic oligonucleotide
gggcgctgcgtacctatgcaagtgc

SEQ ID NO: 215704 - DNA, 27 bp, Artificial Sequence
  Description of Artificial Sequence: Synthetic oligonucleotide
ggcgctgcgtacctatgcaagtgccta

SEQ ID NO: 215705 - DNA, 27 bp, Artificial Sequence
  Description of Artificial Sequence: Synthetic oligonucleotide
gcgctgcgtacctatgcaagtgcctag

SEQ ID NO: 215706 - DNA, 27 bp, Artificial Sequence
  Description of Artificial Sequence: Synthetic oligonucleotide
cgctgcgtacctatgcaagtgcctagc

SEQ ID NO: 215707 - DNA, 30 bp, Artificial Sequence
  Description of Artificial Sequence: Synthetic oligonucleotide
gctgcgtacctatgcaagtgcctagctatg

SEQ ID NO: 215708 - DNA, 32 bp, Artificial Sequence
  Description of Artificial Sequence: Synthetic oligonucleotide
ctgcgtacctatgcaagtgcctagctatgaag

SEQ ID NO: 215709 - DNA, 33 bp, Artificial Sequence
  Description of Artificial Sequence: Synthetic oligonucleotide
tgcgtacctatgcaagtgcctagctatgaagtc

SEQ ID NO: 215710 - DNA, 32 bp, Artificial Sequence
  Description of Artificial Sequence: Synthetic oligonucleotide
gcgtacctatgcaagtgcctagctatgaagtc

SEQ ID NO: 215711 - DNA, 32 bp, Artificial Sequence
  Description of Artificial Sequence: Synthetic oligonucleotide
cgtacctatgcaagtgcctagctatgaagtcc

SEQ ID NO: 215712 - DNA, 32 bp, Artificial Sequence
  Description of Artificial Sequence: Synthetic oligonucleotide
gtacctatgcaagtgcctagctatgaagtccc

SEQ ID NO: 215713 - DNA, 33 bp, Artificial Sequence
  Description of Artificial Sequence: Synthetic oligonucleotide
tacctatgcaagtgcctagctatgaagtcccag

SEQ ID NO: 215714 - DNA, 32 bp, Artificial Sequence
  Description of Artificial Sequence: Synthetic oligonucleotide
acctatgcaagtgcctagctatgaagtcccag

SEQ ID NO: 215715 - DNA, 31 bp, Artificial Sequence
  Description of Artificial Sequence: Synthetic oligonucleotide
cctatgcaagtgcctagctatgaagtcccag

SEQ ID NO: 215716 - DNA, 31 bp, Artificial Sequence
  Description of Artificial Sequence: Synthetic oligonucleotide
ctatgcaagtgcctagctatgaagtcccagg

SEQ ID NO: 215717 - DNA, 31 bp, Artificial Sequence
  Description of Artificial Sequence: Synthetic oligonucleotide
tatgcaagtgcctagctatgaagtcccaggc

SEQ ID NO: 215718 - DNA, 30 bp, Artificial Sequence
  Description of Artificial Sequence: Synthetic oligonucleotide
atgcaagtgcctagctatgaagtcccaggc

SEQ ID NO: 215719 - DNA, 29 bp, Artificial Sequence
  Description of Artificial Sequence: Synthetic oligonucleotide
tgcaagtgcctagctatgaagtcccaggc

SEQ ID NO: 215720 - DNA, 28 bp, Artificial Sequence
  Description of Artificial Sequence: Synthetic oligonucleotide
gcaagtgcctagctatgaagtcccaggc

SEQ ID NO: 215721 - DNA, 28 bp, Artificial Sequence
  Description of Artificial Sequence: Synthetic oligonucleotide
caagtgcctagctatgaagtcccaggcg

SEQ ID NO: 215722 - DNA, 25 bp, Artificial Sequence
  Description of Artificial Sequence: Synthetic oligonucleotide
gccacctccaggatcaccgcctaca

SEQ ID NO: 215723 - DNA, 26 bp, Artificial Sequence
  Description of Artificial Sequence: Synthetic oligonucleotide
ccacctccaggatcaccgcctacagt

SEQ ID NO: 215724 - DNA, 27 bp, Artificial Sequence
  Description of Artificial Sequence: Synthetic oligonucleotide
cacctccaggatcaccgcctacagtgt

SEQ ID NO: 215725 - DNA, 28 bp, Artificial Sequence
  Description of Artificial Sequence: Synthetic oligonucleotide
acctccaggatcaccgcctacagtgttc

SEQ ID NO: 215726 - DNA, 27 bp, Artificial Sequence
  Description of Artificial Sequence: Synthetic oligonucleotide
cctccaggatcaccgcctacagtgttc

SEQ ID NO: 215727 - DNA, 27 bp, Artificial Sequence
  Description of Artificial Sequence: Synthetic oligonucleotide
ctccaggatcaccgcctacagtgttcc

SEQ ID NO: 215728 - DNA, 27 bp, Artificial Sequence
  Description of Artificial Sequence: Synthetic oligonucleotide
tccaggatcaccgcctacagtgttccc

SEQ ID NO: 215729 - DNA, 26 bp, Artificial Sequence
  Description of Artificial Sequence: Synthetic oligonucleotide
ccaggatcaccgcctacagtgttccc

SEQ ID NO: 215730 - DNA, 26 bp, Artificial Sequence
  Description of Artificial Sequence: Synthetic oligonucleotide
caggatcaccgcctacagtgttcccg

SEQ ID NO: 215731 - DNA, 27 bp, Artificial Sequence
  Description of Artificial Sequence: Synthetic oligonucleotide
aggatcaccgcctacagtgttcccggt

SEQ ID NO: 215732 - DNA, 26 bp, Artificial Sequence
  Description of Artificial Sequence: Synthetic oligonucleotide
ggatcaccgcctacagtgttcccggt

SEQ ID NO: 215733 - DNA, 26 bp, Artificial Sequence
  Description of Artificial Sequence: Synthetic oligonucleotide
gatcaccgcctacagtgttcccggtg

SEQ ID NO: 215734 - DNA, 26 bp, Artificial Sequence
  Description of Artificial Sequence: Synthetic oligonucleotide
atcaccgcctacagtgttcccggtgg

SEQ ID NO: 215735 - DNA, 25 bp, Artificial Sequence
  Description of Artificial Sequence: Synthetic oligonucleotide
tcaccgcctacagtgttcccggtgg

SEQ ID NO: 215736 - DNA, 24 bp, Artificial Sequence
  Description of Artificial Sequence: Synthetic oligonucleotide
caccgcctacagtgttcccggtgg

SEQ ID NO: 215737 - DNA, 24 bp, Artificial Sequence
  Description of Artificial Sequence: Synthetic oligonucleotide
accgcctacagtgttcccggtggg

SEQ ID NO: 215738 - DNA, 23 bp, Artificial Sequence
  Description of Artificial Sequence: Synthetic oligonucleotide
ccgcctacagtgttcccggtggg

SEQ ID NO: 215739 - DNA, 25 bp, Artificial Sequence
  Description of Artificial Sequence: Synthetic oligonucleotide
cgcctacagtgttcccggtgggcta

SEQ ID NO: 215740 - DNA, 27 bp, Artificial Sequence
  Description of Artificial Sequence: Synthetic oligonucleotide
gcctacagtgttcccggtgggctactt

SEQ ID NO: 215741 - DNA, 27 bp, Artificial Sequence
  Description of Artificial Sequence: Synthetic oligonucleotide
cctacagtgttcccggtgggctacttg

SEQ ID NO: 215742 - DNA, 27 bp, Artificial Sequence
  Description of Artificial Sequence: Synthetic oligonucleotide
ctacagtgttcccggtgggctacttgg

SEQ ID NO: 215743 - DNA, 28 bp, Artificial Sequence
  Description of Artificial Sequence: Synthetic oligonucleotide
tacagtgttcccggtgggctacttggtg

SEQ ID NO: 215744 - DNA, 27 bp, Artificial Sequence
  Description of Artificial Sequence: Synthetic oligonucleotide
acagtgttcccggtgggctacttggtg

SEQ ID NO: 215745 - DNA, 26 bp, Artificial Sequence
  Description of Artificial Sequence: Synthetic oligonucleotide
cagtgttcccggtgggctacttggtg

SEQ ID NO: 215746 - DNA, 27 bp, Artificial Sequence
  Description of Artificial Sequence: Synthetic oligonucleotide
agtgttcccggtgggctacttggtggt

SEQ ID NO: 215747 - DNA, 34 bp, Artificial Sequence
  Description of Artificial Sequence: Synthetic oligonucleotide
tctctgttccctctgtcgctgctgttttttttgc

SEQ ID NO: 215748 - DNA, 33 bp, Artificial Sequence
  Description of Artificial Sequence: Synthetic oligonucleotide
ctctgttccctctgtcgctgctgttttttttgc

SEQ ID NO: 215749 - DNA, 33 bp, Artificial Sequence
  Description of Artificial Sequence: Synthetic oligonucleotide
tctgttccctctgtcgctgctgttttttttgcg

SEQ ID NO: 215750 - DNA, 32 bp, Artificial Sequence
  Description of Artificial Sequence: Synthetic oligonucleotide
ctgttccctctgtcgctgctgttttttttgcg

SEQ ID NO: 215751 - DNA, 32 bp, Artificial Sequence
  Description of Artificial Sequence: Synthetic oligonucleotide
tgttccctctgtcgctgctgttttttttgcgg

SEQ ID NO: 215752 - DNA, 31 bp, Artificial Sequence
  Description of Artificial Sequence: Synthetic oligonucleotide
gttccctctgtcgctgctgttttttttgcgg

SEQ ID NO: 215753 - DNA, 31 bp, Artificial Sequence
  Description of Artificial Sequence: Synthetic oligonucleotide
ttccctctgtcgctgctgttttttttgcggc

SEQ ID NO: 215754 - DNA, 30 bp, Artificial Sequence
  Description of Artificial Sequence: Synthetic oligonucleotide
tccctctgtcgctgctgttttttttgcggc

SEQ ID NO: 215755 - DNA, 29 bp, Artificial Sequence
  Description of Artificial Sequence: Synthetic oligonucleotide
ccctctgtcgctgctgttttttttgcggc

SEQ ID NO: 215756 - DNA, 29 bp, Artificial Sequence
  Description of Artificial Sequence: Synthetic oligonucleotide
cctctgtcgctgctgttttttttgcggcc

SEQ ID NO: 215757 - DNA, 29 bp, Artificial Sequence
  Description of Artificial Sequence: Synthetic oligonucleotide
ctctgtcgctgctgttttttttgcggccg

SEQ ID NO: 215758 - DNA, 29 bp, Artificial Sequence
  Description of Artificial Sequence: Synthetic oligonucleotide
tctgtcgctgctgttttttttgcggccgc

SEQ ID NO: 215759 - DNA, 28 bp, Artificial Sequence
  Description of Artificial Sequence: Synthetic oligonucleotide
ctgtcgctgctgttttttttgcggccgc

SEQ ID NO: 215760 - DNA, 28 bp, Artificial Sequence
  Description of Artificial Sequence: Synthetic oligonucleotide
tgtcgctgctgttttttttgcggccgcc

SEQ ID NO: 215761 - DNA, 27 bp, Artificial Sequence
  Description of Artificial Sequence: Synthetic oligonucleotide
gtcgctgctgttttttttgcggccgcc

SEQ ID NO: 215762 - DNA, 29 bp, Artificial Sequence
  Description of Artificial Sequence: Synthetic oligonucleotide
tcgctgctgttttttttgcggccgcctac

SEQ ID NO: 215763 - DNA, 28 bp, Artificial Sequence
  Description of Artificial Sequence: Synthetic oligonucleotide
cgctgctgttttttttgcggccgcctac

SEQ ID NO: 215764 - DNA, 28 bp, Artificial Sequence
  Description of Artificial Sequence: Synthetic oligonucleotide
gctgctgttttttttgcggccgcctacc

SEQ ID NO: 215765 - DNA, 28 bp, Artificial Sequence
  Description of Artificial Sequence: Synthetic oligonucleotide
ctgctgttttttttgcggccgcctaccc

SEQ ID NO: 215766 - DNA, 28 bp, Artificial Sequence
  Description of Artificial Sequence: Synthetic oligonucleotide
tgctgttttttttgcggccgcctacccg

SEQ ID NO: 215767 - DNA, 27 bp, Artificial Sequence
  Description of Artificial Sequence: Synthetic oligonucleotide
gctgttttttttgcggccgcctacccg

SEQ ID NO: 215768 - DNA, 27 bp, Artificial Sequence
  Description of Artificial Sequence: Synthetic oligonucleotide
ctgttttttttgcggccgcctacccgg

SEQ ID NO: 215769 - DNA, 27 bp, Artificial Sequence
  Description of Artificial Sequence: Synthetic oligonucleotide
tgttttttttgcggccgcctacccggg

SEQ ID NO: 215770 - DNA, 27 bp, Artificial Sequence
  Description of Artificial Sequence: Synthetic oligonucleotide
gttttttttgcggccgcctacccggga

SEQ ID NO: 215771 - DNA, 27 bp, Artificial Sequence
  Description of Artificial Sequence: Synthetic oligonucleotide
ttttttttgcggccgcctacccgggag

SEQ ID NO: 215772 - DNA, 27 bp, Artificial Sequence
  Description of Artificial Sequence: Synthetic oligonucleotide
tttttttgcggccgcctacccgggagt

SEQ ID NO: 215773 - DNA, 27 bp, Artificial Sequence
  Description of Artificial Sequence: Synthetic oligonucleotide
ttttttgcggccgcctacccgggagtt

SEQ ID NO: 215774 - DNA, 26 bp, Artificial Sequence
  Description of Artificial Sequence: Synthetic oligonucleotide
tttttgcggccgcctacccgggagtt

SEQ ID NO: 215775 - DNA, 25 bp, Artificial Sequence
  Description of Artificial Sequence: Synthetic oligonucleotide
ttttgcggccgcctacccgggagtt

SEQ ID NO: 215776 - DNA, 24 bp, Artificial Sequence
  Description of Artificial Sequence: Synthetic oligonucleotide
tttgcggccgcctacccgggagtt

SEQ ID NO: 215777 - DNA, 23 bp, Artificial Sequence
  Description of Artificial Sequence: Synthetic oligonucleotide
ttgcggccgcctacccgggagtt

SEQ ID NO: 215778 - DNA, 22 bp, Artificial Sequence
  Description of Artificial Sequence: Synthetic oligonucleotide
tgcggccgcctacccgggagtt

SEQ ID NO: 215779 - DNA, 22 bp, Artificial Sequence
  Description of Artificial Sequence: Synthetic oligonucleotide
gcgctgggacgccggactaagg

SEQ ID NO: 215780 - DNA, 22 bp, Artificial Sequence
  Description of Artificial Sequence: Synthetic oligonucleotide
cgctgggacgccggactaaggg

SEQ ID NO: 215781 - DNA, 22 bp, Artificial Sequence
  Description of Artificial Sequence: Synthetic oligonucleotide
gctgggacgccggactaagggc

SEQ ID NO: 215782 - DNA, 22 bp, Artificial Sequence
  Description of Artificial Sequence: Synthetic oligonucleotide
ctgggacgccggactaagggcg

SEQ ID NO: 215783 - DNA, 25 bp, Artificial Sequence
  Description of Artificial Sequence: Synthetic oligonucleotide
tgggacgccggactaagggcgcaaa

SEQ ID NO: 215784 - DNA, 24 bp, Artificial Sequence
  Description of Artificial Sequence: Synthetic oligonucleotide
gggacgccggactaagggcgcaaa

SEQ ID NO: 215785 - DNA, 24 bp, Artificial Sequence
  Description of Artificial Sequence: Synthetic oligonucleotide
ggacgccggactaagggcgcaaag

SEQ ID NO: 215786 - DNA, 24 bp, Artificial Sequence
  Description of Artificial Sequence: Synthetic oligonucleotide
gacgccggactaagggcgcaaagc

SEQ ID NO: 215787 - DNA, 24 bp, Artificial Sequence
  Description of Artificial Sequence: Synthetic oligonucleotide
acgccggactaagggcgcaaagcc

SEQ ID NO: 215788 - DNA, 23 bp, Artificial Sequence
  Description of Artificial Sequence: Synthetic oligonucleotide
cgccggactaagggcgcaaagcc

SEQ ID NO: 215789 - DNA, 23 bp, Artificial Sequence
  Description of Artificial Sequence: Synthetic oligonucleotide
gccggactaagggcgcaaagccc

SEQ ID NO: 215790 - DNA, 25 bp, Artificial Sequence
  Description of Artificial Sequence: Synthetic oligonucleotide
ccggactaagggcgcaaagccccaa

SEQ ID NO: 215791 - DNA, 25 bp, Artificial Sequence
  Description of Artificial Sequence: Synthetic oligonucleotide
cggactaagggcgcaaagccccaag

SEQ ID NO: 215792 - DNA, 25 bp, Artificial Sequence
  Description of Artificial Sequence: Synthetic oligonucleotide
ggactaagggcgcaaagccccaagg

SEQ ID NO: 215793 - DNA, 27 bp, Artificial Sequence
  Description of Artificial Sequence: Synthetic oligonucleotide
gactaagggcgcaaagccccaagggta

SEQ ID NO: 215794 - DNA, 27 bp, Artificial Sequence
  Description of Artificial Sequence: Synthetic oligonucleotide
actaagggcgcaaagccccaagggtag

SEQ ID NO: 215795 - DNA, 26 bp, Artificial Sequence
  Description of Artificial Sequence: Synthetic oligonucleotide
ctaagggcgcaaagccccaagggtag

SEQ ID NO: 215796 - DNA, 26 bp, Artificial Sequence
  Description of Artificial Sequence: Synthetic oligonucleotide
taagggcgcaaagccccaagggtagc

SEQ ID NO: 215797 - DNA, 25 bp, Artificial Sequence
  Description of Artificial Sequence: Synthetic oligonucleotide
aagggcgcaaagccccaagggtagc

SEQ ID NO: 215798 - DNA, 24 bp, Artificial Sequence
  Description of Artificial Sequence: Synthetic oligonucleotide
agggcgcaaagccccaagggtagc

SEQ ID NO: 215799 - DNA, 20 bp, Artificial Sequence
  Description of Artificial Sequence: Synthetic oligonucleotide
atggcccgcggggctgcgct

SEQ ID NO: 215800 - DNA, 20 bp, Artificial Sequence
  Description of Artificial Sequence: Synthetic oligonucleotide
tggcccgcggggctgcgctt

SEQ ID NO: 215801 - DNA, 20 bp, Artificial Sequence
  Description of Artificial Sequence: Synthetic oligonucleotide
ggcccgcggggctgcgcttt

SEQ ID NO: 215802 - DNA, 20 bp, Artificial Sequence
  Description of Artificial Sequence: Synthetic oligonucleotide
gcccgcggggctgcgctgtt

SEQ ID NO: 215803 - DNA, 20 bp, Artificial Sequence
  Description of Artificial Sequence: Synthetic oligonucleotide
cccgcggggctgcgctggtt

SEQ ID NO: 215804 - DNA, 20 bp, Artificial Sequence
  Description of Artificial Sequence: Synthetic oligonucleotide
ccgcggggctgcgctggctt

SEQ ID NO: 215805 - DNA, 20 bp, Artificial Sequence
  Description of Artificial Sequence: Synthetic oligonucleotide
cgcggggctgcgctggcgtt

SEQ ID NO: 215806 - DNA, 20 bp, Artificial Sequence
  Description of Artificial Sequence: Synthetic oligonucleotide
gcggggctgcgctggcgctt

SEQ ID NO: 215807 - DNA, 20 bp, Artificial Sequence
  Description of Artificial Sequence: Synthetic oligonucleotide
cggggctgcgctggcgctgt

SEQ ID NO: 215808 - DNA, 20 bp, Artificial Sequence
  Description of Artificial Sequence: Synthetic oligonucleotide
ggggctgcgctggcgctgct

SEQ ID NO: 215809 - DNA, 20 bp, Artificial Sequence
  Description of Artificial Sequence: Synthetic oligonucleotide
gggctgcgctggcgctgctg

SEQ ID NO: 215810 - DNA, 21 bp, Artificial Sequence
  Description of Artificial Sequence: Synthetic oligonucleotide
ggctgcgctggcgctgctgct

SEQ ID NO: 215811 - DNA, 23 bp, Artificial Sequence
  Description of Artificial Sequence: Synthetic oligonucleotide
gctgcgctggcgctgctgctctt

SEQ ID NO: 215812 - DNA, 23 bp, Artificial Sequence
  Description of Artificial Sequence: Synthetic oligonucleotide
ctgcgctggcgctgctgctcttc

SEQ ID NO: 215813 - DNA, 23 bp, Artificial Sequence
  Description of Artificial Sequence: Synthetic oligonucleotide
tgcgctggcgctgctgctcttcg

SEQ ID NO: 215814 - DNA, 22 bp, Artificial Sequence
  Description of Artificial Sequence: Synthetic oligonucleotide
gcgctggcgctgctgctcttcg

SEQ ID NO: 215815 - DNA, 22 bp, Artificial Sequence
  Description of Artificial Sequence: Synthetic oligonucleotide
cgctggcgctgctgctcttcgg

SEQ ID NO: 215816 - DNA, 22 bp, Artificial Sequence
  Description of Artificial Sequence: Synthetic oligonucleotide
gctggcgctgctgctcttcggc

SEQ ID NO: 215817 - DNA, 23 bp, Artificial Sequence
  Description of Artificial Sequence: Synthetic oligonucleotide
ctggcgctgctgctcttcggcct

SEQ ID NO: 215818 - DNA, 23 bp, Artificial Sequence
  Description of Artificial Sequence: Synthetic oligonucleotide
tggcgctgctgctcttcggcctg

SEQ ID NO: 215819 - DNA, 22 bp, Artificial Sequence
  Description of Artificial Sequence: Synthetic oligonucleotide
ggcgctgctgctcttcggcctg

SEQ ID NO: 215820 - DNA, 23 bp, Artificial Sequence
  Description of Artificial Sequence: Synthetic oligonucleotide
gcgctgctgctcttcggcctgct

SEQ ID NO: 215821 - DNA, 23 bp, Artificial Sequence
  Description of Artificial Sequence: Synthetic oligonucleotide
cgctgctgctcttcggcctgctg

SEQ ID NO: 215822 - DNA, 23 bp, Artificial Sequence
  Description of Artificial Sequence: Synthetic oligonucleotide
gctgctgctcttcggcctgctgg

SEQ ID NO: 215823 - DNA, 24 bp, Artificial Sequence
  Description of Artificial Sequence: Synthetic oligonucleotide
ctgctgctcttcggcctgctgggt

SEQ ID NO: 215824 - DNA, 26 bp, Artificial Sequence
  Description of Artificial Sequence: Synthetic oligonucleotide
tgctgctcttcggcctgctgggtgtt

SEQ ID NO: 215825 - DNA, 25 bp, Artificial Sequence
  Description of Artificial Sequence: Synthetic oligonucleotide
gctgctcttcggcctgctgggtgtt

SEQ ID NO: 215826 - DNA, 26 bp, Artificial Sequence
  Description of Artificial Sequence: Synthetic oligonucleotide
ctgctcttcggcctgctgggtgttct

SEQ ID NO: 215827 - DNA, 26 bp, Artificial Sequence
  Description of Artificial Sequence: Synthetic oligonucleotide
tgctcttcggcctgctgggtgttctg

SEQ ID NO: 215828 - DNA, 25 bp, Artificial Sequence
  Description of Artificial Sequence: Synthetic oligonucleotide
gctcttcggcctgctgggtgttctg

SEQ ID NO: 215829 - DNA, 26 bp, Artificial Sequence
  Description of Artificial Sequence: Synthetic oligonucleotide
ctcttcggcctgctgggtgttctggt

SEQ ID NO: 215830 - DNA, 26 bp, Artificial Sequence
  Description of Artificial Sequence: Synthetic oligonucleotide
tcttcggcctgctgggtgttctggtc

SEQ ID NO: 215831 - DNA, 25 bp, Artificial Sequence
  Description of Artificial Sequence: Synthetic oligonucleotide
cttcggcctgctgggtgttctggtc

SEQ ID NO: 215832 - DNA, 25 bp, Artificial Sequence
  Description of Artificial Sequence: Synthetic oligonucleotide
ttcggcctgctgggtgttctggtcg

SEQ ID NO: 215833 - DNA, 24 bp, Artificial Sequence
  Description of Artificial Sequence: Synthetic oligonucleotide
tcggcctgctgggtgttctggtcg

SEQ ID NO: 215834 - DNA, 23 bp, Artificial Sequence
  Description of Artificial Sequence: Synthetic oligonucleotide
cggcctgctgggtgttctggtcg

SEQ ID NO: 215835 - DNA, 23 bp, Artificial Sequence
  Description of Artificial Sequence: Synthetic oligonucleotide
ggcctgctgggtgttctggtcgc

SEQ ID NO: 215836 - DNA, 23 bp, Artificial Sequence
  Description of Artificial Sequence: Synthetic oligonucleotide
gcctgctgggtgttctggtcgcc

SEQ ID NO: 215837 - DNA, 23 bp, Artificial Sequence
  Description of Artificial Sequence: Synthetic oligonucleotide
cctgctgggtgttctggtcgccg

SEQ ID NO: 215838 - DNA, 23 bp, Artificial Sequence
  Description of Artificial Sequence: Synthetic oligonucleotide
ctgctgggtgttctggtcgccgc

SEQ ID NO: 215839 - DNA, 23 bp, Artificial Sequence
  Description of Artificial Sequence: Synthetic oligonucleotide
tgctgggtgttctggtcgccgcc

SEQ ID NO: 215840 - DNA, 22 bp, Artificial Sequence
  Description of Artificial Sequence: Synthetic oligonucleotide
gctgggtgttctggtcgccgcc

SEQ ID NO: 215841 - DNA, 22 bp, Artificial Sequence
  Description of Artificial Sequence: Synthetic oligonucleotide
ctgggtgttctggtcgccgccc

SEQ ID NO: 215842 - DNA, 22 bp, Artificial Sequence
  Description of Artificial Sequence: Synthetic oligonucleotide
tgggtgttctggtcgccgcccc

SEQ ID NO: 215843 - DNA, 21 bp, Artificial Sequence
  Description of Artificial Sequence: Synthetic oligonucleotide
gggtgttctggtcgccgcccc

SEQ ID NO: 215844 - DNA, 21 bp, Artificial Sequence
  Description of Artificial Sequence: Synthetic oligonucleotide
ggtgttctggtcgccgccccg

SEQ ID NO: 215845 - DNA, 23 bp, Artificial Sequence
  Description of Artificial Sequence: Synthetic oligonucleotide
gtgttctggtcgccgccccggat

SEQ ID NO: 215846 - DNA, 23 bp, Artificial Sequence
  Description of Artificial Sequence: Synthetic oligonucleotide
tgttctggtcgccgccccggatg

SEQ ID NO: 215847 - DNA, 22 bp, Artificial Sequence
  Description of Artificial Sequence: Synthetic oligonucleotide
gttctggtcgccgccccggatg

SEQ ID NO: 215848 - DNA, 23 bp, Artificial Sequence
  Description of Artificial Sequence: Synthetic oligonucleotide
ttctggtcgccgccccggatggt

SEQ ID NO: 215849 - DNA, 22 bp, Artificial Sequence
  Description of Artificial Sequence: Synthetic oligonucleotide
tctggtcgccgccccggatggt

SEQ ID NO: 215850 - DNA, 21 bp, Artificial Sequence
  Description of Artificial Sequence: Synthetic oligonucleotide
ctggtcgccgccccggatggt

SEQ ID NO: 215851 - DNA, 21 bp, Artificial Sequence
  Description of Artificial Sequence: Synthetic oligonucleotide
tggtcgccgccccggatggtg

SEQ ID NO: 215852 - DNA, 20 bp, Artificial Sequence
  Description of Artificial Sequence: Synthetic oligonucleotide
ggtcgccgccccggatggtg

SEQ ID NO: 215853 - DNA, 23 bp, Artificial Sequence
  Description of Artificial Sequence: Synthetic oligonucleotide
gtcgccgccccggatggtggttt

SEQ ID NO: 215854 - DNA, 23 bp, Artificial Sequence
  Description of Artificial Sequence: Synthetic oligonucleotide
tcgccgccccggatggtggtttc

SEQ ID NO: 215855 - DNA, 22 bp, Artificial Sequence
  Description of Artificial Sequence: Synthetic oligonucleotide
cgccgccccggatggtggtttc

SEQ ID NO: 215856 - DNA, 27 bp, Artificial Sequence
  Description of Artificial Sequence: Synthetic oligonucleotide
gccgccccggatggtggtttcgattta

SEQ ID NO: 215857 - DNA, 28 bp, Artificial Sequence
  Description of Artificial Sequence: Synthetic oligonucleotide
ccgccccggatggtggtttcgatttatc

SEQ ID NO: 215858 - DNA, 28 bp, Artificial Sequence
  Description of Artificial Sequence: Synthetic oligonucleotide
cgccccggatggtggtttcgatttatcc

SEQ ID NO: 215859 - DNA, 28 bp, Artificial Sequence
  Description of Artificial Sequence: Synthetic oligonucleotide
gccccggatggtggtttcgatttatccg

SEQ ID NO: 215860 - DNA, 30 bp, Artificial Sequence
  Description of Artificial Sequence: Synthetic oligonucleotide
ccccggatggtggtttcgatttatccgatg

SEQ ID NO: 215861 - DNA, 30 bp, Artificial Sequence
  Description of Artificial Sequence: Synthetic oligonucleotide
cccggatggtggtttcgatttatccgatgc

SEQ ID NO: 215862 - DNA, 30 bp, Artificial Sequence
  Description of Artificial Sequence: Synthetic oligonucleotide
ccggatggtggtttcgatttatccgatgcc

SEQ ID NO: 215863 - DNA, 30 bp, Artificial Sequence
  Description of Artificial Sequence: Synthetic oligonucleotide
cggatggtggtttcgatttatccgatgccc

SEQ ID NO: 215864 - DNA, 32 bp, Artificial Sequence
  Description of Artificial Sequence: Synthetic oligonucleotide
ggatggtggtttcgatttatccgatgcccttc

SEQ ID NO: 215865 - DNA, 32 bp, Artificial Sequence
  Description of Artificial Sequence: Synthetic oligonucleotide
gatggtggtttcgatttatccgatgcccttcc

SEQ ID NO: 215866 - DNA, 33 bp, Artificial Sequence
  Description of Artificial Sequence: Synthetic oligonucleotide
atggtggtttcgatttatccgatgcccttcctg

SEQ ID NO: 215867 - DNA, 32 bp, Artificial Sequence
  Description of Artificial Sequence: Synthetic oligonucleotide
tggtggtttcgatttatccgatgcccttcctg

SEQ ID NO: 215868 - DNA, 31 bp, Artificial Sequence
  Description of Artificial Sequence: Synthetic oligonucleotide
ggtggtttcgatttatccgatgcccttcctg

SEQ ID NO: 215869 - DNA, 32 bp, Artificial Sequence
  Description of Artificial Sequence: Synthetic oligonucleotide
gtggtttcgatttatccgatgcccttcctgac

SEQ ID NO: 215870 - DNA, 35 bp, Artificial Sequence
  Description of Artificial Sequence: Synthetic oligonucleotide
tggtttcgatttatccgatgcccttcctgacaatg

SEQ ID NO: 215871 - DNA, 34 bp, Artificial Sequence
  Description of Artificial Sequence: Synthetic oligonucleotide
ggtttcgatttatccgatgcccttcctgacaatg

SEQ ID NO: 215872 - DNA, 38 bp, Artificial Sequence
  Description of Artificial Sequence: Synthetic oligonucleotide
gtttcgatttatccgatgcccttcctgacaatgaaaac

SEQ ID NO: 215873 - DNA, 40 bp, Artificial Sequence
  Description of Artificial Sequence: Synthetic oligonucleotide
tttcgatttatccgatgcccttcctgacaatgaaaacaag

SEQ ID NO: 215874 - DNA, 39 bp, Artificial Sequence
  Description of Artificial Sequence: Synthetic oligonucleotide
ttcgatttatccgatgcccttcctgacaatgaaaacaag

SEQ ID NO: 215875 - DNA, 38 bp, Artificial Sequence
  Description of Artificial Sequence: Synthetic oligonucleotide
tcgatttatccgatgcccttcctgacaatgaaaacaag

SEQ ID NO: 215876 - DNA, 37 bp, Artificial Sequence
  Description of Artificial Sequence: Synthetic oligonucleotide
cgatttatccgatgcccttcctgacaatgaaaacaag

SEQ ID NO: 215877 - DNA, 40 bp, Artificial Sequence
  Description of Artificial Sequence: Synthetic oligonucleotide
gatttatccgatgcccttcctgacaatgaaaacaagaaac

SEQ ID NO: 215878 - DNA, 40 bp, Artificial Sequence
  Description of Artificial Sequence: Synthetic oligonucleotide
atttatccgatgcccttcctgacaatgaaaacaagaaacc

SEQ ID NO: 215879 - DNA, 39 bp, Artificial Sequence
  Description of Artificial Sequence: Synthetic oligonucleotide
tttatccgatgcccttcctgacaatgaaaacaagaaacc

SEQ ID NO: 215880 - DNA, 38 bp, Artificial Sequence
  Description of Artificial Sequence: Synthetic oligonucleotide
ttatccgatgcccttcctgacaatgaaaacaagaaacc

SEQ ID NO: 215881 - DNA, 37 bp, Artificial Sequence
  Description of Artificial Sequence: Synthetic oligonucleotide
tatccgatgcccttcctgacaatgaaaacaagaaacc

SEQ ID NO: 215882 - DNA, 36 bp, Artificial Sequence
  Description of Artificial Sequence: Synthetic oligonucleotide
atccgatgcccttcctgacaatgaaaacaagaaacc

SEQ ID NO: 215883 - DNA, 35 bp, Artificial Sequence
  Description of Artificial Sequence: Synthetic oligonucleotide
tccgatgcccttcctgacaatgaaaacaagaaacc

SEQ ID NO: 215884 - DNA, 34 bp, Artificial Sequence
  Description of Artificial Sequence: Synthetic oligonucleotide
ccgatgcccttcctgacaatgaaaacaagaaacc

SEQ ID NO: 215885 - DNA, 34 bp, Artificial Sequence
  Description of Artificial Sequence: Synthetic oligonucleotide
cgatgcccttcctgacaatgaaaacaagaaaccc

SEQ ID NO: 215886 - DNA, 35 bp, Artificial Sequence
  Description of Artificial Sequence: Synthetic oligonucleotide
gatgcccttcctgacaatgaaaacaagaaacccac

SEQ ID NO: 215887 - DNA, 36 bp, Artificial Sequence
  Description of Artificial Sequence: Synthetic oligonucleotide
atgcccttcctgacaatgaaaacaagaaacccactg

SEQ ID NO: 215888 - DNA, 35 bp, Artificial Sequence
  Description of Artificial Sequence: Synthetic oligonucleotide
tgcccttcctgacaatgaaaacaagaaacccactg

SEQ ID NO: 215889 - DNA, 34 bp, Artificial Sequence
  Description of Artificial Sequence: Synthetic oligonucleotide
gcccttcctgacaatgaaaacaagaaacccactg

SEQ ID NO: 215890 - DNA, 34 bp, Artificial Sequence
  Description of Artificial Sequence: Synthetic oligonucleotide
cccttcctgacaatgaaaacaagaaacccactgc

SEQ ID NO: 215891 - DNA, 37 bp, Artificial Sequence
  Description of Artificial Sequence: Synthetic oligonucleotide
ccttcctgacaatgaaaacaagaaacccactgcaatc

SEQ ID NO: 215892 - DNA, 37 bp, Artificial Sequence
  Description of Artificial Sequence: Synthetic oligonucleotide
cttcctgacaatgaaaacaagaaacccactgcaatcc

SEQ ID NO: 215893 - DNA, 37 bp, Artificial Sequence
  Description of Artificial Sequence: Synthetic oligonucleotide
ttcctgacaatgaaaacaagaaacccactgcaatccc

SEQ ID NO: 215894 - DNA, 36 bp, Artificial Sequence
  Description of Artificial Sequence: Synthetic oligonucleotide
tcctgacaatgaaaacaagaaacccactgcaatccc

SEQ ID NO: 215895 - DNA, 35 bp, Artificial Sequence
  Description of Artificial Sequence: Synthetic oligonucleotide
cctgacaatgaaaacaagaaacccactgcaatccc

SEQ ID NO: 215896 - DNA, 35 bp, Artificial Sequence
  Description of Artificial Sequence: Synthetic oligonucleotide
ctgacaatgaaaacaagaaacccactgcaatcccc

SEQ ID NO: 215897 - DNA, 37 bp, Artificial Sequence
  Description of Artificial Sequence: Synthetic oligonucleotide
tgacaatgaaaacaagaaacccactgcaatccccaag

SEQ ID NO: 215898 - DNA, 36 bp, Artificial Sequence
  Description of Artificial Sequence: Synthetic oligonucleotide
gacaatgaaaacaagaaacccactgcaatccccaag

SEQ ID NO: 215899 - DNA, 39 bp, Artificial Sequence
  Description of Artificial Sequence: Synthetic oligonucleotide
acaatgaaaacaagaaacccactgcaatccccaagaaac

SEQ ID NO: 215900 - DNA, 38 bp, Artificial Sequence
  Description of Artificial Sequence: Synthetic oligonucleotide
caatgaaaacaagaaacccactgcaatccccaagaaac

SEQ ID NO: 215901 - DNA, 38 bp, Artificial Sequence
  Description of Artificial Sequence: Synthetic oligonucleotide
aatgaaaacaagaaacccactgcaatccccaagaaacc

SEQ ID NO: 215902 - DNA, 37 bp, Artificial Sequence
  Description of Artificial Sequence: Synthetic oligonucleotide
atgaaaacaagaaacccactgcaatccccaagaaacc

SEQ ID NO: 215903 - DNA, 36 bp, Artificial Sequence
  Description of Artificial Sequence: Synthetic oligonucleotide
tgaaaacaagaaacccactgcaatccccaagaaacc

SEQ ID NO: 215904 - DNA, 35 bp, Artificial Sequence
  Description of Artificial Sequence: Synthetic oligonucleotide
gaaaacaagaaacccactgcaatccccaagaaacc

SEQ ID NO: 215905 - DNA, 35 bp, Artificial Sequence
  Description of Artificial Sequence: Synthetic oligonucleotide
aaaacaagaaacccactgcaatccccaagaaaccc

SEQ ID NO: 215906 - DNA, 34 bp, Artificial Sequence
  Description of Artificial Sequence: Synthetic oligonucleotide
aaacaagaaacccactgcaatccccaagaaaccc

SEQ ID NO: 215907 - DNA, 33 bp, Artificial Sequence
  Description of Artificial Sequence: Synthetic oligonucleotide
aacaagaaacccactgcaatccccaagaaaccc

SEQ ID NO: 215908 - DNA, 32 bp, Artificial Sequence
  Description of Artificial Sequence: Synthetic oligonucleotide
acaagaaacccactgcaatccccaagaaaccc

SEQ ID NO: 215909 - DNA, 31 bp, Artificial Sequence
  Description of Artificial Sequence: Synthetic oligonucleotide
caagaaacccactgcaatccccaagaaaccc

SEQ ID NO: 215910 - DNA, 32 bp, Artificial Sequence
  Description of Artificial Sequence: Synthetic oligonucleotide
aagaaacccactgcaatccccaagaaacccag

SEQ ID NO: 215911 - DNA, 31 bp, Artificial Sequence
  Description of Artificial Sequence: Synthetic oligonucleotide
agaaacccactgcaatccccaagaaacccag

SEQ ID NO: 215912 - DNA, 30 bp, Artificial Sequence
  Description of Artificial Sequence: Synthetic oligonucleotide
gaaacccactgcaatccccaagaaacccag

SEQ ID NO: 215913 - DNA, 31 bp, Artificial Sequence
  Description of Artificial Sequence: Synthetic oligonucleotide
aaacccactgcaatccccaagaaacccagtg

SEQ ID NO: 215914 - DNA, 30 bp, Artificial Sequence
  Description of Artificial Sequence: Synthetic oligonucleotide
aacccactgcaatccccaagaaacccagtg

SEQ ID NO: 215915 - DNA, 29 bp, Artificial Sequence
  Description of Artificial Sequence: Synthetic oligonucleotide
acccactgcaatccccaagaaacccagtg

SEQ ID NO: 215916 - DNA, 28 bp, Artificial Sequence
  Description of Artificial Sequence: Synthetic oligonucleotide
cccactgcaatccccaagaaacccagtg

SEQ ID NO: 215917 - DNA, 28 bp, Artificial Sequence
  Description of Artificial Sequence: Synthetic oligonucleotide
ccactgcaatccccaagaaacccagtgc

SEQ ID NO: 215918 - DNA, 29 bp, Artificial Sequence
  Description of Artificial Sequence: Synthetic oligonucleotide
cactgcaatccccaagaaacccagtgctg

SEQ ID NO: 215919 - DNA, 29 bp, Artificial Sequence
  Description of Artificial Sequence: Synthetic oligonucleotide
actgcaatccccaagaaacccagtgctgg

SEQ ID NO: 215920 - DNA, 28 bp, Artificial Sequence
  Description of Artificial Sequence: Synthetic oligonucleotide
ctgcaatccccaagaaacccagtgctgg

SEQ ID NO: 215921 - DNA, 28 bp, Artificial Sequence
  Description of Artificial Sequence: Synthetic oligonucleotide
tgcaatccccaagaaacccagtgctggg

SEQ ID NO: 215922 - DNA, 27 bp, Artificial Sequence
  Description of Artificial Sequence: Synthetic oligonucleotide
gcaatccccaagaaacccagtgctggg

SEQ ID NO: 215923 - DNA, 27 bp, Artificial Sequence
  Description of Artificial Sequence: Synthetic oligonucleotide
caatccccaagaaacccagtgctgggg

SEQ ID NO: 215924 - DNA, 29 bp, Artificial Sequence
  Description of Artificial Sequence: Synthetic oligonucleotide
aatccccaagaaacccagtgctggggatg

SEQ ID NO: 215925 - DNA, 28 bp, Artificial Sequence
  Description of Artificial Sequence: Synthetic oligonucleotide
atccccaagaaacccagtgctggggatg

SEQ ID NO: 215926 - DNA, 27 bp, Artificial Sequence
  Description of Artificial Sequence: Synthetic oligonucleotide
tccccaagaaacccagtgctggggatg

SEQ ID NO: 215927 - DNA, 27 bp, Artificial Sequence
  Description of Artificial Sequence: Synthetic oligonucleotide
ccccaagaaacccagtgctggggatga

SEQ ID NO: 215928 - DNA, 27 bp, Artificial Sequence
  Description of Artificial Sequence: Synthetic oligonucleotide
cccaagaaacccagtgctggggatgac

SEQ ID NO: 215929 - DNA, 30 bp, Artificial Sequence
  Description of Artificial Sequence: Synthetic oligonucleotide
ccaagaaacccagtgctggggatgactttg

SEQ ID NO: 215930 - DNA, 31 bp, Artificial Sequence
  Description of Artificial Sequence: Synthetic oligonucleotide
caagaaacccagtgctggggatgactttgac

SEQ ID NO: 215931 - DNA, 34 bp, Artificial Sequence
  Description of Artificial Sequence: Synthetic oligonucleotide
aagaaacccagtgctggggatgactttgacttag

SEQ ID NO: 215932 - DNA, 33 bp, Artificial Sequence
  Description of Artificial Sequence: Synthetic oligonucleotide
agaaacccagtgctggggatgactttgacttag

SEQ ID NO: 215933 - DNA, 32 bp, Artificial Sequence
  Description of Artificial Sequence: Synthetic oligonucleotide
gaaacccagtgctggggatgactttgacttag

SEQ ID NO: 215934 - DNA, 32 bp, Artificial Sequence
  Description of Artificial Sequence: Synthetic oligonucleotide
aaacccagtgctggggatgactttgacttagg

SEQ ID NO: 215935 - DNA, 31 bp, Artificial Sequence
  Description of Artificial Sequence: Synthetic oligonucleotide
aacccagtgctggggatgactttgacttagg

SEQ ID NO: 215936 - DNA, 30 bp, Artificial Sequence
  Description of Artificial Sequence: Synthetic oligonucleotide
acccagtgctggggatgactttgacttagg

SEQ ID NO: 215937 - DNA, 29 bp, Artificial Sequence
  Description of Artificial Sequence: Synthetic oligonucleotide
cccagtgctggggatgactttgacttagg

SEQ ID NO: 215938 - DNA, 30 bp, Artificial Sequence
  Description of Artificial Sequence: Synthetic oligonucleotide
ccagtgctggggatgactttgacttaggag

SEQ ID NO: 215939 - DNA, 32 bp, Artificial Sequence
  Description of Artificial Sequence: Synthetic oligonucleotide
cagtgctggggatgactttgacttaggagatg

SEQ ID NO: 215940 - DNA, 32 bp, Artificial Sequence
  Description of Artificial Sequence: Synthetic oligonucleotide
agtgctggggatgactttgacttaggagatgc

SEQ ID NO: 215941 - DNA, 31 bp, Artificial Sequence
  Description of Artificial Sequence: Synthetic oligonucleotide
gtgctggggatgactttgacttaggagatgc

SEQ ID NO: 215942 - DNA, 32 bp, Artificial Sequence
  Description of Artificial Sequence: Synthetic oligonucleotide
tgctggggatgactttgacttaggagatgctg

SEQ ID NO: 215943 - DNA, 31 bp, Artificial Sequence
  Description of Artificial Sequence: Synthetic oligonucleotide
gctggggatgactttgacttaggagatgctg

SEQ ID NO: 215944 - DNA, 33 bp, Artificial Sequence
  Description of Artificial Sequence: Synthetic oligonucleotide
ctggggatgactttgacttaggagatgctgttg

SEQ ID NO: 215945 - DNA, 35 bp, Artificial Sequence
  Description of Artificial Sequence: Synthetic oligonucleotide
tggggatgactttgacttaggagatgctgttgttg

SEQ ID NO: 215946 - DNA, 34 bp, Artificial Sequence
  Description of Artificial Sequence: Synthetic oligonucleotide
ggggatgactttgacttaggagatgctgttgttg

SEQ ID NO: 215947 - DNA, 36 bp, Artificial Sequence
  Description of Artificial Sequence: Synthetic oligonucleotide
gggatgactttgacttaggagatgctgttgttgatg

SEQ ID NO: 215948 - DNA, 36 bp, Artificial Sequence
  Description of Artificial Sequence: Synthetic oligonucleotide
ggatgactttgacttaggagatgctgttgttgatgg

SEQ ID NO: 215949 - DNA, 37 bp, Artificial Sequence
  Description of Artificial Sequence: Synthetic oligonucleotide
gatgactttgacttaggagatgctgttgttgatggag

SEQ ID NO: 215950 - DNA, 42 bp, Artificial Sequence
  Description of Artificial Sequence: Synthetic oligonucleotide
atgactttgacttaggagatgctgttgttgatggagaaaatg

SEQ ID NO: 215951 - DNA, 41 bp, Artificial Sequence
  Description of Artificial Sequence: Synthetic oligonucleotide
tgactttgacttaggagatgctgttgttgatggagaaaatg

SEQ ID NO: 215952 - DNA, 40 bp, Artificial Sequence
  Description of Artificial Sequence: Synthetic oligonucleotide
gactttgacttaggagatgctgttgttgatggagaaaatg

SEQ ID NO: 215953 - DNA, 41 bp, Artificial Sequence
  Description of Artificial Sequence: Synthetic oligonucleotide
actttgacttaggagatgctgttgttgatggagaaaatgac

SEQ ID NO: 215954 - DNA, 40 bp, Artificial Sequence
  Description of Artificial Sequence: Synthetic oligonucleotide
ctttgacttaggagatgctgttgttgatggagaaaatgac

SEQ ID NO: 215955 - DNA, 40 bp, Artificial Sequence
  Description of Artificial Sequence: Synthetic oligonucleotide
tttgacttaggagatgctgttgttgatggagaaaatgacg

SEQ ID NO: 215956 - DNA, 39 bp, Artificial Sequence
  Description of Artificial Sequence: Synthetic oligonucleotide
ttgacttaggagatgctgttgttgatggagaaaatgacg

SEQ ID NO: 215957 - DNA, 38 bp, Artificial Sequence
  Description of Artificial Sequence: Synthetic oligonucleotide
tgacttaggagatgctgttgttgatggagaaaatgacg

SEQ ID NO: 215958 - DNA, 37 bp, Artificial Sequence
  Description of Artificial Sequence: Synthetic oligonucleotide
gacttaggagatgctgttgttgatggagaaaatgacg

SEQ ID NO: 215959 - DNA, 38 bp, Artificial Sequence
  Description of Artificial Sequence: Synthetic oligonucleotide
acttaggagatgctgttgttgatggagaaaatgacgac

SEQ ID NO: 215960 - DNA, 37 bp, Artificial Sequence
  Description of Artificial Sequence: Synthetic oligonucleotide
cttaggagatgctgttgttgatggagaaaatgacgac

SEQ ID NO: 215961 - DNA, 37 bp, Artificial Sequence
  Description of Artificial Sequence: Synthetic oligonucleotide
ttaggagatgctgttgttgatggagaaaatgacgacc

SEQ ID NO: 215962 - DNA, 36 bp, Artificial Sequence
  Description of Artificial Sequence: Synthetic oligonucleotide
taggagatgctgttgttgatggagaaaatgacgacc

SEQ ID NO: 215963 - DNA, 35 bp, Artificial Sequence
  Description of Artificial Sequence: Synthetic oligonucleotide
aggagatgctgttgttgatggagaaaatgacgacc

SEQ ID NO: 215964 - DNA, 34 bp, Artificial Sequence
  Description of Artificial Sequence: Synthetic oligonucleotide
ggagatgctgttgttgatggagaaaatgacgacc

SEQ ID NO: 215965 - DNA, 34 bp, Artificial Sequence
  Description of Artificial Sequence: Synthetic oligonucleotide
gagatgctgttgttgatggagaaaatgacgaccc

SEQ ID NO: 215966 - DNA, 35 bp, Artificial Sequence
  Description of Artificial Sequence: Synthetic oligonucleotide
agatgctgttgttgatggagaaaatgacgacccac

SEQ ID NO: 215967 - DNA, 34 bp, Artificial Sequence
  Description of Artificial Sequence: Synthetic oligonucleotide
gatgctgttgttgatggagaaaatgacgacccac

SEQ ID NO: 215968 - DNA, 34 bp, Artificial Sequence
  Description of Artificial Sequence: Synthetic oligonucleotide
atgctgttgttgatggagaaaatgacgacccacg

SEQ ID NO: 215969 - DNA, 33 bp, Artificial Sequence
  Description of Artificial Sequence: Synthetic oligonucleotide
tgctgttgttgatggagaaaatgacgacccacg

SEQ ID NO: 215970 - DNA, 32 bp, Artificial Sequence
  Description of Artificial Sequence: Synthetic oligonucleotide
gctgttgttgatggagaaaatgacgacccacg

SEQ ID NO: 215971 - DNA, 33 bp, Artificial Sequence
  Description of Artificial Sequence: Synthetic oligonucleotide
ctgttgttgatggagaaaatgacgacccacgac

SEQ ID NO: 215972 - DNA, 33 bp, Artificial Sequence
  Description of Artificial Sequence: Synthetic oligonucleotide
tgttgttgatggagaaaatgacgacccacgacc

SEQ ID NO: 215973 - DNA, 32 bp, Artificial Sequence
  Description of Artificial Sequence: Synthetic oligonucleotide
gttgttgatggagaaaatgacgacccacgacc

SEQ ID NO: 215974 - DNA, 33 bp, Artificial Sequence
  Description of Artificial Sequence: Synthetic oligonucleotide
ttgttgatggagaaaatgacgacccacgaccac

SEQ ID NO: 215975 - DNA, 32 bp, Artificial Sequence
  Description of Artificial Sequence: Synthetic oligonucleotide
tgttgatggagaaaatgacgacccacgaccac

SEQ ID NO: 215976 - DNA, 31 bp, Artificial Sequence
  Description of Artificial Sequence: Synthetic oligonucleotide
gttgatggagaaaatgacgacccacgaccac

SEQ ID NO: 215977 - DNA, 31 bp, Artificial Sequence
  Description of Artificial Sequence: Synthetic oligonucleotide
ttgatggagaaaatgacgacccacgaccacc

SEQ ID NO: 215978 - DNA, 30 bp, Artificial Sequence
  Description of Artificial Sequence: Synthetic oligonucleotide
tgatggagaaaatgacgacccacgaccacc

SEQ ID NO: 215979 - DNA, 29 bp, Artificial Sequence
  Description of Artificial Sequence: Synthetic oligonucleotide
gatggagaaaatgacgacccacgaccacc

SEQ ID NO: 215980 - DNA, 29 bp, Artificial Sequence
  Description of Artificial Sequence: Synthetic oligonucleotide
atggagaaaatgacgacccacgaccaccg

SEQ ID NO: 215981 - DNA, 28 bp, Artificial Sequence
  Description of Artificial Sequence: Synthetic oligonucleotide
tggagaaaatgacgacccacgaccaccg

SEQ ID NO: 215982 - DNA, 27 bp, Artificial Sequence
  Description of Artificial Sequence: Synthetic oligonucleotide
ggagaaaatgacgacccacgaccaccg

SEQ ID NO: 215983 - DNA, 29 bp, Artificial Sequence
  Description of Artificial Sequence: Synthetic oligonucleotide
gagaaaatgacgacccacgaccaccgaac

SEQ ID NO: 215984 - DNA, 29 bp, Artificial Sequence
  Description of Artificial Sequence: Synthetic oligonucleotide
agaaaatgacgacccacgaccaccgaacc

SEQ ID NO: 215985 - DNA, 28 bp, Artificial Sequence
  Description of Artificial Sequence: Synthetic oligonucleotide
gaaaatgacgacccacgaccaccgaacc

SEQ ID NO: 215986 - DNA, 28 bp, Artificial Sequence
  Description of Artificial Sequence: Synthetic oligonucleotide
aaaatgacgacccacgaccaccgaaccc

SEQ ID NO: 215987 - DNA, 27 bp, Artificial Sequence
  Description of Artificial Sequence: Synthetic oligonucleotide
aaatgacgacccacgaccaccgaaccc

SEQ ID NO: 215988 - DNA, 27 bp, Artificial Sequence
  Description of Artificial Sequence: Synthetic oligonucleotide
aatgacgacccacgaccaccgaaccca

SEQ ID NO: 215989 - DNA, 26 bp, Artificial Sequence
  Description of Artificial Sequence: Synthetic oligonucleotide
atgacgacccacgaccaccgaaccca

SEQ ID NO: 215990 - DNA, 25 bp, Artificial Sequence
  Description of Artificial Sequence: Synthetic oligonucleotide
tgacgacccacgaccaccgaaccca

SEQ ID NO: 215991 - DNA, 24 bp, Artificial Sequence
  Description of Artificial Sequence: Synthetic oligonucleotide
gacgacccacgaccaccgaaccca

SEQ ID NO: 215992 - DNA, 24 bp, Artificial Sequence
  Description of Artificial Sequence: Synthetic oligonucleotide
acgacccacgaccaccgaacccac

SEQ ID NO: 215993 - DNA, 23 bp, Artificial Sequence
  Description of Artificial Sequence: Synthetic oligonucleotide
cgacccacgaccaccgaacccac

SEQ ID NO: 215994 - DNA, 23 bp, Artificial Sequence
  Description of Artificial Sequence: Synthetic oligonucleotide
gacccacgaccaccgaacccacc

SEQ ID NO: 215995 - DNA, 26 bp, Artificial Sequence
  Description of Artificial Sequence: Synthetic oligonucleotide
acccacgaccaccgaacccacccaaa

SEQ ID NO: 215996 - DNA, 25 bp, Artificial Sequence
  Description of Artificial Sequence: Synthetic oligonucleotide
cccacgaccaccgaacccacccaaa

SEQ ID NO: 215997 - DNA, 25 bp, Artificial Sequence
  Description of Artificial Sequence: Synthetic oligonucleotide
ccacgaccaccgaacccacccaaac

SEQ ID NO: 215998 - DNA, 25 bp, Artificial Sequence
  Description of Artificial Sequence: Synthetic oligonucleotide
cacgaccaccgaacccacccaaacc

SEQ ID NO: 215999 - DNA, 27 bp, Artificial Sequence
  Description of Artificial Sequence: Synthetic oligonucleotide
acgaccaccgaacccacccaaaccgat

SEQ ID NO: 216000 - DNA, 26 bp, Artificial Sequence
  Description of Artificial Sequence: Synthetic oligonucleotide
cgaccaccgaacccacccaaaccgat

SEQ ID NO: 216001 - DNA, 26 bp, Artificial Sequence
  Description of Artificial Sequence: Synthetic oligonucleotide
gaccaccgaacccacccaaaccgatg

SEQ ID NO: 216002 - DNA, 26 bp, Artificial Sequence
  Description of Artificial Sequence: Synthetic oligonucleotide
accaccgaacccacccaaaccgatgc

SEQ ID NO: 216003 - DNA, 25 bp, Artificial Sequence
  Description of Artificial Sequence: Synthetic oligonucleotide
ccaccgaacccacccaaaccgatgc

SEQ ID NO: 216004 - DNA, 27 bp, Artificial Sequence
  Description of Artificial Sequence: Synthetic oligonucleotide
caccgaacccacccaaaccgatgccaa

SEQ ID NO: 216005 - DNA, 29 bp, Artificial Sequence
  Description of Artificial Sequence: Synthetic oligonucleotide
accgaacccacccaaaccgatgccaaatc

SEQ ID NO: 216006 - DNA, 28 bp, Artificial Sequence
  Description of Artificial Sequence: Synthetic oligonucleotide
ccgaacccacccaaaccgatgccaaatc

SEQ ID NO: 216007 - DNA, 28 bp, Artificial Sequence
  Description of Artificial Sequence: Synthetic oligonucleotide
cgaacccacccaaaccgatgccaaatcc

SEQ ID NO: 216008 - DNA, 31 bp, Artificial Sequence
  Description of Artificial Sequence: Synthetic oligonucleotide
gaacccacccaaaccgatgccaaatccaaac

SEQ ID NO: 216009 - DNA, 31 bp, Artificial Sequence
  Description of Artificial Sequence: Synthetic oligonucleotide
aacccacccaaaccgatgccaaatccaaacc

SEQ ID NO: 216010 - DNA, 30 bp, Artificial Sequence
  Description of Artificial Sequence: Synthetic oligonucleotide
acccacccaaaccgatgccaaatccaaacc

SEQ ID NO: 216011 - DNA, 29 bp, Artificial Sequence
  Description of Artificial Sequence: Synthetic oligonucleotide
cccacccaaaccgatgccaaatccaaacc

SEQ ID NO: 216012 - DNA, 29 bp, Artificial Sequence
  Description of Artificial Sequence: Synthetic oligonucleotide
ccacccaaaccgatgccaaatccaaaccc

SEQ ID NO: 216013 - DNA, 29 bp, Artificial Sequence
  Description of Artificial Sequence: Synthetic oligonucleotide
cacccaaaccgatgccaaatccaaacccc

SEQ ID NO: 216014 - DNA, 31 bp, Artificial Sequence
  Description of Artificial Sequence: Synthetic oligonucleotide
acccaaaccgatgccaaatccaaaccccaac

SEQ ID NO: 216015 - DNA, 30 bp, Artificial Sequence
  Description of Artificial Sequence: Synthetic oligonucleotide
cccaaaccgatgccaaatccaaaccccaac

SEQ ID NO: 216016 - DNA, 30 bp, Artificial Sequence
  Description of Artificial Sequence: Synthetic oligonucleotide
ccaaaccgatgccaaatccaaaccccaacc

SEQ ID NO: 216017 - DNA, 31 bp, Artificial Sequence
  Description of Artificial Sequence: Synthetic oligonucleotide
caaaccgatgccaaatccaaaccccaaccac

SEQ ID NO: 216018 - DNA, 31 bp, Artificial Sequence
  Description of Artificial Sequence: Synthetic oligonucleotide
aaaccgatgccaaatccaaaccccaaccacc

SEQ ID NO: 216019 - DNA, 30 bp, Artificial Sequence
  Description of Artificial Sequence: Synthetic oligonucleotide
aaccgatgccaaatccaaaccccaaccacc

SEQ ID NO: 216020 - DNA, 29 bp, Artificial Sequence
  Description of Artificial Sequence: Synthetic oligonucleotide
accgatgccaaatccaaaccccaaccacc

SEQ ID NO: 216021 - DNA, 28 bp, Artificial Sequence
  Description of Artificial Sequence: Synthetic oligonucleotide
ccgatgccaaatccaaaccccaaccacc

SEQ ID NO: 216022 - DNA, 28 bp, Artificial Sequence
  Description of Artificial Sequence: Synthetic oligonucleotide
cgatgccaaatccaaaccccaaccaccc

SEQ ID NO: 216023 - DNA, 30 bp, Artificial Sequence
  Description of Artificial Sequence: Synthetic oligonucleotide
gatgccaaatccaaaccccaaccaccctag

SEQ ID NO: 216024 - DNA, 32 bp, Artificial Sequence
  Description of Artificial Sequence: Synthetic oligonucleotide
atgccaaatccaaaccccaaccaccctagttc

SEQ ID NO: 216025 - DNA, 31 bp, Artificial Sequence
  Description of Artificial Sequence: Synthetic oligonucleotide
tgccaaatccaaaccccaaccaccctagttc

SEQ ID NO: 216026 - DNA, 30 bp, Artificial Sequence
  Description of Artificial Sequence: Synthetic oligonucleotide
gccaaatccaaaccccaaccaccctagttc

SEQ ID NO: 216027 - DNA, 30 bp, Artificial Sequence
  Description of Artificial Sequence: Synthetic oligonucleotide
ccaaatccaaaccccaaccaccctagttcc

SEQ ID NO: 216028 - DNA, 31 bp, Artificial Sequence
  Description of Artificial Sequence: Synthetic oligonucleotide
caaatccaaaccccaaccaccctagttcctc

SEQ ID NO: 216029 - DNA, 31 bp, Artificial Sequence
  Description of Artificial Sequence: Synthetic oligonucleotide
aaatccaaaccccaaccaccctagttcctcc

SEQ ID NO: 216030 - DNA, 30 bp, Artificial Sequence
  Description of Artificial Sequence: Synthetic oligonucleotide
aatccaaaccccaaccaccctagttcctcc

SEQ ID NO: 216031 - DNA, 29 bp, Artificial Sequence
  Description of Artificial Sequence: Synthetic oligonucleotide
atccaaaccccaaccaccctagttcctcc

SEQ ID NO: 216032 - DNA, 28 bp, Artificial Sequence
  Description of Artificial Sequence: Synthetic oligonucleotide
tccaaaccccaaccaccctagttcctcc

SEQ ID NO: 216033 - DNA, 27 bp, Artificial Sequence
  Description of Artificial Sequence: Synthetic oligonucleotide
ccaaaccccaaccaccctagttcctcc

SEQ ID NO: 216034 - DNA, 27 bp, Artificial Sequence
  Description of Artificial Sequence: Synthetic oligonucleotide
caaaccccaaccaccctagttcctccg

SEQ ID NO: 216035 - DNA, 27 bp, Artificial Sequence
  Description of Artificial Sequence: Synthetic oligonucleotide
aaaccccaaccaccctagttcctccgg

SEQ ID NO: 216036 - DNA, 27 bp, Artificial Sequence
  Description of Artificial Sequence: Synthetic oligonucleotide
aaccccaaccaccctagttcctccggt

SEQ ID NO: 216037 - DNA, 27 bp, Artificial Sequence
  Description of Artificial Sequence: Synthetic oligonucleotide
accccaaccaccctagttcctccggta

SEQ ID NO: 216038 - DNA, 26 bp, Artificial Sequence
  Description of Artificial Sequence: Synthetic oligonucleotide
ccccaaccaccctagttcctccggta

SEQ ID NO: 216039 - DNA, 26 bp, Artificial Sequence
  Description of Artificial Sequence: Synthetic oligonucleotide
cccaaccaccctagttcctccggtag

SEQ ID NO: 216040 - DNA, 27 bp, Artificial Sequence
  Description of Artificial Sequence: Synthetic oligonucleotide
ccaaccaccctagttcctccggtagct

SEQ ID NO: 216041 - DNA, 30 bp, Artificial Sequence
  Description of Artificial Sequence: Synthetic oligonucleotide
caaccaccctagttcctccggtagcttttc

SEQ ID NO: 216042 - DNA, 31 bp, Artificial Sequence
  Description of Artificial Sequence: Synthetic oligonucleotide
aaccaccctagttcctccggtagcttttcag

SEQ ID NO: 216043 - DNA, 30 bp, Artificial Sequence
  Description of Artificial Sequence: Synthetic oligonucleotide
accaccctagttcctccggtagcttttcag

SEQ ID NO: 216044 - DNA, 29 bp, Artificial Sequence
  Description of Artificial Sequence: Synthetic oligonucleotide
ccaccctagttcctccggtagcttttcag

SEQ ID NO: 216045 - DNA, 31 bp, Artificial Sequence
  Description of Artificial Sequence: Synthetic oligonucleotide
caccctagttcctccggtagcttttcagatg

SEQ ID NO: 216046 - DNA, 31 bp, Artificial Sequence
  Description of Artificial Sequence: Synthetic oligonucleotide
accctagttcctccggtagcttttcagatgc

SEQ ID NO: 216047 - DNA, 30 bp, Artificial Sequence
  Description of Artificial Sequence: Synthetic oligonucleotide
ccctagttcctccggtagcttttcagatgc

SEQ ID NO: 216048 - DNA, 31 bp, Artificial Sequence
  Description of Artificial Sequence: Synthetic oligonucleotide
cctagttcctccggtagcttttcagatgctg

SEQ ID NO: 216049 - DNA, 32 bp, Artificial Sequence
  Description of Artificial Sequence: Synthetic oligonucleotide
ctagttcctccggtagcttttcagatgctgac

SEQ ID NO: 216050 - DNA, 32 bp, Artificial Sequence
  Description of Artificial Sequence: Synthetic oligonucleotide
tagttcctccggtagcttttcagatgctgacc

SEQ ID NO: 216051 - DNA, 31 bp, Artificial Sequence
  Description of Artificial Sequence: Synthetic oligonucleotide
agttcctccggtagcttttcagatgctgacc

SEQ ID NO: 216052 - DNA, 30 bp, Artificial Sequence
  Description of Artificial Sequence: Synthetic oligonucleotide
gttcctccggtagcttttcagatgctgacc

SEQ ID NO: 216053 - DNA, 32 bp, Artificial Sequence
  Description of Artificial Sequence: Synthetic oligonucleotide
ttcctccggtagcttttcagatgctgaccttg

SEQ ID NO: 216054 - DNA, 31 bp, Artificial Sequence
  Description of Artificial Sequence: Synthetic oligonucleotide
tcctccggtagcttttcagatgctgaccttg

SEQ ID NO: 216055 - DNA, 30 bp, Artificial Sequence
  Description of Artificial Sequence: Synthetic oligonucleotide
cctccggtagcttttcagatgctgaccttg

SEQ ID NO: 216056 - DNA, 30 bp, Artificial Sequence
  Description of Artificial Sequence: Synthetic oligonucleotide
ctccggtagcttttcagatgctgaccttgc

SEQ ID NO: 216057 - DNA, 30 bp, Artificial Sequence
  Description of Artificial Sequence: Synthetic oligonucleotide
tccggtagcttttcagatgctgaccttgcg

SEQ ID NO: 216058 - DNA, 29 bp, Artificial Sequence
  Description of Artificial Sequence: Synthetic oligonucleotide
ccggtagcttttcagatgctgaccttgcg

SEQ ID NO: 216059 - DNA, 29 bp, Artificial Sequence
  Description of Artificial Sequence: Synthetic oligonucleotide
cggtagcttttcagatgctgaccttgcgg

SEQ ID NO: 216060 - DNA, 31 bp, Artificial Sequence
  Description of Artificial Sequence: Synthetic oligonucleotide
ggtagcttttcagatgctgaccttgcggatg

SEQ ID NO: 216061 - DNA, 31 bp, Artificial Sequence
  Description of Artificial Sequence: Synthetic oligonucleotide
gtagcttttcagatgctgaccttgcggatgg

SEQ ID NO: 216062 - DNA, 31 bp, Artificial Sequence
  Description of Artificial Sequence: Synthetic oligonucleotide
tagcttttcagatgctgaccttgcggatggc

SEQ ID NO: 216063 - DNA, 30 bp, Artificial Sequence
  Description of Artificial Sequence: Synthetic oligonucleotide
agcttttcagatgctgaccttgcggatggc

SEQ ID NO: 216064 - DNA, 29 bp, Artificial Sequence
  Description of Artificial Sequence: Synthetic oligonucleotide
gcttttcagatgctgaccttgcggatggc

SEQ ID NO: 216065 - DNA, 29 bp, Artificial Sequence
  Description of Artificial Sequence: Synthetic oligonucleotide
cttttcagatgctgaccttgcggatggcg

SEQ ID NO: 216066 - DNA, 32 bp, Artificial Sequence
  Description of Artificial Sequence: Synthetic oligonucleotide
ttttcagatgctgaccttgcggatggcgtttc

SEQ ID NO: 216067 - DNA, 31 bp, Artificial Sequence
  Description of Artificial Sequence: Synthetic oligonucleotide
tttcagatgctgaccttgcggatggcgtttc

SEQ ID NO: 216068 - DNA, 30 bp, Artificial Sequence
  Description of Artificial Sequence: Synthetic oligonucleotide
ttcagatgctgaccttgcggatggcgtttc

SEQ ID NO: 216069 - DNA, 29 bp, Artificial Sequence
  Description of Artificial Sequence: Synthetic oligonucleotide
tcagatgctgaccttgcggatggcgtttc

SEQ ID NO: 216070 - DNA, 28 bp, Artificial Sequence
  Description of Artificial Sequence: Synthetic oligonucleotide
cagatgctgaccttgcggatggcgtttc

SEQ ID NO: 216071 - DNA, 29 bp, Artificial Sequence
  Description of Artificial Sequence: Synthetic oligonucleotide
agatgctgaccttgcggatggcgtttcag

SEQ ID NO: 216072 - DNA, 28 bp, Artificial Sequence
  Description of Artificial Sequence: Synthetic oligonucleotide
gatgctgaccttgcggatggcgtttcag

SEQ ID NO: 216073 - DNA, 28 bp, Artificial Sequence
  Description of Artificial Sequence: Synthetic oligonucleotide
atgctgaccttgcggatggcgtttcagg

SEQ ID NO: 216074 - DNA, 27 bp, Artificial Sequence
  Description of Artificial Sequence: Synthetic oligonucleotide
tgctgaccttgcggatggcgtttcagg

SEQ ID NO: 216075 - DNA, 27 bp, Artificial Sequence
  Description of Artificial Sequence: Synthetic oligonucleotide
gctgaccttgcggatggcgtttcaggt

SEQ ID NO: 216076 - DNA, 27 bp, Artificial Sequence
  Description of Artificial Sequence: Synthetic oligonucleotide
ctgaccttgcggatggcgtttcaggtg

SEQ ID NO: 216077 - DNA, 27 bp, Artificial Sequence
  Description of Artificial Sequence: Synthetic oligonucleotide
tgaccttgcggatggcgtttcaggtgg

SEQ ID NO: 216078 - DNA, 27 bp, Artificial Sequence
  Description of Artificial Sequence: Synthetic oligonucleotide
gaccttgcggatggcgtttcaggtgga

SEQ ID NO: 216079 - DNA, 27 bp, Artificial Sequence
  Description of Artificial Sequence: Synthetic oligonucleotide
accttgcggatggcgtttcaggtggag

SEQ ID NO: 216080 - DNA, 27 bp, Artificial Sequence
  Description of Artificial Sequence: Synthetic oligonucleotide
ccttgcggatggcgtttcaggtggaga

SEQ ID NO: 216081 - DNA, 28 bp, Artificial Sequence
  Description of Artificial Sequence: Synthetic oligonucleotide
cttgcggatggcgtttcaggtggagaag

SEQ ID NO: 216082 - DNA, 28 bp, Artificial Sequence
  Description of Artificial Sequence: Synthetic oligonucleotide
ttgcggatggcgtttcaggtggagaagg

SEQ ID NO: 216083 - DNA, 27 bp, Artificial Sequence
  Description of Artificial Sequence: Synthetic oligonucleotide
tgcggatggcgtttcaggtggagaagg

SEQ ID NO: 216084 - DNA, 27 bp, Artificial Sequence
  Description of Artificial Sequence: Synthetic oligonucleotide
gcggatggcgtttcaggtggagaagga

SEQ ID NO: 216085 - DNA, 30 bp, Artificial Sequence
  Description of Artificial Sequence: Synthetic oligonucleotide
cggatggcgtttcaggtggagaaggaaaag

SEQ ID NO: 216086 - DNA, 30 bp, Artificial Sequence
  Description of Artificial Sequence: Synthetic oligonucleotide
ggatggcgtttcaggtggagaaggaaaagg

SEQ ID NO: 216087 - DNA, 31 bp, Artificial Sequence
  Description of Artificial Sequence: Synthetic oligonucleotide
gatggcgtttcaggtggagaaggaaaaggag

SEQ ID NO: 216088 - DNA, 31 bp, Artificial Sequence
  Description of Artificial Sequence: Synthetic oligonucleotide
atggcgtttcaggtggagaaggaaaaggagg

SEQ ID NO: 216089 - DNA, 30 bp, Artificial Sequence
  Description of Artificial Sequence: Synthetic oligonucleotide
tggcgtttcaggtggagaaggaaaaggagg

SEQ ID NO: 216090 - DNA, 29 bp, Artificial Sequence
  Description of Artificial Sequence: Synthetic oligonucleotide
ggcgtttcaggtggagaaggaaaaggagg

SEQ ID NO: 216091 - DNA, 29 bp, Artificial Sequence
  Description of Artificial Sequence: Synthetic oligonucleotide
gcgtttcaggtggagaaggaaaaggaggc

SEQ ID NO: 216092 - DNA, 30 bp, Artificial Sequence
  Description of Artificial Sequence: Synthetic oligonucleotide
cgtttcaggtggagaaggaaaaggaggcag

SEQ ID NO: 216093 - DNA, 31 bp, Artificial Sequence
  Description of Artificial Sequence: Synthetic oligonucleotide
gtttcaggtggagaaggaaaaggaggcagtg

SEQ ID NO: 216094 - DNA, 33 bp, Artificial Sequence
  Description of Artificial Sequence: Synthetic oligonucleotide
tttcaggtggagaaggaaaaggaggcagtgatg

SEQ ID NO: 216095 - DNA, 32 bp, Artificial Sequence
  Description of Artificial Sequence: Synthetic oligonucleotide
ttcaggtggagaaggaaaaggaggcagtgatg

SEQ ID NO: 216096 - DNA, 31 bp, Artificial Sequence
  Description of Artificial Sequence: Synthetic oligonucleotide
tcaggtggagaaggaaaaggaggcagtgatg

SEQ ID NO: 216097 - DNA, 30 bp, Artificial Sequence
  Description of Artificial Sequence: Synthetic oligonucleotide
caggtggagaaggaaaaggaggcagtgatg

SEQ ID NO: 216098 - DNA, 30 bp, Artificial Sequence
  Description of Artificial Sequence: Synthetic oligonucleotide
aggtggagaaggaaaaggaggcagtgatgg

SEQ ID NO: 216099 - DNA, 29 bp, Artificial Sequence
  Description of Artificial Sequence: Synthetic oligonucleotide
ggtggagaaggaaaaggaggcagtgatgg

SEQ ID NO: 216100 - DNA, 30 bp, Artificial Sequence
  Description of Artificial Sequence: Synthetic oligonucleotide
gtggagaaggaaaaggaggcagtgatggtg

SEQ ID NO: 216101 - DNA, 30 bp, Artificial Sequence
  Description of Artificial Sequence: Synthetic oligonucleotide
tggagaaggaaaaggaggcagtgatggtgg

SEQ ID NO: 216102 - DNA, 29 bp, Artificial Sequence
  Description of Artificial Sequence: Synthetic oligonucleotide
ggagaaggaaaaggaggcagtgatggtgg

SEQ ID NO: 216103 - DNA, 30 bp, Artificial Sequence
  Description of Artificial Sequence: Synthetic oligonucleotide
gagaaggaaaaggaggcagtgatggtggag

SEQ ID NO: 216104 - DNA, 30 bp, Artificial Sequence
  Description of Artificial Sequence: Synthetic oligonucleotide
agaaggaaaaggaggcagtgatggtggagg

SEQ ID NO: 216105 - DNA, 29 bp, Artificial Sequence
  Description of Artificial Sequence: Synthetic oligonucleotide
gaaggaaaaggaggcagtgatggtggagg

SEQ ID NO: 216106 - DNA, 29 bp, Artificial Sequence
  Description of Artificial Sequence: Synthetic oligonucleotide
aaggaaaaggaggcagtgatggtggaggc

SEQ ID NO: 216107 - DNA, 28 bp, Artificial Sequence
  Description of Artificial Sequence: Synthetic oligonucleotide
aggaaaaggaggcagtgatggtggaggc

SEQ ID NO: 216108 - DNA, 27 bp, Artificial Sequence
  Description of Artificial Sequence: Synthetic oligonucleotide
ggaaaaggaggcagtgatggtggaggc

SEQ ID NO: 216109 - DNA, 28 bp, Artificial Sequence
  Description of Artificial Sequence: Synthetic oligonucleotide
gaaaaggaggcagtgatggtggaggcag

SEQ ID NO: 216110 - DNA, 28 bp, Artificial Sequence
  Description of Artificial Sequence: Synthetic oligonucleotide
aaaaggaggcagtgatggtggaggcagc

SEQ ID NO: 216111 - DNA, 27 bp, Artificial Sequence
  Description of Artificial Sequence: Synthetic oligonucleotide
aaaggaggcagtgatggtggaggcagc

SEQ ID NO: 216112 - DNA, 26 bp, Artificial Sequence
  Description of Artificial Sequence: Synthetic oligonucleotide
aaggaggcagtgatggtggaggcagc

SEQ ID NO: 216113 - DNA, 25 bp, Artificial Sequence
  Description of Artificial Sequence: Synthetic oligonucleotide
aggaggcagtgatggtggaggcagc

SEQ ID NO: 216114 - DNA, 24 bp, Artificial Sequence
  Description of Artificial Sequence: Synthetic oligonucleotide
ggaggcagtgatggtggaggcagc

SEQ ID NO: 216115 - DNA, 25 bp, Artificial Sequence
  Description of Artificial Sequence: Synthetic oligonucleotide
gaggcagtgatggtggaggcagcca

SEQ ID NO: 216116 - DNA, 26 bp, Artificial Sequence
  Description of Artificial Sequence: Synthetic oligonucleotide
aggcagtgatggtggaggcagccaca

SEQ ID NO: 216117 - DNA, 25 bp, Artificial Sequence
  Description of Artificial Sequence: Synthetic oligonucleotide
ggcagtgatggtggaggcagccaca

SEQ ID NO: 216118 - DNA, 25 bp, Artificial Sequence
  Description of Artificial Sequence: Synthetic oligonucleotide
gcagtgatggtggaggcagccacag

SEQ ID NO: 216119 - DNA, 27 bp, Artificial Sequence
  Description of Artificial Sequence: Synthetic oligonucleotide
cagtgatggtggaggcagccacaggaa

SEQ ID NO: 216120 - DNA, 28 bp, Artificial Sequence
  Description of Artificial Sequence: Synthetic oligonucleotide
agtgatggtggaggcagccacaggaaag

SEQ ID NO: 216121 - DNA, 27 bp, Artificial Sequence
  Description of Artificial Sequence: Synthetic oligonucleotide
gtgatggtggaggcagccacaggaaag

SEQ ID NO: 216122 - DNA, 29 bp, Artificial Sequence
  Description of Artificial Sequence: Synthetic oligonucleotide
tgatggtggaggcagccacaggaaagaag

SEQ ID NO: 216123 - DNA, 28 bp, Artificial Sequence
  Description of Artificial Sequence: Synthetic oligonucleotide
gatggtggaggcagccacaggaaagaag

SEQ ID NO: 216124 - DNA, 28 bp, Artificial Sequence
  Description of Artificial Sequence: Synthetic oligonucleotide
atggtggaggcagccacaggaaagaagg

SEQ ID NO: 216125 - DNA, 27 bp, Artificial Sequence
  Description of Artificial Sequence: Synthetic oligonucleotide
tggtggaggcagccacaggaaagaagg

SEQ ID NO: 216126 - DNA, 26 bp, Artificial Sequence
  Description of Artificial Sequence: Synthetic oligonucleotide
ggtggaggcagccacaggaaagaagg

SEQ ID NO: 216127 - DNA, 26 bp, Artificial Sequence
  Description of Artificial Sequence: Synthetic oligonucleotide
gtggaggcagccacaggaaagaaggg

SEQ ID NO: 216128 - DNA, 27 bp, Artificial Sequence
  Description of Artificial Sequence: Synthetic oligonucleotide
tggaggcagccacaggaaagaagggga

SEQ ID NO: 216129 - DNA, 27 bp, Artificial Sequence
  Description of Artificial Sequence: Synthetic oligonucleotide
ggaggcagccacaggaaagaaggggaa

SEQ ID NO: 216130 - DNA, 27 bp, Artificial Sequence
  Description of Artificial Sequence: Synthetic oligonucleotide
gaggcagccacaggaaagaaggggaag

SEQ ID NO: 216131 - DNA, 28 bp, Artificial Sequence
  Description of Artificial Sequence: Synthetic oligonucleotide
aggcagccacaggaaagaaggggaagag

SEQ ID NO: 216132 - DNA, 27 bp, Artificial Sequence
  Description of Artificial Sequence: Synthetic oligonucleotide
ggcagccacaggaaagaaggggaagag

SEQ ID NO: 216133 - DNA, 27 bp, Artificial Sequence
  Description of Artificial Sequence: Synthetic oligonucleotide
gcagccacaggaaagaaggggaagagg

SEQ ID NO: 216134 - DNA, 27 bp, Artificial Sequence
  Description of Artificial Sequence: Synthetic oligonucleotide
cagccacaggaaagaaggggaagaggc

SEQ ID NO: 216135 - DNA, 27 bp, Artificial Sequence
  Description of Artificial Sequence: Synthetic oligonucleotide
agccacaggaaagaaggggaagaggcc

SEQ ID NO: 216136 - DNA, 26 bp, Artificial Sequence
  Description of Artificial Sequence: Synthetic oligonucleotide
gccacaggaaagaaggggaagaggcc

SEQ ID NO: 216137 - DNA, 27 bp, Artificial Sequence
  Description of Artificial Sequence: Synthetic oligonucleotide
ccacaggaaagaaggggaagaggccga

SEQ ID NO: 216138 - DNA, 27 bp, Artificial Sequence
  Description of Artificial Sequence: Synthetic oligonucleotide
cacaggaaagaaggggaagaggccgac

SEQ ID NO: 216139 - DNA, 27 bp, Artificial Sequence
  Description of Artificial Sequence: Synthetic oligonucleotide
acaggaaagaaggggaagaggccgacg

SEQ ID NO: 216140 - DNA, 26 bp, Artificial Sequence
  Description of Artificial Sequence: Synthetic oligonucleotide
caggaaagaaggggaagaggccgacg

SEQ ID NO: 216141 - DNA, 26 bp, Artificial Sequence
  Description of Artificial Sequence: Synthetic oligonucleotide
aggaaagaaggggaagaggccgacgc

SEQ ID NO: 216142 - DNA, 25 bp, Artificial Sequence
  Description of Artificial Sequence: Synthetic oligonucleotide
ggaaagaaggggaagaggccgacgc

SEQ ID NO: 216143 - DNA, 25 bp, Artificial Sequence
  Description of Artificial Sequence: Synthetic oligonucleotide
gaaagaaggggaagaggccgacgcc

SEQ ID NO: 216144 - DNA, 25 bp, Artificial Sequence
  Description of Artificial Sequence: Synthetic oligonucleotide
aaagaaggggaagaggccgacgccc

SEQ ID NO: 216145 - DNA, 24 bp, Artificial Sequence
  Description of Artificial Sequence: Synthetic oligonucleotide
aagaaggggaagaggccgacgccc

SEQ ID NO: 216146 - DNA, 23 bp, Artificial Sequence
  Description of Artificial Sequence: Synthetic oligonucleotide
agaaggggaagaggccgacgccc

SEQ ID NO: 216147 - DNA, 22 bp, Artificial Sequence
  Description of Artificial Sequence: Synthetic oligonucleotide
gaaggggaagaggccgacgccc

SEQ ID NO: 216148 - DNA, 23 bp, Artificial Sequence
  Description of Artificial Sequence: Synthetic oligonucleotide
aaggggaagaggccgacgcccca

SEQ ID NO: 216149 - DNA, 22 bp, Artificial Sequence
  Description of Artificial Sequence: Synthetic oligonucleotide
aggggaagaggccgacgcccca

SEQ ID NO: 216150 - DNA, 21 bp, Artificial Sequence
  Description of Artificial Sequence: Synthetic oligonucleotide
ggggaagaggccgacgcccca

SEQ ID NO: 216151 - DNA, 21 bp, Artificial Sequence
  Description of Artificial Sequence: Synthetic oligonucleotide
gggaagaggccgacgccccag

SEQ ID NO: 216152 - DNA, 21 bp, Artificial Sequence
  Description of Artificial Sequence: Synthetic oligonucleotide
ggaagaggccgacgccccagg

SEQ ID NO: 216153 - DNA, 21 bp, Artificial Sequence
  Description of Artificial Sequence: Synthetic oligonucleotide
gaagaggccgacgccccaggc

SEQ ID NO: 216154 - DNA, 22 bp, Artificial Sequence
  Description of Artificial Sequence: Synthetic oligonucleotide
aagaggccgacgccccaggcgt

SEQ ID NO: 216155 - DNA, 21 bp, Artificial Sequence
  Description of Artificial Sequence: Synthetic oligonucleotide
agaggccgacgccccaggcgt

SEQ ID NO: 216156 - DNA, 20 bp, Artificial Sequence
  Description of Artificial Sequence: Synthetic oligonucleotide
gaggccgacgccccaggcgt

SEQ ID NO: 216157 - DNA, 22 bp, Artificial Sequence
  Description of Artificial Sequence: Synthetic oligonucleotide
aggccgacgccccaggcgtgat

SEQ ID NO: 216158 - DNA, 21 bp, Artificial Sequence
  Description of Artificial Sequence: Synthetic oligonucleotide
ggccgacgccccaggcgtgat

SEQ ID NO: 216159 - DNA, 21 bp, Artificial Sequence
  Description of Artificial Sequence: Synthetic oligonucleotide
gccgacgccccaggcgtgatc

SEQ ID NO: 216160 - DNA, 21 bp, Artificial Sequence
  Description of Artificial Sequence: Synthetic oligonucleotide
ccgacgccccaggcgtgatcc

SEQ ID NO: 216161 - DNA, 21 bp, Artificial Sequence
  Description of Artificial Sequence: Synthetic oligonucleotide
cgacgccccaggcgtgatccc

SEQ ID NO: 216162 - DNA, 21 bp, Artificial Sequence
  Description of Artificial Sequence: Synthetic oligonucleotide
gacgccccaggcgtgatcccc

SEQ ID NO: 216163 - DNA, 21 bp, Artificial Sequence
  Description of Artificial Sequence: Synthetic oligonucleotide
acgccccaggcgtgatccccg

SEQ ID NO: 216164 - DNA, 20 bp, Artificial Sequence
  Description of Artificial Sequence: Synthetic oligonucleotide
cgccccaggcgtgatccccg

SEQ ID NO: 216165 - DNA, 20 bp, Artificial Sequence
  Description of Artificial Sequence: Synthetic oligonucleotide
gccccaggcgtgatccccgg

SEQ ID NO: 216166 - DNA, 23 bp, Artificial Sequence
  Description of Artificial Sequence: Synthetic oligonucleotide
ccccaggcgtgatccccgggatt

SEQ ID NO: 216167 - DNA, 24 bp, Artificial Sequence
  Description of Artificial Sequence: Synthetic oligonucleotide
cccaggcgtgatccccgggattgt

SEQ ID NO: 216168 - DNA, 24 bp, Artificial Sequence
  Description of Artificial Sequence: Synthetic oligonucleotide
ccaggcgtgatccccgggattgtg

SEQ ID NO: 216169 - DNA, 24 bp, Artificial Sequence
  Description of Artificial Sequence: Synthetic oligonucleotide
caggcgtgatccccgggattgtgg

SEQ ID NO: 216170 - DNA, 24 bp, Artificial Sequence
  Description of Artificial Sequence: Synthetic oligonucleotide
aggcgtgatccccgggattgtggg

SEQ ID NO: 216171 - DNA, 23 bp, Artificial Sequence
  Description of Artificial Sequence: Synthetic oligonucleotide
ggcgtgatccccgggattgtggg

SEQ ID NO: 216172 - DNA, 23 bp, Artificial Sequence
  Description of Artificial Sequence: Synthetic oligonucleotide
gcgtgatccccgggattgtgggg

SEQ ID NO: 216173 - DNA, 23 bp, Artificial Sequence
  Description of Artificial Sequence: Synthetic oligonucleotide
cgtgatccccgggattgtggggg

SEQ ID NO: 216174 - DNA, 24 bp, Artificial Sequence
  Description of Artificial Sequence: Synthetic oligonucleotide
gtgatccccgggattgtgggggct

SEQ ID NO: 216175 - DNA, 25 bp, Artificial Sequence
  Description of Artificial Sequence: Synthetic oligonucleotide
tgatccccgggattgtgggggctgt

SEQ ID NO: 216176 - DNA, 24 bp, Artificial Sequence
  Description of Artificial Sequence: Synthetic oligonucleotide
gatccccgggattgtgggggctgt

SEQ ID NO: 216177 - DNA, 24 bp, Artificial Sequence
  Description of Artificial Sequence: Synthetic oligonucleotide
atccccgggattgtgggggctgtc

SEQ ID NO: 216178 - DNA, 23 bp, Artificial Sequence
  Description of Artificial Sequence: Synthetic oligonucleotide
tccccgggattgtgggggctgtc

SEQ ID NO: 216179 - DNA, 22 bp, Artificial Sequence
  Description of Artificial Sequence: Synthetic oligonucleotide
ccccgggattgtgggggctgtc

SEQ ID NO: 216180 - DNA, 23 bp, Artificial Sequence
  Description of Artificial Sequence: Synthetic oligonucleotide
cccgggattgtgggggctgtcgt

SEQ ID NO: 216181 - DNA, 23 bp, Artificial Sequence
  Description of Artificial Sequence: Synthetic oligonucleotide
ccgggattgtgggggctgtcgtg

SEQ ID NO: 216182 - DNA, 24 bp, Artificial Sequence
  Description of Artificial Sequence: Synthetic oligonucleotide
cgggattgtgggggctgtcgtggt

SEQ ID NO: 216183 - DNA, 24 bp, Artificial Sequence
  Description of Artificial Sequence: Synthetic oligonucleotide
gggattgtgggggctgtcgtggtc

SEQ ID NO: 216184 - DNA, 24 bp, Artificial Sequence
  Description of Artificial Sequence: Synthetic oligonucleotide
ggattgtgggggctgtcgtggtcg

SEQ ID NO: 216185 - DNA, 24 bp, Artificial Sequence
  Description of Artificial Sequence: Synthetic oligonucleotide
gattgtgggggctgtcgtggtcgc

SEQ ID NO: 216186 - DNA, 24 bp, Artificial Sequence
  Description of Artificial Sequence: Synthetic oligonucleotide
attgtgggggctgtcgtggtcgcc

SEQ ID NO: 216187 - DNA, 23 bp, Artificial Sequence
  Description of Artificial Sequence: Synthetic oligonucleotide
ttgtgggggctgtcgtggtcgcc

SEQ ID NO: 216188 - DNA, 22 bp, Artificial Sequence
  Description of Artificial Sequence: Synthetic oligonucleotide
tgtgggggctgtcgtggtcgcc

SEQ ID NO: 216189 - DNA, 21 bp, Artificial Sequence
  Description of Artificial Sequence: Synthetic oligonucleotide
gtgggggctgtcgtggtcgcc

SEQ ID NO: 216190 - DNA, 22 bp, Artificial Sequence
  Description of Artificial Sequence: Synthetic oligonucleotide
tgggggctgtcgtggtcgccgt

SEQ ID NO: 216191 - DNA, 21 bp, Artificial Sequence
  Description of Artificial Sequence: Synthetic oligonucleotide
gggggctgtcgtggtcgccgt

SEQ ID NO: 216192 - DNA, 21 bp, Artificial Sequence
  Description of Artificial Sequence: Synthetic oligonucleotide
ggggctgtcgtggtcgccgtg

SEQ ID NO: 216193 - DNA, 21 bp, Artificial Sequence
  Description of Artificial Sequence: Synthetic oligonucleotide
gggctgtcgtggtcgccgtgg

SEQ ID NO: 216194 - DNA, 22 bp, Artificial Sequence
  Description of Artificial Sequence: Synthetic oligonucleotide
ggctgtcgtggtcgccgtggct

SEQ ID NO: 216195 - DNA, 22 bp, Artificial Sequence
  Description of Artificial Sequence: Synthetic oligonucleotide
gctgtcgtggtcgccgtggctg

SEQ ID NO: 216196 - DNA, 23 bp, Artificial Sequence
  Description of Artificial Sequence: Synthetic oligonucleotide
ctgtcgtggtcgccgtggctgga

SEQ ID NO: 216197 - DNA, 23 bp, Artificial Sequence
  Description of Artificial Sequence: Synthetic oligonucleotide
tgtcgtggtcgccgtggctggag

SEQ ID NO: 216198 - DNA, 22 bp, Artificial Sequence
  Description of Artificial Sequence: Synthetic oligonucleotide
gtcgtggtcgccgtggctggag

SEQ ID NO: 216199 - DNA, 22 bp, Artificial Sequence
  Description of Artificial Sequence: Synthetic oligonucleotide
tcgtggtcgccgtggctggagc

SEQ ID NO: 216200 - DNA, 21 bp, Artificial Sequence
  Description of Artificial Sequence: Synthetic oligonucleotide
cgtggtcgccgtggctggagc

SEQ ID NO: 216201 - DNA, 23 bp, Artificial Sequence
  Description of Artificial Sequence: Synthetic oligonucleotide
gtggtcgccgtggctggagccat

SEQ ID NO: 216202 - DNA, 24 bp, Artificial Sequence
  Description of Artificial Sequence: Synthetic oligonucleotide
tggtcgccgtggctggagccatct

SEQ ID NO: 216203 - DNA, 23 bp, Artificial Sequence
  Description of Artificial Sequence: Synthetic oligonucleotide
ggtcgccgtggctggagccatct

SEQ ID NO: 216204 - DNA, 25 bp, Artificial Sequence
  Description of Artificial Sequence: Synthetic oligonucleotide
gtcgccgtggctggagccatctcta

SEQ ID NO: 216205 - DNA, 25 bp, Artificial Sequence
  Description of Artificial Sequence: Synthetic oligonucleotide
tcgccgtggctggagccatctctag

SEQ ID NO: 216206 - DNA, 24 bp, Artificial Sequence
  Description of Artificial Sequence: Synthetic oligonucleotide
cgccgtggctggagccatctctag

SEQ ID NO: 216207 - DNA, 26 bp, Artificial Sequence
  Description of Artificial Sequence: Synthetic oligonucleotide
gccgtggctggagccatctctagctt

SEQ ID NO: 216208 - DNA, 27 bp, Artificial Sequence
  Description of Artificial Sequence: Synthetic oligonucleotide
ccgtggctggagccatctctagcttca

SEQ ID NO: 216209 - DNA, 29 bp, Artificial Sequence
  Description of Artificial Sequence: Synthetic oligonucleotide
cgtggctggagccatctctagcttcattg

SEQ ID NO: 216210 - DNA, 29 bp, Artificial Sequence
  Description of Artificial Sequence: Synthetic oligonucleotide
gtggctggagccatctctagcttcattgc

SEQ ID NO: 216211 - DNA, 32 bp, Artificial Sequence
  Description of Artificial Sequence: Synthetic oligonucleotide
tggctggagccatctctagcttcattgcttac

SEQ ID NO: 216212 - DNA, 31 bp, Artificial Sequence
  Description of Artificial Sequence: Synthetic oligonucleotide
ggctggagccatctctagcttcattgcttac

SEQ ID NO: 216213 - DNA, 31 bp, Artificial Sequence
  Description of Artificial Sequence: Synthetic oligonucleotide
gctggagccatctctagcttcattgcttacc

SEQ ID NO: 216214 - DNA, 32 bp, Artificial Sequence
  Description of Artificial Sequence: Synthetic oligonucleotide
ctggagccatctctagcttcattgcttaccag

SEQ ID NO: 216215 - DNA, 37 bp, Artificial Sequence
  Description of Artificial Sequence: Synthetic oligonucleotide
tggagccatctctagcttcattgcttaccagaaaaag

SEQ ID NO: 216216 - DNA, 36 bp, Artificial Sequence
  Description of Artificial Sequence: Synthetic oligonucleotide
ggagccatctctagcttcattgcttaccagaaaaag

SEQ ID NO: 216217 - DNA, 38 bp, Artificial Sequence
  Description of Artificial Sequence: Synthetic oligonucleotide
gagccatctctagcttcattgcttaccagaaaaagaag

SEQ ID NO: 216218 - DNA, 38 bp, Artificial Sequence
  Description of Artificial Sequence: Synthetic oligonucleotide
agccatctctagcttcattgcttaccagaaaaagaagc

SEQ ID NO: 216219 - DNA, 37 bp, Artificial Sequence
  Description of Artificial Sequence: Synthetic oligonucleotide
gccatctctagcttcattgcttaccagaaaaagaagc

SEQ ID NO: 216220 - DNA, 40 bp, Artificial Sequence
  Description of Artificial Sequence: Synthetic oligonucleotide
ccatctctagcttcattgcttaccagaaaaagaagctatg

SEQ ID NO: 216221 - DNA, 40 bp, Artificial Sequence
  Description of Artificial Sequence: Synthetic oligonucleotide
catctctagcttcattgcttaccagaaaaagaagctatgc

SEQ ID NO: 216222 - DNA, 42 bp, Artificial Sequence
  Description of Artificial Sequence: Synthetic oligonucleotide
atctctagcttcattgcttaccagaaaaagaagctatgcttc

SEQ ID NO: 216223 - DNA, 41 bp, Artificial Sequence
  Description of Artificial Sequence: Synthetic oligonucleotide
tctctagcttcattgcttaccagaaaaagaagctatgcttc

SEQ ID NO: 216224 - DNA, 40 bp, Artificial Sequence
  Description of Artificial Sequence: Synthetic oligonucleotide
ctctagcttcattgcttaccagaaaaagaagctatgcttc

SEQ ID NO: 216225 - DNA, 43 bp, Artificial Sequence
  Description of Artificial Sequence: Synthetic oligonucleotide
tctagcttcattgcttaccagaaaaagaagctatgcttcaaag

SEQ ID NO: 216226 - DNA, 42 bp, Artificial Sequence
  Description of Artificial Sequence: Synthetic oligonucleotide
ctagcttcattgcttaccagaaaaagaagctatgcttcaaag

SEQ ID NO: 216227 - DNA, 47 bp, Artificial Sequence
  Description of Artificial Sequence: Synthetic oligonucleotide
tagcttcattgcttaccagaaaaagaagctatgcttcaaagaaaatg

SEQ ID NO: 216228 - DNA, 46 bp, Artificial Sequence
  Description of Artificial Sequence: Synthetic oligonucleotide
agcttcattgcttaccagaaaaagaagctatgcttcaaagaaaatg

SEQ ID NO: 216229 - DNA, 45 bp, Artificial Sequence
  Description of Artificial Sequence: Synthetic oligonucleotide
gcttcattgcttaccagaaaaagaagctatgcttcaaagaaaatg

SEQ ID NO: 216230 - DNA, 45 bp, Artificial Sequence
  Description of Artificial Sequence: Synthetic oligonucleotide
cttcattgcttaccagaaaaagaagctatgcttcaaagaaaatgc

SEQ ID NO: 216231 - DNA, 46 bp, Artificial Sequence
  Description of Artificial Sequence: Synthetic oligonucleotide
ttcattgcttaccagaaaaagaagctatgcttcaaagaaaatgcag

SEQ ID NO: 216232 - DNA, 45 bp, Artificial Sequence
  Description of Artificial Sequence: Synthetic oligonucleotide
tcattgcttaccagaaaaagaagctatgcttcaaagaaaatgcag

SEQ ID NO: 216233 - DNA, 44 bp, Artificial Sequence
  Description of Artificial Sequence: Synthetic oligonucleotide
cattgcttaccagaaaaagaagctatgcttcaaagaaaatgcag

SEQ ID NO: 216234 - DNA, 46 bp, Artificial Sequence
  Description of Artificial Sequence: Synthetic oligonucleotide
attgcttaccagaaaaagaagctatgcttcaaagaaaatgcagaac

SEQ ID NO: 216235 - DNA, 45 bp, Artificial Sequence
  Description of Artificial Sequence: Synthetic oligonucleotide
ttgcttaccagaaaaagaagctatgcttcaaagaaaatgcagaac

SEQ ID NO: 216236 - DNA, 44 bp, Artificial Sequence
  Description of Artificial Sequence: Synthetic oligonucleotide
tgcttaccagaaaaagaagctatgcttcaaagaaaatgcagaac

SEQ ID NO: 216237 - DNA, 43 bp, Artificial Sequence
  Description of Artificial Sequence: Synthetic oligonucleotide
gcttaccagaaaaagaagctatgcttcaaagaaaatgcagaac

SEQ ID NO: 216238 - DNA, 45 bp, Artificial Sequence
  Description of Artificial Sequence: Synthetic oligonucleotide
cttaccagaaaaagaagctatgcttcaaagaaaatgcagaacaag

SEQ ID NO: 216239 - DNA, 45 bp, Artificial Sequence
  Description of Artificial Sequence: Synthetic oligonucleotide
ttaccagaaaaagaagctatgcttcaaagaaaatgcagaacaagg

SEQ ID NO: 216240 - DNA, 44 bp, Artificial Sequence
  Description of Artificial Sequence: Synthetic oligonucleotide
taccagaaaaagaagctatgcttcaaagaaaatgcagaacaagg

SEQ ID NO: 216241 - DNA, 43 bp, Artificial Sequence
  Description of Artificial Sequence: Synthetic oligonucleotide
accagaaaaagaagctatgcttcaaagaaaatgcagaacaagg

SEQ ID NO: 216242 - DNA, 42 bp, Artificial Sequence
  Description of Artificial Sequence: Synthetic oligonucleotide
ccagaaaaagaagctatgcttcaaagaaaatgcagaacaagg

SEQ ID NO: 216243 - DNA, 42 bp, Artificial Sequence
  Description of Artificial Sequence: Synthetic oligonucleotide
cagaaaaagaagctatgcttcaaagaaaatgcagaacaaggg

SEQ ID NO: 216244 - DNA, 42 bp, Artificial Sequence
  Description of Artificial Sequence: Synthetic oligonucleotide
agaaaaagaagctatgcttcaaagaaaatgcagaacaagggg

SEQ ID NO: 216245 - DNA, 41 bp, Artificial Sequence
  Description of Artificial Sequence: Synthetic oligonucleotide
gaaaaagaagctatgcttcaaagaaaatgcagaacaagggg

SEQ ID NO: 216246 - DNA, 42 bp, Artificial Sequence
  Description of Artificial Sequence: Synthetic oligonucleotide
aaaaagaagctatgcttcaaagaaaatgcagaacaaggggag

SEQ ID NO: 216247 - DNA, 41 bp, Artificial Sequence
  Description of Artificial Sequence: Synthetic oligonucleotide
aaaagaagctatgcttcaaagaaaatgcagaacaaggggag

SEQ ID NO: 216248 - DNA, 40 bp, Artificial Sequence
  Description of Artificial Sequence: Synthetic oligonucleotide
aaagaagctatgcttcaaagaaaatgcagaacaaggggag

SEQ ID NO: 216249 - DNA, 39 bp, Artificial Sequence
  Description of Artificial Sequence: Synthetic oligonucleotide
aagaagctatgcttcaaagaaaatgcagaacaaggggag

SEQ ID NO: 216250 - DNA, 38 bp, Artificial Sequence
  Description of Artificial Sequence: Synthetic oligonucleotide
agaagctatgcttcaaagaaaatgcagaacaaggggag

SEQ ID NO: 216251 - DNA, 37 bp, Artificial Sequence
  Description of Artificial Sequence: Synthetic oligonucleotide
gaagctatgcttcaaagaaaatgcagaacaaggggag

SEQ ID NO: 216252 - DNA, 37 bp, Artificial Sequence
  Description of Artificial Sequence: Synthetic oligonucleotide
aagctatgcttcaaagaaaatgcagaacaaggggagg

SEQ ID NO: 216253 - DNA, 36 bp, Artificial Sequence
  Description of Artificial Sequence: Synthetic oligonucleotide
agctatgcttcaaagaaaatgcagaacaaggggagg

SEQ ID NO: 216254 - DNA, 35 bp, Artificial Sequence
  Description of Artificial Sequence: Synthetic oligonucleotide
gctatgcttcaaagaaaatgcagaacaaggggagg

SEQ ID NO: 216255 - DNA, 36 bp, Artificial Sequence
  Description of Artificial Sequence: Synthetic oligonucleotide
ctatgcttcaaagaaaatgcagaacaaggggaggtg

SEQ ID NO: 216256 - DNA, 36 bp, Artificial Sequence
  Description of Artificial Sequence: Synthetic oligonucleotide
tatgcttcaaagaaaatgcagaacaaggggaggtgg

SEQ ID NO: 216257 - DNA, 35 bp, Artificial Sequence
  Description of Artificial Sequence: Synthetic oligonucleotide
atgcttcaaagaaaatgcagaacaaggggaggtgg

SEQ ID NO: 216258 - DNA, 34 bp, Artificial Sequence
  Description of Artificial Sequence: Synthetic oligonucleotide
tgcttcaaagaaaatgcagaacaaggggaggtgg

SEQ ID NO: 216259 - DNA, 33 bp, Artificial Sequence
  Description of Artificial Sequence: Synthetic oligonucleotide
gcttcaaagaaaatgcagaacaaggggaggtgg

SEQ ID NO: 216260 - DNA, 34 bp, Artificial Sequence
  Description of Artificial Sequence: Synthetic oligonucleotide
cttcaaagaaaatgcagaacaaggggaggtggac

SEQ ID NO: 216261 - DNA, 36 bp, Artificial Sequence
  Description of Artificial Sequence: Synthetic oligonucleotide
ttcaaagaaaatgcagaacaaggggaggtggacatg

SEQ ID NO: 216262 - DNA, 35 bp, Artificial Sequence
  Description of Artificial Sequence: Synthetic oligonucleotide
tcaaagaaaatgcagaacaaggggaggtggacatg

SEQ ID NO: 216263 - DNA, 34 bp, Artificial Sequence
  Description of Artificial Sequence: Synthetic oligonucleotide
caaagaaaatgcagaacaaggggaggtggacatg

SEQ ID NO: 216264 - DNA, 34 bp, Artificial Sequence
  Description of Artificial Sequence: Synthetic oligonucleotide
aaagaaaatgcagaacaaggggaggtggacatgg

SEQ ID NO: 216265 - DNA, 33 bp, Artificial Sequence
  Description of Artificial Sequence: Synthetic oligonucleotide
aagaaaatgcagaacaaggggaggtggacatgg

SEQ ID NO: 216266 - DNA, 32 bp, Artificial Sequence
  Description of Artificial Sequence: Synthetic oligonucleotide
agaaaatgcagaacaaggggaggtggacatgg

SEQ ID NO: 216267 - DNA, 31 bp, Artificial Sequence
  Description of Artificial Sequence: Synthetic oligonucleotide
gaaaatgcagaacaaggggaggtggacatgg

SEQ ID NO: 216268 - DNA, 32 bp, Artificial Sequence
  Description of Artificial Sequence: Synthetic oligonucleotide
aaaatgcagaacaaggggaggtggacatggag

SEQ ID NO: 216269 - DNA, 31 bp, Artificial Sequence
  Description of Artificial Sequence: Synthetic oligonucleotide
aaatgcagaacaaggggaggtggacatggag

SEQ ID NO: 216270 - DNA, 30 bp, Artificial Sequence
  Description of Artificial Sequence: Synthetic oligonucleotide
aatgcagaacaaggggaggtggacatggag

SEQ ID NO: 216271 - DNA, 29 bp, Artificial Sequence
  Description of Artificial Sequence: Synthetic oligonucleotide
atgcagaacaaggggaggtggacatggag

SEQ ID NO: 216272 - DNA, 28 bp, Artificial Sequence
  Description of Artificial Sequence: Synthetic oligonucleotide
tgcagaacaaggggaggtggacatggag

SEQ ID NO: 216273 - DNA, 27 bp, Artificial Sequence
  Description of Artificial Sequence: Synthetic oligonucleotide
gcagaacaaggggaggtggacatggag

SEQ ID NO: 216274 - DNA, 28 bp, Artificial Sequence
  Description of Artificial Sequence: Synthetic oligonucleotide
cagaacaaggggaggtggacatggagag

SEQ ID NO: 216275 - DNA, 28 bp, Artificial Sequence
  Description of Artificial Sequence: Synthetic oligonucleotide
agaacaaggggaggtggacatggagagc

SEQ ID NO: 216276 - DNA, 27 bp, Artificial Sequence
  Description of Artificial Sequence: Synthetic oligonucleotide
gaacaaggggaggtggacatggagagc

SEQ ID NO: 216277 - DNA, 27 bp, Artificial Sequence
  Description of Artificial Sequence: Synthetic oligonucleotide
aacaaggggaggtggacatggagagcc

SEQ ID NO: 216278 - DNA, 27 bp, Artificial Sequence
  Description of Artificial Sequence: Synthetic oligonucleotide
acaaggggaggtggacatggagagcca

SEQ ID NO: 216279 - DNA, 26 bp, Artificial Sequence
  Description of Artificial Sequence: Synthetic oligonucleotide
caaggggaggtggacatggagagcca

SEQ ID NO: 216280 - DNA, 26 bp, Artificial Sequence
  Description of Artificial Sequence: Synthetic oligonucleotide
aaggggaggtggacatggagagccac

SEQ ID NO: 216281 - DNA, 25 bp, Artificial Sequence
  Description of Artificial Sequence: Synthetic oligonucleotide
aggggaggtggacatggagagccac

SEQ ID NO: 216282 - DNA, 24 bp, Artificial Sequence
  Description of Artificial Sequence: Synthetic oligonucleotide
ggggaggtggacatggagagccac

SEQ ID NO: 216283 - DNA, 24 bp, Artificial Sequence
  Description of Artificial Sequence: Synthetic oligonucleotide
gggaggtggacatggagagccacc

SEQ ID NO: 216284 - DNA, 24 bp, Artificial Sequence
  Description of Artificial Sequence: Synthetic oligonucleotide
ggaggtggacatggagagccaccg

SEQ ID NO: 216285 - DNA, 27 bp, Artificial Sequence
  Description of Artificial Sequence: Synthetic oligonucleotide
gaggtggacatggagagccaccggaat

SEQ ID NO: 216286 - DNA, 27 bp, Artificial Sequence
  Description of Artificial Sequence: Synthetic oligonucleotide
aggtggacatggagagccaccggaatg

SEQ ID NO: 216287 - DNA, 26 bp, Artificial Sequence
  Description of Artificial Sequence: Synthetic oligonucleotide
ggtggacatggagagccaccggaatg

SEQ ID NO: 216288 - DNA, 26 bp, Artificial Sequence
  Description of Artificial Sequence: Synthetic oligonucleotide
gtggacatggagagccaccggaatgc

SEQ ID NO: 216289 - DNA, 27 bp, Artificial Sequence
  Description of Artificial Sequence: Synthetic oligonucleotide
tggacatggagagccaccggaatgcca

SEQ ID NO: 216290 - DNA, 27 bp, Artificial Sequence
  Description of Artificial Sequence: Synthetic oligonucleotide
ggacatggagagccaccggaatgccaa

SEQ ID NO: 216291 - DNA, 27 bp, Artificial Sequence
  Description of Artificial Sequence: Synthetic oligonucleotide
gacatggagagccaccggaatgccaac

SEQ ID NO: 216292 - DNA, 27 bp, Artificial Sequence
  Description of Artificial Sequence: Synthetic oligonucleotide
acatggagagccaccggaatgccaacg

SEQ ID NO: 216293 - DNA, 26 bp, Artificial Sequence
  Description of Artificial Sequence: Synthetic oligonucleotide
catggagagccaccggaatgccaacg

SEQ ID NO: 216294 - DNA, 27 bp, Artificial Sequence
  Description of Artificial Sequence: Synthetic oligonucleotide
atggagagccaccggaatgccaacgca

SEQ ID NO: 216295 - DNA, 26 bp, Artificial Sequence
  Description of Artificial Sequence: Synthetic oligonucleotide
tggagagccaccggaatgccaacgca

SEQ ID NO: 216296 - DNA, 25 bp, Artificial Sequence
  Description of Artificial Sequence: Synthetic oligonucleotide
ggagagccaccggaatgccaacgca

SEQ ID NO: 216297 - DNA, 26 bp, Artificial Sequence
  Description of Artificial Sequence: Synthetic oligonucleotide
gagagccaccggaatgccaacgcaga

SEQ ID NO: 216298 - DNA, 26 bp, Artificial Sequence
  Description of Artificial Sequence: Synthetic oligonucleotide
agagccaccggaatgccaacgcagag

SEQ ID NO: 216299 - DNA, 25 bp, Artificial Sequence
  Description of Artificial Sequence: Synthetic oligonucleotide
gagccaccggaatgccaacgcagag

SEQ ID NO: 216300 - DNA, 25 bp, Artificial Sequence
  Description of Artificial Sequence: Synthetic oligonucleotide
agccaccggaatgccaacgcagagc

SEQ ID NO: 216301 - DNA, 24 bp, Artificial Sequence
  Description of Artificial Sequence: Synthetic oligonucleotide
gccaccggaatgccaacgcagagc

SEQ ID NO: 216302 - DNA, 25 bp, Artificial Sequence
  Description of Artificial Sequence: Synthetic oligonucleotide
ccaccggaatgccaacgcagagcca

SEQ ID NO: 216303 - DNA, 25 bp, Artificial Sequence
  Description of Artificial Sequence: Synthetic oligonucleotide
caccggaatgccaacgcagagccag

SEQ ID NO: 216304 - DNA, 26 bp, Artificial Sequence
  Description of Artificial Sequence: Synthetic oligonucleotide
accggaatgccaacgcagagccagct

SEQ ID NO: 216305 - DNA, 25 bp, Artificial Sequence
  Description of Artificial Sequence: Synthetic oligonucleotide
ccggaatgccaacgcagagccagct

SEQ ID NO: 216306 - DNA, 27 bp, Artificial Sequence
  Description of Artificial Sequence: Synthetic oligonucleotide
cggaatgccaacgcagagccagctgtt

SEQ ID NO: 216307 - DNA, 27 bp, Artificial Sequence
  Description of Artificial Sequence: Synthetic oligonucleotide
ggaatgccaacgcagagccagctgttc

SEQ ID NO: 216308 - DNA, 28 bp, Artificial Sequence
  Description of Artificial Sequence: Synthetic oligonucleotide
gaatgccaacgcagagccagctgttcag

SEQ ID NO: 216309 - DNA, 28 bp, Artificial Sequence
  Description of Artificial Sequence: Synthetic oligonucleotide
aatgccaacgcagagccagctgttcagc

SEQ ID NO: 216310 - DNA, 27 bp, Artificial Sequence
  Description of Artificial Sequence: Synthetic oligonucleotide
atgccaacgcagagccagctgttcagc

SEQ ID NO: 216311 - DNA, 26 bp, Artificial Sequence
  Description of Artificial Sequence: Synthetic oligonucleotide
tgccaacgcagagccagctgttcagc

SEQ ID NO: 216312 - DNA, 25 bp, Artificial Sequence
  Description of Artificial Sequence: Synthetic oligonucleotide
gccaacgcagagccagctgttcagc

SEQ ID NO: 216313 - DNA, 27 bp, Artificial Sequence
  Description of Artificial Sequence: Synthetic oligonucleotide
ccaacgcagagccagctgttcagcgta

SEQ ID NO: 216314 - DNA, 27 bp, Artificial Sequence
  Description of Artificial Sequence: Synthetic oligonucleotide
caacgcagagccagctgttcagcgtac

SEQ ID NO: 216315 - DNA, 28 bp, Artificial Sequence
  Description of Artificial Sequence: Synthetic oligonucleotide
aacgcagagccagctgttcagcgtactc

SEQ ID NO: 216316 - DNA, 27 bp, Artificial Sequence
  Description of Artificial Sequence: Synthetic oligonucleotide
acgcagagccagctgttcagcgtactc

SEQ ID NO: 216317 - DNA, 27 bp, Artificial Sequence
  Description of Artificial Sequence: Synthetic oligonucleotide
cgcagagccagctgttcagcgtactct

SEQ ID NO: 216318 - DNA, 31 bp, Artificial Sequence
  Description of Artificial Sequence: Synthetic oligonucleotide
gcagagccagctgttcagcgtactcttttag

SEQ ID NO: 216319 - DNA, 32 bp, Artificial Sequence
  Description of Artificial Sequence: Synthetic oligonucleotide
cagagccagctgttcagcgtactcttttagag

SEQ ID NO: 216320 - DNA, 37 bp, Artificial Sequence
  Description of Artificial Sequence: Synthetic oligonucleotide
agagccagctgttcagcgtactcttttagagaaatag

SEQ ID NO: 216321 - DNA, 29 bp, Artificial Sequence
  Description of Artificial Sequence: Synthetic oligonucleotide
cgccccggatggtggtttcgatttatctg

SEQ ID NO: 216322 - DNA, 31 bp, Artificial Sequence
  Description of Artificial Sequence: Synthetic oligonucleotide
gccccggatggtggtttcgatttatctgatg

SEQ ID NO: 216323 - DNA, 31 bp, Artificial Sequence
  Description of Artificial Sequence: Synthetic oligonucleotide
ccccggatggtggtttcgatttatctgatgc

SEQ ID NO: 216324 - DNA, 31 bp, Artificial Sequence
  Description of Artificial Sequence: Synthetic oligonucleotide
cccggatggtggtttcgatttatctgatgcc

SEQ ID NO: 216325 - DNA, 31 bp, Artificial Sequence
  Description of Artificial Sequence: Synthetic oligonucleotide
ccggatggtggtttcgatttatctgatgccc

SEQ ID NO: 216326 - DNA, 33 bp, Artificial Sequence
  Description of Artificial Sequence: Synthetic oligonucleotide
cggatggtggtttcgatttatctgatgcccttc

SEQ ID NO: 216327 - DNA, 33 bp, Artificial Sequence
  Description of Artificial Sequence: Synthetic oligonucleotide
ggatggtggtttcgatttatctgatgcccttcc

SEQ ID NO: 216328 - DNA, 34 bp, Artificial Sequence
  Description of Artificial Sequence: Synthetic oligonucleotide
gatggtggtttcgatttatctgatgcccttcctg

SEQ ID NO: 216329 - DNA, 35 bp, Artificial Sequence
  Description of Artificial Sequence: Synthetic oligonucleotide
atggtggtttcgatttatctgatgcccttcctgac

SEQ ID NO: 216330 - DNA, 34 bp, Artificial Sequence
  Description of Artificial Sequence: Synthetic oligonucleotide
tggtggtttcgatttatctgatgcccttcctgac

SEQ ID NO: 216331 - DNA, 33 bp, Artificial Sequence
  Description of Artificial Sequence: Synthetic oligonucleotide
ggtggtttcgatttatctgatgcccttcctgac

SEQ ID NO: 216332 - DNA, 36 bp, Artificial Sequence
  Description of Artificial Sequence: Synthetic oligonucleotide
gtggtttcgatttatctgatgcccttcctgacaatg

SEQ ID NO: 216333 - DNA, 40 bp, Artificial Sequence
  Description of Artificial Sequence: Synthetic oligonucleotide
tggtttcgatttatctgatgcccttcctgacaatgaaaac

SEQ ID NO: 216334 - DNA, 39 bp, Artificial Sequence
  Description of Artificial Sequence: Synthetic oligonucleotide
ggtttcgatttatctgatgcccttcctgacaatgaaaac

SEQ ID NO: 216335 - DNA, 41 bp, Artificial Sequence
  Description of Artificial Sequence: Synthetic oligonucleotide
gtttcgatttatctgatgcccttcctgacaatgaaaacaag

SEQ ID NO: 216336 - DNA, 44 bp, Artificial Sequence
  Description of Artificial Sequence: Synthetic oligonucleotide
tttcgatttatctgatgcccttcctgacaatgaaaacaagaaac

SEQ ID NO: 216337 - DNA, 43 bp, Artificial Sequence
  Description of Artificial Sequence: Synthetic oligonucleotide
ttcgatttatctgatgcccttcctgacaatgaaaacaagaaac

SEQ ID NO: 216338 - DNA, 42 bp, Artificial Sequence
  Description of Artificial Sequence: Synthetic oligonucleotide
tcgatttatctgatgcccttcctgacaatgaaaacaagaaac

SEQ ID NO: 216339 - DNA, 41 bp, Artificial Sequence
  Description of Artificial Sequence: Synthetic oligonucleotide
cgatttatctgatgcccttcctgacaatgaaaacaagaaac

SEQ ID NO: 216340 - DNA, 41 bp, Artificial Sequence
  Description of Artificial Sequence: Synthetic oligonucleotide
gatttatctgatgcccttcctgacaatgaaaacaagaaacc

SEQ ID NO: 216341 - DNA, 41 bp, Artificial Sequence
  Description of Artificial Sequence: Synthetic oligonucleotide
atttatctgatgcccttcctgacaatgaaaacaagaaaccc

SEQ ID NO: 216342 - DNA, 40 bp, Artificial Sequence
  Description of Artificial Sequence: Synthetic oligonucleotide
tttatctgatgcccttcctgacaatgaaaacaagaaaccc

SEQ ID NO: 216343 - DNA, 39 bp, Artificial Sequence
  Description of Artificial Sequence: Synthetic oligonucleotide
ttatctgatgcccttcctgacaatgaaaacaagaaaccc

SEQ ID NO: 216344 - DNA, 38 bp, Artificial Sequence
  Description of Artificial Sequence: Synthetic oligonucleotide
tatctgatgcccttcctgacaatgaaaacaagaaaccc

SEQ ID NO: 216345 - DNA, 37 bp, Artificial Sequence
  Description of Artificial Sequence: Synthetic oligonucleotide
atctgatgcccttcctgacaatgaaaacaagaaaccc

SEQ ID NO: 216346 - DNA, 36 bp, Artificial Sequence
  Description of Artificial Sequence: Synthetic oligonucleotide
tctgatgcccttcctgacaatgaaaacaagaaaccc

SEQ ID NO: 216347 - DNA, 35 bp, Artificial Sequence
  Description of Artificial Sequence: Synthetic oligonucleotide
ctgatgcccttcctgacaatgaaaacaagaaaccc

SEQ ID NO: 216348 - DNA, 36 bp, Artificial Sequence
  Description of Artificial Sequence: Synthetic oligonucleotide
tgatgcccttcctgacaatgaaaacaagaaacccac

SEQ ID NO: 216349 - DNA, 21 bp, Artificial Sequence
  Description of Artificial Sequence: Synthetic oligonucleotide
gtgttctggtcgccgccccgg

SEQ ID NO: 216350 - DNA, 20 bp, Artificial Sequence
  Description of Artificial Sequence: Synthetic oligonucleotide
atggcccgcggggctgccct

SEQ ID NO: 216351 - DNA, 20 bp, Artificial Sequence
  Description of Artificial Sequence: Synthetic oligonucleotide
tggcccgcggggctgccctt

SEQ ID NO: 216352 - DNA, 20 bp, Artificial Sequence
  Description of Artificial Sequence: Synthetic oligonucleotide
ggcccgcggggctgcccttt

SEQ ID NO: 216353 - DNA, 20 bp, Artificial Sequence
  Description of Artificial Sequence: Synthetic oligonucleotide
gcccgcggggctgccctgtt

SEQ ID NO: 216354 - DNA, 20 bp, Artificial Sequence
  Description of Artificial Sequence: Synthetic oligonucleotide
cccgcggggctgccctggtt

SEQ ID NO: 216355 - DNA, 20 bp, Artificial Sequence
  Description of Artificial Sequence: Synthetic oligonucleotide
ccgcggggctgccctggctt

SEQ ID NO: 216356 - DNA, 20 bp, Artificial Sequence
  Description of Artificial Sequence: Synthetic oligonucleotide
cgcggggctgccctggcgtt

SEQ ID NO: 216357 - DNA, 20 bp, Artificial Sequence
  Description of Artificial Sequence: Synthetic oligonucleotide
gcggggctgccctggcgctt

SEQ ID NO: 216358 - DNA, 20 bp, Artificial Sequence
  Description of Artificial Sequence: Synthetic oligonucleotide
cggggctgccctggcgctgt

SEQ ID NO: 216359 - DNA, 20 bp, Artificial Sequence
  Description of Artificial Sequence: Synthetic oligonucleotide
ggggctgccctggcgctgct

SEQ ID NO: 216360 - DNA, 20 bp, Artificial Sequence
  Description of Artificial Sequence: Synthetic oligonucleotide
gggctgccctggcgctgctg

SEQ ID NO: 216361 - DNA, 21 bp, Artificial Sequence
  Description of Artificial Sequence: Synthetic oligonucleotide
ggctgccctggcgctgctgct

SEQ ID NO: 216362 - DNA, 23 bp, Artificial Sequence
  Description of Artificial Sequence: Synthetic oligonucleotide
gctgccctggcgctgctgctctt

SEQ ID NO: 216363 - DNA, 23 bp, Artificial Sequence
  Description of Artificial Sequence: Synthetic oligonucleotide
ctgccctggcgctgctgctcttc

SEQ ID NO: 216364 - DNA, 23 bp, Artificial Sequence
  Description of Artificial Sequence: Synthetic oligonucleotide
tgccctggcgctgctgctcttcg

SEQ ID NO: 216365 - DNA, 22 bp, Artificial Sequence
  Description of Artificial Sequence: Synthetic oligonucleotide
gccctggcgctgctgctcttcg

SEQ ID NO: 216366 - DNA, 22 bp, Artificial Sequence
  Description of Artificial Sequence: Synthetic oligonucleotide
ccctggcgctgctgctcttcgg

SEQ ID NO: 216367 - DNA, 22 bp, Artificial Sequence
  Description of Artificial Sequence: Synthetic oligonucleotide
cctggcgctgctgctcttcggc

SEQ ID NO: 216368 - DNA, 45 bp, Artificial Sequence
  Description of Artificial Sequence: Synthetic oligonucleotide
cttcattgcttaccagaaaaagaagctatgcttcaaagaaaatgg

SEQ ID NO: 216369 - DNA, 45 bp, Artificial Sequence
  Description of Artificial Sequence: Synthetic oligonucleotide
ttcattgcttaccagaaaaagaagctatgcttcaaagaaaatggg

SEQ ID NO: 216370 - DNA, 44 bp, Artificial Sequence
  Description of Artificial Sequence: Synthetic oligonucleotide
tcattgcttaccagaaaaagaagctatgcttcaaagaaaatggg

SEQ ID NO: 216371 - DNA, 43 bp, Artificial Sequence
  Description of Artificial Sequence: Synthetic oligonucleotide
cattgcttaccagaaaaagaagctatgcttcaaagaaaatggg

SEQ ID NO: 216372 - DNA, 43 bp, Artificial Sequence
  Description of Artificial Sequence: Synthetic oligonucleotide
attgcttaccagaaaaagaagctatgcttcaaagaaaatgggg

SEQ ID NO: 216373 - DNA, 42 bp, Artificial Sequence
  Description of Artificial Sequence: Synthetic oligonucleotide
ttgcttaccagaaaaagaagctatgcttcaaagaaaatgggg

SEQ ID NO: 216374 - DNA, 41 bp, Artificial Sequence
  Description of Artificial Sequence: Synthetic oligonucleotide
tgcttaccagaaaaagaagctatgcttcaaagaaaatgggg

SEQ ID NO: 216375 - DNA, 40 bp, Artificial Sequence
  Description of Artificial Sequence: Synthetic oligonucleotide
gcttaccagaaaaagaagctatgcttcaaagaaaatgggg

SEQ ID NO: 216376 - DNA, 42 bp, Artificial Sequence
  Description of Artificial Sequence: Synthetic oligonucleotide
cttaccagaaaaagaagctatgcttcaaagaaaatggggaac

SEQ ID NO: 216377 - DNA, 44 bp, Artificial Sequence
  Description of Artificial Sequence: Synthetic oligonucleotide
ttaccagaaaaagaagctatgcttcaaagaaaatggggaacaag

SEQ ID NO: 216378 - DNA, 43 bp, Artificial Sequence
  Description of Artificial Sequence: Synthetic oligonucleotide
taccagaaaaagaagctatgcttcaaagaaaatggggaacaag

SEQ ID NO: 216379 - DNA, 42 bp, Artificial Sequence
  Description of Artificial Sequence: Synthetic oligonucleotide
accagaaaaagaagctatgcttcaaagaaaatggggaacaag

SEQ ID NO: 216380 - DNA, 41 bp, Artificial Sequence
  Description of Artificial Sequence: Synthetic oligonucleotide
ccagaaaaagaagctatgcttcaaagaaaatggggaacaag

SEQ ID NO: 216381 - DNA, 41 bp, Artificial Sequence
  Description of Artificial Sequence: Synthetic oligonucleotide
cagaaaaagaagctatgcttcaaagaaaatggggaacaagg

SEQ ID NO: 216382 - DNA, 41 bp, Artificial Sequence
  Description of Artificial Sequence: Synthetic oligonucleotide
agaaaaagaagctatgcttcaaagaaaatggggaacaaggg

SEQ ID NO: 216383 - DNA, 40 bp, Artificial Sequence
  Description of Artificial Sequence: Synthetic oligonucleotide
gaaaaagaagctatgcttcaaagaaaatggggaacaaggg

SEQ ID NO: 216384 - DNA, 40 bp, Artificial Sequence
  Description of Artificial Sequence: Synthetic oligonucleotide
aaaaagaagctatgcttcaaagaaaatggggaacaagggg

SEQ ID NO: 216385 - DNA, 39 bp, Artificial Sequence
  Description of Artificial Sequence: Synthetic oligonucleotide
aaaagaagctatgcttcaaagaaaatggggaacaagggg

SEQ ID NO: 216386 - DNA, 38 bp, Artificial Sequence
  Description of Artificial Sequence: Synthetic oligonucleotide
aaagaagctatgcttcaaagaaaatggggaacaagggg

SEQ ID NO: 216387 - DNA, 37 bp, Artificial Sequence
  Description of Artificial Sequence: Synthetic oligonucleotide
aagaagctatgcttcaaagaaaatggggaacaagggg

SEQ ID NO: 216388 - DNA, 36 bp, Artificial Sequence
  Description of Artificial Sequence: Synthetic oligonucleotide
agaagctatgcttcaaagaaaatggggaacaagggg

SEQ ID NO: 216389 - DNA, 35 bp, Artificial Sequence
  Description of Artificial Sequence: Synthetic oligonucleotide
gaagctatgcttcaaagaaaatggggaacaagggg

SEQ ID NO: 216390 - DNA, 36 bp, Artificial Sequence
  Description of Artificial Sequence: Synthetic oligonucleotide
aagctatgcttcaaagaaaatggggaacaaggggag

SEQ ID NO: 216391 - DNA, 35 bp, Artificial Sequence
  Description of Artificial Sequence: Synthetic oligonucleotide
agctatgcttcaaagaaaatggggaacaaggggag

SEQ ID NO: 216392 - DNA, 34 bp, Artificial Sequence
  Description of Artificial Sequence: Synthetic oligonucleotide
gctatgcttcaaagaaaatggggaacaaggggag

SEQ ID NO: 216393 - DNA, 34 bp, Artificial Sequence
  Description of Artificial Sequence: Synthetic oligonucleotide
ctatgcttcaaagaaaatggggaacaaggggagg

SEQ ID NO: 216394 - DNA, 35 bp, Artificial Sequence
  Description of Artificial Sequence: Synthetic oligonucleotide
tatgcttcaaagaaaatggggaacaaggggaggtg

SEQ ID NO: 216395 - DNA, 34 bp, Artificial Sequence
  Description of Artificial Sequence: Synthetic oligonucleotide
atgcttcaaagaaaatggggaacaaggggaggtg

SEQ ID NO: 216396 - DNA, 33 bp, Artificial Sequence
  Description of Artificial Sequence: Synthetic oligonucleotide
tgcttcaaagaaaatggggaacaaggggaggtg

SEQ ID NO: 216397 - DNA, 32 bp, Artificial Sequence
  Description of Artificial Sequence: Synthetic oligonucleotide
gcttcaaagaaaatggggaacaaggggaggtg

SEQ ID NO: 216398 - DNA, 32 bp, Artificial Sequence
  Description of Artificial Sequence: Synthetic oligonucleotide
cttcaaagaaaatggggaacaaggggaggtgg

SEQ ID NO: 216399 - DNA, 33 bp, Artificial Sequence
  Description of Artificial Sequence: Synthetic oligonucleotide
ttcaaagaaaatggggaacaaggggaggtggac

SEQ ID NO: 216400 - DNA, 32 bp, Artificial Sequence
  Description of Artificial Sequence: Synthetic oligonucleotide
tcaaagaaaatggggaacaaggggaggtggac

SEQ ID NO: 216401 - DNA, 31 bp, Artificial Sequence
  Description of Artificial Sequence: Synthetic oligonucleotide
caaagaaaatggggaacaaggggaggtggac

SEQ ID NO: 216402 - DNA, 33 bp, Artificial Sequence
  Description of Artificial Sequence: Synthetic oligonucleotide
aaagaaaatggggaacaaggggaggtggacatg

SEQ ID NO: 216403 - DNA, 32 bp, Artificial Sequence
  Description of Artificial Sequence: Synthetic oligonucleotide
aagaaaatggggaacaaggggaggtggacatg

SEQ ID NO: 216404 - DNA, 31 bp, Artificial Sequence
  Description of Artificial Sequence: Synthetic oligonucleotide
agaaaatggggaacaaggggaggtggacatg

SEQ ID NO: 216405 - DNA, 30 bp, Artificial Sequence
  Description of Artificial Sequence: Synthetic oligonucleotide
gaaaatggggaacaaggggaggtggacatg

SEQ ID NO: 216406 - DNA, 30 bp, Artificial Sequence
  Description of Artificial Sequence: Synthetic oligonucleotide
aaaatggggaacaaggggaggtggacatgg

SEQ ID NO: 216407 - DNA, 29 bp, Artificial Sequence
  Description of Artificial Sequence: Synthetic oligonucleotide
aaatggggaacaaggggaggtggacatgg

SEQ ID NO: 216408 - DNA, 28 bp, Artificial Sequence
  Description of Artificial Sequence: Synthetic oligonucleotide
aatggggaacaaggggaggtggacatgg

SEQ ID NO: 216409 - DNA, 27 bp, Artificial Sequence
  Description of Artificial Sequence: Synthetic oligonucleotide
atggggaacaaggggaggtggacatgg

SEQ ID NO: 216410 - DNA, 27 bp, Artificial Sequence
  Description of Artificial Sequence: Synthetic oligonucleotide
tggggaacaaggggaggtggacatgga

SEQ ID NO: 216411 - DNA, 26 bp, Artificial Sequence
  Description of Artificial Sequence: Synthetic oligonucleotide
ggggaacaaggggaggtggacatgga

SEQ ID NO: 216412 - DNA, 27 bp, Artificial Sequence
  Description of Artificial Sequence: Synthetic oligonucleotide
gggaacaaggggaggtggacatggaga

SEQ ID NO: 216413 - DNA, 27 bp, Artificial Sequence
  Description of Artificial Sequence: Synthetic oligonucleotide
ggaacaaggggaggtggacatggagag

SEQ ID NO: 216414 - DNA, 24 bp, Artificial Sequence
  Description of Artificial Sequence: Synthetic oligonucleotide
atggcggctgcgctgttcgtgctg

SEQ ID NO: 216415 - DNA, 23 bp, Artificial Sequence
  Description of Artificial Sequence: Synthetic oligonucleotide
tggcggctgcgctgttcgtgctg

SEQ ID NO: 216416 - DNA, 22 bp, Artificial Sequence
  Description of Artificial Sequence: Synthetic oligonucleotide
ggcggctgcgctgttcgtgctg

SEQ ID NO: 216417 - DNA, 23 bp, Artificial Sequence
  Description of Artificial Sequence: Synthetic oligonucleotide
gcggctgcgctgttcgtgctgct

SEQ ID NO: 216418 - DNA, 23 bp, Artificial Sequence
  Description of Artificial Sequence: Synthetic oligonucleotide
cggctgcgctgttcgtgctgctg

SEQ ID NO: 216419 - DNA, 23 bp, Artificial Sequence
  Description of Artificial Sequence: Synthetic oligonucleotide
ggctgcgctgttcgtgctgctgg

SEQ ID NO: 216420 - DNA, 26 bp, Artificial Sequence
  Description of Artificial Sequence: Synthetic oligonucleotide
gctgcgctgttcgtgctgctgggatt

SEQ ID NO: 216421 - DNA, 26 bp, Artificial Sequence
  Description of Artificial Sequence: Synthetic oligonucleotide
ctgcgctgttcgtgctgctgggattc

SEQ ID NO: 216422 - DNA, 26 bp, Artificial Sequence
  Description of Artificial Sequence: Synthetic oligonucleotide
tgcgctgttcgtgctgctgggattcg

SEQ ID NO: 216423 - DNA, 25 bp, Artificial Sequence
  Description of Artificial Sequence: Synthetic oligonucleotide
gcgctgttcgtgctgctgggattcg

SEQ ID NO: 216424 - DNA, 25 bp, Artificial Sequence
  Description of Artificial Sequence: Synthetic oligonucleotide
cgctgttcgtgctgctgggattcgc

SEQ ID NO: 216425 - DNA, 25 bp, Artificial Sequence
  Description of Artificial Sequence: Synthetic oligonucleotide
gctgttcgtgctgctgggattcgcg

SEQ ID NO: 216426 - DNA, 26 bp, Artificial Sequence
  Description of Artificial Sequence: Synthetic oligonucleotide
ctgttcgtgctgctgggattcgcgct

SEQ ID NO: 216427 - DNA, 26 bp, Artificial Sequence
  Description of Artificial Sequence: Synthetic oligonucleotide
tgttcgtgctgctgggattcgcgctg

SEQ ID NO: 216428 - DNA, 25 bp, Artificial Sequence
  Description of Artificial Sequence: Synthetic oligonucleotide
gttcgtgctgctgggattcgcgctg

SEQ ID NO: 216429 - DNA, 26 bp, Artificial Sequence
  Description of Artificial Sequence: Synthetic oligonucleotide
ttcgtgctgctgggattcgcgctgct

SEQ ID NO: 216430 - DNA, 25 bp, Artificial Sequence
  Description of Artificial Sequence: Synthetic oligonucleotide
tcgtgctgctgggattcgcgctgct

SEQ ID NO: 216431 - DNA, 24 bp, Artificial Sequence
  Description of Artificial Sequence: Synthetic oligonucleotide
cgtgctgctgggattcgcgctgct

SEQ ID NO: 216432 - DNA, 24 bp, Artificial Sequence
  Description of Artificial Sequence: Synthetic oligonucleotide
gtgctgctgggattcgcgctgctg

SEQ ID NO: 216433 - DNA, 24 bp, Artificial Sequence
  Description of Artificial Sequence: Synthetic oligonucleotide
tgctgctgggattcgcgctgctgg

SEQ ID NO: 216434 - DNA, 23 bp, Artificial Sequence
  Description of Artificial Sequence: Synthetic oligonucleotide
gctgctgggattcgcgctgctgg

SEQ ID NO: 216435 - DNA, 23 bp, Artificial Sequence
  Description of Artificial Sequence: Synthetic oligonucleotide
ctgctgggattcgcgctgctggg

SEQ ID NO: 216436 - DNA, 24 bp, Artificial Sequence
  Description of Artificial Sequence: Synthetic oligonucleotide
tgctgggattcgcgctgctgggca

SEQ ID NO: 216437 - DNA, 23 bp, Artificial Sequence
  Description of Artificial Sequence: Synthetic oligonucleotide
gctgggattcgcgctgctgggca

SEQ ID NO: 216438 - DNA, 23 bp, Artificial Sequence
  Description of Artificial Sequence: Synthetic oligonucleotide
ctgggattcgcgctgctgggcac

SEQ ID NO: 216439 - DNA, 23 bp, Artificial Sequence
  Description of Artificial Sequence: Synthetic oligonucleotide
tgggattcgcgctgctgggcacc

SEQ ID NO: 216440 - DNA, 22 bp, Artificial Sequence
  Description of Artificial Sequence: Synthetic oligonucleotide
gggattcgcgctgctgggcacc

SEQ ID NO: 216441 - DNA, 23 bp, Artificial Sequence
  Description of Artificial Sequence: Synthetic oligonucleotide
ggattcgcgctgctgggcaccca

SEQ ID NO: 216442 - DNA, 23 bp, Artificial Sequence
  Description of Artificial Sequence: Synthetic oligonucleotide
gattcgcgctgctgggcacccac

SEQ ID NO: 216443 - DNA, 23 bp, Artificial Sequence
  Description of Artificial Sequence: Synthetic oligonucleotide
attcgcgctgctgggcacccacg

SEQ ID NO: 216444 - DNA, 22 bp, Artificial Sequence
  Description of Artificial Sequence: Synthetic oligonucleotide
ttcgcgctgctgggcacccacg

SEQ ID NO: 216445 - DNA, 21 bp, Artificial Sequence
  Description of Artificial Sequence: Synthetic oligonucleotide
tcgcgctgctgggcacccacg

SEQ ID NO: 216446 - DNA, 20 bp, Artificial Sequence
  Description of Artificial Sequence: Synthetic oligonucleotide
cgcgctgctgggcacccacg

SEQ ID NO: 216447 - DNA, 21 bp, Artificial Sequence
  Description of Artificial Sequence: Synthetic oligonucleotide
gcgctgctgggcacccacgga

SEQ ID NO: 216448 - DNA, 21 bp, Artificial Sequence
  Description of Artificial Sequence: Synthetic oligonucleotide
cgctgctgggcacccacggag

SEQ ID NO: 216449 - DNA, 21 bp, Artificial Sequence
  Description of Artificial Sequence: Synthetic oligonucleotide
gctgctgggcacccacggagc

SEQ ID NO: 216450 - DNA, 22 bp, Artificial Sequence
  Description of Artificial Sequence: Synthetic oligonucleotide
ctgctgggcacccacggagcct

SEQ ID NO: 216451 - DNA, 22 bp, Artificial Sequence
  Description of Artificial Sequence: Synthetic oligonucleotide
tgctgggcacccacggagcctc

SEQ ID NO: 216452 - DNA, 21 bp, Artificial Sequence
  Description of Artificial Sequence: Synthetic oligonucleotide
gctgggcacccacggagcctc

SEQ ID NO: 216453 - DNA, 21 bp, Artificial Sequence
  Description of Artificial Sequence: Synthetic oligonucleotide
ctgggcacccacggagcctcc

SEQ ID NO: 216454 - DNA, 21 bp, Artificial Sequence
  Description of Artificial Sequence: Synthetic oligonucleotide
tgggcacccacggagcctccg

SEQ ID NO: 216455 - DNA, 20 bp, Artificial Sequence
  Description of Artificial Sequence: Synthetic oligonucleotide
gggcacccacggagcctccg

SEQ ID NO: 216456 - DNA, 20 bp, Artificial Sequence
  Description of Artificial Sequence: Synthetic oligonucleotide
ggcacccacggagcctccgg

SEQ ID NO: 216457 - DNA, 20 bp, Artificial Sequence
  Description of Artificial Sequence: Synthetic oligonucleotide
gcacccacggagcctccggg

SEQ ID NO: 216458 - DNA, 20 bp, Artificial Sequence
  Description of Artificial Sequence: Synthetic oligonucleotide
cacccacggagcctccgggg

SEQ ID NO: 216459 - DNA, 21 bp, Artificial Sequence
  Description of Artificial Sequence: Synthetic oligonucleotide
acccacggagcctccggggct

SEQ ID NO: 216460 - DNA, 20 bp, Artificial Sequence
  Description of Artificial Sequence: Synthetic oligonucleotide
cccacggagcctccggggct

SEQ ID NO: 216461 - DNA, 20 bp, Artificial Sequence
  Description of Artificial Sequence: Synthetic oligonucleotide
ccacggagcctccggggctg

SEQ ID NO: 216462 - DNA, 20 bp, Artificial Sequence
  Description of Artificial Sequence: Synthetic oligonucleotide
cacggagcctccggggctgc

SEQ ID NO: 216463 - DNA, 20 bp, Artificial Sequence
  Description of Artificial Sequence: Synthetic oligonucleotide
acggagcctccggggctgcc

SEQ ID NO: 216464 - DNA, 20 bp, Artificial Sequence
  Description of Artificial Sequence: Synthetic oligonucleotide
cggagcctccggggctgcct

SEQ ID NO: 216465 - DNA, 20 bp, Artificial Sequence
  Description of Artificial Sequence: Synthetic oligonucleotide
ggagcctccggggctgccgt

SEQ ID NO: 216466 - DNA, 20 bp, Artificial Sequence
  Description of Artificial Sequence: Synthetic oligonucleotide
gagcctccggggctgccggt

SEQ ID NO: 216467 - DNA, 21 bp, Artificial Sequence
  Description of Artificial Sequence: Synthetic oligonucleotide
agcctccggggctgccggctt

SEQ ID NO: 216468 - DNA, 20 bp, Artificial Sequence
  Description of Artificial Sequence: Synthetic oligonucleotide
gcctccggggctgccggctt

SEQ ID NO: 216469 - DNA, 20 bp, Artificial Sequence
  Description of Artificial Sequence: Synthetic oligonucleotide
cctccggggctgccggcttc

SEQ ID NO: 216470 - DNA, 21 bp, Artificial Sequence
  Description of Artificial Sequence: Synthetic oligonucleotide
ctccggggctgccggcttcgt

SEQ ID NO: 216471 - DNA, 21 bp, Artificial Sequence
  Description of Artificial Sequence: Synthetic oligonucleotide
tccggggctgccggcttcgtc

SEQ ID NO: 216472 - DNA, 20 bp, Artificial Sequence
  Description of Artificial Sequence: Synthetic oligonucleotide
ccggggctgccggcttcgtc

SEQ ID NO: 216473 - DNA, 21 bp, Artificial Sequence
  Description of Artificial Sequence: Synthetic oligonucleotide
cggggctgccggcttcgtcca

SEQ ID NO: 216474 - DNA, 21 bp, Artificial Sequence
  Description of Artificial Sequence: Synthetic oligonucleotide
ggggctgccggcttcgtccag

SEQ ID NO: 216475 - DNA, 21 bp, Artificial Sequence
  Description of Artificial Sequence: Synthetic oligonucleotide
gggctgccggcttcgtccagg

SEQ ID NO: 216476 - DNA, 21 bp, Artificial Sequence
  Description of Artificial Sequence: Synthetic oligonucleotide
ggctgccggcttcgtccaggc

SEQ ID NO: 216477 - DNA, 21 bp, Artificial Sequence
  Description of Artificial Sequence: Synthetic oligonucleotide
gctgccggcttcgtccaggcg

SEQ ID NO: 216478 - DNA, 21 bp, Artificial Sequence
  Description of Artificial Sequence: Synthetic oligonucleotide
ctgccggcttcgtccaggcgc

SEQ ID NO: 216479 - DNA, 21 bp, Artificial Sequence
  Description of Artificial Sequence: Synthetic oligonucleotide
tgccggcttcgtccaggcgcc

SEQ ID NO: 216480 - DNA, 20 bp, Artificial Sequence
  Description of Artificial Sequence: Synthetic oligonucleotide
gccggcttcgtccaggcgcc

SEQ ID NO: 216481 - DNA, 20 bp, Artificial Sequence
  Description of Artificial Sequence: Synthetic oligonucleotide
ccggcttcgtccaggcgccg

SEQ ID NO: 216482 - DNA, 21 bp, Artificial Sequence
  Description of Artificial Sequence: Synthetic oligonucleotide
cggcttcgtccaggcgccgct

SEQ ID NO: 216483 - DNA, 22 bp, Artificial Sequence
  Description of Artificial Sequence: Synthetic oligonucleotide
ggcttcgtccaggcgccgctgt

SEQ ID NO: 216484 - DNA, 22 bp, Artificial Sequence
  Description of Artificial Sequence: Synthetic oligonucleotide
gcttcgtccaggcgccgctgtc

SEQ ID NO: 216485 - DNA, 22 bp, Artificial Sequence
  Description of Artificial Sequence: Synthetic oligonucleotide
cttcgtccaggcgccgctgtcc

SEQ ID NO: 216486 - DNA, 23 bp, Artificial Sequence
  Description of Artificial Sequence: Synthetic oligonucleotide
ttcgtccaggcgccgctgtccca

SEQ ID NO: 216487 - DNA, 22 bp, Artificial Sequence
  Description of Artificial Sequence: Synthetic oligonucleotide
tcgtccaggcgccgctgtccca

SEQ ID NO: 216488 - DNA, 21 bp, Artificial Sequence
  Description of Artificial Sequence: Synthetic oligonucleotide
cgtccaggcgccgctgtccca

SEQ ID NO: 216489 - DNA, 21 bp, Artificial Sequence
  Description of Artificial Sequence: Synthetic oligonucleotide
gtccaggcgccgctgtcccag

SEQ ID NO: 216490 - DNA, 22 bp, Artificial Sequence
  Description of Artificial Sequence: Synthetic oligonucleotide
tccaggcgccgctgtcccagca

SEQ ID NO: 216491 - DNA, 21 bp, Artificial Sequence
  Description of Artificial Sequence: Synthetic oligonucleotide
ccaggcgccgctgtcccagca

SEQ ID NO: 216492 - DNA, 22 bp, Artificial Sequence
  Description of Artificial Sequence: Synthetic oligonucleotide
caggcgccgctgtcccagcaga

SEQ ID NO: 216493 - DNA, 22 bp, Artificial Sequence
  Description of Artificial Sequence: Synthetic oligonucleotide
aggcgccgctgtcccagcagag

SEQ ID NO: 216494 - DNA, 21 bp, Artificial Sequence
  Description of Artificial Sequence: Synthetic oligonucleotide
ggcgccgctgtcccagcagag

SEQ ID NO: 216495 - DNA, 22 bp, Artificial Sequence
  Description of Artificial Sequence: Synthetic oligonucleotide
gcgccgctgtcccagcagaggt

SEQ ID NO: 216496 - DNA, 22 bp, Artificial Sequence
  Description of Artificial Sequence: Synthetic oligonucleotide
cgccgctgtcccagcagaggtg

SEQ ID NO: 216497 - DNA, 22 bp, Artificial Sequence
  Description of Artificial Sequence: Synthetic oligonucleotide
gccgctgtcccagcagaggtgg

SEQ ID NO: 216498 - DNA, 23 bp, Artificial Sequence
  Description of Artificial Sequence: Synthetic oligonucleotide
ccgctgtcccagcagaggtgggt

SEQ ID NO: 216499 - DNA, 23 bp, Artificial Sequence
  Description of Artificial Sequence: Synthetic oligonucleotide
cgctgtcccagcagaggtgggtg

SEQ ID NO: 216500 - DNA, 23 bp, Artificial Sequence
  Description of Artificial Sequence: Synthetic oligonucleotide
gctgtcccagcagaggtgggtgg

SEQ ID NO: 216501 - DNA, 23 bp, Artificial Sequence
  Description of Artificial Sequence: Synthetic oligonucleotide
ctgtcccagcagaggtgggtggg

SEQ ID NO: 216502 - DNA, 23 bp, Artificial Sequence
  Description of Artificial Sequence: Synthetic oligonucleotide
tgtcccagcagaggtgggtgggg

SEQ ID NO: 216503 - DNA, 22 bp, Artificial Sequence
  Description of Artificial Sequence: Synthetic oligonucleotide
gtcccagcagaggtgggtgggg

SEQ ID NO: 216504 - DNA, 22 bp, Artificial Sequence
  Description of Artificial Sequence: Synthetic oligonucleotide
tcccagcagaggtgggtggggg

SEQ ID NO: 216505 - DNA, 21 bp, Artificial Sequence
  Description of Artificial Sequence: Synthetic oligonucleotide
cccagcagaggtgggtggggg

SEQ ID NO: 216506 - DNA, 21 bp, Artificial Sequence
  Description of Artificial Sequence: Synthetic oligonucleotide
ccagcagaggtgggtgggggg

SEQ ID NO: 216507 - DNA, 22 bp, Artificial Sequence
  Description of Artificial Sequence: Synthetic oligonucleotide
cagcagaggtgggtggggggca

SEQ ID NO: 216508 - DNA, 23 bp, Artificial Sequence
  Description of Artificial Sequence: Synthetic oligonucleotide
agcagaggtgggtggggggcagt

SEQ ID NO: 216509 - DNA, 22 bp, Artificial Sequence
  Description of Artificial Sequence: Synthetic oligonucleotide
gcagaggtgggtggggggcagt

SEQ ID NO: 216510 - DNA, 23 bp, Artificial Sequence
  Description of Artificial Sequence: Synthetic oligonucleotide
cagaggtgggtggggggcagtgt

SEQ ID NO: 216511 - DNA, 23 bp, Artificial Sequence
  Description of Artificial Sequence: Synthetic oligonucleotide
agaggtgggtggggggcagtgtg

SEQ ID NO: 216512 - DNA, 22 bp, Artificial Sequence
  Description of Artificial Sequence: Synthetic oligonucleotide
gaggtgggtggggggcagtgtg

SEQ ID NO: 216513 - DNA, 23 bp, Artificial Sequence
  Description of Artificial Sequence: Synthetic oligonucleotide
aggtgggtggggggcagtgtgga

SEQ ID NO: 216514 - DNA, 22 bp, Artificial Sequence
  Description of Artificial Sequence: Synthetic oligonucleotide
ggtgggtggggggcagtgtgga

SEQ ID NO: 216515 - DNA, 22 bp, Artificial Sequence
  Description of Artificial Sequence: Synthetic oligonucleotide
gtgggtggggggcagtgtggag

SEQ ID NO: 216516 - DNA, 23 bp, Artificial Sequence
  Description of Artificial Sequence: Synthetic oligonucleotide
tgggtggggggcagtgtggagct

SEQ ID NO: 216517 - DNA, 22 bp, Artificial Sequence
  Description of Artificial Sequence: Synthetic oligonucleotide
gggtggggggcagtgtggagct

SEQ ID NO: 216518 - DNA, 22 bp, Artificial Sequence
  Description of Artificial Sequence: Synthetic oligonucleotide
ggtggggggcagtgtggagctg

SEQ ID NO: 216519 - DNA, 23 bp, Artificial Sequence
  Description of Artificial Sequence: Synthetic oligonucleotide
gtggggggcagtgtggagctgca

SEQ ID NO: 216520 - DNA, 24 bp, Artificial Sequence
  Description of Artificial Sequence: Synthetic oligonucleotide
tggggggcagtgtggagctgcact

SEQ ID NO: 216521 - DNA, 23 bp, Artificial Sequence
  Description of Artificial Sequence: Synthetic oligonucleotide
ggggggcagtgtggagctgcact

SEQ ID NO: 216522 - DNA, 23 bp, Artificial Sequence
  Description of Artificial Sequence: Synthetic oligonucleotide
gggggcagtgtggagctgcactg

SEQ ID NO: 216523 - DNA, 23 bp, Artificial Sequence
  Description of Artificial Sequence: Synthetic oligonucleotide
ggggcagtgtggagctgcactgc

SEQ ID NO: 216524 - DNA, 24 bp, Artificial Sequence
  Description of Artificial Sequence: Synthetic oligonucleotide
gggcagtgtggagctgcactgcga

SEQ ID NO: 216525 - DNA, 24 bp, Artificial Sequence
  Description of Artificial Sequence: Synthetic oligonucleotide
ggcagtgtggagctgcactgcgag

SEQ ID NO: 216526 - DNA, 24 bp, Artificial Sequence
  Description of Artificial Sequence: Synthetic oligonucleotide
gcagtgtggagctgcactgcgagg

SEQ ID NO: 216527 - DNA, 24 bp, Artificial Sequence
  Description of Artificial Sequence: Synthetic oligonucleotide
cagtgtggagctgcactgcgaggc

SEQ ID NO: 216528 - DNA, 24 bp, Artificial Sequence
  Description of Artificial Sequence: Synthetic oligonucleotide
agtgtggagctgcactgcgaggcc

SEQ ID NO: 216529 - DNA, 23 bp, Artificial Sequence
  Description of Artificial Sequence: Synthetic oligonucleotide
gtgtggagctgcactgcgaggcc

SEQ ID NO: 216530 - DNA, 24 bp, Artificial Sequence
  Description of Artificial Sequence: Synthetic oligonucleotide
tgtggagctgcactgcgaggccgt

SEQ ID NO: 216531 - DNA, 23 bp, Artificial Sequence
  Description of Artificial Sequence: Synthetic oligonucleotide
gtggagctgcactgcgaggccgt

SEQ ID NO: 216532 - DNA, 23 bp, Artificial Sequence
  Description of Artificial Sequence: Synthetic oligonucleotide
tggagctgcactgcgaggccgtg

SEQ ID NO: 216533 - DNA, 22 bp, Artificial Sequence
  Description of Artificial Sequence: Synthetic oligonucleotide
ggagctgcactgcgaggccgtg

SEQ ID NO: 216534 - DNA, 22 bp, Artificial Sequence
  Description of Artificial Sequence: Synthetic oligonucleotide
gagctgcactgcgaggccgtgg

SEQ ID NO: 216535 - DNA, 22 bp, Artificial Sequence
  Description of Artificial Sequence: Synthetic oligonucleotide
agctgcactgcgaggccgtggg

SEQ ID NO: 216536 - DNA, 21 bp, Artificial Sequence
  Description of Artificial Sequence: Synthetic oligonucleotide
gctgcactgcgaggccgtggg

SEQ ID NO: 216537 - DNA, 22 bp, Artificial Sequence
  Description of Artificial Sequence: Synthetic oligonucleotide
ctgcactgcgaggccgtgggca

SEQ ID NO: 216538 - DNA, 22 bp, Artificial Sequence
  Description of Artificial Sequence: Synthetic oligonucleotide
tgcactgcgaggccgtgggcag

SEQ ID NO: 216539 - DNA, 21 bp, Artificial Sequence
  Description of Artificial Sequence: Synthetic oligonucleotide
gcactgcgaggccgtgggcag

SEQ ID NO: 216540 - DNA, 21 bp, Artificial Sequence
  Description of Artificial Sequence: Synthetic oligonucleotide
cactgcgaggccgtgggcagc

SEQ ID NO: 216541 - DNA, 21 bp, Artificial Sequence
  Description of Artificial Sequence: Synthetic oligonucleotide
actgcgaggccgtgggcagcc

SEQ ID NO: 216542 - DNA, 20 bp, Artificial Sequence
  Description of Artificial Sequence: Synthetic oligonucleotide
ctgcgaggccgtgggcagcc

SEQ ID NO: 216543 - DNA, 20 bp, Artificial Sequence
  Description of Artificial Sequence: Synthetic oligonucleotide
tgcgaggccgtgggcagccc

SEQ ID NO: 216544 - DNA, 20 bp, Artificial Sequence
  Description of Artificial Sequence: Synthetic oligonucleotide
gcgaggccgtgggcagccct

SEQ ID NO: 216545 - DNA, 20 bp, Artificial Sequence
  Description of Artificial Sequence: Synthetic oligonucleotide
cgaggccgtgggcagcccgt

SEQ ID NO: 216546 - DNA, 20 bp, Artificial Sequence
  Description of Artificial Sequence: Synthetic oligonucleotide
gaggccgtgggcagcccggt

SEQ ID NO: 216547 - DNA, 20 bp, Artificial Sequence
  Description of Artificial Sequence: Synthetic oligonucleotide
aggccgtgggcagcccggtg

SEQ ID NO: 216548 - DNA, 20 bp, Artificial Sequence
  Description of Artificial Sequence: Synthetic oligonucleotide
ggccgtgggcagcccggtgt

SEQ ID NO: 216549 - DNA, 20 bp, Artificial Sequence
  Description of Artificial Sequence: Synthetic oligonucleotide
gccgtgggcagcccggtgct

SEQ ID NO: 216550 - DNA, 20 bp, Artificial Sequence
  Description of Artificial Sequence: Synthetic oligonucleotide
ccgtgggcagcccggtgcct

SEQ ID NO: 216551 - DNA, 20 bp, Artificial Sequence
  Description of Artificial Sequence: Synthetic oligonucleotide
cgtgggcagcccggtgccct

SEQ ID NO: 216552 - DNA, 20 bp, Artificial Sequence
  Description of Artificial Sequence: Synthetic oligonucleotide
gtgggcagcccggtgcccga

SEQ ID NO: 216553 - DNA, 22 bp, Artificial Sequence
  Description of Artificial Sequence: Synthetic oligonucleotide
tgggcagcccggtgcccgagat

SEQ ID NO: 216554 - DNA, 21 bp, Artificial Sequence
  Description of Artificial Sequence: Synthetic oligonucleotide
gggcagcccggtgcccgagat

SEQ ID NO: 216555 - DNA, 21 bp, Artificial Sequence
  Description of Artificial Sequence: Synthetic oligonucleotide
ggcagcccggtgcccgagatc

SEQ ID NO: 216556 - DNA, 22 bp, Artificial Sequence
  Description of Artificial Sequence: Synthetic oligonucleotide
gcagcccggtgcccgagatcca

SEQ ID NO: 216557 - DNA, 23 bp, Artificial Sequence
  Description of Artificial Sequence: Synthetic oligonucleotide
cagcccggtgcccgagatccagt

SEQ ID NO: 216558 - DNA, 23 bp, Artificial Sequence
  Description of Artificial Sequence: Synthetic oligonucleotide
agcccggtgcccgagatccagtg

SEQ ID NO: 216559 - DNA, 22 bp, Artificial Sequence
  Description of Artificial Sequence: Synthetic oligonucleotide
gcccggtgcccgagatccagtg

SEQ ID NO: 216560 - DNA, 23 bp, Artificial Sequence
  Description of Artificial Sequence: Synthetic oligonucleotide
cccggtgcccgagatccagtggt

SEQ ID NO: 216561 - DNA, 23 bp, Artificial Sequence
  Description of Artificial Sequence: Synthetic oligonucleotide
ccggtgcccgagatccagtggtg

SEQ ID NO: 216562 - DNA, 26 bp, Artificial Sequence
  Description of Artificial Sequence: Synthetic oligonucleotide
cggtgcccgagatccagtggtggttt

SEQ ID NO: 216563 - DNA, 27 bp, Artificial Sequence
  Description of Artificial Sequence: Synthetic oligonucleotide
ggtgcccgagatccagtggtggtttga

SEQ ID NO: 216564 - DNA, 28 bp, Artificial Sequence
  Description of Artificial Sequence: Synthetic oligonucleotide
gtgcccgagatccagtggtggtttgaag

SEQ ID NO: 216565 - DNA, 28 bp, Artificial Sequence
  Description of Artificial Sequence: Synthetic oligonucleotide
tgcccgagatccagtggtggtttgaagg

SEQ ID NO: 216566 - DNA, 27 bp, Artificial Sequence
  Description of Artificial Sequence: Synthetic oligonucleotide
gcccgagatccagtggtggtttgaagg

SEQ ID NO: 216567 - DNA, 27 bp, Artificial Sequence
  Description of Artificial Sequence: Synthetic oligonucleotide
cccgagatccagtggtggtttgaaggg

SEQ ID NO: 216568 - DNA, 27 bp, Artificial Sequence
  Description of Artificial Sequence: Synthetic oligonucleotide
ccgagatccagtggtggtttgaagggc

SEQ ID NO: 216569 - DNA, 28 bp, Artificial Sequence
  Description of Artificial Sequence: Synthetic oligonucleotide
cgagatccagtggtggtttgaagggcag

SEQ ID NO: 216570 - DNA, 28 bp, Artificial Sequence
  Description of Artificial Sequence: Synthetic oligonucleotide
gagatccagtggtggtttgaagggcagg

SEQ ID NO: 216571 - DNA, 28 bp, Artificial Sequence
  Description of Artificial Sequence: Synthetic oligonucleotide
agatccagtggtggtttgaagggcaggg

SEQ ID NO: 216572 - DNA, 27 bp, Artificial Sequence
  Description of Artificial Sequence: Synthetic oligonucleotide
gatccagtggtggtttgaagggcaggg

SEQ ID NO: 216573 - DNA, 28 bp, Artificial Sequence
  Description of Artificial Sequence: Synthetic oligonucleotide
atccagtggtggtttgaagggcagggtc

SEQ ID NO: 216574 - DNA, 27 bp, Artificial Sequence
  Description of Artificial Sequence: Synthetic oligonucleotide
tccagtggtggtttgaagggcagggtc

SEQ ID NO: 216575 - DNA, 26 bp, Artificial Sequence
  Description of Artificial Sequence: Synthetic oligonucleotide
ccagtggtggtttgaagggcagggtc

SEQ ID NO: 216576 - DNA, 26 bp, Artificial Sequence
  Description of Artificial Sequence: Synthetic oligonucleotide
cagtggtggtttgaagggcagggtcc

SEQ ID NO: 216577 - DNA, 27 bp, Artificial Sequence
  Description of Artificial Sequence: Synthetic oligonucleotide
agtggtggtttgaagggcagggtccca

SEQ ID NO: 216578 - DNA, 27 bp, Artificial Sequence
  Description of Artificial Sequence: Synthetic oligonucleotide
gtggtggtttgaagggcagggtcccaa

SEQ ID NO: 216579 - DNA, 27 bp, Artificial Sequence
  Description of Artificial Sequence: Synthetic oligonucleotide
tggtggtttgaagggcagggtcccaac

SEQ ID NO: 216580 - DNA, 26 bp, Artificial Sequence
  Description of Artificial Sequence: Synthetic oligonucleotide
ggtggtttgaagggcagggtcccaac

SEQ ID NO: 216581 - DNA, 27 bp, Artificial Sequence
  Description of Artificial Sequence: Synthetic oligonucleotide
gtggtttgaagggcagggtcccaacga

SEQ ID NO: 216582 - DNA, 27 bp, Artificial Sequence
  Description of Artificial Sequence: Synthetic oligonucleotide
tggtttgaagggcagggtcccaacgac

SEQ ID NO: 216583 - DNA, 27 bp, Artificial Sequence
  Description of Artificial Sequence: Synthetic oligonucleotide
ggtttgaagggcagggtcccaacgaca

SEQ ID NO: 216584 - DNA, 27 bp, Artificial Sequence
  Description of Artificial Sequence: Synthetic oligonucleotide
gtttgaagggcagggtcccaacgacac

SEQ ID NO: 216585 - DNA, 27 bp, Artificial Sequence
  Description of Artificial Sequence: Synthetic oligonucleotide
tttgaagggcagggtcccaacgacacc

SEQ ID NO: 216586 - DNA, 27 bp, Artificial Sequence
  Description of Artificial Sequence: Synthetic oligonucleotide
ttgaagggcagggtcccaacgacacct

SEQ ID NO: 216587 - DNA, 26 bp, Artificial Sequence
  Description of Artificial Sequence: Synthetic oligonucleotide
tgaagggcagggtcccaacgacacct

SEQ ID NO: 216588 - DNA, 25 bp, Artificial Sequence
  Description of Artificial Sequence: Synthetic oligonucleotide
gaagggcagggtcccaacgacacct

SEQ ID NO: 216589 - DNA, 25 bp, Artificial Sequence
  Description of Artificial Sequence: Synthetic oligonucleotide
aagggcagggtcccaacgacacctg

SEQ ID NO: 216590 - DNA, 24 bp, Artificial Sequence
  Description of Artificial Sequence: Synthetic oligonucleotide
agggcagggtcccaacgacacctg

SEQ ID NO: 216591 - DNA, 23 bp, Artificial Sequence
  Description of Artificial Sequence: Synthetic oligonucleotide
gggcagggtcccaacgacacctg

SEQ ID NO: 216592 - DNA, 24 bp, Artificial Sequence
  Description of Artificial Sequence: Synthetic oligonucleotide
ggcagggtcccaacgacacctgct

SEQ ID NO: 216593 - DNA, 24 bp, Artificial Sequence
  Description of Artificial Sequence: Synthetic oligonucleotide
gcagggtcccaacgacacctgctc

SEQ ID NO: 216594 - DNA, 24 bp, Artificial Sequence
  Description of Artificial Sequence: Synthetic oligonucleotide
cagggtcccaacgacacctgctcc

SEQ ID NO: 216595 - DNA, 25 bp, Artificial Sequence
  Description of Artificial Sequence: Synthetic oligonucleotide
agggtcccaacgacacctgctccca

SEQ ID NO: 216596 - DNA, 24 bp, Artificial Sequence
  Description of Artificial Sequence: Synthetic oligonucleotide
gggtcccaacgacacctgctccca

SEQ ID NO: 216597 - DNA, 24 bp, Artificial Sequence
  Description of Artificial Sequence: Synthetic oligonucleotide
ggtcccaacgacacctgctcccag

SEQ ID NO: 216598 - DNA, 25 bp, Artificial Sequence
  Description of Artificial Sequence: Synthetic oligonucleotide
gtcccaacgacacctgctcccagct

SEQ ID NO: 216599 - DNA, 26 bp, Artificial Sequence
  Description of Artificial Sequence: Synthetic oligonucleotide
tcccaacgacacctgctcccagctct

SEQ ID NO: 216600 - DNA, 25 bp, Artificial Sequence
  Description of Artificial Sequence: Synthetic oligonucleotide
cccaacgacacctgctcccagctct

SEQ ID NO: 216601 - DNA, 25 bp, Artificial Sequence
  Description of Artificial Sequence: Synthetic oligonucleotide
ccaacgacacctgctcccagctctg

SEQ ID NO: 216602 - DNA, 25 bp, Artificial Sequence
  Description of Artificial Sequence: Synthetic oligonucleotide
caacgacacctgctcccagctctgg

SEQ ID NO: 216603 - DNA, 26 bp, Artificial Sequence
  Description of Artificial Sequence: Synthetic oligonucleotide
aacgacacctgctcccagctctggga

SEQ ID NO: 216604 - DNA, 25 bp, Artificial Sequence
  Description of Artificial Sequence: Synthetic oligonucleotide
acgacacctgctcccagctctggga

SEQ ID NO: 216605 - DNA, 24 bp, Artificial Sequence
  Description of Artificial Sequence: Synthetic oligonucleotide
cgacacctgctcccagctctggga

SEQ ID NO: 216606 - DNA, 24 bp, Artificial Sequence
  Description of Artificial Sequence: Synthetic oligonucleotide
gacacctgctcccagctctgggac

SEQ ID NO: 216607 - DNA, 24 bp, Artificial Sequence
  Description of Artificial Sequence: Synthetic oligonucleotide
acacctgctcccagctctgggacg

SEQ ID NO: 216608 - DNA, 23 bp, Artificial Sequence
  Description of Artificial Sequence: Synthetic oligonucleotide
cacctgctcccagctctgggacg

SEQ ID NO: 216609 - DNA, 23 bp, Artificial Sequence
  Description of Artificial Sequence: Synthetic oligonucleotide
acctgctcccagctctgggacgg

SEQ ID NO: 216610 - DNA, 22 bp, Artificial Sequence
  Description of Artificial Sequence: Synthetic oligonucleotide
cctgctcccagctctgggacgg

SEQ ID NO: 216611 - DNA, 22 bp, Artificial Sequence
  Description of Artificial Sequence: Synthetic oligonucleotide
ctgctcccagctctgggacggc

SEQ ID NO: 216612 - DNA, 22 bp, Artificial Sequence
  Description of Artificial Sequence: Synthetic oligonucleotide
tgctcccagctctgggacggcg

SEQ ID NO: 216613 - DNA, 21 bp, Artificial Sequence
  Description of Artificial Sequence: Synthetic oligonucleotide
gctcccagctctgggacggcg

SEQ ID NO: 216614 - DNA, 21 bp, Artificial Sequence
  Description of Artificial Sequence: Synthetic oligonucleotide
ctcccagctctgggacggcgc

SEQ ID NO: 216615 - DNA, 21 bp, Artificial Sequence
  Description of Artificial Sequence: Synthetic oligonucleotide
tcccagctctgggacggcgcc

SEQ ID NO: 216616 - DNA, 20 bp, Artificial Sequence
  Description of Artificial Sequence: Synthetic oligonucleotide
cccagctctgggacggcgcc

SEQ ID NO: 216617 - DNA, 20 bp, Artificial Sequence
  Description of Artificial Sequence: Synthetic oligonucleotide
ccagctctgggacggcgccc

SEQ ID NO: 216618 - DNA, 20 bp, Artificial Sequence
  Description of Artificial Sequence: Synthetic oligonucleotide
cagctctgggacggcgcccg

SEQ ID NO: 216619 - DNA, 20 bp, Artificial Sequence
  Description of Artificial Sequence: Synthetic oligonucleotide
agctctgggacggcgcccgg

SEQ ID NO: 216620 - DNA, 20 bp, Artificial Sequence
  Description of Artificial Sequence: Synthetic oligonucleotide
gctctgggacggcgcccggt

SEQ ID NO: 216621 - DNA, 20 bp, Artificial Sequence
  Description of Artificial Sequence: Synthetic oligonucleotide
ctctgggacggcgcccggct

SEQ ID NO: 216622 - DNA, 20 bp, Artificial Sequence
  Description of Artificial Sequence: Synthetic oligonucleotide
tctgggacggcgcccggctg

SEQ ID NO: 216623 - DNA, 20 bp, Artificial Sequence
  Description of Artificial Sequence: Synthetic oligonucleotide
ctgggacggcgcccggctgt

SEQ ID NO: 216624 - DNA, 20 bp, Artificial Sequence
  Description of Artificial Sequence: Synthetic oligonucleotide
tgggacggcgcccggctgga

SEQ ID NO: 216625 - DNA, 20 bp, Artificial Sequence
  Description of Artificial Sequence: Synthetic oligonucleotide
gggacggcgcccggctggat

SEQ ID NO: 216626 - DNA, 20 bp, Artificial Sequence
  Description of Artificial Sequence: Synthetic oligonucleotide
ggacggcgcccggctggact

SEQ ID NO: 216627 - DNA, 20 bp, Artificial Sequence
  Description of Artificial Sequence: Synthetic oligonucleotide
gacggcgcccggctggacct

SEQ ID NO: 216628 - DNA, 20 bp, Artificial Sequence
  Description of Artificial Sequence: Synthetic oligonucleotide
acggcgcccggctggaccgt

SEQ ID NO: 216629 - DNA, 20 bp, Artificial Sequence
  Description of Artificial Sequence: Synthetic oligonucleotide
cggcgcccggctggaccgtt

SEQ ID NO: 216630 - DNA, 20 bp, Artificial Sequence
  Description of Artificial Sequence: Synthetic oligonucleotide
ggcgcccggctggaccgctt

SEQ ID NO: 216631 - DNA, 20 bp, Artificial Sequence
  Description of Artificial Sequence: Synthetic oligonucleotide
gcgcccggctggaccgcgtt

SEQ ID NO: 216632 - DNA, 20 bp, Artificial Sequence
  Description of Artificial Sequence: Synthetic oligonucleotide
cgcccggctggaccgcgtct

SEQ ID NO: 216633 - DNA, 20 bp, Artificial Sequence
  Description of Artificial Sequence: Synthetic oligonucleotide
gcccggctggaccgcgtcca

SEQ ID NO: 216634 - DNA, 22 bp, Artificial Sequence
  Description of Artificial Sequence: Synthetic oligonucleotide
cccggctggaccgcgtccacat

SEQ ID NO: 216635 - DNA, 22 bp, Artificial Sequence
  Description of Artificial Sequence: Synthetic oligonucleotide
ccggctggaccgcgtccacatc

SEQ ID NO: 216636 - DNA, 23 bp, Artificial Sequence
  Description of Artificial Sequence: Synthetic oligonucleotide
cggctggaccgcgtccacatcca

SEQ ID NO: 216637 - DNA, 23 bp, Artificial Sequence
  Description of Artificial Sequence: Synthetic oligonucleotide
ggctggaccgcgtccacatccac

SEQ ID NO: 216638 - DNA, 23 bp, Artificial Sequence
  Description of Artificial Sequence: Synthetic oligonucleotide
gctggaccgcgtccacatccacg

SEQ ID NO: 216639 - DNA, 23 bp, Artificial Sequence
  Description of Artificial Sequence: Synthetic oligonucleotide
ctggaccgcgtccacatccacgc

SEQ ID NO: 216640 - DNA, 24 bp, Artificial Sequence
  Description of Artificial Sequence: Synthetic oligonucleotide
tggaccgcgtccacatccacgcca

SEQ ID NO: 216641 - DNA, 23 bp, Artificial Sequence
  Description of Artificial Sequence: Synthetic oligonucleotide
ggaccgcgtccacatccacgcca

SEQ ID NO: 216642 - DNA, 23 bp, Artificial Sequence
  Description of Artificial Sequence: Synthetic oligonucleotide
gaccgcgtccacatccacgccac

SEQ ID NO: 216643 - DNA, 25 bp, Artificial Sequence
  Description of Artificial Sequence: Synthetic oligonucleotide
accgcgtccacatccacgccaccta

SEQ ID NO: 216644 - DNA, 24 bp, Artificial Sequence
  Description of Artificial Sequence: Synthetic oligonucleotide
ccgcgtccacatccacgccaccta

SEQ ID NO: 216645 - DNA, 24 bp, Artificial Sequence
  Description of Artificial Sequence: Synthetic oligonucleotide
cgcgtccacatccacgccacctac

SEQ ID NO: 216646 - DNA, 25 bp, Artificial Sequence
  Description of Artificial Sequence: Synthetic oligonucleotide
gcgtccacatccacgccacctacca

SEQ ID NO: 216647 - DNA, 25 bp, Artificial Sequence
  Description of Artificial Sequence: Synthetic oligonucleotide
cgtccacatccacgccacctaccac

SEQ ID NO: 216648 - DNA, 26 bp, Artificial Sequence
  Description of Artificial Sequence: Synthetic oligonucleotide
gtccacatccacgccacctaccacca

SEQ ID NO: 216649 - DNA, 26 bp, Artificial Sequence
  Description of Artificial Sequence: Synthetic oligonucleotide
tccacatccacgccacctaccaccag

SEQ ID NO: 216650 - DNA, 25 bp, Artificial Sequence
  Description of Artificial Sequence: Synthetic oligonucleotide
ccacatccacgccacctaccaccag

SEQ ID NO: 216651 - DNA, 26 bp, Artificial Sequence
  Description of Artificial Sequence: Synthetic oligonucleotide
cacatccacgccacctaccaccagca

SEQ ID NO: 216652 - DNA, 26 bp, Artificial Sequence
  Description of Artificial Sequence: Synthetic oligonucleotide
acatccacgccacctaccaccagcac

SEQ ID NO: 216653 - DNA, 25 bp, Artificial Sequence
  Description of Artificial Sequence: Synthetic oligonucleotide
catccacgccacctaccaccagcac

SEQ ID NO: 216654 - DNA, 25 bp, Artificial Sequence
  Description of Artificial Sequence: Synthetic oligonucleotide
atccacgccacctaccaccagcacg

SEQ ID NO: 216655 - DNA, 24 bp, Artificial Sequence
  Description of Artificial Sequence: Synthetic oligonucleotide
tccacgccacctaccaccagcacg

SEQ ID NO: 216656 - DNA, 23 bp, Artificial Sequence
  Description of Artificial Sequence: Synthetic oligonucleotide
ccacgccacctaccaccagcacg

SEQ ID NO: 216657 - DNA, 23 bp, Artificial Sequence
  Description of Artificial Sequence: Synthetic oligonucleotide
cacgccacctaccaccagcacgc

SEQ ID NO: 216658 - DNA, 23 bp, Artificial Sequence
  Description of Artificial Sequence: Synthetic oligonucleotide
acgccacctaccaccagcacgcg

SEQ ID NO: 216659 - DNA, 22 bp, Artificial Sequence
  Description of Artificial Sequence: Synthetic oligonucleotide
cgccacctaccaccagcacgcg

SEQ ID NO: 216660 - DNA, 22 bp, Artificial Sequence
  Description of Artificial Sequence: Synthetic oligonucleotide
gccacctaccaccagcacgcgg

SEQ ID NO: 216661 - DNA, 22 bp, Artificial Sequence
  Description of Artificial Sequence: Synthetic oligonucleotide
ccacctaccaccagcacgcggc

SEQ ID NO: 216662 - DNA, 23 bp, Artificial Sequence
  Description of Artificial Sequence: Synthetic oligonucleotide
cacctaccaccagcacgcggcca

SEQ ID NO: 216663 - DNA, 23 bp, Artificial Sequence
  Description of Artificial Sequence: Synthetic oligonucleotide
acctaccaccagcacgcggccag

SEQ ID NO: 216664 - DNA, 22 bp, Artificial Sequence
  Description of Artificial Sequence: Synthetic oligonucleotide
cctaccaccagcacgcggccag

SEQ ID NO: 216665 - DNA, 23 bp, Artificial Sequence
  Description of Artificial Sequence: Synthetic oligonucleotide
ctaccaccagcacgcggccagca

SEQ ID NO: 216666 - DNA, 23 bp, Artificial Sequence
  Description of Artificial Sequence: Synthetic oligonucleotide
taccaccagcacgcggccagcac

SEQ ID NO: 216667 - DNA, 22 bp, Artificial Sequence
  Description of Artificial Sequence: Synthetic oligonucleotide
accaccagcacgcggccagcac

SEQ ID NO: 216668 - DNA, 21 bp, Artificial Sequence
  Description of Artificial Sequence: Synthetic oligonucleotide
ccaccagcacgcggccagcac

SEQ ID NO: 216669 - DNA, 23 bp, Artificial Sequence
  Description of Artificial Sequence: Synthetic oligonucleotide
caccagcacgcggccagcaccat

SEQ ID NO: 216670 - DNA, 24 bp, Artificial Sequence
  Description of Artificial Sequence: Synthetic oligonucleotide
accagcacgcggccagcaccatct

SEQ ID NO: 216671 - DNA, 23 bp, Artificial Sequence
  Description of Artificial Sequence: Synthetic oligonucleotide
ccagcacgcggccagcaccatct

SEQ ID NO: 216672 - DNA, 23 bp, Artificial Sequence
  Description of Artificial Sequence: Synthetic oligonucleotide
cagcacgcggccagcaccatctc

SEQ ID NO: 216673 - DNA, 25 bp, Artificial Sequence
  Description of Artificial Sequence: Synthetic oligonucleotide
agcacgcggccagcaccatctccat

SEQ ID NO: 216674 - DNA, 24 bp, Artificial Sequence
  Description of Artificial Sequence: Synthetic oligonucleotide
gcacgcggccagcaccatctccat

SEQ ID NO: 216675 - DNA, 24 bp, Artificial Sequence
  Description of Artificial Sequence: Synthetic oligonucleotide
cacgcggccagcaccatctccatc

SEQ ID NO: 216676 - DNA, 25 bp, Artificial Sequence
  Description of Artificial Sequence: Synthetic oligonucleotide
acgcggccagcaccatctccatcga

SEQ ID NO: 216677 - DNA, 24 bp, Artificial Sequence
  Description of Artificial Sequence: Synthetic oligonucleotide
cgcggccagcaccatctccatcga

SEQ ID NO: 216678 - DNA, 25 bp, Artificial Sequence
  Description of Artificial Sequence: Synthetic oligonucleotide
gcggccagcaccatctccatcgaca

SEQ ID NO: 216679 - DNA, 25 bp, Artificial Sequence
  Description of Artificial Sequence: Synthetic oligonucleotide
cggccagcaccatctccatcgacac

SEQ ID NO: 216680 - DNA, 25 bp, Artificial Sequence
  Description of Artificial Sequence: Synthetic oligonucleotide
ggccagcaccatctccatcgacacg

SEQ ID NO: 216681 - DNA, 26 bp, Artificial Sequence
  Description of Artificial Sequence: Synthetic oligonucleotide
gccagcaccatctccatcgacacgct

SEQ ID NO: 216682 - DNA, 26 bp, Artificial Sequence
  Description of Artificial Sequence: Synthetic oligonucleotide
ccagcaccatctccatcgacacgctc

SEQ ID NO: 216683 - DNA, 27 bp, Artificial Sequence
  Description of Artificial Sequence: Synthetic oligonucleotide
cagcaccatctccatcgacacgctcgt

SEQ ID NO: 216684 - DNA, 27 bp, Artificial Sequence
  Description of Artificial Sequence: Synthetic oligonucleotide
agcaccatctccatcgacacgctcgtg

SEQ ID NO: 216685 - DNA, 26 bp, Artificial Sequence
  Description of Artificial Sequence: Synthetic oligonucleotide
gcaccatctccatcgacacgctcgtg

SEQ ID NO: 216686 - DNA, 27 bp, Artificial Sequence
  Description of Artificial Sequence: Synthetic oligonucleotide
caccatctccatcgacacgctcgtgga

SEQ ID NO: 216687 - DNA, 27 bp, Artificial Sequence
  Description of Artificial Sequence: Synthetic oligonucleotide
accatctccatcgacacgctcgtggag

SEQ ID NO: 216688 - DNA, 26 bp, Artificial Sequence
  Description of Artificial Sequence: Synthetic oligonucleotide
ccatctccatcgacacgctcgtggag

SEQ ID NO: 216689 - DNA, 27 bp, Artificial Sequence
  Description of Artificial Sequence: Synthetic oligonucleotide
catctccatcgacacgctcgtggagga

SEQ ID NO: 216690 - DNA, 27 bp, Artificial Sequence
  Description of Artificial Sequence: Synthetic oligonucleotide
atctccatcgacacgctcgtggaggag

SEQ ID NO: 216691 - DNA, 26 bp, Artificial Sequence
  Description of Artificial Sequence: Synthetic oligonucleotide
tctccatcgacacgctcgtggaggag

SEQ ID NO: 216692 - DNA, 25 bp, Artificial Sequence
  Description of Artificial Sequence: Synthetic oligonucleotide
ctccatcgacacgctcgtggaggag

SEQ ID NO: 216693 - DNA, 26 bp, Artificial Sequence
  Description of Artificial Sequence: Synthetic oligonucleotide
tccatcgacacgctcgtggaggagga

SEQ ID NO: 216694 - DNA, 25 bp, Artificial Sequence
  Description of Artificial Sequence: Synthetic oligonucleotide
ccatcgacacgctcgtggaggagga

SEQ ID NO: 216695 - DNA, 26 bp, Artificial Sequence
  Description of Artificial Sequence: Synthetic oligonucleotide
catcgacacgctcgtggaggaggaca

SEQ ID NO: 216696 - DNA, 26 bp, Artificial Sequence
  Description of Artificial Sequence: Synthetic oligonucleotide
atcgacacgctcgtggaggaggacac

SEQ ID NO: 216697 - DNA, 25 bp, Artificial Sequence
  Description of Artificial Sequence: Synthetic oligonucleotide
tcgacacgctcgtggaggaggacac

SEQ ID NO: 216698 - DNA, 24 bp, Artificial Sequence
  Description of Artificial Sequence: Synthetic oligonucleotide
cgacacgctcgtggaggaggacac

SEQ ID NO: 216699 - DNA, 24 bp, Artificial Sequence
  Description of Artificial Sequence: Synthetic oligonucleotide
gacacgctcgtggaggaggacacg

SEQ ID NO: 216700 - DNA, 24 bp, Artificial Sequence
  Description of Artificial Sequence: Synthetic oligonucleotide
acacgctcgtggaggaggacacgg

SEQ ID NO: 216701 - DNA, 23 bp, Artificial Sequence
  Description of Artificial Sequence: Synthetic oligonucleotide
cacgctcgtggaggaggacacgg

SEQ ID NO: 216702 - DNA, 23 bp, Artificial Sequence
  Description of Artificial Sequence: Synthetic oligonucleotide
acgctcgtggaggaggacacggg

SEQ ID NO: 216703 - DNA, 22 bp, Artificial Sequence
  Description of Artificial Sequence: Synthetic oligonucleotide
cgctcgtggaggaggacacggg

SEQ ID NO: 216704 - DNA, 23 bp, Artificial Sequence
  Description of Artificial Sequence: Synthetic oligonucleotide
gctcgtggaggaggacacgggca

SEQ ID NO: 216705 - DNA, 26 bp, Artificial Sequence
  Description of Artificial Sequence: Synthetic oligonucleotide
ctcgtggaggaggacacgggcactta

SEQ ID NO: 216706 - DNA, 26 bp, Artificial Sequence
  Description of Artificial Sequence: Synthetic oligonucleotide
tcgtggaggaggacacgggcacttac

SEQ ID NO: 216707 - DNA, 25 bp, Artificial Sequence
  Description of Artificial Sequence: Synthetic oligonucleotide
cgtggaggaggacacgggcacttac

SEQ ID NO: 216708 - DNA, 26 bp, Artificial Sequence
  Description of Artificial Sequence: Synthetic oligonucleotide
gtggaggaggacacgggcacttacga

SEQ ID NO: 216709 - DNA, 27 bp, Artificial Sequence
  Description of Artificial Sequence: Synthetic oligonucleotide
tggaggaggacacgggcacttacgagt

SEQ ID NO: 216710 - DNA, 26 bp, Artificial Sequence
  Description of Artificial Sequence: Synthetic oligonucleotide
ggaggaggacacgggcacttacgagt

SEQ ID NO: 216711 - DNA, 26 bp, Artificial Sequence
  Description of Artificial Sequence: Synthetic oligonucleotide
gaggaggacacgggcacttacgagtg

SEQ ID NO: 216712 - DNA, 26 bp, Artificial Sequence
  Description of Artificial Sequence: Synthetic oligonucleotide
aggaggacacgggcacttacgagtgc

SEQ ID NO: 216713 - DNA, 25 bp, Artificial Sequence
  Description of Artificial Sequence: Synthetic oligonucleotide
ggaggacacgggcacttacgagtgc

SEQ ID NO: 216714 - DNA, 25 bp, Artificial Sequence
  Description of Artificial Sequence: Synthetic oligonucleotide
gaggacacgggcacttacgagtgcc

SEQ ID NO: 216715 - DNA, 25 bp, Artificial Sequence
  Description of Artificial Sequence: Synthetic oligonucleotide
aggacacgggcacttacgagtgccg

SEQ ID NO: 216716 - DNA, 24 bp, Artificial Sequence
  Description of Artificial Sequence: Synthetic oligonucleotide
ggacacgggcacttacgagtgccg

SEQ ID NO: 216717 - DNA, 24 bp, Artificial Sequence
  Description of Artificial Sequence: Synthetic oligonucleotide
gacacgggcacttacgagtgccgg

SEQ ID NO: 216718 - DNA, 24 bp, Artificial Sequence
  Description of Artificial Sequence: Synthetic oligonucleotide
acacgggcacttacgagtgccggg

SEQ ID NO: 216719 - DNA, 23 bp, Artificial Sequence
  Description of Artificial Sequence: Synthetic oligonucleotide
cacgggcacttacgagtgccggg

SEQ ID NO: 216720 - DNA, 23 bp, Artificial Sequence
  Description of Artificial Sequence: Synthetic oligonucleotide
acgggcacttacgagtgccgggc

SEQ ID NO: 216721 - DNA, 22 bp, Artificial Sequence
  Description of Artificial Sequence: Synthetic oligonucleotide
cgggcacttacgagtgccgggc

SEQ ID NO: 216722 - DNA, 23 bp, Artificial Sequence
  Description of Artificial Sequence: Synthetic oligonucleotide
gggcacttacgagtgccgggcca

SEQ ID NO: 216723 - DNA, 23 bp, Artificial Sequence
  Description of Artificial Sequence: Synthetic oligonucleotide
ggcacttacgagtgccgggccag

SEQ ID NO: 216724 - DNA, 25 bp, Artificial Sequence
  Description of Artificial Sequence: Synthetic oligonucleotide
gcacttacgagtgccgggccagcaa

SEQ ID NO: 216725 - DNA, 25 bp, Artificial Sequence
  Description of Artificial Sequence: Synthetic oligonucleotide
cacttacgagtgccgggccagcaac

SEQ ID NO: 216726 - DNA, 26 bp, Artificial Sequence
  Description of Artificial Sequence: Synthetic oligonucleotide
acttacgagtgccgggccagcaacga

SEQ ID NO: 216727 - DNA, 25 bp, Artificial Sequence
  Description of Artificial Sequence: Synthetic oligonucleotide
cttacgagtgccgggccagcaacga

SEQ ID NO: 216728 - DNA, 25 bp, Artificial Sequence
  Description of Artificial Sequence: Synthetic oligonucleotide
ttacgagtgccgggccagcaacgac

SEQ ID NO: 216729 - DNA, 24 bp, Artificial Sequence
  Description of Artificial Sequence: Synthetic oligonucleotide
tacgagtgccgggccagcaacgac

SEQ ID NO: 216730 - DNA, 23 bp, Artificial Sequence
  Description of Artificial Sequence: Synthetic oligonucleotide
acgagtgccgggccagcaacgac

SEQ ID NO: 216731 - DNA, 22 bp, Artificial Sequence
  Description of Artificial Sequence: Synthetic oligonucleotide
cgagtgccgggccagcaacgac

SEQ ID NO: 216732 - DNA, 22 bp, Artificial Sequence
  Description of Artificial Sequence: Synthetic oligonucleotide
gagtgccgggccagcaacgacc

SEQ ID NO: 216733 - DNA, 22 bp, Artificial Sequence
  Description of Artificial Sequence: Synthetic oligonucleotide
agtgccgggccagcaacgaccc

SEQ ID NO: 216734 - DNA, 21 bp, Artificial Sequence
  Description of Artificial Sequence: Synthetic oligonucleotide
gtgccgggccagcaacgaccc

SEQ ID NO: 216735 - DNA, 21 bp, Artificial Sequence
  Description of Artificial Sequence: Synthetic oligonucleotide
tgccgggccagcaacgacccg

SEQ ID NO: 216736 - DNA, 20 bp, Artificial Sequence
  Description of Artificial Sequence: Synthetic oligonucleotide
gccgggccagcaacgacccg

SEQ ID NO: 216737 - DNA, 22 bp, Artificial Sequence
  Description of Artificial Sequence: Synthetic oligonucleotide
ccgggccagcaacgacccggat

SEQ ID NO: 216738 - DNA, 22 bp, Artificial Sequence
  Description of Artificial Sequence: Synthetic oligonucleotide
cgggccagcaacgacccggatc

SEQ ID NO: 216739 - DNA, 22 bp, Artificial Sequence
  Description of Artificial Sequence: Synthetic oligonucleotide
gggccagcaacgacccggatcg

SEQ ID NO: 216740 - DNA, 24 bp, Artificial Sequence
  Description of Artificial Sequence: Synthetic oligonucleotide
ggccagcaacgacccggatcgcaa

SEQ ID NO: 216741 - DNA, 24 bp, Artificial Sequence
  Description of Artificial Sequence: Synthetic oligonucleotide
gccagcaacgacccggatcgcaac

SEQ ID NO: 216742 - DNA, 25 bp, Artificial Sequence
  Description of Artificial Sequence: Synthetic oligonucleotide
ccagcaacgacccggatcgcaacca

SEQ ID NO: 216743 - DNA, 25 bp, Artificial Sequence
  Description of Artificial Sequence: Synthetic oligonucleotide
cagcaacgacccggatcgcaaccac

SEQ ID NO: 216744 - DNA, 26 bp, Artificial Sequence
  Description of Artificial Sequence: Synthetic oligonucleotide
agcaacgacccggatcgcaaccacct

SEQ ID NO: 216745 - DNA, 25 bp, Artificial Sequence
  Description of Artificial Sequence: Synthetic oligonucleotide
gcaacgacccggatcgcaaccacct

SEQ ID NO: 216746 - DNA, 26 bp, Artificial Sequence
  Description of Artificial Sequence: Synthetic oligonucleotide
caacgacccggatcgcaaccacctga

SEQ ID NO: 216747 - DNA, 26 bp, Artificial Sequence
  Description of Artificial Sequence: Synthetic oligonucleotide
aacgacccggatcgcaaccacctgac

SEQ ID NO: 216748 - DNA, 25 bp, Artificial Sequence
  Description of Artificial Sequence: Synthetic oligonucleotide
acgacccggatcgcaaccacctgac

SEQ ID NO: 216749 - DNA, 24 bp, Artificial Sequence
  Description of Artificial Sequence: Synthetic oligonucleotide
cgacccggatcgcaaccacctgac

SEQ ID NO: 216750 - DNA, 24 bp, Artificial Sequence
  Description of Artificial Sequence: Synthetic oligonucleotide
gacccggatcgcaaccacctgacc

SEQ ID NO: 216751 - DNA, 24 bp, Artificial Sequence
  Description of Artificial Sequence: Synthetic oligonucleotide
acccggatcgcaaccacctgaccc

SEQ ID NO: 216752 - DNA, 23 bp, Artificial Sequence
  Description of Artificial Sequence: Synthetic oligonucleotide
cccggatcgcaaccacctgaccc

SEQ ID NO: 216753 - DNA, 23 bp, Artificial Sequence
  Description of Artificial Sequence: Synthetic oligonucleotide
ccggatcgcaaccacctgacccg

SEQ ID NO: 216754 - DNA, 23 bp, Artificial Sequence
  Description of Artificial Sequence: Synthetic oligonucleotide
cggatcgcaaccacctgacccgg

SEQ ID NO: 216755 - DNA, 23 bp, Artificial Sequence
  Description of Artificial Sequence: Synthetic oligonucleotide
ggatcgcaaccacctgacccggg

SEQ ID NO: 216756 - DNA, 23 bp, Artificial Sequence
  Description of Artificial Sequence: Synthetic oligonucleotide
gatcgcaaccacctgacccgggc

SEQ ID NO: 216757 - DNA, 23 bp, Artificial Sequence
  Description of Artificial Sequence: Synthetic oligonucleotide
atcgcaaccacctgacccgggcg

SEQ ID NO: 216758 - DNA, 22 bp, Artificial Sequence
  Description of Artificial Sequence: Synthetic oligonucleotide
tcgcaaccacctgacccgggcg

SEQ ID NO: 216759 - DNA, 21 bp, Artificial Sequence
  Description of Artificial Sequence: Synthetic oligonucleotide
cgcaaccacctgacccgggcg

SEQ ID NO: 216760 - DNA, 21 bp, Artificial Sequence
  Description of Artificial Sequence: Synthetic oligonucleotide
gcaaccacctgacccgggcgc

SEQ ID NO: 216761 - DNA, 21 bp, Artificial Sequence
  Description of Artificial Sequence: Synthetic oligonucleotide
caaccacctgacccgggcgcc

SEQ ID NO: 216762 - DNA, 22 bp, Artificial Sequence
  Description of Artificial Sequence: Synthetic oligonucleotide
aaccacctgacccgggcgccca

SEQ ID NO: 216763 - DNA, 21 bp, Artificial Sequence
  Description of Artificial Sequence: Synthetic oligonucleotide
accacctgacccgggcgccca

SEQ ID NO: 216764 - DNA, 20 bp, Artificial Sequence
  Description of Artificial Sequence: Synthetic oligonucleotide
ccacctgacccgggcgccca

SEQ ID NO: 216765 - DNA, 20 bp, Artificial Sequence
  Description of Artificial Sequence: Synthetic oligonucleotide
cacctgacccgggcgcccag

SEQ ID NO: 216766 - DNA, 20 bp, Artificial Sequence
  Description of Artificial Sequence: Synthetic oligonucleotide
acctgacccgggcgcccagg

SEQ ID NO: 216767 - DNA, 20 bp, Artificial Sequence
  Description of Artificial Sequence: Synthetic oligonucleotide
cctgacccgggcgcccaggt

SEQ ID NO: 216768 - DNA, 20 bp, Artificial Sequence
  Description of Artificial Sequence: Synthetic oligonucleotide
ctgacccgggcgcccagggt

SEQ ID NO: 216769 - DNA, 22 bp, Artificial Sequence
  Description of Artificial Sequence: Synthetic oligonucleotide
tgacccgggcgcccagggtcaa

SEQ ID NO: 216770 - DNA, 21 bp, Artificial Sequence
  Description of Artificial Sequence: Synthetic oligonucleotide
gacccgggcgcccagggtcaa

SEQ ID NO: 216771 - DNA, 22 bp, Artificial Sequence
  Description of Artificial Sequence: Synthetic oligonucleotide
acccgggcgcccagggtcaagt

SEQ ID NO: 216772 - DNA, 21 bp, Artificial Sequence
  Description of Artificial Sequence: Synthetic oligonucleotide
cccgggcgcccagggtcaagt

SEQ ID NO: 216773 - DNA, 21 bp, Artificial Sequence
  Description of Artificial Sequence: Synthetic oligonucleotide
ccgggcgcccagggtcaagtg

SEQ ID NO: 216774 - DNA, 21 bp, Artificial Sequence
  Description of Artificial Sequence: Synthetic oligonucleotide
cgggcgcccagggtcaagtgg

SEQ ID NO: 216775 - DNA, 22 bp, Artificial Sequence
  Description of Artificial Sequence: Synthetic oligonucleotide
gggcgcccagggtcaagtgggt

SEQ ID NO: 216776 - DNA, 22 bp, Artificial Sequence
  Description of Artificial Sequence: Synthetic oligonucleotide
ggcgcccagggtcaagtgggtc

SEQ ID NO: 216777 - DNA, 22 bp, Artificial Sequence
  Description of Artificial Sequence: Synthetic oligonucleotide
gcgcccagggtcaagtgggtcc

SEQ ID NO: 216778 - DNA, 22 bp, Artificial Sequence
  Description of Artificial Sequence: Synthetic oligonucleotide
cgcccagggtcaagtgggtccg

SEQ ID NO: 216779 - DNA, 22 bp, Artificial Sequence
  Description of Artificial Sequence: Synthetic oligonucleotide
gcccagggtcaagtgggtccgc

SEQ ID NO: 216780 - DNA, 22 bp, Artificial Sequence
  Description of Artificial Sequence: Synthetic oligonucleotide
cccagggtcaagtgggtccgcg

SEQ ID NO: 216781 - DNA, 22 bp, Artificial Sequence
  Description of Artificial Sequence: Synthetic oligonucleotide
ccagggtcaagtgggtccgcgc

SEQ ID NO: 216782 - DNA, 22 bp, Artificial Sequence
  Description of Artificial Sequence: Synthetic oligonucleotide
cagggtcaagtgggtccgcgcc

SEQ ID NO: 216783 - DNA, 23 bp, Artificial Sequence
  Description of Artificial Sequence: Synthetic oligonucleotide
agggtcaagtgggtccgcgccca

SEQ ID NO: 216784 - DNA, 22 bp, Artificial Sequence
  Description of Artificial Sequence: Synthetic oligonucleotide
gggtcaagtgggtccgcgccca

SEQ ID NO: 216785 - DNA, 22 bp, Artificial Sequence
  Description of Artificial Sequence: Synthetic oligonucleotide
ggtcaagtgggtccgcgcccag

SEQ ID NO: 216786 - DNA, 22 bp, Artificial Sequence
  Description of Artificial Sequence: Synthetic oligonucleotide
gtcaagtgggtccgcgcccagg

SEQ ID NO: 216787 - DNA, 23 bp, Artificial Sequence
  Description of Artificial Sequence: Synthetic oligonucleotide
tcaagtgggtccgcgcccaggca

SEQ ID NO: 216788 - DNA, 22 bp, Artificial Sequence
  Description of Artificial Sequence: Synthetic oligonucleotide
caagtgggtccgcgcccaggca

SEQ ID NO: 216789 - DNA, 23 bp, Artificial Sequence
  Description of Artificial Sequence: Synthetic oligonucleotide
aagtgggtccgcgcccaggcagt

SEQ ID NO: 216790 - DNA, 22 bp, Artificial Sequence
  Description of Artificial Sequence: Synthetic oligonucleotide
agtgggtccgcgcccaggcagt

SEQ ID NO: 216791 - DNA, 21 bp, Artificial Sequence
  Description of Artificial Sequence: Synthetic oligonucleotide
gtgggtccgcgcccaggcagt

SEQ ID NO: 216792 - DNA, 21 bp, Artificial Sequence
  Description of Artificial Sequence: Synthetic oligonucleotide
tgggtccgcgcccaggcagtc

SEQ ID NO: 216793 - DNA, 20 bp, Artificial Sequence
  Description of Artificial Sequence: Synthetic oligonucleotide
gggtccgcgcccaggcagtc

SEQ ID NO: 216794 - DNA, 21 bp, Artificial Sequence
  Description of Artificial Sequence: Synthetic oligonucleotide
ggtccgcgcccaggcagtcgt

SEQ ID NO: 216795 - DNA, 21 bp, Artificial Sequence
  Description of Artificial Sequence: Synthetic oligonucleotide
gtccgcgcccaggcagtcgtg

SEQ ID NO: 216796 - DNA, 23 bp, Artificial Sequence
  Description of Artificial Sequence: Synthetic oligonucleotide
tccgcgcccaggcagtcgtgcta

SEQ ID NO: 216797 - DNA, 22 bp, Artificial Sequence
  Description of Artificial Sequence: Synthetic oligonucleotide
ccgcgcccaggcagtcgtgcta

SEQ ID NO: 216798 - DNA, 23 bp, Artificial Sequence
  Description of Artificial Sequence: Synthetic oligonucleotide
cgcgcccaggcagtcgtgctagt

SEQ ID NO: 216799 - DNA, 23 bp, Artificial Sequence
  Description of Artificial Sequence: Synthetic oligonucleotide
gcgcccaggcagtcgtgctagtc

SEQ ID NO: 216800 - DNA, 24 bp, Artificial Sequence
  Description of Artificial Sequence: Synthetic oligonucleotide
cgcccaggcagtcgtgctagtcct

SEQ ID NO: 216801 - DNA, 24 bp, Artificial Sequence
  Description of Artificial Sequence: Synthetic oligonucleotide
gcccaggcagtcgtgctagtcctg

SEQ ID NO: 216802 - DNA, 26 bp, Artificial Sequence
  Description of Artificial Sequence: Synthetic oligonucleotide
cccaggcagtcgtgctagtcctggaa

SEQ ID NO: 216803 - DNA, 26 bp, Artificial Sequence
  Description of Artificial Sequence: Synthetic oligonucleotide
ccaggcagtcgtgctagtcctggaac

SEQ ID NO: 216804 - DNA, 26 bp, Artificial Sequence
  Description of Artificial Sequence: Synthetic oligonucleotide
caggcagtcgtgctagtcctggaacc

SEQ ID NO: 216805 - DNA, 26 bp, Artificial Sequence
  Description of Artificial Sequence: Synthetic oligonucleotide
aggcagtcgtgctagtcctggaaccc

SEQ ID NO: 216806 - DNA, 25 bp, Artificial Sequence
  Description of Artificial Sequence: Synthetic oligonucleotide
ggcagtcgtgctagtcctggaaccc

SEQ ID NO: 216807 - DNA, 25 bp, Artificial Sequence
  Description of Artificial Sequence: Synthetic oligonucleotide
gcagtcgtgctagtcctggaacccg

SEQ ID NO: 216808 - DNA, 25 bp, Artificial Sequence
  Description of Artificial Sequence: Synthetic oligonucleotide
cagtcgtgctagtcctggaacccgg

SEQ ID NO: 216809 - DNA, 26 bp, Artificial Sequence
  Description of Artificial Sequence: Synthetic oligonucleotide
agtcgtgctagtcctggaacccggca

SEQ ID NO: 216810 - DNA, 25 bp, Artificial Sequence
  Description of Artificial Sequence: Synthetic oligonucleotide
gtcgtgctagtcctggaacccggca

SEQ ID NO: 216811 - DNA, 26 bp, Artificial Sequence
  Description of Artificial Sequence: Synthetic oligonucleotide
tcgtgctagtcctggaacccggcaca

SEQ ID NO: 216812 - DNA, 25 bp, Artificial Sequence
  Description of Artificial Sequence: Synthetic oligonucleotide
cgtgctagtcctggaacccggcaca

SEQ ID NO: 216813 - DNA, 26 bp, Artificial Sequence
  Description of Artificial Sequence: Synthetic oligonucleotide
gtgctagtcctggaacccggcacagt

SEQ ID NO: 216814 - DNA, 27 bp, Artificial Sequence
  Description of Artificial Sequence: Synthetic oligonucleotide
tgctagtcctggaacccggcacagtct

SEQ ID NO: 216815 - DNA, 27 bp, Artificial Sequence
  Description of Artificial Sequence: Synthetic oligonucleotide
gctagtcctggaacccggcacagtctt

SEQ ID NO: 216816 - DNA, 27 bp, Artificial Sequence
  Description of Artificial Sequence: Synthetic oligonucleotide
ctagtcctggaacccggcacagtcttc

SEQ ID NO: 216817 - DNA, 28 bp, Artificial Sequence
  Description of Artificial Sequence: Synthetic oligonucleotide
tagtcctggaacccggcacagtcttcac

SEQ ID NO: 216818 - DNA, 27 bp, Artificial Sequence
  Description of Artificial Sequence: Synthetic oligonucleotide
agtcctggaacccggcacagtcttcac

SEQ ID NO: 216819 - DNA, 27 bp, Artificial Sequence
  Description of Artificial Sequence: Synthetic oligonucleotide
gtcctggaacccggcacagtcttcact

SEQ ID NO: 216820 - DNA, 28 bp, Artificial Sequence
  Description of Artificial Sequence: Synthetic oligonucleotide
tcctggaacccggcacagtcttcactac

SEQ ID NO: 216821 - DNA, 27 bp, Artificial Sequence
  Description of Artificial Sequence: Synthetic oligonucleotide
cctggaacccggcacagtcttcactac

SEQ ID NO: 216822 - DNA, 27 bp, Artificial Sequence
  Description of Artificial Sequence: Synthetic oligonucleotide
ctggaacccggcacagtcttcactacc

SEQ ID NO: 216823 - DNA, 27 bp, Artificial Sequence
  Description of Artificial Sequence: Synthetic oligonucleotide
tggaacccggcacagtcttcactaccg

SEQ ID NO: 216824 - DNA, 27 bp, Artificial Sequence
  Description of Artificial Sequence: Synthetic oligonucleotide
ggaacccggcacagtcttcactaccgt

SEQ ID NO: 216825 - DNA, 28 bp, Artificial Sequence
  Description of Artificial Sequence: Synthetic oligonucleotide
gaacccggcacagtcttcactaccgtag

SEQ ID NO: 216826 - DNA, 30 bp, Artificial Sequence
  Description of Artificial Sequence: Synthetic oligonucleotide
aacccggcacagtcttcactaccgtagaag

SEQ ID NO: 216827 - DNA, 29 bp, Artificial Sequence
  Description of Artificial Sequence: Synthetic oligonucleotide
acccggcacagtcttcactaccgtagaag

SEQ ID NO: 216828 - DNA, 28 bp, Artificial Sequence
  Description of Artificial Sequence: Synthetic oligonucleotide
cccggcacagtcttcactaccgtagaag

SEQ ID NO: 216829 - DNA, 29 bp, Artificial Sequence
  Description of Artificial Sequence: Synthetic oligonucleotide
ccggcacagtcttcactaccgtagaagac

SEQ ID NO: 216830 - DNA, 29 bp, Artificial Sequence
  Description of Artificial Sequence: Synthetic oligonucleotide
cggcacagtcttcactaccgtagaagacc

SEQ ID NO: 216831 - DNA, 31 bp, Artificial Sequence
  Description of Artificial Sequence: Synthetic oligonucleotide
ggcacagtcttcactaccgtagaagaccttg

SEQ ID NO: 216832 - DNA, 31 bp, Artificial Sequence
  Description of Artificial Sequence: Synthetic oligonucleotide
gcacagtcttcactaccgtagaagaccttgg

SEQ ID NO: 216833 - DNA, 31 bp, Artificial Sequence
  Description of Artificial Sequence: Synthetic oligonucleotide
cacagtcttcactaccgtagaagaccttggc

SEQ ID NO: 216834 - DNA, 32 bp, Artificial Sequence
  Description of Artificial Sequence: Synthetic oligonucleotide
acagtcttcactaccgtagaagaccttggctc

SEQ ID NO: 216835 - DNA, 31 bp, Artificial Sequence
  Description of Artificial Sequence: Synthetic oligonucleotide
cagtcttcactaccgtagaagaccttggctc

SEQ ID NO: 216836 - DNA, 31 bp, Artificial Sequence
  Description of Artificial Sequence: Synthetic oligonucleotide
agtcttcactaccgtagaagaccttggctcc

SEQ ID NO: 216837 - DNA, 30 bp, Artificial Sequence
  Description of Artificial Sequence: Synthetic oligonucleotide
gtcttcactaccgtagaagaccttggctcc

SEQ ID NO: 216838 - DNA, 32 bp, Artificial Sequence
  Description of Artificial Sequence: Synthetic oligonucleotide
tcttcactaccgtagaagaccttggctccaag

SEQ ID NO: 216839 - DNA, 31 bp, Artificial Sequence
  Description of Artificial Sequence: Synthetic oligonucleotide
cttcactaccgtagaagaccttggctccaag

SEQ ID NO: 216840 - DNA, 34 bp, Artificial Sequence
  Description of Artificial Sequence: Synthetic oligonucleotide
ttcactaccgtagaagaccttggctccaagatac

SEQ ID NO: 216841 - DNA, 33 bp, Artificial Sequence
  Description of Artificial Sequence: Synthetic oligonucleotide
tcactaccgtagaagaccttggctccaagatac

SEQ ID NO: 216842 - DNA, 32 bp, Artificial Sequence
  Description of Artificial Sequence: Synthetic oligonucleotide
cactaccgtagaagaccttggctccaagatac

SEQ ID NO: 216843 - DNA, 33 bp, Artificial Sequence
  Description of Artificial Sequence: Synthetic oligonucleotide
actaccgtagaagaccttggctccaagatactc

SEQ ID NO: 216844 - DNA, 32 bp, Artificial Sequence
  Description of Artificial Sequence: Synthetic oligonucleotide
ctaccgtagaagaccttggctccaagatactc

SEQ ID NO: 216845 - DNA, 32 bp, Artificial Sequence
  Description of Artificial Sequence: Synthetic oligonucleotide
taccgtagaagaccttggctccaagatactcc

SEQ ID NO: 216846 - DNA, 31 bp, Artificial Sequence
  Description of Artificial Sequence: Synthetic oligonucleotide
accgtagaagaccttggctccaagatactcc

SEQ ID NO: 216847 - DNA, 30 bp, Artificial Sequence
  Description of Artificial Sequence: Synthetic oligonucleotide
ccgtagaagaccttggctccaagatactcc

SEQ ID NO: 216848 - DNA, 31 bp, Artificial Sequence
  Description of Artificial Sequence: Synthetic oligonucleotide
cgtagaagaccttggctccaagatactcctc

SEQ ID NO: 216849 - DNA, 32 bp, Artificial Sequence
  Description of Artificial Sequence: Synthetic oligonucleotide
gtagaagaccttggctccaagatactcctcac

SEQ ID NO: 216850 - DNA, 32 bp, Artificial Sequence
  Description of Artificial Sequence: Synthetic oligonucleotide
tagaagaccttggctccaagatactcctcacc

SEQ ID NO: 216851 - DNA, 31 bp, Artificial Sequence
  Description of Artificial Sequence: Synthetic oligonucleotide
agaagaccttggctccaagatactcctcacc

SEQ ID NO: 216852 - DNA, 30 bp, Artificial Sequence
  Description of Artificial Sequence: Synthetic oligonucleotide
gaagaccttggctccaagatactcctcacc

SEQ ID NO: 216853 - DNA, 31 bp, Artificial Sequence
  Description of Artificial Sequence: Synthetic oligonucleotide
aagaccttggctccaagatactcctcacctg

SEQ ID NO: 216854 - DNA, 30 bp, Artificial Sequence
  Description of Artificial Sequence: Synthetic oligonucleotide
agaccttggctccaagatactcctcacctg

SEQ ID NO: 216855 - DNA, 29 bp, Artificial Sequence
  Description of Artificial Sequence: Synthetic oligonucleotide
gaccttggctccaagatactcctcacctg

SEQ ID NO: 216856 - DNA, 29 bp, Artificial Sequence
  Description of Artificial Sequence: Synthetic oligonucleotide
accttggctccaagatactcctcacctgc

SEQ ID NO: 216857 - DNA, 28 bp, Artificial Sequence
  Description of Artificial Sequence: Synthetic oligonucleotide
ccttggctccaagatactcctcacctgc

SEQ ID NO: 216858 - DNA, 29 bp, Artificial Sequence
  Description of Artificial Sequence: Synthetic oligonucleotide
cttggctccaagatactcctcacctgctc

SEQ ID NO: 216859 - DNA, 29 bp, Artificial Sequence
  Description of Artificial Sequence: Synthetic oligonucleotide
ttggctccaagatactcctcacctgctcc

SEQ ID NO: 216860 - DNA, 28 bp, Artificial Sequence
  Description of Artificial Sequence: Synthetic oligonucleotide
tggctccaagatactcctcacctgctcc

SEQ ID NO: 216861 - DNA, 27 bp, Artificial Sequence
  Description of Artificial Sequence: Synthetic oligonucleotide
ggctccaagatactcctcacctgctcc

SEQ ID NO: 216862 - DNA, 29 bp, Artificial Sequence
  Description of Artificial Sequence: Synthetic oligonucleotide
gctccaagatactcctcacctgctccttg

SEQ ID NO: 216863 - DNA, 32 bp, Artificial Sequence
  Description of Artificial Sequence: Synthetic oligonucleotide
ctccaagatactcctcacctgctccttgaatg

SEQ ID NO: 216864 - DNA, 33 bp, Artificial Sequence
  Description of Artificial Sequence: Synthetic oligonucleotide
tccaagatactcctcacctgctccttgaatgac

SEQ ID NO: 216865 - DNA, 32 bp, Artificial Sequence
  Description of Artificial Sequence: Synthetic oligonucleotide
ccaagatactcctcacctgctccttgaatgac

SEQ ID NO: 216866 - DNA, 33 bp, Artificial Sequence
  Description of Artificial Sequence: Synthetic oligonucleotide
caagatactcctcacctgctccttgaatgacag

SEQ ID NO: 216867 - DNA, 33 bp, Artificial Sequence
  Description of Artificial Sequence: Synthetic oligonucleotide
aagatactcctcacctgctccttgaatgacagc

SEQ ID NO: 216868 - DNA, 32 bp, Artificial Sequence
  Description of Artificial Sequence: Synthetic oligonucleotide
agatactcctcacctgctccttgaatgacagc

SEQ ID NO: 216869 - DNA, 31 bp, Artificial Sequence
  Description of Artificial Sequence: Synthetic oligonucleotide
gatactcctcacctgctccttgaatgacagc

SEQ ID NO: 216870 - DNA, 31 bp, Artificial Sequence
  Description of Artificial Sequence: Synthetic oligonucleotide
atactcctcacctgctccttgaatgacagcg

SEQ ID NO: 216871 - DNA, 30 bp, Artificial Sequence
  Description of Artificial Sequence: Synthetic oligonucleotide
tactcctcacctgctccttgaatgacagcg

SEQ ID NO: 216872 - DNA, 29 bp, Artificial Sequence
  Description of Artificial Sequence: Synthetic oligonucleotide
actcctcacctgctccttgaatgacagcg

SEQ ID NO: 216873 - DNA, 28 bp, Artificial Sequence
  Description of Artificial Sequence: Synthetic oligonucleotide
ctcctcacctgctccttgaatgacagcg

SEQ ID NO: 216874 - DNA, 28 bp, Artificial Sequence
  Description of Artificial Sequence: Synthetic oligonucleotide
tcctcacctgctccttgaatgacagcgc

SEQ ID NO: 216875 - DNA, 27 bp, Artificial Sequence
  Description of Artificial Sequence: Synthetic oligonucleotide
cctcacctgctccttgaatgacagcgc

SEQ ID NO: 216876 - DNA, 27 bp, Artificial Sequence
  Description of Artificial Sequence: Synthetic oligonucleotide
ctcacctgctccttgaatgacagcgcc

SEQ ID NO: 216877 - DNA, 28 bp, Artificial Sequence
  Description of Artificial Sequence: Synthetic oligonucleotide
tcacctgctccttgaatgacagcgccac

SEQ ID NO: 216878 - DNA, 27 bp, Artificial Sequence
  Description of Artificial Sequence: Synthetic oligonucleotide
cacctgctccttgaatgacagcgccac

SEQ ID NO: 216879 - DNA, 28 bp, Artificial Sequence
  Description of Artificial Sequence: Synthetic oligonucleotide
acctgctccttgaatgacagcgccacag

SEQ ID NO: 216880 - DNA, 27 bp, Artificial Sequence
  Description of Artificial Sequence: Synthetic oligonucleotide
cctgctccttgaatgacagcgccacag

SEQ ID NO: 216881 - DNA, 28 bp, Artificial Sequence
  Description of Artificial Sequence: Synthetic oligonucleotide
ctgctccttgaatgacagcgccacagag

SEQ ID NO: 216882 - DNA, 28 bp, Artificial Sequence
  Description of Artificial Sequence: Synthetic oligonucleotide
tgctccttgaatgacagcgccacagagg

SEQ ID NO: 216883 - DNA, 27 bp, Artificial Sequence
  Description of Artificial Sequence: Synthetic oligonucleotide
gctccttgaatgacagcgccacagagg

SEQ ID NO: 216884 - DNA, 28 bp, Artificial Sequence
  Description of Artificial Sequence: Synthetic oligonucleotide
ctccttgaatgacagcgccacagaggtc

SEQ ID NO: 216885 - DNA, 29 bp, Artificial Sequence
  Description of Artificial Sequence: Synthetic oligonucleotide
tccttgaatgacagcgccacagaggtcac

SEQ ID NO: 216886 - DNA, 28 bp, Artificial Sequence
  Description of Artificial Sequence: Synthetic oligonucleotide
ccttgaatgacagcgccacagaggtcac

SEQ ID NO: 216887 - DNA, 29 bp, Artificial Sequence
  Description of Artificial Sequence: Synthetic oligonucleotide
cttgaatgacagcgccacagaggtcacag

SEQ ID NO: 216888 - DNA, 29 bp, Artificial Sequence
  Description of Artificial Sequence: Synthetic oligonucleotide
ttgaatgacagcgccacagaggtcacagg

SEQ ID NO: 216889 - DNA, 28 bp, Artificial Sequence
  Description of Artificial Sequence: Synthetic oligonucleotide
tgaatgacagcgccacagaggtcacagg

SEQ ID NO: 216890 - DNA, 27 bp, Artificial Sequence
  Description of Artificial Sequence: Synthetic oligonucleotide
gaatgacagcgccacagaggtcacagg

SEQ ID NO: 216891 - DNA, 27 bp, Artificial Sequence
  Description of Artificial Sequence: Synthetic oligonucleotide
aatgacagcgccacagaggtcacaggg

SEQ ID NO: 216892 - DNA, 26 bp, Artificial Sequence
  Description of Artificial Sequence: Synthetic oligonucleotide
atgacagcgccacagaggtcacaggg

SEQ ID NO: 216893 - DNA, 25 bp, Artificial Sequence
  Description of Artificial Sequence: Synthetic oligonucleotide
tgacagcgccacagaggtcacaggg

SEQ ID NO: 216894 - DNA, 24 bp, Artificial Sequence
  Description of Artificial Sequence: Synthetic oligonucleotide
gacagcgccacagaggtcacaggg

SEQ ID NO: 216895 - DNA, 25 bp, Artificial Sequence
  Description of Artificial Sequence: Synthetic oligonucleotide
acagcgccacagaggtcacagggca

SEQ ID NO: 216896 - DNA, 24 bp, Artificial Sequence
  Description of Artificial Sequence: Synthetic oligonucleotide
cagcgccacagaggtcacagggca

SEQ ID NO: 216897 - DNA, 24 bp, Artificial Sequence
  Description of Artificial Sequence: Synthetic oligonucleotide
agcgccacagaggtcacagggcac

SEQ ID NO: 216898 - DNA, 23 bp, Artificial Sequence
  Description of Artificial Sequence: Synthetic oligonucleotide
gcgccacagaggtcacagggcac

SEQ ID NO: 216899 - DNA, 23 bp, Artificial Sequence
  Description of Artificial Sequence: Synthetic oligonucleotide
cgccacagaggtcacagggcacc

SEQ ID NO: 216900 - DNA, 23 bp, Artificial Sequence
  Description of Artificial Sequence: Synthetic oligonucleotide
gccacagaggtcacagggcaccg

SEQ ID NO: 216901 - DNA, 24 bp, Artificial Sequence
  Description of Artificial Sequence: Synthetic oligonucleotide
ccacagaggtcacagggcaccgct

SEQ ID NO: 216902 - DNA, 24 bp, Artificial Sequence
  Description of Artificial Sequence: Synthetic oligonucleotide
cacagaggtcacagggcaccgctg

SEQ ID NO: 216903 - DNA, 24 bp, Artificial Sequence
  Description of Artificial Sequence: Synthetic oligonucleotide
acagaggtcacagggcaccgctgg

SEQ ID NO: 216904 - DNA, 23 bp, Artificial Sequence
  Description of Artificial Sequence: Synthetic oligonucleotide
cagaggtcacagggcaccgctgg

SEQ ID NO: 216905 - DNA, 24 bp, Artificial Sequence
  Description of Artificial Sequence: Synthetic oligonucleotide
agaggtcacagggcaccgctggct

SEQ ID NO: 216906 - DNA, 23 bp, Artificial Sequence
  Description of Artificial Sequence: Synthetic oligonucleotide
gaggtcacagggcaccgctggct

SEQ ID NO: 216907 - DNA, 25 bp, Artificial Sequence
  Description of Artificial Sequence: Synthetic oligonucleotide
aggtcacagggcaccgctggctgaa

SEQ ID NO: 216908 - DNA, 24 bp, Artificial Sequence
  Description of Artificial Sequence: Synthetic oligonucleotide
ggtcacagggcaccgctggctgaa

SEQ ID NO: 216909 - DNA, 24 bp, Artificial Sequence
  Description of Artificial Sequence: Synthetic oligonucleotide
gtcacagggcaccgctggctgaag

SEQ ID NO: 216910 - DNA, 24 bp, Artificial Sequence
  Description of Artificial Sequence: Synthetic oligonucleotide
tcacagggcaccgctggctgaagg

SEQ ID NO: 216911 - DNA, 23 bp, Artificial Sequence
  Description of Artificial Sequence: Synthetic oligonucleotide
cacagggcaccgctggctgaagg

SEQ ID NO: 216912 - DNA, 23 bp, Artificial Sequence
  Description of Artificial Sequence: Synthetic oligonucleotide
acagggcaccgctggctgaaggg

SEQ ID NO: 216913 - DNA, 22 bp, Artificial Sequence
  Description of Artificial Sequence: Synthetic oligonucleotide
cagggcaccgctggctgaaggg

SEQ ID NO: 216914 - DNA, 22 bp, Artificial Sequence
  Description of Artificial Sequence: Synthetic oligonucleotide
agggcaccgctggctgaagggg

SEQ ID NO: 216915 - DNA, 21 bp, Artificial Sequence
  Description of Artificial Sequence: Synthetic oligonucleotide
gggcaccgctggctgaagggg

SEQ ID NO: 216916 - DNA, 21 bp, Artificial Sequence
  Description of Artificial Sequence: Synthetic oligonucleotide
ggcaccgctggctgaaggggg

SEQ ID NO: 216917 - DNA, 21 bp, Artificial Sequence
  Description of Artificial Sequence: Synthetic oligonucleotide
gcaccgctggctgaagggggg

SEQ ID NO: 216918 - DNA, 21 bp, Artificial Sequence
  Description of Artificial Sequence: Synthetic oligonucleotide
caccgctggctgaaggggggc

SEQ ID NO: 216919 - DNA, 22 bp, Artificial Sequence
  Description of Artificial Sequence: Synthetic oligonucleotide
accgctggctgaaggggggcgt

SEQ ID NO: 216920 - DNA, 21 bp, Artificial Sequence
  Description of Artificial Sequence: Synthetic oligonucleotide
ccgctggctgaaggggggcgt

SEQ ID NO: 216921 - DNA, 21 bp, Artificial Sequence
  Description of Artificial Sequence: Synthetic oligonucleotide
cgctggctgaaggggggcgtg

SEQ ID NO: 216922 - DNA, 22 bp, Artificial Sequence
  Description of Artificial Sequence: Synthetic oligonucleotide
gctggctgaaggggggcgtggt

SEQ ID NO: 216923 - DNA, 22 bp, Artificial Sequence
  Description of Artificial Sequence: Synthetic oligonucleotide
ctggctgaaggggggcgtggtg

SEQ ID NO: 216924 - DNA, 23 bp, Artificial Sequence
  Description of Artificial Sequence: Synthetic oligonucleotide
tggctgaaggggggcgtggtgct

SEQ ID NO: 216925 - DNA, 22 bp, Artificial Sequence
  Description of Artificial Sequence: Synthetic oligonucleotide
ggctgaaggggggcgtggtgct

SEQ ID NO: 216926 - DNA, 24 bp, Artificial Sequence
  Description of Artificial Sequence: Synthetic oligonucleotide
gctgaaggggggcgtggtgctgaa

SEQ ID NO: 216927 - DNA, 24 bp, Artificial Sequence
  Description of Artificial Sequence: Synthetic oligonucleotide
ctgaaggggggcgtggtgctgaag

SEQ ID NO: 216928 - DNA, 25 bp, Artificial Sequence
  Description of Artificial Sequence: Synthetic oligonucleotide
tgaaggggggcgtggtgctgaagga

SEQ ID NO: 216929 - DNA, 24 bp, Artificial Sequence
  Description of Artificial Sequence: Synthetic oligonucleotide
gaaggggggcgtggtgctgaagga

SEQ ID NO: 216930 - DNA, 24 bp, Artificial Sequence
  Description of Artificial Sequence: Synthetic oligonucleotide
aaggggggcgtggtgctgaaggag

SEQ ID NO: 216931 - DNA, 23 bp, Artificial Sequence
  Description of Artificial Sequence: Synthetic oligonucleotide
aggggggcgtggtgctgaaggag

SEQ ID NO: 216932 - DNA, 22 bp, Artificial Sequence
  Description of Artificial Sequence: Synthetic oligonucleotide
ggggggcgtggtgctgaaggag

SEQ ID NO: 216933 - DNA, 23 bp, Artificial Sequence
  Description of Artificial Sequence: Synthetic oligonucleotide
gggggcgtggtgctgaaggagga

SEQ ID NO: 216934 - DNA, 23 bp, Artificial Sequence
  Description of Artificial Sequence: Synthetic oligonucleotide
ggggcgtggtgctgaaggaggac

SEQ ID NO: 216935 - DNA, 23 bp, Artificial Sequence
  Description of Artificial Sequence: Synthetic oligonucleotide
gggcgtggtgctgaaggaggacg

SEQ ID NO: 216936 - DNA, 23 bp, Artificial Sequence
  Description of Artificial Sequence: Synthetic oligonucleotide
ggcgtggtgctgaaggaggacgc

SEQ ID NO: 216937 - DNA, 23 bp, Artificial Sequence
  Description of Artificial Sequence: Synthetic oligonucleotide
gcgtggtgctgaaggaggacgcg

SEQ ID NO: 216938 - DNA, 24 bp, Artificial Sequence
  Description of Artificial Sequence: Synthetic oligonucleotide
cgtggtgctgaaggaggacgcgct

SEQ ID NO: 216939 - DNA, 24 bp, Artificial Sequence
  Description of Artificial Sequence: Synthetic oligonucleotide
gtggtgctgaaggaggacgcgctg

SEQ ID NO: 216940 - DNA, 24 bp, Artificial Sequence
  Description of Artificial Sequence: Synthetic oligonucleotide
tggtgctgaaggaggacgcgctgc

SEQ ID NO: 216941 - DNA, 23 bp, Artificial Sequence
  Description of Artificial Sequence: Synthetic oligonucleotide
ggtgctgaaggaggacgcgctgc

SEQ ID NO: 216942 - DNA, 23 bp, Artificial Sequence
  Description of Artificial Sequence: Synthetic oligonucleotide
gtgctgaaggaggacgcgctgcc

SEQ ID NO: 216943 - DNA, 23 bp, Artificial Sequence
  Description of Artificial Sequence: Synthetic oligonucleotide
tgctgaaggaggacgcgctgccc

SEQ ID NO: 216944 - DNA, 22 bp, Artificial Sequence
  Description of Artificial Sequence: Synthetic oligonucleotide
gctgaaggaggacgcgctgccc

SEQ ID NO: 216945 - DNA, 22 bp, Artificial Sequence
  Description of Artificial Sequence: Synthetic oligonucleotide
ctgaaggaggacgcgctgcccg

SEQ ID NO: 216946 - DNA, 22 bp, Artificial Sequence
  Description of Artificial Sequence: Synthetic oligonucleotide
tgaaggaggacgcgctgcccgg

SEQ ID NO: 216947 - DNA, 21 bp, Artificial Sequence
  Description of Artificial Sequence: Synthetic oligonucleotide
gaaggaggacgcgctgcccgg

SEQ ID NO: 216948 - DNA, 21 bp, Artificial Sequence
  Description of Artificial Sequence: Synthetic oligonucleotide
aaggaggacgcgctgcccggc

SEQ ID NO: 216949 - DNA, 20 bp, Artificial Sequence
  Description of Artificial Sequence: Synthetic oligonucleotide
aggaggacgcgctgcccggc

SEQ ID NO: 216950 - DNA, 20 bp, Artificial Sequence
  Description of Artificial Sequence: Synthetic oligonucleotide
ggaggacgcgctgcccggct

SEQ ID NO: 216951 - DNA, 20 bp, Artificial Sequence
  Description of Artificial Sequence: Synthetic oligonucleotide
gaggacgcgctgcccggcca

SEQ ID NO: 216952 - DNA, 24 bp, Artificial Sequence
  Description of Artificial Sequence: Synthetic oligonucleotide
aggacgcgctgcccggccagaaaa

SEQ ID NO: 216953 - DNA, 23 bp, Artificial Sequence
  Description of Artificial Sequence: Synthetic oligonucleotide
ggacgcgctgcccggccagaaaa

SEQ ID NO: 216954 - DNA, 23 bp, Artificial Sequence
  Description of Artificial Sequence: Synthetic oligonucleotide
gacgcgctgcccggccagaaaac

SEQ ID NO: 216955 - DNA, 23 bp, Artificial Sequence
  Description of Artificial Sequence: Synthetic oligonucleotide
acgcgctgcccggccagaaaacg

SEQ ID NO: 216956 - DNA, 22 bp, Artificial Sequence
  Description of Artificial Sequence: Synthetic oligonucleotide
cgcgctgcccggccagaaaacg

SEQ ID NO: 216957 - DNA, 23 bp, Artificial Sequence
  Description of Artificial Sequence: Synthetic oligonucleotide
gcgctgcccggccagaaaacgga

SEQ ID NO: 216958 - DNA, 25 bp, Artificial Sequence
  Description of Artificial Sequence: Synthetic oligonucleotide
cgctgcccggccagaaaacggagtt

SEQ ID NO: 216959 - DNA, 27 bp, Artificial Sequence
  Description of Artificial Sequence: Synthetic oligonucleotide
gctgcccggccagaaaacggagttcaa

SEQ ID NO: 216960 - DNA, 27 bp, Artificial Sequence
  Description of Artificial Sequence: Synthetic oligonucleotide
ctgcccggccagaaaacggagttcaag

SEQ ID NO: 216961 - DNA, 27 bp, Artificial Sequence
  Description of Artificial Sequence: Synthetic oligonucleotide
tgcccggccagaaaacggagttcaagg

SEQ ID NO: 216962 - DNA, 27 bp, Artificial Sequence
  Description of Artificial Sequence: Synthetic oligonucleotide
gcccggccagaaaacggagttcaaggt

SEQ ID NO: 216963 - DNA, 27 bp, Artificial Sequence
  Description of Artificial Sequence: Synthetic oligonucleotide
cccggccagaaaacggagttcaaggtg

SEQ ID NO: 216964 - DNA, 27 bp, Artificial Sequence
  Description of Artificial Sequence: Synthetic oligonucleotide
ccggccagaaaacggagttcaaggtgg

SEQ ID NO: 216965 - DNA, 28 bp, Artificial Sequence
  Description of Artificial Sequence: Synthetic oligonucleotide
cggccagaaaacggagttcaaggtggac

SEQ ID NO: 216966 - DNA, 29 bp, Artificial Sequence
  Description of Artificial Sequence: Synthetic oligonucleotide
ggccagaaaacggagttcaaggtggactc

SEQ ID NO: 216967 - DNA, 29 bp, Artificial Sequence
  Description of Artificial Sequence: Synthetic oligonucleotide
gccagaaaacggagttcaaggtggactcc

SEQ ID NO: 216968 - DNA, 29 bp, Artificial Sequence
  Description of Artificial Sequence: Synthetic oligonucleotide
ccagaaaacggagttcaaggtggactccg

SEQ ID NO: 216969 - DNA, 30 bp, Artificial Sequence
  Description of Artificial Sequence: Synthetic oligonucleotide
cagaaaacggagttcaaggtggactccgac

SEQ ID NO: 216970 - DNA, 30 bp, Artificial Sequence
  Description of Artificial Sequence: Synthetic oligonucleotide
agaaaacggagttcaaggtggactccgacg

SEQ ID NO: 216971 - DNA, 29 bp, Artificial Sequence
  Description of Artificial Sequence: Synthetic oligonucleotide
gaaaacggagttcaaggtggactccgacg

SEQ ID NO: 216972 - DNA, 30 bp, Artificial Sequence
  Description of Artificial Sequence: Synthetic oligonucleotide
aaaacggagttcaaggtggactccgacgac

SEQ ID NO: 216973 - DNA, 29 bp, Artificial Sequence
  Description of Artificial Sequence: Synthetic oligonucleotide
aaacggagttcaaggtggactccgacgac

SEQ ID NO: 216974 - DNA, 28 bp, Artificial Sequence
  Description of Artificial Sequence: Synthetic oligonucleotide
aacggagttcaaggtggactccgacgac

SEQ ID NO: 216975 - DNA, 27 bp, Artificial Sequence
  Description of Artificial Sequence: Synthetic oligonucleotide
acggagttcaaggtggactccgacgac

SEQ ID NO: 216976 - DNA, 26 bp, Artificial Sequence
  Description of Artificial Sequence: Synthetic oligonucleotide
cggagttcaaggtggactccgacgac

SEQ ID NO: 216977 - DNA, 27 bp, Artificial Sequence
  Description of Artificial Sequence: Synthetic oligonucleotide
ggagttcaaggtggactccgacgacca

SEQ ID NO: 216978 - DNA, 27 bp, Artificial Sequence
  Description of Artificial Sequence: Synthetic oligonucleotide
gagttcaaggtggactccgacgaccag

SEQ ID NO: 216979 - DNA, 28 bp, Artificial Sequence
  Description of Artificial Sequence: Synthetic oligonucleotide
agttcaaggtggactccgacgaccagtg

SEQ ID NO: 216980 - DNA, 27 bp, Artificial Sequence
  Description of Artificial Sequence: Synthetic oligonucleotide
gttcaaggtggactccgacgaccagtg

SEQ ID NO: 216981 - DNA, 27 bp, Artificial Sequence
  Description of Artificial Sequence: Synthetic oligonucleotide
ttcaaggtggactccgacgaccagtgg

SEQ ID NO: 216982 - DNA, 26 bp, Artificial Sequence
  Description of Artificial Sequence: Synthetic oligonucleotide
tcaaggtggactccgacgaccagtgg

SEQ ID NO: 216983 - DNA, 25 bp, Artificial Sequence
  Description of Artificial Sequence: Synthetic oligonucleotide
caaggtggactccgacgaccagtgg

SEQ ID NO: 216984 - DNA, 25 bp, Artificial Sequence
  Description of Artificial Sequence: Synthetic oligonucleotide
aaggtggactccgacgaccagtggg

SEQ ID NO: 216985 - DNA, 24 bp, Artificial Sequence
  Description of Artificial Sequence: Synthetic oligonucleotide
aggtggactccgacgaccagtggg

SEQ ID NO: 216986 - DNA, 23 bp, Artificial Sequence
  Description of Artificial Sequence: Synthetic oligonucleotide
ggtggactccgacgaccagtggg

SEQ ID NO: 216987 - DNA, 24 bp, Artificial Sequence
  Description of Artificial Sequence: Synthetic oligonucleotide
gtggactccgacgaccagtgggga

SEQ ID NO: 216988 - DNA, 25 bp, Artificial Sequence
  Description of Artificial Sequence: Synthetic oligonucleotide
tggactccgacgaccagtggggaga

SEQ ID NO: 216989 - DNA, 24 bp, Artificial Sequence
  Description of Artificial Sequence: Synthetic oligonucleotide
ggactccgacgaccagtggggaga

SEQ ID NO: 216990 - DNA, 26 bp, Artificial Sequence
  Description of Artificial Sequence: Synthetic oligonucleotide
gactccgacgaccagtggggagagta

SEQ ID NO: 216991 - DNA, 27 bp, Artificial Sequence
  Description of Artificial Sequence: Synthetic oligonucleotide
actccgacgaccagtggggagagtact

SEQ ID NO: 216992 - DNA, 26 bp, Artificial Sequence
  Description of Artificial Sequence: Synthetic oligonucleotide
ctccgacgaccagtggggagagtact

SEQ ID NO: 216993 - DNA, 26 bp, Artificial Sequence
  Description of Artificial Sequence: Synthetic oligonucleotide
tccgacgaccagtggggagagtactc

SEQ ID NO: 216994 - DNA, 25 bp, Artificial Sequence
  Description of Artificial Sequence: Synthetic oligonucleotide
ccgacgaccagtggggagagtactc

SEQ ID NO: 216995 - DNA, 26 bp, Artificial Sequence
  Description of Artificial Sequence: Synthetic oligonucleotide
cgacgaccagtggggagagtactcct

SEQ ID NO: 216996 - DNA, 26 bp, Artificial Sequence
  Description of Artificial Sequence: Synthetic oligonucleotide
gacgaccagtggggagagtactcctg

SEQ ID NO: 216997 - DNA, 26 bp, Artificial Sequence
  Description of Artificial Sequence: Synthetic oligonucleotide
acgaccagtggggagagtactcctgc

SEQ ID NO: 216998 - DNA, 25 bp, Artificial Sequence
  Description of Artificial Sequence: Synthetic oligonucleotide
cgaccagtggggagagtactcctgc

SEQ ID NO: 216999 - DNA, 26 bp, Artificial Sequence
  Description of Artificial Sequence: Synthetic oligonucleotide
gaccagtggggagagtactcctgcgt

SEQ ID NO: 217000 - DNA, 27 bp, Artificial Sequence
  Description of Artificial Sequence: Synthetic oligonucleotide
accagtggggagagtactcctgcgtct

SEQ ID NO: 217001 - DNA, 27 bp, Artificial Sequence
  Description of Artificial Sequence: Synthetic oligonucleotide
ccagtggggagagtactcctgcgtctt

SEQ ID NO: 217002 - DNA, 27 bp, Artificial Sequence
  Description of Artificial Sequence: Synthetic oligonucleotide
cagtggggagagtactcctgcgtcttc

SEQ ID NO: 217003 - DNA, 27 bp, Artificial Sequence
  Description of Artificial Sequence: Synthetic oligonucleotide
agtggggagagtactcctgcgtcttcc

SEQ ID NO: 217004 - DNA, 27 bp, Artificial Sequence
  Description of Artificial Sequence: Synthetic oligonucleotide
gtggggagagtactcctgcgtcttcct

SEQ ID NO: 217005 - DNA, 27 bp, Artificial Sequence
  Description of Artificial Sequence: Synthetic oligonucleotide
tggggagagtactcctgcgtcttcctc

SEQ ID NO: 217006 - DNA, 26 bp, Artificial Sequence
  Description of Artificial Sequence: Synthetic oligonucleotide
ggggagagtactcctgcgtcttcctc

SEQ ID NO: 217007 - DNA, 26 bp, Artificial Sequence
  Description of Artificial Sequence: Synthetic oligonucleotide
gggagagtactcctgcgtcttcctcc

SEQ ID NO: 217008 - DNA, 26 bp, Artificial Sequence
  Description of Artificial Sequence: Synthetic oligonucleotide
ggagagtactcctgcgtcttcctccc

SEQ ID NO: 217009 - DNA, 26 bp, Artificial Sequence
  Description of Artificial Sequence: Synthetic oligonucleotide
gagagtactcctgcgtcttcctcccc

SEQ ID NO: 217010 - DNA, 27 bp, Artificial Sequence
  Description of Artificial Sequence: Synthetic oligonucleotide
agagtactcctgcgtcttcctccccga

SEQ ID NO: 217011 - DNA, 26 bp, Artificial Sequence
  Description of Artificial Sequence: Synthetic oligonucleotide
gagtactcctgcgtcttcctccccga

SEQ ID NO: 217012 - DNA, 26 bp, Artificial Sequence
  Description of Artificial Sequence: Synthetic oligonucleotide
agtactcctgcgtcttcctccccgag

SEQ ID NO: 217013 - DNA, 25 bp, Artificial Sequence
  Description of Artificial Sequence: Synthetic oligonucleotide
gtactcctgcgtcttcctccccgag

SEQ ID NO: 217014 - DNA, 25 bp, Artificial Sequence
  Description of Artificial Sequence: Synthetic oligonucleotide
tactcctgcgtcttcctccccgagc

SEQ ID NO: 217015 - DNA, 24 bp, Artificial Sequence
  Description of Artificial Sequence: Synthetic oligonucleotide
actcctgcgtcttcctccccgagc

SEQ ID NO: 217016 - DNA, 23 bp, Artificial Sequence
  Description of Artificial Sequence: Synthetic oligonucleotide
ctcctgcgtcttcctccccgagc

SEQ ID NO: 217017 - DNA, 23 bp, Artificial Sequence
  Description of Artificial Sequence: Synthetic oligonucleotide
tcctgcgtcttcctccccgagcc

SEQ ID NO: 217018 - DNA, 22 bp, Artificial Sequence
  Description of Artificial Sequence: Synthetic oligonucleotide
cctgcgtcttcctccccgagcc

SEQ ID NO: 217019 - DNA, 24 bp, Artificial Sequence
  Description of Artificial Sequence: Synthetic oligonucleotide
ctgcgtcttcctccccgagcccat

SEQ ID NO: 217020 - DNA, 24 bp, Artificial Sequence
  Description of Artificial Sequence: Synthetic oligonucleotide
tgcgtcttcctccccgagcccatg

SEQ ID NO: 217021 - DNA, 23 bp, Artificial Sequence
  Description of Artificial Sequence: Synthetic oligonucleotide
gcgtcttcctccccgagcccatg

SEQ ID NO: 217022 - DNA, 23 bp, Artificial Sequence
  Description of Artificial Sequence: Synthetic oligonucleotide
cgtcttcctccccgagcccatgg

SEQ ID NO: 217023 - DNA, 23 bp, Artificial Sequence
  Description of Artificial Sequence: Synthetic oligonucleotide
gtcttcctccccgagcccatggg

SEQ ID NO: 217024 - DNA, 24 bp, Artificial Sequence
  Description of Artificial Sequence: Synthetic oligonucleotide
tcttcctccccgagcccatgggca

SEQ ID NO: 217025 - DNA, 23 bp, Artificial Sequence
  Description of Artificial Sequence: Synthetic oligonucleotide
cttcctccccgagcccatgggca

SEQ ID NO: 217026 - DNA, 23 bp, Artificial Sequence
  Description of Artificial Sequence: Synthetic oligonucleotide
ttcctccccgagcccatgggcac

SEQ ID NO: 217027 - DNA, 22 bp, Artificial Sequence
  Description of Artificial Sequence: Synthetic oligonucleotide
tcctccccgagcccatgggcac

SEQ ID NO: 217028 - DNA, 21 bp, Artificial Sequence
  Description of Artificial Sequence: Synthetic oligonucleotide
cctccccgagcccatgggcac

SEQ ID NO: 217029 - DNA, 21 bp, Artificial Sequence
  Description of Artificial Sequence: Synthetic oligonucleotide
ctccccgagcccatgggcacg

SEQ ID NO: 217030 - DNA, 21 bp, Artificial Sequence
  Description of Artificial Sequence: Synthetic oligonucleotide
tccccgagcccatgggcacgg

SEQ ID NO: 217031 - DNA, 20 bp, Artificial Sequence
  Description of Artificial Sequence: Synthetic oligonucleotide
ccccgagcccatgggcacgg

SEQ ID NO: 217032 - DNA, 20 bp, Artificial Sequence
  Description of Artificial Sequence: Synthetic oligonucleotide
cccgagcccatgggcacggc

SEQ ID NO: 217033 - DNA, 22 bp, Artificial Sequence
  Description of Artificial Sequence: Synthetic oligonucleotide
ccgagcccatgggcacggccaa

SEQ ID NO: 217034 - DNA, 24 bp, Artificial Sequence
  Description of Artificial Sequence: Synthetic oligonucleotide
cgagcccatgggcacggccaacat

SEQ ID NO: 217035 - DNA, 24 bp, Artificial Sequence
  Description of Artificial Sequence: Synthetic oligonucleotide
gagcccatgggcacggccaacatc

SEQ ID NO: 217036 - DNA, 25 bp, Artificial Sequence
  Description of Artificial Sequence: Synthetic oligonucleotide
agcccatgggcacggccaacatcca

SEQ ID NO: 217037 - DNA, 24 bp, Artificial Sequence
  Description of Artificial Sequence: Synthetic oligonucleotide
gcccatgggcacggccaacatcca

SEQ ID NO: 217038 - DNA, 24 bp, Artificial Sequence
  Description of Artificial Sequence: Synthetic oligonucleotide
cccatgggcacggccaacatccag

SEQ ID NO: 217039 - DNA, 25 bp, Artificial Sequence
  Description of Artificial Sequence: Synthetic oligonucleotide
ccatgggcacggccaacatccagct

SEQ ID NO: 217040 - DNA, 25 bp, Artificial Sequence
  Description of Artificial Sequence: Synthetic oligonucleotide
catgggcacggccaacatccagctc

SEQ ID NO: 217041 - DNA, 26 bp, Artificial Sequence
  Description of Artificial Sequence: Synthetic oligonucleotide
atgggcacggccaacatccagctcca

SEQ ID NO: 217042 - DNA, 25 bp, Artificial Sequence
  Description of Artificial Sequence: Synthetic oligonucleotide
tgggcacggccaacatccagctcca

SEQ ID NO: 217043 - DNA, 24 bp, Artificial Sequence
  Description of Artificial Sequence: Synthetic oligonucleotide
gggcacggccaacatccagctcca

SEQ ID NO: 217044 - DNA, 24 bp, Artificial Sequence
  Description of Artificial Sequence: Synthetic oligonucleotide
ggcacggccaacatccagctccac

SEQ ID NO: 217045 - DNA, 24 bp, Artificial Sequence
  Description of Artificial Sequence: Synthetic oligonucleotide
gcacggccaacatccagctccacg

SEQ ID NO: 217046 - DNA, 24 bp, Artificial Sequence
  Description of Artificial Sequence: Synthetic oligonucleotide
cacggccaacatccagctccacgg

SEQ ID NO: 217047 - DNA, 24 bp, Artificial Sequence
  Description of Artificial Sequence: Synthetic oligonucleotide
acggccaacatccagctccacggg

SEQ ID NO: 217048 - DNA, 23 bp, Artificial Sequence
  Description of Artificial Sequence: Synthetic oligonucleotide
cggccaacatccagctccacggg

SEQ ID NO: 217049 - DNA, 23 bp, Artificial Sequence
  Description of Artificial Sequence: Synthetic oligonucleotide
ggccaacatccagctccacgggc

SEQ ID NO: 217050 - DNA, 24 bp, Artificial Sequence
  Description of Artificial Sequence: Synthetic oligonucleotide
gccaacatccagctccacgggcct

SEQ ID NO: 217051 - DNA, 24 bp, Artificial Sequence
  Description of Artificial Sequence: Synthetic oligonucleotide
ccaacatccagctccacgggcctc

SEQ ID NO: 217052 - DNA, 24 bp, Artificial Sequence
  Description of Artificial Sequence: Synthetic oligonucleotide
caacatccagctccacgggcctcc

SEQ ID NO: 217053 - DNA, 25 bp, Artificial Sequence
  Description of Artificial Sequence: Synthetic oligonucleotide
aacatccagctccacgggcctccca

SEQ ID NO: 217054 - DNA, 24 bp, Artificial Sequence
  Description of Artificial Sequence: Synthetic oligonucleotide
acatccagctccacgggcctccca

SEQ ID NO: 217055 - DNA, 23 bp, Artificial Sequence
  Description of Artificial Sequence: Synthetic oligonucleotide
catccagctccacgggcctccca

SEQ ID NO: 217056 - DNA, 24 bp, Artificial Sequence
  Description of Artificial Sequence: Synthetic oligonucleotide
atccagctccacgggcctcccaga

SEQ ID NO: 217057 - DNA, 23 bp, Artificial Sequence
  Description of Artificial Sequence: Synthetic oligonucleotide
tccagctccacgggcctcccaga

SEQ ID NO: 217058 - DNA, 22 bp, Artificial Sequence
  Description of Artificial Sequence: Synthetic oligonucleotide
ccagctccacgggcctcccaga

SEQ ID NO: 217059 - DNA, 23 bp, Artificial Sequence
  Description of Artificial Sequence: Synthetic oligonucleotide
cagctccacgggcctcccagagt

SEQ ID NO: 217060 - DNA, 25 bp, Artificial Sequence
  Description of Artificial Sequence: Synthetic oligonucleotide
agctccacgggcctcccagagtgaa

SEQ ID NO: 217061 - DNA, 24 bp, Artificial Sequence
  Description of Artificial Sequence: Synthetic oligonucleotide
gctccacgggcctcccagagtgaa

SEQ ID NO: 217062 - DNA, 24 bp, Artificial Sequence
  Description of Artificial Sequence: Synthetic oligonucleotide
ctccacgggcctcccagagtgaag

SEQ ID NO: 217063 - DNA, 24 bp, Artificial Sequence
  Description of Artificial Sequence: Synthetic oligonucleotide
tccacgggcctcccagagtgaagg

SEQ ID NO: 217064 - DNA, 23 bp, Artificial Sequence
  Description of Artificial Sequence: Synthetic oligonucleotide
ccacgggcctcccagagtgaagg

SEQ ID NO: 217065 - DNA, 24 bp, Artificial Sequence
  Description of Artificial Sequence: Synthetic oligonucleotide
cacgggcctcccagagtgaaggct

SEQ ID NO: 217066 - DNA, 25 bp, Artificial Sequence
  Description of Artificial Sequence: Synthetic oligonucleotide
acgggcctcccagagtgaaggctgt

SEQ ID NO: 217067 - DNA, 24 bp, Artificial Sequence
  Description of Artificial Sequence: Synthetic oligonucleotide
cgggcctcccagagtgaaggctgt

SEQ ID NO: 217068 - DNA, 26 bp, Artificial Sequence
  Description of Artificial Sequence: Synthetic oligonucleotide
gggcctcccagagtgaaggctgtgaa

SEQ ID NO: 217069 - DNA, 27 bp, Artificial Sequence
  Description of Artificial Sequence: Synthetic oligonucleotide
ggcctcccagagtgaaggctgtgaagt

SEQ ID NO: 217070 - DNA, 27 bp, Artificial Sequence
  Description of Artificial Sequence: Synthetic oligonucleotide
gcctcccagagtgaaggctgtgaagtc

SEQ ID NO: 217071 - DNA, 27 bp, Artificial Sequence
  Description of Artificial Sequence: Synthetic oligonucleotide
cctcccagagtgaaggctgtgaagtcg

SEQ ID NO: 217072 - DNA, 28 bp, Artificial Sequence
  Description of Artificial Sequence: Synthetic oligonucleotide
ctcccagagtgaaggctgtgaagtcgtc

SEQ ID NO: 217073 - DNA, 29 bp, Artificial Sequence
  Description of Artificial Sequence: Synthetic oligonucleotide
tcccagagtgaaggctgtgaagtcgtcag

SEQ ID NO: 217074 - DNA, 28 bp, Artificial Sequence
  Description of Artificial Sequence: Synthetic oligonucleotide
cccagagtgaaggctgtgaagtcgtcag

SEQ ID NO: 217075 - DNA, 30 bp, Artificial Sequence
  Description of Artificial Sequence: Synthetic oligonucleotide
ccagagtgaaggctgtgaagtcgtcagaac

SEQ ID NO: 217076 - DNA, 31 bp, Artificial Sequence
  Description of Artificial Sequence: Synthetic oligonucleotide
cagagtgaaggctgtgaagtcgtcagaacac

SEQ ID NO: 217077 - DNA, 33 bp, Artificial Sequence
  Description of Artificial Sequence: Synthetic oligonucleotide
agagtgaaggctgtgaagtcgtcagaacacatc

SEQ ID NO: 217078 - DNA, 32 bp, Artificial Sequence
  Description of Artificial Sequence: Synthetic oligonucleotide
gagtgaaggctgtgaagtcgtcagaacacatc

SEQ ID NO: 217079 - DNA, 34 bp, Artificial Sequence
  Description of Artificial Sequence: Synthetic oligonucleotide
agtgaaggctgtgaagtcgtcagaacacatcaac

SEQ ID NO: 217080 - DNA, 33 bp, Artificial Sequence
  Description of Artificial Sequence: Synthetic oligonucleotide
gtgaaggctgtgaagtcgtcagaacacatcaac

SEQ ID NO: 217081 - DNA, 33 bp, Artificial Sequence
  Description of Artificial Sequence: Synthetic oligonucleotide
tgaaggctgtgaagtcgtcagaacacatcaacg

SEQ ID NO: 217082 - DNA, 32 bp, Artificial Sequence
  Description of Artificial Sequence: Synthetic oligonucleotide
gaaggctgtgaagtcgtcagaacacatcaacg

SEQ ID NO: 217083 - DNA, 33 bp, Artificial Sequence
  Description of Artificial Sequence: Synthetic oligonucleotide
aaggctgtgaagtcgtcagaacacatcaacgag

SEQ ID NO: 217084 - DNA, 32 bp, Artificial Sequence
  Description of Artificial Sequence: Synthetic oligonucleotide
aggctgtgaagtcgtcagaacacatcaacgag

SEQ ID NO: 217085 - DNA, 31 bp, Artificial Sequence
  Description of Artificial Sequence: Synthetic oligonucleotide
ggctgtgaagtcgtcagaacacatcaacgag

SEQ ID NO: 217086 - DNA, 31 bp, Artificial Sequence
  Description of Artificial Sequence: Synthetic oligonucleotide
gctgtgaagtcgtcagaacacatcaacgagg

SEQ ID NO: 217087 - DNA, 31 bp, Artificial Sequence
  Description of Artificial Sequence: Synthetic oligonucleotide
ctgtgaagtcgtcagaacacatcaacgaggg

SEQ ID NO: 217088 - DNA, 31 bp, Artificial Sequence
  Description of Artificial Sequence: Synthetic oligonucleotide
tgtgaagtcgtcagaacacatcaacgagggg

SEQ ID NO: 217089 - DNA, 30 bp, Artificial Sequence
  Description of Artificial Sequence: Synthetic oligonucleotide
gtgaagtcgtcagaacacatcaacgagggg

SEQ ID NO: 217090 - DNA, 30 bp, Artificial Sequence
  Description of Artificial Sequence: Synthetic oligonucleotide
tgaagtcgtcagaacacatcaacgaggggg

SEQ ID NO: 217091 - DNA, 29 bp, Artificial Sequence
  Description of Artificial Sequence: Synthetic oligonucleotide
gaagtcgtcagaacacatcaacgaggggg

SEQ ID NO: 217092 - DNA, 30 bp, Artificial Sequence
  Description of Artificial Sequence: Synthetic oligonucleotide
aagtcgtcagaacacatcaacgagggggag

SEQ ID NO: 217093 - DNA, 29 bp, Artificial Sequence
  Description of Artificial Sequence: Synthetic oligonucleotide
agtcgtcagaacacatcaacgagggggag

SEQ ID NO: 217094 - DNA, 28 bp, Artificial Sequence
  Description of Artificial Sequence: Synthetic oligonucleotide
gtcgtcagaacacatcaacgagggggag

SEQ ID NO: 217095 - DNA, 29 bp, Artificial Sequence
  Description of Artificial Sequence: Synthetic oligonucleotide
tcgtcagaacacatcaacgagggggagac

SEQ ID NO: 217096 - DNA, 28 bp, Artificial Sequence
  Description of Artificial Sequence: Synthetic oligonucleotide
cgtcagaacacatcaacgagggggagac

SEQ ID NO: 217097 - DNA, 28 bp, Artificial Sequence
  Description of Artificial Sequence: Synthetic oligonucleotide
gtcagaacacatcaacgagggggagacg

SEQ ID NO: 217098 - DNA, 28 bp, Artificial Sequence
  Description of Artificial Sequence: Synthetic oligonucleotide
tcagaacacatcaacgagggggagacgg

SEQ ID NO: 217099 - DNA, 27 bp, Artificial Sequence
  Description of Artificial Sequence: Synthetic oligonucleotide
cagaacacatcaacgagggggagacgg

SEQ ID NO: 217100 - DNA, 27 bp, Artificial Sequence
  Description of Artificial Sequence: Synthetic oligonucleotide
agaacacatcaacgagggggagacggc

SEQ ID NO: 217101 - DNA, 26 bp, Artificial Sequence
  Description of Artificial Sequence: Synthetic oligonucleotide
gaacacatcaacgagggggagacggc

SEQ ID NO: 217102 - DNA, 27 bp, Artificial Sequence
  Description of Artificial Sequence: Synthetic oligonucleotide
aacacatcaacgagggggagacggcca

SEQ ID NO: 217103 - DNA, 27 bp, Artificial Sequence
  Description of Artificial Sequence: Synthetic oligonucleotide
acacatcaacgagggggagacggccat

SEQ ID NO: 217104 - DNA, 26 bp, Artificial Sequence
  Description of Artificial Sequence: Synthetic oligonucleotide
cacatcaacgagggggagacggccat

SEQ ID NO: 217105 - DNA, 26 bp, Artificial Sequence
  Description of Artificial Sequence: Synthetic oligonucleotide
acatcaacgagggggagacggccatg

SEQ ID NO: 217106 - DNA, 25 bp, Artificial Sequence
  Description of Artificial Sequence: Synthetic oligonucleotide
catcaacgagggggagacggccatg

SEQ ID NO: 217107 - DNA, 26 bp, Artificial Sequence
  Description of Artificial Sequence: Synthetic oligonucleotide
atcaacgagggggagacggccatgct

SEQ ID NO: 217108 - DNA, 25 bp, Artificial Sequence
  Description of Artificial Sequence: Synthetic oligonucleotide
tcaacgagggggagacggccatgct

SEQ ID NO: 217109 - DNA, 24 bp, Artificial Sequence
  Description of Artificial Sequence: Synthetic oligonucleotide
caacgagggggagacggccatgct

SEQ ID NO: 217110 - DNA, 24 bp, Artificial Sequence
  Description of Artificial Sequence: Synthetic oligonucleotide
aacgagggggagacggccatgctg

SEQ ID NO: 217111 - DNA, 23 bp, Artificial Sequence
  Description of Artificial Sequence: Synthetic oligonucleotide
acgagggggagacggccatgctg

SEQ ID NO: 217112 - DNA, 22 bp, Artificial Sequence
  Description of Artificial Sequence: Synthetic oligonucleotide
cgagggggagacggccatgctg

SEQ ID NO: 217113 - DNA, 23 bp, Artificial Sequence
  Description of Artificial Sequence: Synthetic oligonucleotide
gagggggagacggccatgctggt

SEQ ID NO: 217114 - DNA, 24 bp, Artificial Sequence
  Description of Artificial Sequence: Synthetic oligonucleotide
agggggagacggccatgctggtct

SEQ ID NO: 217115 - DNA, 23 bp, Artificial Sequence
  Description of Artificial Sequence: Synthetic oligonucleotide
gggggagacggccatgctggtct

SEQ ID NO: 217116 - DNA, 23 bp, Artificial Sequence
  Description of Artificial Sequence: Synthetic oligonucleotide
ggggagacggccatgctggtctg

SEQ ID NO: 217117 - DNA, 25 bp, Artificial Sequence
  Description of Artificial Sequence: Synthetic oligonucleotide
gggagacggccatgctggtctgcaa

SEQ ID NO: 217118 - DNA, 26 bp, Artificial Sequence
  Description of Artificial Sequence: Synthetic oligonucleotide
ggagacggccatgctggtctgcaagt

SEQ ID NO: 217119 - DNA, 27 bp, Artificial Sequence
  Description of Artificial Sequence: Synthetic oligonucleotide
gagacggccatgctggtctgcaagtca

SEQ ID NO: 217120 - DNA, 27 bp, Artificial Sequence
  Description of Artificial Sequence: Synthetic oligonucleotide
agacggccatgctggtctgcaagtcag

SEQ ID NO: 217121 - DNA, 27 bp, Artificial Sequence
  Description of Artificial Sequence: Synthetic oligonucleotide
gacggccatgctggtctgcaagtcaga

SEQ ID NO: 217122 - DNA, 27 bp, Artificial Sequence
  Description of Artificial Sequence: Synthetic oligonucleotide
acggccatgctggtctgcaagtcagag

SEQ ID NO: 217123 - DNA, 27 bp, Artificial Sequence
  Description of Artificial Sequence: Synthetic oligonucleotide
cggccatgctggtctgcaagtcagagt

SEQ ID NO: 217124 - DNA, 27 bp, Artificial Sequence
  Description of Artificial Sequence: Synthetic oligonucleotide
ggccatgctggtctgcaagtcagagtc

SEQ ID NO: 217125 - DNA, 27 bp, Artificial Sequence
  Description of Artificial Sequence: Synthetic oligonucleotide
gccatgctggtctgcaagtcagagtcc

SEQ ID NO: 217126 - DNA, 27 bp, Artificial Sequence
  Description of Artificial Sequence: Synthetic oligonucleotide
ccatgctggtctgcaagtcagagtccg

SEQ ID NO: 217127 - DNA, 28 bp, Artificial Sequence
  Description of Artificial Sequence: Synthetic oligonucleotide
catgctggtctgcaagtcagagtccgtg

SEQ ID NO: 217128 - DNA, 28 bp, Artificial Sequence
  Description of Artificial Sequence: Synthetic oligonucleotide
atgctggtctgcaagtcagagtccgtgc

SEQ ID NO: 217129 - DNA, 27 bp, Artificial Sequence
  Description of Artificial Sequence: Synthetic oligonucleotide
tgctggtctgcaagtcagagtccgtgc

SEQ ID NO: 217130 - DNA, 26 bp, Artificial Sequence
  Description of Artificial Sequence: Synthetic oligonucleotide
gctggtctgcaagtcagagtccgtgc

SEQ ID NO: 217131 - DNA, 27 bp, Artificial Sequence
  Description of Artificial Sequence: Synthetic oligonucleotide
ctggtctgcaagtcagagtccgtgcca

SEQ ID NO: 217132 - DNA, 27 bp, Artificial Sequence
  Description of Artificial Sequence: Synthetic oligonucleotide
tggtctgcaagtcagagtccgtgccac

SEQ ID NO: 217133 - DNA, 26 bp, Artificial Sequence
  Description of Artificial Sequence: Synthetic oligonucleotide
ggtctgcaagtcagagtccgtgccac

SEQ ID NO: 217134 - DNA, 27 bp, Artificial Sequence
  Description of Artificial Sequence: Synthetic oligonucleotide
gtctgcaagtcagagtccgtgccacct

SEQ ID NO: 217135 - DNA, 27 bp, Artificial Sequence
  Description of Artificial Sequence: Synthetic oligonucleotide
tctgcaagtcagagtccgtgccacctg

SEQ ID NO: 217136 - DNA, 27 bp, Artificial Sequence
  Description of Artificial Sequence: Synthetic oligonucleotide
ctgcaagtcagagtccgtgccacctgt

SEQ ID NO: 217137 - DNA, 27 bp, Artificial Sequence
  Description of Artificial Sequence: Synthetic oligonucleotide
tgcaagtcagagtccgtgccacctgtc

SEQ ID NO: 217138 - DNA, 27 bp, Artificial Sequence
  Description of Artificial Sequence: Synthetic oligonucleotide
gcaagtcagagtccgtgccacctgtca

SEQ ID NO: 217139 - DNA, 27 bp, Artificial Sequence
  Description of Artificial Sequence: Synthetic oligonucleotide
caagtcagagtccgtgccacctgtcac

SEQ ID NO: 217140 - DNA, 28 bp, Artificial Sequence
  Description of Artificial Sequence: Synthetic oligonucleotide
aagtcagagtccgtgccacctgtcactg

SEQ ID NO: 217141 - DNA, 27 bp, Artificial Sequence
  Description of Artificial Sequence: Synthetic oligonucleotide
agtcagagtccgtgccacctgtcactg

SEQ ID NO: 217142 - DNA, 27 bp, Artificial Sequence
  Description of Artificial Sequence: Synthetic oligonucleotide
gtcagagtccgtgccacctgtcactga

SEQ ID NO: 217143 - DNA, 27 bp, Artificial Sequence
  Description of Artificial Sequence: Synthetic oligonucleotide
tcagagtccgtgccacctgtcactgac

SEQ ID NO: 217144 - DNA, 27 bp, Artificial Sequence
  Description of Artificial Sequence: Synthetic oligonucleotide
cagagtccgtgccacctgtcactgact

SEQ ID NO: 217145 - DNA, 27 bp, Artificial Sequence
  Description of Artificial Sequence: Synthetic oligonucleotide
agagtccgtgccacctgtcactgactg

SEQ ID NO: 217146 - DNA, 26 bp, Artificial Sequence
  Description of Artificial Sequence: Synthetic oligonucleotide
gagtccgtgccacctgtcactgactg

SEQ ID NO: 217147 - DNA, 26 bp, Artificial Sequence
  Description of Artificial Sequence: Synthetic oligonucleotide
agtccgtgccacctgtcactgactgg

SEQ ID NO: 217148 - DNA, 25 bp, Artificial Sequence
  Description of Artificial Sequence: Synthetic oligonucleotide
gtccgtgccacctgtcactgactgg

SEQ ID NO: 217149 - DNA, 25 bp, Artificial Sequence
  Description of Artificial Sequence: Synthetic oligonucleotide
tccgtgccacctgtcactgactggg

SEQ ID NO: 217150 - DNA, 24 bp, Artificial Sequence
  Description of Artificial Sequence: Synthetic oligonucleotide
ccgtgccacctgtcactgactggg

SEQ ID NO: 217151 - DNA, 24 bp, Artificial Sequence
  Description of Artificial Sequence: Synthetic oligonucleotide
cgtgccacctgtcactgactgggc

SEQ ID NO: 217152 - DNA, 25 bp, Artificial Sequence
  Description of Artificial Sequence: Synthetic oligonucleotide
gtgccacctgtcactgactgggcct

SEQ ID NO: 217153 - DNA, 25 bp, Artificial Sequence
  Description of Artificial Sequence: Synthetic oligonucleotide
tgccacctgtcactgactgggcctg

SEQ ID NO: 217154 - DNA, 24 bp, Artificial Sequence
  Description of Artificial Sequence: Synthetic oligonucleotide
gccacctgtcactgactgggcctg

SEQ ID NO: 217155 - DNA, 26 bp, Artificial Sequence
  Description of Artificial Sequence: Synthetic oligonucleotide
ccacctgtcactgactgggcctggta

SEQ ID NO: 217156 - DNA, 27 bp, Artificial Sequence
  Description of Artificial Sequence: Synthetic oligonucleotide
cacctgtcactgactgggcctggtaca

SEQ ID NO: 217157 - DNA, 28 bp, Artificial Sequence
  Description of Artificial Sequence: Synthetic oligonucleotide
acctgtcactgactgggcctggtacaag

SEQ ID NO: 217158 - DNA, 27 bp, Artificial Sequence
  Description of Artificial Sequence: Synthetic oligonucleotide
cctgtcactgactgggcctggtacaag

SEQ ID NO: 217159 - DNA, 29 bp, Artificial Sequence
  Description of Artificial Sequence: Synthetic oligonucleotide
ctgtcactgactgggcctggtacaagatc

SEQ ID NO: 217160 - DNA, 30 bp, Artificial Sequence
  Description of Artificial Sequence: Synthetic oligonucleotide
tgtcactgactgggcctggtacaagatcac

SEQ ID NO: 217161 - DNA, 29 bp, Artificial Sequence
  Description of Artificial Sequence: Synthetic oligonucleotide
gtcactgactgggcctggtacaagatcac

SEQ ID NO: 217162 - DNA, 30 bp, Artificial Sequence
  Description of Artificial Sequence: Synthetic oligonucleotide
tcactgactgggcctggtacaagatcactg

SEQ ID NO: 217163 - DNA, 29 bp, Artificial Sequence
  Description of Artificial Sequence: Synthetic oligonucleotide
cactgactgggcctggtacaagatcactg

SEQ ID NO: 217164 - DNA, 30 bp, Artificial Sequence
  Description of Artificial Sequence: Synthetic oligonucleotide
actgactgggcctggtacaagatcactgac

SEQ ID NO: 217165 - DNA, 29 bp, Artificial Sequence
  Description of Artificial Sequence: Synthetic oligonucleotide
ctgactgggcctggtacaagatcactgac

SEQ ID NO: 217166 - DNA, 30 bp, Artificial Sequence
  Description of Artificial Sequence: Synthetic oligonucleotide
tgactgggcctggtacaagatcactgactc

SEQ ID NO: 217167 - DNA, 29 bp, Artificial Sequence
  Description of Artificial Sequence: Synthetic oligonucleotide
gactgggcctggtacaagatcactgactc

SEQ ID NO: 217168 - DNA, 30 bp, Artificial Sequence
  Description of Artificial Sequence: Synthetic oligonucleotide
actgggcctggtacaagatcactgactctg

SEQ ID NO: 217169 - DNA, 29 bp, Artificial Sequence
  Description of Artificial Sequence: Synthetic oligonucleotide
ctgggcctggtacaagatcactgactctg

SEQ ID NO: 217170 - DNA, 30 bp, Artificial Sequence
  Description of Artificial Sequence: Synthetic oligonucleotide
tgggcctggtacaagatcactgactctgag

SEQ ID NO: 217171 - DNA, 29 bp, Artificial Sequence
  Description of Artificial Sequence: Synthetic oligonucleotide
gggcctggtacaagatcactgactctgag

SEQ ID NO: 217172 - DNA, 29 bp, Artificial Sequence
  Description of Artificial Sequence: Synthetic oligonucleotide
ggcctggtacaagatcactgactctgagg

SEQ ID NO: 217173 - DNA, 30 bp, Artificial Sequence
  Description of Artificial Sequence: Synthetic oligonucleotide
gcctggtacaagatcactgactctgaggac

SEQ ID NO: 217174 - DNA, 32 bp, Artificial Sequence
  Description of Artificial Sequence: Synthetic oligonucleotide
cctggtacaagatcactgactctgaggacaag

SEQ ID NO: 217175 - DNA, 32 bp, Artificial Sequence
  Description of Artificial Sequence: Synthetic oligonucleotide
ctggtacaagatcactgactctgaggacaagg

SEQ ID NO: 217176 - DNA, 32 bp, Artificial Sequence
  Description of Artificial Sequence: Synthetic oligonucleotide
tggtacaagatcactgactctgaggacaaggc

SEQ ID NO: 217177 - DNA, 31 bp, Artificial Sequence
  Description of Artificial Sequence: Synthetic oligonucleotide
ggtacaagatcactgactctgaggacaaggc

SEQ ID NO: 217178 - DNA, 31 bp, Artificial Sequence
  Description of Artificial Sequence: Synthetic oligonucleotide
gtacaagatcactgactctgaggacaaggcc

SEQ ID NO: 217179 - DNA, 31 bp, Artificial Sequence
  Description of Artificial Sequence: Synthetic oligonucleotide
tacaagatcactgactctgaggacaaggccc

SEQ ID NO: 217180 - DNA, 30 bp, Artificial Sequence
  Description of Artificial Sequence: Synthetic oligonucleotide
acaagatcactgactctgaggacaaggccc

SEQ ID NO: 217181 - DNA, 29 bp, Artificial Sequence
  Description of Artificial Sequence: Synthetic oligonucleotide
caagatcactgactctgaggacaaggccc

SEQ ID NO: 217182 - DNA, 30 bp, Artificial Sequence
  Description of Artificial Sequence: Synthetic oligonucleotide
aagatcactgactctgaggacaaggccctc

SEQ ID NO: 217183 - DNA, 29 bp, Artificial Sequence
  Description of Artificial Sequence: Synthetic oligonucleotide
agatcactgactctgaggacaaggccctc

SEQ ID NO: 217184 - DNA, 28 bp, Artificial Sequence
  Description of Artificial Sequence: Synthetic oligonucleotide
gatcactgactctgaggacaaggccctc

SEQ ID NO: 217185 - DNA, 30 bp, Artificial Sequence
  Description of Artificial Sequence: Synthetic oligonucleotide
atcactgactctgaggacaaggccctcatg

SEQ ID NO: 217186 - DNA, 29 bp, Artificial Sequence
  Description of Artificial Sequence: Synthetic oligonucleotide
tcactgactctgaggacaaggccctcatg

SEQ ID NO: 217187 - DNA, 28 bp, Artificial Sequence
  Description of Artificial Sequence: Synthetic oligonucleotide
cactgactctgaggacaaggccctcatg

SEQ ID NO: 217188 - DNA, 30 bp, Artificial Sequence
  Description of Artificial Sequence: Synthetic oligonucleotide
actgactctgaggacaaggccctcatgaac

SEQ ID NO: 217189 - DNA, 29 bp, Artificial Sequence
  Description of Artificial Sequence: Synthetic oligonucleotide
ctgactctgaggacaaggccctcatgaac

SEQ ID NO: 217190 - DNA, 29 bp, Artificial Sequence
  Description of Artificial Sequence: Synthetic oligonucleotide
tgactctgaggacaaggccctcatgaacg

SEQ ID NO: 217191 - DNA, 28 bp, Artificial Sequence
  Description of Artificial Sequence: Synthetic oligonucleotide
gactctgaggacaaggccctcatgaacg

SEQ ID NO: 217192 - DNA, 28 bp, Artificial Sequence
  Description of Artificial Sequence: Synthetic oligonucleotide
actctgaggacaaggccctcatgaacgg

SEQ ID NO: 217193 - DNA, 27 bp, Artificial Sequence
  Description of Artificial Sequence: Synthetic oligonucleotide
ctctgaggacaaggccctcatgaacgg

SEQ ID NO: 217194 - DNA, 27 bp, Artificial Sequence
  Description of Artificial Sequence: Synthetic oligonucleotide
tctgaggacaaggccctcatgaacggc

SEQ ID NO: 217195 - DNA, 27 bp, Artificial Sequence
  Description of Artificial Sequence: Synthetic oligonucleotide
ctgaggacaaggccctcatgaacggct

SEQ ID NO: 217196 - DNA, 27 bp, Artificial Sequence
  Description of Artificial Sequence: Synthetic oligonucleotide
tgaggacaaggccctcatgaacggctc

SEQ ID NO: 217197 - DNA, 26 bp, Artificial Sequence
  Description of Artificial Sequence: Synthetic oligonucleotide
gaggacaaggccctcatgaacggctc

SEQ ID NO: 217198 - DNA, 26 bp, Artificial Sequence
  Description of Artificial Sequence: Synthetic oligonucleotide
aggacaaggccctcatgaacggctcc

SEQ ID NO: 217199 - DNA, 25 bp, Artificial Sequence
  Description of Artificial Sequence: Synthetic oligonucleotide
ggacaaggccctcatgaacggctcc

SEQ ID NO: 217200 - DNA, 26 bp, Artificial Sequence
  Description of Artificial Sequence: Synthetic oligonucleotide
gacaaggccctcatgaacggctccga

SEQ ID NO: 217201 - DNA, 27 bp, Artificial Sequence
  Description of Artificial Sequence: Synthetic oligonucleotide
acaaggccctcatgaacggctccgaga

SEQ ID NO: 217202 - DNA, 26 bp, Artificial Sequence
  Description of Artificial Sequence: Synthetic oligonucleotide
caaggccctcatgaacggctccgaga

SEQ ID NO: 217203 - DNA, 26 bp, Artificial Sequence
  Description of Artificial Sequence: Synthetic oligonucleotide
aaggccctcatgaacggctccgagag

SEQ ID NO: 217204 - DNA, 25 bp, Artificial Sequence
  Description of Artificial Sequence: Synthetic oligonucleotide
aggccctcatgaacggctccgagag

SEQ ID NO: 217205 - DNA, 24 bp, Artificial Sequence
  Description of Artificial Sequence: Synthetic oligonucleotide
ggccctcatgaacggctccgagag

SEQ ID NO: 217206 - DNA, 25 bp, Artificial Sequence
  Description of Artificial Sequence: Synthetic oligonucleotide
gccctcatgaacggctccgagagca

SEQ ID NO: 217207 - DNA, 25 bp, Artificial Sequence
  Description of Artificial Sequence: Synthetic oligonucleotide
ccctcatgaacggctccgagagcag

SEQ ID NO: 217208 - DNA, 27 bp, Artificial Sequence
  Description of Artificial Sequence: Synthetic oligonucleotide
cctcatgaacggctccgagagcaggtt

SEQ ID NO: 217209 - DNA, 27 bp, Artificial Sequence
  Description of Artificial Sequence: Synthetic oligonucleotide
ctcatgaacggctccgagagcaggttc

SEQ ID NO: 217210 - DNA, 29 bp, Artificial Sequence
  Description of Artificial Sequence: Synthetic oligonucleotide
tcatgaacggctccgagagcaggttcttc

SEQ ID NO: 217211 - DNA, 28 bp, Artificial Sequence
  Description of Artificial Sequence: Synthetic oligonucleotide
catgaacggctccgagagcaggttcttc

SEQ ID NO: 217212 - DNA, 28 bp, Artificial Sequence
  Description of Artificial Sequence: Synthetic oligonucleotide
atgaacggctccgagagcaggttcttcg

SEQ ID NO: 217213 - DNA, 27 bp, Artificial Sequence
  Description of Artificial Sequence: Synthetic oligonucleotide
tgaacggctccgagagcaggttcttcg

SEQ ID NO: 217214 - DNA, 27 bp, Artificial Sequence
  Description of Artificial Sequence: Synthetic oligonucleotide
gaacggctccgagagcaggttcttcgt

SEQ ID NO: 217215 - DNA, 27 bp, Artificial Sequence
  Description of Artificial Sequence: Synthetic oligonucleotide
aacggctccgagagcaggttcttcgtg

SEQ ID NO: 217216 - DNA, 27 bp, Artificial Sequence
  Description of Artificial Sequence: Synthetic oligonucleotide
acggctccgagagcaggttcttcgtga

SEQ ID NO: 217217 - DNA, 26 bp, Artificial Sequence
  Description of Artificial Sequence: Synthetic oligonucleotide
cggctccgagagcaggttcttcgtga

SEQ ID NO: 217218 - DNA, 27 bp, Artificial Sequence
  Description of Artificial Sequence: Synthetic oligonucleotide
ggctccgagagcaggttcttcgtgagt

SEQ ID NO: 217219 - DNA, 28 bp, Artificial Sequence
  Description of Artificial Sequence: Synthetic oligonucleotide
gctccgagagcaggttcttcgtgagttc

SEQ ID NO: 217220 - DNA, 28 bp, Artificial Sequence
  Description of Artificial Sequence: Synthetic oligonucleotide
ctccgagagcaggttcttcgtgagttcc

SEQ ID NO: 217221 - DNA, 29 bp, Artificial Sequence
  Description of Artificial Sequence: Synthetic oligonucleotide
tccgagagcaggttcttcgtgagttcctc

SEQ ID NO: 217222 - DNA, 28 bp, Artificial Sequence
  Description of Artificial Sequence: Synthetic oligonucleotide
ccgagagcaggttcttcgtgagttcctc

SEQ ID NO: 217223 - DNA, 28 bp, Artificial Sequence
  Description of Artificial Sequence: Synthetic oligonucleotide
cgagagcaggttcttcgtgagttcctcg

SEQ ID NO: 217224 - DNA, 28 bp, Artificial Sequence
  Description of Artificial Sequence: Synthetic oligonucleotide
gagagcaggttcttcgtgagttcctcgc

SEQ ID NO: 217225 - DNA, 29 bp, Artificial Sequence
  Description of Artificial Sequence: Synthetic oligonucleotide
agagcaggttcttcgtgagttcctcgcag

SEQ ID NO: 217226 - DNA, 28 bp, Artificial Sequence
  Description of Artificial Sequence: Synthetic oligonucleotide
gagcaggttcttcgtgagttcctcgcag

SEQ ID NO: 217227 - DNA, 28 bp, Artificial Sequence
  Description of Artificial Sequence: Synthetic oligonucleotide
agcaggttcttcgtgagttcctcgcagg

SEQ ID NO: 217228 - DNA, 27 bp, Artificial Sequence
  Description of Artificial Sequence: Synthetic oligonucleotide
gcaggttcttcgtgagttcctcgcagg

SEQ ID NO: 217229 - DNA, 27 bp, Artificial Sequence
  Description of Artificial Sequence: Synthetic oligonucleotide
caggttcttcgtgagttcctcgcaggg

SEQ ID NO: 217230 - DNA, 27 bp, Artificial Sequence
  Description of Artificial Sequence: Synthetic oligonucleotide
aggttcttcgtgagttcctcgcagggc

SEQ ID NO: 217231 - DNA, 26 bp, Artificial Sequence
  Description of Artificial Sequence: Synthetic oligonucleotide
ggttcttcgtgagttcctcgcagggc

SEQ ID NO: 217232 - DNA, 26 bp, Artificial Sequence
  Description of Artificial Sequence: Synthetic oligonucleotide
gttcttcgtgagttcctcgcagggcc

SEQ ID NO: 217233 - DNA, 26 bp, Artificial Sequence
  Description of Artificial Sequence: Synthetic oligonucleotide
ttcttcgtgagttcctcgcagggccg

SEQ ID NO: 217234 - DNA, 25 bp, Artificial Sequence
  Description of Artificial Sequence: Synthetic oligonucleotide
tcttcgtgagttcctcgcagggccg

SEQ ID NO: 217235 - DNA, 24 bp, Artificial Sequence
  Description of Artificial Sequence: Synthetic oligonucleotide
cttcgtgagttcctcgcagggccg

SEQ ID NO: 217236 - DNA, 25 bp, Artificial Sequence
  Description of Artificial Sequence: Synthetic oligonucleotide
ttcgtgagttcctcgcagggccggt

SEQ ID NO: 217237 - DNA, 24 bp, Artificial Sequence
  Description of Artificial Sequence: Synthetic oligonucleotide
tcgtgagttcctcgcagggccggt

SEQ ID NO: 217238 - DNA, 23 bp, Artificial Sequence
  Description of Artificial Sequence: Synthetic oligonucleotide
cgtgagttcctcgcagggccggt

SEQ ID NO: 217239 - DNA, 24 bp, Artificial Sequence
  Description of Artificial Sequence: Synthetic oligonucleotide
gtgagttcctcgcagggccggtca

SEQ ID NO: 217240 - DNA, 25 bp, Artificial Sequence
  Description of Artificial Sequence: Synthetic oligonucleotide
tgagttcctcgcagggccggtcaga

SEQ ID NO: 217241 - DNA, 24 bp, Artificial Sequence
  Description of Artificial Sequence: Synthetic oligonucleotide
gagttcctcgcagggccggtcaga

SEQ ID NO: 217242 - DNA, 24 bp, Artificial Sequence
  Description of Artificial Sequence: Synthetic oligonucleotide
agttcctcgcagggccggtcagag

SEQ ID NO: 217243 - DNA, 23 bp, Artificial Sequence
  Description of Artificial Sequence: Synthetic oligonucleotide
gttcctcgcagggccggtcagag

SEQ ID NO: 217244 - DNA, 25 bp, Artificial Sequence
  Description of Artificial Sequence: Synthetic oligonucleotide
ttcctcgcagggccggtcagagcta

SEQ ID NO: 217245 - DNA, 24 bp, Artificial Sequence
  Description of Artificial Sequence: Synthetic oligonucleotide
tcctcgcagggccggtcagagcta

SEQ ID NO: 217246 - DNA, 23 bp, Artificial Sequence
  Description of Artificial Sequence: Synthetic oligonucleotide
cctcgcagggccggtcagagcta

SEQ ID NO: 217247 - DNA, 24 bp, Artificial Sequence
  Description of Artificial Sequence: Synthetic oligonucleotide
ctcgcagggccggtcagagctaca

SEQ ID NO: 217248 - DNA, 27 bp, Artificial Sequence
  Description of Artificial Sequence: Synthetic oligonucleotide
tcgcagggccggtcagagctacacatt

SEQ ID NO: 217249 - DNA, 26 bp, Artificial Sequence
  Description of Artificial Sequence: Synthetic oligonucleotide
cgcagggccggtcagagctacacatt

SEQ ID NO: 217250 - DNA, 27 bp, Artificial Sequence
  Description of Artificial Sequence: Synthetic oligonucleotide
gcagggccggtcagagctacacattga

SEQ ID NO: 217251 - DNA, 27 bp, Artificial Sequence
  Description of Artificial Sequence: Synthetic oligonucleotide
cagggccggtcagagctacacattgag

SEQ ID NO: 217252 - DNA, 29 bp, Artificial Sequence
  Description of Artificial Sequence: Synthetic oligonucleotide
agggccggtcagagctacacattgagaac

SEQ ID NO: 217253 - DNA, 28 bp, Artificial Sequence
  Description of Artificial Sequence: Synthetic oligonucleotide
gggccggtcagagctacacattgagaac

SEQ ID NO: 217254 - DNA, 28 bp, Artificial Sequence
  Description of Artificial Sequence: Synthetic oligonucleotide
ggccggtcagagctacacattgagaacc

SEQ ID NO: 217255 - DNA, 29 bp, Artificial Sequence
  Description of Artificial Sequence: Synthetic oligonucleotide
gccggtcagagctacacattgagaacctg

SEQ ID NO: 217256 - DNA, 31 bp, Artificial Sequence
  Description of Artificial Sequence: Synthetic oligonucleotide
ccggtcagagctacacattgagaacctgaac

SEQ ID NO: 217257 - DNA, 33 bp, Artificial Sequence
  Description of Artificial Sequence: Synthetic oligonucleotide
cggtcagagctacacattgagaacctgaacatg

SEQ ID NO: 217258 - DNA, 33 bp, Artificial Sequence
  Description of Artificial Sequence: Synthetic oligonucleotide
ggtcagagctacacattgagaacctgaacatgg

SEQ ID NO: 217259 - DNA, 34 bp, Artificial Sequence
  Description of Artificial Sequence: Synthetic oligonucleotide
gtcagagctacacattgagaacctgaacatggag

SEQ ID NO: 217260 - DNA, 34 bp, Artificial Sequence
  Description of Artificial Sequence: Synthetic oligonucleotide
tcagagctacacattgagaacctgaacatggagg

SEQ ID NO: 217261 - DNA, 33 bp, Artificial Sequence
  Description of Artificial Sequence: Synthetic oligonucleotide
cagagctacacattgagaacctgaacatggagg

SEQ ID NO: 217262 - DNA, 33 bp, Artificial Sequence
  Description of Artificial Sequence: Synthetic oligonucleotide
agagctacacattgagaacctgaacatggaggc

SEQ ID NO: 217263 - DNA, 32 bp, Artificial Sequence
  Description of Artificial Sequence: Synthetic oligonucleotide
gagctacacattgagaacctgaacatggaggc

SEQ ID NO: 217264 - DNA, 32 bp, Artificial Sequence
  Description of Artificial Sequence: Synthetic oligonucleotide
agctacacattgagaacctgaacatggaggcc

SEQ ID NO: 217265 - DNA, 31 bp, Artificial Sequence
  Description of Artificial Sequence: Synthetic oligonucleotide
gctacacattgagaacctgaacatggaggcc

SEQ ID NO: 217266 - DNA, 31 bp, Artificial Sequence
  Description of Artificial Sequence: Synthetic oligonucleotide
ctacacattgagaacctgaacatggaggccg

SEQ ID NO: 217267 - DNA, 32 bp, Artificial Sequence
  Description of Artificial Sequence: Synthetic oligonucleotide
tacacattgagaacctgaacatggaggccgac

SEQ ID NO: 217268 - DNA, 31 bp, Artificial Sequence
  Description of Artificial Sequence: Synthetic oligonucleotide
acacattgagaacctgaacatggaggccgac

SEQ ID NO: 217269 - DNA, 30 bp, Artificial Sequence
  Description of Artificial Sequence: Synthetic oligonucleotide
cacattgagaacctgaacatggaggccgac

SEQ ID NO: 217270 - DNA, 30 bp, Artificial Sequence
  Description of Artificial Sequence: Synthetic oligonucleotide
acattgagaacctgaacatggaggccgacc

SEQ ID NO: 217271 - DNA, 29 bp, Artificial Sequence
  Description of Artificial Sequence: Synthetic oligonucleotide
cattgagaacctgaacatggaggccgacc

SEQ ID NO: 217272 - DNA, 29 bp, Artificial Sequence
  Description of Artificial Sequence: Synthetic oligonucleotide
attgagaacctgaacatggaggccgaccc

SEQ ID NO: 217273 - DNA, 28 bp, Artificial Sequence
  Description of Artificial Sequence: Synthetic oligonucleotide
ttgagaacctgaacatggaggccgaccc

SEQ ID NO: 217274 - DNA, 27 bp, Artificial Sequence
  Description of Artificial Sequence: Synthetic oligonucleotide
tgagaacctgaacatggaggccgaccc

SEQ ID NO: 217275 - DNA, 26 bp, Artificial Sequence
  Description of Artificial Sequence: Synthetic oligonucleotide
gagaacctgaacatggaggccgaccc

SEQ ID NO: 217276 - DNA, 26 bp, Artificial Sequence
  Description of Artificial Sequence: Synthetic oligonucleotide
agaacctgaacatggaggccgacccc

SEQ ID NO: 217277 - DNA, 25 bp, Artificial Sequence
  Description of Artificial Sequence: Synthetic oligonucleotide
gaacctgaacatggaggccgacccc

SEQ ID NO: 217278 - DNA, 25 bp, Artificial Sequence
  Description of Artificial Sequence: Synthetic oligonucleotide
aacctgaacatggaggccgaccccg

SEQ ID NO: 217279 - DNA, 24 bp, Artificial Sequence
  Description of Artificial Sequence: Synthetic oligonucleotide
acctgaacatggaggccgaccccg

SEQ ID NO: 217280 - DNA, 23 bp, Artificial Sequence
  Description of Artificial Sequence: Synthetic oligonucleotide
cctgaacatggaggccgaccccg

SEQ ID NO: 217281 - DNA, 23 bp, Artificial Sequence
  Description of Artificial Sequence: Synthetic oligonucleotide
ctgaacatggaggccgaccccgg

SEQ ID NO: 217282 - DNA, 23 bp, Artificial Sequence
  Description of Artificial Sequence: Synthetic oligonucleotide
tgaacatggaggccgaccccggc

SEQ ID NO: 217283 - DNA, 22 bp, Artificial Sequence
  Description of Artificial Sequence: Synthetic oligonucleotide
gaacatggaggccgaccccggc

SEQ ID NO: 217284 - DNA, 23 bp, Artificial Sequence
  Description of Artificial Sequence: Synthetic oligonucleotide
aacatggaggccgaccccggcca

SEQ ID NO: 217285 - DNA, 22 bp, Artificial Sequence
  Description of Artificial Sequence: Synthetic oligonucleotide
acatggaggccgaccccggcca

SEQ ID NO: 217286 - DNA, 21 bp, Artificial Sequence
  Description of Artificial Sequence: Synthetic oligonucleotide
catggaggccgaccccggcca

SEQ ID NO: 217287 - DNA, 23 bp, Artificial Sequence
  Description of Artificial Sequence: Synthetic oligonucleotide
atggaggccgaccccggccagta

SEQ ID NO: 217288 - DNA, 22 bp, Artificial Sequence
  Description of Artificial Sequence: Synthetic oligonucleotide
tggaggccgaccccggccagta

SEQ ID NO: 217289 - DNA, 21 bp, Artificial Sequence
  Description of Artificial Sequence: Synthetic oligonucleotide
ggaggccgaccccggccagta

SEQ ID NO: 217290 - DNA, 21 bp, Artificial Sequence
  Description of Artificial Sequence: Synthetic oligonucleotide
gaggccgaccccggccagtac

SEQ ID NO: 217291 - DNA, 21 bp, Artificial Sequence
  Description of Artificial Sequence: Synthetic oligonucleotide
aggccgaccccggccagtacc

SEQ ID NO: 217292 - DNA, 20 bp, Artificial Sequence
  Description of Artificial Sequence: Synthetic oligonucleotide
ggccgaccccggccagtacc

SEQ ID NO: 217293 - DNA, 20 bp, Artificial Sequence
  Description of Artificial Sequence: Synthetic oligonucleotide
gccgaccccggccagtaccg

SEQ ID NO: 217294 - DNA, 21 bp, Artificial Sequence
  Description of Artificial Sequence: Synthetic oligonucleotide
ccgaccccggccagtaccggt

SEQ ID NO: 217295 - DNA, 21 bp, Artificial Sequence
  Description of Artificial Sequence: Synthetic oligonucleotide
cgaccccggccagtaccggtg

SEQ ID NO: 217296 - DNA, 23 bp, Artificial Sequence
  Description of Artificial Sequence: Synthetic oligonucleotide
gaccccggccagtaccggtgcaa

SEQ ID NO: 217297 - DNA, 23 bp, Artificial Sequence
  Description of Artificial Sequence: Synthetic oligonucleotide
accccggccagtaccggtgcaac

SEQ ID NO: 217298 - DNA, 22 bp, Artificial Sequence
  Description of Artificial Sequence: Synthetic oligonucleotide
ccccggccagtaccggtgcaac

SEQ ID NO: 217299 - DNA, 22 bp, Artificial Sequence
  Description of Artificial Sequence: Synthetic oligonucleotide
cccggccagtaccggtgcaacg

SEQ ID NO: 217300 - DNA, 22 bp, Artificial Sequence
  Description of Artificial Sequence: Synthetic oligonucleotide
ccggccagtaccggtgcaacgg

SEQ ID NO: 217301 - DNA, 23 bp, Artificial Sequence
  Description of Artificial Sequence: Synthetic oligonucleotide
cggccagtaccggtgcaacggca

SEQ ID NO: 217302 - DNA, 23 bp, Artificial Sequence
  Description of Artificial Sequence: Synthetic oligonucleotide
ggccagtaccggtgcaacggcac

SEQ ID NO: 217303 - DNA, 24 bp, Artificial Sequence
  Description of Artificial Sequence: Synthetic oligonucleotide
gccagtaccggtgcaacggcacca

SEQ ID NO: 217304 - DNA, 24 bp, Artificial Sequence
  Description of Artificial Sequence: Synthetic oligonucleotide
ccagtaccggtgcaacggcaccag

SEQ ID NO: 217305 - DNA, 25 bp, Artificial Sequence
  Description of Artificial Sequence: Synthetic oligonucleotide
cagtaccggtgcaacggcaccagct
